United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 93

SEQ ID NO: 3310683 - RNA, 15 nt, Mycobacterium tuberculosis H37Rv
gcgucgagcagcacc

SEQ ID NO: 3310684 - RNA, 22 nt, Mycobacterium tuberculosis H37Rv
gcgucgagguggcgcacaucgc

SEQ ID NO: 3310685 - RNA, 17 nt, Mycobacterium tuberculosis H37Rv
gcgucgagugccgccac

SEQ ID NO: 3310686 - RNA, 20 nt, Mycobacterium tuberculosis H37Rv
gcgucgaucguuccgcugga

SEQ ID NO: 3310687 - RNA, 22 nt, Mycobacterium tuberculosis H37Rv
gcgucgaugagguucaucgccg

SEQ ID NO: 3310688 - RNA, 12 nt, Mycobacterium tuberculosis H37Rv
gcgucgaugccg

SEQ ID NO: 3310689 - RNA, 18 nt, Mycobacterium tuberculosis H37Rv
gcgucgaugcgcugcuca

SEQ ID NO: 3310690 - RNA, 16 nt, Mycobacterium tuberculosis H37Rv
gcgucgauggcgucgg

SEQ ID NO: 3310691 - RNA, 21 nt, Mycobacterium tuberculosis H37Rv
gcgucgcaacgcgaucaccuc

SEQ ID NO: 3310692 - RNA, 16 nt, Mycobacterium tuberculosis H37Rv
gcgucgcaggauuccc

SEQ ID NO: 3310693 - RNA, 14 nt, Mycobacterium tuberculosis H37Rv
gcgucgccgccauu

SEQ ID NO: 3310694 - RNA, 12 nt, Mycobacterium tuberculosis H37Rv
gcgucgccgccg

SEQ ID NO: 3310695 - RNA, 21 nt, Mycobacterium tuberculosis H37Rv
gcgucgccggccccgccggcg

SEQ ID NO: 3310696 - RNA, 21 nt, Mycobacterium tuberculosis H37Rv
gcgucgcgccugcccggguga

SEQ ID NO: 3310697 - RNA, 14 nt, Mycobacterium tuberculosis H37Rv
gcgucgcgcgccuu

SEQ ID NO: 3310698 - RNA, 23 nt, Mycobacterium tuberculosis H37Rv
gcgugcaccgagccgucgucgag

SEQ ID NO: 3310699 - RNA, 13 nt, Mycobacterium tuberculosis H37Rv
gcgugcagaaucc

SEQ ID NO: 3310700 - RNA, 19 nt, Mycobacterium tuberculosis H37Rv
gcgugcagaauccguucga

SEQ ID NO: 3310701 - RNA, 20 nt, Mycobacterium tuberculosis H37Rv
gcgugcagaauccguucgac

SEQ ID NO: 3310702 - RNA, 23 nt, Mycobacterium tuberculosis H37Rv
gcgugcagaauccguucgacgag

SEQ ID NO: 3310703 - RNA, 21 nt, Mycobacterium tuberculosis H37Rv
gcgugcagaucacgggugugc

SEQ ID NO: 3310704 - RNA, 23 nt, Mycobacterium tuberculosis H37Rv
gcgugcagcaggaaguagccgag

SEQ ID NO: 3310705 - RNA, 16 nt, Mycobacterium tuberculosis H37Rv
gcgugcaucgcgauuc

SEQ ID NO: 3310706 - RNA, 23 nt, Mycobacterium tuberculosis H37Rv
gcgugcaucgcgauuccggcggc

SEQ ID NO: 3310707 - RNA, 12 nt, Mycobacterium tuberculosis H37Rv
gcgugccagcgc

SEQ ID NO: 3310708 - RNA, 24 nt, Mycobacterium tuberculosis H37Rv
gcgugccagcgccccgcgguccug

SEQ ID NO: 3310709 - RNA, 18 nt, Mycobacterium tuberculosis H37Rv
gcgugccgaccagcaucu

SEQ ID NO: 3310710 - RNA, 15 nt, Mycobacterium tuberculosis H37Rv
gcgugccgacccgcu

SEQ ID NO: 3310711 - RNA, 19 nt, Mycobacterium tuberculosis H37Rv
gcgugccgacccgcuucgc

SEQ ID NO: 3310712 - RNA, 22 nt, Mycobacterium tuberculosis H37Rv
gcgugccgacccgcuucgcccg

SEQ ID NO: 3310713 - RNA, 13 nt, Mycobacterium tuberculosis H37Rv
gcgugccgcagcg

SEQ ID NO: 3310714 - RNA, 15 nt, Mycobacterium tuberculosis H37Rv
gcgugccgcagcggc

SEQ ID NO: 3310715 - RNA, 21 nt, Mycobacterium tuberculosis H37Rv
gcgugccggggauaucacgac

SEQ ID NO: 3310716 - RNA, 22 nt, Mycobacterium tuberculosis H37Rv
gcgugcgacgauaucgggagcg

SEQ ID NO: 3310717 - RNA, 13 nt, Mycobacterium tuberculosis H37Rv
gcgugcgcaaggc

SEQ ID NO: 3310718 - RNA, 13 nt, Mycobacterium tuberculosis H37Rv
gcgugcgccgggg

SEQ ID NO: 3310719 - RNA, 19 nt, Mycobacterium tuberculosis H37Rv
gcgugcgggggacgggucg

SEQ ID NO: 3310720 - RNA, 23 nt, Mycobacterium tuberculosis H37Rv
gcgugcucgccguaagcaccagc

SEQ ID NO: 3310721 - RNA, 15 nt, Mycobacterium tuberculosis H37Rv
gcgugcucggccugu

SEQ ID NO: 3310722 - RNA, 13 nt, Mycobacterium tuberculosis H37Rv
gcgugcugccgcc

SEQ ID NO: 3310723 - RNA, 15 nt, Mycobacterium tuberculosis H37Rv
gcgugcugccgccuu

SEQ ID NO: 3310724 - RNA, 21 nt, Mycobacterium tuberculosis H37Rv
gcgugcugccguauccaggcg

SEQ ID NO: 3310725 - RNA, 13 nt, Mycobacterium tuberculosis H37Rv
gcgugcugcggcu

SEQ ID NO: 3310726 - RNA, 16 nt, Mycobacterium tuberculosis H37Rv
gcgugcugcggcuggu

SEQ ID NO: 3310727 - RNA, 13 nt, Mycobacterium tuberculosis H37Rv
gcgugcuggcgca

SEQ ID NO: 3310728 - RNA, 14 nt, Mycobacterium tuberculosis H37Rv
gcgugcugugcuca

SEQ ID NO: 3310729 - RNA, 19 nt, Mycobacterium tuberculosis H37Rv
gcgugcugugcucacgagc

SEQ ID NO: 3310730 - RNA, 14 nt, Mycobacterium tuberculosis H37Rv
gcgugcuugaccgc

SEQ ID NO: 3310731 - RNA, 17 nt, Mycobacterium tuberculosis H37Rv
gcgugcuugaccgccug

SEQ ID NO: 3310732 - RNA, 16 nt, Mycobacterium tuberculosis H37Rv
gcgugcuugagcacgu

SEQ ID NO: 3310733 - RNA, 13 nt, Mycobacterium tuberculosis H37Rv
gcguggaucgcgc

SEQ ID NO: 3310734 - RNA, 15 nt, Mycobacterium tuberculosis H37Rv
gcguggaucuuggcc

SEQ ID NO: 3310735 - RNA, 23 nt, Mycobacterium tuberculosis H37Rv
gcguggaucuuggccagcagcgc

SEQ ID NO: 3310736 - RNA, 19 nt, Mycobacterium tuberculosis H37Rv
gcguggcaguacaccggcg

SEQ ID NO: 3310737 - RNA, 20 nt, Mycobacterium tuberculosis H37Rv
gcguggccaauccggcggcg

SEQ ID NO: 3310738 - RNA, 14 nt, Mycobacterium tuberculosis H37Rv
gcguggccgccggc

SEQ ID NO: 3310739 - RNA, 17 nt, Mycobacterium tuberculosis H37Rv
gcguggccgccggcgcu

SEQ ID NO: 3310740 - RNA, 15 nt, Mycobacterium tuberculosis H37Rv
gcguggcgcaccacc

SEQ ID NO: 3310741 - RNA, 22 nt, Mycobacterium tuberculosis H37Rv
gcguggcgcaccaccgccccgc

SEQ ID NO: 3310742 - RNA, 22 nt, Mycobacterium tuberculosis H37Rv
gcguggcgcccgugccgcccgc

SEQ ID NO: 3310743 - RNA, 13 nt, Mycobacterium tuberculosis H37Rv
gcguggcgccggc

SEQ ID NO: 3310744 - RNA, 16 nt, Mycobacterium tuberculosis H37Rv
gcguggcguugguggu

SEQ ID NO: 3310745 - RNA, 23 nt, Mycobacterium tuberculosis H37Rv
gcguggcuggcaccucccgggcg

SEQ ID NO: 3310746 - RNA, 19 nt, Mycobacterium tuberculosis H37Rv
gcguggcuggcggcgaccg

SEQ ID NO: 3310747 - RNA, 20 nt, Mycobacterium tuberculosis H37Rv
gcguggcuucacccaacccc

SEQ ID NO: 3310748 - RNA, 23 nt, Mycobacterium tuberculosis H37Rv
gcgugggacgcagucgcaacagu

SEQ ID NO: 3310749 - RNA, 14 nt, Mycobacterium tuberculosis H37Rv
gcgugggcauuccc

SEQ ID NO: 3310750 - RNA, 14 nt, Mycobacterium tuberculosis H37Rv
gcgugggccugcgc

SEQ ID NO: 3310751 - RNA, 14 nt, Mycobacterium tuberculosis H37Rv
gcgugggcgcggcg

SEQ ID NO: 3310752 - RNA, 15 nt, Mycobacterium tuberculosis H37Rv
gcgugggugucggcg

SEQ ID NO: 3310753 - RNA, 17 nt, Mycobacterium tuberculosis H37Rv
gcgugguaaccagggca

SEQ ID NO: 3310754 - RNA, 21 nt, Mycobacterium tuberculosis H37Rv
gcgugguaccgcuuguccacc

SEQ ID NO: 3310755 - RNA, 24 nt, Mycobacterium tuberculosis H37Rv
gcguggucaccccuucgccagcgc

SEQ ID NO: 3310756 - RNA, 18 nt, Mycobacterium tuberculosis H37Rv
gcguggucgccccgauga

SEQ ID NO: 3310757 - RNA, 15 nt, Mycobacterium tuberculosis H37Rv
gcguggucgcgcggc

SEQ ID NO: 3310758 - RNA, 16 nt, Mycobacterium tuberculosis H37Rv
gcguggucgcgcggca

SEQ ID NO: 3310759 - RNA, 15 nt, Mycobacterium tuberculosis H37Rv
gcguggucggcgaac

SEQ ID NO: 3310760 - RNA, 18 nt, Mycobacterium tuberculosis H37Rv
gcguggucgggaacccgg

SEQ ID NO: 3310761 - RNA, 17 nt, Mycobacterium tuberculosis H37Rv
gcguggugaagucggug

SEQ ID NO: 3310762 - RNA, 18 nt, Mycobacterium tuberculosis H37Rv
gcguggugaagucggugc

SEQ ID NO: 3310763 - RNA, 20 nt, Mycobacterium tuberculosis H37Rv
gcguggugaagucggugccg

SEQ ID NO: 3310764 - RNA, 20 nt, Mycobacterium tuberculosis H37Rv
gcguggugauccggucuccg

SEQ ID NO: 3310765 - RNA, 12 nt, Mycobacterium tuberculosis H37Rv
gcguggugcuga

SEQ ID NO: 3310766 - RNA, 18 nt, Mycobacterium tuberculosis H37Rv
gcguggugcugaccgcgc

SEQ ID NO: 3310767 - RNA, 13 nt, Mycobacterium tuberculosis H37Rv
gcgugguguccac

SEQ ID NO: 3310768 - RNA, 15 nt, Mycobacterium tuberculosis H37Rv
gcgugguguccaccg

SEQ ID NO: 3310769 - RNA, 14 nt, Mycobacterium tuberculosis H37Rv
gcgugguucggucg

SEQ ID NO: 3310770 - RNA, 15 nt, Mycobacterium tuberculosis H37Rv
gcguguaaccccagg

SEQ ID NO: 3310771 - RNA, 22 nt, Mycobacterium tuberculosis H37Rv
gcguguaccagcccagcggcug

SEQ ID NO: 3310772 - RNA, 14 nt, Mycobacterium tuberculosis H37Rv
gcguguaccugucc

SEQ ID NO: 3310773 - RNA, 16 nt, Mycobacterium tuberculosis H37Rv
gcguguacggcggcua

SEQ ID NO: 3310774 - RNA, 16 nt, Mycobacterium tuberculosis H37Rv
gcguguagccugcggc

SEQ ID NO: 3310775 - RNA, 19 nt, Mycobacterium tuberculosis H37Rv
gcguguagccugcggcggu

SEQ ID NO: 3310776 - RNA, 19 nt, Mycobacterium tuberculosis H37Rv
gcguguccuuugccaccuc

SEQ ID NO: 3310777 - RNA, 14 nt, Mycobacterium tuberculosis H37Rv
gcgugucgacuccg

SEQ ID NO: 3310778 - RNA, 21 nt, Mycobacterium tuberculosis H37Rv
gcgugucgagcgccgcaguga

SEQ ID NO: 3310779 - RNA, 18 nt, Mycobacterium tuberculosis H37Rv
gcgugucgaugcgggcug

SEQ ID NO: 3310780 - RNA, 17 nt, Mycobacterium tuberculosis H37Rv
gcgugucgcgucgugcg

SEQ ID NO: 3310781 - RNA, 20 nt, Mycobacterium tuberculosis H37Rv
gcgugucgggaacgaguacg

SEQ ID NO: 3310782 - RNA, 14 nt, Mycobacterium tuberculosis H37Rv
gcgugucuggcgaa

SEQ ID NO: 3310783 - RNA, 23 nt, Mycobacterium tuberculosis H37Rv
gcgugucugggaccccgcugcga

SEQ ID NO: 3310784 - RNA, 21 nt, Mycobacterium tuberculosis H37Rv
gcgugucuguacaacgacacg

SEQ ID NO: 3310785 - RNA, 17 nt, Mycobacterium tuberculosis H37Rv
gcgugucuugucgcgca

SEQ ID NO: 3310786 - RNA, 15 nt, Mycobacterium tuberculosis H37Rv
gcguguggagcucgc

SEQ ID NO: 3310787 - RNA, 12 nt, Mycobacterium tuberculosis H37Rv
gcguguggcgca

SEQ ID NO: 3310788 - RNA, 22 nt, Mycobacterium tuberculosis H37Rv
gcguguggcuuugacugcuggg

SEQ ID NO: 3310789 - RNA, 23 nt, Mycobacterium tuberculosis H37Rv
gcguuaagguacccggucggguc

SEQ ID NO: 3310790 - RNA, 12 nt, Mycobacterium tuberculosis H37Rv
gcguuacgccgc

SEQ ID NO: 3310791 - RNA, 14 nt, Mycobacterium tuberculosis H37Rv
gcguuacgccgcga

SEQ ID NO: 3310792 - RNA, 21 nt, Mycobacterium tuberculosis H37Rv
gcguucaccacgaucgcgagc

SEQ ID NO: 3310793 - RNA, 18 nt, Mycobacterium tuberculosis H37Rv
gcguucaccugcgucggc

SEQ ID NO: 3310794 - RNA, 18 nt, Mycobacterium tuberculosis H37Rv
gcuacucgaaacccaugu

SEQ ID NO: 3310795 - RNA, 14 nt, Mycobacterium tuberculosis H37Rv
gcuacuuggucagu

SEQ ID NO: 3310796 - RNA, 20 nt, Mycobacterium tuberculosis H37Rv
gcuagcagagacaugccggc

SEQ ID NO: 3310797 - RNA, 24 nt, Mycobacterium tuberculosis H37Rv
gcuagcagcagcccgacagugguc

SEQ ID NO: 3310798 - RNA, 20 nt, Mycobacterium tuberculosis H37Rv
gcuagccaccaggcggucag

SEQ ID NO: 3310799 - RNA, 14 nt, Mycobacterium tuberculosis H37Rv
gcuagcccggcggc

SEQ ID NO: 3310800 - RNA, 19 nt, Mycobacterium tuberculosis H37Rv
gcuagccgacagcucaucg

SEQ ID NO: 3310801 - RNA, 21 nt, Mycobacterium tuberculosis H37Rv
gcuagccgggcgcgccggcca

SEQ ID NO: 3310802 - RNA, 18 nt, Mycobacterium tuberculosis H37Rv
gcuagccguucggcugcc

SEQ ID NO: 3310803 - RNA, 20 nt, Mycobacterium tuberculosis H37Rv
gcuagcgccaaauccggcuu

SEQ ID NO: 3310804 - RNA, 15 nt, Mycobacterium tuberculosis H37Rv
gcuagcgcuugcgac

SEQ ID NO: 3310805 - RNA, 21 nt, Mycobacterium tuberculosis H37Rv
gcuagcgcuugcgaccccggc

SEQ ID NO: 3310806 - RNA, 15 nt, Mycobacterium tuberculosis H37Rv
gcuagcucucgcggc

SEQ ID NO: 3310807 - RNA, 16 nt, Mycobacterium tuberculosis H37Rv
gcuaggaccaccagcg

SEQ ID NO: 3310808 - RNA, 18 nt, Mycobacterium tuberculosis H37Rv
gcuaggaccgcgguggcc

SEQ ID NO: 3310809 - RNA, 21 nt, Mycobacterium tuberculosis H37Rv
gcuaggaucggauggcggcca

SEQ ID NO: 3310810 - RNA, 19 nt, Mycobacterium tuberculosis H37Rv
gcuaggucaggugauucgc

SEQ ID NO: 3310811 - RNA, 23 nt, Mycobacterium tuberculosis H37Rv
gcuaggucaguucccagaccacc

SEQ ID NO: 3310812 - RNA, 16 nt, Mycobacterium tuberculosis H37Rv
gcuaggugacgccgcc

SEQ ID NO: 3310813 - RNA, 19 nt, Mycobacterium tuberculosis H37Rv
gcuagugcgggccgugacc

SEQ ID NO: 3310814 - RNA, 19 nt, Mycobacterium tuberculosis H37Rv
gcuagugugaccgucagcc

SEQ ID NO: 3310815 - RNA, 14 nt, Mycobacterium tuberculosis H37Rv
gcuaucaugaccac

SEQ ID NO: 3310816 - RNA, 15 nt, Mycobacterium tuberculosis H37Rv
gcuaucaugaccacc

SEQ ID NO: 3310817 - RNA, 15 nt, Mycobacterium tuberculosis H37Rv
gcuaucccaggggca

SEQ ID NO: 3310818 - RNA, 16 nt, Mycobacterium tuberculosis H37Rv
gcuauccgagugaucg

SEQ ID NO: 3310819 - RNA, 17 nt, Mycobacterium tuberculosis H37Rv
gcuaucgcuagccggcu

SEQ ID NO: 3310820 - RNA, 22 nt, Mycobacterium tuberculosis H37Rv
gcuaugcgccgcaugccaccga

SEQ ID NO: 3310821 - RNA, 23 nt, Mycobacterium tuberculosis H37Rv
gcuaugcgccgcaugccaccgag

SEQ ID NO: 3310822 - RNA, 22 nt, Mycobacterium tuberculosis H37Rv
gcuauggcauuaccacuucggc

SEQ ID NO: 3310823 - RNA, 15 nt, Mycobacterium tuberculosis H37Rv
gcuauucgccagcgc

SEQ ID NO: 3310824 - RNA, 16 nt, Mycobacterium tuberculosis H37Rv
gcuauucgccagcgcc

SEQ ID NO: 3310825 - RNA, 20 nt, Mycobacterium tuberculosis H37Rv
gcuauucggcggcauguuca

SEQ ID NO: 3310826 - RNA, 16 nt, Mycobacterium tuberculosis H37Rv
gcucaaaucaugcgau

SEQ ID NO: 3310827 - RNA, 21 nt, Mycobacterium tuberculosis H37Rv
gcucaaaucaugcgauucugc

SEQ ID NO: 3310828 - RNA, 14 nt, Mycobacterium tuberculosis H37Rv
gcucaacaccagcc

SEQ ID NO: 3310829 - RNA, 22 nt, Mycobacterium tuberculosis H37Rv
gcucaacaccagccggucgucg

SEQ ID NO: 3310830 - RNA, 22 nt, Mycobacterium tuberculosis H37Rv
gcucaacaccgaguuccucugc

SEQ ID NO: 3310831 - RNA, 20 nt, Mycobacterium tuberculosis H37Rv
gcucaaccucuggcggcggg

SEQ ID NO: 3310832 - RNA, 15 nt, Mycobacterium tuberculosis H37Rv
gcucaagcgcgucgu

SEQ ID NO: 3310833 - RNA, 18 nt, Mycobacterium tuberculosis H37Rv
gcucaaggacgcaccgcc

SEQ ID NO: 3310834 - RNA, 19 nt, Mycobacterium tuberculosis H37Rv
gcucaaugaucgcggcggc

SEQ ID NO: 3310835 - RNA, 13 nt, Mycobacterium tuberculosis H37Rv
gcucacaauggcu

SEQ ID NO: 3310836 - RNA, 19 nt, Mycobacterium tuberculosis H37Rv
gcucacacucggccgggcu

SEQ ID NO: 3310837 - RNA, 13 nt, Mycobacterium tuberculosis H37Rv
gcucacacuggcu

SEQ ID NO: 3310838 - RNA, 16 nt, Mycobacterium tuberculosis H37Rv
gcucacagcacagcgc

SEQ ID NO: 3310839 - RNA, 17 nt, Mycobacterium tuberculosis H37Rv
gcucacagcacagcgca

SEQ ID NO: 3310840 - RNA, 19 nt, Mycobacterium tuberculosis H37Rv
gcucacagcacagcgcagc

SEQ ID NO: 3310841 - RNA, 17 nt, Mycobacterium tuberculosis H37Rv
gcucacauacagcaggc

SEQ ID NO: 3310842 - RNA, 20 nt, Mycobacterium tuberculosis H37Rv
gcucacauacagcaggccgc

SEQ ID NO: 3310843 - RNA, 21 nt, Mycobacterium tuberculosis H37Rv
gcucacauucaacagauccga

SEQ ID NO: 3310844 - RNA, 20 nt, Mycobacterium tuberculosis H37Rv
gcucaccaaggucggcgauc

SEQ ID NO: 3310845 - RNA, 15 nt, Mycobacterium tuberculosis H37Rv
gcucaccaggcgagc

SEQ ID NO: 3310846 - RNA, 17 nt, Mycobacterium tuberculosis H37Rv
gcucacccggagcaccc

SEQ ID NO: 3310847 - RNA, 15 nt, Mycobacterium tuberculosis H37Rv
gcucacccugcucga

SEQ ID NO: 3310848 - RNA, 17 nt, Mycobacterium tuberculosis H37Rv
gcucaccgacaugacgc

SEQ ID NO: 3310849 - RNA, 18 nt, Mycobacterium tuberculosis H37Rv
gcucaccgacgcugacca

SEQ ID NO: 3310850 - RNA, 17 nt, Mycobacterium tuberculosis H37Rv
gcucaccgcgcaucauc

SEQ ID NO: 3310851 - RNA, 13 nt, Mycobacterium tuberculosis H37Rv
gcucaccggggcc

SEQ ID NO: 3310852 - RNA, 16 nt, Mycobacterium tuberculosis H37Rv
gcucaccucaugaucu

SEQ ID NO: 3310853 - RNA, 21 nt, Mycobacterium tuberculosis H37Rv
gcucaccucaugaucucacca

SEQ ID NO: 3310854 - RNA, 23 nt, Mycobacterium tuberculosis H37Rv
gcucacgacuggcgcccagccgg

SEQ ID NO: 3310855 - RNA, 12 nt, Mycobacterium tuberculosis H37Rv
gcucacgaucac

SEQ ID NO: 3310856 - RNA, 14 nt, Mycobacterium tuberculosis H37Rv
gcucacgaucaccc

SEQ ID NO: 3310857 - RNA, 15 nt, Mycobacterium tuberculosis H37Rv
gcucacgaucacccg

SEQ ID NO: 3310858 - RNA, 22 nt, Mycobacterium tuberculosis H37Rv
gcucacgccggguguggcuuga

SEQ ID NO: 3310859 - RNA, 14 nt, Mycobacterium tuberculosis H37Rv
gcucacgcggucaa

SEQ ID NO: 3310860 - RNA, 17 nt, Mycobacterium tuberculosis H37Rv
gcucacgcggucaacgc

SEQ ID NO: 3310861 - RNA, 16 nt, Mycobacterium tuberculosis H37Rv
gcucacgcuccgccgg

SEQ ID NO: 3310862 - RNA, 23 nt, Mycobacterium tuberculosis H37Rv
gcucacggacgcugggcgguagc

SEQ ID NO: 3310863 - RNA, 12 nt, Mycobacterium tuberculosis H37Rv
gcucacggcggc

SEQ ID NO: 3310864 - RNA, 13 nt, Mycobacterium tuberculosis H37Rv
gcucacggcggcg

SEQ ID NO: 3310865 - RNA, 17 nt, Mycobacterium tuberculosis H37Rv
gcucacggcggcgaacu

SEQ ID NO: 3310866 - RNA, 13 nt, Mycobacterium tuberculosis H37Rv
gcucacgguggcc

SEQ ID NO: 3310867 - RNA, 20 nt, Mycobacterium tuberculosis H37Rv
gcucacgguggccgcaucga

SEQ ID NO: 3310868 - RNA, 17 nt, Mycobacterium tuberculosis H37Rv
gcucacuacccgcaacg

SEQ ID NO: 3310869 - RNA, 19 nt, Mycobacterium tuberculosis H37Rv
gcucacuacccgcaacgag

SEQ ID NO: 3310870 - RNA, 17 nt, Mycobacterium tuberculosis H37Rv
gcucagcaacgucacgu

SEQ ID NO: 3310871 - RNA, 20 nt, Mycobacterium tuberculosis H37Rv
gcucagccggcccugcggcc

SEQ ID NO: 3310872 - RNA, 20 nt, Mycobacterium tuberculosis H37Rv
gcucagccguccgggcggcc

SEQ ID NO: 3310873 - RNA, 22 nt, Mycobacterium tuberculosis H37Rv
gcucagccguccgggcggccuc

SEQ ID NO: 3310874 - RNA, 23 nt, Mycobacterium tuberculosis H37Rv
gcucagcgcgcgccgcuggguga

SEQ ID NO: 3310875 - RNA, 17 nt, Mycobacterium tuberculosis H37Rv
gcucagcgcggccacgc

SEQ ID NO: 3310876 - RNA, 14 nt, Mycobacterium tuberculosis H37Rv
gcucagcgcggccc

SEQ ID NO: 3310877 - RNA, 13 nt, Mycobacterium tuberculosis H37Rv
gcucagcgguggc

SEQ ID NO: 3310878 - RNA, 14 nt, Mycobacterium tuberculosis H37Rv
gcucagcgugcgcu

SEQ ID NO: 3310879 - RNA, 20 nt, Mycobacterium tuberculosis H37Rv
gcucagcgugcgcuggcuga

SEQ ID NO: 3310880 - RNA, 22 nt, Mycobacterium tuberculosis H37Rv
gcucagcuaaaaaccgcugccg

SEQ ID NO: 3310881 - RNA, 15 nt, Mycobacterium tuberculosis H37Rv
gcucagcuggucggc

SEQ ID NO: 3310882 - RNA, 17 nt, Mycobacterium tuberculosis H37Rv
gcucagcuggucggcuu

SEQ ID NO: 3310883 - RNA, 20 nt, Mycobacterium tuberculosis H37Rv
gcucagcugguggcggcggu

SEQ ID NO: 3310884 - RNA, 22 nt, Mycobacterium tuberculosis H37Rv
gcucagcugguggcggcgguac

SEQ ID NO: 3310885 - RNA, 14 nt, Mycobacterium tuberculosis H37Rv
gcucagcuucgcgu

SEQ ID NO: 3310886 - RNA, 19 nt, Mycobacterium tuberculosis H37Rv
gcucaggacgaacgcuggc

SEQ ID NO: 3310887 - RNA, 23 nt, Mycobacterium tuberculosis H37Rv
gcucaggggcuacuaggcccagc

SEQ ID NO: 3310888 - RNA, 16 nt, Mycobacterium tuberculosis H37Rv
gcucagggugcgccgc

SEQ ID NO: 3310889 - RNA, 17 nt, Mycobacterium tuberculosis H37Rv
gcucagggugcgccgca

SEQ ID NO: 3310890 - RNA, 14 nt, Mycobacterium tuberculosis H37Rv
gcucgaagcccgga

SEQ ID NO: 3310891 - RNA, 13 nt, Mycobacterium tuberculosis H37Rv
gcucgaaggaccg

SEQ ID NO: 3310892 - RNA, 16 nt, Mycobacterium tuberculosis H37Rv
gcucgaauacaccuug

SEQ ID NO: 3310893 - RNA, 17 nt, Mycobacterium tuberculosis H37Rv
gcucgacaaccacggca

SEQ ID NO: 3310894 - RNA, 21 nt, Mycobacterium tuberculosis H37Rv
gcucgaccagacgcugcccaa

SEQ ID NO: 3310895 - RNA, 12 nt, Mycobacterium tuberculosis H37Rv
gcucgaccagga

SEQ ID NO: 3310896 - RNA, 21 nt, Mycobacterium tuberculosis H37Rv
gcucgaccugaggcaccucgg

SEQ ID NO: 3310897 - RNA, 21 nt, Mycobacterium tuberculosis H37Rv
gcucgacgaagaucgcgugcc

SEQ ID NO: 3310898 - RNA, 23 nt, Mycobacterium tuberculosis H37Rv
gcucgacgaaugugagcgcgcuc

SEQ ID NO: 3310899 - RNA, 17 nt, Mycobacterium tuberculosis H37Rv
gcucgacgaucugcagc

SEQ ID NO: 3310900 - RNA, 20 nt, Mycobacterium tuberculosis H37Rv
gcucgacgaucugcagcacu

SEQ ID NO: 3310901 - RNA, 16 nt, Mycobacterium tuberculosis H37Rv
gcucgacgcccgccac

SEQ ID NO: 3310902 - RNA, 17 nt, Mycobacterium tuberculosis H37Rv
gcucgacggcccgccgu

SEQ ID NO: 3310903 - RNA, 19 nt, Mycobacterium tuberculosis H37Rv
gcucgacggcuccgauucc

SEQ ID NO: 3310904 - RNA, 18 nt, Mycobacterium tuberculosis H37Rv
gcucgacguacagcgcgg

SEQ ID NO: 3310905 - RNA, 15 nt, Mycobacterium tuberculosis H37Rv
gcucgagcucggcga

SEQ ID NO: 3310906 - RNA, 16 nt, Mycobacterium tuberculosis H37Rv
gcucgagcucggcgau

SEQ ID NO: 3310907 - RNA, 14 nt, Mycobacterium tuberculosis H37Rv
gcucgaggaccacc

SEQ ID NO: 3310908 - RNA, 19 nt, Mycobacterium tuberculosis H37Rv
gcucgaggcccgggugcua

SEQ ID NO: 3310909 - RNA, 17 nt, Mycobacterium tuberculosis H37Rv
gcucgagucgcagcacg

SEQ ID NO: 3310910 - RNA, 14 nt, Mycobacterium tuberculosis H37Rv
gcucgauacccagg

SEQ ID NO: 3310911 - RNA, 15 nt, Mycobacterium tuberculosis H37Rv
gcucgauacggcccu

SEQ ID NO: 3310912 - RNA, 22 nt, Mycobacterium tuberculosis H37Rv
gcucgaucacuagcgccccugg

SEQ ID NO: 3310913 - RNA, 15 nt, Mycobacterium tuberculosis H37Rv
gcucgaucagccggg

SEQ ID NO: 3310914 - RNA, 16 nt, Mycobacterium tuberculosis H37Rv
gcucgaucagccgggu

SEQ ID NO: 3310915 - RNA, 20 nt, Mycobacterium tuberculosis H37Rv
gcucgaucaucgggagccgc

SEQ ID NO: 3310916 - RNA, 22 nt, Mycobacterium tuberculosis H37Rv
gcucgaucgcguucugcaccag

SEQ ID NO: 3310917 - RNA, 14 nt, Mycobacterium tuberculosis H37Rv
gcucgaucugucgc

SEQ ID NO: 3310918 - RNA, 14 nt, Mycobacterium tuberculosis H37Rv
gcucgauggcggcc

SEQ ID NO: 3310919 - RNA, 21 nt, Mycobacterium tuberculosis H37Rv
gcucgauggcggccaccagcg

SEQ ID NO: 3310920 - RNA, 18 nt, Mycobacterium tuberculosis H37Rv
gcucgaugucagcggccg

SEQ ID NO: 3310921 - RNA, 15 nt, Mycobacterium tuberculosis H37Rv
gcucgcaaucguugg

SEQ ID NO: 3310922 - RNA, 17 nt, Mycobacterium tuberculosis H37Rv
gcucgcaaucguuggcc

SEQ ID NO: 3310923 - RNA, 17 nt, Mycobacterium tuberculosis H37Rv
gcucgcacagcaccacg

SEQ ID NO: 3310924 - RNA, 15 nt, Mycobacterium tuberculosis H37Rv
gcucgcaccaccacg

SEQ ID NO: 3310925 - RNA, 21 nt, Mycobacterium tuberculosis H37Rv
gcucgcacccgcucggcgcgc

SEQ ID NO: 3310926 - RNA, 19 nt, Mycobacterium tuberculosis H37Rv
gcucgcacucguugccgac

SEQ ID NO: 3310927 - RNA, 18 nt, Mycobacterium tuberculosis H37Rv
gcucgcagaucgugggga

SEQ ID NO: 3310928 - RNA, 13 nt, Mycobacterium tuberculosis H37Rv
gcucgcaggccgg

SEQ ID NO: 3310929 - RNA, 17 nt, Mycobacterium tuberculosis H37Rv
gcucgcaggccggcggc

SEQ ID NO: 3310930 - RNA, 20 nt, Mycobacterium tuberculosis H37Rv
gcucgcaggccggcggcggu

SEQ ID NO: 3310931 - RNA, 13 nt, Mycobacterium tuberculosis H37Rv
gcucgcaucaucg

SEQ ID NO: 3310932 - RNA, 17 nt, Mycobacterium tuberculosis H37Rv
gcucgcauucggcgagc

SEQ ID NO: 3310933 - RNA, 13 nt, Mycobacterium tuberculosis H37Rv
gcucgccaccucg

SEQ ID NO: 3310934 - RNA, 13 nt, Mycobacterium tuberculosis H37Rv
gcucgccagcacg

SEQ ID NO: 3310935 - RNA, 15 nt, Mycobacterium tuberculosis H37Rv
gcucgccagcacgac

SEQ ID NO: 3310936 - RNA, 18 nt, Mycobacterium tuberculosis H37Rv
gcucgccagccugaaccg

SEQ ID NO: 3310937 - RNA, 22 nt, Mycobacterium tuberculosis H37Rv
gcucgccaggcaagccagcacu

SEQ ID NO: 3310938 - RNA, 17 nt, Mycobacterium tuberculosis H37Rv
gcucgccaggccuaggc

SEQ ID NO: 3310939 - RNA, 20 nt, Mycobacterium tuberculosis H37Rv
gcucgccagggucgcgagcc

SEQ ID NO: 3310940 - RNA, 22 nt, Mycobacterium tuberculosis H37Rv
gcucgcccagugaaucggaccg

SEQ ID NO: 3310941 - RNA, 13 nt, Mycobacterium tuberculosis H37Rv
gcucgcccgccgc

SEQ ID NO: 3310942 - RNA, 16 nt, Mycobacterium tuberculosis H37Rv
gcucgcccgccgccac

SEQ ID NO: 3310943 - RNA, 21 nt, Mycobacterium tuberculosis H37Rv
gcucgcccgcuacggcagccc

SEQ ID NO: 3310944 - RNA, 18 nt, Mycobacterium tuberculosis H37Rv
gcucgcccuauacgcaac

SEQ ID NO: 3310945 - RNA, 14 nt, Mycobacterium tuberculosis H37Rv
gcucgcccucagag

SEQ ID NO: 3310946 - RNA, 15 nt, Mycobacterium tuberculosis H37Rv
gcucgccgaccagcu

SEQ ID NO: 3310947 - RNA, 20 nt, Mycobacterium tuberculosis H37Rv
gcucgccgagcagacacaga

SEQ ID NO: 3310948 - RNA, 23 nt, Mycobacterium tuberculosis H37Rv
gcucgccgagcagacacagaauc

SEQ ID NO: 3310949 - RNA, 15 nt, Mycobacterium tuberculosis H37Rv
gcucgccgagcugug

SEQ ID NO: 3310950 - RNA, 15 nt, Mycobacterium tuberculosis H37Rv
gcucgccgaggaaau

SEQ ID NO: 3310951 - RNA, 18 nt, Mycobacterium tuberculosis H37Rv
gcucgccgauuuggccgu

SEQ ID NO: 3310952 - RNA, 18 nt, Mycobacterium tuberculosis H37Rv
gcucgccggccaacuggg

SEQ ID NO: 3310953 - RNA, 14 nt, Mycobacterium tuberculosis H37Rv
gcucgccggcgaac

SEQ ID NO: 3310954 - RNA, 20 nt, Mycobacterium tuberculosis H37Rv
gcucgccggcucggcgguac

SEQ ID NO: 3310955 - RNA, 23 nt, Mycobacterium tuberculosis H37Rv
gcucgccgggcuuaggccgcggc

SEQ ID NO: 3310956 - RNA, 16 nt, Mycobacterium tuberculosis H37Rv
gcucgccgggucagcc

SEQ ID NO: 3310957 - RNA, 20 nt, Mycobacterium tuberculosis H37Rv
gcucgccgguaggcggccag

SEQ ID NO: 3310958 - RNA, 21 nt, Mycobacterium tuberculosis H37Rv
gcucgccgguaggcggccagc

SEQ ID NO: 3310959 - RNA, 21 nt, Mycobacterium tuberculosis H37Rv
gcucgccguaagcaccagcca

SEQ ID NO: 3310960 - RNA, 13 nt, Mycobacterium tuberculosis H37Rv
gcucgccgugacc

SEQ ID NO: 3310961 - RNA, 14 nt, Mycobacterium tuberculosis H37Rv
gcucgccgugacca

SEQ ID NO: 3310962 - RNA, 21 nt, Mycobacterium tuberculosis H37Rv
gcucgccgugaccaggugcca

SEQ ID NO: 3310963 - RNA, 13 nt, Mycobacterium tuberculosis H37Rv
gcucgccguggug

SEQ ID NO: 3310964 - RNA, 15 nt, Mycobacterium tuberculosis H37Rv
gcucgccguggugga

SEQ ID NO: 3310965 - RNA, 19 nt, Mycobacterium tuberculosis H37Rv
gcucgccguuauccgacga

SEQ ID NO: 3310966 - RNA, 15 nt, Mycobacterium tuberculosis H37Rv
gcucgcgaaggggcg

SEQ ID NO: 3310967 - RNA, 13 nt, Mycobacterium tuberculosis H37Rv
gcucgcgaucguc

SEQ ID NO: 3310968 - RNA, 18 nt, Mycobacterium tuberculosis H37Rv
gcucgcgcaaggcgccgc

SEQ ID NO: 3310969 - RNA, 12 nt, Mycobacterium tuberculosis H37Rv
gcucgcgcgcug

SEQ ID NO: 3310970 - RNA, 14 nt, Mycobacterium tuberculosis H37Rv
gcucgcgcgcuggg

SEQ ID NO: 3310971 - RNA, 21 nt, Mycobacterium tuberculosis H37Rv
gcucgcggcuucaguccggcc

SEQ ID NO: 3310972 - RNA, 13 nt, Mycobacterium tuberculosis H37Rv
gcucgcggucaug

SEQ ID NO: 3310973 - RNA, 21 nt, Mycobacterium tuberculosis H37Rv
gcucgcguggccgccggcgcu

SEQ ID NO: 3310974 - RNA, 15 nt, Mycobacterium tuberculosis H37Rv
gcucgcucaccggcu

SEQ ID NO: 3310975 - RNA, 20 nt, Mycobacterium tuberculosis H37Rv
gcucgcucaccggcuggugc

SEQ ID NO: 3310976 - RNA, 16 nt, Mycobacterium tuberculosis H37Rv
gcucgcucugcgcggc

SEQ ID NO: 3310977 - RNA, 17 nt, Mycobacterium tuberculosis H37Rv
gcucgcucugcgcggcu

SEQ ID NO: 3310978 - RNA, 20 nt, Mycobacterium tuberculosis H37Rv
gcucgcugaucuggggcacc

SEQ ID NO: 3310979 - RNA, 13 nt, Mycobacterium tuberculosis H37Rv
gcucgcugcacca

SEQ ID NO: 3310980 - RNA, 18 nt, Mycobacterium tuberculosis H37Rv
gcucgcugcaccagcugc

SEQ ID NO: 3310981 - RNA, 23 nt, Mycobacterium tuberculosis H37Rv
gcucgcugcgcgcccaccgggcg

SEQ ID NO: 3310982 - RNA, 20 nt, Mycobacterium tuberculosis H37Rv
gcucgcuucaggcaccggau

SEQ ID NO: 3310983 - RNA, 21 nt, Mycobacterium tuberculosis H37Rv
gcucggagagguagggcucca

SEQ ID NO: 3310984 - RNA, 23 nt, Mycobacterium tuberculosis H37Rv
gcucggagagguagggcuccacc

SEQ ID NO: 3310985 - RNA, 21 nt, Mycobacterium tuberculosis H37Rv
gcucggcaccgagcuugucca

SEQ ID NO: 3310986 - RNA, 20 nt, Mycobacterium tuberculosis H37Rv
gcucguuguguauggucacg

SEQ ID NO: 3310987 - RNA, 16 nt, Mycobacterium tuberculosis H37Rv
gcucguuugcgagcag

SEQ ID NO: 3310988 - RNA, 15 nt, Mycobacterium tuberculosis H37Rv
gcucuccauggccga

SEQ ID NO: 3310989 - RNA, 17 nt, Mycobacterium tuberculosis H37Rv
gcucucgcggcguucgc

SEQ ID NO: 3310990 - RNA, 14 nt, Mycobacterium tuberculosis H37Rv
gcucucggucagag

SEQ ID NO: 3310991 - RNA, 18 nt, Mycobacterium tuberculosis H37Rv
gcucucggucaguuccuc

SEQ ID NO: 3310992 - RNA, 14 nt, Mycobacterium tuberculosis H37Rv
gcucucgguggucc

SEQ ID NO: 3310993 - RNA, 20 nt, Mycobacterium tuberculosis H37Rv
gcucucuucgcgcgcugggc

SEQ ID NO: 3310994 - RNA, 13 nt, Mycobacterium tuberculosis H37Rv
gcucugaggucac

SEQ ID NO: 3310995 - RNA, 19 nt, Mycobacterium tuberculosis H37Rv
gcucugcgccacagcagcg

SEQ ID NO: 3310996 - RNA, 13 nt, Mycobacterium tuberculosis H37Rv
gcucugcggccac

SEQ ID NO: 3310997 - RNA, 14 nt, Mycobacterium tuberculosis H37Rv
gcucuggacgguca

SEQ ID NO: 3310998 - RNA, 13 nt, Mycobacterium tuberculosis H37Rv
gcucuggcuccga

SEQ ID NO: 3310999 - RNA, 19 nt, Mycobacterium tuberculosis H37Rv
gcugaacaccgugggcgga

SEQ ID NO: 3311000 - RNA, 20 nt, Mycobacterium tuberculosis H37Rv
gcugaacauuccggcaccuc

SEQ ID NO: 3311001 - RNA, 23 nt, Mycobacterium tuberculosis H37Rv
gcugaacauuccggcaccuccgc

SEQ ID NO: 3311002 - RNA, 13 nt, Mycobacterium tuberculosis H37Rv
gcugaacgcgagc

SEQ ID NO: 3311003 - RNA, 19 nt, Mycobacterium tuberculosis H37Rv
gcugaacgggaugaauuca

SEQ ID NO: 3311004 - RNA, 17 nt, Mycobacterium tuberculosis H37Rv
gcugaagaucaacaggc

SEQ ID NO: 3311005 - RNA, 20 nt, Mycobacterium tuberculosis H37Rv
gcugaagaucaacaggcguc

SEQ ID NO: 3311006 - RNA, 23 nt, Mycobacterium tuberculosis H37Rv
gcugaagccaaaugcgcugucgc

SEQ ID NO: 3311007 - RNA, 15 nt, Mycobacterium tuberculosis H37Rv
gcugaagcccauggc

SEQ ID NO: 3311008 - RNA, 22 nt, Mycobacterium tuberculosis H37Rv
gcugaaggccgguagcgcgggu

SEQ ID NO: 3311009 - RNA, 20 nt, Mycobacterium tuberculosis H37Rv
gcugaaucaccccggcggcc

SEQ ID NO: 3311010 - RNA, 23 nt, Mycobacterium tuberculosis H37Rv
gcugaauguugguuugccggcgg

SEQ ID NO: 3311011 - RNA, 15 nt, Mycobacterium tuberculosis H37Rv
gcugaauucggcgag

SEQ ID NO: 3311012 - RNA, 14 nt, Mycobacterium tuberculosis H37Rv
gcugaauuggcgcc

SEQ ID NO: 3311013 - RNA, 21 nt, Mycobacterium tuberculosis H37Rv
gcugaauuggcgccgaugacc

SEQ ID NO: 3311014 - RNA, 16 nt, Mycobacterium tuberculosis H37Rv
gcugaauuucgaugag

SEQ ID NO: 3311015 - RNA, 13 nt, Mycobacterium tuberculosis H37Rv
gcugacacgacga

SEQ ID NO: 3311016 - RNA, 13 nt, Mycobacterium tuberculosis H37Rv
gcugaccagcguc

SEQ ID NO: 3311017 - RNA, 22 nt, Mycobacterium tuberculosis H37Rv
gcugaccagcguccagccgccc

SEQ ID NO: 3311018 - RNA, 18 nt, Mycobacterium tuberculosis H37Rv
gcugaccaugaccgggcu

SEQ ID NO: 3311019 - RNA, 14 nt, Mycobacterium tuberculosis H37Rv
gcugaccccgccgg

SEQ ID NO: 3311020 - RNA, 13 nt, Mycobacterium tuberculosis H37Rv
gcugacccgccga

SEQ ID NO: 3311021 - RNA, 14 nt, Mycobacterium tuberculosis H37Rv
gcugacccgcggua

SEQ ID NO: 3311022 - RNA, 16 nt, Mycobacterium tuberculosis H37Rv
gcugacccgcgguagc

SEQ ID NO: 3311023 - RNA, 18 nt, Mycobacterium tuberculosis H37Rv
gcugacccgggccgggcc

SEQ ID NO: 3311024 - RNA, 14 nt, Mycobacterium tuberculosis H37Rv
gcugaccgaagagc

SEQ ID NO: 3311025 - RNA, 15 nt, Mycobacterium tuberculosis H37Rv
gcugaccgaagagcu

SEQ ID NO: 3311026 - RNA, 17 nt, Mycobacterium tuberculosis H37Rv
gcugaccgaauggccgc

SEQ ID NO: 3311027 - RNA, 21 nt, Mycobacterium tuberculosis H37Rv
gcugaccgacccggaccuggg

SEQ ID NO: 3311028 - RNA, 15 nt, Mycobacterium tuberculosis H37Rv
gcugaccgccagcgg

SEQ ID NO: 3311029 - RNA, 21 nt, Mycobacterium tuberculosis H37Rv
gcugaccgccagcggccgcuc

SEQ ID NO: 3311030 - RNA, 21 nt, Mycobacterium tuberculosis H37Rv
gcugaccgcgccggacagcgc

SEQ ID NO: 3311031 - RNA, 22 nt, Mycobacterium tuberculosis H37Rv
gcugaccgcuaccagcugggcg

SEQ ID NO: 3311032 - RNA, 24 nt, Mycobacterium tuberculosis H37Rv
gcugaccgcuaccagcugggcgac

SEQ ID NO: 3311033 - RNA, 19 nt, Mycobacterium tuberculosis H37Rv
gcugaccggaucugacggc

SEQ ID NO: 3311034 - RNA, 23 nt, Mycobacterium tuberculosis H37Rv
gcugaccggcuauuagcggcuug

SEQ ID NO: 3311035 - RNA, 16 nt, Mycobacterium tuberculosis H37Rv
gcugaccggggcgccc

SEQ ID NO: 3311036 - RNA, 19 nt, Mycobacterium tuberculosis H37Rv
gcugaccggggcgcccggc

SEQ ID NO: 3311037 - RNA, 16 nt, Mycobacterium tuberculosis H37Rv
gcugaccggggucggc

SEQ ID NO: 3311038 - RNA, 21 nt, Mycobacterium tuberculosis H37Rv
gcugaccggggucggccugcg

SEQ ID NO: 3311039 - RNA, 23 nt, Mycobacterium tuberculosis H37Rv
gcugaccggggucggccugcggc

SEQ ID NO: 3311040 - RNA, 16 nt, Mycobacterium tuberculosis H37Rv
gcugaccugaaaaucc

SEQ ID NO: 3311041 - RNA, 23 nt, Mycobacterium tuberculosis H37Rv
gcugaccugggguguagccagcg

SEQ ID NO: 3311042 - RNA, 23 nt, Mycobacterium tuberculosis H37Rv
gcugaccuucaggcccugccgac

SEQ ID NO: 3311043 - RNA, 22 nt, Mycobacterium tuberculosis H37Rv
gcugaccuucucacgcaccaug

SEQ ID NO: 3311044 - RNA, 19 nt, Mycobacterium tuberculosis H37Rv
gcugacgacugggcgccca

SEQ ID NO: 3311045 - RNA, 15 nt, Mycobacterium tuberculosis H37Rv
gcugacgaguugaug

SEQ ID NO: 3311046 - RNA, 16 nt, Mycobacterium tuberculosis H37Rv
gcugacgaucuccacc

SEQ ID NO: 3311047 - RNA, 15 nt, Mycobacterium tuberculosis H37Rv
gcugacgauggccag

SEQ ID NO: 3311048 - RNA, 14 nt, Mycobacterium tuberculosis H37Rv
gcugacgcccuccu

SEQ ID NO: 3311049 - RNA, 15 nt, Mycobacterium tuberculosis H37Rv
gcugacgcccuccug

SEQ ID NO: 3311050 - RNA, 16 nt, Mycobacterium tuberculosis H37Rv
gcugacgcccuccugg

SEQ ID NO: 3311051 - RNA, 16 nt, Mycobacterium tuberculosis H37Rv
gcugacggccugcaac

SEQ ID NO: 3311052 - RNA, 18 nt, Mycobacterium tuberculosis H37Rv
gcugacgguuugcggagc

SEQ ID NO: 3311053 - RNA, 14 nt, Mycobacterium tuberculosis H37Rv
gcugacgucaccac

SEQ ID NO: 3311054 - RNA, 20 nt, Mycobacterium tuberculosis H37Rv
gcugacgucuuggaacacgg

SEQ ID NO: 3311055 - RNA, 16 nt, Mycobacterium tuberculosis H37Rv
gcugacgugucggcug

SEQ ID NO: 3311056 - RNA, 17 nt, Mycobacterium tuberculosis H37Rv
gcugacuagggucaccg

SEQ ID NO: 3311057 - RNA, 15 nt, Mycobacterium tuberculosis H37Rv
gcugacuccugcggc

SEQ ID NO: 3311058 - RNA, 21 nt, Mycobacterium tuberculosis H37Rv
gcugagacgguguugcucgcc

SEQ ID NO: 3311059 - RNA, 16 nt, Mycobacterium tuberculosis H37Rv
gcugagcaaguccugc

SEQ ID NO: 3311060 - RNA, 17 nt, Mycobacterium tuberculosis H37Rv
gcugagcaaguccugca

SEQ ID NO: 3311061 - RNA, 14 nt, Mycobacterium tuberculosis H37Rv
gcugagcacgcgga

SEQ ID NO: 3311062 - RNA, 15 nt, Mycobacterium tuberculosis H37Rv
gcugagcaggucucg

SEQ ID NO: 3311063 - RNA, 22 nt, Mycobacterium tuberculosis H37Rv
gcugagcaggucucguaucgca

SEQ ID NO: 3311064 - RNA, 20 nt, Mycobacterium tuberculosis H37Rv
gcugagccccccgagcccgc

SEQ ID NO: 3311065 - RNA, 16 nt, Mycobacterium tuberculosis H37Rv
gcugagccggucauag

SEQ ID NO: 3311066 - RNA, 14 nt, Mycobacterium tuberculosis H37Rv
gcugagcgccaggc

SEQ ID NO: 3311067 - RNA, 16 nt, Mycobacterium tuberculosis H37Rv
gcugagcggccggcau

SEQ ID NO: 3311068 - RNA, 19 nt, Mycobacterium tuberculosis H37Rv
gcugagcucgaugucagcg

SEQ ID NO: 3311069 - RNA, 21 nt, Mycobacterium tuberculosis H37Rv
gcugagcucgaugucagcggc

SEQ ID NO: 3311070 - RNA, 23 nt, Mycobacterium tuberculosis H37Rv
gcugagcucgaugucagcggccg

SEQ ID NO: 3311071 - RNA, 14 nt, Mycobacterium tuberculosis H37Rv
gcugagcugcucgc

SEQ ID NO: 3311072 - RNA, 15 nt, Mycobacterium tuberculosis H37Rv
gcugagcugcucgcc

SEQ ID NO: 3311073 - RNA, 16 nt, Mycobacterium tuberculosis H37Rv
gcugagcugcucgccg

SEQ ID NO: 3311074 - RNA, 16 nt, Mycobacterium tuberculosis H37Rv
gcugaggaacgccggc

SEQ ID NO: 3311075 - RNA, 22 nt, Mycobacterium tuberculosis H37Rv
gcugaggaacgccggcaucgcg

SEQ ID NO: 3311076 - RNA, 17 nt, Mycobacterium tuberculosis H37Rv
gcugaggcggcgacgac

SEQ ID NO: 3311077 - RNA, 12 nt, Mycobacterium tuberculosis H37Rv
gcugagggugga

SEQ ID NO: 3311078 - RNA, 19 nt, Mycobacterium tuberculosis H37Rv
gcugaggguggaccggucg

SEQ ID NO: 3311079 - RNA, 19 nt, Mycobacterium tuberculosis H37Rv
gcugagguaauucgcggcc

SEQ ID NO: 3311080 - RNA, 17 nt, Mycobacterium tuberculosis H37Rv
gcugaguccccaggugg

SEQ ID NO: 3311081 - RNA, 21 nt, Mycobacterium tuberculosis H37Rv
gcugaguccccaggugggcag

SEQ ID NO: 3311082 - RNA, 14 nt, Mycobacterium tuberculosis H37Rv
gcugccggccgcgu

SEQ ID NO: 3311083 - RNA, 16 nt, Mycobacterium tuberculosis H37Rv
gcugccgguagcacag

SEQ ID NO: 3311084 - RNA, 20 nt, Mycobacterium tuberculosis H37Rv
gcugccgguagcacagcagc

SEQ ID NO: 3311085 - RNA, 20 nt, Mycobacterium tuberculosis H37Rv
gcugccggugugcggcguac

SEQ ID NO: 3311086 - RNA, 13 nt, Mycobacterium tuberculosis H37Rv
gcugccguaucca

SEQ ID NO: 3311087 - RNA, 17 nt, Mycobacterium tuberculosis H37Rv
gcugccguauccaggcg

SEQ ID NO: 3311088 - RNA, 22 nt, Mycobacterium tuberculosis H37Rv
gcugccguauccaggcgugcau

SEQ ID NO: 3311089 - RNA, 14 nt, Mycobacterium tuberculosis H37Rv
gcugccgucagccg

SEQ ID NO: 3311090 - RNA, 18 nt, Mycobacterium tuberculosis H37Rv
gcugccgucagcugaccg

SEQ ID NO: 3311091 - RNA, 16 nt, Mycobacterium tuberculosis H37Rv
gcugccgucgcugccc

SEQ ID NO: 3311092 - RNA, 17 nt, Mycobacterium tuberculosis H37Rv
gcugccgucgcugcccc

SEQ ID NO: 3311093 - RNA, 14 nt, Mycobacterium tuberculosis H37Rv
gcugccgucggugc

SEQ ID NO: 3311094 - RNA, 13 nt, Mycobacterium tuberculosis H37Rv
gcugccugccgcg

SEQ ID NO: 3311095 - RNA, 12 nt, Mycobacterium tuberculosis H37Rv
gcugccuucuuu

SEQ ID NO: 3311096 - RNA, 19 nt, Mycobacterium tuberculosis H37Rv
gcugccuuggcgcggcacc

SEQ ID NO: 3311097 - RNA, 21 nt, Mycobacterium tuberculosis H37Rv
gcugcgaaagccacucgcgca

SEQ ID NO: 3311098 - RNA, 22 nt, Mycobacterium tuberculosis H37Rv
gcugcgaaagccacucgcgcac

SEQ ID NO: 3311099 - RNA, 20 nt, Mycobacterium tuberculosis H37Rv
gcugcgaagccgagcaucag

SEQ ID NO: 3311100 - RNA, 22 nt, Mycobacterium tuberculosis H37Rv
gcugcgacaggacgucggcgaa

SEQ ID NO: 3311101 - RNA, 19 nt, Mycobacterium tuberculosis H37Rv
gcugcgagaucgcggcgac

SEQ ID NO: 3311102 - RNA, 22 nt, Mycobacterium tuberculosis H37Rv
gcugcgagaucuugaugccuuu

SEQ ID NO: 3311103 - RNA, 16 nt, Mycobacterium tuberculosis H37Rv
gcugcgcaacaccauc

SEQ ID NO: 3311104 - RNA, 19 nt, Mycobacterium tuberculosis H37Rv
gcugcgcaacaccaucagc

SEQ ID NO: 3311105 - RNA, 19 nt, Mycobacterium tuberculosis H37Rv
gcugcgcaccgccgcgcga

SEQ ID NO: 3311106 - RNA, 14 nt, Mycobacterium tuberculosis H37Rv
gcugcgcagcggca

SEQ ID NO: 3311107 - RNA, 17 nt, Mycobacterium tuberculosis H37Rv
gcugcgccagaaucccg

SEQ ID NO: 3311108 - RNA, 23 nt, Mycobacterium tuberculosis H37Rv
gcugcgccgauacccagcggguc

SEQ ID NO: 3311109 - RNA, 18 nt, Mycobacterium tuberculosis H37Rv
gcugcgccgggcucgcga

SEQ ID NO: 3311110 - RNA, 24 nt, Mycobacterium tuberculosis H37Rv
gcugcgccgggcucgcgaucguca

SEQ ID NO: 3311111 - RNA, 14 nt, Mycobacterium tuberculosis H37Rv
gcugcgccgucgca

SEQ ID NO: 3311112 - RNA, 20 nt, Mycobacterium tuberculosis H37Rv
gcugcgccgucgcagccagc

SEQ ID NO: 3311113 - RNA, 14 nt, Mycobacterium tuberculosis H37Rv
gcugcgcgaagggg

SEQ ID NO: 3311114 - RNA, 23 nt, Mycobacterium tuberculosis H37Rv
gcugcgcgacugauccucgauga

SEQ ID NO: 3311115 - RNA, 16 nt, Mycobacterium tuberculosis H37Rv
gcugcgcgaucccaac

SEQ ID NO: 3311116 - RNA, 21 nt, Mycobacterium tuberculosis H37Rv
gcugcgcgaugucguucgcgu

SEQ ID NO: 3311117 - RNA, 13 nt, Mycobacterium tuberculosis H37Rv
gcugcgcgcggcg

SEQ ID NO: 3311118 - RNA, 13 nt, Mycobacterium tuberculosis H37Rv
gcugcgcggugcc

SEQ ID NO: 3311119 - RNA, 14 nt, Mycobacterium tuberculosis H37Rv
gcugcgcgucgagc

SEQ ID NO: 3311120 - RNA, 16 nt, Mycobacterium tuberculosis H37Rv
gcugcgcuuugcacag

SEQ ID NO: 3311121 - RNA, 19 nt, Mycobacterium tuberculosis H37Rv
gcugcggauacagccgccg

SEQ ID NO: 3311122 - RNA, 21 nt, Mycobacterium tuberculosis H37Rv
gcugcggauacagccgccgcc

SEQ ID NO: 3311123 - RNA, 19 nt, Mycobacterium tuberculosis H37Rv
gcugcggauuaagucggcg

SEQ ID NO: 3311124 - RNA, 22 nt, Mycobacterium tuberculosis H37Rv
gcugcggauuaagucggcggcc

SEQ ID NO: 3311125 - RNA, 14 nt, Mycobacterium tuberculosis H37Rv
gcugcggcaacgag

SEQ ID NO: 3311126 - RNA, 12 nt, Mycobacterium tuberculosis H37Rv
gcugcggcagcg

SEQ ID NO: 3311127 - RNA, 13 nt, Mycobacterium tuberculosis H37Rv
gcugcggccaggg

SEQ ID NO: 3311128 - RNA, 15 nt, Mycobacterium tuberculosis H37Rv
gcugcggccagggag

SEQ ID NO: 3311129 - RNA, 23 nt, Mycobacterium tuberculosis H37Rv
gcugcggcccacaccagcgcagc

SEQ ID NO: 3311130 - RNA, 12 nt, Mycobacterium tuberculosis H37Rv
gcugcggccgcg

SEQ ID NO: 3311131 - RNA, 12 nt, Mycobacterium tuberculosis H37Rv
gcugcggcgacg

SEQ ID NO: 3311132 - RNA, 16 nt, Mycobacterium tuberculosis H37Rv
gcugcggcgacgguga

SEQ ID NO: 3311133 - RNA, 17 nt, Mycobacterium tuberculosis H37Rv
gcugcggcgaucugguc

SEQ ID NO: 3311134 - RNA, 18 nt, Mycobacterium tuberculosis H37Rv
gcugcggcgaucuggucg

SEQ ID NO: 3311135 - RNA, 18 nt, Mycobacterium tuberculosis H37Rv
gcugcggcgcuggccagc

SEQ ID NO: 3311136 - RNA, 13 nt, Mycobacterium tuberculosis H37Rv
gcugcggcggcuu

SEQ ID NO: 3311137 - RNA, 19 nt, Mycobacterium tuberculosis H37Rv
gcugcggcuuggccaucac

SEQ ID NO: 3311138 - RNA, 20 nt, Mycobacterium tuberculosis H37Rv
gcugcggcuuggccaucacg

SEQ ID NO: 3311139 - RNA, 16 nt, Mycobacterium tuberculosis H37Rv
gcugcggcuuucagcg

SEQ ID NO: 3311140 - RNA, 18 nt, Mycobacterium tuberculosis H37Rv
gcugcggcuuucagcgcu

SEQ ID NO: 3311141 - RNA, 15 nt, Mycobacterium tuberculosis H37Rv
gcugcgggcccggcg

SEQ ID NO: 3311142 - RNA, 23 nt, Mycobacterium tuberculosis H37Rv
gcugcggggcgauccccagcacc

SEQ ID NO: 3311143 - RNA, 13 nt, Mycobacterium tuberculosis H37Rv
gcugcgggucucg

SEQ ID NO: 3311144 - RNA, 21 nt, Mycobacterium tuberculosis H37Rv
gcugcgggucucgccgaccuu

SEQ ID NO: 3311145 - RNA, 19 nt, Mycobacterium tuberculosis H37Rv
gcugcgggugauugagcuc

SEQ ID NO: 3311146 - RNA, 21 nt, Mycobacterium tuberculosis H37Rv
gcugcgggugauugagcucag

SEQ ID NO: 3311147 - RNA, 17 nt, Mycobacterium tuberculosis H37Rv
gcugcgguaagaaucga

SEQ ID NO: 3311148 - RNA, 20 nt, Mycobacterium tuberculosis H37Rv
gcugcgguaagaaucgaagc

SEQ ID NO: 3311149 - RNA, 16 nt, Mycobacterium tuberculosis H37Rv
gcugcggucgcggcug

SEQ ID NO: 3311150 - RNA, 16 nt, Mycobacterium tuberculosis H37Rv
gcugcggugcgggcuu

SEQ ID NO: 3311151 - RNA, 14 nt, Mycobacterium tuberculosis H37Rv
gcugcggugggcca

SEQ ID NO: 3311152 - RNA, 17 nt, Mycobacterium tuberculosis H37Rv
gcugcggugggccaggu

SEQ ID NO: 3311153 - RNA, 13 nt, Mycobacterium tuberculosis H37Rv
gcugcguccugga

SEQ ID NO: 3311154 - RNA, 14 nt, Mycobacterium tuberculosis H37Rv
gcugcguccuggau

SEQ ID NO: 3311155 - RNA, 16 nt, Mycobacterium tuberculosis H37Rv
gcugcucacgcagcag

SEQ ID NO: 3311156 - RNA, 18 nt, Mycobacterium tuberculosis H37Rv
gcugcuccaguucgccgu

SEQ ID NO: 3311157 - RNA, 22 nt, Mycobacterium tuberculosis H37Rv
gcugcuccaguucgccguuguc

SEQ ID NO: 3311158 - RNA, 20 nt, Mycobacterium tuberculosis H37Rv
gcugcucgagcagaucagca

SEQ ID NO: 3311159 - RNA, 15 nt, Mycobacterium tuberculosis H37Rv
gcugcucgaucaucg

SEQ ID NO: 3311160 - RNA, 22 nt, Mycobacterium tuberculosis H37Rv
gcugcucgaucaucgggagccg

SEQ ID NO: 3311161 - RNA, 20 nt, Mycobacterium tuberculosis H37Rv
gcugcucggucaggcggcug

SEQ ID NO: 3311162 - RNA, 17 nt, Mycobacterium tuberculosis H37Rv
gcugcucgucggcgccg

SEQ ID NO: 3311163 - RNA, 21 nt, Mycobacterium tuberculosis H37Rv
gcugcucgucuuggcggcggu

SEQ ID NO: 3311164 - RNA, 20 nt, Mycobacterium tuberculosis H37Rv
gcugcucgugagccccagcg

SEQ ID NO: 3311165 - RNA, 20 nt, Mycobacterium tuberculosis H37Rv
gcugcucugagcuuggucgc

SEQ ID NO: 3311166 - RNA, 21 nt, Mycobacterium tuberculosis H37Rv
gcugcugaccugcaugggcag

SEQ ID NO: 3311167 - RNA, 15 nt, Mycobacterium tuberculosis H37Rv
gcugcugccgcaccg

SEQ ID NO: 3311168 - RNA, 22 nt, Mycobacterium tuberculosis H37Rv
gcugcugccgcaccggugcucg

SEQ ID NO: 3311169 - RNA, 14 nt, Mycobacterium tuberculosis H37Rv
gcugcugcgcggug

SEQ ID NO: 3311170 - RNA, 16 nt, Mycobacterium tuberculosis H37Rv
gcugcugcucggccug

SEQ ID NO: 3311171 - RNA, 15 nt, Mycobacterium tuberculosis H37Rv
gcugcuggcagacca

SEQ ID NO: 3311172 - RNA, 15 nt, Mycobacterium tuberculosis H37Rv
gcugcuggcgcgccu

SEQ ID NO: 3311173 - RNA, 18 nt, Mycobacterium tuberculosis H37Rv
gcugcuucuccgagauca

SEQ ID NO: 3311174 - RNA, 19 nt, Mycobacterium tuberculosis H37Rv
gcugcuuggcggucugcgc

SEQ ID NO: 3311175 - RNA, 20 nt, Mycobacterium tuberculosis H37Rv
gcugcuuggcggucugcgcc

SEQ ID NO: 3311176 - RNA, 17 nt, Mycobacterium tuberculosis H37Rv
gcugcuuggucgcccag

SEQ ID NO: 3311177 - RNA, 18 nt, Mycobacterium tuberculosis H37Rv
gcuggaaaaucgggucac

SEQ ID NO: 3311178 - RNA, 15 nt, Mycobacterium tuberculosis H37Rv
gcuggucguggcggu

SEQ ID NO: 3311179 - RNA, 20 nt, Mycobacterium tuberculosis H37Rv
gcuggugaucagcucaguga

SEQ ID NO: 3311180 - RNA, 23 nt, Mycobacterium tuberculosis H37Rv
gcuggugaucagcucagugaugc

SEQ ID NO: 3311181 - RNA, 13 nt, Mycobacterium tuberculosis H37Rv
gcuggugccaacu

SEQ ID NO: 3311182 - RNA, 15 nt, Mycobacterium tuberculosis H37Rv
gcuggugccaacugc

SEQ ID NO: 3311183 - RNA, 20 nt, Mycobacterium tuberculosis H37Rv
gcuggugccaacugcgccgu

SEQ ID NO: 3311184 - RNA, 18 nt, Mycobacterium tuberculosis H37Rv
gcuggugcgcccaucaug

SEQ ID NO: 3311185 - RNA, 22 nt, Mycobacterium tuberculosis H37Rv
gcuggugcguagcccacccggg

SEQ ID NO: 3311186 - RNA, 16 nt, Mycobacterium tuberculosis H37Rv
gcugguggaguucgcg

SEQ ID NO: 3311187 - RNA, 12 nt, Mycobacterium tuberculosis H37Rv
gcugguggcggc

SEQ ID NO: 3311188 - RNA, 15 nt, Mycobacterium tuberculosis H37Rv
gcugguggcggcgac

SEQ ID NO: 3311189 - RNA, 18 nt, Mycobacterium tuberculosis H37Rv
gcugguggcggcgacacg

SEQ ID NO: 3311190 - RNA, 13 nt, Mycobacterium tuberculosis H37Rv
gcugguggcgugc

SEQ ID NO: 3311191 - RNA, 18 nt, Mycobacterium tuberculosis H37Rv
gcuggugggacgcggccg

SEQ ID NO: 3311192 - RNA, 13 nt, Mycobacterium tuberculosis H37Rv
gcuggugguaucg

SEQ ID NO: 3311193 - RNA, 14 nt, Mycobacterium tuberculosis H37Rv
gcugguggucagca

SEQ ID NO: 3311194 - RNA, 14 nt, Mycobacterium tuberculosis H37Rv
gcugguguccagcc

SEQ ID NO: 3311195 - RNA, 22 nt, Mycobacterium tuberculosis H37Rv
gcuggugugcgggcgugagugc

SEQ ID NO: 3311196 - RNA, 22 nt, Mycobacterium tuberculosis H37Rv
gcugguuucggccgcauccccg

SEQ ID NO: 3311197 - RNA, 16 nt, Mycobacterium tuberculosis H37Rv
gcugguuucggggacc

SEQ ID NO: 3311198 - RNA, 20 nt, Mycobacterium tuberculosis H37Rv
gcugguuucggggaccacgc

SEQ ID NO: 3311199 - RNA, 16 nt, Mycobacterium tuberculosis H37Rv
gcuguaacacccggcc

SEQ ID NO: 3311200 - RNA, 16 nt, Mycobacterium tuberculosis H37Rv
gcuguaauuccucgga

SEQ ID NO: 3311201 - RNA, 16 nt, Mycobacterium tuberculosis H37Rv
gcuguacccgaccagc

SEQ ID NO: 3311202 - RNA, 17 nt, Mycobacterium tuberculosis H37Rv
gcuguacccgaccagca

SEQ ID NO: 3311203 - RNA, 21 nt, Mycobacterium tuberculosis H37Rv
gcuguacccgaccagcaccag

SEQ ID NO: 3311204 - RNA, 15 nt, Mycobacterium tuberculosis H37Rv
gcuguacugcggugc

SEQ ID NO: 3311205 - RNA, 24 nt, Mycobacterium tuberculosis H37Rv
gcuguacuugggauugcgggccug

SEQ ID NO: 3311206 - RNA, 16 nt, Mycobacterium tuberculosis H37Rv
gcuguaggccagcccg

SEQ ID NO: 3311207 - RNA, 15 nt, Mycobacterium tuberculosis H37Rv
gcuguaggcgaucac

SEQ ID NO: 3311208 - RNA, 18 nt, Mycobacterium tuberculosis H37Rv
gcuguaggucagcgcguc

SEQ ID NO: 3311209 - RNA, 16 nt, Mycobacterium tuberculosis H37Rv
gcugucaagcgggcug

SEQ ID NO: 3311210 - RNA, 16 nt, Mycobacterium tuberculosis H37Rv
gcugucacgccugcca

SEQ ID NO: 3311211 - RNA, 22 nt, Mycobacterium tuberculosis H37Rv
gcugucacguagcgagcccacg

SEQ ID NO: 3311212 - RNA, 20 nt, Mycobacterium tuberculosis H37Rv
gcuguccaccgaggccugac

SEQ ID NO: 3311213 - RNA, 17 nt, Mycobacterium tuberculosis H37Rv
gcuguccaggucugggc

SEQ ID NO: 3311214 - RNA, 18 nt, Mycobacterium tuberculosis H37Rv
gcuguccgacuucuccag

SEQ ID NO: 3311215 - RNA, 18 nt, Mycobacterium tuberculosis H37Rv
gcuguccgcgggccgcgc

SEQ ID NO: 3311216 - RNA, 15 nt, Mycobacterium tuberculosis H37Rv
gcugucgaaguuggu

SEQ ID NO: 3311217 - RNA, 20 nt, Mycobacterium tuberculosis H37Rv
gcugucgaaguuggucacga

SEQ ID NO: 3311218 - RNA, 18 nt, Mycobacterium tuberculosis H37Rv
gcugucgaucagcgaccc

SEQ ID NO: 3311219 - RNA, 18 nt, Mycobacterium tuberculosis H37Rv
gcugucgcgggccaccac

SEQ ID NO: 3311220 - RNA, 14 nt, Mycobacterium tuberculosis H37Rv
gcugucggcuuccu

SEQ ID NO: 3311221 - RNA, 14 nt, Mycobacterium tuberculosis H37Rv
gcugucgggcagcu

SEQ ID NO: 3311222 - RNA, 12 nt, Mycobacterium tuberculosis H37Rv
gcugucggugcc

SEQ ID NO: 3311223 - RNA, 23 nt, Mycobacterium tuberculosis H37Rv
gcugucguuugacgagccgacca

SEQ ID NO: 3311224 - RNA, 16 nt, Mycobacterium tuberculosis H37Rv
gcugugaacaggccga

SEQ ID NO: 3311225 - RNA, 13 nt, Mycobacterium tuberculosis H37Rv
gcugugauagcgc

SEQ ID NO: 3311226 - RNA, 18 nt, Mycobacterium tuberculosis H37Rv
gcugugaucgagucgcga

SEQ ID NO: 3311227 - RNA, 18 nt, Mycobacterium tuberculosis H37Rv
gcugugcaggcgggaacg

SEQ ID NO: 3311228 - RNA, 13 nt, Mycobacterium tuberculosis H37Rv
gcugugccggcca

SEQ ID NO: 3311229 - RNA, 13 nt, Mycobacterium tuberculosis H37Rv
gcugugcucacga

SEQ ID NO: 3311230 - RNA, 23 nt, Mycobacterium tuberculosis H37Rv
gcugugcucacgagcaaaccaga

SEQ ID NO: 3311231 - RNA, 11 nt, Mycobacterium tuberculosis H37Rv
gcugugcucga

SEQ ID NO: 3311232 - RNA, 14 nt, Mycobacterium tuberculosis H37Rv
gcugugcucgacga

SEQ ID NO: 3311233 - RNA, 20 nt, Mycobacterium tuberculosis H37Rv
gcugugcuucguugucggcg

SEQ ID NO: 3311234 - RNA, 19 nt, Mycobacterium tuberculosis H37Rv
gcuguggccagcaucauca

SEQ ID NO: 3311235 - RNA, 19 nt, Mycobacterium tuberculosis H37Rv
gcuguggcccgucauacuc

SEQ ID NO: 3311236 - RNA, 20 nt, Mycobacterium tuberculosis H37Rv
gcuguggccgccguaacucu

SEQ ID NO: 3311237 - RNA, 17 nt, Mycobacterium tuberculosis H37Rv
gcuguggcgggagaucg

SEQ ID NO: 3311238 - RNA, 12 nt, Mycobacterium tuberculosis H37Rv
gcuguggcucga

SEQ ID NO: 3311239 - RNA, 15 nt, Mycobacterium tuberculosis H37Rv
gcuguggcucgacga

SEQ ID NO: 3311240 - RNA, 15 nt, Mycobacterium tuberculosis H37Rv
gcugugggauucggg

SEQ ID NO: 3311241 - RNA, 17 nt, Mycobacterium tuberculosis H37Rv
gcugugggcugagaugg

SEQ ID NO: 3311242 - RNA, 17 nt, Mycobacterium tuberculosis H37Rv
gcuguggucgcugcugc

SEQ ID NO: 3311243 - RNA, 16 nt, Mycobacterium tuberculosis H37Rv
gcuguggucggugcca

SEQ ID NO: 3311244 - RNA, 21 nt, Mycobacterium tuberculosis H37Rv
gcugugguggugaugggcaug

SEQ ID NO: 3311245 - RNA, 13 nt, Mycobacterium tuberculosis H37Rv
gcugugugggagc

SEQ ID NO: 3311246 - RNA, 15 nt, Mycobacterium tuberculosis H37Rv
gcuguugaagccgcc

SEQ ID NO: 3311247 - RNA, 18 nt, Mycobacterium tuberculosis H37Rv
gcuguugcaucgccgcga

SEQ ID NO: 3311248 - RNA, 19 nt, Mycobacterium tuberculosis H37Rv
gcuguuguugucgggauug

SEQ ID NO: 3311249 - RNA, 20 nt, Mycobacterium tuberculosis H37Rv
gcuguuugguugcgccagga

SEQ ID NO: 3311250 - RNA, 22 nt, Mycobacterium tuberculosis H37Rv
gcuuaacagcggguccuucugc

SEQ ID NO: 3311251 - RNA, 19 nt, Mycobacterium tuberculosis H37Rv
gcuuacuuaaccaggcgag

SEQ ID NO: 3311252 - RNA, 18 nt, Mycobacterium tuberculosis H37Rv
gcuuacuugaucucggcg

SEQ ID NO: 3311253 - RNA, 17 nt, Mycobacterium tuberculosis H37Rv
gcuuagaacgugcuggu

SEQ ID NO: 3311254 - RNA, 15 nt, Mycobacterium tuberculosis H37Rv
gcuuagcgcaugggc

SEQ ID NO: 3311255 - RNA, 18 nt, Mycobacterium tuberculosis H37Rv
gcuuagcgcgaaagcgcc

SEQ ID NO: 3311256 - RNA, 17 nt, Mycobacterium tuberculosis H37Rv
gcuuagcuuccggguuc

SEQ ID NO: 3311257 - RNA, 18 nt, Mycobacterium tuberculosis H37Rv
gcuuagggcgcccgcccc

SEQ ID NO: 3311258 - RNA, 20 nt, Mycobacterium tuberculosis H37Rv
gcuuaugcgucugcucgccg

SEQ ID NO: 3311259 - RNA, 20 nt, Mycobacterium tuberculosis H37Rv
gcuucaagauuaccgaagcc

SEQ ID NO: 3311260 - RNA, 22 nt, Mycobacterium tuberculosis H37Rv
gcuucaagauuaccgaagcccg

SEQ ID NO: 3311261 - RNA, 15 nt, Mycobacterium tuberculosis H37Rv
gcuucacagccacca

SEQ ID NO: 3311262 - RNA, 24 nt, Mycobacterium tuberculosis H37Rv
gcuucacagccaccagccgggcaa

SEQ ID NO: 3311263 - RNA, 15 nt, Mycobacterium tuberculosis H37Rv
gcuucaggaucggcg

SEQ ID NO: 3311264 - RNA, 16 nt, Mycobacterium tuberculosis H37Rv
gcuucaggaucggcga

SEQ ID NO: 3311265 - RNA, 18 nt, Mycobacterium tuberculosis H37Rv
gcuucaggcgccacugcu

SEQ ID NO: 3311266 - RNA, 17 nt, Mycobacterium tuberculosis H37Rv
gcuuccaacucggcggc

SEQ ID NO: 3311267 - RNA, 21 nt, Mycobacterium tuberculosis H37Rv
gcuuccaacucggcggccagc

SEQ ID NO: 3311268 - RNA, 14 nt, Mycobacterium tuberculosis H37Rv
gcuuccacgccgga

SEQ ID NO: 3311269 - RNA, 17 nt, Mycobacterium tuberculosis H37Rv
gcuuccaucgccacugu

SEQ ID NO: 3311270 - RNA, 14 nt, Mycobacterium tuberculosis H37Rv
gcuucccccggucc

SEQ ID NO: 3311271 - RNA, 16 nt, Mycobacterium tuberculosis H37Rv
gcuucccggaagcgcc

SEQ ID NO: 3311272 - RNA, 21 nt, Mycobacterium tuberculosis H37Rv
gcuucccggaagcgccggccc

SEQ ID NO: 3311273 - RNA, 18 nt, Mycobacterium tuberculosis H37Rv
gcuuccggaacaaaggcu

SEQ ID NO: 3311274 - RNA, 15 nt, Mycobacterium tuberculosis H37Rv
gcuugucagccgcga

SEQ ID NO: 3311275 - RNA, 19 nt, Mycobacterium tuberculosis H37Rv
gcuugucgaccacgaccgu

SEQ ID NO: 3311276 - RNA, 14 nt, Mycobacterium tuberculosis H37Rv
gcuugucgagcagg

SEQ ID NO: 3311277 - RNA, 18 nt, Mycobacterium tuberculosis H37Rv
gcuugucgguagguguca

SEQ ID NO: 3311278 - RNA, 14 nt, Mycobacterium tuberculosis H37Rv
gcuugugcccaaua

SEQ ID NO: 3311279 - RNA, 21 nt, Mycobacterium tuberculosis H37Rv
gcuuguuuuccaccagcgagc

SEQ ID NO: 3311280 - RNA, 20 nt, Mycobacterium tuberculosis H37Rv
gcuuuaaccgcgucaucacc

SEQ ID NO: 3311281 - RNA, 19 nt, Mycobacterium tuberculosis H37Rv
gcuuuagugucugcucgcg

SEQ ID NO: 3311282 - RNA, 21 nt, Mycobacterium tuberculosis H37Rv
gcuuuccgccgcaccggauca

SEQ ID NO: 3311283 - RNA, 19 nt, Mycobacterium tuberculosis H37Rv
gcuuuccucaccagccguc

SEQ ID NO: 3311284 - RNA, 19 nt, Mycobacterium tuberculosis H37Rv
gcuuucgauauagccgccg

SEQ ID NO: 3311285 - RNA, 22 nt, Mycobacterium tuberculosis H37Rv
gcuuucgauauagccgccggug

SEQ ID NO: 3311286 - RNA, 20 nt, Mycobacterium tuberculosis H37Rv
gcuuucgcgugcggcugcca

SEQ ID NO: 3311287 - RNA, 19 nt, Mycobacterium tuberculosis H37Rv
gcuuucugcacccgccagg

SEQ ID NO: 3311288 - RNA, 20 nt, Mycobacterium tuberculosis H37Rv
gcuuucuuggcgggcgccuu

SEQ ID NO: 3311289 - RNA, 21 nt, Mycobacterium tuberculosis H37Rv
gcuuugagucccgguagacca

SEQ ID NO: 3311290 - RNA, 15 nt, Mycobacterium tuberculosis H37Rv
gcuuugcacagcggc

SEQ ID NO: 3311291 - RNA, 19 nt, Mycobacterium tuberculosis H37Rv
gcuuugcacagcggcaucg

SEQ ID NO: 3311292 - RNA, 14 nt, Mycobacterium tuberculosis H37Rv
gcuuugccaacaaa

SEQ ID NO: 3311293 - RNA, 15 nt, Mycobacterium tuberculosis H37Rv
gcuuuggccgccgug

SEQ ID NO: 3311294 - RNA, 14 nt, Mycobacterium tuberculosis H37Rv
gcuuugggcugccg

SEQ ID NO: 3311295 - RNA, 16 nt, Mycobacterium tuberculosis H37Rv
gcuuugguuagaggau

SEQ ID NO: 3311296 - RNA, 20 nt, Mycobacterium tuberculosis H37Rv
gcuuuugcgucugcucgcca

SEQ ID NO: 3311297 - RNA, 21 nt, Mycobacterium tuberculosis H37Rv
gcuuuugcgucugcucgcgca

SEQ ID NO: 3311298 - RNA, 15 nt, Mycobacterium tuberculosis H37Rv
ggaaaaagcccgaca

SEQ ID NO: 3311299 - RNA, 19 nt, Mycobacterium tuberculosis H37Rv
ggaaaaauuucuucgccga

SEQ ID NO: 3311300 - RNA, 16 nt, Mycobacterium tuberculosis H37Rv
ggaaaaccccggccac

SEQ ID NO: 3311301 - RNA, 21 nt, Mycobacterium tuberculosis H37Rv
ggaaaacugaguugagcgcca

SEQ ID NO: 3311302 - RNA, 16 nt, Mycobacterium tuberculosis H37Rv
ggaaaagaacccggga

SEQ ID NO: 3311303 - RNA, 17 nt, Mycobacterium tuberculosis H37Rv
ggaaacagcgaucgccg

SEQ ID NO: 3311304 - RNA, 16 nt, Mycobacterium tuberculosis H37Rv
ggaaaccacagcgcca

SEQ ID NO: 3311305 - RNA, 14 nt, Mycobacterium tuberculosis H37Rv
ggaaaccaucgcca

SEQ ID NO: 3311306 - RNA, 16 nt, Mycobacterium tuberculosis H37Rv
ggaaacccggccagcu

SEQ ID NO: 3311307 - RNA, 19 nt, Mycobacterium tuberculosis H37Rv
ggaaacccggccgccgaga

SEQ ID NO: 3311308 - RNA, 14 nt, Mycobacterium tuberculosis H37Rv
ggaaacccugcacc

SEQ ID NO: 3311309 - RNA, 22 nt, Mycobacterium tuberculosis H37Rv
ggaaaccgccccgugggccucg

SEQ ID NO: 3311310 - RNA, 23 nt, Mycobacterium tuberculosis H37Rv
ggaaaccucuucgggugcagcca

SEQ ID NO: 3311311 - RNA, 17 nt, Mycobacterium tuberculosis H37Rv
ggaaacggagccgagcc

SEQ ID NO: 3311312 - RNA, 20 nt, Mycobacterium tuberculosis H37Rv
ggaaacuccgcggcgcgcaa

SEQ ID NO: 3311313 - RNA, 11 nt, Mycobacterium tuberculosis H37Rv
ggaaagcucuc

SEQ ID NO: 3311314 - RNA, 20 nt, Mycobacterium tuberculosis H37Rv
ggaaaggcuuccgcgugcga

SEQ ID NO: 3311315 - RNA, 22 nt, Mycobacterium tuberculosis H37Rv
ggaaauacuuuggaugcccgua

SEQ ID NO: 3311316 - RNA, 13 nt, Mycobacterium tuberculosis H37Rv
ggaaaugucuccu

SEQ ID NO: 3311317 - RNA, 21 nt, Mycobacterium tuberculosis H37Rv
ggaacaacggcguaaucggga

SEQ ID NO: 3311318 - RNA, 18 nt, Mycobacterium tuberculosis H37Rv
ggaacaaugagaucggga

SEQ ID NO: 3311319 - RNA, 15 nt, Mycobacterium tuberculosis H37Rv
ggaacaccaccaggc

SEQ ID NO: 3311320 - RNA, 21 nt, Mycobacterium tuberculosis H37Rv
ggaacaccaccaggcugucgu

SEQ ID NO: 3311321 - RNA, 14 nt, Mycobacterium tuberculosis H37Rv
ggaacaccgaggcg

SEQ ID NO: 3311322 - RNA, 16 nt, Mycobacterium tuberculosis H37Rv
ggaacaccgcccggcc

SEQ ID NO: 3311323 - RNA, 21 nt, Mycobacterium tuberculosis H37Rv
ggaacaccgcccggcccggcu

SEQ ID NO: 3311324 - RNA, 15 nt, Mycobacterium tuberculosis H37Rv
ggaacacgaugccca

SEQ ID NO: 3311325 - RNA, 19 nt, Mycobacterium tuberculosis H37Rv
ggaaccaccaguaccaccg

SEQ ID NO: 3311326 - RNA, 20 nt, Mycobacterium tuberculosis H37Rv
ggaaccauugcccgacgaug

SEQ ID NO: 3311327 - RNA, 14 nt, Mycobacterium tuberculosis H37Rv
ggaacccagcacug

SEQ ID NO: 3311328 - RNA, 16 nt, Mycobacterium tuberculosis H37Rv
ggaacccagcacuggg

SEQ ID NO: 3311329 - RNA, 23 nt, Mycobacterium tuberculosis H37Rv
ggaaccccccauagcaagaaccg

SEQ ID NO: 3311330 - RNA, 17 nt, Mycobacterium tuberculosis H37Rv
ggaaccccgagcugcca

SEQ ID NO: 3311331 - RNA, 13 nt, Mycobacterium tuberculosis H37Rv
ggaaccgaucggu

SEQ ID NO: 3311332 - RNA, 14 nt, Mycobacterium tuberculosis H37Rv
ggaaccgcucguca

SEQ ID NO: 3311333 - RNA, 16 nt, Mycobacterium tuberculosis H37Rv
ggaaccgggcaaauca

SEQ ID NO: 3311334 - RNA, 18 nt, Mycobacterium tuberculosis H37Rv
ggaaccgggcaaaucaag

SEQ ID NO: 3311335 - RNA, 16 nt, Mycobacterium tuberculosis H37Rv
ggaaccgguaucgcca

SEQ ID NO: 3311336 - RNA, 17 nt, Mycobacterium tuberculosis H37Rv
ggaaccgguaucgccaa

SEQ ID NO: 3311337 - RNA, 19 nt, Mycobacterium tuberculosis H37Rv
ggaaccguccaagccggcu

SEQ ID NO: 3311338 - RNA, 20 nt, Mycobacterium tuberculosis H37Rv
ggaaccuugaccgaccagcu

SEQ ID NO: 3311339 - RNA, 21 nt, Mycobacterium tuberculosis H37Rv
ggaaccuugaccgaccagcug

SEQ ID NO: 3311340 - RNA, 17 nt, Mycobacterium tuberculosis H37Rv
ggaacgagccacgccag

SEQ ID NO: 3311341 - RNA, 17 nt, Mycobacterium tuberculosis H37Rv
ggaacgaucgaugaccu

SEQ ID NO: 3311342 - RNA, 18 nt, Mycobacterium tuberculosis H37Rv
ggaacgaugccggcaagc

SEQ ID NO: 3311343 - RNA, 13 nt, Mycobacterium tuberculosis H37Rv
ggaacgccgagca

SEQ ID NO: 3311344 - RNA, 12 nt, Mycobacterium tuberculosis H37Rv
ggaacgccggca

SEQ ID NO: 3311345 - RNA, 14 nt, Mycobacterium tuberculosis H37Rv
ggaacgccucaggg

SEQ ID NO: 3311346 - RNA, 18 nt, Mycobacterium tuberculosis H37Rv
ggaacgcgucgccgacgc

SEQ ID NO: 3311347 - RNA, 21 nt, Mycobacterium tuberculosis H37Rv
ggaacgcuaggcgauccagac

SEQ ID NO: 3311348 - RNA, 13 nt, Mycobacterium tuberculosis H37Rv
ggaacggccagga

SEQ ID NO: 3311349 - RNA, 17 nt, Mycobacterium tuberculosis H37Rv
ggaacggugcacagcag

SEQ ID NO: 3311350 - RNA, 19 nt, Mycobacterium tuberculosis H37Rv
ggaacguccagccguggcg

SEQ ID NO: 3311351 - RNA, 17 nt, Mycobacterium tuberculosis H37Rv
ggaacguuucgcugucc

SEQ ID NO: 3311352 - RNA, 21 nt, Mycobacterium tuberculosis H37Rv
ggaacuacccgccagcaaacc

SEQ ID NO: 3311353 - RNA, 16 nt, Mycobacterium tuberculosis H37Rv
ggaacuccggguggcg

SEQ ID NO: 3311354 - RNA, 17 nt, Mycobacterium tuberculosis H37Rv
ggaacugaccacgucgg

SEQ ID NO: 3311355 - RNA, 23 nt, Mycobacterium tuberculosis H37Rv
ggaacugaccacgucggacagcu

SEQ ID NO: 3311356 - RNA, 19 nt, Mycobacterium tuberculosis H37Rv
ggaacugaugaaccacggc

SEQ ID NO: 3311357 - RNA, 21 nt, Mycobacterium tuberculosis H37Rv
ggaacuggaccggugccagca

SEQ ID NO: 3311358 - RNA, 17 nt, Mycobacterium tuberculosis H37Rv
ggaacuugugccgggcg

SEQ ID NO: 3311359 - RNA, 20 nt, Mycobacterium tuberculosis H37Rv
ggaacuuguugacgaaccca

SEQ ID NO: 3311360 - RNA, 20 nt, Mycobacterium tuberculosis H37Rv
ggaagaccggaucgccuugg

SEQ ID NO: 3311361 - RNA, 14 nt, Mycobacterium tuberculosis H37Rv
ggaagaucacgcgu

SEQ ID NO: 3311362 - RNA, 23 nt, Mycobacterium tuberculosis H37Rv
ggaagaucacgcgucgugccacu

SEQ ID NO: 3311363 - RNA, 21 nt, Mycobacterium tuberculosis H37Rv
ggaagcccggcagaugcagcg

SEQ ID NO: 3311364 - RNA, 15 nt, Mycobacterium tuberculosis H37Rv
ggaagccgaccaccg

SEQ ID NO: 3311365 - RNA, 23 nt, Mycobacterium tuberculosis H37Rv
ggaagccgaccuucucggcguac

SEQ ID NO: 3311366 - RNA, 17 nt, Mycobacterium tuberculosis H37Rv
ggaagccgacgaccagc

SEQ ID NO: 3311367 - RNA, 17 nt, Mycobacterium tuberculosis H37Rv
ggaagccgcaccgcugu

SEQ ID NO: 3311368 - RNA, 17 nt, Mycobacterium tuberculosis H37Rv
ggaagccugcgggccgg

SEQ ID NO: 3311369 - RNA, 16 nt, Mycobacterium tuberculosis H37Rv
ggaagcgccggccgau

SEQ ID NO: 3311370 - RNA, 17 nt, Mycobacterium tuberculosis H37Rv
ggaccaacgccaacgcc

SEQ ID NO: 3311371 - RNA, 16 nt, Mycobacterium tuberculosis H37Rv
ggaccacagccgcgcc

SEQ ID NO: 3311372 - RNA, 19 nt, Mycobacterium tuberculosis H37Rv
ggaccacagccgcgccgac

SEQ ID NO: 3311373 - RNA, 21 nt, Mycobacterium tuberculosis H37Rv
ggaccaccacuaggucgccgg

SEQ ID NO: 3311374 - RNA, 17 nt, Mycobacterium tuberculosis H37Rv
ggaccaccgcucgccac

SEQ ID NO: 3311375 - RNA, 24 nt, Mycobacterium tuberculosis H37Rv
ggaccaccgggccgacagcacgcc

SEQ ID NO: 3311376 - RNA, 13 nt, Mycobacterium tuberculosis H37Rv
ggaccacgccgac

SEQ ID NO: 3311377 - RNA, 12 nt, Mycobacterium tuberculosis H37Rv
ggaccacggcgu

SEQ ID NO: 3311378 - RNA, 20 nt, Mycobacterium tuberculosis H37Rv
ggaccacgugaucgacgacc

SEQ ID NO: 3311379 - RNA, 23 nt, Mycobacterium tuberculosis H37Rv
ggaccacuaguucgagcugccag

SEQ ID NO: 3311380 - RNA, 21 nt, Mycobacterium tuberculosis H37Rv
ggaccagaggcgcuucgccac

SEQ ID NO: 3311381 - RNA, 16 nt, Mycobacterium tuberculosis H37Rv
ggaccagauacgucgu

SEQ ID NO: 3311382 - RNA, 18 nt, Mycobacterium tuberculosis H37Rv
ggaccagcugccggcgac

SEQ ID NO: 3311383 - RNA, 22 nt, Mycobacterium tuberculosis H37Rv
ggaccagugcgguggcagguga

SEQ ID NO: 3311384 - RNA, 17 nt, Mycobacterium tuberculosis H37Rv
ggaccauagccugcgcc

SEQ ID NO: 3311385 - RNA, 20 nt, Mycobacterium tuberculosis H37Rv
ggaccauagccugcgccgac

SEQ ID NO: 3311386 - RNA, 16 nt, Mycobacterium tuberculosis H37Rv
ggaccauagucgccgu

SEQ ID NO: 3311387 - RNA, 17 nt, Mycobacterium tuberculosis H37Rv
ggaccaucccgccgauc

SEQ ID NO: 3311388 - RNA, 22 nt, Mycobacterium tuberculosis H37Rv
ggaccaucccgccgaucacugu

SEQ ID NO: 3311389 - RNA, 19 nt, Mycobacterium tuberculosis H37Rv
ggacccaccgucacccccg

SEQ ID NO: 3311390 - RNA, 12 nt, Mycobacterium tuberculosis H37Rv
ggacccagcacc

SEQ ID NO: 3311391 - RNA, 13 nt, Mycobacterium tuberculosis H37Rv
ggacccgcagcug

SEQ ID NO: 3311392 - RNA, 20 nt, Mycobacterium tuberculosis H37Rv
ggacccgcccuugccgccga

SEQ ID NO: 3311393 - RNA, 19 nt, Mycobacterium tuberculosis H37Rv
ggacccgcgcgucgcccag

SEQ ID NO: 3311394 - RNA, 11 nt, Mycobacterium tuberculosis H37Rv
ggacccgcggg

SEQ ID NO: 3311395 - RNA, 18 nt, Mycobacterium tuberculosis H37Rv
ggacccgcuacgacgguc

SEQ ID NO: 3311396 - RNA, 16 nt, Mycobacterium tuberculosis H37Rv
ggacccgugcacgauc

SEQ ID NO: 3311397 - RNA, 19 nt, Mycobacterium tuberculosis H37Rv
ggacccuaacucccccgcu

SEQ ID NO: 3311398 - RNA, 21 nt, Mycobacterium tuberculosis H37Rv
ggaccgaucuuggccaccgcc

SEQ ID NO: 3311399 - RNA, 15 nt, Mycobacterium tuberculosis H37Rv
ggaccgaugacgauc

SEQ ID NO: 3311400 - RNA, 22 nt, Mycobacterium tuberculosis H37Rv
ggaccgaugacgaucggcggcg

SEQ ID NO: 3311401 - RNA, 17 nt, Mycobacterium tuberculosis H37Rv
ggaccgauuucgccugc

SEQ ID NO: 3311402 - RNA, 20 nt, Mycobacterium tuberculosis H37Rv
ggaccgauuucgccugcggc

SEQ ID NO: 3311403 - RNA, 22 nt, Mycobacterium tuberculosis H37Rv
ggaccgcagcgacgggaaagcc

SEQ ID NO: 3311404 - RNA, 14 nt, Mycobacterium tuberculosis H37Rv
ggaccgcagcguga

SEQ ID NO: 3311405 - RNA, 23 nt, Mycobacterium tuberculosis H37Rv
ggaccgcagcgugaucuggccac

SEQ ID NO: 3311406 - RNA, 18 nt, Mycobacterium tuberculosis H37Rv
ggaccgccgccgacaauc

SEQ ID NO: 3311407 - RNA, 21 nt, Mycobacterium tuberculosis H37Rv
ggaccgcgacggcgccggcau

SEQ ID NO: 3311408 - RNA, 17 nt, Mycobacterium tuberculosis H37Rv
ggaccgcggucauggcg

SEQ ID NO: 3311409 - RNA, 17 nt, Mycobacterium tuberculosis H37Rv
ggaccgcucgucgccgg

SEQ ID NO: 3311410 - RNA, 15 nt, Mycobacterium tuberculosis H37Rv
ggaccgggaucguca

SEQ ID NO: 3311411 - RNA, 15 nt, Mycobacterium tuberculosis H37Rv
ggaccggucgacagc

SEQ ID NO: 3311412 - RNA, 16 nt, Mycobacterium tuberculosis H37Rv
ggaccgucgccgguga

SEQ ID NO: 3311413 - RNA, 14 nt, Mycobacterium tuberculosis H37Rv
ggaccgucguggcg

SEQ ID NO: 3311414 - RNA, 19 nt, Mycobacterium tuberculosis H37Rv
ggaccgucuuuggugccga

SEQ ID NO: 3311415 - RNA, 22 nt, Mycobacterium tuberculosis H37Rv
ggaccgucuuuggugccgagca

SEQ ID NO: 3311416 - RNA, 19 nt, Mycobacterium tuberculosis H37Rv
ggaccgugacguaucgccg

SEQ ID NO: 3311417 - RNA, 14 nt, Mycobacterium tuberculosis H37Rv
ggaccguggcagcu

SEQ ID NO: 3311418 - RNA, 19 nt, Mycobacterium tuberculosis H37Rv
ggaccguuaccggacccgc

SEQ ID NO: 3311419 - RNA, 13 nt, Mycobacterium tuberculosis H37Rv
ggaccucgcccau

SEQ ID NO: 3311420 - RNA, 20 nt, Mycobacterium tuberculosis H37Rv
ggaccucggcgaccugcucg

SEQ ID NO: 3311421 - RNA, 14 nt, Mycobacterium tuberculosis H37Rv
ggaccucggcgauc

SEQ ID NO: 3311422 - RNA, 15 nt, Mycobacterium tuberculosis H37Rv
ggaccuggcggcggu

SEQ ID NO: 3311423 - RNA, 20 nt, Mycobacterium tuberculosis H37Rv
ggaccuucugucccugcagu

SEQ ID NO: 3311424 - RNA, 22 nt, Mycobacterium tuberculosis H37Rv
ggaccuuggcgaccaugcuccu

SEQ ID NO: 3311425 - RNA, 18 nt, Mycobacterium tuberculosis H37Rv
ggacgaaaaaaucgugcg

SEQ ID NO: 3311426 - RNA, 23 nt, Mycobacterium tuberculosis H37Rv
ggacgaacaacgcgacgaagcag

SEQ ID NO: 3311427 - RNA, 14 nt, Mycobacterium tuberculosis H37Rv
ggacgaaucccgcg

SEQ ID NO: 3311428 - RNA, 20 nt, Mycobacterium tuberculosis H37Rv
ggacgacaacaggccgucga

SEQ ID NO: 3311429 - RNA, 12 nt, Mycobacterium tuberculosis H37Rv
ggacgacaccgc

SEQ ID NO: 3311430 - RNA, 16 nt, Mycobacterium tuberculosis H37Rv
ggacgacgaucaagcc

SEQ ID NO: 3311431 - RNA, 17 nt, Mycobacterium tuberculosis H37Rv
ggacgacgaucaagccu

SEQ ID NO: 3311432 - RNA, 15 nt, Mycobacterium tuberculosis H37Rv
ggacgacgccgacga

SEQ ID NO: 3311433 - RNA, 20 nt, Mycobacterium tuberculosis H37Rv
ggacgacgccgacgaugacg

SEQ ID NO: 3311434 - RNA, 20 nt, Mycobacterium tuberculosis H37Rv
ggacgaggucauaucgacgg

SEQ ID NO: 3311435 - RNA, 16 nt, Mycobacterium tuberculosis H37Rv
ggacgauaccgggcua

SEQ ID NO: 3311436 - RNA, 13 nt, Mycobacterium tuberculosis H37Rv
ggacgaucagggu

SEQ ID NO: 3311437 - RNA, 21 nt, Mycobacterium tuberculosis H37Rv
ggacgaugaugaucaccguca

SEQ ID NO: 3311438 - RNA, 22 nt, Mycobacterium tuberculosis H37Rv
ggacgauggcaagggccgacgu

SEQ ID NO: 3311439 - RNA, 16 nt, Mycobacterium tuberculosis H37Rv
ggacgcaacucgacgc

SEQ ID NO: 3311440 - RNA, 12 nt, Mycobacterium tuberculosis H37Rv
ggacgccacgga

SEQ ID NO: 3311441 - RNA, 17 nt, Mycobacterium tuberculosis H37Rv
ggacgccgcgccgcaga

SEQ ID NO: 3311442 - RNA, 19 nt, Mycobacterium tuberculosis H37Rv
ggacgccuugaucggcgag

SEQ ID NO: 3311443 - RNA, 15 nt, Mycobacterium tuberculosis H37Rv
ggacgccuugcacaa

SEQ ID NO: 3311444 - RNA, 21 nt, Mycobacterium tuberculosis H37Rv
ggacgccuugcacaagcugaa

SEQ ID NO: 3311445 - RNA, 17 nt, Mycobacterium tuberculosis H37Rv
ggacgcgaaauccccug

SEQ ID NO: 3311446 - RNA, 20 nt, Mycobacterium tuberculosis H37Rv
ggacgcgaaauccccugcgc

SEQ ID NO: 3311447 - RNA, 18 nt, Mycobacterium tuberculosis H37Rv
ggacgcgacucggcgguc

SEQ ID NO: 3311448 - RNA, 16 nt, Mycobacterium tuberculosis H37Rv
ggacgcgaucggcguc

SEQ ID NO: 3311449 - RNA, 21 nt, Mycobacterium tuberculosis H37Rv
ggacgcgcggauuucgccgug

SEQ ID NO: 3311450 - RNA, 14 nt, Mycobacterium tuberculosis H37Rv
ggacgcgguuuugu

SEQ ID NO: 3311451 - RNA, 12 nt, Mycobacterium tuberculosis H37Rv
ggacgcuccggg

SEQ ID NO: 3311452 - RNA, 15 nt, Mycobacterium tuberculosis H37Rv
ggacgcugccgguca

SEQ ID NO: 3311453 - RNA, 17 nt, Mycobacterium tuberculosis H37Rv
ggacgcuuggguagccu

SEQ ID NO: 3311454 - RNA, 21 nt, Mycobacterium tuberculosis H37Rv
ggacggagcccaaaaccgcga

SEQ ID NO: 3311455 - RNA, 21 nt, Mycobacterium tuberculosis H37Rv
ggacggcagccaccagcgacg

SEQ ID NO: 3311456 - RNA, 23 nt, Mycobacterium tuberculosis H37Rv
ggacggcauagcagccagcgucc

SEQ ID NO: 3311457 - RNA, 21 nt, Mycobacterium tuberculosis H37Rv
ggacggccaacagggcgccga

SEQ ID NO: 3311458 - RNA, 16 nt, Mycobacterium tuberculosis H37Rv
ggacggcguagacguc

SEQ ID NO: 3311459 - RNA, 20 nt, Mycobacterium tuberculosis H37Rv
ggacggcguugagcaggugc

SEQ ID NO: 3311460 - RNA, 20 nt, Mycobacterium tuberculosis H37Rv
ggacggcugccgucagccgu

SEQ ID NO: 3311461 - RNA, 20 nt, Mycobacterium tuberculosis H37Rv
ggacgggaugcuuggucucg

SEQ ID NO: 3311462 - RNA, 17 nt, Mycobacterium tuberculosis H37Rv
ggacgggcgcgucggcg

SEQ ID NO: 3311463 - RNA, 14 nt, Mycobacterium tuberculosis H37Rv
ggacgggucgccgc

SEQ ID NO: 3311464 - RNA, 16 nt, Mycobacterium tuberculosis H37Rv
ggacgggucucgcgag

SEQ ID NO: 3311465 - RNA, 12 nt, Mycobacterium tuberculosis H37Rv
ggacggucgcca

SEQ ID NO: 3311466 - RNA, 18 nt, Mycobacterium tuberculosis H37Rv
ggagcggguggccgggau

SEQ ID NO: 3311467 - RNA, 13 nt, Mycobacterium tuberculosis H37Rv
ggagcgugggcgu

SEQ ID NO: 3311468 - RNA, 18 nt, Mycobacterium tuberculosis H37Rv
ggagcucacgugcugccg

SEQ ID NO: 3311469 - RNA, 20 nt, Mycobacterium tuberculosis H37Rv
ggagcucacgugcugccgau

SEQ ID NO: 3311470 - RNA, 16 nt, Mycobacterium tuberculosis H37Rv
ggagcucuugcgggca

SEQ ID NO: 3311471 - RNA, 22 nt, Mycobacterium tuberculosis H37Rv
ggagcucuugcgggcagccgcc

SEQ ID NO: 3311472 - RNA, 14 nt, Mycobacterium tuberculosis H37Rv
ggagcugccgggag

SEQ ID NO: 3311473 - RNA, 23 nt, Mycobacterium tuberculosis H37Rv
ggagcugccgggagggguucacc

SEQ ID NO: 3311474 - RNA, 15 nt, Mycobacterium tuberculosis H37Rv
ggagcuggcugacga

SEQ ID NO: 3311475 - RNA, 15 nt, Mycobacterium tuberculosis H37Rv
ggaggaaccccgcgc

SEQ ID NO: 3311476 - RNA, 14 nt, Mycobacterium tuberculosis H37Rv
ggaggcaagcaacc

SEQ ID NO: 3311477 - RNA, 22 nt, Mycobacterium tuberculosis H37Rv
ggaggcaagcaaccggugcgca

SEQ ID NO: 3311478 - RNA, 19 nt, Mycobacterium tuberculosis H37Rv
ggaggccaacccugcggcg

SEQ ID NO: 3311479 - RNA, 20 nt, Mycobacterium tuberculosis H37Rv
ggaggccaacccugcggcgu

SEQ ID NO: 3311480 - RNA, 14 nt, Mycobacterium tuberculosis H37Rv
ggaggccgccgcgc

SEQ ID NO: 3311481 - RNA, 20 nt, Mycobacterium tuberculosis H37Rv
ggaggcggaccaggccgcgc

SEQ ID NO: 3311482 - RNA, 22 nt, Mycobacterium tuberculosis H37Rv
ggaggcuaggcguuugguguga

SEQ ID NO: 3311483 - RNA, 20 nt, Mycobacterium tuberculosis H37Rv
ggaggcuucgaggaacacga

SEQ ID NO: 3311484 - RNA, 17 nt, Mycobacterium tuberculosis H37Rv
ggagggccgcgaucgac

SEQ ID NO: 3311485 - RNA, 23 nt, Mycobacterium tuberculosis H37Rv
ggaggguucgccgaagccggacc

SEQ ID NO: 3311486 - RNA, 21 nt, Mycobacterium tuberculosis H37Rv
ggagguacccccagcacccgg

SEQ ID NO: 3311487 - RNA, 21 nt, Mycobacterium tuberculosis H37Rv
ggaggucaaaaucagggugcc

SEQ ID NO: 3311488 - RNA, 20 nt, Mycobacterium tuberculosis H37Rv
ggaggugaaccccgccggca

SEQ ID NO: 3311489 - RNA, 14 nt, Mycobacterium tuberculosis H37Rv
ggagguggcgcggg

SEQ ID NO: 3311490 - RNA, 15 nt, Mycobacterium tuberculosis H37Rv
ggaguagccgcagcu

SEQ ID NO: 3311491 - RNA, 21 nt, Mycobacterium tuberculosis H37Rv
ggaguagccgcagcugagccg

SEQ ID NO: 3311492 - RNA, 17 nt, Mycobacterium tuberculosis H37Rv
ggagucaagcagcagca

SEQ ID NO: 3311493 - RNA, 15 nt, Mycobacterium tuberculosis H37Rv
ggagucgaacaucac

SEQ ID NO: 3311494 - RNA, 14 nt, Mycobacterium tuberculosis H37Rv
ggagucgacgacgu

SEQ ID NO: 3311495 - RNA, 17 nt, Mycobacterium tuberculosis H37Rv
ggagucgacggugccgu

SEQ ID NO: 3311496 - RNA, 19 nt, Mycobacterium tuberculosis H37Rv
ggagucgacggugccgucg

SEQ ID NO: 3311497 - RNA, 20 nt, Mycobacterium tuberculosis H37Rv
ggagucgacggugccgucgg

SEQ ID NO: 3311498 - RNA, 16 nt, Mycobacterium tuberculosis H37Rv
ggagucgacgguuugc

SEQ ID NO: 3311499 - RNA, 15 nt, Mycobacterium tuberculosis H37Rv
ggagucgucgagcug

SEQ ID NO: 3311500 - RNA, 22 nt, Mycobacterium tuberculosis H37Rv
ggagucgucgagcugaccacgg

SEQ ID NO: 3311501 - RNA, 20 nt, Mycobacterium tuberculosis H37Rv
ggagucgucggcaugggccg

SEQ ID NO: 3311502 - RNA, 24 nt, Mycobacterium tuberculosis H37Rv
ggagucgucguguuggccgggucg

SEQ ID NO: 3311503 - RNA, 22 nt, Mycobacterium tuberculosis H37Rv
ggagucuucaacgucgagaucc

SEQ ID NO: 3311504 - RNA, 21 nt, Mycobacterium tuberculosis H37Rv
ggagucuucggcgacaggccg

SEQ ID NO: 3311505 - RNA, 22 nt, Mycobacterium tuberculosis H37Rv
ggagucuucgucgucggaaucg

SEQ ID NO: 3311506 - RNA, 17 nt, Mycobacterium tuberculosis H37Rv
ggagugaggcugugccc

SEQ ID NO: 3311507 - RNA, 22 nt, Mycobacterium tuberculosis H37Rv
ggagugcgccggcuggcggccu

SEQ ID NO: 3311508 - RNA, 12 nt, Mycobacterium tuberculosis H37Rv
ggaguggccggg

SEQ ID NO: 3311509 - RNA, 16 nt, Mycobacterium tuberculosis H37Rv
ggaguucuuguagccg

SEQ ID NO: 3311510 - RNA, 13 nt, Mycobacterium tuberculosis H37Rv
ggaguugaagaag

SEQ ID NO: 3311511 - RNA, 15 nt, Mycobacterium tuberculosis H37Rv
ggaguugaagaagcc

SEQ ID NO: 3311512 - RNA, 18 nt, Mycobacterium tuberculosis H37Rv
ggaguugaagaagcccga

SEQ ID NO: 3311513 - RNA, 20 nt, Mycobacterium tuberculosis H37Rv
ggaguugagcugucgcaacg

SEQ ID NO: 3311514 - RNA, 17 nt, Mycobacterium tuberculosis H37Rv
ggaguuuccgaagcccg

SEQ ID NO: 3311515 - RNA, 19 nt, Mycobacterium tuberculosis H37Rv
ggaguuuuucgggguggcg

SEQ ID NO: 3311516 - RNA, 12 nt, Mycobacterium tuberculosis H37Rv
ggauaacccagc

SEQ ID NO: 3311517 - RNA, 19 nt, Mycobacterium tuberculosis H37Rv
ggauaacccagcaccacaa

SEQ ID NO: 3311518 - RNA, 14 nt, Mycobacterium tuberculosis H37Rv
ggauacccagcgcc

SEQ ID NO: 3311519 - RNA, 15 nt, Mycobacterium tuberculosis H37Rv
ggauacccagcgccc

SEQ ID NO: 3311520 - RNA, 21 nt, Mycobacterium tuberculosis H37Rv
ggauacccagcgcccggccac

SEQ ID NO: 3311521 - RNA, 22 nt, Mycobacterium tuberculosis H37Rv
ggauacccagcgcccggccacu

SEQ ID NO: 3311522 - RNA, 23 nt, Mycobacterium tuberculosis H37Rv
ggauacccuuugcacgguggcaa

SEQ ID NO: 3311523 - RNA, 20 nt, Mycobacterium tuberculosis H37Rv
ggauaccgcugggucgccgu

SEQ ID NO: 3311524 - RNA, 13 nt, Mycobacterium tuberculosis H37Rv
ggauaccggucag

SEQ ID NO: 3311525 - RNA, 20 nt, Mycobacterium tuberculosis H37Rv
ggauaccgucaugggcggcu

SEQ ID NO: 3311526 - RNA, 22 nt, Mycobacterium tuberculosis H37Rv
ggauacgggcugacgaucucca

SEQ ID NO: 3311527 - RNA, 16 nt, Mycobacterium tuberculosis H37Rv
ggauacggugcgacga

SEQ ID NO: 3311528 - RNA, 22 nt, Mycobacterium tuberculosis H37Rv
ggauacuguucugcuggcugug

SEQ ID NO: 3311529 - RNA, 14 nt, Mycobacterium tuberculosis H37Rv
ggauagacggcgac

SEQ ID NO: 3311530 - RNA, 17 nt, Mycobacterium tuberculosis H37Rv
ggauagcgcagcucgcu

SEQ ID NO: 3311531 - RNA, 18 nt, Mycobacterium tuberculosis H37Rv
ggauagcgucgucccagc

SEQ ID NO: 3311532 - RNA, 17 nt, Mycobacterium tuberculosis H37Rv
ggauaguucaccacaug

SEQ ID NO: 3311533 - RNA, 18 nt, Mycobacterium tuberculosis H37Rv
ggauaguuuucggccgcc

SEQ ID NO: 3311534 - RNA, 15 nt, Mycobacterium tuberculosis H37Rv
ggauaucacgacgcc

SEQ ID NO: 3311535 - RNA, 21 nt, Mycobacterium tuberculosis H37Rv
ggaucaaaaaccacgcgucgc

SEQ ID NO: 3311536 - RNA, 17 nt, Mycobacterium tuberculosis H37Rv
ggaucaaaaccucgugc

SEQ ID NO: 3311537 - RNA, 17 nt, Mycobacterium tuberculosis H37Rv
ggaucaaccggcccucc

SEQ ID NO: 3311538 - RNA, 15 nt, Mycobacterium tuberculosis H37Rv
ggaucaacgcacggc

SEQ ID NO: 3311539 - RNA, 15 nt, Mycobacterium tuberculosis H37Rv
ggaucacaucggcca

SEQ ID NO: 3311540 - RNA, 13 nt, Mycobacterium tuberculosis H37Rv
ggaucaccaucgc

SEQ ID NO: 3311541 - RNA, 14 nt, Mycobacterium tuberculosis H37Rv
ggaucaccaucgcc

SEQ ID NO: 3311542 - RNA, 13 nt, Mycobacterium tuberculosis H37Rv
ggaucaccgcgcc

SEQ ID NO: 3311543 - RNA, 14 nt, Mycobacterium tuberculosis H37Rv
ggaucacgaccgcg

SEQ ID NO: 3311544 - RNA, 12 nt, Mycobacterium tuberculosis H37Rv
ggaucacgccac

SEQ ID NO: 3311545 - RNA, 15 nt, Mycobacterium tuberculosis H37Rv
ggaucagcccgcgca

SEQ ID NO: 3311546 - RNA, 20 nt, Mycobacterium tuberculosis H37Rv
ggaucagcgaguggucccgu

SEQ ID NO: 3311547 - RNA, 16 nt, Mycobacterium tuberculosis H37Rv
ggaucagggcuuucgc

SEQ ID NO: 3311548 - RNA, 20 nt, Mycobacterium tuberculosis H37Rv
ggaucaguuugccaucggga

SEQ ID NO: 3311549 - RNA, 17 nt, Mycobacterium tuberculosis H37Rv
ggaucaucgccgcggcc

SEQ ID NO: 3311550 - RNA, 16 nt, Mycobacterium tuberculosis H37Rv
ggaucaugaccaucga

SEQ ID NO: 3311551 - RNA, 13 nt, Mycobacterium tuberculosis H37Rv
ggaucauguucgg

SEQ ID NO: 3311552 - RNA, 17 nt, Mycobacterium tuberculosis H37Rv
ggaucauguucggccac

SEQ ID NO: 3311553 - RNA, 12 nt, Mycobacterium tuberculosis H37Rv
ggauccagcagg

SEQ ID NO: 3311554 - RNA, 20 nt, Mycobacterium tuberculosis H37Rv
ggauccaggcccagccgagc

SEQ ID NO: 3311555 - RNA, 12 nt, Mycobacterium tuberculosis H37Rv
ggaucccagccc

SEQ ID NO: 3311556 - RNA, 19 nt, Mycobacterium tuberculosis H37Rv
ggaucccagugccagugcc

SEQ ID NO: 3311557 - RNA, 12 nt, Mycobacterium tuberculosis H37Rv
ggaucccgccgc

SEQ ID NO: 3311558 - RNA, 15 nt, Mycobacterium tuberculosis H37Rv
ggaucccggccgggu

SEQ ID NO: 3311559 - RNA, 11 nt, Mycobacterium tuberculosis H37Rv
ggaucccggug

SEQ ID NO: 3311560 - RNA, 18 nt, Mycobacterium tuberculosis H37Rv
ggaucccgguggcagcac

SEQ ID NO: 3311561 - RNA, 17 nt, Mycobacterium tuberculosis H37Rv
ggauccgaagagccagc

SEQ ID NO: 3311562 - RNA, 15 nt, Mycobacterium tuberculosis H37Rv
ggauuccagcagccu

SEQ ID NO: 3311563 - RNA, 17 nt, Mycobacterium tuberculosis H37Rv
ggauuccagcagccugc

SEQ ID NO: 3311564 - RNA, 19 nt, Mycobacterium tuberculosis H37Rv
ggauucccgcccagcagca

SEQ ID NO: 3311565 - RNA, 21 nt, Mycobacterium tuberculosis H37Rv
ggauucgaagccgagcuccuc

SEQ ID NO: 3311566 - RNA, 15 nt, Mycobacterium tuberculosis H37Rv
ggauucggcggucgc

SEQ ID NO: 3311567 - RNA, 15 nt, Mycobacterium tuberculosis H37Rv
ggauucggcugccac

SEQ ID NO: 3311568 - RNA, 17 nt, Mycobacterium tuberculosis H37Rv
ggauucgguaucagggg

SEQ ID NO: 3311569 - RNA, 15 nt, Mycobacterium tuberculosis H37Rv
ggauucugcugacca

SEQ ID NO: 3311570 - RNA, 18 nt, Mycobacterium tuberculosis H37Rv
ggauucuucagcgcggca

SEQ ID NO: 3311571 - RNA, 19 nt, Mycobacterium tuberculosis H37Rv
ggauugcuguacugcggug

SEQ ID NO: 3311572 - RNA, 18 nt, Mycobacterium tuberculosis H37Rv
ggauugcuugggugccuc

SEQ ID NO: 3311573 - RNA, 20 nt, Mycobacterium tuberculosis H37Rv
ggauuggaggcgggcguuga

SEQ ID NO: 3311574 - RNA, 16 nt, Mycobacterium tuberculosis H37Rv
ggauuggcgucagcag

SEQ ID NO: 3311575 - RNA, 18 nt, Mycobacterium tuberculosis H37Rv
ggauuggcgucagcagca

SEQ ID NO: 3311576 - RNA, 17 nt, Mycobacterium tuberculosis H37Rv
ggcaaacgcacccaucg

SEQ ID NO: 3311577 - RNA, 18 nt, Mycobacterium tuberculosis H37Rv
ggcaaacgcgcaggucag

SEQ ID NO: 3311578 - RNA, 22 nt, Mycobacterium tuberculosis H37Rv
ggcaaacguaccgucauggcga

SEQ ID NO: 3311579 - RNA, 19 nt, Mycobacterium tuberculosis H37Rv
ggcaaacuccugcaggauc

SEQ ID NO: 3311580 - RNA, 13 nt, Mycobacterium tuberculosis H37Rv
ggcaaacugggca

SEQ ID NO: 3311581 - RNA, 17 nt, Mycobacterium tuberculosis H37Rv
ggcaaagcgagcaccgc

SEQ ID NO: 3311582 - RNA, 21 nt, Mycobacterium tuberculosis H37Rv
ggcaaagcgagcaccgcggua

SEQ ID NO: 3311583 - RNA, 16 nt, Mycobacterium tuberculosis H37Rv
ggcaaaggacgucgac

SEQ ID NO: 3311584 - RNA, 22 nt, Mycobacterium tuberculosis H37Rv
ggcaaaucaagcacagcccggc

SEQ ID NO: 3311585 - RNA, 19 nt, Mycobacterium tuberculosis H37Rv
ggcaacaacguucggcaca

SEQ ID NO: 3311586 - RNA, 19 nt, Mycobacterium tuberculosis H37Rv
ggcaacaccaccucgacga

SEQ ID NO: 3311587 - RNA, 19 nt, Mycobacterium tuberculosis H37Rv
ggcaacagcaccagugugg

SEQ ID NO: 3311588 - RNA, 12 nt, Mycobacterium tuberculosis H37Rv
ggcaacagggga

SEQ ID NO: 3311589 - RNA, 18 nt, Mycobacterium tuberculosis H37Rv
ggcaacaucgagcgccag

SEQ ID NO: 3311590 - RNA, 18 nt, Mycobacterium tuberculosis H37Rv
ggcaaccacaucaccggc

SEQ ID NO: 3311591 - RNA, 22 nt, Mycobacterium tuberculosis H37Rv
ggcaaccacaucaccggcgauc

SEQ ID NO: 3311592 - RNA, 21 nt, Mycobacterium tuberculosis H37Rv
ggcaaccaccggccgcgcaga

SEQ ID NO: 3311593 - RNA, 14 nt, Mycobacterium tuberculosis H37Rv
ggcaaccagcagca

SEQ ID NO: 3311594 - RNA, 15 nt, Mycobacterium tuberculosis H37Rv
ggcaaccagcagcag

SEQ ID NO: 3311595 - RNA, 20 nt, Mycobacterium tuberculosis H37Rv
ggcaaccagcgagcccagcu

SEQ ID NO: 3311596 - RNA, 13 nt, Mycobacterium tuberculosis H37Rv
ggcaaccagcuuc

SEQ ID NO: 3311597 - RNA, 21 nt, Mycobacterium tuberculosis H37Rv
ggcaaccccgagcggagccgc

SEQ ID NO: 3311598 - RNA, 19 nt, Mycobacterium tuberculosis H37Rv
ggcaaccgccgugugccac

SEQ ID NO: 3311599 - RNA, 13 nt, Mycobacterium tuberculosis H37Rv
ggcaaccgcgcgc

SEQ ID NO: 3311600 - RNA, 14 nt, Mycobacterium tuberculosis H37Rv
ggcaaccugccggg

SEQ ID NO: 3311601 - RNA, 17 nt, Mycobacterium tuberculosis H37Rv
ggcaaccuuuggccgcu

SEQ ID NO: 3311602 - RNA, 13 nt, Mycobacterium tuberculosis H37Rv
ggcaacgacacgc

SEQ ID NO: 3311603 - RNA, 14 nt, Mycobacterium tuberculosis H37Rv
ggcaacgaucaggu

SEQ ID NO: 3311604 - RNA, 14 nt, Mycobacterium tuberculosis H37Rv
ggcaacgaucgaca

SEQ ID NO: 3311605 - RNA, 17 nt, Mycobacterium tuberculosis H37Rv
ggcaacgccgcgccguu

SEQ ID NO: 3311606 - RNA, 12 nt, Mycobacterium tuberculosis H37Rv
ggcaacgccucc

SEQ ID NO: 3311607 - RNA, 16 nt, Mycobacterium tuberculosis H37Rv
ggcaacgcgaaccggc

SEQ ID NO: 3311608 - RNA, 22 nt, Mycobacterium tuberculosis H37Rv
ggcaacgcgaaccggccaucga

SEQ ID NO: 3311609 - RNA, 17 nt, Mycobacterium tuberculosis H37Rv
ggcaacgcggucugcuc

SEQ ID NO: 3311610 - RNA, 20 nt, Mycobacterium tuberculosis H37Rv
ggcaacggacgggaucgccc

SEQ ID NO: 3311611 - RNA, 13 nt, Mycobacterium tuberculosis H37Rv
ggcaacggccgcu

SEQ ID NO: 3311612 - RNA, 17 nt, Mycobacterium tuberculosis H37Rv
ggcaacggcgcgccgac

SEQ ID NO: 3311613 - RNA, 13 nt, Mycobacterium tuberculosis H37Rv
ggcaacggcggcg

SEQ ID NO: 3311614 - RNA, 12 nt, Mycobacterium tuberculosis H37Rv
ggcaacugcagc

SEQ ID NO: 3311615 - RNA, 18 nt, Mycobacterium tuberculosis H37Rv
ggcaacugcagcauggcc

SEQ ID NO: 3311616 - RNA, 18 nt, Mycobacterium tuberculosis H37Rv
ggcaagaacccgauaaca

SEQ ID NO: 3311617 - RNA, 20 nt, Mycobacterium tuberculosis H37Rv
ggcaagaccgaacagcggca

SEQ ID NO: 3311618 - RNA, 15 nt, Mycobacterium tuberculosis H37Rv
ggcaagcacaccgcc

SEQ ID NO: 3311619 - RNA, 16 nt, Mycobacterium tuberculosis H37Rv
ggcaagcacaccgcca

SEQ ID NO: 3311620 - RNA, 18 nt, Mycobacterium tuberculosis H37Rv
ggcaagcacaccgccagc

SEQ ID NO: 3311621 - RNA, 21 nt, Mycobacterium tuberculosis H37Rv
ggcaagcacaccgccagcggc

SEQ ID NO: 3311622 - RNA, 18 nt, Mycobacterium tuberculosis H37Rv
ggcaagcacgcgacggcg

SEQ ID NO: 3311623 - RNA, 22 nt, Mycobacterium tuberculosis H37Rv
ggcaagccauucacgagccgcu

SEQ ID NO: 3311624 - RNA, 15 nt, Mycobacterium tuberculosis H37Rv
ggcaagcccaaaaag

SEQ ID NO: 3311625 - RNA, 18 nt, Mycobacterium tuberculosis H37Rv
ggcaagccgauugcuucu

SEQ ID NO: 3311626 - RNA, 14 nt, Mycobacterium tuberculosis H37Rv
ggcaagcucguccg

SEQ ID NO: 3311627 - RNA, 21 nt, Mycobacterium tuberculosis H37Rv
ggcaaggacaagccgcugaug

SEQ ID NO: 3311628 - RNA, 16 nt, Mycobacterium tuberculosis H37Rv
ggcaaggcauccaacg

SEQ ID NO: 3311629 - RNA, 21 nt, Mycobacterium tuberculosis H37Rv
ggcaaggcauccaacgcggcg

SEQ ID NO: 3311630 - RNA, 14 nt, Mycobacterium tuberculosis H37Rv
ggcaaggcggcggc

SEQ ID NO: 3311631 - RNA, 16 nt, Mycobacterium tuberculosis H37Rv
ggcaagggcauacagc

SEQ ID NO: 3311632 - RNA, 14 nt, Mycobacterium tuberculosis H37Rv
ggcaagggccgacg

SEQ ID NO: 3311633 - RNA, 15 nt, Mycobacterium tuberculosis H37Rv
ggcaagggccgacgu

SEQ ID NO: 3311634 - RNA, 14 nt, Mycobacterium tuberculosis H37Rv
ggcaagucaacacc

SEQ ID NO: 3311635 - RNA, 14 nt, Mycobacterium tuberculosis H37Rv
ggcaagucgacgcc

SEQ ID NO: 3311636 - RNA, 21 nt, Mycobacterium tuberculosis H37Rv
ggcaagucgcccagccgagcg

SEQ ID NO: 3311637 - RNA, 18 nt, Mycobacterium tuberculosis H37Rv
ggcaaguuccacgggugg

SEQ ID NO: 3311638 - RNA, 15 nt, Mycobacterium tuberculosis H37Rv
ggcaauaccgccagc

SEQ ID NO: 3311639 - RNA, 19 nt, Mycobacterium tuberculosis H37Rv
ggcaauaccgccagcgcca

SEQ ID NO: 3311640 - RNA, 20 nt, Mycobacterium tuberculosis H37Rv
ggcaaucaccgccggcggcg

SEQ ID NO: 3311641 - RNA, 19 nt, Mycobacterium tuberculosis H37Rv
ggcaaucaucucccgaccg

SEQ ID NO: 3311642 - RNA, 22 nt, Mycobacterium tuberculosis H37Rv
ggcaaucgcucugugucgccga

SEQ ID NO: 3311643 - RNA, 18 nt, Mycobacterium tuberculosis H37Rv
ggcaaugacggccugcac

SEQ ID NO: 3311644 - RNA, 18 nt, Mycobacterium tuberculosis H37Rv
ggcaaugccgcggccagu

SEQ ID NO: 3311645 - RNA, 22 nt, Mycobacterium tuberculosis H37Rv
ggcaauggccagcaccacggcc

SEQ ID NO: 3311646 - RNA, 14 nt, Mycobacterium tuberculosis H37Rv
ggcaauuacccgac

SEQ ID NO: 3311647 - RNA, 22 nt, Mycobacterium tuberculosis H37Rv
ggcaauuacccgacuucaagac

SEQ ID NO: 3311648 - RNA, 17 nt, Mycobacterium tuberculosis H37Rv
ggcaauuccgccgagcg

SEQ ID NO: 3311649 - RNA, 16 nt, Mycobacterium tuberculosis H37Rv
ggcacaaccggauuga

SEQ ID NO: 3311650 - RNA, 22 nt, Mycobacterium tuberculosis H37Rv
ggcacaauaggcuccagcgcgc

SEQ ID NO: 3311651 - RNA, 13 nt, Mycobacterium tuberculosis H37Rv
ggcacaaucaccg

SEQ ID NO: 3311652 - RNA, 22 nt, Mycobacterium tuberculosis H37Rv
ggcacaaucggauagccgugcu

SEQ ID NO: 3311653 - RNA, 14 nt, Mycobacterium tuberculosis H37Rv
ggcacaaucggcgc

SEQ ID NO: 3311654 - RNA, 19 nt, Mycobacterium tuberculosis H37Rv
ggcacacccaucaccgcca

SEQ ID NO: 3311655 - RNA, 21 nt, Mycobacterium tuberculosis H37Rv
ggcacacccaucaccgccagc

SEQ ID NO: 3311656 - RNA, 18 nt, Mycobacterium tuberculosis H37Rv
ggcacacccaucagcccu

SEQ ID NO: 3311657 - RNA, 20 nt, Mycobacterium tuberculosis H37Rv
ggcacaccccgguucgacgu

SEQ ID NO: 3311658 - RNA, 14 nt, Mycobacterium tuberculosis H37Rv
ggcacgacccggga

SEQ ID NO: 3311659 - RNA, 19 nt, Mycobacterium tuberculosis H37Rv
ggcacgacccgggaaggaa

SEQ ID NO: 3311660 - RNA, 16 nt, Mycobacterium tuberculosis H37Rv
ggcacgaccgcucccg

SEQ ID NO: 3311661 - RNA, 17 nt, Mycobacterium tuberculosis H37Rv
ggcacgaccgcucccgg

SEQ ID NO: 3311662 - RNA, 21 nt, Mycobacterium tuberculosis H37Rv
ggcacgacgccggccuggccg

SEQ ID NO: 3311663 - RNA, 17 nt, Mycobacterium tuberculosis H37Rv
ggcacgaucaaccgggu

SEQ ID NO: 3311664 - RNA, 17 nt, Mycobacterium tuberculosis H37Rv
ggcacgaucaucggggu

SEQ ID NO: 3311665 - RNA, 13 nt, Mycobacterium tuberculosis H37Rv
ggcacgaucggca

SEQ ID NO: 3311666 - RNA, 18 nt, Mycobacterium tuberculosis H37Rv
ggcacgaucgucgcggcc

SEQ ID NO: 3311667 - RNA, 17 nt, Mycobacterium tuberculosis H37Rv
ggcacgcacaaguucuu

SEQ ID NO: 3311668 - RNA, 18 nt, Mycobacterium tuberculosis H37Rv
ggcacgcaugccggugau

SEQ ID NO: 3311669 - RNA, 22 nt, Mycobacterium tuberculosis H37Rv
ggcacgccauaccggcuggcca

SEQ ID NO: 3311670 - RNA, 14 nt, Mycobacterium tuberculosis H37Rv
ggcacgcccucguc

SEQ ID NO: 3311671 - RNA, 20 nt, Mycobacterium tuberculosis H37Rv
ggcacgcccucgucgaucgc

SEQ ID NO: 3311672 - RNA, 22 nt, Mycobacterium tuberculosis H37Rv
ggcacgcccucgucgaucgccg

SEQ ID NO: 3311673 - RNA, 15 nt, Mycobacterium tuberculosis H37Rv
ggcacgccggcggcg

SEQ ID NO: 3311674 - RNA, 20 nt, Mycobacterium tuberculosis H37Rv
ggcacgccgggcaucggcgg

SEQ ID NO: 3311675 - RNA, 14 nt, Mycobacterium tuberculosis H37Rv
ggcacgcgggaagu

SEQ ID NO: 3311676 - RNA, 22 nt, Mycobacterium tuberculosis H37Rv
ggcacgcgggaagugcacccgg

SEQ ID NO: 3311677 - RNA, 20 nt, Mycobacterium tuberculosis H37Rv
ggcacgcuccagcucggcca

SEQ ID NO: 3311678 - RNA, 23 nt, Mycobacterium tuberculosis H37Rv
ggcacgcucggugaaggucaccg

SEQ ID NO: 3311679 - RNA, 13 nt, Mycobacterium tuberculosis H37Rv
ggcacgcugucga

SEQ ID NO: 3311680 - RNA, 24 nt, Mycobacterium tuberculosis H37Rv
ggcacggaugcgauggccgacgcu

SEQ ID NO: 3311681 - RNA, 19 nt, Mycobacterium tuberculosis H37Rv
ggcacgggaaucgcucgcg

SEQ ID NO: 3311682 - RNA, 16 nt, Mycobacterium tuberculosis H37Rv
ggcacgggcgucgucg

SEQ ID NO: 3311683 - RNA, 11 nt, Mycobacterium tuberculosis H37Rv
ggcacgggugu

SEQ ID NO: 3311684 - RNA, 18 nt, Mycobacterium tuberculosis H37Rv
ggcacggucacacgccag

SEQ ID NO: 3311685 - RNA, 22 nt, Mycobacterium tuberculosis H37Rv
ggcacggucacacgccagccgg

SEQ ID NO: 3311686 - RNA, 22 nt, Mycobacterium tuberculosis H37Rv
ggcacggucgcccgaucggcgg

SEQ ID NO: 3311687 - RNA, 15 nt, Mycobacterium tuberculosis H37Rv
ggcacggugucgcgc

SEQ ID NO: 3311688 - RNA, 21 nt, Mycobacterium tuberculosis H37Rv
ggcacggugucgcgcgaccug

SEQ ID NO: 3311689 - RNA, 18 nt, Mycobacterium tuberculosis H37Rv
ggcacguccgaucggcgc

SEQ ID NO: 3311690 - RNA, 19 nt, Mycobacterium tuberculosis H37Rv
ggcacguccgaucggcgcg

SEQ ID NO: 3311691 - RNA, 17 nt, Mycobacterium tuberculosis H37Rv
ggcacgucggcgccgac

SEQ ID NO: 3311692 - RNA, 18 nt, Mycobacterium tuberculosis H37Rv
ggcacguucagccaggcg

SEQ ID NO: 3311693 - RNA, 15 nt, Mycobacterium tuberculosis H37Rv
ggcacguucggcgca

SEQ ID NO: 3311694 - RNA, 18 nt, Mycobacterium tuberculosis H37Rv
ggcacguugugaucguca

SEQ ID NO: 3311695 - RNA, 17 nt, Mycobacterium tuberculosis H37Rv
ggcacuaacggcguguc

SEQ ID NO: 3311696 - RNA, 13 nt, Mycobacterium tuberculosis H37Rv
ggcacuccaccgg

SEQ ID NO: 3311697 - RNA, 15 nt, Mycobacterium tuberculosis H37Rv
ggcacuccagcggcg

SEQ ID NO: 3311698 - RNA, 16 nt, Mycobacterium tuberculosis H37Rv
ggcacuccagcggcgg

SEQ ID NO: 3311699 - RNA, 17 nt, Mycobacterium tuberculosis H37Rv
ggcacuccagcggcggg

SEQ ID NO: 3311700 - RNA, 21 nt, Mycobacterium tuberculosis H37Rv
ggcacucccggaguggccagu

SEQ ID NO: 3311701 - RNA, 15 nt, Mycobacterium tuberculosis H37Rv
ggcacugaccgcgau

SEQ ID NO: 3311702 - RNA, 15 nt, Mycobacterium tuberculosis H37Rv
ggcacugacgcgccc

SEQ ID NO: 3311703 - RNA, 22 nt, Mycobacterium tuberculosis H37Rv
ggcacugaucggaaacggagcc

SEQ ID NO: 3311704 - RNA, 13 nt, Mycobacterium tuberculosis H37Rv
ggcacugcccagc

SEQ ID NO: 3311705 - RNA, 20 nt, Mycobacterium tuberculosis H37Rv
ggcacugcccagcagaccaa

SEQ ID NO: 3311706 - RNA, 16 nt, Mycobacterium tuberculosis H37Rv
ggcacugcgaucgcga

SEQ ID NO: 3311707 - RNA, 14 nt, Mycobacterium tuberculosis H37Rv
ggcacugcggccag

SEQ ID NO: 3311708 - RNA, 20 nt, Mycobacterium tuberculosis H37Rv
ggcacuggguccacgcgcuc

SEQ ID NO: 3311709 - RNA, 23 nt, Mycobacterium tuberculosis H37Rv
ggcacuuaccgagccgucagcgu

SEQ ID NO: 3311710 - RNA, 19 nt, Mycobacterium tuberculosis H37Rv
ggcacuuagcccgauggug

SEQ ID NO: 3311711 - RNA, 17 nt, Mycobacterium tuberculosis H37Rv
ggcacuuccagcccggc

SEQ ID NO: 3311712 - RNA, 19 nt, Mycobacterium tuberculosis H37Rv
ggcacuugccacggcccgg

SEQ ID NO: 3311713 - RNA, 23 nt, Mycobacterium tuberculosis H37Rv
ggcagaacuggacaagcuccucg

SEQ ID NO: 3311714 - RNA, 22 nt, Mycobacterium tuberculosis H37Rv
ggcagaagucguugcgcggucu

SEQ ID NO: 3311715 - RNA, 22 nt, Mycobacterium tuberculosis H37Rv
ggcagaaucggugggcgggcaa

SEQ ID NO: 3311716 - RNA, 12 nt, Mycobacterium tuberculosis H37Rv
ggcagacacgcu

SEQ ID NO: 3311717 - RNA, 12 nt, Mycobacterium tuberculosis H37Rv
ggcagacauggc

SEQ ID NO: 3311718 - RNA, 19 nt, Mycobacterium tuberculosis H37Rv
ggcagacauggcaagucaa

SEQ ID NO: 3311719 - RNA, 15 nt, Mycobacterium tuberculosis H37Rv
ggcagaccaacgcuc

SEQ ID NO: 3311720 - RNA, 14 nt, Mycobacterium tuberculosis H37Rv
ggcagacccgagcg

SEQ ID NO: 3311721 - RNA, 19 nt, Mycobacterium tuberculosis H37Rv
ggcagaccgaucggcaggc

SEQ ID NO: 3311722 - RNA, 16 nt, Mycobacterium tuberculosis H37Rv
ggcagaccggcaucga

SEQ ID NO: 3311723 - RNA, 13 nt, Mycobacterium tuberculosis H37Rv
ggcagaccgguga

SEQ ID NO: 3311724 - RNA, 22 nt, Mycobacterium tuberculosis H37Rv
ggcagacgcguuucgucgaccg

SEQ ID NO: 3311725 - RNA, 13 nt, Mycobacterium tuberculosis H37Rv
ggcagagccgacu

SEQ ID NO: 3311726 - RNA, 13 nt, Mycobacterium tuberculosis H37Rv
ggcagagccgccg

SEQ ID NO: 3311727 - RNA, 23 nt, Mycobacterium tuberculosis H37Rv
ggcagagccgccguugccgccgg

SEQ ID NO: 3311728 - RNA, 21 nt, Mycobacterium tuberculosis H37Rv
ggcagaucccacgccaggauc

SEQ ID NO: 3311729 - RNA, 16 nt, Mycobacterium tuberculosis H37Rv
ggcagaucgauaccgu

SEQ ID NO: 3311730 - RNA, 18 nt, Mycobacterium tuberculosis H37Rv
ggcagaugaauugccggg

SEQ ID NO: 3311731 - RNA, 14 nt, Mycobacterium tuberculosis H37Rv
ggcagauggucucg

SEQ ID NO: 3311732 - RNA, 22 nt, Mycobacterium tuberculosis H37Rv
ggcagauuggaagacgccggcg

SEQ ID NO: 3311733 - RNA, 20 nt, Mycobacterium tuberculosis H37Rv
ggcagcaaaaacgcugccgc

SEQ ID NO: 3311734 - RNA, 12 nt, Mycobacterium tuberculosis H37Rv
ggcagcaacagg

SEQ ID NO: 3311735 - RNA, 13 nt, Mycobacterium tuberculosis H37Rv
ggcagcaacaggc

SEQ ID NO: 3311736 - RNA, 15 nt, Mycobacterium tuberculosis H37Rv
ggcagcaacgacguc

SEQ ID NO: 3311737 - RNA, 12 nt, Mycobacterium tuberculosis H37Rv
ggcagcacaggc

SEQ ID NO: 3311738 - RNA, 14 nt, Mycobacterium tuberculosis H37Rv
ggcagcaccagcgc

SEQ ID NO: 3311739 - RNA, 16 nt, Mycobacterium tuberculosis H37Rv
ggcagcacccgcacgg

SEQ ID NO: 3311740 - RNA, 22 nt, Mycobacterium tuberculosis H37Rv
ggcagcaccggugaccucggua

SEQ ID NO: 3311741 - RNA, 20 nt, Mycobacterium tuberculosis H37Rv
ggcagcacggucugggucuu

SEQ ID NO: 3311742 - RNA, 11 nt, Mycobacterium tuberculosis H37Rv
ggcagcacguc

SEQ ID NO: 3311743 - RNA, 19 nt, Mycobacterium tuberculosis H37Rv
ggcagcacucuucgaugaa

SEQ ID NO: 3311744 - RNA, 24 nt, Mycobacterium tuberculosis H37Rv
ggcagcacuuggacccggccggcc

SEQ ID NO: 3311745 - RNA, 20 nt, Mycobacterium tuberculosis H37Rv
ggcagcagcaaaacccgagc

SEQ ID NO: 3311746 - RNA, 18 nt, Mycobacterium tuberculosis H37Rv
ggcagcagcagagccaac

SEQ ID NO: 3311747 - RNA, 14 nt, Mycobacterium tuberculosis H37Rv
ggcagcagcccggg

SEQ ID NO: 3311748 - RNA, 17 nt, Mycobacterium tuberculosis H37Rv
ggcagcagccggcgggc

SEQ ID NO: 3311749 - RNA, 21 nt, Mycobacterium tuberculosis H37Rv
ggcagcagcgcaacggccagc

SEQ ID NO: 3311750 - RNA, 22 nt, Mycobacterium tuberculosis H37Rv
ggcagcagcgcaacggccagcg

SEQ ID NO: 3311751 - RNA, 14 nt, Mycobacterium tuberculosis H37Rv
ggcagcagcgccgu

SEQ ID NO: 3311752 - RNA, 19 nt, Mycobacterium tuberculosis H37Rv
ggcagcagcgggcgcgcua

SEQ ID NO: 3311753 - RNA, 18 nt, Mycobacterium tuberculosis H37Rv
ggcagcaggacaccuacc

SEQ ID NO: 3311754 - RNA, 13 nt, Mycobacterium tuberculosis H37Rv
ggcaggccagcau

SEQ ID NO: 3311755 - RNA, 14 nt, Mycobacterium tuberculosis H37Rv
ggcaggccagcaug

SEQ ID NO: 3311756 - RNA, 17 nt, Mycobacterium tuberculosis H37Rv
ggcaggccauccgggcu

SEQ ID NO: 3311757 - RNA, 16 nt, Mycobacterium tuberculosis H37Rv
ggcaggcccgacggcg

SEQ ID NO: 3311758 - RNA, 19 nt, Mycobacterium tuberculosis H37Rv
ggcaggcccgacggcgccc

SEQ ID NO: 3311759 - RNA, 14 nt, Mycobacterium tuberculosis H37Rv
ggcaggccgcuggg

SEQ ID NO: 3311760 - RNA, 12 nt, Mycobacterium tuberculosis H37Rv
ggcaggccggcg

SEQ ID NO: 3311761 - RNA, 14 nt, Mycobacterium tuberculosis H37Rv
ggcaggccggcguc

SEQ ID NO: 3311762 - RNA, 15 nt, Mycobacterium tuberculosis H37Rv
ggcaggccggcgucg

SEQ ID NO: 3311763 - RNA, 12 nt, Mycobacterium tuberculosis H37Rv
ggcaggccgggc

SEQ ID NO: 3311764 - RNA, 15 nt, Mycobacterium tuberculosis H37Rv
ggcaggccucggcgc

SEQ ID NO: 3311765 - RNA, 20 nt, Mycobacterium tuberculosis H37Rv
ggcaggccucggcgccgccc

SEQ ID NO: 3311766 - RNA, 23 nt, Mycobacterium tuberculosis H37Rv
ggcaggccucggcgccgcccagc

SEQ ID NO: 3311767 - RNA, 23 nt, Mycobacterium tuberculosis H37Rv
ggcaggccuuuuggcgaaccgca

SEQ ID NO: 3311768 - RNA, 14 nt, Mycobacterium tuberculosis H37Rv
ggcaggcggccgcc

SEQ ID NO: 3311769 - RNA, 19 nt, Mycobacterium tuberculosis H37Rv
ggcaggcuggcgagggcug

SEQ ID NO: 3311770 - RNA, 22 nt, Mycobacterium tuberculosis H37Rv
ggcaggcuuagcuuccggguuc

SEQ ID NO: 3311771 - RNA, 16 nt, Mycobacterium tuberculosis H37Rv
ggcagggcagcccggc

SEQ ID NO: 3311772 - RNA, 13 nt, Mycobacterium tuberculosis H37Rv
ggcagggccagcg

SEQ ID NO: 3311773 - RNA, 15 nt, Mycobacterium tuberculosis H37Rv
ggcagggccagcggc

SEQ ID NO: 3311774 - RNA, 14 nt, Mycobacterium tuberculosis H37Rv
ggcagggccuggaa

SEQ ID NO: 3311775 - RNA, 15 nt, Mycobacterium tuberculosis H37Rv
ggcagggcggugcca

SEQ ID NO: 3311776 - RNA, 17 nt, Mycobacterium tuberculosis H37Rv
ggcaggguggccagcag

SEQ ID NO: 3311777 - RNA, 18 nt, Mycobacterium tuberculosis H37Rv
ggcaggguggccagcagg

SEQ ID NO: 3311778 - RNA, 19 nt, Mycobacterium tuberculosis H37Rv
ggcaggguggccagcaggc

SEQ ID NO: 3311779 - RNA, 14 nt, Mycobacterium tuberculosis H37Rv
ggcaggugaucccg

SEQ ID NO: 3311780 - RNA, 18 nt, Mycobacterium tuberculosis H37Rv
ggcagguugcguugcagg

SEQ ID NO: 3311781 - RNA, 19 nt, Mycobacterium tuberculosis H37Rv
ggcagguugcguugcagga

SEQ ID NO: 3311782 - RNA, 20 nt, Mycobacterium tuberculosis H37Rv
ggcagguuggccaccgccca

SEQ ID NO: 3311783 - RNA, 21 nt, Mycobacterium tuberculosis H37Rv
ggcaguagcuguggcccgcgg

SEQ ID NO: 3311784 - RNA, 14 nt, Mycobacterium tuberculosis H37Rv
ggcaguccagccgg

SEQ ID NO: 3311785 - RNA, 16 nt, Mycobacterium tuberculosis H37Rv
ggcagucccagcgccg

SEQ ID NO: 3311786 - RNA, 18 nt, Mycobacterium tuberculosis H37Rv
ggcaguggcagcccgucg

SEQ ID NO: 3311787 - RNA, 16 nt, Mycobacterium tuberculosis H37Rv
ggcaguggcgcggcga

SEQ ID NO: 3311788 - RNA, 20 nt, Mycobacterium tuberculosis H37Rv
ggcagugguuacagaugaag

SEQ ID NO: 3311789 - RNA, 17 nt, Mycobacterium tuberculosis H37Rv
ggcaguucgcggccauc

SEQ ID NO: 3311790 - RNA, 18 nt, Mycobacterium tuberculosis H37Rv
ggcaguugaacucgacca

SEQ ID NO: 3311791 - RNA, 21 nt, Mycobacterium tuberculosis H37Rv
ggcaguugaacucgaccaccg

SEQ ID NO: 3311792 - RNA, 13 nt, Mycobacterium tuberculosis H37Rv
ggcaguuugcggg

SEQ ID NO: 3311793 - RNA, 17 nt, Mycobacterium tuberculosis H37Rv
ggcaguuuggcggcagg

SEQ ID NO: 3311794 - RNA, 22 nt, Mycobacterium tuberculosis H37Rv
ggcauaacccuggccggugcgc

SEQ ID NO: 3311795 - RNA, 16 nt, Mycobacterium tuberculosis H37Rv
ggcauacauccaggcu

SEQ ID NO: 3311796 - RNA, 21 nt, Mycobacterium tuberculosis H37Rv
ggcauacauccaggcuguggc

SEQ ID NO: 3311797 - RNA, 23 nt, Mycobacterium tuberculosis H37Rv
ggcauacaucgccuugcccagcg

SEQ ID NO: 3311798 - RNA, 19 nt, Mycobacterium tuberculosis H37Rv
ggcauaccgaacagcaccu

SEQ ID NO: 3311799 - RNA, 22 nt, Mycobacterium tuberculosis H37Rv
ggcauagaucgggucguuggcg

SEQ ID NO: 3311800 - RNA, 18 nt, Mycobacterium tuberculosis H37Rv
ggcauagccgaacagcgg

SEQ ID NO: 3311801 - RNA, 14 nt, Mycobacterium tuberculosis H37Rv
ggcaucaccgccgc

SEQ ID NO: 3311802 - RNA, 16 nt, Mycobacterium tuberculosis H37Rv
ggcaucaccgccgcgg

SEQ ID NO: 3311803 - RNA, 18 nt, Mycobacterium tuberculosis H37Rv
ggcaucaccgccgcggcc

SEQ ID NO: 3311804 - RNA, 21 nt, Mycobacterium tuberculosis H37Rv
ggcaucaccgccgcggccgcc

SEQ ID NO: 3311805 - RNA, 16 nt, Mycobacterium tuberculosis H37Rv
ggcaucaccggaaccc

SEQ ID NO: 3311806 - RNA, 22 nt, Mycobacterium tuberculosis H37Rv
ggcaucaucgcugugcgcuggu

SEQ ID NO: 3311807 - RNA, 14 nt, Mycobacterium tuberculosis H37Rv
ggcauccagcagcg

SEQ ID NO: 3311808 - RNA, 17 nt, Mycobacterium tuberculosis H37Rv
ggcauccagcagcgccu

SEQ ID NO: 3311809 - RNA, 21 nt, Mycobacterium tuberculosis H37Rv
ggcaucccggccgcucagcga

SEQ ID NO: 3311810 - RNA, 22 nt, Mycobacterium tuberculosis H37Rv
ggcaucccgggcaguccaggca

SEQ ID NO: 3311811 - RNA, 18 nt, Mycobacterium tuberculosis H37Rv
ggcauccgagcgggaacg

SEQ ID NO: 3311812 - RNA, 18 nt, Mycobacterium tuberculosis H37Rv
ggcauccgccccgcccgc

SEQ ID NO: 3311813 - RNA, 12 nt, Mycobacterium tuberculosis H37Rv
ggcauccugcac

SEQ ID NO: 3311814 - RNA, 22 nt, Mycobacterium tuberculosis H37Rv
ggcauccugcacgacccgcugg

SEQ ID NO: 3311815 - RNA, 13 nt, Mycobacterium tuberculosis H37Rv
ggcaucgacgcgu

SEQ ID NO: 3311816 - RNA, 14 nt, Mycobacterium tuberculosis H37Rv
ggcaucgacugcca

SEQ ID NO: 3311817 - RNA, 17 nt, Mycobacterium tuberculosis H37Rv
ggcaucgacugccagcg

SEQ ID NO: 3311818 - RNA, 16 nt, Mycobacterium tuberculosis H37Rv
ggcaucgagacgagcc

SEQ ID NO: 3311819 - RNA, 17 nt, Mycobacterium tuberculosis H37Rv
ggcaucgagacgagcca

SEQ ID NO: 3311820 - RNA, 14 nt, Mycobacterium tuberculosis H37Rv
ggcaucgaggccag

SEQ ID NO: 3311821 - RNA, 16 nt, Mycobacterium tuberculosis H37Rv
ggcaucgaggccagca

SEQ ID NO: 3311822 - RNA, 19 nt, Mycobacterium tuberculosis H37Rv
ggcaucgaggccagcagcu

SEQ ID NO: 3311823 - RNA, 20 nt, Mycobacterium tuberculosis H37Rv
ggcaucgauaauggccgagu

SEQ ID NO: 3311824 - RNA, 19 nt, Mycobacterium tuberculosis H37Rv
ggcaucgccgcgggugauc

SEQ ID NO: 3311825 - RNA, 19 nt, Mycobacterium tuberculosis H37Rv
ggcaucgcgagccagcugc

SEQ ID NO: 3311826 - RNA, 21 nt, Mycobacterium tuberculosis H37Rv
ggcaucgcgagccagcugcuc

SEQ ID NO: 3311827 - RNA, 21 nt, Mycobacterium tuberculosis H37Rv
ggcaucgcgcgcggcuccguu

SEQ ID NO: 3311828 - RNA, 17 nt, Mycobacterium tuberculosis H37Rv
ggcaucgcgggcggcgc

SEQ ID NO: 3311829 - RNA, 11 nt, Mycobacterium tuberculosis H37Rv
ggcaucggcca

SEQ ID NO: 3311830 - RNA, 20 nt, Mycobacterium tuberculosis H37Rv
ggcaucggccaucucgucga

SEQ ID NO: 3311831 - RNA, 23 nt, Mycobacterium tuberculosis H37Rv
ggcaucggccuguucgccgucgc

SEQ ID NO: 3311832 - RNA, 14 nt, Mycobacterium tuberculosis H37Rv
ggcaucggcggccu

SEQ ID NO: 3311833 - RNA, 19 nt, Mycobacterium tuberculosis H37Rv
ggcaucggcggccugcucg

SEQ ID NO: 3311834 - RNA, 15 nt, Mycobacterium tuberculosis H37Rv
ggcaucggcggcguc

SEQ ID NO: 3311835 - RNA, 15 nt, Mycobacterium tuberculosis H37Rv
ggcaucggcgguucc

SEQ ID NO: 3311836 - RNA, 17 nt, Mycobacterium tuberculosis H37Rv
ggcaucggucagcgcgg

SEQ ID NO: 3311837 - RNA, 19 nt, Mycobacterium tuberculosis H37Rv
ggcaucgucgacgaugucg

SEQ ID NO: 3311838 - RNA, 20 nt, Mycobacterium tuberculosis H37Rv
ggcaucgucgucgcugccgc

SEQ ID NO: 3311839 - RNA, 20 nt, Mycobacterium tuberculosis H37Rv
ggcaucuccaccgucgccgc

SEQ ID NO: 3311840 - RNA, 21 nt, Mycobacterium tuberculosis H37Rv
ggcaugaagcaguuggccgag

SEQ ID NO: 3311841 - RNA, 15 nt, Mycobacterium tuberculosis H37Rv
ggcaugacauacagc

SEQ ID NO: 3311842 - RNA, 19 nt, Mycobacterium tuberculosis H37Rv
ggcaugacauacagcgggc

SEQ ID NO: 3311843 - RNA, 14 nt, Mycobacterium tuberculosis H37Rv
ggcaugccacacac

SEQ ID NO: 3311844 - RNA, 13 nt, Mycobacterium tuberculosis H37Rv
ggcaugccggcga

SEQ ID NO: 3311845 - RNA, 14 nt, Mycobacterium tuberculosis H37Rv
ggcaugccggcgaa

SEQ ID NO: 3311846 - RNA, 20 nt, Mycobacterium tuberculosis H37Rv
ggcaugcgacagaugccggg

SEQ ID NO: 3311847 - RNA, 16 nt, Mycobacterium tuberculosis H37Rv
ggcaugcggaucggcg

SEQ ID NO: 3311848 - RNA, 12 nt, Mycobacterium tuberculosis H37Rv
ggcaugcucugg

SEQ ID NO: 3311849 - RNA, 16 nt, Mycobacterium tuberculosis H37Rv
ggcaugcucuggcaau

SEQ ID NO: 3311850 - RNA, 20 nt, Mycobacterium tuberculosis H37Rv
ggccaccuuagcgcuugccg

SEQ ID NO: 3311851 - RNA, 15 nt, Mycobacterium tuberculosis H37Rv
ggccacgaccucggg

SEQ ID NO: 3311852 - RNA, 18 nt, Mycobacterium tuberculosis H37Rv
ggccacgaccucgggauc

SEQ ID NO: 3311853 - RNA, 18 nt, Mycobacterium tuberculosis H37Rv
ggccacgaugaucccaag

SEQ ID NO: 3311854 - RNA, 21 nt, Mycobacterium tuberculosis H37Rv
ggccacgaugcgcacaccgac

SEQ ID NO: 3311855 - RNA, 13 nt, Mycobacterium tuberculosis H37Rv
ggccacgcaccgg

SEQ ID NO: 3311856 - RNA, 15 nt, Mycobacterium tuberculosis H37Rv
ggccacgccagcucg

SEQ ID NO: 3311857 - RNA, 18 nt, Mycobacterium tuberculosis H37Rv
ggccacgccagcucgccg

SEQ ID NO: 3311858 - RNA, 17 nt, Mycobacterium tuberculosis H37Rv
ggccacgccgaucaaca

SEQ ID NO: 3311859 - RNA, 16 nt, Mycobacterium tuberculosis H37Rv
ggccacggcgucggcc

SEQ ID NO: 3311860 - RNA, 19 nt, Mycobacterium tuberculosis H37Rv
ggccacggcgucggccacc

SEQ ID NO: 3311861 - RNA, 19 nt, Mycobacterium tuberculosis H37Rv
ggccacggcuuugcggcgc

SEQ ID NO: 3311862 - RNA, 17 nt, Mycobacterium tuberculosis H37Rv
ggccacggggcugccgg

SEQ ID NO: 3311863 - RNA, 19 nt, Mycobacterium tuberculosis H37Rv
ggccacgguccggcccacc

SEQ ID NO: 3311864 - RNA, 18 nt, Mycobacterium tuberculosis H37Rv
ggccacgguggcgcaagu

SEQ ID NO: 3311865 - RNA, 15 nt, Mycobacterium tuberculosis H37Rv
ggccacguagcagca

SEQ ID NO: 3311866 - RNA, 20 nt, Mycobacterium tuberculosis H37Rv
ggccacucacauuggccagg

SEQ ID NO: 3311867 - RNA, 21 nt, Mycobacterium tuberculosis H37Rv
ggccacucacauuggccaggu

SEQ ID NO: 3311868 - RNA, 24 nt, Mycobacterium tuberculosis H37Rv
ggccacuccaguacgguccggcgu

SEQ ID NO: 3311869 - RNA, 21 nt, Mycobacterium tuberculosis H37Rv
ggccacuccgguggccaacac

SEQ ID NO: 3311870 - RNA, 23 nt, Mycobacterium tuberculosis H37Rv
ggccacugagucugauggccucg

SEQ ID NO: 3311871 - RNA, 21 nt, Mycobacterium tuberculosis H37Rv
ggccacugcguuccaucgccg

SEQ ID NO: 3311872 - RNA, 21 nt, Mycobacterium tuberculosis H37Rv
ggccacuugaugcucgaugcg

SEQ ID NO: 3311873 - RNA, 22 nt, Mycobacterium tuberculosis H37Rv
ggccacuuggaugcgacccguu

SEQ ID NO: 3311874 - RNA, 19 nt, Mycobacterium tuberculosis H37Rv
ggccagaaacgcgauggug

SEQ ID NO: 3311875 - RNA, 16 nt, Mycobacterium tuberculosis H37Rv
ggccagacggugcagc

SEQ ID NO: 3311876 - RNA, 23 nt, Mycobacterium tuberculosis H37Rv
ggccagacggugcagcuccccgc

SEQ ID NO: 3311877 - RNA, 14 nt, Mycobacterium tuberculosis H37Rv
ggccagagccgccc

SEQ ID NO: 3311878 - RNA, 15 nt, Mycobacterium tuberculosis H37Rv
ggccagagccgcccu

SEQ ID NO: 3311879 - RNA, 15 nt, Mycobacterium tuberculosis H37Rv
ggccagagccgcgcg

SEQ ID NO: 3311880 - RNA, 21 nt, Mycobacterium tuberculosis H37Rv
ggccagagccgcgcgccgguu

SEQ ID NO: 3311881 - RNA, 19 nt, Mycobacterium tuberculosis H37Rv
ggccagcaacugccgcacc

SEQ ID NO: 3311882 - RNA, 16 nt, Mycobacterium tuberculosis H37Rv
ggccagcaagacgaug

SEQ ID NO: 3311883 - RNA, 14 nt, Mycobacterium tuberculosis H37Rv
ggccagcacaccgu

SEQ ID NO: 3311884 - RNA, 20 nt, Mycobacterium tuberculosis H37Rv
ggccagcacaccgucgacga

SEQ ID NO: 3311885 - RNA, 15 nt, Mycobacterium tuberculosis H37Rv
ggccagcaccacggc

SEQ ID NO: 3311886 - RNA, 17 nt, Mycobacterium tuberculosis H37Rv
ggccagcaccacggcca

SEQ ID NO: 3311887 - RNA, 20 nt, Mycobacterium tuberculosis H37Rv
ggccagcaccacggccagcg

SEQ ID NO: 3311888 - RNA, 23 nt, Mycobacterium tuberculosis H37Rv
ggccagcaccacggccagcgggu

SEQ ID NO: 3311889 - RNA, 19 nt, Mycobacterium tuberculosis H37Rv
ggccagcaccagcucacgu

SEQ ID NO: 3311890 - RNA, 20 nt, Mycobacterium tuberculosis H37Rv
ggccagcaccucgaccgcca

SEQ ID NO: 3311891 - RNA, 19 nt, Mycobacterium tuberculosis H37Rv
ggccagcacgccgccggcc

SEQ ID NO: 3311892 - RNA, 15 nt, Mycobacterium tuberculosis H37Rv
ggccagcacggcgac

SEQ ID NO: 3311893 - RNA, 21 nt, Mycobacterium tuberculosis H37Rv
ggccagcacuccgcgggguug

SEQ ID NO: 3311894 - RNA, 22 nt, Mycobacterium tuberculosis H37Rv
ggccagcagaaacaucgacagc

SEQ ID NO: 3311895 - RNA, 16 nt, Mycobacterium tuberculosis H37Rv
ggccagcagaucaggu

SEQ ID NO: 3311896 - RNA, 11 nt, Mycobacterium tuberculosis H37Rv
ggccagcagca

SEQ ID NO: 3311897 - RNA, 13 nt, Mycobacterium tuberculosis H37Rv
ggccagcagcagc

SEQ ID NO: 3311898 - RNA, 14 nt, Mycobacterium tuberculosis H37Rv
ggccagcagccgcg

SEQ ID NO: 3311899 - RNA, 15 nt, Mycobacterium tuberculosis H37Rv
ggccagcagcgcggg

SEQ ID NO: 3311900 - RNA, 18 nt, Mycobacterium tuberculosis H37Rv
ggccagcagcgcgggauc

SEQ ID NO: 3311901 - RNA, 17 nt, Mycobacterium tuberculosis H37Rv
ggccagcagggccacca

SEQ ID NO: 3311902 - RNA, 15 nt, Mycobacterium tuberculosis H37Rv
ggccagcagugcggu

SEQ ID NO: 3311903 - RNA, 22 nt, Mycobacterium tuberculosis H37Rv
ggccagcaucagcucgaugccg

SEQ ID NO: 3311904 - RNA, 14 nt, Mycobacterium tuberculosis H37Rv
ggccagcaucauca

SEQ ID NO: 3311905 - RNA, 16 nt, Mycobacterium tuberculosis H37Rv
ggccagcaucgcggug

SEQ ID NO: 3311906 - RNA, 20 nt, Mycobacterium tuberculosis H37Rv
ggccagcaugucgggccgcu

SEQ ID NO: 3311907 - RNA, 13 nt, Mycobacterium tuberculosis H37Rv
ggccagccacagc

SEQ ID NO: 3311908 - RNA, 17 nt, Mycobacterium tuberculosis H37Rv
ggccagccagcgggcga

SEQ ID NO: 3311909 - RNA, 23 nt, Mycobacterium tuberculosis H37Rv
ggccagccagcgggcgaugagcg

SEQ ID NO: 3311910 - RNA, 15 nt, Mycobacterium tuberculosis H37Rv
ggccagcccagccgg

SEQ ID NO: 3311911 - RNA, 13 nt, Mycobacterium tuberculosis H37Rv
ggccagcccgagc

SEQ ID NO: 3311912 - RNA, 14 nt, Mycobacterium tuberculosis H37Rv
ggccagcccgagcu

SEQ ID NO: 3311913 - RNA, 17 nt, Mycobacterium tuberculosis H37Rv
ggccagcccgagcucgg

SEQ ID NO: 3311914 - RNA, 11 nt, Mycobacterium tuberculosis H37Rv
ggccagccgac

SEQ ID NO: 3311915 - RNA, 19 nt, Mycobacterium tuberculosis H37Rv
ggccagccgacgcggcggg

SEQ ID NO: 3311916 - RNA, 15 nt, Mycobacterium tuberculosis H37Rv
ggccagccgcacggu

SEQ ID NO: 3311917 - RNA, 13 nt, Mycobacterium tuberculosis H37Rv
ggccagccgcggc

SEQ ID NO: 3311918 - RNA, 14 nt, Mycobacterium tuberculosis H37Rv
ggccagccgcggcc

SEQ ID NO: 3311919 - RNA, 15 nt, Mycobacterium tuberculosis H37Rv
ggccagccgcggccc

SEQ ID NO: 3311920 - RNA, 15 nt, Mycobacterium tuberculosis H37Rv
ggccagccgcucacc

SEQ ID NO: 3311921 - RNA, 15 nt, Mycobacterium tuberculosis H37Rv
ggccagccgcuccac

SEQ ID NO: 3311922 - RNA, 17 nt, Mycobacterium tuberculosis H37Rv
ggccagccgcuccacgu

SEQ ID NO: 3311923 - RNA, 15 nt, Mycobacterium tuberculosis H37Rv
ggccagccuaccggc

SEQ ID NO: 3311924 - RNA, 11 nt, Mycobacterium tuberculosis H37Rv
ggccagcgcau

SEQ ID NO: 3311925 - RNA, 14 nt, Mycobacterium tuberculosis H37Rv
ggccagcgcaucgg

SEQ ID NO: 3311926 - RNA, 14 nt, Mycobacterium tuberculosis H37Rv
ggccagcgcgcuca

SEQ ID NO: 3311927 - RNA, 12 nt, Mycobacterium tuberculosis H37Rv
ggccagcgcggc

SEQ ID NO: 3311928 - RNA, 14 nt, Mycobacterium tuberculosis H37Rv
ggccagcgcggcga

SEQ ID NO: 3311929 - RNA, 19 nt, Mycobacterium tuberculosis H37Rv
ggccagcgcggcgagggcg

SEQ ID NO: 3311930 - RNA, 21 nt, Mycobacterium tuberculosis H37Rv
ggccagcgcggcgcgcggggc

SEQ ID NO: 3311931 - RNA, 22 nt, Mycobacterium tuberculosis H37Rv
ggccagcgcggcgcgcggggcc

SEQ ID NO: 3311932 - RNA, 15 nt, Mycobacterium tuberculosis H37Rv
ggccagcgcggcguc

SEQ ID NO: 3311933 - RNA, 17 nt, Mycobacterium tuberculosis H37Rv
ggccagcgcgucgccgu

SEQ ID NO: 3311934 - RNA, 21 nt, Mycobacterium tuberculosis H37Rv
ggccagcgcgucgccgucgau

SEQ ID NO: 3311935 - RNA, 23 nt, Mycobacterium tuberculosis H37Rv
ggccagcgcgucgggaugcgcgu

SEQ ID NO: 3311936 - RNA, 19 nt, Mycobacterium tuberculosis H37Rv
ggccagcgcuucgucggcc

SEQ ID NO: 3311937 - RNA, 18 nt, Mycobacterium tuberculosis H37Rv
ggccagcggcagccuggc

SEQ ID NO: 3311938 - RNA, 21 nt, Mycobacterium tuberculosis H37Rv
ggccagcggccauccggcggc

SEQ ID NO: 3311939 - RNA, 13 nt, Mycobacterium tuberculosis H37Rv
ggccagcggguga

SEQ ID NO: 3311940 - RNA, 20 nt, Mycobacterium tuberculosis H37Rv
ggccagcgucaacagcgugg

SEQ ID NO: 3311941 - RNA, 17 nt, Mycobacterium tuberculosis H37Rv
ggccagcguguccgcca

SEQ ID NO: 3311942 - RNA, 16 nt, Mycobacterium tuberculosis H37Rv
ggccagcuccagcgcc

SEQ ID NO: 3311943 - RNA, 12 nt, Mycobacterium tuberculosis H37Rv
ggccagcucccg

SEQ ID NO: 3311944 - RNA, 18 nt, Mycobacterium tuberculosis H37Rv
ggccagcucccgcgagcg

SEQ ID NO: 3311945 - RNA, 19 nt, Mycobacterium tuberculosis H37Rv
ggccagcuccgugacaccg

SEQ ID NO: 3311946 - RNA, 18 nt, Mycobacterium tuberculosis H37Rv
ggcccagcaaccgcucgg

SEQ ID NO: 3311947 - RNA, 20 nt, Mycobacterium tuberculosis H37Rv
ggcccagcaaccgcucggcg

SEQ ID NO: 3311948 - RNA, 17 nt, Mycobacterium tuberculosis H37Rv
ggcccagccgagcggcg

SEQ ID NO: 3311949 - RNA, 18 nt, Mycobacterium tuberculosis H37Rv
ggcccagccgagcggcgg

SEQ ID NO: 3311950 - RNA, 19 nt, Mycobacterium tuberculosis H37Rv
ggcccagccgagcggcggc

SEQ ID NO: 3311951 - RNA, 21 nt, Mycobacterium tuberculosis H37Rv
ggcccagccggaccgcgacgg

SEQ ID NO: 3311952 - RNA, 21 nt, Mycobacterium tuberculosis H37Rv
ggcccagcgcccccagcagcu

SEQ ID NO: 3311953 - RNA, 11 nt, Mycobacterium tuberculosis H37Rv
ggcccagcgcg

SEQ ID NO: 3311954 - RNA, 12 nt, Mycobacterium tuberculosis H37Rv
ggcccagcgcgc

SEQ ID NO: 3311955 - RNA, 17 nt, Mycobacterium tuberculosis H37Rv
ggcccagcgcgccagcu

SEQ ID NO: 3311956 - RNA, 20 nt, Mycobacterium tuberculosis H37Rv
ggcccagcuagguccgaacu

SEQ ID NO: 3311957 - RNA, 17 nt, Mycobacterium tuberculosis H37Rv
ggcccaggcuguccgac

SEQ ID NO: 3311958 - RNA, 16 nt, Mycobacterium tuberculosis H37Rv
ggcccagguugccuug

SEQ ID NO: 3311959 - RNA, 22 nt, Mycobacterium tuberculosis H37Rv
ggcccagguugccuuggcggcc

SEQ ID NO: 3311960 - RNA, 18 nt, Mycobacterium tuberculosis H37Rv
ggcccagguugcggucuu

SEQ ID NO: 3311961 - RNA, 20 nt, Mycobacterium tuberculosis H37Rv
ggcccagugggacuggcgug

SEQ ID NO: 3311962 - RNA, 21 nt, Mycobacterium tuberculosis H37Rv
ggcccagugggacuggcguga

SEQ ID NO: 3311963 - RNA, 16 nt, Mycobacterium tuberculosis H37Rv
ggcccauaacagcugg

SEQ ID NO: 3311964 - RNA, 17 nt, Mycobacterium tuberculosis H37Rv
ggcccauaccgauggug

SEQ ID NO: 3311965 - RNA, 21 nt, Mycobacterium tuberculosis H37Rv
ggccccaagcgugcugccgcc

SEQ ID NO: 3311966 - RNA, 22 nt, Mycobacterium tuberculosis H37Rv
ggccccaagcgugcugccgccu

SEQ ID NO: 3311967 - RNA, 23 nt, Mycobacterium tuberculosis H37Rv
ggccccaagcgugcugccgccuu

SEQ ID NO: 3311968 - RNA, 13 nt, Mycobacterium tuberculosis H37Rv
ggccccaccgagc

SEQ ID NO: 3311969 - RNA, 16 nt, Mycobacterium tuberculosis H37Rv
ggccccaccgguaccg

SEQ ID NO: 3311970 - RNA, 13 nt, Mycobacterium tuberculosis H37Rv
ggccccaggggca

SEQ ID NO: 3311971 - RNA, 18 nt, Mycobacterium tuberculosis H37Rv
ggcccccacacaggcaga

SEQ ID NO: 3311972 - RNA, 20 nt, Mycobacterium tuberculosis H37Rv
ggccccccgcgccugccuca

SEQ ID NO: 3311973 - RNA, 12 nt, Mycobacterium tuberculosis H37Rv
ggccccgccagc

SEQ ID NO: 3311974 - RNA, 16 nt, Mycobacterium tuberculosis H37Rv
ggccccgccagcggca

SEQ ID NO: 3311975 - RNA, 18 nt, Mycobacterium tuberculosis H37Rv
ggccccgccagcggcagc

SEQ ID NO: 3311976 - RNA, 18 nt, Mycobacterium tuberculosis H37Rv
ggccccgccgaugccgcc

SEQ ID NO: 3311977 - RNA, 22 nt, Mycobacterium tuberculosis H37Rv
ggccccgccgaugccgccggcc

SEQ ID NO: 3311978 - RNA, 16 nt, Mycobacterium tuberculosis H37Rv
ggccccgccgauggag

SEQ ID NO: 3311979 - RNA, 15 nt, Mycobacterium tuberculosis H37Rv
ggccccgccggcgcc

SEQ ID NO: 3311980 - RNA, 15 nt, Mycobacterium tuberculosis H37Rv
ggccccgccgucacc

SEQ ID NO: 3311981 - RNA, 18 nt, Mycobacterium tuberculosis H37Rv
ggccccgccguugccgcc

SEQ ID NO: 3311982 - RNA, 23 nt, Mycobacterium tuberculosis H37Rv
ggccccgccguuuccgccgccgc

SEQ ID NO: 3311983 - RNA, 16 nt, Mycobacterium tuberculosis H37Rv
ggccccgcgcagcguc

SEQ ID NO: 3311984 - RNA, 18 nt, Mycobacterium tuberculosis H37Rv
ggccccgcgccggccgca

SEQ ID NO: 3311985 - RNA, 13 nt, Mycobacterium tuberculosis H37Rv
ggccccgcggagc

SEQ ID NO: 3311986 - RNA, 20 nt, Mycobacterium tuberculosis H37Rv
ggccccgcggcgccgccacg

SEQ ID NO: 3311987 - RNA, 14 nt, Mycobacterium tuberculosis H37Rv
ggccccggugacgc

SEQ ID NO: 3311988 - RNA, 19 nt, Mycobacterium tuberculosis H37Rv
ggccccggugacgccgucg

SEQ ID NO: 3311989 - RNA, 19 nt, Mycobacterium tuberculosis H37Rv
ggccccgguggugcugccg

SEQ ID NO: 3311990 - RNA, 20 nt, Mycobacterium tuberculosis H37Rv
ggccccguccgauuucccag

SEQ ID NO: 3311991 - RNA, 15 nt, Mycobacterium tuberculosis H37Rv
ggccccgucgccgau

SEQ ID NO: 3311992 - RNA, 16 nt, Mycobacterium tuberculosis H37Rv
ggccccgucgccgauc

SEQ ID NO: 3311993 - RNA, 12 nt, Mycobacterium tuberculosis H37Rv
ggcccgaaacga

SEQ ID NO: 3311994 - RNA, 20 nt, Mycobacterium tuberculosis H37Rv
ggcccgaaaugccgggcccg

SEQ ID NO: 3311995 - RNA, 21 nt, Mycobacterium tuberculosis H37Rv
ggcccgaaaugccgggcccga

SEQ ID NO: 3311996 - RNA, 20 nt, Mycobacterium tuberculosis H37Rv
ggcccgaagaucuccuccug

SEQ ID NO: 3311997 - RNA, 20 nt, Mycobacterium tuberculosis H37Rv
ggcccgaaucgccugccaca

SEQ ID NO: 3311998 - RNA, 16 nt, Mycobacterium tuberculosis H37Rv
ggcccgacacggcggc

SEQ ID NO: 3311999 - RNA, 20 nt, Mycobacterium tuberculosis H37Rv
ggcccgaccuguccacccag

SEQ ID NO: 3312000 - RNA, 14 nt, Mycobacterium tuberculosis H37Rv
ggcccgacgacgac

SEQ ID NO: 3312001 - RNA, 17 nt, Mycobacterium tuberculosis H37Rv
ggcccgacgacgacguu

SEQ ID NO: 3312002 - RNA, 18 nt, Mycobacterium tuberculosis H37Rv
ggcccgacggcgcccagc

SEQ ID NO: 3312003 - RNA, 22 nt, Mycobacterium tuberculosis H37Rv
ggcccgacggguaucccguccc

SEQ ID NO: 3312004 - RNA, 22 nt, Mycobacterium tuberculosis H37Rv
ggcccgagccgcgugggccgcu

SEQ ID NO: 3312005 - RNA, 17 nt, Mycobacterium tuberculosis H37Rv
ggcccgaggcggguaca

SEQ ID NO: 3312006 - RNA, 23 nt, Mycobacterium tuberculosis H37Rv
ggcccgaggugccggggccccau

SEQ ID NO: 3312007 - RNA, 22 nt, Mycobacterium tuberculosis H37Rv
ggcccgaguuggcgaagcccga

SEQ ID NO: 3312008 - RNA, 23 nt, Mycobacterium tuberculosis H37Rv
ggcccgauaaaugccgcgugggc

SEQ ID NO: 3312009 - RNA, 12 nt, Mycobacterium tuberculosis H37Rv
ggcccgauccag

SEQ ID NO: 3312010 - RNA, 13 nt, Mycobacterium tuberculosis H37Rv
ggcccgauccagu

SEQ ID NO: 3312011 - RNA, 17 nt, Mycobacterium tuberculosis H37Rv
ggcccgaucccgaucga

SEQ ID NO: 3312012 - RNA, 19 nt, Mycobacterium tuberculosis H37Rv
ggcccgaucgaccgcugga

SEQ ID NO: 3312013 - RNA, 15 nt, Mycobacterium tuberculosis H37Rv
ggcccgaucggcaac

SEQ ID NO: 3312014 - RNA, 18 nt, Mycobacterium tuberculosis H37Rv
ggcccgaucugagcugcc

SEQ ID NO: 3312015 - RNA, 13 nt, Mycobacterium tuberculosis H37Rv
ggcccgaugaccg

SEQ ID NO: 3312016 - RNA, 15 nt, Mycobacterium tuberculosis H37Rv
ggcccgaugaccggu

SEQ ID NO: 3312017 - RNA, 16 nt, Mycobacterium tuberculosis H37Rv
ggcccgaugccgagga

SEQ ID NO: 3312018 - RNA, 21 nt, Mycobacterium tuberculosis H37Rv
ggcccgauugaguucggcggc

SEQ ID NO: 3312019 - RNA, 22 nt, Mycobacterium tuberculosis H37Rv
ggcccgauugaguucggcggcc

SEQ ID NO: 3312020 - RNA, 21 nt, Mycobacterium tuberculosis H37Rv
ggcccgcaacgcgucggucgc

SEQ ID NO: 3312021 - RNA, 15 nt, Mycobacterium tuberculosis H37Rv
ggcccgcacgaaccg

SEQ ID NO: 3312022 - RNA, 20 nt, Mycobacterium tuberculosis H37Rv
ggcccgcacgaaccggucga

SEQ ID NO: 3312023 - RNA, 12 nt, Mycobacterium tuberculosis H37Rv
ggcccgcacggc

SEQ ID NO: 3312024 - RNA, 21 nt, Mycobacterium tuberculosis H37Rv
ggcccgcacggccgcagccga

SEQ ID NO: 3312025 - RNA, 16 nt, Mycobacterium tuberculosis H37Rv
ggcccgcacguuggcg

SEQ ID NO: 3312026 - RNA, 19 nt, Mycobacterium tuberculosis H37Rv
ggcccgcacguuggcggcc

SEQ ID NO: 3312027 - RNA, 19 nt, Mycobacterium tuberculosis H37Rv
ggcccgcagccaaguccgc

SEQ ID NO: 3312028 - RNA, 15 nt, Mycobacterium tuberculosis H37Rv
ggcccgcauccgcac

SEQ ID NO: 3312029 - RNA, 12 nt, Mycobacterium tuberculosis H37Rv
ggcccgcaucgu

SEQ ID NO: 3312030 - RNA, 20 nt, Mycobacterium tuberculosis H37Rv
ggcccgccacaacggcggcg

SEQ ID NO: 3312031 - RNA, 17 nt, Mycobacterium tuberculosis H37Rv
ggcccgccacgaugucg

SEQ ID NO: 3312032 - RNA, 20 nt, Mycobacterium tuberculosis H37Rv
ggcccgccagaacggcgucg

SEQ ID NO: 3312033 - RNA, 18 nt, Mycobacterium tuberculosis H37Rv
ggcccgccagcagggcca

SEQ ID NO: 3312034 - RNA, 13 nt, Mycobacterium tuberculosis H37Rv
ggcccgccagccc

SEQ ID NO: 3312035 - RNA, 21 nt, Mycobacterium tuberculosis H37Rv
ggcccgccaucauggcggccc

SEQ ID NO: 3312036 - RNA, 12 nt, Mycobacterium tuberculosis H37Rv
ggcccgcccgua

SEQ ID NO: 3312037 - RNA, 14 nt, Mycobacterium tuberculosis H37Rv
ggcccgccggcccc

SEQ ID NO: 3312038 - RNA, 21 nt, Mycobacterium tuberculosis H37Rv
ggcccgccggccccgccggcc

SEQ ID NO: 3312039 - RNA, 21 nt, Mycobacterium tuberculosis H37Rv
ggcccgccgucaccgccguug

SEQ ID NO: 3312040 - RNA, 14 nt, Mycobacterium tuberculosis H37Rv
ggcccgccgucccc

SEQ ID NO: 3312041 - RNA, 20 nt, Mycobacterium tuberculosis H37Rv
ggcccgcgaauacgaggacg

SEQ ID NO: 3312042 - RNA, 14 nt, Mycobacterium tuberculosis H37Rv
ggccgaccgcgcac

SEQ ID NO: 3312043 - RNA, 14 nt, Mycobacterium tuberculosis H37Rv
ggccgacgauagcg

SEQ ID NO: 3312044 - RNA, 18 nt, Mycobacterium tuberculosis H37Rv
ggccgacgauagcggccc

SEQ ID NO: 3312045 - RNA, 14 nt, Mycobacterium tuberculosis H37Rv
ggccgacgaugugc

SEQ ID NO: 3312046 - RNA, 16 nt, Mycobacterium tuberculosis H37Rv
ggccgacgggacaacc

SEQ ID NO: 3312047 - RNA, 19 nt, Mycobacterium tuberculosis H37Rv
ggccgacgggacaacccgu

SEQ ID NO: 3312048 - RNA, 18 nt, Mycobacterium tuberculosis H37Rv
ggccgacgucgaccacug

SEQ ID NO: 3312049 - RNA, 23 nt, Mycobacterium tuberculosis H37Rv
ggccgagacggcguugucgacga

SEQ ID NO: 3312050 - RNA, 18 nt, Mycobacterium tuberculosis H37Rv
ggccgagagcagccagcc

SEQ ID NO: 3312051 - RNA, 20 nt, Mycobacterium tuberculosis H37Rv
ggccgagagcagccagccac

SEQ ID NO: 3312052 - RNA, 15 nt, Mycobacterium tuberculosis H37Rv
ggccgagaucacgcc

SEQ ID NO: 3312053 - RNA, 17 nt, Mycobacterium tuberculosis H37Rv
ggccgagcauccgacac

SEQ ID NO: 3312054 - RNA, 13 nt, Mycobacterium tuberculosis H37Rv
ggccgagcccggu

SEQ ID NO: 3312055 - RNA, 15 nt, Mycobacterium tuberculosis H37Rv
ggccgagccgcccgc

SEQ ID NO: 3312056 - RNA, 18 nt, Mycobacterium tuberculosis H37Rv
ggccgagcgcaccacggc

SEQ ID NO: 3312057 - RNA, 19 nt, Mycobacterium tuberculosis H37Rv
ggccgagcgcaccgcugac

SEQ ID NO: 3312058 - RNA, 12 nt, Mycobacterium tuberculosis H37Rv
ggccgagcgcga

SEQ ID NO: 3312059 - RNA, 21 nt, Mycobacterium tuberculosis H37Rv
ggccgagcggagacuccagca

SEQ ID NO: 3312060 - RNA, 17 nt, Mycobacterium tuberculosis H37Rv
ggccgaguccggcaaga

SEQ ID NO: 3312061 - RNA, 20 nt, Mycobacterium tuberculosis H37Rv
ggccgaguucgucagcggcc

SEQ ID NO: 3312062 - RNA, 17 nt, Mycobacterium tuberculosis H37Rv
ggccgaucagcgcggcg

SEQ ID NO: 3312063 - RNA, 17 nt, Mycobacterium tuberculosis H37Rv
ggccgaucagcguggcg

SEQ ID NO: 3312064 - RNA, 19 nt, Mycobacterium tuberculosis H37Rv
ggccgaucucuccggcggc

SEQ ID NO: 3312065 - RNA, 20 nt, Mycobacterium tuberculosis H37Rv
ggccgaucucuccggcggcg

SEQ ID NO: 3312066 - RNA, 19 nt, Mycobacterium tuberculosis H37Rv
ggccgauggugugcacggc

SEQ ID NO: 3312067 - RNA, 16 nt, Mycobacterium tuberculosis H37Rv
ggccgauuccgcgcgu

SEQ ID NO: 3312068 - RNA, 21 nt, Mycobacterium tuberculosis H37Rv
ggccgauuccgcgcguccguc

SEQ ID NO: 3312069 - RNA, 15 nt, Mycobacterium tuberculosis H37Rv
ggccgcaagccgcga

SEQ ID NO: 3312070 - RNA, 21 nt, Mycobacterium tuberculosis H37Rv
ggccgcaaggcgccgauaccg

SEQ ID NO: 3312071 - RNA, 21 nt, Mycobacterium tuberculosis H37Rv
ggccgcaaucaugucagcgcu

SEQ ID NO: 3312072 - RNA, 15 nt, Mycobacterium tuberculosis H37Rv
ggccgcaaugcguug

SEQ ID NO: 3312073 - RNA, 15 nt, Mycobacterium tuberculosis H37Rv
ggccgcaccagcauu

SEQ ID NO: 3312074 - RNA, 19 nt, Mycobacterium tuberculosis H37Rv
ggccgcacgccggccagcg

SEQ ID NO: 3312075 - RNA, 15 nt, Mycobacterium tuberculosis H37Rv
ggccgcacgggcgac

SEQ ID NO: 3312076 - RNA, 21 nt, Mycobacterium tuberculosis H37Rv
ggccgcacgggcgaccugcgg

SEQ ID NO: 3312077 - RNA, 15 nt, Mycobacterium tuberculosis H37Rv
ggccgcacggucagc

SEQ ID NO: 3312078 - RNA, 23 nt, Mycobacterium tuberculosis H37Rv
ggccgcacggucagcgcgcacga

SEQ ID NO: 3312079 - RNA, 17 nt, Mycobacterium tuberculosis H37Rv
ggccgcacugcugguca

SEQ ID NO: 3312080 - RNA, 20 nt, Mycobacterium tuberculosis H37Rv
ggccgcacuuucuuccucgg

SEQ ID NO: 3312081 - RNA, 21 nt, Mycobacterium tuberculosis H37Rv
ggccgcacuuucuuccucggg

SEQ ID NO: 3312082 - RNA, 16 nt, Mycobacterium tuberculosis H37Rv
ggccgcagccagcaag

SEQ ID NO: 3312083 - RNA, 22 nt, Mycobacterium tuberculosis H37Rv
ggccgcagccagcaagucugcc

SEQ ID NO: 3312084 - RNA, 16 nt, Mycobacterium tuberculosis H37Rv
ggccgcagcggccagc

SEQ ID NO: 3312085 - RNA, 17 nt, Mycobacterium tuberculosis H37Rv
ggccgcagcggccagcc

SEQ ID NO: 3312086 - RNA, 13 nt, Mycobacterium tuberculosis H37Rv
ggccgcaggccag

SEQ ID NO: 3312087 - RNA, 14 nt, Mycobacterium tuberculosis H37Rv
ggccgcaggccagc

SEQ ID NO: 3312088 - RNA, 20 nt, Mycobacterium tuberculosis H37Rv
ggccgcauauugcggcgccg

SEQ ID NO: 3312089 - RNA, 15 nt, Mycobacterium tuberculosis H37Rv
ggccgcaucgacgcu

SEQ ID NO: 3312090 - RNA, 23 nt, Mycobacterium tuberculosis H37Rv
ggccgcaucgacgcucaucucgg

SEQ ID NO: 3312091 - RNA, 20 nt, Mycobacterium tuberculosis H37Rv
ggccgcaucgccucaccacg

SEQ ID NO: 3312092 - RNA, 23 nt, Mycobacterium tuberculosis H37Rv
ggccgcaucggucaaugccacua

SEQ ID NO: 3312093 - RNA, 15 nt, Mycobacterium tuberculosis H37Rv
ggccgcaugccacgg

SEQ ID NO: 3312094 - RNA, 18 nt, Mycobacterium tuberculosis H37Rv
ggccgcauuagccugcgu

SEQ ID NO: 3312095 - RNA, 20 nt, Mycobacterium tuberculosis H37Rv
ggccgccacaccgccgccaa

SEQ ID NO: 3312096 - RNA, 13 nt, Mycobacterium tuberculosis H37Rv
ggccgccaccgcg

SEQ ID NO: 3312097 - RNA, 19 nt, Mycobacterium tuberculosis H37Rv
ggccgccaccgcgacgagc

SEQ ID NO: 3312098 - RNA, 19 nt, Mycobacterium tuberculosis H37Rv
ggccgccaccgucaccgcc

SEQ ID NO: 3312099 - RNA, 21 nt, Mycobacterium tuberculosis H37Rv
ggccgccaccgucaccgccgu

SEQ ID NO: 3312100 - RNA, 17 nt, Mycobacterium tuberculosis H37Rv
ggccgccaccucccagg

SEQ ID NO: 3312101 - RNA, 13 nt, Mycobacterium tuberculosis H37Rv
ggccgccagccgg

SEQ ID NO: 3312102 - RNA, 12 nt, Mycobacterium tuberculosis H37Rv
ggccgccagcgc

SEQ ID NO: 3312103 - RNA, 13 nt, Mycobacterium tuberculosis H37Rv
ggccgccagcgca

SEQ ID NO: 3312104 - RNA, 16 nt, Mycobacterium tuberculosis H37Rv
ggccgccagcgcacga

SEQ ID NO: 3312105 - RNA, 22 nt, Mycobacterium tuberculosis H37Rv
ggccgccagcgcgccgaucacg

SEQ ID NO: 3312106 - RNA, 18 nt, Mycobacterium tuberculosis H37Rv
ggccgccaguucggcguc

SEQ ID NO: 3312107 - RNA, 19 nt, Mycobacterium tuberculosis H37Rv
ggccgccauccccuggcca

SEQ ID NO: 3312108 - RNA, 22 nt, Mycobacterium tuberculosis H37Rv
ggccgccauccccuggccagca

SEQ ID NO: 3312109 - RNA, 14 nt, Mycobacterium tuberculosis H37Rv
ggccgcccagaugu

SEQ ID NO: 3312110 - RNA, 22 nt, Mycobacterium tuberculosis H37Rv
ggccgccccaggcugguccggg

SEQ ID NO: 3312111 - RNA, 23 nt, Mycobacterium tuberculosis H37Rv
ggccgccccaggcugguccgggu

SEQ ID NO: 3312112 - RNA, 16 nt, Mycobacterium tuberculosis H37Rv
ggccgcccgcucgaug

SEQ ID NO: 3312113 - RNA, 16 nt, Mycobacterium tuberculosis H37Rv
ggccgcccggcgagca

SEQ ID NO: 3312114 - RNA, 13 nt, Mycobacterium tuberculosis H37Rv
ggccgcccguaga

SEQ ID NO: 3312115 - RNA, 18 nt, Mycobacterium tuberculosis H37Rv
ggccgccgaaacucacca

SEQ ID NO: 3312116 - RNA, 20 nt, Mycobacterium tuberculosis H37Rv
ggccgccgaccggagccgcc

SEQ ID NO: 3312117 - RNA, 23 nt, Mycobacterium tuberculosis H37Rv
ggccgccgacuccccgccgggca

SEQ ID NO: 3312118 - RNA, 12 nt, Mycobacterium tuberculosis H37Rv
ggccgccgagga

SEQ ID NO: 3312119 - RNA, 17 nt, Mycobacterium tuberculosis H37Rv
ggccgccgaugccaccg

SEQ ID NO: 3312120 - RNA, 20 nt, Mycobacterium tuberculosis H37Rv
ggccgccgaugccaccgcuu

SEQ ID NO: 3312121 - RNA, 15 nt, Mycobacterium tuberculosis H37Rv
ggccgccgccccggc

SEQ ID NO: 3312122 - RNA, 20 nt, Mycobacterium tuberculosis H37Rv
ggccgccgcgauggccccug

SEQ ID NO: 3312123 - RNA, 14 nt, Mycobacterium tuberculosis H37Rv
ggccgccgcgcacc

SEQ ID NO: 3312124 - RNA, 13 nt, Mycobacterium tuberculosis H37Rv
ggccgccgcggcg

SEQ ID NO: 3312125 - RNA, 14 nt, Mycobacterium tuberculosis H37Rv
ggccgccgcgucga

SEQ ID NO: 3312126 - RNA, 13 nt, Mycobacterium tuberculosis H37Rv
ggccgccgcugcc

SEQ ID NO: 3312127 - RNA, 15 nt, Mycobacterium tuberculosis H37Rv
ggccgccgcugccgc

SEQ ID NO: 3312128 - RNA, 15 nt, Mycobacterium tuberculosis H37Rv
ggccgccggacccgu

SEQ ID NO: 3312129 - RNA, 18 nt, Mycobacterium tuberculosis H37Rv
ggccgccggacccgucga

SEQ ID NO: 3312130 - RNA, 14 nt, Mycobacterium tuberculosis H37Rv
ggccgccggccagc

SEQ ID NO: 3312131 - RNA, 14 nt, Mycobacterium tuberculosis H37Rv
ggccgccggccgcg

SEQ ID NO: 3312132 - RNA, 13 nt, Mycobacterium tuberculosis H37Rv
ggccgccggcgcc

SEQ ID NO: 3312133 - RNA, 14 nt, Mycobacterium tuberculosis H37Rv
ggccgccggcgccg

SEQ ID NO: 3312134 - RNA, 16 nt, Mycobacterium tuberculosis H37Rv
ggccgccggguccgga

SEQ ID NO: 3312135 - RNA, 20 nt, Mycobacterium tuberculosis H37Rv
ggccgccggguccggaaccg

SEQ ID NO: 3312136 - RNA, 12 nt, Mycobacterium tuberculosis H37Rv
ggccgccggucc

SEQ ID NO: 3312137 - RNA, 13 nt, Mycobacterium tuberculosis H37Rv
ggccgccgucccc

SEQ ID NO: 3312138 - RNA, 15 nt, Mycobacterium tuberculosis H37Rv
ggccgucgcuggugu

SEQ ID NO: 3312139 - RNA, 13 nt, Mycobacterium tuberculosis H37Rv
ggccgucggcguc

SEQ ID NO: 3312140 - RNA, 20 nt, Mycobacterium tuberculosis H37Rv
ggccgucggggaguucgcgc

SEQ ID NO: 3312141 - RNA, 20 nt, Mycobacterium tuberculosis H37Rv
ggccgucgggugcagcacgg

SEQ ID NO: 3312142 - RNA, 15 nt, Mycobacterium tuberculosis H37Rv
ggccgucgucgguca

SEQ ID NO: 3312143 - RNA, 18 nt, Mycobacterium tuberculosis H37Rv
ggccgucgucggucaccg

SEQ ID NO: 3312144 - RNA, 15 nt, Mycobacterium tuberculosis H37Rv
ggccgucucgccgug

SEQ ID NO: 3312145 - RNA, 16 nt, Mycobacterium tuberculosis H37Rv
ggccgucucggcaugc

SEQ ID NO: 3312146 - RNA, 17 nt, Mycobacterium tuberculosis H37Rv
ggccgucucggcaugcu

SEQ ID NO: 3312147 - RNA, 17 nt, Mycobacterium tuberculosis H37Rv
ggccgucuugccggcca

SEQ ID NO: 3312148 - RNA, 22 nt, Mycobacterium tuberculosis H37Rv
ggccgugaagggauccggaagc

SEQ ID NO: 3312149 - RNA, 14 nt, Mycobacterium tuberculosis H37Rv
ggccgugaccgagc

SEQ ID NO: 3312150 - RNA, 16 nt, Mycobacterium tuberculosis H37Rv
ggccgugaccgagccg

SEQ ID NO: 3312151 - RNA, 18 nt, Mycobacterium tuberculosis H37Rv
ggccgugaccgagccgcg

SEQ ID NO: 3312152 - RNA, 19 nt, Mycobacterium tuberculosis H37Rv
ggccgugagcccggcgauc

SEQ ID NO: 3312153 - RNA, 16 nt, Mycobacterium tuberculosis H37Rv
ggccgugaugccacgg

SEQ ID NO: 3312154 - RNA, 19 nt, Mycobacterium tuberculosis H37Rv
ggccgugaugccacggcgu

SEQ ID NO: 3312155 - RNA, 21 nt, Mycobacterium tuberculosis H37Rv
ggccgugaugccacggcgucg

SEQ ID NO: 3312156 - RNA, 15 nt, Mycobacterium tuberculosis H37Rv
ggccguggcuggacc

SEQ ID NO: 3312157 - RNA, 24 nt, Mycobacterium tuberculosis H37Rv
ggccguggcuggacccgcauggcg

SEQ ID NO: 3312158 - RNA, 18 nt, Mycobacterium tuberculosis H37Rv
ggccguguacgugcucgu

SEQ ID NO: 3312159 - RNA, 17 nt, Mycobacterium tuberculosis H37Rv
ggccgugucgggcgcga

SEQ ID NO: 3312160 - RNA, 19 nt, Mycobacterium tuberculosis H37Rv
ggccguguucuaccugcac

SEQ ID NO: 3312161 - RNA, 20 nt, Mycobacterium tuberculosis H37Rv
ggccguguucuaccugcacc

SEQ ID NO: 3312162 - RNA, 16 nt, Mycobacterium tuberculosis H37Rv
ggccguugacgguguc

SEQ ID NO: 3312163 - RNA, 24 nt, Mycobacterium tuberculosis H37Rv
ggccguugccaacaacaucagcga

SEQ ID NO: 3312164 - RNA, 17 nt, Mycobacterium tuberculosis H37Rv
ggccguugccccgucgu

SEQ ID NO: 3312165 - RNA, 23 nt, Mycobacterium tuberculosis H37Rv
ggccguugcuauucgccagcgcc

SEQ ID NO: 3312166 - RNA, 22 nt, Mycobacterium tuberculosis H37Rv
ggccguuggcggcgguggccag

SEQ ID NO: 3312167 - RNA, 20 nt, Mycobacterium tuberculosis H37Rv
ggccguugggccaccggcgc

SEQ ID NO: 3312168 - RNA, 15 nt, Mycobacterium tuberculosis H37Rv
ggccguuucggcgcc

SEQ ID NO: 3312169 - RNA, 18 nt, Mycobacterium tuberculosis H37Rv
ggccuaacucgccugcac

SEQ ID NO: 3312170 - RNA, 22 nt, Mycobacterium tuberculosis H37Rv
ggccuaccaggcgcggcccagg

SEQ ID NO: 3312171 - RNA, 16 nt, Mycobacterium tuberculosis H37Rv
ggccuagcaugaggcc

SEQ ID NO: 3312172 - RNA, 14 nt, Mycobacterium tuberculosis H37Rv
ggccuagccgcggc

SEQ ID NO: 3312173 - RNA, 17 nt, Mycobacterium tuberculosis H37Rv
ggccuagccgcggcacc

SEQ ID NO: 3312174 - RNA, 15 nt, Mycobacterium tuberculosis H37Rv
ggccuaggacgccgc

SEQ ID NO: 3312175 - RNA, 14 nt, Mycobacterium tuberculosis H37Rv
ggccuaggccgagg

SEQ ID NO: 3312176 - RNA, 16 nt, Mycobacterium tuberculosis H37Rv
ggccuagggcggcggc

SEQ ID NO: 3312177 - RNA, 18 nt, Mycobacterium tuberculosis H37Rv
ggccuaggucgacgccga

SEQ ID NO: 3312178 - RNA, 19 nt, Mycobacterium tuberculosis H37Rv
ggccuaggucgacgccgac

SEQ ID NO: 3312179 - RNA, 16 nt, Mycobacterium tuberculosis H37Rv
ggccucaacgccagcu

SEQ ID NO: 3312180 - RNA, 19 nt, Mycobacterium tuberculosis H37Rv
ggccucagacaacggguug

SEQ ID NO: 3312181 - RNA, 13 nt, Mycobacterium tuberculosis H37Rv
ggccucagcccgg

SEQ ID NO: 3312182 - RNA, 16 nt, Mycobacterium tuberculosis H37Rv
ggccucagcccggcca

SEQ ID NO: 3312183 - RNA, 19 nt, Mycobacterium tuberculosis H37Rv
ggccucagcccggccagcc

SEQ ID NO: 3312184 - RNA, 21 nt, Mycobacterium tuberculosis H37Rv
ggccuccacauacgcggcggc

SEQ ID NO: 3312185 - RNA, 21 nt, Mycobacterium tuberculosis H37Rv
ggccuccacccgccacgguuc

SEQ ID NO: 3312186 - RNA, 14 nt, Mycobacterium tuberculosis H37Rv
ggccuccaucgcga

SEQ ID NO: 3312187 - RNA, 13 nt, Mycobacterium tuberculosis H37Rv
ggccucccacggc

SEQ ID NO: 3312188 - RNA, 17 nt, Mycobacterium tuberculosis H37Rv
ggccucccacggcgcgu

SEQ ID NO: 3312189 - RNA, 18 nt, Mycobacterium tuberculosis H37Rv
ggccucccacucacccag

SEQ ID NO: 3312190 - RNA, 14 nt, Mycobacterium tuberculosis H37Rv
ggccucccgggccg

SEQ ID NO: 3312191 - RNA, 15 nt, Mycobacterium tuberculosis H37Rv
ggccuccgcugccgc

SEQ ID NO: 3312192 - RNA, 16 nt, Mycobacterium tuberculosis H37Rv
ggccuccgcugccgcc

SEQ ID NO: 3312193 - RNA, 11 nt, Mycobacterium tuberculosis H37Rv
ggccuccucgu

SEQ ID NO: 3312194 - RNA, 16 nt, Mycobacterium tuberculosis H37Rv
ggccuccucgucgcuc

SEQ ID NO: 3312195 - RNA, 20 nt, Mycobacterium tuberculosis H37Rv
ggccuccugcuggcccugcu

SEQ ID NO: 3312196 - RNA, 20 nt, Mycobacterium tuberculosis H37Rv
ggccucgaagggcuugucgc

SEQ ID NO: 3312197 - RNA, 23 nt, Mycobacterium tuberculosis H37Rv
ggccucgaagggcuugucgccgg

SEQ ID NO: 3312198 - RNA, 17 nt, Mycobacterium tuberculosis H37Rv
ggccucgaccgccagcc

SEQ ID NO: 3312199 - RNA, 19 nt, Mycobacterium tuberculosis H37Rv
ggccucgcugggcucaugg

SEQ ID NO: 3312200 - RNA, 15 nt, Mycobacterium tuberculosis H37Rv
ggccucggccagcgu

SEQ ID NO: 3312201 - RNA, 16 nt, Mycobacterium tuberculosis H37Rv
ggccucggccagcguc

SEQ ID NO: 3312202 - RNA, 18 nt, Mycobacterium tuberculosis H37Rv
ggccucggccagcgucag

SEQ ID NO: 3312203 - RNA, 23 nt, Mycobacterium tuberculosis H37Rv
ggccucggccagcgucagcuguu

SEQ ID NO: 3312204 - RNA, 16 nt, Mycobacterium tuberculosis H37Rv
ggccucggcgagcacg

SEQ ID NO: 3312205 - RNA, 16 nt, Mycobacterium tuberculosis H37Rv
ggccucggcgccgucg

SEQ ID NO: 3312206 - RNA, 19 nt, Mycobacterium tuberculosis H37Rv
ggccucggggaucgcaagc

SEQ ID NO: 3312207 - RNA, 23 nt, Mycobacterium tuberculosis H37Rv
ggccucggucugguggucggcga

SEQ ID NO: 3312208 - RNA, 16 nt, Mycobacterium tuberculosis H37Rv
ggccucguccagcucg

SEQ ID NO: 3312209 - RNA, 14 nt, Mycobacterium tuberculosis H37Rv
ggccucgucgaugu

SEQ ID NO: 3312210 - RNA, 15 nt, Mycobacterium tuberculosis H37Rv
ggccucgucgugcac

SEQ ID NO: 3312211 - RNA, 23 nt, Mycobacterium tuberculosis H37Rv
ggccucgucgugcaccucguccc

SEQ ID NO: 3312212 - RNA, 17 nt, Mycobacterium tuberculosis H37Rv
ggccucguuguagccga

SEQ ID NO: 3312213 - RNA, 16 nt, Mycobacterium tuberculosis H37Rv
ggccugaaccacgcgu

SEQ ID NO: 3312214 - RNA, 15 nt, Mycobacterium tuberculosis H37Rv
ggccugaccggucac

SEQ ID NO: 3312215 - RNA, 16 nt, Mycobacterium tuberculosis H37Rv
ggccugagcggccauc

SEQ ID NO: 3312216 - RNA, 20 nt, Mycobacterium tuberculosis H37Rv
ggccugagcgucgucgccgg

SEQ ID NO: 3312217 - RNA, 22 nt, Mycobacterium tuberculosis H37Rv
ggccugcaacgucacucccugg

SEQ ID NO: 3312218 - RNA, 17 nt, Mycobacterium tuberculosis H37Rv
ggccugcaccacggcgg

SEQ ID NO: 3312219 - RNA, 18 nt, Mycobacterium tuberculosis H37Rv
ggccugcaccacggcggc

SEQ ID NO: 3312220 - RNA, 20 nt, Mycobacterium tuberculosis H37Rv
ggccugcaccagcgaguuga

SEQ ID NO: 3312221 - RNA, 16 nt, Mycobacterium tuberculosis H37Rv
ggccugcacgccggcg

SEQ ID NO: 3312222 - RNA, 18 nt, Mycobacterium tuberculosis H37Rv
ggccugcagccgaugcuc

SEQ ID NO: 3312223 - RNA, 17 nt, Mycobacterium tuberculosis H37Rv
ggccugcagcgaugacg

SEQ ID NO: 3312224 - RNA, 13 nt, Mycobacterium tuberculosis H37Rv
ggccugcccagca

SEQ ID NO: 3312225 - RNA, 23 nt, Mycobacterium tuberculosis H37Rv
ggccugcccccggcgcggcggac

SEQ ID NO: 3312226 - RNA, 16 nt, Mycobacterium tuberculosis H37Rv
ggccugccgcucgccg

SEQ ID NO: 3312227 - RNA, 22 nt, Mycobacterium tuberculosis H37Rv
ggccugcgaacacgcgaugacg

SEQ ID NO: 3312228 - RNA, 17 nt, Mycobacterium tuberculosis H37Rv
ggccugcgacgagccca

SEQ ID NO: 3312229 - RNA, 14 nt, Mycobacterium tuberculosis H37Rv
ggccugcgcagacu

SEQ ID NO: 3312230 - RNA, 13 nt, Mycobacterium tuberculosis H37Rv
ggccugcgccggc

SEQ ID NO: 3312231 - RNA, 13 nt, Mycobacterium tuberculosis H37Rv
ggccugcgcgacc

SEQ ID NO: 3312232 - RNA, 18 nt, Mycobacterium tuberculosis H37Rv
ggccugcgcgaccgacca

SEQ ID NO: 3312233 - RNA, 19 nt, Mycobacterium tuberculosis H37Rv
ggccugcgcgaccgaccag

SEQ ID NO: 3312234 - RNA, 20 nt, Mycobacterium tuberculosis H37Rv
ggcgaccugccggaccgcgg

SEQ ID NO: 3312235 - RNA, 22 nt, Mycobacterium tuberculosis H37Rv
ggcgaccugcgcgagguuggcg

SEQ ID NO: 3312236 - RNA, 16 nt, Mycobacterium tuberculosis H37Rv
ggcgaccugcucgcug

SEQ ID NO: 3312237 - RNA, 23 nt, Mycobacterium tuberculosis H37Rv
ggcgacgaagaagaacucggcgu

SEQ ID NO: 3312238 - RNA, 21 nt, Mycobacterium tuberculosis H37Rv
ggcgacgaaguccccguaguc

SEQ ID NO: 3312239 - RNA, 15 nt, Mycobacterium tuberculosis H37Rv
ggcgacgacccgggu

SEQ ID NO: 3312240 - RNA, 20 nt, Mycobacterium tuberculosis H37Rv
ggcgacgacccgggucggca

SEQ ID NO: 3312241 - RNA, 18 nt, Mycobacterium tuberculosis H37Rv
ggcgacgaccgucggcuc

SEQ ID NO: 3312242 - RNA, 12 nt, Mycobacterium tuberculosis H37Rv
ggcgacgacgac

SEQ ID NO: 3312243 - RNA, 16 nt, Mycobacterium tuberculosis H37Rv
ggcgacgacggccugc

SEQ ID NO: 3312244 - RNA, 21 nt, Mycobacterium tuberculosis H37Rv
ggcgacgagaucugcgauggg

SEQ ID NO: 3312245 - RNA, 11 nt, Mycobacterium tuberculosis H37Rv
ggcgacgaggc

SEQ ID NO: 3312246 - RNA, 16 nt, Mycobacterium tuberculosis H37Rv
ggcgacgaugucgagc

SEQ ID NO: 3312247 - RNA, 22 nt, Mycobacterium tuberculosis H37Rv
ggcgacgaugucgagcgcgauc

SEQ ID NO: 3312248 - RNA, 14 nt, Mycobacterium tuberculosis H37Rv
ggcgacgcacucgg

SEQ ID NO: 3312249 - RNA, 23 nt, Mycobacterium tuberculosis H37Rv
ggcgacgccaguguugcgcugcg

SEQ ID NO: 3312250 - RNA, 20 nt, Mycobacterium tuberculosis H37Rv
ggcgacgcgccgguucagac

SEQ ID NO: 3312251 - RNA, 21 nt, Mycobacterium tuberculosis H37Rv
ggcgacgcggaguccgucgac

SEQ ID NO: 3312252 - RNA, 13 nt, Mycobacterium tuberculosis H37Rv
ggcgacggacucc

SEQ ID NO: 3312253 - RNA, 12 nt, Mycobacterium tuberculosis H37Rv
ggcgacggccaa

SEQ ID NO: 3312254 - RNA, 13 nt, Mycobacterium tuberculosis H37Rv
ggcgacggcggcg

SEQ ID NO: 3312255 - RNA, 15 nt, Mycobacterium tuberculosis H37Rv
ggcgacggcucuacc

SEQ ID NO: 3312256 - RNA, 18 nt, Mycobacterium tuberculosis H37Rv
ggcgacgggucgggcaac

SEQ ID NO: 3312257 - RNA, 20 nt, Mycobacterium tuberculosis H37Rv
ggcgacggugagggcgucgu

SEQ ID NO: 3312258 - RNA, 17 nt, Mycobacterium tuberculosis H37Rv
ggcgacgucaucgccga

SEQ ID NO: 3312259 - RNA, 23 nt, Mycobacterium tuberculosis H37Rv
ggcgacgucaucgccgacccgcc

SEQ ID NO: 3312260 - RNA, 23 nt, Mycobacterium tuberculosis H37Rv
ggcgacgucucgcaugcucacga

SEQ ID NO: 3312261 - RNA, 18 nt, Mycobacterium tuberculosis H37Rv
ggcgacguuggcgggagc

SEQ ID NO: 3312262 - RNA, 16 nt, Mycobacterium tuberculosis H37Rv
ggcgacuacccagcca

SEQ ID NO: 3312263 - RNA, 15 nt, Mycobacterium tuberculosis H37Rv
ggcgacuacggccuc

SEQ ID NO: 3312264 - RNA, 13 nt, Mycobacterium tuberculosis H37Rv
ggcgacucggugc

SEQ ID NO: 3312265 - RNA, 16 nt, Mycobacterium tuberculosis H37Rv
ggcgacucugcggggc

SEQ ID NO: 3312266 - RNA, 16 nt, Mycobacterium tuberculosis H37Rv
ggcgacugcagcgaag

SEQ ID NO: 3312267 - RNA, 16 nt, Mycobacterium tuberculosis H37Rv
ggcgacugcgucggcg

SEQ ID NO: 3312268 - RNA, 20 nt, Mycobacterium tuberculosis H37Rv
ggcgacugucuggucggcua

SEQ ID NO: 3312269 - RNA, 19 nt, Mycobacterium tuberculosis H37Rv
ggcgagaaacacgacagcc

SEQ ID NO: 3312270 - RNA, 16 nt, Mycobacterium tuberculosis H37Rv
ggcgagaacaggaucg

SEQ ID NO: 3312271 - RNA, 21 nt, Mycobacterium tuberculosis H37Rv
ggcgagaacccacgcaugcac

SEQ ID NO: 3312272 - RNA, 19 nt, Mycobacterium tuberculosis H37Rv
ggcgagagcgucaaccacg

SEQ ID NO: 3312273 - RNA, 18 nt, Mycobacterium tuberculosis H37Rv
ggcgagagggcggggcag

SEQ ID NO: 3312274 - RNA, 18 nt, Mycobacterium tuberculosis H37Rv
ggcgagcacaugcugccg

SEQ ID NO: 3312275 - RNA, 22 nt, Mycobacterium tuberculosis H37Rv
ggcgagcacccgcuggucgagc

SEQ ID NO: 3312276 - RNA, 16 nt, Mycobacterium tuberculosis H37Rv
ggcgagcacgcgggca

SEQ ID NO: 3312277 - RNA, 16 nt, Mycobacterium tuberculosis H37Rv
ggcgagcacgucacgc

SEQ ID NO: 3312278 - RNA, 22 nt, Mycobacterium tuberculosis H37Rv
ggcgagcagacgcagaaucgca

SEQ ID NO: 3312279 - RNA, 24 nt, Mycobacterium tuberculosis H37Rv
ggcgagcagacgcagaaucgcacg

SEQ ID NO: 3312280 - RNA, 22 nt, Mycobacterium tuberculosis H37Rv
ggcgagcagacgcauaagcccc

SEQ ID NO: 3312281 - RNA, 12 nt, Mycobacterium tuberculosis H37Rv
ggcgagcagaga

SEQ ID NO: 3312282 - RNA, 21 nt, Mycobacterium tuberculosis H37Rv
ggcgagcagagaacuccgcca

SEQ ID NO: 3312283 - RNA, 13 nt, Mycobacterium tuberculosis H37Rv
ggcgagcagcagg

SEQ ID NO: 3312284 - RNA, 19 nt, Mycobacterium tuberculosis H37Rv
ggcgagcagggcgucgacc

SEQ ID NO: 3312285 - RNA, 22 nt, Mycobacterium tuberculosis H37Rv
ggcgagcagggcgucgaccgcg

SEQ ID NO: 3312286 - RNA, 22 nt, Mycobacterium tuberculosis H37Rv
ggcgagcagucgcaaaagcccc

SEQ ID NO: 3312287 - RNA, 14 nt, Mycobacterium tuberculosis H37Rv
ggcgagccacggca

SEQ ID NO: 3312288 - RNA, 14 nt, Mycobacterium tuberculosis H37Rv
ggcgagcccgcauc

SEQ ID NO: 3312289 - RNA, 17 nt, Mycobacterium tuberculosis H37Rv
ggcgagcccgcaucgca

SEQ ID NO: 3312290 - RNA, 15 nt, Mycobacterium tuberculosis H37Rv
ggcgagccgcgccca

SEQ ID NO: 3312291 - RNA, 17 nt, Mycobacterium tuberculosis H37Rv
ggcgagccgugccagca

SEQ ID NO: 3312292 - RNA, 13 nt, Mycobacterium tuberculosis H37Rv
ggcgagcgcccgc

SEQ ID NO: 3312293 - RNA, 11 nt, Mycobacterium tuberculosis H37Rv
ggcgagcgcgc

SEQ ID NO: 3312294 - RNA, 16 nt, Mycobacterium tuberculosis H37Rv
ggcgagcgcggccugc

SEQ ID NO: 3312295 - RNA, 20 nt, Mycobacterium tuberculosis H37Rv
ggcgagcgcggccugcacca

SEQ ID NO: 3312296 - RNA, 13 nt, Mycobacterium tuberculosis H37Rv
ggcgagcggccuc

SEQ ID NO: 3312297 - RNA, 16 nt, Mycobacterium tuberculosis H37Rv
ggcgagcggccuccag

SEQ ID NO: 3312298 - RNA, 23 nt, Mycobacterium tuberculosis H37Rv
ggcgagcuccgaugccgacggcg

SEQ ID NO: 3312299 - RNA, 13 nt, Mycobacterium tuberculosis H37Rv
ggcgagcucgucg

SEQ ID NO: 3312300 - RNA, 15 nt, Mycobacterium tuberculosis H37Rv
ggcgaggacggcggc

SEQ ID NO: 3312301 - RNA, 15 nt, Mycobacterium tuberculosis H37Rv
ggcgaggcagcaccc

SEQ ID NO: 3312302 - RNA, 18 nt, Mycobacterium tuberculosis H37Rv
ggcgaggcgggagcgugg

SEQ ID NO: 3312303 - RNA, 13 nt, Mycobacterium tuberculosis H37Rv
ggcgaggcucccg

SEQ ID NO: 3312304 - RNA, 19 nt, Mycobacterium tuberculosis H37Rv
ggcgagggcggucagcggc

SEQ ID NO: 3312305 - RNA, 20 nt, Mycobacterium tuberculosis H37Rv
ggcgagggcggucagcggcc

SEQ ID NO: 3312306 - RNA, 20 nt, Mycobacterium tuberculosis H37Rv
ggcgagguauaaacgcggcg

SEQ ID NO: 3312307 - RNA, 22 nt, Mycobacterium tuberculosis H37Rv
ggcgaggucagagaaagccaau

SEQ ID NO: 3312308 - RNA, 23 nt, Mycobacterium tuberculosis H37Rv
ggcgaggucagagaaagccaaua

SEQ ID NO: 3312309 - RNA, 17 nt, Mycobacterium tuberculosis H37Rv
ggcgaggucccggccga

SEQ ID NO: 3312310 - RNA, 20 nt, Mycobacterium tuberculosis H37Rv
ggcgaggucccggccgagcg

SEQ ID NO: 3312311 - RNA, 16 nt, Mycobacterium tuberculosis H37Rv
ggcgaggugcucggau

SEQ ID NO: 3312312 - RNA, 19 nt, Mycobacterium tuberculosis H37Rv
ggcgaggugcucggaucgg

SEQ ID NO: 3312313 - RNA, 18 nt, Mycobacterium tuberculosis H37Rv
ggcgaguacaggcgcagc

SEQ ID NO: 3312314 - RNA, 15 nt, Mycobacterium tuberculosis H37Rv
ggcgaguacggccug

SEQ ID NO: 3312315 - RNA, 16 nt, Mycobacterium tuberculosis H37Rv
ggcgaguagucgacgu

SEQ ID NO: 3312316 - RNA, 15 nt, Mycobacterium tuberculosis H37Rv
ggcgagucgggggcc

SEQ ID NO: 3312317 - RNA, 15 nt, Mycobacterium tuberculosis H37Rv
ggcgagugguccagc

SEQ ID NO: 3312318 - RNA, 22 nt, Mycobacterium tuberculosis H37Rv
ggcgagugucuuagccagcagc

SEQ ID NO: 3312319 - RNA, 19 nt, Mycobacterium tuberculosis H37Rv
ggcgaguuaggccgccagc

SEQ ID NO: 3312320 - RNA, 23 nt, Mycobacterium tuberculosis H37Rv
ggcgaguuaggccgccagccggc

SEQ ID NO: 3312321 - RNA, 16 nt, Mycobacterium tuberculosis H37Rv
ggcgaguucggcagcg

SEQ ID NO: 3312322 - RNA, 22 nt, Mycobacterium tuberculosis H37Rv
ggcgauaaccgacgaucaacgg

SEQ ID NO: 3312323 - RNA, 15 nt, Mycobacterium tuberculosis H37Rv
ggcgauacagcgaca

SEQ ID NO: 3312324 - RNA, 15 nt, Mycobacterium tuberculosis H37Rv
ggcgauagcggcgcu

SEQ ID NO: 3312325 - RNA, 17 nt, Mycobacterium tuberculosis H37Rv
ggcgauaucgcacaugg

SEQ ID NO: 3312326 - RNA, 14 nt, Mycobacterium tuberculosis H37Rv
ggcgauaucggccc

SEQ ID NO: 3312327 - RNA, 17 nt, Mycobacterium tuberculosis H37Rv
ggcgaucaaccgcuguc

SEQ ID NO: 3312328 - RNA, 19 nt, Mycobacterium tuberculosis H37Rv
ggcgaucaaccgcugucac

SEQ ID NO: 3312329 - RNA, 20 nt, Mycobacterium tuberculosis H37Rv
ggcgaucaacgcgcacgcgu

SEQ ID NO: 3312330 - RNA, 17 nt, Mycobacterium tuberculosis H37Rv
ggcgccaccagucacgc

SEQ ID NO: 3312331 - RNA, 17 nt, Mycobacterium tuberculosis H37Rv
ggcgccaccaucgggga

SEQ ID NO: 3312332 - RNA, 21 nt, Mycobacterium tuberculosis H37Rv
ggcgccacccgcgccgcccgc

SEQ ID NO: 3312333 - RNA, 19 nt, Mycobacterium tuberculosis H37Rv
ggcgccaccgccgcugccg

SEQ ID NO: 3312334 - RNA, 20 nt, Mycobacterium tuberculosis H37Rv
ggcgccaccgccgcugccgg

SEQ ID NO: 3312335 - RNA, 16 nt, Mycobacterium tuberculosis H37Rv
ggcgccaccggcgccg

SEQ ID NO: 3312336 - RNA, 14 nt, Mycobacterium tuberculosis H37Rv
ggcgccacggcagc

SEQ ID NO: 3312337 - RNA, 20 nt, Mycobacterium tuberculosis H37Rv
ggcgccacgggugacucggg

SEQ ID NO: 3312338 - RNA, 13 nt, Mycobacterium tuberculosis H37Rv
ggcgccacguggu

SEQ ID NO: 3312339 - RNA, 19 nt, Mycobacterium tuberculosis H37Rv
ggcgccacguggucgagca

SEQ ID NO: 3312340 - RNA, 15 nt, Mycobacterium tuberculosis H37Rv
ggcgccacugaccgc

SEQ ID NO: 3312341 - RNA, 19 nt, Mycobacterium tuberculosis H37Rv
ggcgccacugaccgcgauc

SEQ ID NO: 3312342 - RNA, 18 nt, Mycobacterium tuberculosis H37Rv
ggcgccagaucgacgcca

SEQ ID NO: 3312343 - RNA, 22 nt, Mycobacterium tuberculosis H37Rv
ggcgccagaugccucggagauc

SEQ ID NO: 3312344 - RNA, 11 nt, Mycobacterium tuberculosis H37Rv
ggcgccagcag

SEQ ID NO: 3312345 - RNA, 12 nt, Mycobacterium tuberculosis H37Rv
ggcgccagcagu

SEQ ID NO: 3312346 - RNA, 13 nt, Mycobacterium tuberculosis H37Rv
ggcgccagcgccg

SEQ ID NO: 3312347 - RNA, 13 nt, Mycobacterium tuberculosis H37Rv
ggcgccaggucgg

SEQ ID NO: 3312348 - RNA, 15 nt, Mycobacterium tuberculosis H37Rv
ggcgccaggucggcg

SEQ ID NO: 3312349 - RNA, 17 nt, Mycobacterium tuberculosis H37Rv
ggcgccaggucggcggg

SEQ ID NO: 3312350 - RNA, 13 nt, Mycobacterium tuberculosis H37Rv
ggcgccaguucgg

SEQ ID NO: 3312351 - RNA, 17 nt, Mycobacterium tuberculosis H37Rv
ggcgccaguucggcggg

SEQ ID NO: 3312352 - RNA, 20 nt, Mycobacterium tuberculosis H37Rv
ggcgccaucccgccgcccgc

SEQ ID NO: 3312353 - RNA, 16 nt, Mycobacterium tuberculosis H37Rv
ggcgccaugaagccgg

SEQ ID NO: 3312354 - RNA, 19 nt, Mycobacterium tuberculosis H37Rv
ggcgccaugcgccaacccg

SEQ ID NO: 3312355 - RNA, 22 nt, Mycobacterium tuberculosis H37Rv
ggcgcccacaaauauccugcgg

SEQ ID NO: 3312356 - RNA, 14 nt, Mycobacterium tuberculosis H37Rv
ggcgcccacaucgu

SEQ ID NO: 3312357 - RNA, 19 nt, Mycobacterium tuberculosis H37Rv
ggcgcccacaucgucggcg

SEQ ID NO: 3312358 - RNA, 23 nt, Mycobacterium tuberculosis H37Rv
ggcgcccacaucgucggcgggcg

SEQ ID NO: 3312359 - RNA, 13 nt, Mycobacterium tuberculosis H37Rv
ggcgcccagccgg

SEQ ID NO: 3312360 - RNA, 14 nt, Mycobacterium tuberculosis H37Rv
ggcgcccagcgccu

SEQ ID NO: 3312361 - RNA, 17 nt, Mycobacterium tuberculosis H37Rv
ggcgcccagcgccucga

SEQ ID NO: 3312362 - RNA, 13 nt, Mycobacterium tuberculosis H37Rv
ggcgcccagcgcu

SEQ ID NO: 3312363 - RNA, 15 nt, Mycobacterium tuberculosis H37Rv
ggcgcccagcgcuag

SEQ ID NO: 3312364 - RNA, 14 nt, Mycobacterium tuberculosis H37Rv
ggcgcccaggaacu

SEQ ID NO: 3312365 - RNA, 20 nt, Mycobacterium tuberculosis H37Rv
ggcgcccauagcaccucgau

SEQ ID NO: 3312366 - RNA, 14 nt, Mycobacterium tuberculosis H37Rv
ggcgcccaucgcga

SEQ ID NO: 3312367 - RNA, 20 nt, Mycobacterium tuberculosis H37Rv
ggcgcccaugcugacacgac

SEQ ID NO: 3312368 - RNA, 21 nt, Mycobacterium tuberculosis H37Rv
ggcgcccccgccauugccgcc

SEQ ID NO: 3312369 - RNA, 23 nt, Mycobacterium tuberculosis H37Rv
ggcgcccccgccauugccgccgg

SEQ ID NO: 3312370 - RNA, 14 nt, Mycobacterium tuberculosis H37Rv
ggcgcccgaagccg

SEQ ID NO: 3312371 - RNA, 15 nt, Mycobacterium tuberculosis H37Rv
ggcgcccgaagccgg

SEQ ID NO: 3312372 - RNA, 13 nt, Mycobacterium tuberculosis H37Rv
ggcgcccgccccg

SEQ ID NO: 3312373 - RNA, 19 nt, Mycobacterium tuberculosis H37Rv
ggcgcccgcccgagccgcu

SEQ ID NO: 3312374 - RNA, 12 nt, Mycobacterium tuberculosis H37Rv
ggcgcccgccgg

SEQ ID NO: 3312375 - RNA, 15 nt, Mycobacterium tuberculosis H37Rv
ggcgcccgccggcaa

SEQ ID NO: 3312376 - RNA, 16 nt, Mycobacterium tuberculosis H37Rv
ggcgcccgcgugacgc

SEQ ID NO: 3312377 - RNA, 21 nt, Mycobacterium tuberculosis H37Rv
ggcgcccgcucggccgcagcc

SEQ ID NO: 3312378 - RNA, 23 nt, Mycobacterium tuberculosis H37Rv
ggcgcccggcuuuugcgcccagc

SEQ ID NO: 3312379 - RNA, 12 nt, Mycobacterium tuberculosis H37Rv
ggcgcccgggau

SEQ ID NO: 3312380 - RNA, 20 nt, Mycobacterium tuberculosis H37Rv
ggcgcccgggucccggcagc

SEQ ID NO: 3312381 - RNA, 16 nt, Mycobacterium tuberculosis H37Rv
ggcgcccggucgagcc

SEQ ID NO: 3312382 - RNA, 19 nt, Mycobacterium tuberculosis H37Rv
ggcgcccggucgagccagc

SEQ ID NO: 3312383 - RNA, 21 nt, Mycobacterium tuberculosis H37Rv
ggcgcccggucgagccagcgg

SEQ ID NO: 3312384 - RNA, 17 nt, Mycobacterium tuberculosis H37Rv
ggcgcccgucuccagca

SEQ ID NO: 3312385 - RNA, 14 nt, Mycobacterium tuberculosis H37Rv
ggcgcccugcgcca

SEQ ID NO: 3312386 - RNA, 13 nt, Mycobacterium tuberculosis H37Rv
ggcgccgaaaccg

SEQ ID NO: 3312387 - RNA, 23 nt, Mycobacterium tuberculosis H37Rv
ggcgccgaacaccggcuccagca

SEQ ID NO: 3312388 - RNA, 13 nt, Mycobacterium tuberculosis H37Rv
ggcgccgaaccag

SEQ ID NO: 3312389 - RNA, 15 nt, Mycobacterium tuberculosis H37Rv
ggcgccgaaccagcg

SEQ ID NO: 3312390 - RNA, 17 nt, Mycobacterium tuberculosis H37Rv
ggcgccgaacccggugu

SEQ ID NO: 3312391 - RNA, 19 nt, Mycobacterium tuberculosis H37Rv
ggcgccgaagccuugcagc

SEQ ID NO: 3312392 - RNA, 21 nt, Mycobacterium tuberculosis H37Rv
ggcgccgacgacuccggcaag

SEQ ID NO: 3312393 - RNA, 17 nt, Mycobacterium tuberculosis H37Rv
ggcgccgagauccuggu

SEQ ID NO: 3312394 - RNA, 16 nt, Mycobacterium tuberculosis H37Rv
ggcgccgagcagcccg

SEQ ID NO: 3312395 - RNA, 19 nt, Mycobacterium tuberculosis H37Rv
ggcgccgagcagcccgcgg

SEQ ID NO: 3312396 - RNA, 13 nt, Mycobacterium tuberculosis H37Rv
ggcgccgaggucg

SEQ ID NO: 3312397 - RNA, 22 nt, Mycobacterium tuberculosis H37Rv
ggcgccgauaccggcggcgagc

SEQ ID NO: 3312398 - RNA, 19 nt, Mycobacterium tuberculosis H37Rv
ggcgccgcaaucagacggc

SEQ ID NO: 3312399 - RNA, 19 nt, Mycobacterium tuberculosis H37Rv
ggcgccgcaaugacgucgu

SEQ ID NO: 3312400 - RNA, 14 nt, Mycobacterium tuberculosis H37Rv
ggcgccgcagcgcu

SEQ ID NO: 3312401 - RNA, 17 nt, Mycobacterium tuberculosis H37Rv
ggcgccgcagggccgcg

SEQ ID NO: 3312402 - RNA, 15 nt, Mycobacterium tuberculosis H37Rv
ggcgccgcauaccag

SEQ ID NO: 3312403 - RNA, 15 nt, Mycobacterium tuberculosis H37Rv
ggcgccgccaagggc

SEQ ID NO: 3312404 - RNA, 21 nt, Mycobacterium tuberculosis H37Rv
ggcgccgccacugccggcagc

SEQ ID NO: 3312405 - RNA, 22 nt, Mycobacterium tuberculosis H37Rv
ggcgccgccacugccggcagcg

SEQ ID NO: 3312406 - RNA, 19 nt, Mycobacterium tuberculosis H37Rv
ggcgccgccauugucgcca

SEQ ID NO: 3312407 - RNA, 15 nt, Mycobacterium tuberculosis H37Rv
ggcgccgcccgaggc

SEQ ID NO: 3312408 - RNA, 14 nt, Mycobacterium tuberculosis H37Rv
ggcgccgcccgcgc

SEQ ID NO: 3312409 - RNA, 22 nt, Mycobacterium tuberculosis H37Rv
ggcgccgcccgcgccaccagca

SEQ ID NO: 3312410 - RNA, 18 nt, Mycobacterium tuberculosis H37Rv
ggcgccgcccuugccgcc

SEQ ID NO: 3312411 - RNA, 20 nt, Mycobacterium tuberculosis H37Rv
ggcgccgcccuugccgccgg

SEQ ID NO: 3312412 - RNA, 22 nt, Mycobacterium tuberculosis H37Rv
ggcgccgcccuugccgccggcc

SEQ ID NO: 3312413 - RNA, 22 nt, Mycobacterium tuberculosis H37Rv
ggcgccgccgaccagaacgcca

SEQ ID NO: 3312414 - RNA, 23 nt, Mycobacterium tuberculosis H37Rv
ggcgccgccgaccagaacgccag

SEQ ID NO: 3312415 - RNA, 21 nt, Mycobacterium tuberculosis H37Rv
ggcgccgccgccaaugccacc

SEQ ID NO: 3312416 - RNA, 14 nt, Mycobacterium tuberculosis H37Rv
ggcgccgccggcac

SEQ ID NO: 3312417 - RNA, 13 nt, Mycobacterium tuberculosis H37Rv
ggcgccgccggcg

SEQ ID NO: 3312418 - RNA, 16 nt, Mycobacterium tuberculosis H37Rv
ggcgccgccggugcca

SEQ ID NO: 3312419 - RNA, 18 nt, Mycobacterium tuberculosis H37Rv
ggcgccgccggugccacc

SEQ ID NO: 3312420 - RNA, 16 nt, Mycobacterium tuberculosis H37Rv
ggcgccgccguccagc

SEQ ID NO: 3312421 - RNA, 23 nt, Mycobacterium tuberculosis H37Rv
ggcgccgccguccagcgccgcgg

SEQ ID NO: 3312422 - RNA, 15 nt, Mycobacterium tuberculosis H37Rv
ggcgccgccgucgcc

SEQ ID NO: 3312423 - RNA, 16 nt, Mycobacterium tuberculosis H37Rv
ggcgccgccgucgccg

SEQ ID NO: 3312424 - RNA, 17 nt, Mycobacterium tuberculosis H37Rv
ggcgccgccgucgccgc

SEQ ID NO: 3312425 - RNA, 13 nt, Mycobacterium tuberculosis H37Rv
ggcgccgccguug

SEQ ID NO: 3312426 - RNA, 15 nt, Mycobacterium tuberculosis H37Rv
ggcgcggcgggcagc

SEQ ID NO: 3312427 - RNA, 14 nt, Mycobacterium tuberculosis H37Rv
ggcgcggcugccgc

SEQ ID NO: 3312428 - RNA, 17 nt, Mycobacterium tuberculosis H37Rv
ggcgcggcugccgcggu

SEQ ID NO: 3312429 - RNA, 16 nt, Mycobacterium tuberculosis H37Rv
ggcgcgggccggcgac

SEQ ID NO: 3312430 - RNA, 18 nt, Mycobacterium tuberculosis H37Rv
ggcgcgggccggcgacug

SEQ ID NO: 3312431 - RNA, 14 nt, Mycobacterium tuberculosis H37Rv
ggcgcgggcgccgg

SEQ ID NO: 3312432 - RNA, 15 nt, Mycobacterium tuberculosis H37Rv
ggcgcggggccgccg

SEQ ID NO: 3312433 - RNA, 24 nt, Mycobacterium tuberculosis H37Rv
ggcgcggggccgccgcggccggcg

SEQ ID NO: 3312434 - RNA, 14 nt, Mycobacterium tuberculosis H37Rv
ggcgcggggcggcc

SEQ ID NO: 3312435 - RNA, 15 nt, Mycobacterium tuberculosis H37Rv
ggcgcgggucggcga

SEQ ID NO: 3312436 - RNA, 22 nt, Mycobacterium tuberculosis H37Rv
ggcgcgggucggcgaccgcgcu

SEQ ID NO: 3312437 - RNA, 15 nt, Mycobacterium tuberculosis H37Rv
ggcgcgggugaccag

SEQ ID NO: 3312438 - RNA, 16 nt, Mycobacterium tuberculosis H37Rv
ggcgcgggugcgccgg

SEQ ID NO: 3312439 - RNA, 18 nt, Mycobacterium tuberculosis H37Rv
ggcgcgggugcgccggcg

SEQ ID NO: 3312440 - RNA, 19 nt, Mycobacterium tuberculosis H37Rv
ggcgcggguggcgccaggu

SEQ ID NO: 3312441 - RNA, 17 nt, Mycobacterium tuberculosis H37Rv
ggcgcgguaccgcucgg

SEQ ID NO: 3312442 - RNA, 13 nt, Mycobacterium tuberculosis H37Rv
ggcgcggucaccg

SEQ ID NO: 3312443 - RNA, 13 nt, Mycobacterium tuberculosis H37Rv
ggcgcgguccucc

SEQ ID NO: 3312444 - RNA, 16 nt, Mycobacterium tuberculosis H37Rv
ggcgcggucgaagcug

SEQ ID NO: 3312445 - RNA, 16 nt, Mycobacterium tuberculosis H37Rv
ggcgcggucgaccuga

SEQ ID NO: 3312446 - RNA, 20 nt, Mycobacterium tuberculosis H37Rv
ggcgcggucgaccugagccc

SEQ ID NO: 3312447 - RNA, 19 nt, Mycobacterium tuberculosis H37Rv
ggcgcggucggagucgagc

SEQ ID NO: 3312448 - RNA, 13 nt, Mycobacterium tuberculosis H37Rv
ggcgcggugccgg

SEQ ID NO: 3312449 - RNA, 17 nt, Mycobacterium tuberculosis H37Rv
ggcgcgguucgucggcg

SEQ ID NO: 3312450 - RNA, 21 nt, Mycobacterium tuberculosis H37Rv
ggcgcgguuucggcgucaccg

SEQ ID NO: 3312451 - RNA, 17 nt, Mycobacterium tuberculosis H37Rv
ggcgcgguuugcucguu

SEQ ID NO: 3312452 - RNA, 19 nt, Mycobacterium tuberculosis H37Rv
ggcgcgguuugcucguuca

SEQ ID NO: 3312453 - RNA, 21 nt, Mycobacterium tuberculosis H37Rv
ggcgcguaguaaugcucgacg

SEQ ID NO: 3312454 - RNA, 22 nt, Mycobacterium tuberculosis H37Rv
ggcgcguaguaaugcucgacgu

SEQ ID NO: 3312455 - RNA, 14 nt, Mycobacterium tuberculosis H37Rv
ggcgcgucauggcg

SEQ ID NO: 3312456 - RNA, 18 nt, Mycobacterium tuberculosis H37Rv
ggcgcgucauggcgagua

SEQ ID NO: 3312457 - RNA, 20 nt, Mycobacterium tuberculosis H37Rv
ggcgcguccgggcucgcgcu

SEQ ID NO: 3312458 - RNA, 23 nt, Mycobacterium tuberculosis H37Rv
ggcgcguccucgccgcacgccgg

SEQ ID NO: 3312459 - RNA, 18 nt, Mycobacterium tuberculosis H37Rv
ggcgcgucggcaccgauc

SEQ ID NO: 3312460 - RNA, 22 nt, Mycobacterium tuberculosis H37Rv
ggcgcgucggcguuggggcucg

SEQ ID NO: 3312461 - RNA, 17 nt, Mycobacterium tuberculosis H37Rv
ggcgcguugcguaucga

SEQ ID NO: 3312462 - RNA, 21 nt, Mycobacterium tuberculosis H37Rv
ggcgcguugcguaucgacccg

SEQ ID NO: 3312463 - RNA, 23 nt, Mycobacterium tuberculosis H37Rv
ggcgcguugcguaucgacccgcg

SEQ ID NO: 3312464 - RNA, 21 nt, Mycobacterium tuberculosis H37Rv
ggcgcuaccagccauagugcg

SEQ ID NO: 3312465 - RNA, 13 nt, Mycobacterium tuberculosis H37Rv
ggcgcucagcgcg

SEQ ID NO: 3312466 - RNA, 21 nt, Mycobacterium tuberculosis H37Rv
ggcgcucauaggccggcgguc

SEQ ID NO: 3312467 - RNA, 17 nt, Mycobacterium tuberculosis H37Rv
ggcgcucaucacccagc

SEQ ID NO: 3312468 - RNA, 16 nt, Mycobacterium tuberculosis H37Rv
ggcgcuccacugacca

SEQ ID NO: 3312469 - RNA, 17 nt, Mycobacterium tuberculosis H37Rv
ggcgcucccgccggcag

SEQ ID NO: 3312470 - RNA, 13 nt, Mycobacterium tuberculosis H37Rv
ggcgcuccggcgu

SEQ ID NO: 3312471 - RNA, 19 nt, Mycobacterium tuberculosis H37Rv
ggcgcucgaaggccgcacu

SEQ ID NO: 3312472 - RNA, 18 nt, Mycobacterium tuberculosis H37Rv
ggcgcucgcgcgcugggc

SEQ ID NO: 3312473 - RNA, 14 nt, Mycobacterium tuberculosis H37Rv
ggcgcucggcgagc

SEQ ID NO: 3312474 - RNA, 17 nt, Mycobacterium tuberculosis H37Rv
ggcgcucggcgagcaac

SEQ ID NO: 3312475 - RNA, 16 nt, Mycobacterium tuberculosis H37Rv
ggcgcugaagccgacg

SEQ ID NO: 3312476 - RNA, 20 nt, Mycobacterium tuberculosis H37Rv
ggcgcugacuagggucaccg

SEQ ID NO: 3312477 - RNA, 15 nt, Mycobacterium tuberculosis H37Rv
ggcgcugagggugcu

SEQ ID NO: 3312478 - RNA, 19 nt, Mycobacterium tuberculosis H37Rv
ggcgcugauccggucggcc

SEQ ID NO: 3312479 - RNA, 20 nt, Mycobacterium tuberculosis H37Rv
ggcgcugauccggucggcca

SEQ ID NO: 3312480 - RNA, 11 nt, Mycobacterium tuberculosis H37Rv
ggcgcugaucg

SEQ ID NO: 3312481 - RNA, 12 nt, Mycobacterium tuberculosis H37Rv
ggcgcugaucgc

SEQ ID NO: 3312482 - RNA, 21 nt, Mycobacterium tuberculosis H37Rv
ggcgcugaucgcgcgcaccgg

SEQ ID NO: 3312483 - RNA, 14 nt, Mycobacterium tuberculosis H37Rv
ggcgcugaucggca

SEQ ID NO: 3312484 - RNA, 21 nt, Mycobacterium tuberculosis H37Rv
ggcgcugauggugcugcggcg

SEQ ID NO: 3312485 - RNA, 11 nt, Mycobacterium tuberculosis H37Rv
ggcgcugcagc

SEQ ID NO: 3312486 - RNA, 14 nt, Mycobacterium tuberculosis H37Rv
ggcgcugcagcugc

SEQ ID NO: 3312487 - RNA, 14 nt, Mycobacterium tuberculosis H37Rv
ggcgcugcccgccg

SEQ ID NO: 3312488 - RNA, 19 nt, Mycobacterium tuberculosis H37Rv
ggcgcugcccgggcugccg

SEQ ID NO: 3312489 - RNA, 21 nt, Mycobacterium tuberculosis H37Rv
ggcgcugcccgggcugccgcc

SEQ ID NO: 3312490 - RNA, 13 nt, Mycobacterium tuberculosis H37Rv
ggcgcugcgcacc

SEQ ID NO: 3312491 - RNA, 16 nt, Mycobacterium tuberculosis H37Rv
ggcgcugcgcaccgcc

SEQ ID NO: 3312492 - RNA, 16 nt, Mycobacterium tuberculosis H37Rv
ggcgcugcggcgugcc

SEQ ID NO: 3312493 - RNA, 20 nt, Mycobacterium tuberculosis H37Rv
ggcgcugcggcgugccgggu

SEQ ID NO: 3312494 - RNA, 21 nt, Mycobacterium tuberculosis H37Rv
ggcgcugcugccauugccgau

SEQ ID NO: 3312495 - RNA, 21 nt, Mycobacterium tuberculosis H37Rv
ggcgcuggaccgggucgggca

SEQ ID NO: 3312496 - RNA, 22 nt, Mycobacterium tuberculosis H37Rv
ggcgcuggaccgggucgggcac

SEQ ID NO: 3312497 - RNA, 17 nt, Mycobacterium tuberculosis H37Rv
ggcgcuggacggcgggc

SEQ ID NO: 3312498 - RNA, 18 nt, Mycobacterium tuberculosis H37Rv
ggcgcuggacggcgggcc

SEQ ID NO: 3312499 - RNA, 17 nt, Mycobacterium tuberculosis H37Rv
ggcgcuggcgggcgauc

SEQ ID NO: 3312500 - RNA, 18 nt, Mycobacterium tuberculosis H37Rv
ggcgcuggcguggccaac

SEQ ID NO: 3312501 - RNA, 22 nt, Mycobacterium tuberculosis H37Rv
ggcgcuggucgcgguggcggcg

SEQ ID NO: 3312502 - RNA, 15 nt, Mycobacterium tuberculosis H37Rv
ggcgcuggugcgcca

SEQ ID NO: 3312503 - RNA, 22 nt, Mycobacterium tuberculosis H37Rv
ggcgcuugcaccaggggcgcgu

SEQ ID NO: 3312504 - RNA, 13 nt, Mycobacterium tuberculosis H37Rv
ggcgcuugccggg

SEQ ID NO: 3312505 - RNA, 14 nt, Mycobacterium tuberculosis H37Rv
ggcgcuugccgggg

SEQ ID NO: 3312506 - RNA, 22 nt, Mycobacterium tuberculosis H37Rv
ggcggaaaaucggcuggcccga

SEQ ID NO: 3312507 - RNA, 22 nt, Mycobacterium tuberculosis H37Rv
ggcggaaacggcaccggauccg

SEQ ID NO: 3312508 - RNA, 23 nt, Mycobacterium tuberculosis H37Rv
ggcggaacagcuucgcgcagccg

SEQ ID NO: 3312509 - RNA, 18 nt, Mycobacterium tuberculosis H37Rv
ggcggaaggcgucgaaca

SEQ ID NO: 3312510 - RNA, 15 nt, Mycobacterium tuberculosis H37Rv
ggcggacaccucggg

SEQ ID NO: 3312511 - RNA, 19 nt, Mycobacterium tuberculosis H37Rv
ggcggaccaggccgcgcgc

SEQ ID NO: 3312512 - RNA, 22 nt, Mycobacterium tuberculosis H37Rv
ggcggaccaggccgcgcgcacc

SEQ ID NO: 3312513 - RNA, 20 nt, Mycobacterium tuberculosis H37Rv
ggcggacccgcucgcggcga

SEQ ID NO: 3312514 - RNA, 23 nt, Mycobacterium tuberculosis H37Rv
ggcggacccggugacccgcuggg

SEQ ID NO: 3312515 - RNA, 12 nt, Mycobacterium tuberculosis H37Rv
ggcggacgcccg

SEQ ID NO: 3312516 - RNA, 17 nt, Mycobacterium tuberculosis H37Rv
ggcggacgugaccagau

SEQ ID NO: 3312517 - RNA, 23 nt, Mycobacterium tuberculosis H37Rv
ggcggacgugaccagaucgacgc

SEQ ID NO: 3312518 - RNA, 19 nt, Mycobacterium tuberculosis H37Rv
ggcggagaaaagcgcgcua

SEQ ID NO: 3312519 - RNA, 16 nt, Mycobacterium tuberculosis H37Rv
ggcggagacggcggcc

SEQ ID NO: 3312520 - RNA, 13 nt, Mycobacterium tuberculosis H37Rv
ggcggaggcuggg

SEQ ID NO: 3312521 - RNA, 18 nt, Mycobacterium tuberculosis H37Rv
ggcggauaaccggcaugc

SEQ ID NO: 3312522 - RNA, 12 nt, Mycobacterium tuberculosis H37Rv
ggcggcgcgccg

SEQ ID NO: 3312523 - RNA, 14 nt, Mycobacterium tuberculosis H37Rv
ggcggcgcgccgau

SEQ ID NO: 3312524 - RNA, 17 nt, Mycobacterium tuberculosis H37Rv
ggcggcgcgggucggcg

SEQ ID NO: 3312525 - RNA, 17 nt, Mycobacterium tuberculosis H37Rv
ggcggcgcggucgaagc

SEQ ID NO: 3312526 - RNA, 13 nt, Mycobacterium tuberculosis H37Rv
ggcggcgcugcag

SEQ ID NO: 3312527 - RNA, 14 nt, Mycobacterium tuberculosis H37Rv
ggcggcgcugcagc

SEQ ID NO: 3312528 - RNA, 18 nt, Mycobacterium tuberculosis H37Rv
ggcggcgcugcagcugcu

SEQ ID NO: 3312529 - RNA, 19 nt, Mycobacterium tuberculosis H37Rv
ggcggcgcugcagcugcuc

SEQ ID NO: 3312530 - RNA, 22 nt, Mycobacterium tuberculosis H37Rv
ggcggcgcuggucgcgguggcg

SEQ ID NO: 3312531 - RNA, 15 nt, Mycobacterium tuberculosis H37Rv
ggcggcggacccgcu

SEQ ID NO: 3312532 - RNA, 15 nt, Mycobacterium tuberculosis H37Rv
ggcggcggaggcugg

SEQ ID NO: 3312533 - RNA, 18 nt, Mycobacterium tuberculosis H37Rv
ggcggcggauuccggcau

SEQ ID NO: 3312534 - RNA, 14 nt, Mycobacterium tuberculosis H37Rv
ggcggcggccagcc

SEQ ID NO: 3312535 - RNA, 19 nt, Mycobacterium tuberculosis H37Rv
ggcggcggccgcagcggcc

SEQ ID NO: 3312536 - RNA, 23 nt, Mycobacterium tuberculosis H37Rv
ggcggcggccgcagcggccagcc

SEQ ID NO: 3312537 - RNA, 12 nt, Mycobacterium tuberculosis H37Rv
ggcggcggccug

SEQ ID NO: 3312538 - RNA, 15 nt, Mycobacterium tuberculosis H37Rv
ggcggcggcgcgauc

SEQ ID NO: 3312539 - RNA, 16 nt, Mycobacterium tuberculosis H37Rv
ggcggcggcggagcga

SEQ ID NO: 3312540 - RNA, 16 nt, Mycobacterium tuberculosis H37Rv
ggcggcggcggcaagu

SEQ ID NO: 3312541 - RNA, 22 nt, Mycobacterium tuberculosis H37Rv
ggcggcggcuguugcggcggcg

SEQ ID NO: 3312542 - RNA, 21 nt, Mycobacterium tuberculosis H37Rv
ggcggcggggacucugccacc

SEQ ID NO: 3312543 - RNA, 13 nt, Mycobacterium tuberculosis H37Rv
ggcggcgggggcg

SEQ ID NO: 3312544 - RNA, 16 nt, Mycobacterium tuberculosis H37Rv
ggcggcgggggcggcg

SEQ ID NO: 3312545 - RNA, 14 nt, Mycobacterium tuberculosis H37Rv
ggcggcggucgagc

SEQ ID NO: 3312546 - RNA, 15 nt, Mycobacterium tuberculosis H37Rv
ggcggcggucggcug

SEQ ID NO: 3312547 - RNA, 17 nt, Mycobacterium tuberculosis H37Rv
ggcggcggucggcuggg

SEQ ID NO: 3312548 - RNA, 15 nt, Mycobacterium tuberculosis H37Rv
ggcggcggugcagca

SEQ ID NO: 3312549 - RNA, 15 nt, Mycobacterium tuberculosis H37Rv
ggcggcggugcguca

SEQ ID NO: 3312550 - RNA, 20 nt, Mycobacterium tuberculosis H37Rv
ggcggcggugcgucagcugg

SEQ ID NO: 3312551 - RNA, 22 nt, Mycobacterium tuberculosis H37Rv
ggcggcggugcgucagcugguu

SEQ ID NO: 3312552 - RNA, 19 nt, Mycobacterium tuberculosis H37Rv
ggcggcgguggccagcguc

SEQ ID NO: 3312553 - RNA, 15 nt, Mycobacterium tuberculosis H37Rv
ggcggcggugggcgc

SEQ ID NO: 3312554 - RNA, 16 nt, Mycobacterium tuberculosis H37Rv
ggcggcguccaccugc

SEQ ID NO: 3312555 - RNA, 22 nt, Mycobacterium tuberculosis H37Rv
ggcggcguccaccugcuccgcu

SEQ ID NO: 3312556 - RNA, 16 nt, Mycobacterium tuberculosis H37Rv
ggcggcguccagcagc

SEQ ID NO: 3312557 - RNA, 21 nt, Mycobacterium tuberculosis H37Rv
ggcggcguccaucgcgcgccg

SEQ ID NO: 3312558 - RNA, 22 nt, Mycobacterium tuberculosis H37Rv
ggcggcgucgacggcuccuccg

SEQ ID NO: 3312559 - RNA, 13 nt, Mycobacterium tuberculosis H37Rv
ggcggcgucgagc

SEQ ID NO: 3312560 - RNA, 19 nt, Mycobacterium tuberculosis H37Rv
ggcggcgucgagcaccucc

SEQ ID NO: 3312561 - RNA, 22 nt, Mycobacterium tuberculosis H37Rv
ggcggcgucgagggagcgccgc

SEQ ID NO: 3312562 - RNA, 21 nt, Mycobacterium tuberculosis H37Rv
ggcggcgugaagugagcucgg

SEQ ID NO: 3312563 - RNA, 14 nt, Mycobacterium tuberculosis H37Rv
ggcggcgugcccgu

SEQ ID NO: 3312564 - RNA, 16 nt, Mycobacterium tuberculosis H37Rv
ggcggcgugcuccugc

SEQ ID NO: 3312565 - RNA, 22 nt, Mycobacterium tuberculosis H37Rv
ggcggcguggcgccggccacga

SEQ ID NO: 3312566 - RNA, 21 nt, Mycobacterium tuberculosis H37Rv
ggcggcguuaccaccgucacc

SEQ ID NO: 3312567 - RNA, 12 nt, Mycobacterium tuberculosis H37Rv
ggcggcuaccca

SEQ ID NO: 3312568 - RNA, 22 nt, Mycobacterium tuberculosis H37Rv
ggcggcucaaccucuggcggcg

SEQ ID NO: 3312569 - RNA, 13 nt, Mycobacterium tuberculosis H37Rv
ggcggcuccaccg

SEQ ID NO: 3312570 - RNA, 22 nt, Mycobacterium tuberculosis H37Rv
ggcggcucccauggcgcgagca

SEQ ID NO: 3312571 - RNA, 15 nt, Mycobacterium tuberculosis H37Rv
ggcggcucgggugcg

SEQ ID NO: 3312572 - RNA, 22 nt, Mycobacterium tuberculosis H37Rv
ggcggcucuagaucgccgagcg

SEQ ID NO: 3312573 - RNA, 15 nt, Mycobacterium tuberculosis H37Rv
ggcggcugaacggca

SEQ ID NO: 3312574 - RNA, 17 nt, Mycobacterium tuberculosis H37Rv
ggcggcugaacggcagc

SEQ ID NO: 3312575 - RNA, 12 nt, Mycobacterium tuberculosis H37Rv
ggcggcugcacg

SEQ ID NO: 3312576 - RNA, 13 nt, Mycobacterium tuberculosis H37Rv
ggcggcugcagcc

SEQ ID NO: 3312577 - RNA, 14 nt, Mycobacterium tuberculosis H37Rv
ggcggcugccgguu

SEQ ID NO: 3312578 - RNA, 17 nt, Mycobacterium tuberculosis H37Rv
ggcggcuggucucuggc

SEQ ID NO: 3312579 - RNA, 12 nt, Mycobacterium tuberculosis H37Rv
ggcggcugucgg

SEQ ID NO: 3312580 - RNA, 19 nt, Mycobacterium tuberculosis H37Rv
ggcggcuguggucgcugcu

SEQ ID NO: 3312581 - RNA, 20 nt, Mycobacterium tuberculosis H37Rv
ggcggcuguggucgcugcug

SEQ ID NO: 3312582 - RNA, 20 nt, Mycobacterium tuberculosis H37Rv
ggcggcuuagaacgugcugg

SEQ ID NO: 3312583 - RNA, 18 nt, Mycobacterium tuberculosis H37Rv
ggcggcuuccucgagcga

SEQ ID NO: 3312584 - RNA, 22 nt, Mycobacterium tuberculosis H37Rv
ggcggcuuccucgagcgaaccg

SEQ ID NO: 3312585 - RNA, 14 nt, Mycobacterium tuberculosis H37Rv
ggcggcuucgacgu

SEQ ID NO: 3312586 - RNA, 19 nt, Mycobacterium tuberculosis H37Rv
ggcggcuucgacgucggcg

SEQ ID NO: 3312587 - RNA, 23 nt, Mycobacterium tuberculosis H37Rv
ggcggcuucguggcggcgcgcgc

SEQ ID NO: 3312588 - RNA, 18 nt, Mycobacterium tuberculosis H37Rv
ggcgggaacggugccgau

SEQ ID NO: 3312589 - RNA, 20 nt, Mycobacterium tuberculosis H37Rv
ggcgggaacggugccgaucg

SEQ ID NO: 3312590 - RNA, 19 nt, Mycobacterium tuberculosis H37Rv
ggcgggacaaccgggcggg

SEQ ID NO: 3312591 - RNA, 15 nt, Mycobacterium tuberculosis H37Rv
ggcgggacgucgccg

SEQ ID NO: 3312592 - RNA, 13 nt, Mycobacterium tuberculosis H37Rv
ggcgggagcaccg

SEQ ID NO: 3312593 - RNA, 18 nt, Mycobacterium tuberculosis H37Rv
ggcgggagucgucgagcu

SEQ ID NO: 3312594 - RNA, 16 nt, Mycobacterium tuberculosis H37Rv
ggcgggaugcgcgccc

SEQ ID NO: 3312595 - RNA, 16 nt, Mycobacterium tuberculosis H37Rv
ggcgggauggccgccg

SEQ ID NO: 3312596 - RNA, 16 nt, Mycobacterium tuberculosis H37Rv
ggcgggcaacgcagca

SEQ ID NO: 3312597 - RNA, 15 nt, Mycobacterium tuberculosis H37Rv
ggcgggcaaucaccg

SEQ ID NO: 3312598 - RNA, 21 nt, Mycobacterium tuberculosis H37Rv
ggcgggcaaucaccgccggcg

SEQ ID NO: 3312599 - RNA, 14 nt, Mycobacterium tuberculosis H37Rv
ggcgggcacgcaca

SEQ ID NO: 3312600 - RNA, 19 nt, Mycobacterium tuberculosis H37Rv
ggcgggcacgcacaaguuc

SEQ ID NO: 3312601 - RNA, 18 nt, Mycobacterium tuberculosis H37Rv
ggcgggcacucagcaggg

SEQ ID NO: 3312602 - RNA, 14 nt, Mycobacterium tuberculosis H37Rv
ggcgggcagcgggc

SEQ ID NO: 3312603 - RNA, 19 nt, Mycobacterium tuberculosis H37Rv
ggcgggccaccguaaacag

SEQ ID NO: 3312604 - RNA, 13 nt, Mycobacterium tuberculosis H37Rv
ggcgggcccgccg

SEQ ID NO: 3312605 - RNA, 22 nt, Mycobacterium tuberculosis H37Rv
ggcgggccguacacaccgagca

SEQ ID NO: 3312606 - RNA, 20 nt, Mycobacterium tuberculosis H37Rv
ggcgggcgaucuuggcgaca

SEQ ID NO: 3312607 - RNA, 21 nt, Mycobacterium tuberculosis H37Rv
ggcgggcgccuuggucgccgc

SEQ ID NO: 3312608 - RNA, 16 nt, Mycobacterium tuberculosis H37Rv
ggcgggcgcggguggc

SEQ ID NO: 3312609 - RNA, 17 nt, Mycobacterium tuberculosis H37Rv
ggcgggcgcggguggcg

SEQ ID NO: 3312610 - RNA, 13 nt, Mycobacterium tuberculosis H37Rv
ggcgggcggcagc

SEQ ID NO: 3312611 - RNA, 24 nt, Mycobacterium tuberculosis H37Rv
ggcgggcucuacucgcggccggcg

SEQ ID NO: 3312612 - RNA, 22 nt, Mycobacterium tuberculosis H37Rv
ggcgggcugaucgcccggcgcg

SEQ ID NO: 3312613 - RNA, 21 nt, Mycobacterium tuberculosis H37Rv
ggcgggcugauuucgugcgau

SEQ ID NO: 3312614 - RNA, 14 nt, Mycobacterium tuberculosis H37Rv
ggcgggcugcagcc

SEQ ID NO: 3312615 - RNA, 12 nt, Mycobacterium tuberculosis H37Rv
ggcggggcagaa

SEQ ID NO: 3312616 - RNA, 13 nt, Mycobacterium tuberculosis H37Rv
ggcggggccggcg

SEQ ID NO: 3312617 - RNA, 16 nt, Mycobacterium tuberculosis H37Rv
ggcggggccggcggcu

SEQ ID NO: 3312618 - RNA, 23 nt, Mycobacterium tuberculosis H37Rv
ggcgggggcgucgccgccgggca

SEQ ID NO: 3312619 - RNA, 14 nt, Mycobacterium tuberculosis H37Rv
ggcggggugagggg

SEQ ID NO: 3312620 - RNA, 14 nt, Mycobacterium tuberculosis H37Rv
ggcggggugcgccc

SEQ ID NO: 3312621 - RNA, 18 nt, Mycobacterium tuberculosis H37Rv
ggcgggguugaucaccga

SEQ ID NO: 3312622 - RNA, 17 nt, Mycobacterium tuberculosis H37Rv
ggcggguaagcgaccga

SEQ ID NO: 3312623 - RNA, 14 nt, Mycobacterium tuberculosis H37Rv
ggcgggucagcgcg

SEQ ID NO: 3312624 - RNA, 14 nt, Mycobacterium tuberculosis H37Rv
ggcgggugaacgcg

SEQ ID NO: 3312625 - RNA, 13 nt, Mycobacterium tuberculosis H37Rv
ggcgggugccgag

SEQ ID NO: 3312626 - RNA, 15 nt, Mycobacterium tuberculosis H37Rv
ggcgggugcgacauc

SEQ ID NO: 3312627 - RNA, 15 nt, Mycobacterium tuberculosis H37Rv
ggcgggugcggcgau

SEQ ID NO: 3312628 - RNA, 14 nt, Mycobacterium tuberculosis H37Rv
ggcggguggcuccu

SEQ ID NO: 3312629 - RNA, 16 nt, Mycobacterium tuberculosis H37Rv
ggcggguggugcggcc

SEQ ID NO: 3312630 - RNA, 21 nt, Mycobacterium tuberculosis H37Rv
ggcgguaaaugccugcccacc

SEQ ID NO: 3312631 - RNA, 22 nt, Mycobacterium tuberculosis H37Rv
ggcgguaacucuggugugggcg

SEQ ID NO: 3312632 - RNA, 13 nt, Mycobacterium tuberculosis H37Rv
ggcgguaauacag

SEQ ID NO: 3312633 - RNA, 22 nt, Mycobacterium tuberculosis H37Rv
ggcgguacaccgacacgccguu

SEQ ID NO: 3312634 - RNA, 13 nt, Mycobacterium tuberculosis H37Rv
ggcgguacggguc

SEQ ID NO: 3312635 - RNA, 23 nt, Mycobacterium tuberculosis H37Rv
ggcgguaguacucgcgcagguag

SEQ ID NO: 3312636 - RNA, 18 nt, Mycobacterium tuberculosis H37Rv
ggcgguagucggccagcu

SEQ ID NO: 3312637 - RNA, 21 nt, Mycobacterium tuberculosis H37Rv
ggcgguaugccacaggcugcc

SEQ ID NO: 3312638 - RNA, 21 nt, Mycobacterium tuberculosis H37Rv
ggcggucaccaccgacccgcu

SEQ ID NO: 3312639 - RNA, 12 nt, Mycobacterium tuberculosis H37Rv
ggcggucagaug

SEQ ID NO: 3312640 - RNA, 23 nt, Mycobacterium tuberculosis H37Rv
ggcggucagcagcgccgucagca

SEQ ID NO: 3312641 - RNA, 14 nt, Mycobacterium tuberculosis H37Rv
ggcggucagcggcu

SEQ ID NO: 3312642 - RNA, 19 nt, Mycobacterium tuberculosis H37Rv
ggcggucagcggcucggcg

SEQ ID NO: 3312643 - RNA, 16 nt, Mycobacterium tuberculosis H37Rv
ggcggucagcggcugg

SEQ ID NO: 3312644 - RNA, 20 nt, Mycobacterium tuberculosis H37Rv
ggcggucaggucugacagac

SEQ ID NO: 3312645 - RNA, 17 nt, Mycobacterium tuberculosis H37Rv
ggcggucccugaagcca

SEQ ID NO: 3312646 - RNA, 20 nt, Mycobacterium tuberculosis H37Rv
ggcggucccugaagccagcg

SEQ ID NO: 3312647 - RNA, 13 nt, Mycobacterium tuberculosis H37Rv
ggcggucgccgcg

SEQ ID NO: 3312648 - RNA, 12 nt, Mycobacterium tuberculosis H37Rv
ggcggucggccg

SEQ ID NO: 3312649 - RNA, 13 nt, Mycobacterium tuberculosis H37Rv
ggcggucggcugg

SEQ ID NO: 3312650 - RNA, 17 nt, Mycobacterium tuberculosis H37Rv
ggcggucucgucaaccu

SEQ ID NO: 3312651 - RNA, 12 nt, Mycobacterium tuberculosis H37Rv
ggcggucugcgc

SEQ ID NO: 3312652 - RNA, 16 nt, Mycobacterium tuberculosis H37Rv
ggcggucugggugagc

SEQ ID NO: 3312653 - RNA, 22 nt, Mycobacterium tuberculosis H37Rv
ggcggucuguaagacagcuauc

SEQ ID NO: 3312654 - RNA, 18 nt, Mycobacterium tuberculosis H37Rv
ggcggugaaaucgcacag

SEQ ID NO: 3312655 - RNA, 14 nt, Mycobacterium tuberculosis H37Rv
ggcggugaaggccc

SEQ ID NO: 3312656 - RNA, 17 nt, Mycobacterium tuberculosis H37Rv
ggcggugagccgccagg

SEQ ID NO: 3312657 - RNA, 18 nt, Mycobacterium tuberculosis H37Rv
ggcggugagccgccagga

SEQ ID NO: 3312658 - RNA, 16 nt, Mycobacterium tuberculosis H37Rv
ggcggugcccagcagc

SEQ ID NO: 3312659 - RNA, 13 nt, Mycobacterium tuberculosis H37Rv
ggcggugccgacg

SEQ ID NO: 3312660 - RNA, 12 nt, Mycobacterium tuberculosis H37Rv
ggcggugccgcc

SEQ ID NO: 3312661 - RNA, 13 nt, Mycobacterium tuberculosis H37Rv
ggcggugccgccg

SEQ ID NO: 3312662 - RNA, 15 nt, Mycobacterium tuberculosis H37Rv
ggcggugccggcggc

SEQ ID NO: 3312663 - RNA, 16 nt, Mycobacterium tuberculosis H37Rv
ggcggugccggcggcg

SEQ ID NO: 3312664 - RNA, 15 nt, Mycobacterium tuberculosis H37Rv
ggcggugcgcaccac

SEQ ID NO: 3312665 - RNA, 13 nt, Mycobacterium tuberculosis H37Rv
ggcgguggcccga

SEQ ID NO: 3312666 - RNA, 15 nt, Mycobacterium tuberculosis H37Rv
ggcgguggccgacaa

SEQ ID NO: 3312667 - RNA, 17 nt, Mycobacterium tuberculosis H37Rv
ggcgguggcgaacagca

SEQ ID NO: 3312668 - RNA, 15 nt, Mycobacterium tuberculosis H37Rv
ggcgguggcggugcu

SEQ ID NO: 3312669 - RNA, 14 nt, Mycobacterium tuberculosis H37Rv
ggcggugggcagca

SEQ ID NO: 3312670 - RNA, 18 nt, Mycobacterium tuberculosis H37Rv
ggcggugggcagcagcug

SEQ ID NO: 3312671 - RNA, 21 nt, Mycobacterium tuberculosis H37Rv
ggcggugggcuuggcgccgau

SEQ ID NO: 3312672 - RNA, 19 nt, Mycobacterium tuberculosis H37Rv
ggcggugggggcguacugu

SEQ ID NO: 3312673 - RNA, 12 nt, Mycobacterium tuberculosis H37Rv
ggcggugggucg

SEQ ID NO: 3312674 - RNA, 16 nt, Mycobacterium tuberculosis H37Rv
ggcgguggugucgcuc

SEQ ID NO: 3312675 - RNA, 17 nt, Mycobacterium tuberculosis H37Rv
ggcgguggugucgcucg

SEQ ID NO: 3312676 - RNA, 14 nt, Mycobacterium tuberculosis H37Rv
ggcgguguccagaa

SEQ ID NO: 3312677 - RNA, 14 nt, Mycobacterium tuberculosis H37Rv
ggcggugucggcgc

SEQ ID NO: 3312678 - RNA, 23 nt, Mycobacterium tuberculosis H37Rv
ggcggugucgucaucggggccug

SEQ ID NO: 3312679 - RNA, 16 nt, Mycobacterium tuberculosis H37Rv
ggcgguguugcucccg

SEQ ID NO: 3312680 - RNA, 16 nt, Mycobacterium tuberculosis H37Rv
ggcgguuccacgcugc

SEQ ID NO: 3312681 - RNA, 21 nt, Mycobacterium tuberculosis H37Rv
ggcgguuccauacagccgccg

SEQ ID NO: 3312682 - RNA, 22 nt, Mycobacterium tuberculosis H37Rv
ggcgguugaucgccggccugcu

SEQ ID NO: 3312683 - RNA, 18 nt, Mycobacterium tuberculosis H37Rv
ggcgguuuuguucccgag

SEQ ID NO: 3312684 - RNA, 23 nt, Mycobacterium tuberculosis H37Rv
ggcgguuuuguucccgaguuggu

SEQ ID NO: 3312685 - RNA, 15 nt, Mycobacterium tuberculosis H37Rv
ggcguacagcgccug

SEQ ID NO: 3312686 - RNA, 16 nt, Mycobacterium tuberculosis H37Rv
ggcguaccuucgagcg

SEQ ID NO: 3312687 - RNA, 15 nt, Mycobacterium tuberculosis H37Rv
ggcguacucggcauc

SEQ ID NO: 3312688 - RNA, 21 nt, Mycobacterium tuberculosis H37Rv
ggcguagaucaucuggcuggu

SEQ ID NO: 3312689 - RNA, 19 nt, Mycobacterium tuberculosis H37Rv
ggcguagcccaugccgaug

SEQ ID NO: 3312690 - RNA, 21 nt, Mycobacterium tuberculosis H37Rv
ggcguagcccaugccgaugcc

SEQ ID NO: 3312691 - RNA, 13 nt, Mycobacterium tuberculosis H37Rv
ggcguagcgagcg

SEQ ID NO: 3312692 - RNA, 21 nt, Mycobacterium tuberculosis H37Rv
ggcguagguccuugucggccc

SEQ ID NO: 3312693 - RNA, 14 nt, Mycobacterium tuberculosis H37Rv
ggcguagucggcgg

SEQ ID NO: 3312694 - RNA, 21 nt, Mycobacterium tuberculosis H37Rv
ggcguagucggcggugcagau

SEQ ID NO: 3312695 - RNA, 22 nt, Mycobacterium tuberculosis H37Rv
ggcguauugcaccgccaggucg

SEQ ID NO: 3312696 - RNA, 15 nt, Mycobacterium tuberculosis H37Rv
ggcguauugcggccu

SEQ ID NO: 3312697 - RNA, 20 nt, Mycobacterium tuberculosis H37Rv
ggcgucaaaggccuugacgu

SEQ ID NO: 3312698 - RNA, 19 nt, Mycobacterium tuberculosis H37Rv
ggcgucaagcaaguccacc

SEQ ID NO: 3312699 - RNA, 20 nt, Mycobacterium tuberculosis H37Rv
ggcgucaccgccggugcuga

SEQ ID NO: 3312700 - RNA, 22 nt, Mycobacterium tuberculosis H37Rv
ggcgucaccgccggugcugacg

SEQ ID NO: 3312701 - RNA, 13 nt, Mycobacterium tuberculosis H37Rv
ggcgucagcagca

SEQ ID NO: 3312702 - RNA, 21 nt, Mycobacterium tuberculosis H37Rv
ggcgucagcaguucggcgaug

SEQ ID NO: 3312703 - RNA, 14 nt, Mycobacterium tuberculosis H37Rv
ggcgucauccgcgg

SEQ ID NO: 3312704 - RNA, 15 nt, Mycobacterium tuberculosis H37Rv
ggcgucauccgcggc

SEQ ID NO: 3312705 - RNA, 16 nt, Mycobacterium tuberculosis H37Rv
ggcgucauccgcggca

SEQ ID NO: 3312706 - RNA, 21 nt, Mycobacterium tuberculosis H37Rv
ggcgucaucgacuugccgccg

SEQ ID NO: 3312707 - RNA, 18 nt, Mycobacterium tuberculosis H37Rv
ggcgucaugaacgaucgg

SEQ ID NO: 3312708 - RNA, 16 nt, Mycobacterium tuberculosis H37Rv
ggcgucaugaugucga

SEQ ID NO: 3312709 - RNA, 16 nt, Mycobacterium tuberculosis H37Rv
ggcgucaugcccaggu

SEQ ID NO: 3312710 - RNA, 12 nt, Mycobacterium tuberculosis H37Rv
ggcguccagcag

SEQ ID NO: 3312711 - RNA, 22 nt, Mycobacterium tuberculosis H37Rv
ggcguccaucgccaccgcguca

SEQ ID NO: 3312712 - RNA, 18 nt, Mycobacterium tuberculosis H37Rv
ggcgucccaaucgggauc

SEQ ID NO: 3312713 - RNA, 19 nt, Mycobacterium tuberculosis H37Rv
ggcgucccagccgaucacg

SEQ ID NO: 3312714 - RNA, 21 nt, Mycobacterium tuberculosis H37Rv
ggcgucccagccgaucacggg

SEQ ID NO: 3312715 - RNA, 15 nt, Mycobacterium tuberculosis H37Rv
ggcguguucugaucg

SEQ ID NO: 3312716 - RNA, 18 nt, Mycobacterium tuberculosis H37Rv
ggcguuaaugcuucgcgu

SEQ ID NO: 3312717 - RNA, 16 nt, Mycobacterium tuberculosis H37Rv
ggcguuacgggcgauc

SEQ ID NO: 3312718 - RNA, 14 nt, Mycobacterium tuberculosis H37Rv
ggcguucagcggcc

SEQ ID NO: 3312719 - RNA, 20 nt, Mycobacterium tuberculosis H37Rv
ggcguucccacuggaggucg

SEQ ID NO: 3312720 - RNA, 18 nt, Mycobacterium tuberculosis H37Rv
ggcguucccccacucgga

SEQ ID NO: 3312721 - RNA, 15 nt, Mycobacterium tuberculosis H37Rv
ggcguucgucggcug

SEQ ID NO: 3312722 - RNA, 16 nt, Mycobacterium tuberculosis H37Rv
ggcguugaucgacauc

SEQ ID NO: 3312723 - RNA, 17 nt, Mycobacterium tuberculosis H37Rv
ggcguugaucgccgggc

SEQ ID NO: 3312724 - RNA, 12 nt, Mycobacterium tuberculosis H37Rv
ggcguugccacc

SEQ ID NO: 3312725 - RNA, 14 nt, Mycobacterium tuberculosis H37Rv
ggcguugccaccgg

SEQ ID NO: 3312726 - RNA, 19 nt, Mycobacterium tuberculosis H37Rv
ggcguugcugaugucgccg

SEQ ID NO: 3312727 - RNA, 13 nt, Mycobacterium tuberculosis H37Rv
ggcguuggcggcu

SEQ ID NO: 3312728 - RNA, 17 nt, Mycobacterium tuberculosis H37Rv
ggcguugguggucugcc

SEQ ID NO: 3312729 - RNA, 21 nt, Mycobacterium tuberculosis H37Rv
ggcguuguuaucgaagcccga

SEQ ID NO: 3312730 - RNA, 23 nt, Mycobacterium tuberculosis H37Rv
ggcguuguuaucgaagcccgagu

SEQ ID NO: 3312731 - RNA, 19 nt, Mycobacterium tuberculosis H37Rv
ggcguuguugaccagcacg

SEQ ID NO: 3312732 - RNA, 16 nt, Mycobacterium tuberculosis H37Rv
ggcguuucggcgggcg

SEQ ID NO: 3312733 - RNA, 17 nt, Mycobacterium tuberculosis H37Rv
ggcguuugaugcgggcg

SEQ ID NO: 3312734 - RNA, 20 nt, Mycobacterium tuberculosis H37Rv
ggcuaacaccgcaggcacau

SEQ ID NO: 3312735 - RNA, 14 nt, Mycobacterium tuberculosis H37Rv
ggcuacaucggcgg

SEQ ID NO: 3312736 - RNA, 18 nt, Mycobacterium tuberculosis H37Rv
ggcuacccaauaggcgaa

SEQ ID NO: 3312737 - RNA, 22 nt, Mycobacterium tuberculosis H37Rv
ggcuaccccagggagugccgca

SEQ ID NO: 3312738 - RNA, 20 nt, Mycobacterium tuberculosis H37Rv
ggcuaccgcaggugccaccu

SEQ ID NO: 3312739 - RNA, 13 nt, Mycobacterium tuberculosis H37Rv
ggcuaccgccgac

SEQ ID NO: 3312740 - RNA, 18 nt, Mycobacterium tuberculosis H37Rv
ggcuaccgccgaccggac

SEQ ID NO: 3312741 - RNA, 20 nt, Mycobacterium tuberculosis H37Rv
ggcuaccgccuugucggcga

SEQ ID NO: 3312742 - RNA, 22 nt, Mycobacterium tuberculosis H37Rv
ggcuaccuaacccgcgccggcc

SEQ ID NO: 3312743 - RNA, 13 nt, Mycobacterium tuberculosis H37Rv
ggcuaccuuggac

SEQ ID NO: 3312744 - RNA, 15 nt, Mycobacterium tuberculosis H37Rv
ggcuacgacggcgcc

SEQ ID NO: 3312745 - RNA, 15 nt, Mycobacterium tuberculosis H37Rv
ggcuacgccuccuuc

SEQ ID NO: 3312746 - RNA, 17 nt, Mycobacterium tuberculosis H37Rv
ggcuacggcugcccguu

SEQ ID NO: 3312747 - RNA, 20 nt, Mycobacterium tuberculosis H37Rv
ggcuacggcugcccguucug

SEQ ID NO: 3312748 - RNA, 15 nt, Mycobacterium tuberculosis H37Rv
ggcuaggcaccagcg

SEQ ID NO: 3312749 - RNA, 14 nt, Mycobacterium tuberculosis H37Rv
ggcuaggccagcac

SEQ ID NO: 3312750 - RNA, 16 nt, Mycobacterium tuberculosis H37Rv
ggcuaggccagcacgg

SEQ ID NO: 3312751 - RNA, 15 nt, Mycobacterium tuberculosis H37Rv
ggcuagggcagcagc

SEQ ID NO: 3312752 - RNA, 19 nt, Mycobacterium tuberculosis H37Rv
ggcuagggcccuggcggcc

SEQ ID NO: 3312753 - RNA, 17 nt, Mycobacterium tuberculosis H37Rv
ggcuagguagucgacga

SEQ ID NO: 3312754 - RNA, 19 nt, Mycobacterium tuberculosis H37Rv
ggcuaguugagcgcugcgc

SEQ ID NO: 3312755 - RNA, 21 nt, Mycobacterium tuberculosis H37Rv
ggcuaguugagcgcugcgccg

SEQ ID NO: 3312756 - RNA, 16 nt, Mycobacterium tuberculosis H37Rv
ggcuauaucccgcccc

SEQ ID NO: 3312757 - RNA, 22 nt, Mycobacterium tuberculosis H37Rv
ggcucaacaccgaguuccucug

SEQ ID NO: 3312758 - RNA, 15 nt, Mycobacterium tuberculosis H37Rv
ggcucaaccucuggc

SEQ ID NO: 3312759 - RNA, 16 nt, Mycobacterium tuberculosis H37Rv
ggcucaaccucuggcg

SEQ ID NO: 3312760 - RNA, 20 nt, Mycobacterium tuberculosis H37Rv
ggcucaaccucuggcggcgg

SEQ ID NO: 3312761 - RNA, 21 nt, Mycobacterium tuberculosis H37Rv
ggcucaaccucuggcggcggg

SEQ ID NO: 3312762 - RNA, 13 nt, Mycobacterium tuberculosis H37Rv
ggcucacagcaca

SEQ ID NO: 3312763 - RNA, 19 nt, Mycobacterium tuberculosis H37Rv
ggcucacagcacagcgcag

SEQ ID NO: 3312764 - RNA, 20 nt, Mycobacterium tuberculosis H37Rv
ggcucacaugcccgcaccgu

SEQ ID NO: 3312765 - RNA, 17 nt, Mycobacterium tuberculosis H37Rv
ggcucacaugugcgcgu

SEQ ID NO: 3312766 - RNA, 16 nt, Mycobacterium tuberculosis H37Rv
ggcucacgcuccgccg

SEQ ID NO: 3312767 - RNA, 14 nt, Mycobacterium tuberculosis H37Rv
ggcucagcggcgac

SEQ ID NO: 3312768 - RNA, 14 nt, Mycobacterium tuberculosis H37Rv
ggcucagcgguggc

SEQ ID NO: 3312769 - RNA, 17 nt, Mycobacterium tuberculosis H37Rv
ggcucagcugggccgcu

SEQ ID NO: 3312770 - RNA, 17 nt, Mycobacterium tuberculosis H37Rv
ggcucaggugcucagcu

SEQ ID NO: 3312771 - RNA, 13 nt, Mycobacterium tuberculosis H37Rv
ggcucaucccgac

SEQ ID NO: 3312772 - RNA, 17 nt, Mycobacterium tuberculosis H37Rv
ggcuccaauugcggccg

SEQ ID NO: 3312773 - RNA, 14 nt, Mycobacterium tuberculosis H37Rv
ggcuccaccgggcc

SEQ ID NO: 3312774 - RNA, 16 nt, Mycobacterium tuberculosis H37Rv
ggcuccagcgcgcgcc

SEQ ID NO: 3312775 - RNA, 23 nt, Mycobacterium tuberculosis H37Rv
ggcucccacucccgccccgcuca

SEQ ID NO: 3312776 - RNA, 21 nt, Mycobacterium tuberculosis H37Rv
ggcuccccggauuccucguca

SEQ ID NO: 3312777 - RNA, 15 nt, Mycobacterium tuberculosis H37Rv
ggcuccgaacauggc

SEQ ID NO: 3312778 - RNA, 22 nt, Mycobacterium tuberculosis H37Rv
ggcuccgaacauggccagcauc

SEQ ID NO: 3312779 - RNA, 20 nt, Mycobacterium tuberculosis H37Rv
ggcuccgauucuucgaugau

SEQ ID NO: 3312780 - RNA, 13 nt, Mycobacterium tuberculosis H37Rv
ggcuccgcaacca

SEQ ID NO: 3312781 - RNA, 14 nt, Mycobacterium tuberculosis H37Rv
ggcuccgccagcgc

SEQ ID NO: 3312782 - RNA, 16 nt, Mycobacterium tuberculosis H37Rv
ggcuccgccagcgccg

SEQ ID NO: 3312783 - RNA, 13 nt, Mycobacterium tuberculosis H37Rv
ggcuccgcccagg

SEQ ID NO: 3312784 - RNA, 12 nt, Mycobacterium tuberculosis H37Rv
ggcuccgccguu

SEQ ID NO: 3312785 - RNA, 13 nt, Mycobacterium tuberculosis H37Rv
ggcuccggccagg

SEQ ID NO: 3312786 - RNA, 15 nt, Mycobacterium tuberculosis H37Rv
ggcuccggccagggg

SEQ ID NO: 3312787 - RNA, 13 nt, Mycobacterium tuberculosis H37Rv
ggcuccggcggca

SEQ ID NO: 3312788 - RNA, 15 nt, Mycobacterium tuberculosis H37Rv
ggcuccggcggcagc

SEQ ID NO: 3312789 - RNA, 16 nt, Mycobacterium tuberculosis H37Rv
ggcuccggcggcagcg

SEQ ID NO: 3312790 - RNA, 17 nt, Mycobacterium tuberculosis H37Rv
ggcuccggcggcagcgg

SEQ ID NO: 3312791 - RNA, 20 nt, Mycobacterium tuberculosis H37Rv
ggcuccgggaugaagcucga

SEQ ID NO: 3312792 - RNA, 23 nt, Mycobacterium tuberculosis H37Rv
ggcuccgugguugccgaagccgg

SEQ ID NO: 3312793 - RNA, 17 nt, Mycobacterium tuberculosis H37Rv
ggcuccguuguccagcg

SEQ ID NO: 3312794 - RNA, 20 nt, Mycobacterium tuberculosis H37Rv
ggcuccuccgguaucggcga

SEQ ID NO: 3312795 - RNA, 21 nt, Mycobacterium tuberculosis H37Rv
ggcuccuccgguaucggcgac

SEQ ID NO: 3312796 - RNA, 21 nt, Mycobacterium tuberculosis H37Rv
ggcuccucgugcacgcacagc

SEQ ID NO: 3312797 - RNA, 17 nt, Mycobacterium tuberculosis H37Rv
ggcucgaaccgacgcgu

SEQ ID NO: 3312798 - RNA, 16 nt, Mycobacterium tuberculosis H37Rv
ggcucgaagcuggcgc

SEQ ID NO: 3312799 - RNA, 14 nt, Mycobacterium tuberculosis H37Rv
ggcucgacgaugcg

SEQ ID NO: 3312800 - RNA, 15 nt, Mycobacterium tuberculosis H37Rv
ggcucgacugccacc

SEQ ID NO: 3312801 - RNA, 16 nt, Mycobacterium tuberculosis H37Rv
ggcucgagucgcagca

SEQ ID NO: 3312802 - RNA, 22 nt, Mycobacterium tuberculosis H37Rv
ggcucgaguguggccgaaagcc

SEQ ID NO: 3312803 - RNA, 21 nt, Mycobacterium tuberculosis H37Rv
ggcucgcauguucuccacgcc

SEQ ID NO: 3312804 - RNA, 18 nt, Mycobacterium tuberculosis H37Rv
ggcucgcgaucgucacgg

SEQ ID NO: 3312805 - RNA, 16 nt, Mycobacterium tuberculosis H37Rv
ggcucgcgcucgaugg

SEQ ID NO: 3312806 - RNA, 13 nt, Mycobacterium tuberculosis H37Rv
ggcucgcucgccg

SEQ ID NO: 3312807 - RNA, 12 nt, Mycobacterium tuberculosis H37Rv
ggcucgcugcaa

SEQ ID NO: 3312808 - RNA, 16 nt, Mycobacterium tuberculosis H37Rv
ggcucgcugcaacauc

SEQ ID NO: 3312809 - RNA, 18 nt, Mycobacterium tuberculosis H37Rv
ggcucgcugcaccagcug

SEQ ID NO: 3312810 - RNA, 14 nt, Mycobacterium tuberculosis H37Rv
ggcucggcaggccc

SEQ ID NO: 3312811 - RNA, 12 nt, Mycobacterium tuberculosis H37Rv
ggcucggcggcc

SEQ ID NO: 3312812 - RNA, 14 nt, Mycobacterium tuberculosis H37Rv
ggcuggcggcgacc

SEQ ID NO: 3312813 - RNA, 22 nt, Mycobacterium tuberculosis H37Rv
ggcuggcggcguggcgccggcc

SEQ ID NO: 3312814 - RNA, 16 nt, Mycobacterium tuberculosis H37Rv
ggcuggcgucaccgcg

SEQ ID NO: 3312815 - RNA, 14 nt, Mycobacterium tuberculosis H37Rv
ggcuggcugugccg

SEQ ID NO: 3312816 - RNA, 13 nt, Mycobacterium tuberculosis H37Rv
ggcugggaaagca

SEQ ID NO: 3312817 - RNA, 21 nt, Mycobacterium tuberculosis H37Rv
ggcugggacgucuccaccgcg

SEQ ID NO: 3312818 - RNA, 19 nt, Mycobacterium tuberculosis H37Rv
ggcuggggccccgcgccgg

SEQ ID NO: 3312819 - RNA, 14 nt, Mycobacterium tuberculosis H37Rv
ggcuggggccgcuu

SEQ ID NO: 3312820 - RNA, 15 nt, Mycobacterium tuberculosis H37Rv
ggcugggggauaccg

SEQ ID NO: 3312821 - RNA, 17 nt, Mycobacterium tuberculosis H37Rv
ggcugggggccggcagc

SEQ ID NO: 3312822 - RNA, 14 nt, Mycobacterium tuberculosis H37Rv
ggcugguaggcgcu

SEQ ID NO: 3312823 - RNA, 22 nt, Mycobacterium tuberculosis H37Rv
ggcuggucacccguaucggguu

SEQ ID NO: 3312824 - RNA, 20 nt, Mycobacterium tuberculosis H37Rv
ggcuggucaggaucgcaccg

SEQ ID NO: 3312825 - RNA, 20 nt, Mycobacterium tuberculosis H37Rv
ggcugguccgggugccggug

SEQ ID NO: 3312826 - RNA, 13 nt, Mycobacterium tuberculosis H37Rv
ggcuggucgccgu

SEQ ID NO: 3312827 - RNA, 19 nt, Mycobacterium tuberculosis H37Rv
ggcuggucuacccgcggcg

SEQ ID NO: 3312828 - RNA, 13 nt, Mycobacterium tuberculosis H37Rv
ggcuggugcaggu

SEQ ID NO: 3312829 - RNA, 19 nt, Mycobacterium tuberculosis H37Rv
ggcuggugccaacugcgcc

SEQ ID NO: 3312830 - RNA, 18 nt, Mycobacterium tuberculosis H37Rv
ggcuggugggacgcggcc

SEQ ID NO: 3312831 - RNA, 22 nt, Mycobacterium tuberculosis H37Rv
ggcuggugucagcugauuaccg

SEQ ID NO: 3312832 - RNA, 15 nt, Mycobacterium tuberculosis H37Rv
ggcugguguccagcc

SEQ ID NO: 3312833 - RNA, 16 nt, Mycobacterium tuberculosis H37Rv
ggcugguuucggccgc

SEQ ID NO: 3312834 - RNA, 15 nt, Mycobacterium tuberculosis H37Rv
ggcuguaacacccgg

SEQ ID NO: 3312835 - RNA, 20 nt, Mycobacterium tuberculosis H37Rv
ggcuguaacacccggccgcc

SEQ ID NO: 3312836 - RNA, 21 nt, Mycobacterium tuberculosis H37Rv
ggcuguacucgcggcgcggcc

SEQ ID NO: 3312837 - RNA, 22 nt, Mycobacterium tuberculosis H37Rv
ggcuguaguccgcuacugcgac

SEQ ID NO: 3312838 - RNA, 14 nt, Mycobacterium tuberculosis H37Rv
ggcugucacaagcc

SEQ ID NO: 3312839 - RNA, 18 nt, Mycobacterium tuberculosis H37Rv
ggcugucacaagccugcc

SEQ ID NO: 3312840 - RNA, 21 nt, Mycobacterium tuberculosis H37Rv
ggcugucacaagccugccggc

SEQ ID NO: 3312841 - RNA, 15 nt, Mycobacterium tuberculosis H37Rv
ggcugucacgccugc

SEQ ID NO: 3312842 - RNA, 18 nt, Mycobacterium tuberculosis H37Rv
ggcugucacgccugccac

SEQ ID NO: 3312843 - RNA, 20 nt, Mycobacterium tuberculosis H37Rv
ggcugucaguucccgcuuga

SEQ ID NO: 3312844 - RNA, 13 nt, Mycobacterium tuberculosis H37Rv
ggcuguccaccga

SEQ ID NO: 3312845 - RNA, 15 nt, Mycobacterium tuberculosis H37Rv
ggcuguccagcagcg

SEQ ID NO: 3312846 - RNA, 19 nt, Mycobacterium tuberculosis H37Rv
ggcuguccgaccucgccgc

SEQ ID NO: 3312847 - RNA, 20 nt, Mycobacterium tuberculosis H37Rv
ggcuguccgaccucgccgcg

SEQ ID NO: 3312848 - RNA, 14 nt, Mycobacterium tuberculosis H37Rv
ggcuguccuccuga

SEQ ID NO: 3312849 - RNA, 21 nt, Mycobacterium tuberculosis H37Rv
ggcugucgagucgguccugcc

SEQ ID NO: 3312850 - RNA, 19 nt, Mycobacterium tuberculosis H37Rv
ggcugucgugccucucggg

SEQ ID NO: 3312851 - RNA, 21 nt, Mycobacterium tuberculosis H37Rv
ggcugucguuugacgagccga

SEQ ID NO: 3312852 - RNA, 20 nt, Mycobacterium tuberculosis H37Rv
ggcugucugcccgcgcucgg

SEQ ID NO: 3312853 - RNA, 18 nt, Mycobacterium tuberculosis H37Rv
ggcugugaucgagucgcg

SEQ ID NO: 3312854 - RNA, 23 nt, Mycobacterium tuberculosis H37Rv
ggcugugauguuguucagcaggc

SEQ ID NO: 3312855 - RNA, 17 nt, Mycobacterium tuberculosis H37Rv
ggcugugccccagggca

SEQ ID NO: 3312856 - RNA, 23 nt, Mycobacterium tuberculosis H37Rv
ggcugugccgagcuugucgagca

SEQ ID NO: 3312857 - RNA, 15 nt, Mycobacterium tuberculosis H37Rv
ggcuguggccagcau

SEQ ID NO: 3312858 - RNA, 13 nt, Mycobacterium tuberculosis H37Rv
ggcuguggccgcg

SEQ ID NO: 3312859 - RNA, 17 nt, Mycobacterium tuberculosis H37Rv
ggcuguggcgcgcaugg

SEQ ID NO: 3312860 - RNA, 15 nt, Mycobacterium tuberculosis H37Rv
ggcuuaccggcgggc

SEQ ID NO: 3312861 - RNA, 17 nt, Mycobacterium tuberculosis H37Rv
ggcuuaugcgucugcuc

SEQ ID NO: 3312862 - RNA, 21 nt, Mycobacterium tuberculosis H37Rv
ggcuuaugcgucugcucgccc

SEQ ID NO: 3312863 - RNA, 21 nt, Mycobacterium tuberculosis H37Rv
ggcuucaguccggccccccga

SEQ ID NO: 3312864 - RNA, 22 nt, Mycobacterium tuberculosis H37Rv
ggcuucaguccggccccccgac

SEQ ID NO: 3312865 - RNA, 22 nt, Mycobacterium tuberculosis H37Rv
ggcuuccggggugacaucgcga

SEQ ID NO: 3312866 - RNA, 19 nt, Mycobacterium tuberculosis H37Rv
ggcuuccuccgacgcgauc

SEQ ID NO: 3312867 - RNA, 13 nt, Mycobacterium tuberculosis H37Rv
ggcuuccuccucg

SEQ ID NO: 3312868 - RNA, 18 nt, Mycobacterium tuberculosis H37Rv
ggcuucgacggcggccaa

SEQ ID NO: 3312869 - RNA, 18 nt, Mycobacterium tuberculosis H37Rv
ggcuucgacgucggcgac

SEQ ID NO: 3312870 - RNA, 22 nt, Mycobacterium tuberculosis H37Rv
ggcuucgacgucggcgaccagg

SEQ ID NO: 3312871 - RNA, 19 nt, Mycobacterium tuberculosis H37Rv
ggcuucgccgcgggacaga

SEQ ID NO: 3312872 - RNA, 22 nt, Mycobacterium tuberculosis H37Rv
ggcuucgcgguuggcggcgaug

SEQ ID NO: 3312873 - RNA, 15 nt, Mycobacterium tuberculosis H37Rv
ggcuucggcgagcgc

SEQ ID NO: 3312874 - RNA, 20 nt, Mycobacterium tuberculosis H37Rv
ggcuucgucggccagcagca

SEQ ID NO: 3312875 - RNA, 15 nt, Mycobacterium tuberculosis H37Rv
ggcuucuagcccguu

SEQ ID NO: 3312876 - RNA, 18 nt, Mycobacterium tuberculosis H37Rv
ggcuugacccuugggcac

SEQ ID NO: 3312877 - RNA, 15 nt, Mycobacterium tuberculosis H37Rv
ggcuugacugcacac

SEQ ID NO: 3312878 - RNA, 20 nt, Mycobacterium tuberculosis H37Rv
ggcuugacugcacaccaccg

SEQ ID NO: 3312879 - RNA, 22 nt, Mycobacterium tuberculosis H37Rv
ggcuugcaaggucgcugcuugc

SEQ ID NO: 3312880 - RNA, 14 nt, Mycobacterium tuberculosis H37Rv
ggcuugccccgccg

SEQ ID NO: 3312881 - RNA, 17 nt, Mycobacterium tuberculosis H37Rv
ggcuugccugcgccgag

SEQ ID NO: 3312882 - RNA, 17 nt, Mycobacterium tuberculosis H37Rv
ggcuugcgauuggcugg

SEQ ID NO: 3312883 - RNA, 18 nt, Mycobacterium tuberculosis H37Rv
ggcuugcgauuggcuggg

SEQ ID NO: 3312884 - RNA, 17 nt, Mycobacterium tuberculosis H37Rv
ggcuugcgcgagcagac

SEQ ID NO: 3312885 - RNA, 20 nt, Mycobacterium tuberculosis H37Rv
ggcuugcgcgcaggugcugg

SEQ ID NO: 3312886 - RNA, 20 nt, Mycobacterium tuberculosis H37Rv
ggcuuggccguaggcggcga

SEQ ID NO: 3312887 - RNA, 23 nt, Mycobacterium tuberculosis H37Rv
ggcuuggccuagccgcggcaccg

SEQ ID NO: 3312888 - RNA, 16 nt, Mycobacterium tuberculosis H37Rv
ggcuuggcgucggccg

SEQ ID NO: 3312889 - RNA, 19 nt, Mycobacterium tuberculosis H37Rv
ggcuugggaaacccggcca

SEQ ID NO: 3312890 - RNA, 15 nt, Mycobacterium tuberculosis H37Rv
ggcuugggccaggcc

SEQ ID NO: 3312891 - RNA, 20 nt, Mycobacterium tuberculosis H37Rv
ggcuuggggucccgccgggu

SEQ ID NO: 3312892 - RNA, 21 nt, Mycobacterium tuberculosis H37Rv
ggcuuggugaaccgcgcggcg

SEQ ID NO: 3312893 - RNA, 16 nt, Mycobacterium tuberculosis H37Rv
ggcuuggugcccagcg

SEQ ID NO: 3312894 - RNA, 20 nt, Mycobacterium tuberculosis H37Rv
ggcuugguguauucgcggau

SEQ ID NO: 3312895 - RNA, 13 nt, Mycobacterium tuberculosis H37Rv
ggcuugugcccaa

SEQ ID NO: 3312896 - RNA, 22 nt, Mycobacterium tuberculosis H37Rv
ggcuugugcccaauagccggau

SEQ ID NO: 3312897 - RNA, 18 nt, Mycobacterium tuberculosis H37Rv
ggcuuucagcaccggauc

SEQ ID NO: 3312898 - RNA, 15 nt, Mycobacterium tuberculosis H37Rv
ggcuuuggacagguc

SEQ ID NO: 3312899 - RNA, 17 nt, Mycobacterium tuberculosis H37Rv
ggcuuuggacaggucaa

SEQ ID NO: 3312900 - RNA, 17 nt, Mycobacterium tuberculosis H37Rv
ggcuuuuacgucugcuc

SEQ ID NO: 3312901 - RNA, 18 nt, Mycobacterium tuberculosis H37Rv
ggcuuuuacgucugcucg

SEQ ID NO: 3312902 - RNA, 20 nt, Mycobacterium tuberculosis H37Rv
ggcuuuugcgucugcucgcc

SEQ ID NO: 3312903 - RNA, 22 nt, Mycobacterium tuberculosis H37Rv
gggaaaacgggguggcacgcau

SEQ ID NO: 3312904 - RNA, 12 nt, Mycobacterium tuberculosis H37Rv
gggaaacaccgg

SEQ ID NO: 3312905 - RNA, 15 nt, Mycobacterium tuberculosis H37Rv
gggaaacccggccag

SEQ ID NO: 3312906 - RNA, 13 nt, Mycobacterium tuberculosis H37Rv
gggaacguccagc

SEQ ID NO: 3312907 - RNA, 22 nt, Mycobacterium tuberculosis H37Rv
gggaacguccagccguggcggc

SEQ ID NO: 3312908 - RNA, 19 nt, Mycobacterium tuberculosis H37Rv
gggauuucgcgucugcucg

SEQ ID NO: 3312909 - RNA, 18 nt, Mycobacterium tuberculosis H37Rv
gggauuuugcgucugcuc

SEQ ID NO: 3312910 - RNA, 19 nt, Mycobacterium tuberculosis H37Rv
gggauuuugcgucugcuca

SEQ ID NO: 3312911 - RNA, 17 nt, Mycobacterium tuberculosis H37Rv
gggcaaacugggcaccg

SEQ ID NO: 3312912 - RNA, 16 nt, Mycobacterium tuberculosis H37Rv
gggcaaagucgguguc

SEQ ID NO: 3312913 - RNA, 17 nt, Mycobacterium tuberculosis H37Rv
gggcaaaucaagcacag

SEQ ID NO: 3312914 - RNA, 19 nt, Mycobacterium tuberculosis H37Rv
gggcaaaucaagcacagcc

SEQ ID NO: 3312915 - RNA, 22 nt, Mycobacterium tuberculosis H37Rv
gggcaaaucaagcacagcccgg

SEQ ID NO: 3312916 - RNA, 18 nt, Mycobacterium tuberculosis H37Rv
gggcaaccagcagcaggu

SEQ ID NO: 3312917 - RNA, 14 nt, Mycobacterium tuberculosis H37Rv
gggcaacgccucga

SEQ ID NO: 3312918 - RNA, 14 nt, Mycobacterium tuberculosis H37Rv
gggcaacugcagca

SEQ ID NO: 3312919 - RNA, 17 nt, Mycobacterium tuberculosis H37Rv
gggcaagcugaccgcca

SEQ ID NO: 3312920 - RNA, 16 nt, Mycobacterium tuberculosis H37Rv
gggcaaggacaagccg

SEQ ID NO: 3312921 - RNA, 15 nt, Mycobacterium tuberculosis H37Rv
gggcaaggcggcggc

SEQ ID NO: 3312922 - RNA, 16 nt, Mycobacterium tuberculosis H37Rv
gggcaaggcggcggcc

SEQ ID NO: 3312923 - RNA, 17 nt, Mycobacterium tuberculosis H37Rv
gggcaaggcggcggcca

SEQ ID NO: 3312924 - RNA, 19 nt, Mycobacterium tuberculosis H37Rv
gggcaauacguagucgccg

SEQ ID NO: 3312925 - RNA, 16 nt, Mycobacterium tuberculosis H37Rv
gggcaaucacaucaaa

SEQ ID NO: 3312926 - RNA, 20 nt, Mycobacterium tuberculosis H37Rv
gggcacaaccagaucuguac

SEQ ID NO: 3312927 - RNA, 20 nt, Mycobacterium tuberculosis H37Rv
gggcacaauaggcuccagcg

SEQ ID NO: 3312928 - RNA, 20 nt, Mycobacterium tuberculosis H37Rv
gggcacaccgguggcgcccu

SEQ ID NO: 3312929 - RNA, 12 nt, Mycobacterium tuberculosis H37Rv
gggcacagccag

SEQ ID NO: 3312930 - RNA, 15 nt, Mycobacterium tuberculosis H37Rv
gggcacagccauggu

SEQ ID NO: 3312931 - RNA, 18 nt, Mycobacterium tuberculosis H37Rv
gggcaccagcgaauccag

SEQ ID NO: 3312932 - RNA, 14 nt, Mycobacterium tuberculosis H37Rv
gggcaccagucgcc

SEQ ID NO: 3312933 - RNA, 13 nt, Mycobacterium tuberculosis H37Rv
gggcaccauaucg

SEQ ID NO: 3312934 - RNA, 14 nt, Mycobacterium tuberculosis H37Rv
gggcaccgagcuga

SEQ ID NO: 3312935 - RNA, 16 nt, Mycobacterium tuberculosis H37Rv
gggcaccgagcugagc

SEQ ID NO: 3312936 - RNA, 22 nt, Mycobacterium tuberculosis H37Rv
gggcaccgagcugagcggccag

SEQ ID NO: 3312937 - RNA, 22 nt, Mycobacterium tuberculosis H37Rv
gggcaccgguuugacguccagg

SEQ ID NO: 3312938 - RNA, 12 nt, Mycobacterium tuberculosis H37Rv
gggcaccgucgg

SEQ ID NO: 3312939 - RNA, 19 nt, Mycobacterium tuberculosis H37Rv
gggcaccuuggccaggaag

SEQ ID NO: 3312940 - RNA, 13 nt, Mycobacterium tuberculosis H37Rv
gggcacgcccucg

SEQ ID NO: 3312941 - RNA, 15 nt, Mycobacterium tuberculosis H37Rv
gggcacgcgaggcgc

SEQ ID NO: 3312942 - RNA, 16 nt, Mycobacterium tuberculosis H37Rv
gggcacggaacgcgag

SEQ ID NO: 3312943 - RNA, 20 nt, Mycobacterium tuberculosis H37Rv
gggcacguugugaucgucag

SEQ ID NO: 3312944 - RNA, 20 nt, Mycobacterium tuberculosis H37Rv
gggcacuccgggcucggcgu

SEQ ID NO: 3312945 - RNA, 22 nt, Mycobacterium tuberculosis H37Rv
gggcacucggcccggcccgggu

SEQ ID NO: 3312946 - RNA, 14 nt, Mycobacterium tuberculosis H37Rv
gggcacugguggcg

SEQ ID NO: 3312947 - RNA, 17 nt, Mycobacterium tuberculosis H37Rv
gggcagaaucggugggc

SEQ ID NO: 3312948 - RNA, 20 nt, Mycobacterium tuberculosis H37Rv
gggcagaaucggugggcggg

SEQ ID NO: 3312949 - RNA, 21 nt, Mycobacterium tuberculosis H37Rv
gggcagaaucggugggcgggc

SEQ ID NO: 3312950 - RNA, 20 nt, Mycobacterium tuberculosis H37Rv
gggcagaccgaucggcaggc

SEQ ID NO: 3312951 - RNA, 16 nt, Mycobacterium tuberculosis H37Rv
gggcagauucuucacc

SEQ ID NO: 3312952 - RNA, 16 nt, Mycobacterium tuberculosis H37Rv
gggcagccccuccgcg

SEQ ID NO: 3312953 - RNA, 11 nt, Mycobacterium tuberculosis H37Rv
gggcagccgca

SEQ ID NO: 3312954 - RNA, 15 nt, Mycobacterium tuberculosis H37Rv
gggcagccgcccgcc

SEQ ID NO: 3312955 - RNA, 11 nt, Mycobacterium tuberculosis H37Rv
gggcagccgcg

SEQ ID NO: 3312956 - RNA, 11 nt, Mycobacterium tuberculosis H37Rv
gggcagccugc

SEQ ID NO: 3312957 - RNA, 23 nt, Mycobacterium tuberculosis H37Rv
gggcagcgaucuugguggccuca

SEQ ID NO: 3312958 - RNA, 15 nt, Mycobacterium tuberculosis H37Rv
gggcagcgccaggcc

SEQ ID NO: 3312959 - RNA, 14 nt, Mycobacterium tuberculosis H37Rv
gggcagcgccucca

SEQ ID NO: 3312960 - RNA, 21 nt, Mycobacterium tuberculosis H37Rv
gggcagcgcgugcuguggaug

SEQ ID NO: 3312961 - RNA, 19 nt, Mycobacterium tuberculosis H37Rv
gggcagcgggcccggacaa

SEQ ID NO: 3312962 - RNA, 11 nt, Mycobacterium tuberculosis H37Rv
gggcagcucgu

SEQ ID NO: 3312963 - RNA, 16 nt, Mycobacterium tuberculosis H37Rv
gggcagcugggcagga

SEQ ID NO: 3312964 - RNA, 14 nt, Mycobacterium tuberculosis H37Rv
gggcagcuguucgg

SEQ ID NO: 3312965 - RNA, 20 nt, Mycobacterium tuberculosis H37Rv
gggcaggagcagcacgucga

SEQ ID NO: 3312966 - RNA, 22 nt, Mycobacterium tuberculosis H37Rv
gggcaggaucgaggcgucggca

SEQ ID NO: 3312967 - RNA, 23 nt, Mycobacterium tuberculosis H37Rv
gggcaggaucuccgggucgaugu

SEQ ID NO: 3312968 - RNA, 17 nt, Mycobacterium tuberculosis H37Rv
gggcaggccauccgggc

SEQ ID NO: 3312969 - RNA, 22 nt, Mycobacterium tuberculosis H37Rv
gggcaggccccacuggugcagc

SEQ ID NO: 3312970 - RNA, 14 nt, Mycobacterium tuberculosis H37Rv
gggcaggccgucga

SEQ ID NO: 3312971 - RNA, 14 nt, Mycobacterium tuberculosis H37Rv
gggcaggcggccag

SEQ ID NO: 3312972 - RNA, 14 nt, Mycobacterium tuberculosis H37Rv
gggcagucaacucc

SEQ ID NO: 3312973 - RNA, 21 nt, Mycobacterium tuberculosis H37Rv
gggcagucaggccuagcgcgg

SEQ ID NO: 3312974 - RNA, 14 nt, Mycobacterium tuberculosis H37Rv
gggcaguccaggca

SEQ ID NO: 3312975 - RNA, 13 nt, Mycobacterium tuberculosis H37Rv
gggcagugaacau

SEQ ID NO: 3312976 - RNA, 13 nt, Mycobacterium tuberculosis H37Rv
gggcagugcgcgg

SEQ ID NO: 3312977 - RNA, 16 nt, Mycobacterium tuberculosis H37Rv
gggcaguggcagcccg

SEQ ID NO: 3312978 - RNA, 18 nt, Mycobacterium tuberculosis H37Rv
gggcaguuuggcggcagg

SEQ ID NO: 3312979 - RNA, 19 nt, Mycobacterium tuberculosis H37Rv
gggcaucagcagagccccg

SEQ ID NO: 3312980 - RNA, 14 nt, Mycobacterium tuberculosis H37Rv
gggcauccuucacc

SEQ ID NO: 3312981 - RNA, 12 nt, Mycobacterium tuberculosis H37Rv
gggcaucgucgc

SEQ ID NO: 3312982 - RNA, 18 nt, Mycobacterium tuberculosis H37Rv
gggcaucgucgccgagcg

SEQ ID NO: 3312983 - RNA, 22 nt, Mycobacterium tuberculosis H37Rv
gggcaucgucgucgcugccgcc

SEQ ID NO: 3312984 - RNA, 21 nt, Mycobacterium tuberculosis H37Rv
gggcaucucggcuacgccucg

SEQ ID NO: 3312985 - RNA, 15 nt, Mycobacterium tuberculosis H37Rv
gggcaugauguugaa

SEQ ID NO: 3312986 - RNA, 21 nt, Mycobacterium tuberculosis H37Rv
gggcaugccggcgaagccggc

SEQ ID NO: 3312987 - RNA, 16 nt, Mycobacterium tuberculosis H37Rv
gggcauggugguggcc

SEQ ID NO: 3312988 - RNA, 14 nt, Mycobacterium tuberculosis H37Rv
gggcaugucgccga

SEQ ID NO: 3312989 - RNA, 23 nt, Mycobacterium tuberculosis H37Rv
gggcaugucgccgaacgccacca

SEQ ID NO: 3312990 - RNA, 18 nt, Mycobacterium tuberculosis H37Rv
gggcauucccgcucgcag

SEQ ID NO: 3312991 - RNA, 17 nt, Mycobacterium tuberculosis H37Rv
gggccaaagccgucagc

SEQ ID NO: 3312992 - RNA, 15 nt, Mycobacterium tuberculosis H37Rv
gggccacagcaacgu

SEQ ID NO: 3312993 - RNA, 16 nt, Mycobacterium tuberculosis H37Rv
gggccaccaccacggc

SEQ ID NO: 3312994 - RNA, 19 nt, Mycobacterium tuberculosis H37Rv
gggccaccaccacggccag

SEQ ID NO: 3312995 - RNA, 13 nt, Mycobacterium tuberculosis H37Rv
gggccaccaccuc

SEQ ID NO: 3312996 - RNA, 21 nt, Mycobacterium tuberculosis H37Rv
gggccaccaguuguccggcua

SEQ ID NO: 3312997 - RNA, 21 nt, Mycobacterium tuberculosis H37Rv
gggccaccgcugucagccgac

SEQ ID NO: 3312998 - RNA, 22 nt, Mycobacterium tuberculosis H37Rv
gggccacgcuucuuccgcgcgc

SEQ ID NO: 3312999 - RNA, 15 nt, Mycobacterium tuberculosis H37Rv
gggccacguagcagc

SEQ ID NO: 3313000 - RNA, 21 nt, Mycobacterium tuberculosis H37Rv
gggccagcaaguacgcgucgg

SEQ ID NO: 3313001 - RNA, 13 nt, Mycobacterium tuberculosis H37Rv
gggccagcagccg

SEQ ID NO: 3313002 - RNA, 12 nt, Mycobacterium tuberculosis H37Rv
gggccagccgcu

SEQ ID NO: 3313003 - RNA, 13 nt, Mycobacterium tuberculosis H37Rv
gggccagccgcuc

SEQ ID NO: 3313004 - RNA, 14 nt, Mycobacterium tuberculosis H37Rv
gggccagccgcuca

SEQ ID NO: 3313005 - RNA, 14 nt, Mycobacterium tuberculosis H37Rv
gggccugggccgca

SEQ ID NO: 3313006 - RNA, 17 nt, Mycobacterium tuberculosis H37Rv
gggcgaauccggcgggu

SEQ ID NO: 3313007 - RNA, 15 nt, Mycobacterium tuberculosis H37Rv
gggcgacagcggcga

SEQ ID NO: 3313008 - RNA, 19 nt, Mycobacterium tuberculosis H37Rv
gggcgacggaaucauguac

SEQ ID NO: 3313009 - RNA, 12 nt, Mycobacterium tuberculosis H37Rv
gggcgacggcga

SEQ ID NO: 3313010 - RNA, 16 nt, Mycobacterium tuberculosis H37Rv
gggcgacuaccggcuc

SEQ ID NO: 3313011 - RNA, 16 nt, Mycobacterium tuberculosis H37Rv
gggcgacuggaccgau

SEQ ID NO: 3313012 - RNA, 16 nt, Mycobacterium tuberculosis H37Rv
gggcgaguacaggcgc

SEQ ID NO: 3313013 - RNA, 17 nt, Mycobacterium tuberculosis H37Rv
gggcgagucccggcggu

SEQ ID NO: 3313014 - RNA, 17 nt, Mycobacterium tuberculosis H37Rv
gggcgagucgggggccg

SEQ ID NO: 3313015 - RNA, 20 nt, Mycobacterium tuberculosis H37Rv
gggcgagucgggggccgcgu

SEQ ID NO: 3313016 - RNA, 17 nt, Mycobacterium tuberculosis H37Rv
gggcgagugucagcaga

SEQ ID NO: 3313017 - RNA, 22 nt, Mycobacterium tuberculosis H37Rv
gggcgaucgcuucgcaagucau

SEQ ID NO: 3313018 - RNA, 17 nt, Mycobacterium tuberculosis H37Rv
gggcgaucgucagccag

SEQ ID NO: 3313019 - RNA, 15 nt, Mycobacterium tuberculosis H37Rv
gggcgaugcugggcg

SEQ ID NO: 3313020 - RNA, 20 nt, Mycobacterium tuberculosis H37Rv
gggcgauucugcgucugcuc

SEQ ID NO: 3313021 - RNA, 20 nt, Mycobacterium tuberculosis H37Rv
gggcgauucugugucugcuc

SEQ ID NO: 3313022 - RNA, 19 nt, Mycobacterium tuberculosis H37Rv
gggcgauuuugcgucugcu

SEQ ID NO: 3313023 - RNA, 22 nt, Mycobacterium tuberculosis H37Rv
gggcgauuuugcgucugcucgc

SEQ ID NO: 3313024 - RNA, 14 nt, Mycobacterium tuberculosis H37Rv
gggcgcaacgggac

SEQ ID NO: 3313025 - RNA, 16 nt, Mycobacterium tuberculosis H37Rv
gggcgcaccgcggacc

SEQ ID NO: 3313026 - RNA, 17 nt, Mycobacterium tuberculosis H37Rv
gggcgcaccgcggaccg

SEQ ID NO: 3313027 - RNA, 13 nt, Mycobacterium tuberculosis H37Rv
gggcgcagguugg

SEQ ID NO: 3313028 - RNA, 23 nt, Mycobacterium tuberculosis H37Rv
gggcgccacgggugacucgggca

SEQ ID NO: 3313029 - RNA, 12 nt, Mycobacterium tuberculosis H37Rv
gggcgccccagg

SEQ ID NO: 3313030 - RNA, 18 nt, Mycobacterium tuberculosis H37Rv
gggcgcccgccccgcgcc

SEQ ID NO: 3313031 - RNA, 21 nt, Mycobacterium tuberculosis H37Rv
gggcgccgaauuggcccgggu

SEQ ID NO: 3313032 - RNA, 16 nt, Mycobacterium tuberculosis H37Rv
gggcgccgacaccggc

SEQ ID NO: 3313033 - RNA, 17 nt, Mycobacterium tuberculosis H37Rv
gggcgccgcuaggugac

SEQ ID NO: 3313034 - RNA, 12 nt, Mycobacterium tuberculosis H37Rv
gggcgccggugu

SEQ ID NO: 3313035 - RNA, 14 nt, Mycobacterium tuberculosis H37Rv
gggcgccucgguga

SEQ ID NO: 3313036 - RNA, 19 nt, Mycobacterium tuberculosis H37Rv
gggcgccuucaccuggugu

SEQ ID NO: 3313037 - RNA, 17 nt, Mycobacterium tuberculosis H37Rv
gggcgccuuccaggcgg

SEQ ID NO: 3313038 - RNA, 16 nt, Mycobacterium tuberculosis H37Rv
gggcgcgcaucugcuc

SEQ ID NO: 3313039 - RNA, 18 nt, Mycobacterium tuberculosis H37Rv
gggcgcgccggcuagggc

SEQ ID NO: 3313040 - RNA, 15 nt, Mycobacterium tuberculosis H37Rv
gggcgcggcccauga

SEQ ID NO: 3313041 - RNA, 12 nt, Mycobacterium tuberculosis H37Rv
gggcgcggggcg

SEQ ID NO: 3313042 - RNA, 16 nt, Mycobacterium tuberculosis H37Rv
gggcgcggggcggccu

SEQ ID NO: 3313043 - RNA, 20 nt, Mycobacterium tuberculosis H37Rv
gggcgcgggugaccaggcgg

SEQ ID NO: 3313044 - RNA, 12 nt, Mycobacterium tuberculosis H37Rv
gggcgcgggugc

SEQ ID NO: 3313045 - RNA, 17 nt, Mycobacterium tuberculosis H37Rv
gggcgcggguggcgcca

SEQ ID NO: 3313046 - RNA, 18 nt, Mycobacterium tuberculosis H37Rv
gggcgcggguggcgccag

SEQ ID NO: 3313047 - RNA, 23 nt, Mycobacterium tuberculosis H37Rv
gggcgcgugggcgugcaggcugg

SEQ ID NO: 3313048 - RNA, 20 nt, Mycobacterium tuberculosis H37Rv
gggcgcguugcguaucgacc

SEQ ID NO: 3313049 - RNA, 23 nt, Mycobacterium tuberculosis H37Rv
gggcgcucgcgcgcugggcgcgc

SEQ ID NO: 3313050 - RNA, 18 nt, Mycobacterium tuberculosis H37Rv
gggcgcugccaauccgau

SEQ ID NO: 3313051 - RNA, 23 nt, Mycobacterium tuberculosis H37Rv
gggcgcugccaauccgaucgagg

SEQ ID NO: 3313052 - RNA, 18 nt, Mycobacterium tuberculosis H37Rv
gggcgcuuaugcgucugc

SEQ ID NO: 3313053 - RNA, 20 nt, Mycobacterium tuberculosis H37Rv
gggcgcuuaugcgucugcuc

SEQ ID NO: 3313054 - RNA, 21 nt, Mycobacterium tuberculosis H37Rv
gggcgcuuaugcgucugcucg

SEQ ID NO: 3313055 - RNA, 16 nt, Mycobacterium tuberculosis H37Rv
gggcggaacgccggca

SEQ ID NO: 3313056 - RNA, 20 nt, Mycobacterium tuberculosis H37Rv
gggcggacaaaagaacgcca

SEQ ID NO: 3313057 - RNA, 13 nt, Mycobacterium tuberculosis H37Rv
gggcggaucgccg

SEQ ID NO: 3313058 - RNA, 18 nt, Mycobacterium tuberculosis H37Rv
gggcggaucggcccagau

SEQ ID NO: 3313059 - RNA, 17 nt, Mycobacterium tuberculosis H37Rv
gggcggcagcgagucga

SEQ ID NO: 3313060 - RNA, 14 nt, Mycobacterium tuberculosis H37Rv
gggcggcaucccca

SEQ ID NO: 3313061 - RNA, 22 nt, Mycobacterium tuberculosis H37Rv
gggcggccaaccccgaugaggc

SEQ ID NO: 3313062 - RNA, 14 nt, Mycobacterium tuberculosis H37Rv
gggcggccaggauc

SEQ ID NO: 3313063 - RNA, 14 nt, Mycobacterium tuberculosis H37Rv
gggcggccaggcgc

SEQ ID NO: 3313064 - RNA, 13 nt, Mycobacterium tuberculosis H37Rv
gggcggccgggcu

SEQ ID NO: 3313065 - RNA, 20 nt, Mycobacterium tuberculosis H37Rv
gggcggcgaccucggcggcg

SEQ ID NO: 3313066 - RNA, 18 nt, Mycobacterium tuberculosis H37Rv
gggcggcgcuggcgucgu

SEQ ID NO: 3313067 - RNA, 21 nt, Mycobacterium tuberculosis H37Rv
gggcggcggugggcgcggacc

SEQ ID NO: 3313068 - RNA, 19 nt, Mycobacterium tuberculosis H37Rv
gggcggcugcgggcccggc

SEQ ID NO: 3313069 - RNA, 17 nt, Mycobacterium tuberculosis H37Rv
gggcgggauccacccag

SEQ ID NO: 3313070 - RNA, 21 nt, Mycobacterium tuberculosis H37Rv
gggcgggaucgacuccggugu

SEQ ID NO: 3313071 - RNA, 13 nt, Mycobacterium tuberculosis H37Rv
gggcgggcgucga

SEQ ID NO: 3313072 - RNA, 21 nt, Mycobacterium tuberculosis H37Rv
gggcgggcuggugucagcuga

SEQ ID NO: 3313073 - RNA, 18 nt, Mycobacterium tuberculosis H37Rv
gggcggucgcguugcaga

SEQ ID NO: 3313074 - RNA, 16 nt, Mycobacterium tuberculosis H37Rv
gggcggucggccggcu

SEQ ID NO: 3313075 - RNA, 15 nt, Mycobacterium tuberculosis H37Rv
gggcggugaggcagc

SEQ ID NO: 3313076 - RNA, 17 nt, Mycobacterium tuberculosis H37Rv
gggcggugaggcagcga

SEQ ID NO: 3313077 - RNA, 22 nt, Mycobacterium tuberculosis H37Rv
gggcgguggccacccggccgcg

SEQ ID NO: 3313078 - RNA, 20 nt, Mycobacterium tuberculosis H37Rv
gggcggugggcagcagcugg

SEQ ID NO: 3313079 - RNA, 20 nt, Mycobacterium tuberculosis H37Rv
gggcgucaagcaaguccacc

SEQ ID NO: 3313080 - RNA, 14 nt, Mycobacterium tuberculosis H37Rv
gggcgucauccgcg

SEQ ID NO: 3313081 - RNA, 16 nt, Mycobacterium tuberculosis H37Rv
gggcguccacgcugac

SEQ ID NO: 3313082 - RNA, 17 nt, Mycobacterium tuberculosis H37Rv
gggcguccacgcugacc

SEQ ID NO: 3313083 - RNA, 15 nt, Mycobacterium tuberculosis H37Rv
gggcguccgccggcg

SEQ ID NO: 3313084 - RNA, 21 nt, Mycobacterium tuberculosis H37Rv
gggcgucgcaacccggccugg

SEQ ID NO: 3313085 - RNA, 14 nt, Mycobacterium tuberculosis H37Rv
gggcgucugcagcg

SEQ ID NO: 3313086 - RNA, 18 nt, Mycobacterium tuberculosis H37Rv
gggcgugacgggcaggag

SEQ ID NO: 3313087 - RNA, 18 nt, Mycobacterium tuberculosis H37Rv
gggcgugaucccgcccaa

SEQ ID NO: 3313088 - RNA, 14 nt, Mycobacterium tuberculosis H37Rv
gggcgugccgacca

SEQ ID NO: 3313089 - RNA, 13 nt, Mycobacterium tuberculosis H37Rv
gggcgugccgccg

SEQ ID NO: 3313090 - RNA, 12 nt, Mycobacterium tuberculosis H37Rv
gggcgugcucgc

SEQ ID NO: 3313091 - RNA, 14 nt, Mycobacterium tuberculosis H37Rv
gggcgugcugccga

SEQ ID NO: 3313092 - RNA, 20 nt, Mycobacterium tuberculosis H37Rv
gggcguguaaccccaggcgc

SEQ ID NO: 3313093 - RNA, 23 nt, Mycobacterium tuberculosis H37Rv
gggcguucccccggcaccgccgg

SEQ ID NO: 3313094 - RNA, 14 nt, Mycobacterium tuberculosis H37Rv
gggcguuggcgacg

SEQ ID NO: 3313095 - RNA, 16 nt, Mycobacterium tuberculosis H37Rv
gggcguuggcgggcug

SEQ ID NO: 3313096 - RNA, 15 nt, Mycobacterium tuberculosis H37Rv
gggcguuucggcggg

SEQ ID NO: 3313097 - RNA, 17 nt, Mycobacterium tuberculosis H37Rv
gggcguuucggcgggcg

SEQ ID NO: 3313098 - RNA, 19 nt, Mycobacterium tuberculosis H37Rv
gggcuaccggcagcugcuc

SEQ ID NO: 3313099 - RNA, 20 nt, Mycobacterium tuberculosis H37Rv
gggcuaccggcagcugcucg

SEQ ID NO: 3313100 - RNA, 21 nt, Mycobacterium tuberculosis H37Rv
gggcuaucguggcggcgucga

SEQ ID NO: 3313101 - RNA, 13 nt, Mycobacterium tuberculosis H37Rv
ggggccccaugcc

SEQ ID NO: 3313102 - RNA, 15 nt, Mycobacterium tuberculosis H37Rv
ggggccccaugccga

SEQ ID NO: 3313103 - RNA, 20 nt, Mycobacterium tuberculosis H37Rv
ggggccccgcgccggccgca

SEQ ID NO: 3313104 - RNA, 19 nt, Mycobacterium tuberculosis H37Rv
ggggccccgcggcgccgcc

SEQ ID NO: 3313105 - RNA, 15 nt, Mycobacterium tuberculosis H37Rv
ggggccgaauccgau

SEQ ID NO: 3313106 - RNA, 22 nt, Mycobacterium tuberculosis H37Rv
ggggccgagccgacaucgaugu

SEQ ID NO: 3313107 - RNA, 18 nt, Mycobacterium tuberculosis H37Rv
ggggccgcaggccagggu

SEQ ID NO: 3313108 - RNA, 20 nt, Mycobacterium tuberculosis H37Rv
ggggccgccagcugcgcagc

SEQ ID NO: 3313109 - RNA, 21 nt, Mycobacterium tuberculosis H37Rv
ggggccgcucacaagccgugc

SEQ ID NO: 3313110 - RNA, 14 nt, Mycobacterium tuberculosis H37Rv
ggggccgcuggggc

SEQ ID NO: 3313111 - RNA, 13 nt, Mycobacterium tuberculosis H37Rv
ggggccggauguc

SEQ ID NO: 3313112 - RNA, 14 nt, Mycobacterium tuberculosis H37Rv
ggggccggcagcgg

SEQ ID NO: 3313113 - RNA, 15 nt, Mycobacterium tuberculosis H37Rv
ggggccggccggcaa

SEQ ID NO: 3313114 - RNA, 18 nt, Mycobacterium tuberculosis H37Rv
ggggccggcggcucgggu

SEQ ID NO: 3313115 - RNA, 13 nt, Mycobacterium tuberculosis H37Rv
ggggccgucggca

SEQ ID NO: 3313116 - RNA, 20 nt, Mycobacterium tuberculosis H37Rv
ggggccucguugaccagaac

SEQ ID NO: 3313117 - RNA, 23 nt, Mycobacterium tuberculosis H37Rv
ggggcgaugagccugcaggccgc

SEQ ID NO: 3313118 - RNA, 15 nt, Mycobacterium tuberculosis H37Rv
ggggcgcaccgagcg

SEQ ID NO: 3313119 - RNA, 14 nt, Mycobacterium tuberculosis H37Rv
ggggcgcagcgcgg

SEQ ID NO: 3313120 - RNA, 13 nt, Mycobacterium tuberculosis H37Rv
ggggcgcccggcc

SEQ ID NO: 3313121 - RNA, 15 nt, Mycobacterium tuberculosis H37Rv
ggggcgcccggccag

SEQ ID NO: 3313122 - RNA, 15 nt, Mycobacterium tuberculosis H37Rv
ggggcgccgccguug

SEQ ID NO: 3313123 - RNA, 23 nt, Mycobacterium tuberculosis H37Rv
ggggcgccggauauggcaguguc

SEQ ID NO: 3313124 - RNA, 14 nt, Mycobacterium tuberculosis H37Rv
ggggcgccugaugc

SEQ ID NO: 3313125 - RNA, 19 nt, Mycobacterium tuberculosis H37Rv
ggggcgcugcagcucacga

SEQ ID NO: 3313126 - RNA, 17 nt, Mycobacterium tuberculosis H37Rv
ggggcggcggugggcgc

SEQ ID NO: 3313127 - RNA, 14 nt, Mycobacterium tuberculosis H37Rv
ggggcggucgagcc

SEQ ID NO: 3313128 - RNA, 24 nt, Mycobacterium tuberculosis H37Rv
ggggcgucgcaacccggccuggag

SEQ ID NO: 3313129 - RNA, 14 nt, Mycobacterium tuberculosis H37Rv
ggggcgucgccgcc

SEQ ID NO: 3313130 - RNA, 22 nt, Mycobacterium tuberculosis H37Rv
ggggcgucguucgcgggugcgc

SEQ ID NO: 3313131 - RNA, 19 nt, Mycobacterium tuberculosis H37Rv
ggggcgugacagggcggca

SEQ ID NO: 3313132 - RNA, 19 nt, Mycobacterium tuberculosis H37Rv
ggggcguuagggccgccau

SEQ ID NO: 3313133 - RNA, 17 nt, Mycobacterium tuberculosis H37Rv
ggggcguuucggcgggc

SEQ ID NO: 3313134 - RNA, 18 nt, Mycobacterium tuberculosis H37Rv
ggggcuacuaggcccagc

SEQ ID NO: 3313135 - RNA, 20 nt, Mycobacterium tuberculosis H37Rv
ggggcuacuaggcccagcac

SEQ ID NO: 3313136 - RNA, 19 nt, Mycobacterium tuberculosis H37Rv
ggggcuauggcgcagcugg

SEQ ID NO: 3313137 - RNA, 16 nt, Mycobacterium tuberculosis H37Rv
ggggcucagcgguggc

SEQ ID NO: 3313138 - RNA, 17 nt, Mycobacterium tuberculosis H37Rv
ggggcucguaggugggc

SEQ ID NO: 3313139 - RNA, 16 nt, Mycobacterium tuberculosis H37Rv
ggggcugccgccguug

SEQ ID NO: 3313140 - RNA, 20 nt, Mycobacterium tuberculosis H37Rv
ggggcugcugcucggccugg

SEQ ID NO: 3313141 - RNA, 19 nt, Mycobacterium tuberculosis H37Rv
ggggcugggcgccaugcgc

SEQ ID NO: 3313142 - RNA, 21 nt, Mycobacterium tuberculosis H37Rv
ggggcugucggcgauggagcg

SEQ ID NO: 3313143 - RNA, 16 nt, Mycobacterium tuberculosis H37Rv
ggggcugugcaggcgg

SEQ ID NO: 3313144 - RNA, 20 nt, Mycobacterium tuberculosis H37Rv
ggggcuuaugcgacugcucg

SEQ ID NO: 3313145 - RNA, 18 nt, Mycobacterium tuberculosis H37Rv
ggggcuuaugcgucugcu

SEQ ID NO: 3313146 - RNA, 19 nt, Mycobacterium tuberculosis H37Rv
ggggcuuaugcgucugcuc

SEQ ID NO: 3313147 - RNA, 20 nt, Mycobacterium tuberculosis H37Rv
ggggcuuaugcgucugcucg

SEQ ID NO: 3313148 - RNA, 22 nt, Mycobacterium tuberculosis H37Rv
ggggcuucaucuggcgccguua

SEQ ID NO: 3313149 - RNA, 18 nt, Mycobacterium tuberculosis H37Rv
ggggcuucugcgucugcu

SEQ ID NO: 3313150 - RNA, 19 nt, Mycobacterium tuberculosis H37Rv
ggggcuucugcgucugcuc

SEQ ID NO: 3313151 - RNA, 20 nt, Mycobacterium tuberculosis H37Rv
ggggcuucugcgucugcucg

SEQ ID NO: 3313152 - RNA, 18 nt, Mycobacterium tuberculosis H37Rv
ggggcuuggcgacgucgc

SEQ ID NO: 3313153 - RNA, 18 nt, Mycobacterium tuberculosis H37Rv
ggggcuuuugcgucugcu

SEQ ID NO: 3313154 - RNA, 19 nt, Mycobacterium tuberculosis H37Rv
ggggcuuuugcgucugcuc

SEQ ID NO: 3313155 - RNA, 20 nt, Mycobacterium tuberculosis H37Rv
ggggcuuuugcgucugcuga

SEQ ID NO: 3313156 - RNA, 12 nt, Mycobacterium tuberculosis H37Rv
gggggacgcuga

SEQ ID NO: 3313157 - RNA, 19 nt, Mycobacterium tuberculosis H37Rv
gggggauccagcaggccgg

SEQ ID NO: 3313158 - RNA, 20 nt, Mycobacterium tuberculosis H37Rv
gggggauccggcgcagcgaa

SEQ ID NO: 3313159 - RNA, 19 nt, Mycobacterium tuberculosis H37Rv
gggggauuucgcgucugcu

SEQ ID NO: 3313160 - RNA, 21 nt, Mycobacterium tuberculosis H37Rv
gggggauuucgcgucugcucg

SEQ ID NO: 3313161 - RNA, 13 nt, Mycobacterium tuberculosis H37Rv
gggggcaggucga

SEQ ID NO: 3313162 - RNA, 12 nt, Mycobacterium tuberculosis H37Rv
gggggccgagcc

SEQ ID NO: 3313163 - RNA, 21 nt, Mycobacterium tuberculosis H37Rv
gggggccggcagcggcuggga

SEQ ID NO: 3313164 - RNA, 14 nt, Mycobacterium tuberculosis H37Rv
gggggcugcugcuc

SEQ ID NO: 3313165 - RNA, 20 nt, Mycobacterium tuberculosis H37Rv
gggggcuuaugcgacugcuc

SEQ ID NO: 3313166 - RNA, 19 nt, Mycobacterium tuberculosis H37Rv
gggggcuuaugcgucugcu

SEQ ID NO: 3313167 - RNA, 19 nt, Mycobacterium tuberculosis H37Rv
gggggcuucugcgucugcu

SEQ ID NO: 3313168 - RNA, 20 nt, Mycobacterium tuberculosis H37Rv
gggggcuucugcgucugcuc

SEQ ID NO: 3313169 - RNA, 21 nt, Mycobacterium tuberculosis H37Rv
gggggcuucugcgucugcucg

SEQ ID NO: 3313170 - RNA, 20 nt, Mycobacterium tuberculosis H37Rv
gggggcuuuuacgucugcuc

SEQ ID NO: 3313171 - RNA, 21 nt, Mycobacterium tuberculosis H37Rv
gggggcuuuuacgucugcucg

SEQ ID NO: 3313172 - RNA, 20 nt, Mycobacterium tuberculosis H37Rv
gggggcuuuugcgucugcug

SEQ ID NO: 3313173 - RNA, 17 nt, Mycobacterium tuberculosis H37Rv
ggggguccggcggccgc

SEQ ID NO: 3313174 - RNA, 20 nt, Mycobacterium tuberculosis H37Rv
gggggucgcacccugcgcgg

SEQ ID NO: 3313175 - RNA, 22 nt, Mycobacterium tuberculosis H37Rv
gggggucgcacccugcgcggcg

SEQ ID NO: 3313176 - RNA, 21 nt, Mycobacterium tuberculosis H37Rv
gggguagaccuucucgccgcc

SEQ ID NO: 3313177 - RNA, 18 nt, Mycobacterium tuberculosis H37Rv
ggggucagcucgccagcc

SEQ ID NO: 3313178 - RNA, 19 nt, Mycobacterium tuberculosis H37Rv
ggggucagcucgccagccu

SEQ ID NO: 3313179 - RNA, 11 nt, Mycobacterium tuberculosis H37Rv
gggguccagcg

SEQ ID NO: 3313180 - RNA, 16 nt, Mycobacterium tuberculosis H37Rv
ggggucccgccgggug

SEQ ID NO: 3313181 - RNA, 17 nt, Mycobacterium tuberculosis H37Rv
gggguccgaugcgugcc

SEQ ID NO: 3313182 - RNA, 13 nt, Mycobacterium tuberculosis H37Rv
gggguccggcggc

SEQ ID NO: 3313183 - RNA, 16 nt, Mycobacterium tuberculosis H37Rv
ggggucgaacagcucg

SEQ ID NO: 3313184 - RNA, 13 nt, Mycobacterium tuberculosis H37Rv
ggggucgaacgcg

SEQ ID NO: 3313185 - RNA, 11 nt, Mycobacterium tuberculosis H37Rv
ggggucgagcg

SEQ ID NO: 3313186 - RNA, 17 nt, Mycobacterium tuberculosis H37Rv
ggggucgccggcaccgg

SEQ ID NO: 3313187 - RNA, 16 nt, Mycobacterium tuberculosis H37Rv
ggggucggcccgccaa

SEQ ID NO: 3313188 - RNA, 21 nt, Mycobacterium tuberculosis H37Rv
ggggucggccugcggcaccgg

SEQ ID NO: 3313189 - RNA, 17 nt, Mycobacterium tuberculosis H37Rv
ggggugcccggccgcca

SEQ ID NO: 3313190 - RNA, 12 nt, Mycobacterium tuberculosis H37Rv
ggggugccggcg

SEQ ID NO: 3313191 - RNA, 13 nt, Mycobacterium tuberculosis H37Rv
ggggugcgcccag

SEQ ID NO: 3313192 - RNA, 18 nt, Mycobacterium tuberculosis H37Rv
ggggugcuuacgugauau

SEQ ID NO: 3313193 - RNA, 15 nt, Mycobacterium tuberculosis H37Rv
gggguggcagcgcgg

SEQ ID NO: 3313194 - RNA, 19 nt, Mycobacterium tuberculosis H37Rv
gggguggcgcgggccggcg

SEQ ID NO: 3313195 - RNA, 12 nt, Mycobacterium tuberculosis H37Rv
gggguggcggca

SEQ ID NO: 3313196 - RNA, 11 nt, Mycobacterium tuberculosis H37Rv
ggggugguggu

SEQ ID NO: 3313197 - RNA, 18 nt, Mycobacterium tuberculosis H37Rv
gggugaguucggcguaga

SEQ ID NO: 3313198 - RNA, 22 nt, Mycobacterium tuberculosis H37Rv
gggugaucgaaaacgggggcgc

SEQ ID NO: 3313199 - RNA, 19 nt, Mycobacterium tuberculosis H37Rv
gggugcagcacggcgccgc

SEQ ID NO: 3313200 - RNA, 20 nt, Mycobacterium tuberculosis H37Rv
gggugcagcacguccgcgga

SEQ ID NO: 3313201 - RNA, 22 nt, Mycobacterium tuberculosis H37Rv
gggugccagaucggcggguggc

SEQ ID NO: 3313202 - RNA, 21 nt, Mycobacterium tuberculosis H37Rv
gggugccagcccguugcagga

SEQ ID NO: 3313203 - RNA, 19 nt, Mycobacterium tuberculosis H37Rv
gggugcccccggugccgcc

SEQ ID NO: 3313204 - RNA, 14 nt, Mycobacterium tuberculosis H37Rv
gggugcccucggcc

SEQ ID NO: 3313205 - RNA, 19 nt, Mycobacterium tuberculosis H37Rv
gggugccgacucggccaca

SEQ ID NO: 3313206 - RNA, 13 nt, Mycobacterium tuberculosis H37Rv
gggugccgaucga

SEQ ID NO: 3313207 - RNA, 12 nt, Mycobacterium tuberculosis H37Rv
gggugccgcagc

SEQ ID NO: 3313208 - RNA, 18 nt, Mycobacterium tuberculosis H37Rv
gggugccggcagcggcgc

SEQ ID NO: 3313209 - RNA, 18 nt, Mycobacterium tuberculosis H37Rv
gggugcgcgaggucggcg

SEQ ID NO: 3313210 - RNA, 15 nt, Mycobacterium tuberculosis H37Rv
gggugcucagcgaca

SEQ ID NO: 3313211 - RNA, 17 nt, Mycobacterium tuberculosis H37Rv
gggugcucucguggaug

SEQ ID NO: 3313212 - RNA, 20 nt, Mycobacterium tuberculosis H37Rv
gggugcugcgcgcggcggcc

SEQ ID NO: 3313213 - RNA, 20 nt, Mycobacterium tuberculosis H37Rv
gggugcuuucgcgucugcuc

SEQ ID NO: 3313214 - RNA, 15 nt, Mycobacterium tuberculosis H37Rv
ggguggaucuucacc

SEQ ID NO: 3313215 - RNA, 18 nt, Mycobacterium tuberculosis H37Rv
ggguggaucuucaccucg

SEQ ID NO: 3313216 - RNA, 18 nt, Mycobacterium tuberculosis H37Rv
ggguggccaccagcggca

SEQ ID NO: 3313217 - RNA, 20 nt, Mycobacterium tuberculosis H37Rv
ggguggccagcaacugccgc

SEQ ID NO: 3313218 - RNA, 18 nt, Mycobacterium tuberculosis H37Rv
ggguggcgaggcagcacc

SEQ ID NO: 3313219 - RNA, 22 nt, Mycobacterium tuberculosis H37Rv
ggguggcgccaggucggcgggc

SEQ ID NO: 3313220 - RNA, 13 nt, Mycobacterium tuberculosis H37Rv
ggguggcgccagu

SEQ ID NO: 3313221 - RNA, 22 nt, Mycobacterium tuberculosis H37Rv
ggguggcgccggugcggcgggc

SEQ ID NO: 3313222 - RNA, 12 nt, Mycobacterium tuberculosis H37Rv
ggguggcggcgg

SEQ ID NO: 3313223 - RNA, 14 nt, Mycobacterium tuberculosis H37Rv
ggguggcggcggcg

SEQ ID NO: 3313224 - RNA, 16 nt, Mycobacterium tuberculosis H37Rv
ggguggcggcggcgga

SEQ ID NO: 3313225 - RNA, 14 nt, Mycobacterium tuberculosis H37Rv
ggguggcggcguca

SEQ ID NO: 3313226 - RNA, 14 nt, Mycobacterium tuberculosis H37Rv
ggguggcugcuggc

SEQ ID NO: 3313227 - RNA, 14 nt, Mycobacterium tuberculosis H37Rv
gggugggcgagcga

SEQ ID NO: 3313228 - RNA, 21 nt, Mycobacterium tuberculosis H37Rv
gggugguagcugacgcugcuc

SEQ ID NO: 3313229 - RNA, 23 nt, Mycobacterium tuberculosis H37Rv
ggguggugaaguagucggcgccg

SEQ ID NO: 3313230 - RNA, 21 nt, Mycobacterium tuberculosis H37Rv
ggguggugccaggucggcggg

SEQ ID NO: 3313231 - RNA, 22 nt, Mycobacterium tuberculosis H37Rv
gggugguucaccucggcgacga

SEQ ID NO: 3313232 - RNA, 19 nt, Mycobacterium tuberculosis H37Rv
ggguguagcaagucgccga

SEQ ID NO: 3313233 - RNA, 23 nt, Mycobacterium tuberculosis H37Rv
gggugucaaucacccagccggaa

SEQ ID NO: 3313234 - RNA, 13 nt, Mycobacterium tuberculosis H37Rv
ggguguccgucga

SEQ ID NO: 3313235 - RNA, 15 nt, Mycobacterium tuberculosis H37Rv
gggugucgggcgcgc

SEQ ID NO: 3313236 - RNA, 15 nt, Mycobacterium tuberculosis H37Rv
gggugucggugucga

SEQ ID NO: 3313237 - RNA, 16 nt, Mycobacterium tuberculosis H37Rv
ggguguugaggccggu

SEQ ID NO: 3313238 - RNA, 16 nt, Mycobacterium tuberculosis H37Rv
ggguguugucgucgag

SEQ ID NO: 3313239 - RNA, 19 nt, Mycobacterium tuberculosis H37Rv
ggguguuugucgcgguggu

SEQ ID NO: 3313240 - RNA, 16 nt, Mycobacterium tuberculosis H37Rv
ggguuaucggcagcag

SEQ ID NO: 3313241 - RNA, 18 nt, Mycobacterium tuberculosis H37Rv
ggguucacguucggugga

SEQ ID NO: 3313242 - RNA, 19 nt, Mycobacterium tuberculosis H37Rv
ggguucgccgaagccggac

SEQ ID NO: 3313243 - RNA, 19 nt, Mycobacterium tuberculosis H37Rv
ggguucuuccacagcgcgu

SEQ ID NO: 3313244 - RNA, 24 nt, Mycobacterium tuberculosis H37Rv
ggguugaggaucccggccgggucg

SEQ ID NO: 3313245 - RNA, 11 nt, Mycobacterium tuberculosis H37Rv
ggguugaucgc

SEQ ID NO: 3313246 - RNA, 23 nt, Mycobacterium tuberculosis H37Rv
ggguugaucggcaacggcggcgu

SEQ ID NO: 3313247 - RNA, 15 nt, Mycobacterium tuberculosis H37Rv
ggguugccagcgacg

SEQ ID NO: 3313248 - RNA, 14 nt, Mycobacterium tuberculosis H37Rv
ggguugcggucacc

SEQ ID NO: 3313249 - RNA, 22 nt, Mycobacterium tuberculosis H37Rv
ggguuggccgaacagcugcccg

SEQ ID NO: 3313250 - RNA, 12 nt, Mycobacterium tuberculosis H37Rv
ggguuggcguca

SEQ ID NO: 3313251 - RNA, 20 nt, Mycobacterium tuberculosis H37Rv
ggguuggcucggcgcagcac

SEQ ID NO: 3313252 - RNA, 13 nt, Mycobacterium tuberculosis H37Rv
ggguugugccgcc

SEQ ID NO: 3313253 - RNA, 15 nt, Mycobacterium tuberculosis H37Rv
ggguuugcagcgaua

SEQ ID NO: 3313254 - RNA, 15 nt, Mycobacterium tuberculosis H37Rv
gguaacaccggcgag

SEQ ID NO: 3313255 - RNA, 16 nt, Mycobacterium tuberculosis H37Rv
gguaacgcagcggcaa

SEQ ID NO: 3313256 - RNA, 11 nt, Mycobacterium tuberculosis H37Rv
gguaacugucc

SEQ ID NO: 3313257 - RNA, 14 nt, Mycobacterium tuberculosis H37Rv
gguaagacgccgaa

SEQ ID NO: 3313258 - RNA, 13 nt, Mycobacterium tuberculosis H37Rv
gguaagccggcgu

SEQ ID NO: 3313259 - RNA, 19 nt, Mycobacterium tuberculosis H37Rv
gguaagcgaacggguaguc

SEQ ID NO: 3313260 - RNA, 15 nt, Mycobacterium tuberculosis H37Rv
gguaauacgucccga

SEQ ID NO: 3313261 - RNA, 18 nt, Mycobacterium tuberculosis H37Rv
gguaaucaccuggcuggu

SEQ ID NO: 3313262 - RNA, 13 nt, Mycobacterium tuberculosis H37Rv
gguaauccgggca

SEQ ID NO: 3313263 - RNA, 14 nt, Mycobacterium tuberculosis H37Rv
gguaaugccagcgg

SEQ ID NO: 3313264 - RNA, 16 nt, Mycobacterium tuberculosis H37Rv
gguaaugguggcgucc

SEQ ID NO: 3313265 - RNA, 18 nt, Mycobacterium tuberculosis H37Rv
gguaauucuugacgccga

SEQ ID NO: 3313266 - RNA, 19 nt, Mycobacterium tuberculosis H37Rv
gguaauucuugacgccgau

SEQ ID NO: 3313267 - RNA, 14 nt, Mycobacterium tuberculosis H37Rv
gguacaccaggccg

SEQ ID NO: 3313268 - RNA, 20 nt, Mycobacterium tuberculosis H37Rv
gguacacccgcucgcccgcc

SEQ ID NO: 3313269 - RNA, 13 nt, Mycobacterium tuberculosis H37Rv
gguacacguccag

SEQ ID NO: 3313270 - RNA, 20 nt, Mycobacterium tuberculosis H37Rv
gguacagacacgcgcgcucg

SEQ ID NO: 3313271 - RNA, 16 nt, Mycobacterium tuberculosis H37Rv
gguacaucaccacgau

SEQ ID NO: 3313272 - RNA, 13 nt, Mycobacterium tuberculosis H37Rv
gguacaucgacca

SEQ ID NO: 3313273 - RNA, 18 nt, Mycobacterium tuberculosis H37Rv
gguaccaaagcugucgac

SEQ ID NO: 3313274 - RNA, 15 nt, Mycobacterium tuberculosis H37Rv
gguaccaaccugcgc

SEQ ID NO: 3313275 - RNA, 21 nt, Mycobacterium tuberculosis H37Rv
gguaccaacgcuucugccugc

SEQ ID NO: 3313276 - RNA, 19 nt, Mycobacterium tuberculosis H37Rv
gguaccacgcuggcgcgua

SEQ ID NO: 3313277 - RNA, 17 nt, Mycobacterium tuberculosis H37Rv
gguaccaucaccgcgcc

SEQ ID NO: 3313278 - RNA, 18 nt, Mycobacterium tuberculosis H37Rv
gguaccaucaccgcgcca

SEQ ID NO: 3313279 - RNA, 13 nt, Mycobacterium tuberculosis H37Rv
gguaccccagcgc

SEQ ID NO: 3313280 - RNA, 17 nt, Mycobacterium tuberculosis H37Rv
gguaccgaucagcaggg

SEQ ID NO: 3313281 - RNA, 12 nt, Mycobacterium tuberculosis H37Rv
gguaccgcccgc

SEQ ID NO: 3313282 - RNA, 17 nt, Mycobacterium tuberculosis H37Rv
gguaccgcgugcgccgg

SEQ ID NO: 3313283 - RNA, 14 nt, Mycobacterium tuberculosis H37Rv
gguaccggcggcaa

SEQ ID NO: 3313284 - RNA, 17 nt, Mycobacterium tuberculosis H37Rv
gguaccggcggcgccgg

SEQ ID NO: 3313285 - RNA, 23 nt, Mycobacterium tuberculosis H37Rv
gguaccgggacgaaucccgcgcc

SEQ ID NO: 3313286 - RNA, 19 nt, Mycobacterium tuberculosis H37Rv
gguaccucaacaccaggcc

SEQ ID NO: 3313287 - RNA, 22 nt, Mycobacterium tuberculosis H37Rv
gguacgccucgacagcggcaau

SEQ ID NO: 3313288 - RNA, 13 nt, Mycobacterium tuberculosis H37Rv
gguacggacagcg

SEQ ID NO: 3313289 - RNA, 22 nt, Mycobacterium tuberculosis H37Rv
gguacggacagcgggagcagca

SEQ ID NO: 3313290 - RNA, 23 nt, Mycobacterium tuberculosis H37Rv
gguacggaccguggcagcugcuc

SEQ ID NO: 3313291 - RNA, 21 nt, Mycobacterium tuberculosis H37Rv
gguacgugaauuaaggugacc

SEQ ID NO: 3313292 - RNA, 15 nt, Mycobacterium tuberculosis H37Rv
gguacucccgcgauc

SEQ ID NO: 3313293 - RNA, 12 nt, Mycobacterium tuberculosis H37Rv
ggucagcgccga

SEQ ID NO: 3313294 - RNA, 17 nt, Mycobacterium tuberculosis H37Rv
ggucagcgcugccaccg

SEQ ID NO: 3313295 - RNA, 19 nt, Mycobacterium tuberculosis H37Rv
ggucagcgcugccaccgcg

SEQ ID NO: 3313296 - RNA, 17 nt, Mycobacterium tuberculosis H37Rv
ggucagcggauccaggc

SEQ ID NO: 3313297 - RNA, 11 nt, Mycobacterium tuberculosis H37Rv
ggucagcggcc

SEQ ID NO: 3313298 - RNA, 13 nt, Mycobacterium tuberculosis H37Rv
ggucagcggcugg

SEQ ID NO: 3313299 - RNA, 17 nt, Mycobacterium tuberculosis H37Rv
ggucagcgggcuugccg

SEQ ID NO: 3313300 - RNA, 17 nt, Mycobacterium tuberculosis H37Rv
ggucagcggggugcugc

SEQ ID NO: 3313301 - RNA, 19 nt, Mycobacterium tuberculosis H37Rv
ggucagcgugcagguaggu

SEQ ID NO: 3313302 - RNA, 16 nt, Mycobacterium tuberculosis H37Rv
ggucagcucgaccuga

SEQ ID NO: 3313303 - RNA, 20 nt, Mycobacterium tuberculosis H37Rv
ggucagcucggugaugucgg

SEQ ID NO: 3313304 - RNA, 15 nt, Mycobacterium tuberculosis H37Rv
ggucagcucgucggc

SEQ ID NO: 3313305 - RNA, 19 nt, Mycobacterium tuberculosis H37Rv
ggucagcugacgggccgcu

SEQ ID NO: 3313306 - RNA, 15 nt, Mycobacterium tuberculosis H37Rv
ggucagcugcugcca

SEQ ID NO: 3313307 - RNA, 15 nt, Mycobacterium tuberculosis H37Rv
ggucaggaucgcacc

SEQ ID NO: 3313308 - RNA, 16 nt, Mycobacterium tuberculosis H37Rv
ggucaggccaggguga

SEQ ID NO: 3313309 - RNA, 14 nt, Mycobacterium tuberculosis H37Rv
ggucaggccgacgu

SEQ ID NO: 3313310 - RNA, 15 nt, Mycobacterium tuberculosis H37Rv
ggucaggccgacguc

SEQ ID NO: 3313311 - RNA, 13 nt, Mycobacterium tuberculosis H37Rv
ggucaggccgccg

SEQ ID NO: 3313312 - RNA, 13 nt, Mycobacterium tuberculosis H37Rv
ggucaggcggccg

SEQ ID NO: 3313313 - RNA, 16 nt, Mycobacterium tuberculosis H37Rv
ggucaggcggcuggcc

SEQ ID NO: 3313314 - RNA, 17 nt, Mycobacterium tuberculosis H37Rv
ggucagguccugggugu

SEQ ID NO: 3313315 - RNA, 20 nt, Mycobacterium tuberculosis H37Rv
ggucaggucugacagaccgg

SEQ ID NO: 3313316 - RNA, 23 nt, Mycobacterium tuberculosis H37Rv
ggucaggucugacagaccgggca

SEQ ID NO: 3313317 - RNA, 19 nt, Mycobacterium tuberculosis H37Rv
ggucagguuggcacgcugu

SEQ ID NO: 3313318 - RNA, 17 nt, Mycobacterium tuberculosis H37Rv
ggucagguugucggcga

SEQ ID NO: 3313319 - RNA, 21 nt, Mycobacterium tuberculosis H37Rv
ggucaguccgacaccggcggc

SEQ ID NO: 3313320 - RNA, 23 nt, Mycobacterium tuberculosis H37Rv
ggucaguccgacaccggcggcau

SEQ ID NO: 3313321 - RNA, 16 nt, Mycobacterium tuberculosis H37Rv
ggucaguucccagacc

SEQ ID NO: 3313322 - RNA, 14 nt, Mycobacterium tuberculosis H37Rv
ggucaguuccucua

SEQ ID NO: 3313323 - RNA, 17 nt, Mycobacterium tuberculosis H37Rv
ggucaucaugucgaggu

SEQ ID NO: 3313324 - RNA, 15 nt, Mycobacterium tuberculosis H37Rv
ggucauccagccagc

SEQ ID NO: 3313325 - RNA, 12 nt, Mycobacterium tuberculosis H37Rv
ggucaucgccac

SEQ ID NO: 3313326 - RNA, 20 nt, Mycobacterium tuberculosis H37Rv
ggucaucgccagcggcaauc

SEQ ID NO: 3313327 - RNA, 19 nt, Mycobacterium tuberculosis H37Rv
ggucaucggccgucucggc

SEQ ID NO: 3313328 - RNA, 15 nt, Mycobacterium tuberculosis H37Rv
ggucaucgggcagcg

SEQ ID NO: 3313329 - RNA, 21 nt, Mycobacterium tuberculosis H37Rv
ggucaucgguugaccggucga

SEQ ID NO: 3313330 - RNA, 17 nt, Mycobacterium tuberculosis H37Rv
gguccaaagcacguccu

SEQ ID NO: 3313331 - RNA, 19 nt, Mycobacterium tuberculosis H37Rv
gguccaacagcgccaguag

SEQ ID NO: 3313332 - RNA, 19 nt, Mycobacterium tuberculosis H37Rv
gguccaaccacgagcauca

SEQ ID NO: 3313333 - RNA, 18 nt, Mycobacterium tuberculosis H37Rv
gguccaaccgggccggcu

SEQ ID NO: 3313334 - RNA, 18 nt, Mycobacterium tuberculosis H37Rv
gguccaagugggccggcg

SEQ ID NO: 3313335 - RNA, 20 nt, Mycobacterium tuberculosis H37Rv
gguccaagugggccggcggu

SEQ ID NO: 3313336 - RNA, 17 nt, Mycobacterium tuberculosis H37Rv
gguccacagccggcggc

SEQ ID NO: 3313337 - RNA, 15 nt, Mycobacterium tuberculosis H37Rv
gguccaccccgccga

SEQ ID NO: 3313338 - RNA, 17 nt, Mycobacterium tuberculosis H37Rv
gguccaccccgccgauc

SEQ ID NO: 3313339 - RNA, 18 nt, Mycobacterium tuberculosis H37Rv
gguccaccggcccucgcc

SEQ ID NO: 3313340 - RNA, 13 nt, Mycobacterium tuberculosis H37Rv
gguccacgacguc

SEQ ID NO: 3313341 - RNA, 14 nt, Mycobacterium tuberculosis H37Rv
gguccacgcgcucg

SEQ ID NO: 3313342 - RNA, 17 nt, Mycobacterium tuberculosis H37Rv
gguccagacccagcucg

SEQ ID NO: 3313343 - RNA, 13 nt, Mycobacterium tuberculosis H37Rv
gguccagccaacg

SEQ ID NO: 3313344 - RNA, 15 nt, Mycobacterium tuberculosis H37Rv
gguccagccaccgcc

SEQ ID NO: 3313345 - RNA, 13 nt, Mycobacterium tuberculosis H37Rv
gguccagcccagc

SEQ ID NO: 3313346 - RNA, 23 nt, Mycobacterium tuberculosis H37Rv
gguccagccgguccagacccagc

SEQ ID NO: 3313347 - RNA, 18 nt, Mycobacterium tuberculosis H37Rv
gguccagcgaggagcagg

SEQ ID NO: 3313348 - RNA, 13 nt, Mycobacterium tuberculosis H37Rv
gguccaggcccug

SEQ ID NO: 3313349 - RNA, 15 nt, Mycobacterium tuberculosis H37Rv
gguccaggcguugga

SEQ ID NO: 3313350 - RNA, 11 nt, Mycobacterium tuberculosis H37Rv
gguccaguuca

SEQ ID NO: 3313351 - RNA, 20 nt, Mycobacterium tuberculosis H37Rv
gguccaucaaccccagcgca

SEQ ID NO: 3313352 - RNA, 15 nt, Mycobacterium tuberculosis H37Rv
gguccaucgcgcugc

SEQ ID NO: 3313353 - RNA, 18 nt, Mycobacterium tuberculosis H37Rv
gguccaucgcgcugcggc

SEQ ID NO: 3313354 - RNA, 18 nt, Mycobacterium tuberculosis H37Rv
gguccauggacggccagg

SEQ ID NO: 3313355 - RNA, 13 nt, Mycobacterium tuberculosis H37Rv
ggucccacggccg

SEQ ID NO: 3313356 - RNA, 17 nt, Mycobacterium tuberculosis H37Rv
gguccccacauggcccg

SEQ ID NO: 3313357 - RNA, 21 nt, Mycobacterium tuberculosis H37Rv
gguccccucggugccacugcc

SEQ ID NO: 3313358 - RNA, 16 nt, Mycobacterium tuberculosis H37Rv
ggucccgaugaccuug

SEQ ID NO: 3313359 - RNA, 15 nt, Mycobacterium tuberculosis H37Rv
ggucccgcauauccg

SEQ ID NO: 3313360 - RNA, 21 nt, Mycobacterium tuberculosis H37Rv
ggucccgccgccuggaaaaag

SEQ ID NO: 3313361 - RNA, 21 nt, Mycobacterium tuberculosis H37Rv
ggucccgccggucacgacguc

SEQ ID NO: 3313362 - RNA, 19 nt, Mycobacterium tuberculosis H37Rv
ggucccugaagccagcgca

SEQ ID NO: 3313363 - RNA, 17 nt, Mycobacterium tuberculosis H37Rv
ggucccuuuguggggcc

SEQ ID NO: 3313364 - RNA, 21 nt, Mycobacterium tuberculosis H37Rv
ggucccuuuguggggccgggc

SEQ ID NO: 3313365 - RNA, 12 nt, Mycobacterium tuberculosis H37Rv
gguccgaccagc

SEQ ID NO: 3313366 - RNA, 20 nt, Mycobacterium tuberculosis H37Rv
gguccgcacgaucugcaggc

SEQ ID NO: 3313367 - RNA, 15 nt, Mycobacterium tuberculosis H37Rv
gguccgccaacggca

SEQ ID NO: 3313368 - RNA, 14 nt, Mycobacterium tuberculosis H37Rv
gguccgccacggcg

SEQ ID NO: 3313369 - RNA, 20 nt, Mycobacterium tuberculosis H37Rv
gguccgccagaucucgcgcg

SEQ ID NO: 3313370 - RNA, 16 nt, Mycobacterium tuberculosis H37Rv
gguccgccgggccccg

SEQ ID NO: 3313371 - RNA, 13 nt, Mycobacterium tuberculosis H37Rv
gguccgccgucga

SEQ ID NO: 3313372 - RNA, 18 nt, Mycobacterium tuberculosis H37Rv
gguccgcggcccucgccu

SEQ ID NO: 3313373 - RNA, 13 nt, Mycobacterium tuberculosis H37Rv
gguccgcgugcug

SEQ ID NO: 3313374 - RNA, 16 nt, Mycobacterium tuberculosis H37Rv
gguccgcgugcugccg

SEQ ID NO: 3313375 - RNA, 15 nt, Mycobacterium tuberculosis H37Rv
gguccggaaccggua

SEQ ID NO: 3313376 - RNA, 15 nt, Mycobacterium tuberculosis H37Rv
gguccggcccgggga

SEQ ID NO: 3313377 - RNA, 22 nt, Mycobacterium tuberculosis H37Rv
gguccggcggccgccaucagcc

SEQ ID NO: 3313378 - RNA, 14 nt, Mycobacterium tuberculosis H37Rv
gguccggcggccgg

SEQ ID NO: 3313379 - RNA, 18 nt, Mycobacterium tuberculosis H37Rv
gguccggcggccgguaga

SEQ ID NO: 3313380 - RNA, 21 nt, Mycobacterium tuberculosis H37Rv
gguccggcguacgccguaccc

SEQ ID NO: 3313381 - RNA, 19 nt, Mycobacterium tuberculosis H37Rv
gguccgggaagucgcugaa

SEQ ID NO: 3313382 - RNA, 17 nt, Mycobacterium tuberculosis H37Rv
gguccggggcaacgauc

SEQ ID NO: 3313383 - RNA, 18 nt, Mycobacterium tuberculosis H37Rv
gguccgucgagucgccga

SEQ ID NO: 3313384 - RNA, 23 nt, Mycobacterium tuberculosis H37Rv
gguccgucggguagugcccacaa

SEQ ID NO: 3313385 - RNA, 22 nt, Mycobacterium tuberculosis H37Rv
gguccguuuuaccucggccgcc

SEQ ID NO: 3313386 - RNA, 20 nt, Mycobacterium tuberculosis H37Rv
gguccuaggugugcgacgac

SEQ ID NO: 3313387 - RNA, 15 nt, Mycobacterium tuberculosis H37Rv
gguccucgagcggca

SEQ ID NO: 3313388 - RNA, 15 nt, Mycobacterium tuberculosis H37Rv
gguccucgucggcgu

SEQ ID NO: 3313389 - RNA, 14 nt, Mycobacterium tuberculosis H37Rv
gguccugcgccgca

SEQ ID NO: 3313390 - RNA, 18 nt, Mycobacterium tuberculosis H37Rv
ggucggagagguagagca

SEQ ID NO: 3313391 - RNA, 13 nt, Mycobacterium tuberculosis H37Rv
ggucggaucggcg

SEQ ID NO: 3313392 - RNA, 14 nt, Mycobacterium tuberculosis H37Rv
ggucggaucggcgc

SEQ ID NO: 3313393 - RNA, 22 nt, Mycobacterium tuberculosis H37Rv
ggucggcaaugucuucgauacc

SEQ ID NO: 3313394 - RNA, 16 nt, Mycobacterium tuberculosis H37Rv
ggucggcacgacccgg

SEQ ID NO: 3313395 - RNA, 19 nt, Mycobacterium tuberculosis H37Rv
ggucggcacgacccgggaa

SEQ ID NO: 3313396 - RNA, 19 nt, Mycobacterium tuberculosis H37Rv
ggucggcaucggagauacg

SEQ ID NO: 3313397 - RNA, 16 nt, Mycobacterium tuberculosis H37Rv
ggucggccaccgugga

SEQ ID NO: 3313398 - RNA, 13 nt, Mycobacterium tuberculosis H37Rv
ggucggccaggcc

SEQ ID NO: 3313399 - RNA, 16 nt, Mycobacterium tuberculosis H37Rv
ggucggccugcggcac

SEQ ID NO: 3313400 - RNA, 17 nt, Mycobacterium tuberculosis H37Rv
ggucggccuucagcguc

SEQ ID NO: 3313401 - RNA, 15 nt, Mycobacterium tuberculosis H37Rv
ggucggcgaccgcgc

SEQ ID NO: 3313402 - RNA, 22 nt, Mycobacterium tuberculosis H37Rv
ggucggcgaucaugggagcggg

SEQ ID NO: 3313403 - RNA, 15 nt, Mycobacterium tuberculosis H37Rv
ggucggcgaucugcg

SEQ ID NO: 3313404 - RNA, 20 nt, Mycobacterium tuberculosis H37Rv
ggucggcgaugaugacggcg

SEQ ID NO: 3313405 - RNA, 22 nt, Mycobacterium tuberculosis H37Rv
ggucggcgaugaugacggcggc

SEQ ID NO: 3313406 - RNA, 14 nt, Mycobacterium tuberculosis H37Rv
ggucggcgauggcg

SEQ ID NO: 3313407 - RNA, 14 nt, Mycobacterium tuberculosis H37Rv
ggucggcgcgccgu

SEQ ID NO: 3313408 - RNA, 22 nt, Mycobacterium tuberculosis H37Rv
ggucggcgugcccgccggcgag

SEQ ID NO: 3313409 - RNA, 17 nt, Mycobacterium tuberculosis H37Rv
ggucggcugauuggccc

SEQ ID NO: 3313410 - RNA, 22 nt, Mycobacterium tuberculosis H37Rv
ggucggcuuccggugccgggau

SEQ ID NO: 3313411 - RNA, 17 nt, Mycobacterium tuberculosis H37Rv
ggucggcuucgacaacc

SEQ ID NO: 3313412 - RNA, 14 nt, Mycobacterium tuberculosis H37Rv
ggucgggacgcugc

SEQ ID NO: 3313413 - RNA, 16 nt, Mycobacterium tuberculosis H37Rv
ggucgggcggcgucga

SEQ ID NO: 3313414 - RNA, 16 nt, Mycobacterium tuberculosis H37Rv
ggucggggagcugcgg

SEQ ID NO: 3313415 - RNA, 14 nt, Mycobacterium tuberculosis H37Rv
ggucgggucgcacc

SEQ ID NO: 3313416 - RNA, 23 nt, Mycobacterium tuberculosis H37Rv
ggucgguaccccagcgcugucgu

SEQ ID NO: 3313417 - RNA, 18 nt, Mycobacterium tuberculosis H37Rv
ggucgguaccgguaccug

SEQ ID NO: 3313418 - RNA, 19 nt, Mycobacterium tuberculosis H37Rv
ggucggucgcuucagcgcc

SEQ ID NO: 3313419 - RNA, 15 nt, Mycobacterium tuberculosis H37Rv
ggucggugacgaaga

SEQ ID NO: 3313420 - RNA, 23 nt, Mycobacterium tuberculosis H37Rv
ggucggugacgaagagcaccgcg

SEQ ID NO: 3313421 - RNA, 17 nt, Mycobacterium tuberculosis H37Rv
ggucggugauggucagc

SEQ ID NO: 3313422 - RNA, 21 nt, Mycobacterium tuberculosis H37Rv
ggucggugauggucagcuggc

SEQ ID NO: 3313423 - RNA, 23 nt, Mycobacterium tuberculosis H37Rv
ggucggugccagcaccacgucga

SEQ ID NO: 3313424 - RNA, 13 nt, Mycobacterium tuberculosis H37Rv
ggucggugcgguc

SEQ ID NO: 3313425 - RNA, 22 nt, Mycobacterium tuberculosis H37Rv
ggucggugggcuugccgcgcac

SEQ ID NO: 3313426 - RNA, 18 nt, Mycobacterium tuberculosis H37Rv
ggucguaggacaccaccg

SEQ ID NO: 3313427 - RNA, 16 nt, Mycobacterium tuberculosis H37Rv
ggucgucauccugguc

SEQ ID NO: 3313428 - RNA, 23 nt, Mycobacterium tuberculosis H37Rv
ggucgucauccuggucaccagcc

SEQ ID NO: 3313429 - RNA, 21 nt, Mycobacterium tuberculosis H37Rv
ggucgucaugccagucgccga

SEQ ID NO: 3313430 - RNA, 18 nt, Mycobacterium tuberculosis H37Rv
ggucguccaucgcgucgu

SEQ ID NO: 3313431 - RNA, 16 nt, Mycobacterium tuberculosis H37Rv
ggucguccgccugcac

SEQ ID NO: 3313432 - RNA, 13 nt, Mycobacterium tuberculosis H37Rv
ggucgucggcguc

SEQ ID NO: 3313433 - RNA, 18 nt, Mycobacterium tuberculosis H37Rv
ggucgugaaaccacaccu

SEQ ID NO: 3313434 - RNA, 19 nt, Mycobacterium tuberculosis H37Rv
ggucgugcaggcgacggcu

SEQ ID NO: 3313435 - RNA, 14 nt, Mycobacterium tuberculosis H37Rv
ggucgugccagcag

SEQ ID NO: 3313436 - RNA, 21 nt, Mycobacterium tuberculosis H37Rv
ggucgugcgacaacacgaccu

SEQ ID NO: 3313437 - RNA, 14 nt, Mycobacterium tuberculosis H37Rv
ggucguggcugugc

SEQ ID NO: 3313438 - RNA, 23 nt, Mycobacterium tuberculosis H37Rv
ggucguggugcaacacgccggcc

SEQ ID NO: 3313439 - RNA, 13 nt, Mycobacterium tuberculosis H37Rv
ggucgugucgcca

SEQ ID NO: 3313440 - RNA, 14 nt, Mycobacterium tuberculosis H37Rv
ggucguucaccgau

SEQ ID NO: 3313441 - RNA, 15 nt, Mycobacterium tuberculosis H37Rv
ggucguucaccgauc

SEQ ID NO: 3313442 - RNA, 13 nt, Mycobacterium tuberculosis H37Rv
ggucguucgccga

SEQ ID NO: 3313443 - RNA, 15 nt, Mycobacterium tuberculosis H37Rv
ggucguugaggccgg

SEQ ID NO: 3313444 - RNA, 17 nt, Mycobacterium tuberculosis H37Rv
ggucguugccggacaac

SEQ ID NO: 3313445 - RNA, 16 nt, Mycobacterium tuberculosis H37Rv
ggucguuggcggcggu

SEQ ID NO: 3313446 - RNA, 17 nt, Mycobacterium tuberculosis H37Rv
ggucguuggcggcgguc

SEQ ID NO: 3313447 - RNA, 21 nt, Mycobacterium tuberculosis H37Rv
ggucguuggugcagaccaccg

SEQ ID NO: 3313448 - RNA, 14 nt, Mycobacterium tuberculosis H37Rv
ggucguugucgggg

SEQ ID NO: 3313449 - RNA, 17 nt, Mycobacterium tuberculosis H37Rv
ggucguuuacggcaagu

SEQ ID NO: 3313450 - RNA, 17 nt, Mycobacterium tuberculosis H37Rv
ggucguuugugaacacc

SEQ ID NO: 3313451 - RNA, 13 nt, Mycobacterium tuberculosis H37Rv
ggucuacgccacc

SEQ ID NO: 3313452 - RNA, 13 nt, Mycobacterium tuberculosis H37Rv
ggucuagcugggu

SEQ ID NO: 3313453 - RNA, 20 nt, Mycobacterium tuberculosis H37Rv
ggucucccagaggucgagcg

SEQ ID NO: 3313454 - RNA, 15 nt, Mycobacterium tuberculosis H37Rv
ggucucccggcugau

SEQ ID NO: 3313455 - RNA, 23 nt, Mycobacterium tuberculosis H37Rv
ggucuccgaacggguagacccac

SEQ ID NO: 3313456 - RNA, 16 nt, Mycobacterium tuberculosis H37Rv
ggucuccggaucgccg

SEQ ID NO: 3313457 - RNA, 17 nt, Mycobacterium tuberculosis H37Rv
ggucuccggaucgccga

SEQ ID NO: 3313458 - RNA, 18 nt, Mycobacterium tuberculosis H37Rv
ggucuccggaucgccgaa

SEQ ID NO: 3313459 - RNA, 20 nt, Mycobacterium tuberculosis H37Rv
ggucuccggcaccgagucua

SEQ ID NO: 3313460 - RNA, 15 nt, Mycobacterium tuberculosis H37Rv
ggucuccggcgcacc

SEQ ID NO: 3313461 - RNA, 17 nt, Mycobacterium tuberculosis H37Rv
ggucucggugccgagca

SEQ ID NO: 3313462 - RNA, 17 nt, Mycobacterium tuberculosis H37Rv
ggucugacaucggccaa

SEQ ID NO: 3313463 - RNA, 14 nt, Mycobacterium tuberculosis H37Rv
ggucugccagcacc

SEQ ID NO: 3313464 - RNA, 18 nt, Mycobacterium tuberculosis H37Rv
ggucugccgggcgcgcgu

SEQ ID NO: 3313465 - RNA, 16 nt, Mycobacterium tuberculosis H37Rv
ggucugcgccgccggc

SEQ ID NO: 3313466 - RNA, 21 nt, Mycobacterium tuberculosis H37Rv
ggucugcgccgccggcggcgg

SEQ ID NO: 3313467 - RNA, 16 nt, Mycobacterium tuberculosis H37Rv
ggucugcggccgauac

SEQ ID NO: 3313468 - RNA, 11 nt, Mycobacterium tuberculosis H37Rv
ggucugcucau

SEQ ID NO: 3313469 - RNA, 10 nt, Mycobacterium tuberculosis H37Rv
ggucugcucc

SEQ ID NO: 3313470 - RNA, 15 nt, Mycobacterium tuberculosis H37Rv
ggucuggacugcagc

SEQ ID NO: 3313471 - RNA, 15 nt, Mycobacterium tuberculosis H37Rv
ggucuguuggugaca

SEQ ID NO: 3313472 - RNA, 14 nt, Mycobacterium tuberculosis H37Rv
ggucuucaggccgc

SEQ ID NO: 3313473 - RNA, 20 nt, Mycobacterium tuberculosis H37Rv
ggucuucaggccgcgcaugg

SEQ ID NO: 3313474 - RNA, 20 nt, Mycobacterium tuberculosis H37Rv
ggucuuccggugcgccgauc

SEQ ID NO: 3313475 - RNA, 21 nt, Mycobacterium tuberculosis H37Rv
ggucuucuucaccgccuuggu

SEQ ID NO: 3313476 - RNA, 17 nt, Mycobacterium tuberculosis H37Rv
ggucuugcaucgccgau

SEQ ID NO: 3313477 - RNA, 14 nt, Mycobacterium tuberculosis H37Rv
ggucuugccgagca

SEQ ID NO: 3313478 - RNA, 16 nt, Mycobacterium tuberculosis H37Rv
ggucuuggcgauccag

SEQ ID NO: 3313479 - RNA, 19 nt, Mycobacterium tuberculosis H37Rv
ggucuuggcgauccaggcc

SEQ ID NO: 3313480 - RNA, 20 nt, Mycobacterium tuberculosis H37Rv
ggucuuuaauccagcgccga

SEQ ID NO: 3313481 - RNA, 15 nt, Mycobacterium tuberculosis H37Rv
ggucuuugagccggu

SEQ ID NO: 3313482 - RNA, 14 nt, Mycobacterium tuberculosis H37Rv
ggucuuugcccgcc

SEQ ID NO: 3313483 - RNA, 16 nt, Mycobacterium tuberculosis H37Rv
ggucuuuguccacgag

SEQ ID NO: 3313484 - RNA, 18 nt, Mycobacterium tuberculosis H37Rv
ggugaaaaucgccaucgg

SEQ ID NO: 3313485 - RNA, 14 nt, Mycobacterium tuberculosis H37Rv
ggugaacaccagca

SEQ ID NO: 3313486 - RNA, 15 nt, Mycobacterium tuberculosis H37Rv
ggugaacgccugcgg

SEQ ID NO: 3313487 - RNA, 22 nt, Mycobacterium tuberculosis H37Rv
ggugcagcacgugugcgggcac

SEQ ID NO: 3313488 - RNA, 14 nt, Mycobacterium tuberculosis H37Rv
ggugcagcccgccg

SEQ ID NO: 3313489 - RNA, 18 nt, Mycobacterium tuberculosis H37Rv
ggugcagcccgccgcuga

SEQ ID NO: 3313490 - RNA, 24 nt, Mycobacterium tuberculosis H37Rv
ggugcagcccgccggauccgccag

SEQ ID NO: 3313491 - RNA, 13 nt, Mycobacterium tuberculosis H37Rv
ggugcagcgacuc

SEQ ID NO: 3313492 - RNA, 23 nt, Mycobacterium tuberculosis H37Rv
ggugcagcgcaggauucugcuga

SEQ ID NO: 3313493 - RNA, 16 nt, Mycobacterium tuberculosis H37Rv
ggugcagcgccgacag

SEQ ID NO: 3313494 - RNA, 17 nt, Mycobacterium tuberculosis H37Rv
ggugcagcgugcagcgg

SEQ ID NO: 3313495 - RNA, 19 nt, Mycobacterium tuberculosis H37Rv
ggugcagcgugcagcggcg

SEQ ID NO: 3313496 - RNA, 15 nt, Mycobacterium tuberculosis H37Rv
ggugcaggaccagaa

SEQ ID NO: 3313497 - RNA, 19 nt, Mycobacterium tuberculosis H37Rv
ggugcaggugaugcaugcu

SEQ ID NO: 3313498 - RNA, 16 nt, Mycobacterium tuberculosis H37Rv
ggugcagucgauuucg

SEQ ID NO: 3313499 - RNA, 21 nt, Mycobacterium tuberculosis H37Rv
ggugcagucgauuucggcggc

SEQ ID NO: 3313500 - RNA, 13 nt, Mycobacterium tuberculosis H37Rv
ggugccaacugcg

SEQ ID NO: 3313501 - RNA, 21 nt, Mycobacterium tuberculosis H37Rv
ggugccaccagugagcccgcu

SEQ ID NO: 3313502 - RNA, 17 nt, Mycobacterium tuberculosis H37Rv
ggugccacgaucggcgg

SEQ ID NO: 3313503 - RNA, 19 nt, Mycobacterium tuberculosis H37Rv
ggugccacguucgcgggcg

SEQ ID NO: 3313504 - RNA, 23 nt, Mycobacterium tuberculosis H37Rv
ggugccacugccguugccgccgg

SEQ ID NO: 3313505 - RNA, 22 nt, Mycobacterium tuberculosis H37Rv
ggugccagaucggcggguggcg

SEQ ID NO: 3313506 - RNA, 16 nt, Mycobacterium tuberculosis H37Rv
ggugccagcaccacgu

SEQ ID NO: 3313507 - RNA, 22 nt, Mycobacterium tuberculosis H37Rv
ggugccagcaccacgucgacga

SEQ ID NO: 3313508 - RNA, 19 nt, Mycobacterium tuberculosis H37Rv
ggugccagcacuccaccgc

SEQ ID NO: 3313509 - RNA, 11 nt, Mycobacterium tuberculosis H37Rv
ggugccagcag

SEQ ID NO: 3313510 - RNA, 12 nt, Mycobacterium tuberculosis H37Rv
ggugccagcagg

SEQ ID NO: 3313511 - RNA, 14 nt, Mycobacterium tuberculosis H37Rv
ggugccaggucggc

SEQ ID NO: 3313512 - RNA, 15 nt, Mycobacterium tuberculosis H37Rv
ggugccaggucggcg

SEQ ID NO: 3313513 - RNA, 20 nt, Mycobacterium tuberculosis H37Rv
ggugccaguacucggccagc

SEQ ID NO: 3313514 - RNA, 22 nt, Mycobacterium tuberculosis H37Rv
ggugccaguacucggccagcgc

SEQ ID NO: 3313515 - RNA, 14 nt, Mycobacterium tuberculosis H37Rv
ggugcccaucggca

SEQ ID NO: 3313516 - RNA, 16 nt, Mycobacterium tuberculosis H37Rv
ggugcccaugaugguc

SEQ ID NO: 3313517 - RNA, 17 nt, Mycobacterium tuberculosis H37Rv
ggugcccgcgaacgauc

SEQ ID NO: 3313518 - RNA, 14 nt, Mycobacterium tuberculosis H37Rv
ggugcccggcggcc

SEQ ID NO: 3313519 - RNA, 17 nt, Mycobacterium tuberculosis H37Rv
ggugcccugccggcagc

SEQ ID NO: 3313520 - RNA, 20 nt, Mycobacterium tuberculosis H37Rv
ggugccgaagaugaccgcuc

SEQ ID NO: 3313521 - RNA, 16 nt, Mycobacterium tuberculosis H37Rv
ggugccgacccgccgc

SEQ ID NO: 3313522 - RNA, 21 nt, Mycobacterium tuberculosis H37Rv
ggugccgagcacucggccacg

SEQ ID NO: 3313523 - RNA, 14 nt, Mycobacterium tuberculosis H37Rv
ggugccgcagcagg

SEQ ID NO: 3313524 - RNA, 15 nt, Mycobacterium tuberculosis H37Rv
ggugccgcagcaggg

SEQ ID NO: 3313525 - RNA, 16 nt, Mycobacterium tuberculosis H37Rv
ggugccgccaccaccg

SEQ ID NO: 3313526 - RNA, 14 nt, Mycobacterium tuberculosis H37Rv
ggugccgccgccgg

SEQ ID NO: 3313527 - RNA, 18 nt, Mycobacterium tuberculosis H37Rv
ggugccgccgccggcgcc

SEQ ID NO: 3313528 - RNA, 15 nt, Mycobacterium tuberculosis H37Rv
ggugccgccgucgau

SEQ ID NO: 3313529 - RNA, 17 nt, Mycobacterium tuberculosis H37Rv
ggugccgccgucgccgc

SEQ ID NO: 3313530 - RNA, 13 nt, Mycobacterium tuberculosis H37Rv
ggugccgccguug

SEQ ID NO: 3313531 - RNA, 18 nt, Mycobacterium tuberculosis H37Rv
ggugccgcggccaccgcc

SEQ ID NO: 3313532 - RNA, 16 nt, Mycobacterium tuberculosis H37Rv
ggugccggcagcggcg

SEQ ID NO: 3313533 - RNA, 17 nt, Mycobacterium tuberculosis H37Rv
ggugccggcauagaucg

SEQ ID NO: 3313534 - RNA, 16 nt, Mycobacterium tuberculosis H37Rv
ggugccggccaucgcc

SEQ ID NO: 3313535 - RNA, 21 nt, Mycobacterium tuberculosis H37Rv
ggugccggccguucgugggca

SEQ ID NO: 3313536 - RNA, 13 nt, Mycobacterium tuberculosis H37Rv
ggugccggcggcg

SEQ ID NO: 3313537 - RNA, 19 nt, Mycobacterium tuberculosis H37Rv
ggugccggcguugccgccg

SEQ ID NO: 3313538 - RNA, 23 nt, Mycobacterium tuberculosis H37Rv
ggugccgggaucgccguccagca

SEQ ID NO: 3313539 - RNA, 16 nt, Mycobacterium tuberculosis H37Rv
ggugccggggcugccg

SEQ ID NO: 3313540 - RNA, 14 nt, Mycobacterium tuberculosis H37Rv
ggugccgggguggc

SEQ ID NO: 3313541 - RNA, 19 nt, Mycobacterium tuberculosis H37Rv
ggugccggucacgucgauc

SEQ ID NO: 3313542 - RNA, 13 nt, Mycobacterium tuberculosis H37Rv
ggugccggugcgc

SEQ ID NO: 3313543 - RNA, 18 nt, Mycobacterium tuberculosis H37Rv
ggugccggugcuccucgg

SEQ ID NO: 3313544 - RNA, 18 nt, Mycobacterium tuberculosis H37Rv
ggugccgucagcggcggc

SEQ ID NO: 3313545 - RNA, 13 nt, Mycobacterium tuberculosis H37Rv
ggugccgucgagu

SEQ ID NO: 3313546 - RNA, 17 nt, Mycobacterium tuberculosis H37Rv
ggugccgucugcggggu

SEQ ID NO: 3313547 - RNA, 22 nt, Mycobacterium tuberculosis H37Rv
ggugccgugaucggcgcccggg

SEQ ID NO: 3313548 - RNA, 19 nt, Mycobacterium tuberculosis H37Rv
ggugccguugcgucugcuc

SEQ ID NO: 3313549 - RNA, 23 nt, Mycobacterium tuberculosis H37Rv
ggugccguugcgucugcucggcg

SEQ ID NO: 3313550 - RNA, 19 nt, Mycobacterium tuberculosis H37Rv
ggugccuacaccggcaagc

SEQ ID NO: 3313551 - RNA, 12 nt, Mycobacterium tuberculosis H37Rv
ggugcgacgauc

SEQ ID NO: 3313552 - RNA, 22 nt, Mycobacterium tuberculosis H37Rv
ggugcgccacgaccgcggcggc

SEQ ID NO: 3313553 - RNA, 23 nt, Mycobacterium tuberculosis H37Rv
ggugcgccacgccaccgcgguca

SEQ ID NO: 3313554 - RNA, 15 nt, Mycobacterium tuberculosis H37Rv
ggugcgccgaucccg

SEQ ID NO: 3313555 - RNA, 14 nt, Mycobacterium tuberculosis H37Rv
ggugcgccgucagc

SEQ ID NO: 3313556 - RNA, 13 nt, Mycobacterium tuberculosis H37Rv
ggugcgcgaagga

SEQ ID NO: 3313557 - RNA, 24 nt, Mycobacterium tuberculosis H37Rv
ggugcgcgaggucggcggcgcagg

SEQ ID NO: 3313558 - RNA, 15 nt, Mycobacterium tuberculosis H37Rv
ggugcgcgcggucga

SEQ ID NO: 3313559 - RNA, 12 nt, Mycobacterium tuberculosis H37Rv
ggugcgcgguug

SEQ ID NO: 3313560 - RNA, 22 nt, Mycobacterium tuberculosis H37Rv
ggugcgcugaugacgcggggcg

SEQ ID NO: 3313561 - RNA, 16 nt, Mycobacterium tuberculosis H37Rv
ggugcgcuggcccaau

SEQ ID NO: 3313562 - RNA, 18 nt, Mycobacterium tuberculosis H37Rv
ggugcgcuugcggccgcg

SEQ ID NO: 3313563 - RNA, 23 nt, Mycobacterium tuberculosis H37Rv
ggugcgcuugcggccgcgcgccg

SEQ ID NO: 3313564 - RNA, 22 nt, Mycobacterium tuberculosis H37Rv
ggugcggaacacgaugcgcggu

SEQ ID NO: 3313565 - RNA, 21 nt, Mycobacterium tuberculosis H37Rv
ggugcggauguccuugcgguc

SEQ ID NO: 3313566 - RNA, 17 nt, Mycobacterium tuberculosis H37Rv
ggugcggcaacagcgcc

SEQ ID NO: 3313567 - RNA, 14 nt, Mycobacterium tuberculosis H37Rv
ggugcggcacgccg

SEQ ID NO: 3313568 - RNA, 12 nt, Mycobacterium tuberculosis H37Rv
ggugcggccacu

SEQ ID NO: 3313569 - RNA, 17 nt, Mycobacterium tuberculosis H37Rv
ggugcggccgcggcgau

SEQ ID NO: 3313570 - RNA, 18 nt, Mycobacterium tuberculosis H37Rv
ggugcggccgcggcgauc

SEQ ID NO: 3313571 - RNA, 17 nt, Mycobacterium tuberculosis H37Rv
ggugcggcgggcucgcu

SEQ ID NO: 3313572 - RNA, 16 nt, Mycobacterium tuberculosis H37Rv
ggugcgggacgccgaa

SEQ ID NO: 3313573 - RNA, 18 nt, Mycobacterium tuberculosis H37Rv
ggugcgggccgguggaaa

SEQ ID NO: 3313574 - RNA, 13 nt, Mycobacterium tuberculosis H37Rv
ggugcggggccgg

SEQ ID NO: 3313575 - RNA, 15 nt, Mycobacterium tuberculosis H37Rv
ggugcgggguuggcc

SEQ ID NO: 3313576 - RNA, 20 nt, Mycobacterium tuberculosis H37Rv
ggugcgguuucaccgacgac

SEQ ID NO: 3313577 - RNA, 17 nt, Mycobacterium tuberculosis H37Rv
ggugcguagcagcgaua

SEQ ID NO: 3313578 - RNA, 18 nt, Mycobacterium tuberculosis H37Rv
ggugcgucacagccgggu

SEQ ID NO: 3313579 - RNA, 15 nt, Mycobacterium tuberculosis H37Rv
ggugcguccaggcca

SEQ ID NO: 3313580 - RNA, 20 nt, Mycobacterium tuberculosis H37Rv
ggugcguccaggccagggcg

SEQ ID NO: 3313581 - RNA, 22 nt, Mycobacterium tuberculosis H37Rv
ggugcguccaggccagggcggu

SEQ ID NO: 3313582 - RNA, 14 nt, Mycobacterium tuberculosis H37Rv
ggugcgucgaugcc

SEQ ID NO: 3313583 - RNA, 14 nt, Mycobacterium tuberculosis H37Rv
ggugggccagcagc

SEQ ID NO: 3313584 - RNA, 19 nt, Mycobacterium tuberculosis H37Rv
ggugggcgcagagucaacg

SEQ ID NO: 3313585 - RNA, 13 nt, Mycobacterium tuberculosis H37Rv
ggugggcgcuggg

SEQ ID NO: 3313586 - RNA, 16 nt, Mycobacterium tuberculosis H37Rv
gguggggccggcgucg

SEQ ID NO: 3313587 - RNA, 22 nt, Mycobacterium tuberculosis H37Rv
gguggggcgcacgauggugugc

SEQ ID NO: 3313588 - RNA, 13 nt, Mycobacterium tuberculosis H37Rv
ggugggggcggcg

SEQ ID NO: 3313589 - RNA, 14 nt, Mycobacterium tuberculosis H37Rv
gguggggucgacgc

SEQ ID NO: 3313590 - RNA, 14 nt, Mycobacterium tuberculosis H37Rv
gguggguagccagc

SEQ ID NO: 3313591 - RNA, 14 nt, Mycobacterium tuberculosis H37Rv
ggugggucggggcg

SEQ ID NO: 3313592 - RNA, 23 nt, Mycobacterium tuberculosis H37Rv
ggugggucggggcggcauuggcg

SEQ ID NO: 3313593 - RNA, 22 nt, Mycobacterium tuberculosis H37Rv
ggugggugaacgccugcgggaa

SEQ ID NO: 3313594 - RNA, 13 nt, Mycobacterium tuberculosis H37Rv
ggugggugcagca

SEQ ID NO: 3313595 - RNA, 18 nt, Mycobacterium tuberculosis H37Rv
ggugguaccggcgccacc

SEQ ID NO: 3313596 - RNA, 18 nt, Mycobacterium tuberculosis H37Rv
ggugguagcugacgcugc

SEQ ID NO: 3313597 - RNA, 19 nt, Mycobacterium tuberculosis H37Rv
gguggucaccaccaucacg

SEQ ID NO: 3313598 - RNA, 21 nt, Mycobacterium tuberculosis H37Rv
gguggucacgccgugugugcg

SEQ ID NO: 3313599 - RNA, 20 nt, Mycobacterium tuberculosis H37Rv
gguggucagguuggcacgcu

SEQ ID NO: 3313600 - RNA, 21 nt, Mycobacterium tuberculosis H37Rv
gguggucagguuggcacgcug

SEQ ID NO: 3313601 - RNA, 17 nt, Mycobacterium tuberculosis H37Rv
gguggucccccgcagcc

SEQ ID NO: 3313602 - RNA, 21 nt, Mycobacterium tuberculosis H37Rv
gguggucgacccggccaggag

SEQ ID NO: 3313603 - RNA, 16 nt, Mycobacterium tuberculosis H37Rv
gguggucggcgacguc

SEQ ID NO: 3313604 - RNA, 14 nt, Mycobacterium tuberculosis H37Rv
gguggucgggcgca

SEQ ID NO: 3313605 - RNA, 16 nt, Mycobacterium tuberculosis H37Rv
gguggucgucccgaug

SEQ ID NO: 3313606 - RNA, 17 nt, Mycobacterium tuberculosis H37Rv
gguggucucgguaggcg

SEQ ID NO: 3313607 - RNA, 21 nt, Mycobacterium tuberculosis H37Rv
gguggugacacgacgugcagg

SEQ ID NO: 3313608 - RNA, 14 nt, Mycobacterium tuberculosis H37Rv
gguggugacgucga

SEQ ID NO: 3313609 - RNA, 16 nt, Mycobacterium tuberculosis H37Rv
gguggugaggaucaug

SEQ ID NO: 3313610 - RNA, 18 nt, Mycobacterium tuberculosis H37Rv
gguggugccaaccugggc

SEQ ID NO: 3313611 - RNA, 13 nt, Mycobacterium tuberculosis H37Rv
gguggugcggaug

SEQ ID NO: 3313612 - RNA, 17 nt, Mycobacterium tuberculosis H37Rv
ggugguggccggggugc

SEQ ID NO: 3313613 - RNA, 20 nt, Mycobacterium tuberculosis H37Rv
gguggugggccguggguguc

SEQ ID NO: 3313614 - RNA, 14 nt, Mycobacterium tuberculosis H37Rv
gguggugucgcucg

SEQ ID NO: 3313615 - RNA, 16 nt, Mycobacterium tuberculosis H37Rv
gguggugucgguucgu

SEQ ID NO: 3313616 - RNA, 23 nt, Mycobacterium tuberculosis H37Rv
ggugguuagguggcuggcugugc

SEQ ID NO: 3313617 - RNA, 15 nt, Mycobacterium tuberculosis H37Rv
gguguaacggcggcu

SEQ ID NO: 3313618 - RNA, 19 nt, Mycobacterium tuberculosis H37Rv
gguguacaccgcgcccgcc

SEQ ID NO: 3313619 - RNA, 20 nt, Mycobacterium tuberculosis H37Rv
gguguacagucgcgcgcucg

SEQ ID NO: 3313620 - RNA, 23 nt, Mycobacterium tuberculosis H37Rv
gguguacagucgcgcgcucgcgg

SEQ ID NO: 3313621 - RNA, 23 nt, Mycobacterium tuberculosis H37Rv
gguguaccagacgaacgaccagg

SEQ ID NO: 3313622 - RNA, 13 nt, Mycobacterium tuberculosis H37Rv
gguguagagagcc

SEQ ID NO: 3313623 - RNA, 14 nt, Mycobacterium tuberculosis H37Rv
gguguagcagcgcc

SEQ ID NO: 3313624 - RNA, 21 nt, Mycobacterium tuberculosis H37Rv
gguguagcccagccgggugga

SEQ ID NO: 3313625 - RNA, 19 nt, Mycobacterium tuberculosis H37Rv
ggugucaugaacgaccgga

SEQ ID NO: 3313626 - RNA, 18 nt, Mycobacterium tuberculosis H37Rv
gguguccagccacgcugu

SEQ ID NO: 3313627 - RNA, 16 nt, Mycobacterium tuberculosis H37Rv
gguguccauguucucc

SEQ ID NO: 3313628 - RNA, 23 nt, Mycobacterium tuberculosis H37Rv
gguguccuccagcugcgcgggcg

SEQ ID NO: 3313629 - RNA, 14 nt, Mycobacterium tuberculosis H37Rv
gguguccucgucga

SEQ ID NO: 3313630 - RNA, 18 nt, Mycobacterium tuberculosis H37Rv
ggugucgauuggcucgcc

SEQ ID NO: 3313631 - RNA, 19 nt, Mycobacterium tuberculosis H37Rv
ggugucgcucgcgaggauc

SEQ ID NO: 3313632 - RNA, 15 nt, Mycobacterium tuberculosis H37Rv
ggugucggcucgagu

SEQ ID NO: 3313633 - RNA, 16 nt, Mycobacterium tuberculosis H37Rv
ggugucggcuggucgc

SEQ ID NO: 3313634 - RNA, 14 nt, Mycobacterium tuberculosis H37Rv
ggugucgggcagca

SEQ ID NO: 3313635 - RNA, 18 nt, Mycobacterium tuberculosis H37Rv
ggugucggugcgcggcaa

SEQ ID NO: 3313636 - RNA, 19 nt, Mycobacterium tuberculosis H37Rv
ggugucgguggccgcggcg

SEQ ID NO: 3313637 - RNA, 17 nt, Mycobacterium tuberculosis H37Rv
ggugucggugucgacgu

SEQ ID NO: 3313638 - RNA, 21 nt, Mycobacterium tuberculosis H37Rv
ggugucucccuugccgccauu

SEQ ID NO: 3313639 - RNA, 16 nt, Mycobacterium tuberculosis H37Rv
ggugugauacagcgcc

SEQ ID NO: 3313640 - RNA, 13 nt, Mycobacterium tuberculosis H37Rv
ggugugcagcagc

SEQ ID NO: 3313641 - RNA, 15 nt, Mycobacterium tuberculosis H37Rv
ggugugcgaacaagu

SEQ ID NO: 3313642 - RNA, 14 nt, Mycobacterium tuberculosis H37Rv
ggugugcggcagcc

SEQ ID NO: 3313643 - RNA, 15 nt, Mycobacterium tuberculosis H37Rv
ggugugcgggcggug

SEQ ID NO: 3313644 - RNA, 21 nt, Mycobacterium tuberculosis H37Rv
ggugugcgggguugggcggag

SEQ ID NO: 3313645 - RNA, 21 nt, Mycobacterium tuberculosis H37Rv
ggugugcucgccgaccagcuu

SEQ ID NO: 3313646 - RNA, 14 nt, Mycobacterium tuberculosis H37Rv
ggugugcugccacc

SEQ ID NO: 3313647 - RNA, 15 nt, Mycobacterium tuberculosis H37Rv
ggugugcugccaccg

SEQ ID NO: 3313648 - RNA, 16 nt, Mycobacterium tuberculosis H37Rv
ggugugcugccaccgg

SEQ ID NO: 3313649 - RNA, 22 nt, Mycobacterium tuberculosis H37Rv
ggugugcuugcucgggucgugc

SEQ ID NO: 3313650 - RNA, 19 nt, Mycobacterium tuberculosis H37Rv
gguguggacuucagcaggc

SEQ ID NO: 3313651 - RNA, 16 nt, Mycobacterium tuberculosis H37Rv
ggugugggcgcaacga

SEQ ID NO: 3313652 - RNA, 15 nt, Mycobacterium tuberculosis H37Rv
gguguggucaccagg

SEQ ID NO: 3313653 - RNA, 20 nt, Mycobacterium tuberculosis H37Rv
gguguggucaccaggccgaa

SEQ ID NO: 3313654 - RNA, 13 nt, Mycobacterium tuberculosis H37Rv
ggugugucggguu

SEQ ID NO: 3313655 - RNA, 23 nt, Mycobacterium tuberculosis H37Rv
gguguguuccaacuccugcagcc

SEQ ID NO: 3313656 - RNA, 22 nt, Mycobacterium tuberculosis H37Rv
gguguguuuggcauggucaggc

SEQ ID NO: 3313657 - RNA, 17 nt, Mycobacterium tuberculosis H37Rv
gguguucgaugggugca

SEQ ID NO: 3313658 - RNA, 17 nt, Mycobacterium tuberculosis H37Rv
gguguugagaucgcccg

SEQ ID NO: 3313659 - RNA, 13 nt, Mycobacterium tuberculosis H37Rv
gguguugaggccg

SEQ ID NO: 3313660 - RNA, 19 nt, Mycobacterium tuberculosis H37Rv
gguguugaugggcagccgc

SEQ ID NO: 3313661 - RNA, 20 nt, Mycobacterium tuberculosis H37Rv
gguguugaugggcagccgcc

SEQ ID NO: 3313662 - RNA, 14 nt, Mycobacterium tuberculosis H37Rv
gguguugccggaga

SEQ ID NO: 3313663 - RNA, 23 nt, Mycobacterium tuberculosis H37Rv
gguguugccggagacgucgccgc

SEQ ID NO: 3313664 - RNA, 21 nt, Mycobacterium tuberculosis H37Rv
gguguugcggcugaccuccca

SEQ ID NO: 3313665 - RNA, 13 nt, Mycobacterium tuberculosis H37Rv
gguguuggacgcc

SEQ ID NO: 3313666 - RNA, 16 nt, Mycobacterium tuberculosis H37Rv
gguguuggcgccagcc

SEQ ID NO: 3313667 - RNA, 19 nt, Mycobacterium tuberculosis H37Rv
gguguugugugcucgucgc

SEQ ID NO: 3313668 - RNA, 17 nt, Mycobacterium tuberculosis H37Rv
gguguuuaugguugugc

SEQ ID NO: 3313669 - RNA, 21 nt, Mycobacterium tuberculosis H37Rv
gguguuuccgaaacccgccgc

SEQ ID NO: 3313670 - RNA, 17 nt, Mycobacterium tuberculosis H37Rv
gguguuugucgcggugg

SEQ ID NO: 3313671 - RNA, 18 nt, Mycobacterium tuberculosis H37Rv
gguuaaccuccaggucgc

SEQ ID NO: 3313672 - RNA, 13 nt, Mycobacterium tuberculosis H37Rv
gguuagcgcggcc

SEQ ID NO: 3313673 - RNA, 21 nt, Mycobacterium tuberculosis H37Rv
gguuagggacuuuccggcgca

SEQ ID NO: 3313674 - RNA, 16 nt, Mycobacterium tuberculosis H37Rv
gguuaucccagacugu

SEQ ID NO: 3313675 - RNA, 15 nt, Mycobacterium tuberculosis H37Rv
gguuaucggcagcag

SEQ ID NO: 3313676 - RNA, 20 nt, Mycobacterium tuberculosis H37Rv
gguucaaagcagcgcaccaa

SEQ ID NO: 3313677 - RNA, 21 nt, Mycobacterium tuberculosis H37Rv
gguucaacgcgcgcacgccac

SEQ ID NO: 3313678 - RNA, 18 nt, Mycobacterium tuberculosis H37Rv
gguucacggggaccagau

SEQ ID NO: 3313679 - RNA, 18 nt, Mycobacterium tuberculosis H37Rv
guaacgccaagcucggcc

SEQ ID NO: 3313680 - RNA, 17 nt, Mycobacterium tuberculosis H37Rv
guaacgccgcucaucca

SEQ ID NO: 3313681 - RNA, 20 nt, Mycobacterium tuberculosis H37Rv
guaacgguaaccggcccgau

SEQ ID NO: 3313682 - RNA, 22 nt, Mycobacterium tuberculosis H37Rv
guaacucgaguagucgcuggcc

SEQ ID NO: 3313683 - RNA, 20 nt, Mycobacterium tuberculosis H37Rv
guaagaaucgaagcggcugc

SEQ ID NO: 3313684 - RNA, 23 nt, Mycobacterium tuberculosis H37Rv
guaagacgccgaacgcgagguuc

SEQ ID NO: 3313685 - RNA, 17 nt, Mycobacterium tuberculosis H37Rv
guaagcaccagccagcc

SEQ ID NO: 3313686 - RNA, 13 nt, Mycobacterium tuberculosis H37Rv
guaagccugguuc

SEQ ID NO: 3313687 - RNA, 15 nt, Mycobacterium tuberculosis H37Rv
guaaggagccgggcc

SEQ ID NO: 3313688 - RNA, 19 nt, Mycobacterium tuberculosis H37Rv
guaagggacaccagcucga

SEQ ID NO: 3313689 - RNA, 21 nt, Mycobacterium tuberculosis H37Rv
guaaguuauccgaccacucca

SEQ ID NO: 3313690 - RNA, 20 nt, Mycobacterium tuberculosis H37Rv
guaauccacacacagccggu

SEQ ID NO: 3313691 - RNA, 16 nt, Mycobacterium tuberculosis H37Rv
guaaucgagcgcggca

SEQ ID NO: 3313692 - RNA, 17 nt, Mycobacterium tuberculosis H37Rv
guaaugcugcugcagca

SEQ ID NO: 3313693 - RNA, 22 nt, Mycobacterium tuberculosis H37Rv
guaauggccgccgguccaugga

SEQ ID NO: 3313694 - RNA, 21 nt, Mycobacterium tuberculosis H37Rv
guaauucaacaagcgacagac

SEQ ID NO: 3313695 - RNA, 15 nt, Mycobacterium tuberculosis H37Rv
guaauugccgaccgc

SEQ ID NO: 3313696 - RNA, 23 nt, Mycobacterium tuberculosis H37Rv
guacaagcauuggcgucgacaac

SEQ ID NO: 3313697 - RNA, 22 nt, Mycobacterium tuberculosis H37Rv
guacaagucgaccaugagccgg

SEQ ID NO: 3313698 - RNA, 23 nt, Mycobacterium tuberculosis H37Rv
guacaagucgaccaugagccggc

SEQ ID NO: 3313699 - RNA, 16 nt, Mycobacterium tuberculosis H37Rv
guacacaaauccgcac

SEQ ID NO: 3313700 - RNA, 13 nt, Mycobacterium tuberculosis H37Rv
guacacagacccg

SEQ ID NO: 3313701 - RNA, 17 nt, Mycobacterium tuberculosis H37Rv
guacacauaggugcggg

SEQ ID NO: 3313702 - RNA, 22 nt, Mycobacterium tuberculosis H37Rv
guacacauaggugcggggccgg

SEQ ID NO: 3313703 - RNA, 14 nt, Mycobacterium tuberculosis H37Rv
guacaccaggccgu

SEQ ID NO: 3313704 - RNA, 17 nt, Mycobacterium tuberculosis H37Rv
guacaccagggugccgg

SEQ ID NO: 3313705 - RNA, 16 nt, Mycobacterium tuberculosis H37Rv
guacaccccaucgaua

SEQ ID NO: 3313706 - RNA, 17 nt, Mycobacterium tuberculosis H37Rv
guacaccgugcgccgaa

SEQ ID NO: 3313707 - RNA, 23 nt, Mycobacterium tuberculosis H37Rv
guacacgaucaagagguccuuga

SEQ ID NO: 3313708 - RNA, 21 nt, Mycobacterium tuberculosis H37Rv
guacacguaccgguccagugu

SEQ ID NO: 3313709 - RNA, 24 nt, Mycobacterium tuberculosis H37Rv
guacacguccaguggcagccagcg

SEQ ID NO: 3313710 - RNA, 17 nt, Mycobacterium tuberculosis H37Rv
guacagacacgcgcgcu

SEQ ID NO: 3313711 - RNA, 21 nt, Mycobacterium tuberculosis H37Rv
guacagaucgagggggacgcu

SEQ ID NO: 3313712 - RNA, 14 nt, Mycobacterium tuberculosis H37Rv
guacagcggcggcg

SEQ ID NO: 3313713 - RNA, 15 nt, Mycobacterium tuberculosis H37Rv
guacagucgcgcgcu

SEQ ID NO: 3313714 - RNA, 16 nt, Mycobacterium tuberculosis H37Rv
guacagucgcgcgcuc

SEQ ID NO: 3313715 - RNA, 16 nt, Mycobacterium tuberculosis H37Rv
guacaucgaggccacg

SEQ ID NO: 3313716 - RNA, 16 nt, Mycobacterium tuberculosis H37Rv
guaccaauccaggcca

SEQ ID NO: 3313717 - RNA, 22 nt, Mycobacterium tuberculosis H37Rv
guaccaauccaggccaccccga

SEQ ID NO: 3313718 - RNA, 21 nt, Mycobacterium tuberculosis H37Rv
guaccagacgaacgaccaggc

SEQ ID NO: 3313719 - RNA, 16 nt, Mycobacterium tuberculosis H37Rv
guaccagagcagcuca

SEQ ID NO: 3313720 - RNA, 16 nt, Mycobacterium tuberculosis H37Rv
guaccagcccagcggc

SEQ ID NO: 3313721 - RNA, 20 nt, Mycobacterium tuberculosis H37Rv
guaccagcccagcggcuggu

SEQ ID NO: 3313722 - RNA, 13 nt, Mycobacterium tuberculosis H37Rv
guaccagcuggcc

SEQ ID NO: 3313723 - RNA, 22 nt, Mycobacterium tuberculosis H37Rv
guacccaccucccgcagccggg

SEQ ID NO: 3313724 - RNA, 22 nt, Mycobacterium tuberculosis H37Rv
guacccacgcauguuggugauc

SEQ ID NO: 3313725 - RNA, 14 nt, Mycobacterium tuberculosis H37Rv
guacccagcgcggc

SEQ ID NO: 3313726 - RNA, 23 nt, Mycobacterium tuberculosis H37Rv
guacccagcgcggccaccaccga

SEQ ID NO: 3313727 - RNA, 14 nt, Mycobacterium tuberculosis H37Rv
guacccaucugcuc

SEQ ID NO: 3313728 - RNA, 13 nt, Mycobacterium tuberculosis H37Rv
guaccccagcgcc

SEQ ID NO: 3313729 - RNA, 23 nt, Mycobacterium tuberculosis H37Rv
guaccccagcgcugucguaccgc

SEQ ID NO: 3313730 - RNA, 15 nt, Mycobacterium tuberculosis H37Rv
guaccccccagcgac

SEQ ID NO: 3313731 - RNA, 15 nt, Mycobacterium tuberculosis H37Rv
guacccgaccagcac

SEQ ID NO: 3313732 - RNA, 16 nt, Mycobacterium tuberculosis H37Rv
guacccgaucacucgg

SEQ ID NO: 3313733 - RNA, 13 nt, Mycobacterium tuberculosis H37Rv
guacccgaucagc

SEQ ID NO: 3313734 - RNA, 18 nt, Mycobacterium tuberculosis H37Rv
guacccgaucagcgacgc

SEQ ID NO: 3313735 - RNA, 21 nt, Mycobacterium tuberculosis H37Rv
guacccgccucgggccggcgu

SEQ ID NO: 3313736 - RNA, 15 nt, Mycobacterium tuberculosis H37Rv
guacccggcgacguu

SEQ ID NO: 3313737 - RNA, 18 nt, Mycobacterium tuberculosis H37Rv
guacccguuaugcgccgc

SEQ ID NO: 3313738 - RNA, 15 nt, Mycobacterium tuberculosis H37Rv
guaccgacgaagauc

SEQ ID NO: 3313739 - RNA, 15 nt, Mycobacterium tuberculosis H37Rv
guaccgagcagcaga

SEQ ID NO: 3313740 - RNA, 15 nt, Mycobacterium tuberculosis H37Rv
guaccgauagccugc

SEQ ID NO: 3313741 - RNA, 17 nt, Mycobacterium tuberculosis H37Rv
guaccgauccaguucac

SEQ ID NO: 3313742 - RNA, 16 nt, Mycobacterium tuberculosis H37Rv
guaccgcccgcaccgu

SEQ ID NO: 3313743 - RNA, 21 nt, Mycobacterium tuberculosis H37Rv
guaccgcgcguugaagucgcc

SEQ ID NO: 3313744 - RNA, 14 nt, Mycobacterium tuberculosis H37Rv
guaccgcuggacag

SEQ ID NO: 3313745 - RNA, 15 nt, Mycobacterium tuberculosis H37Rv
guaccggaaucggcg

SEQ ID NO: 3313746 - RNA, 17 nt, Mycobacterium tuberculosis H37Rv
guaccggcaaacgcgca

SEQ ID NO: 3313747 - RNA, 13 nt, Mycobacterium tuberculosis H37Rv
guaccggccagcc

SEQ ID NO: 3313748 - RNA, 16 nt, Mycobacterium tuberculosis H37Rv
guaccggcugguugac

SEQ ID NO: 3313749 - RNA, 21 nt, Mycobacterium tuberculosis H37Rv
guaccggcugguugaccgagu

SEQ ID NO: 3313750 - RNA, 14 nt, Mycobacterium tuberculosis H37Rv
guaccgggacgaau

SEQ ID NO: 3313751 - RNA, 17 nt, Mycobacterium tuberculosis H37Rv
guaccgguccagugugu

SEQ ID NO: 3313752 - RNA, 16 nt, Mycobacterium tuberculosis H37Rv
guaccuaaggcucacc

SEQ ID NO: 3313753 - RNA, 16 nt, Mycobacterium tuberculosis H37Rv
guaccuagccgcagau

SEQ ID NO: 3313754 - RNA, 16 nt, Mycobacterium tuberculosis H37Rv
guaccuaggaguggua

SEQ ID NO: 3313755 - RNA, 15 nt, Mycobacterium tuberculosis H37Rv
guaccucaucgcaga

SEQ ID NO: 3313756 - RNA, 14 nt, Mycobacterium tuberculosis H37Rv
guaccuuggcgucg

SEQ ID NO: 3313757 - RNA, 23 nt, Mycobacterium tuberculosis H37Rv
guacgacccccgaucaggccgac

SEQ ID NO: 3313758 - RNA, 15 nt, Mycobacterium tuberculosis H37Rv
guacgccgccgcgac

SEQ ID NO: 3313759 - RNA, 14 nt, Mycobacterium tuberculosis H37Rv
guacgccggacccg

SEQ ID NO: 3313760 - RNA, 20 nt, Mycobacterium tuberculosis H37Rv
guacgccguaucggggcacc

SEQ ID NO: 3313761 - RNA, 15 nt, Mycobacterium tuberculosis H37Rv
guacgcgaccgcgau

SEQ ID NO: 3313762 - RNA, 14 nt, Mycobacterium tuberculosis H37Rv
guacgcggcugacg

SEQ ID NO: 3313763 - RNA, 14 nt, Mycobacterium tuberculosis H37Rv
guacggaccgucgc

SEQ ID NO: 3313764 - RNA, 20 nt, Mycobacterium tuberculosis H37Rv
guacggacgcugcauuggcg

SEQ ID NO: 3313765 - RNA, 14 nt, Mycobacterium tuberculosis H37Rv
guacggccaacauc

SEQ ID NO: 3313766 - RNA, 11 nt, Mycobacterium tuberculosis H37Rv
guacggcggcu

SEQ ID NO: 3313767 - RNA, 16 nt, Mycobacterium tuberculosis H37Rv
guacggcgguccggau

SEQ ID NO: 3313768 - RNA, 18 nt, Mycobacterium tuberculosis H37Rv
guacggcguacgccggac

SEQ ID NO: 3313769 - RNA, 15 nt, Mycobacterium tuberculosis H37Rv
guacggggucgccgg

SEQ ID NO: 3313770 - RNA, 23 nt, Mycobacterium tuberculosis H37Rv
guacggggucgccggcaccggau

SEQ ID NO: 3313771 - RNA, 23 nt, Mycobacterium tuberculosis H37Rv
guacggugggugguuguccacgg

SEQ ID NO: 3313772 - RNA, 21 nt, Mycobacterium tuberculosis H37Rv
guacuaacaacaccaccagca

SEQ ID NO: 3313773 - RNA, 16 nt, Mycobacterium tuberculosis H37Rv
guacucccaggccgcc

SEQ ID NO: 3313774 - RNA, 15 nt, Mycobacterium tuberculosis H37Rv
guacucccgcgaucg

SEQ ID NO: 3313775 - RNA, 16 nt, Mycobacterium tuberculosis H37Rv
guaggccggggcgucg

SEQ ID NO: 3313776 - RNA, 19 nt, Mycobacterium tuberculosis H37Rv
guaggccuccgcugccgcc

SEQ ID NO: 3313777 - RNA, 12 nt, Mycobacterium tuberculosis H37Rv
guaggcgaccgc

SEQ ID NO: 3313778 - RNA, 14 nt, Mycobacterium tuberculosis H37Rv
guaggcgaccgcca

SEQ ID NO: 3313779 - RNA, 17 nt, Mycobacterium tuberculosis H37Rv
guaggcgaugagcgugc

SEQ ID NO: 3313780 - RNA, 13 nt, Mycobacterium tuberculosis H37Rv
guaggcgccgcga

SEQ ID NO: 3313781 - RNA, 14 nt, Mycobacterium tuberculosis H37Rv
guaggcgccgcgac

SEQ ID NO: 3313782 - RNA, 15 nt, Mycobacterium tuberculosis H37Rv
guaggcggccagcgc

SEQ ID NO: 3313783 - RNA, 16 nt, Mycobacterium tuberculosis H37Rv
guaggcggcgacccgc

SEQ ID NO: 3313784 - RNA, 17 nt, Mycobacterium tuberculosis H37Rv
guaggcgguguccagaa

SEQ ID NO: 3313785 - RNA, 23 nt, Mycobacterium tuberculosis H37Rv
guaggcuggccgccuccgcggca

SEQ ID NO: 3313786 - RNA, 11 nt, Mycobacterium tuberculosis H37Rv
guagggacgcc

SEQ ID NO: 3313787 - RNA, 17 nt, Mycobacterium tuberculosis H37Rv
guagggcagcgccaggc

SEQ ID NO: 3313788 - RNA, 20 nt, Mycobacterium tuberculosis H37Rv
guagggcggaaacggcaccg

SEQ ID NO: 3313789 - RNA, 11 nt, Mycobacterium tuberculosis H37Rv
guaggggucug

SEQ ID NO: 3313790 - RNA, 21 nt, Mycobacterium tuberculosis H37Rv
guagguccacguucggcugcg

SEQ ID NO: 3313791 - RNA, 18 nt, Mycobacterium tuberculosis H37Rv
guaggucgccgcuuugga

SEQ ID NO: 3313792 - RNA, 21 nt, Mycobacterium tuberculosis H37Rv
guaggucugggcaagaccgcg

SEQ ID NO: 3313793 - RNA, 18 nt, Mycobacterium tuberculosis H37Rv
guaggugcaugucgauga

SEQ ID NO: 3313794 - RNA, 22 nt, Mycobacterium tuberculosis H37Rv
guagguggccggcuugcaguga

SEQ ID NO: 3313795 - RNA, 18 nt, Mycobacterium tuberculosis H37Rv
guagguggggcacuucca

SEQ ID NO: 3313796 - RNA, 15 nt, Mycobacterium tuberculosis H37Rv
guagguugcgccccg

SEQ ID NO: 3313797 - RNA, 17 nt, Mycobacterium tuberculosis H37Rv
guaguaaugcucgacgu

SEQ ID NO: 3313798 - RNA, 14 nt, Mycobacterium tuberculosis H37Rv
guagucacggucgu

SEQ ID NO: 3313799 - RNA, 18 nt, Mycobacterium tuberculosis H37Rv
guagucacggucguggug

SEQ ID NO: 3313800 - RNA, 16 nt, Mycobacterium tuberculosis H37Rv
guaguccagcacggcc

SEQ ID NO: 3313801 - RNA, 23 nt, Mycobacterium tuberculosis H37Rv
guagucccucaucaccucuccgu

SEQ ID NO: 3313802 - RNA, 19 nt, Mycobacterium tuberculosis H37Rv
guaguccgcgccgacggcc

SEQ ID NO: 3313803 - RNA, 22 nt, Mycobacterium tuberculosis H37Rv
guaguccgcgccgacggccagc

SEQ ID NO: 3313804 - RNA, 14 nt, Mycobacterium tuberculosis H37Rv
guaguccugcgggc

SEQ ID NO: 3313805 - RNA, 21 nt, Mycobacterium tuberculosis H37Rv
guagucgauuggcugcgccga

SEQ ID NO: 3313806 - RNA, 17 nt, Mycobacterium tuberculosis H37Rv
guagucgccgggcggcc

SEQ ID NO: 3313807 - RNA, 20 nt, Mycobacterium tuberculosis H37Rv
guagucgccggucaggcuca

SEQ ID NO: 3313808 - RNA, 22 nt, Mycobacterium tuberculosis H37Rv
guagucggccagcucgcgggcc

SEQ ID NO: 3313809 - RNA, 18 nt, Mycobacterium tuberculosis H37Rv
guagucggcgccgagauc

SEQ ID NO: 3313810 - RNA, 21 nt, Mycobacterium tuberculosis H37Rv
guagugcccacaaccgcacca

SEQ ID NO: 3313811 - RNA, 23 nt, Mycobacterium tuberculosis H37Rv
guagugcccacaaccgcaccagg

SEQ ID NO: 3313812 - RNA, 14 nt, Mycobacterium tuberculosis H37Rv
guagugcucgccgg

SEQ ID NO: 3313813 - RNA, 15 nt, Mycobacterium tuberculosis H37Rv
guaguggccggcuuc

SEQ ID NO: 3313814 - RNA, 16 nt, Mycobacterium tuberculosis H37Rv
guaguggugggcgugg

SEQ ID NO: 3313815 - RNA, 21 nt, Mycobacterium tuberculosis H37Rv
guaguucagccaggccgcaau

SEQ ID NO: 3313816 - RNA, 14 nt, Mycobacterium tuberculosis H37Rv
guaguucgaugacu

SEQ ID NO: 3313817 - RNA, 14 nt, Mycobacterium tuberculosis H37Rv
guauagaccaggua

SEQ ID NO: 3313818 - RNA, 15 nt, Mycobacterium tuberculosis H37Rv
guauagcgugaccgu

SEQ ID NO: 3313819 - RNA, 18 nt, Mycobacterium tuberculosis H37Rv
guauaggccguugaucgu

SEQ ID NO: 3313820 - RNA, 18 nt, Mycobacterium tuberculosis H37Rv
guaucaaccggccgguga

SEQ ID NO: 3313821 - RNA, 19 nt, Mycobacterium tuberculosis H37Rv
guaucacgguugccgcgau

SEQ ID NO: 3313822 - RNA, 19 nt, Mycobacterium tuberculosis H37Rv
guauccgacuggccccgcc

SEQ ID NO: 3313823 - RNA, 22 nt, Mycobacterium tuberculosis H37Rv
guauccgacuggccccgccagc

SEQ ID NO: 3313824 - RNA, 20 nt, Mycobacterium tuberculosis H37Rv
guauccggcagaccggugcu

SEQ ID NO: 3313825 - RNA, 23 nt, Mycobacterium tuberculosis H37Rv
guaucgaagcucaauuccaugca

SEQ ID NO: 3313826 - RNA, 15 nt, Mycobacterium tuberculosis H37Rv
guaucggcagauggu

SEQ ID NO: 3313827 - RNA, 19 nt, Mycobacterium tuberculosis H37Rv
guaucggcgugucucgucg

SEQ ID NO: 3313828 - RNA, 23 nt, Mycobacterium tuberculosis H37Rv
guaucggggggucuugccgagca

SEQ ID NO: 3313829 - RNA, 24 nt, Mycobacterium tuberculosis H37Rv
guaucggggggucuugccgagcaa

SEQ ID NO: 3313830 - RNA, 15 nt, Mycobacterium tuberculosis H37Rv
guaucggucagccac

SEQ ID NO: 3313831 - RNA, 13 nt, Mycobacterium tuberculosis H37Rv
guaucgucccggc

SEQ ID NO: 3313832 - RNA, 23 nt, Mycobacterium tuberculosis H37Rv
guaucuguuccuugugaccccgg

SEQ ID NO: 3313833 - RNA, 23 nt, Mycobacterium tuberculosis H37Rv
guaugagcuuccgcgcgcagaug

SEQ ID NO: 3313834 - RNA, 20 nt, Mycobacterium tuberculosis H37Rv
guaugauucacgcucggcgu

SEQ ID NO: 3313835 - RNA, 20 nt, Mycobacterium tuberculosis H37Rv
guaugcacaugaucccauga

SEQ ID NO: 3313836 - RNA, 17 nt, Mycobacterium tuberculosis H37Rv
guaugcccggacgggga

SEQ ID NO: 3313837 - RNA, 17 nt, Mycobacterium tuberculosis H37Rv
guaugcccggauuggcg

SEQ ID NO: 3313838 - RNA, 16 nt, Mycobacterium tuberculosis H37Rv
guauggccgccaccgc

SEQ ID NO: 3313839 - RNA, 14 nt, Mycobacterium tuberculosis H37Rv
guaugucccggugc

SEQ ID NO: 3313840 - RNA, 14 nt, Mycobacterium tuberculosis H37Rv
guauucccacugca

SEQ ID NO: 3313841 - RNA, 21 nt, Mycobacterium tuberculosis H37Rv
guauucccgcuuggcgugacc

SEQ ID NO: 3313842 - RNA, 21 nt, Mycobacterium tuberculosis H37Rv
guauuccgggguaucgacccu

SEQ ID NO: 3313843 - RNA, 15 nt, Mycobacterium tuberculosis H37Rv
guauucggccgcgag

SEQ ID NO: 3313844 - RNA, 13 nt, Mycobacterium tuberculosis H37Rv
guauucguggucg

SEQ ID NO: 3313845 - RNA, 16 nt, Mycobacterium tuberculosis H37Rv
guauugauacugcccg

SEQ ID NO: 3313846 - RNA, 15 nt, Mycobacterium tuberculosis H37Rv
guauugauccaggua

SEQ ID NO: 3313847 - RNA, 20 nt, Mycobacterium tuberculosis H37Rv
guauugaucgaauacaccug

SEQ ID NO: 3313848 - RNA, 19 nt, Mycobacterium tuberculosis H37Rv
guauugcaccgcggccagc

SEQ ID NO: 3313849 - RNA, 23 nt, Mycobacterium tuberculosis H37Rv
guauugcaccgcggccagcacca

SEQ ID NO: 3313850 - RNA, 20 nt, Mycobacterium tuberculosis H37Rv
guauuuugccggauucuccg

SEQ ID NO: 3313851 - RNA, 14 nt, Mycobacterium tuberculosis H37Rv
guauuuuucgacca

SEQ ID NO: 3313852 - RNA, 14 nt, Mycobacterium tuberculosis H37Rv
gucaaacgcaaaga

SEQ ID NO: 3313853 - RNA, 18 nt, Mycobacterium tuberculosis H37Rv
gucaacaccaugguggug

SEQ ID NO: 3313854 - RNA, 18 nt, Mycobacterium tuberculosis H37Rv
gucaacacccgcccgggc

SEQ ID NO: 3313855 - RNA, 18 nt, Mycobacterium tuberculosis H37Rv
gucaacaccgcggccgag

SEQ ID NO: 3313856 - RNA, 17 nt, Mycobacterium tuberculosis H37Rv
gucaacagauaaggauc

SEQ ID NO: 3313857 - RNA, 18 nt, Mycobacterium tuberculosis H37Rv
gucaacagauaaggauca

SEQ ID NO: 3313858 - RNA, 14 nt, Mycobacterium tuberculosis H37Rv
gucaacagcggcaa

SEQ ID NO: 3313859 - RNA, 18 nt, Mycobacterium tuberculosis H37Rv
gucaacagcggcaagaag

SEQ ID NO: 3313860 - RNA, 20 nt, Mycobacterium tuberculosis H37Rv
gucaacagggccaggacaac

SEQ ID NO: 3313861 - RNA, 21 nt, Mycobacterium tuberculosis H37Rv
gucaacauuucugagacacga

SEQ ID NO: 3313862 - RNA, 18 nt, Mycobacterium tuberculosis H37Rv
gucaaccaagcgugccug

SEQ ID NO: 3313863 - RNA, 17 nt, Mycobacterium tuberculosis H37Rv
gucaacccguaaaagcc

SEQ ID NO: 3313864 - RNA, 12 nt, Mycobacterium tuberculosis H37Rv
gucaaccgcgcc

SEQ ID NO: 3313865 - RNA, 20 nt, Mycobacterium tuberculosis H37Rv
gucaaccgguguaauugccg

SEQ ID NO: 3313866 - RNA, 11 nt, Mycobacterium tuberculosis H37Rv
gucaaccugcg

SEQ ID NO: 3313867 - RNA, 19 nt, Mycobacterium tuberculosis H37Rv
gucaaccugcgcaucacca

SEQ ID NO: 3313868 - RNA, 12 nt, Mycobacterium tuberculosis H37Rv
gucaacgacgac

SEQ ID NO: 3313869 - RNA, 16 nt, Mycobacterium tuberculosis H37Rv
gucaacgacgacgaca

SEQ ID NO: 3313870 - RNA, 21 nt, Mycobacterium tuberculosis H37Rv
gucaacgacgacgacaagugc

SEQ ID NO: 3313871 - RNA, 15 nt, Mycobacterium tuberculosis H37Rv
gucacgucgacggcg

SEQ ID NO: 3313872 - RNA, 16 nt, Mycobacterium tuberculosis H37Rv
gucacguggucggcca

SEQ ID NO: 3313873 - RNA, 17 nt, Mycobacterium tuberculosis H37Rv
gucacguggucggccac

SEQ ID NO: 3313874 - RNA, 20 nt, Mycobacterium tuberculosis H37Rv
gucacguggucggccacccc

SEQ ID NO: 3313875 - RNA, 20 nt, Mycobacterium tuberculosis H37Rv
gucacucccuggccgcuucg

SEQ ID NO: 3313876 - RNA, 21 nt, Mycobacterium tuberculosis H37Rv
gucacucgcaagaaccggcau

SEQ ID NO: 3313877 - RNA, 14 nt, Mycobacterium tuberculosis H37Rv
gucacucuggcgag

SEQ ID NO: 3313878 - RNA, 16 nt, Mycobacterium tuberculosis H37Rv
gucacugugacgccgg

SEQ ID NO: 3313879 - RNA, 19 nt, Mycobacterium tuberculosis H37Rv
gucagaaaaagccgcguag

SEQ ID NO: 3313880 - RNA, 20 nt, Mycobacterium tuberculosis H37Rv
gucagaacaccggccaggcc

SEQ ID NO: 3313881 - RNA, 16 nt, Mycobacterium tuberculosis H37Rv
gucagaccgcgaacag

SEQ ID NO: 3313882 - RNA, 22 nt, Mycobacterium tuberculosis H37Rv
gucagacgccggccgccgaccg

SEQ ID NO: 3313883 - RNA, 14 nt, Mycobacterium tuberculosis H37Rv
gucagauagugcau

SEQ ID NO: 3313884 - RNA, 17 nt, Mycobacterium tuberculosis H37Rv
gucagauggccacccgc

SEQ ID NO: 3313885 - RNA, 20 nt, Mycobacterium tuberculosis H37Rv
gucagaugguuggaucgcca

SEQ ID NO: 3313886 - RNA, 16 nt, Mycobacterium tuberculosis H37Rv
gucagauguuguacgg

SEQ ID NO: 3313887 - RNA, 19 nt, Mycobacterium tuberculosis H37Rv
gucagcacccaacccggcg

SEQ ID NO: 3313888 - RNA, 15 nt, Mycobacterium tuberculosis H37Rv
gucagcacgcugacc

SEQ ID NO: 3313889 - RNA, 16 nt, Mycobacterium tuberculosis H37Rv
gucagcagacugccga

SEQ ID NO: 3313890 - RNA, 14 nt, Mycobacterium tuberculosis H37Rv
gucagcagaugggc

SEQ ID NO: 3313891 - RNA, 22 nt, Mycobacterium tuberculosis H37Rv
gucagcagaugggcgucgguca

SEQ ID NO: 3313892 - RNA, 13 nt, Mycobacterium tuberculosis H37Rv
gucagcagcgccg

SEQ ID NO: 3313893 - RNA, 17 nt, Mycobacterium tuberculosis H37Rv
gucagcaguucggcgau

SEQ ID NO: 3313894 - RNA, 21 nt, Mycobacterium tuberculosis H37Rv
gucagcaugggaauccgcugu

SEQ ID NO: 3313895 - RNA, 19 nt, Mycobacterium tuberculosis H37Rv
gucagccaccaucuggaug

SEQ ID NO: 3313896 - RNA, 21 nt, Mycobacterium tuberculosis H37Rv
gucagcccgauacgggugugg

SEQ ID NO: 3313897 - RNA, 15 nt, Mycobacterium tuberculosis H37Rv
gucagccgcggcggc

SEQ ID NO: 3313898 - RNA, 19 nt, Mycobacterium tuberculosis H37Rv
gucagccggaccaccaggu

SEQ ID NO: 3313899 - RNA, 10 nt, Mycobacterium tuberculosis H37Rv
gucagccggu

SEQ ID NO: 3313900 - RNA, 13 nt, Mycobacterium tuberculosis H37Rv
gucagccggugac

SEQ ID NO: 3313901 - RNA, 15 nt, Mycobacterium tuberculosis H37Rv
gucagccugccaggu

SEQ ID NO: 3313902 - RNA, 20 nt, Mycobacterium tuberculosis H37Rv
gucagccugccagguacuca

SEQ ID NO: 3313903 - RNA, 15 nt, Mycobacterium tuberculosis H37Rv
gucagcgaacggcca

SEQ ID NO: 3313904 - RNA, 20 nt, Mycobacterium tuberculosis H37Rv
gucagcgacuugcggugcuc

SEQ ID NO: 3313905 - RNA, 13 nt, Mycobacterium tuberculosis H37Rv
gucagcgccgcgc

SEQ ID NO: 3313906 - RNA, 14 nt, Mycobacterium tuberculosis H37Rv
gucagcgccggcca

SEQ ID NO: 3313907 - RNA, 20 nt, Mycobacterium tuberculosis H37Rv
gucagcgcgccgucggguuc

SEQ ID NO: 3313908 - RNA, 19 nt, Mycobacterium tuberculosis H37Rv
gucagcgcgcggcucgggu

SEQ ID NO: 3313909 - RNA, 15 nt, Mycobacterium tuberculosis H37Rv
gucagcgcggcgacc

SEQ ID NO: 3313910 - RNA, 16 nt, Mycobacterium tuberculosis H37Rv
gucagcgcggcgcaca

SEQ ID NO: 3313911 - RNA, 12 nt, Mycobacterium tuberculosis H37Rv
gucagcgcgucg

SEQ ID NO: 3313912 - RNA, 12 nt, Mycobacterium tuberculosis H37Rv
gucagcggcggc

SEQ ID NO: 3313913 - RNA, 22 nt, Mycobacterium tuberculosis H37Rv
gucagcggcucggcgggggacc

SEQ ID NO: 3313914 - RNA, 14 nt, Mycobacterium tuberculosis H37Rv
gucagcggcugggc

SEQ ID NO: 3313915 - RNA, 18 nt, Mycobacterium tuberculosis H37Rv
gucagcggcugggcgguc

SEQ ID NO: 3313916 - RNA, 14 nt, Mycobacterium tuberculosis H37Rv
gucagcgggcagca

SEQ ID NO: 3313917 - RNA, 16 nt, Mycobacterium tuberculosis H37Rv
gucagcgggcagcagg

SEQ ID NO: 3313918 - RNA, 12 nt, Mycobacterium tuberculosis H37Rv
gucagcgggcuu

SEQ ID NO: 3313919 - RNA, 14 nt, Mycobacterium tuberculosis H37Rv
gucagcgugcaggu

SEQ ID NO: 3313920 - RNA, 15 nt, Mycobacterium tuberculosis H37Rv
gucagcucgaccuga

SEQ ID NO: 3313921 - RNA, 15 nt, Mycobacterium tuberculosis H37Rv
gucagcucgaucacg

SEQ ID NO: 3313922 - RNA, 15 nt, Mycobacterium tuberculosis H37Rv
gucagcucgccagcc

SEQ ID NO: 3313923 - RNA, 19 nt, Mycobacterium tuberculosis H37Rv
gucagcucggcagcaucuc

SEQ ID NO: 3313924 - RNA, 17 nt, Mycobacterium tuberculosis H37Rv
gucagcugguugggggu

SEQ ID NO: 3313925 - RNA, 12 nt, Mycobacterium tuberculosis H37Rv
gucaggaaaccg

SEQ ID NO: 3313926 - RNA, 16 nt, Mycobacterium tuberculosis H37Rv
gucaggaucgcaccga

SEQ ID NO: 3313927 - RNA, 19 nt, Mycobacterium tuberculosis H37Rv
gucaggcagcuccgccgcc

SEQ ID NO: 3313928 - RNA, 19 nt, Mycobacterium tuberculosis H37Rv
gucaggcaguccaccgcgc

SEQ ID NO: 3313929 - RNA, 16 nt, Mycobacterium tuberculosis H37Rv
gucaggccagagucgc

SEQ ID NO: 3313930 - RNA, 12 nt, Mycobacterium tuberculosis H37Rv
gucaggccagcg

SEQ ID NO: 3313931 - RNA, 18 nt, Mycobacterium tuberculosis H37Rv
gucaggccagggugacca

SEQ ID NO: 3313932 - RNA, 19 nt, Mycobacterium tuberculosis H37Rv
gucaggcccauggcagccc

SEQ ID NO: 3313933 - RNA, 20 nt, Mycobacterium tuberculosis H37Rv
gucaggccgacuaaccacug

SEQ ID NO: 3313934 - RNA, 16 nt, Mycobacterium tuberculosis H37Rv
gucaggccgccgcggc

SEQ ID NO: 3313935 - RNA, 16 nt, Mycobacterium tuberculosis H37Rv
gucaggccuccaaaau

SEQ ID NO: 3313936 - RNA, 15 nt, Mycobacterium tuberculosis H37Rv
gucaggcggccgucg

SEQ ID NO: 3313937 - RNA, 20 nt, Mycobacterium tuberculosis H37Rv
gucaggcggccgucgucggc

SEQ ID NO: 3313938 - RNA, 14 nt, Mycobacterium tuberculosis H37Rv
gucaggcggcggac

SEQ ID NO: 3313939 - RNA, 20 nt, Mycobacterium tuberculosis H37Rv
gucaggcgugccggggauau

SEQ ID NO: 3313940 - RNA, 22 nt, Mycobacterium tuberculosis H37Rv
gucaggcucacacucggccggg

SEQ ID NO: 3313941 - RNA, 15 nt, Mycobacterium tuberculosis H37Rv
gucaggcucauccgc

SEQ ID NO: 3313942 - RNA, 16 nt, Mycobacterium tuberculosis H37Rv
gucagggucaccugcg

SEQ ID NO: 3313943 - RNA, 18 nt, Mycobacterium tuberculosis H37Rv
gucagguaauucguccac

SEQ ID NO: 3313944 - RNA, 20 nt, Mycobacterium tuberculosis H37Rv
gucaggucugacagaccggg

SEQ ID NO: 3313945 - RNA, 21 nt, Mycobacterium tuberculosis H37Rv
gucaggugauucgcgcagcgc

SEQ ID NO: 3313946 - RNA, 19 nt, Mycobacterium tuberculosis H37Rv
gucagguggccaaugccuu

SEQ ID NO: 3313947 - RNA, 16 nt, Mycobacterium tuberculosis H37Rv
gucagguucgcaccgg

SEQ ID NO: 3313948 - RNA, 14 nt, Mycobacterium tuberculosis H37Rv
gucaguccucaucg

SEQ ID NO: 3313949 - RNA, 21 nt, Mycobacterium tuberculosis H37Rv
gucaguccucaucgagcgcgc

SEQ ID NO: 3313950 - RNA, 18 nt, Mycobacterium tuberculosis H37Rv
gucaguuacgcaucguca

SEQ ID NO: 3313951 - RNA, 14 nt, Mycobacterium tuberculosis H37Rv
gucauacccagcuc

SEQ ID NO: 3313952 - RNA, 17 nt, Mycobacterium tuberculosis H37Rv
gucauacucgacaccga

SEQ ID NO: 3313953 - RNA, 18 nt, Mycobacterium tuberculosis H37Rv
gucauacucgacaccgac

SEQ ID NO: 3313954 - RNA, 16 nt, Mycobacterium tuberculosis H37Rv
gucauagagcucgccg

SEQ ID NO: 3313955 - RNA, 16 nt, Mycobacterium tuberculosis H37Rv
gucauaucucgagccc

SEQ ID NO: 3313956 - RNA, 20 nt, Mycobacterium tuberculosis H37Rv
gucaucaugucgagguucca

SEQ ID NO: 3313957 - RNA, 22 nt, Mycobacterium tuberculosis H37Rv
gucaucccuuucgcgccgcgag

SEQ ID NO: 3313958 - RNA, 16 nt, Mycobacterium tuberculosis H37Rv
gucauccgacaagcug

SEQ ID NO: 3313959 - RNA, 13 nt, Mycobacterium tuberculosis H37Rv
gucauccgcggca

SEQ ID NO: 3313960 - RNA, 14 nt, Mycobacterium tuberculosis H37Rv
gucauccggccguc

SEQ ID NO: 3313961 - RNA, 13 nt, Mycobacterium tuberculosis H37Rv
gucaucgccagcg

SEQ ID NO: 3313962 - RNA, 14 nt, Mycobacterium tuberculosis H37Rv
gucaucgccagcgg

SEQ ID NO: 3313963 - RNA, 19 nt, Mycobacterium tuberculosis H37Rv
gucaucgccggguagcugu

SEQ ID NO: 3313964 - RNA, 15 nt, Mycobacterium tuberculosis H37Rv
gucaucgcguaguga

SEQ ID NO: 3313965 - RNA, 17 nt, Mycobacterium tuberculosis H37Rv
gucaucggaucaaagcc

SEQ ID NO: 3313966 - RNA, 13 nt, Mycobacterium tuberculosis H37Rv
gucaucuggaagu

SEQ ID NO: 3313967 - RNA, 17 nt, Mycobacterium tuberculosis H37Rv
gucaucuggcgcgccac

SEQ ID NO: 3313968 - RNA, 15 nt, Mycobacterium tuberculosis H37Rv
gucccagagaaucag

SEQ ID NO: 3313969 - RNA, 18 nt, Mycobacterium tuberculosis H37Rv
gucccagccgaucacggg

SEQ ID NO: 3313970 - RNA, 18 nt, Mycobacterium tuberculosis H37Rv
gucccagcgccgcacaga

SEQ ID NO: 3313971 - RNA, 20 nt, Mycobacterium tuberculosis H37Rv
gucccagcucccgcggcgcc

SEQ ID NO: 3313972 - RNA, 16 nt, Mycobacterium tuberculosis H37Rv
gucccagcugaccagc

SEQ ID NO: 3313973 - RNA, 15 nt, Mycobacterium tuberculosis H37Rv
gucccagggcugccg

SEQ ID NO: 3313974 - RNA, 12 nt, Mycobacterium tuberculosis H37Rv
gucccaucgcgu

SEQ ID NO: 3313975 - RNA, 23 nt, Mycobacterium tuberculosis H37Rv
gucccaugcacggccgagcaggu

SEQ ID NO: 3313976 - RNA, 18 nt, Mycobacterium tuberculosis H37Rv
gucccauuugccuugagc

SEQ ID NO: 3313977 - RNA, 14 nt, Mycobacterium tuberculosis H37Rv
guccccaggugggc

SEQ ID NO: 3313978 - RNA, 21 nt, Mycobacterium tuberculosis H37Rv
guccccaggugggcagcaggc

SEQ ID NO: 3313979 - RNA, 15 nt, Mycobacterium tuberculosis H37Rv
guccccaugcagcgc

SEQ ID NO: 3313980 - RNA, 14 nt, Mycobacterium tuberculosis H37Rv
gucccccgcacgcg

SEQ ID NO: 3313981 - RNA, 20 nt, Mycobacterium tuberculosis H37Rv
guccccgacgucaggcagcu

SEQ ID NO: 3313982 - RNA, 14 nt, Mycobacterium tuberculosis H37Rv
guccccgcagcgcc

SEQ ID NO: 3313983 - RNA, 15 nt, Mycobacterium tuberculosis H37Rv
guccccgcagcgccu

SEQ ID NO: 3313984 - RNA, 15 nt, Mycobacterium tuberculosis H37Rv
guccccgcagcucga

SEQ ID NO: 3313985 - RNA, 16 nt, Mycobacterium tuberculosis H37Rv
guccccgcccggccag

SEQ ID NO: 3313986 - RNA, 18 nt, Mycobacterium tuberculosis H37Rv
guccccgcccggccagcu

SEQ ID NO: 3313987 - RNA, 21 nt, Mycobacterium tuberculosis H37Rv
guccccgcccggccagcucgg

SEQ ID NO: 3313988 - RNA, 21 nt, Mycobacterium tuberculosis H37Rv
guccccggcugccagcgccgc

SEQ ID NO: 3313989 - RNA, 16 nt, Mycobacterium tuberculosis H37Rv
guccccguagucguca

SEQ ID NO: 3313990 - RNA, 21 nt, Mycobacterium tuberculosis H37Rv
guccccguugagauaccccga

SEQ ID NO: 3313991 - RNA, 19 nt, Mycobacterium tuberculosis H37Rv
gucccgauggcgguggggc

SEQ ID NO: 3313992 - RNA, 19 nt, Mycobacterium tuberculosis H37Rv
gucccgcaaaaucgucagc

SEQ ID NO: 3313993 - RNA, 22 nt, Mycobacterium tuberculosis H37Rv
gucccgccgaccgacaccacca

SEQ ID NO: 3313994 - RNA, 15 nt, Mycobacterium tuberculosis H37Rv
gucccgccgcaccgc

SEQ ID NO: 3313995 - RNA, 16 nt, Mycobacterium tuberculosis H37Rv
gucccgccgccuggaa

SEQ ID NO: 3313996 - RNA, 21 nt, Mycobacterium tuberculosis H37Rv
gucccgccguugccgccguca

SEQ ID NO: 3313997 - RNA, 15 nt, Mycobacterium tuberculosis H37Rv
gucccgcgagcagcc

SEQ ID NO: 3313998 - RNA, 16 nt, Mycobacterium tuberculosis H37Rv
gucccgcgagcagccc

SEQ ID NO: 3313999 - RNA, 17 nt, Mycobacterium tuberculosis H37Rv
gucccgcggaccgcaac

SEQ ID NO: 3314000 - RNA, 22 nt, Mycobacterium tuberculosis H37Rv
gucccgcgugccacucgaugcu

SEQ ID NO: 3314001 - RNA, 17 nt, Mycobacterium tuberculosis H37Rv
gucccggcgaccggguc

SEQ ID NO: 3314002 - RNA, 19 nt, Mycobacterium tuberculosis H37Rv
gucccggcggucagcggcu

SEQ ID NO: 3314003 - RNA, 16 nt, Mycobacterium tuberculosis H37Rv
gucccgggcaccgucg

SEQ ID NO: 3314004 - RNA, 15 nt, Mycobacterium tuberculosis H37Rv
gucccgguguccagc

SEQ ID NO: 3314005 - RNA, 17 nt, Mycobacterium tuberculosis H37Rv
gucccgguguccagcca

SEQ ID NO: 3314006 - RNA, 20 nt, Mycobacterium tuberculosis H37Rv
gucccgugcgcgcgcagcug

SEQ ID NO: 3314007 - RNA, 21 nt, Mycobacterium tuberculosis H37Rv
gucccgugcgcgcgcagcuga

SEQ ID NO: 3314008 - RNA, 19 nt, Mycobacterium tuberculosis H37Rv
gucccguucgcccgcccgu

SEQ ID NO: 3314009 - RNA, 15 nt, Mycobacterium tuberculosis H37Rv
gucccguugccgccc

SEQ ID NO: 3314010 - RNA, 15 nt, Mycobacterium tuberculosis H37Rv
gucccugcgccguca

SEQ ID NO: 3314011 - RNA, 20 nt, Mycobacterium tuberculosis H37Rv
gucccugcgccgucaacacc

SEQ ID NO: 3314012 - RNA, 19 nt, Mycobacterium tuberculosis H37Rv
gucccugugucgccgucgc

SEQ ID NO: 3314013 - RNA, 23 nt, Mycobacterium tuberculosis H37Rv
gucccuuguggucugccagcacc

SEQ ID NO: 3314014 - RNA, 16 nt, Mycobacterium tuberculosis H37Rv
guccgaacacggugaa

SEQ ID NO: 3314015 - RNA, 15 nt, Mycobacterium tuberculosis H37Rv
guccgaaccaccugu

SEQ ID NO: 3314016 - RNA, 19 nt, Mycobacterium tuberculosis H37Rv
guccgaacuugacgaacuc

SEQ ID NO: 3314017 - RNA, 21 nt, Mycobacterium tuberculosis H37Rv
guccgaaguacuggccgccgc

SEQ ID NO: 3314018 - RNA, 20 nt, Mycobacterium tuberculosis H37Rv
guccgacaccacggaccagc

SEQ ID NO: 3314019 - RNA, 19 nt, Mycobacterium tuberculosis H37Rv
guccgacaccggcggcauc

SEQ ID NO: 3314020 - RNA, 19 nt, Mycobacterium tuberculosis H37Rv
guccgaccagcggccgacc

SEQ ID NO: 3314021 - RNA, 19 nt, Mycobacterium tuberculosis H37Rv
guccgacgcaccaacgcga

SEQ ID NO: 3314022 - RNA, 15 nt, Mycobacterium tuberculosis H37Rv
guccgacuucuccag

SEQ ID NO: 3314023 - RNA, 20 nt, Mycobacterium tuberculosis H37Rv
guccgaucggcgcgccgauc

SEQ ID NO: 3314024 - RNA, 21 nt, Mycobacterium tuberculosis H37Rv
guccgaucguuucagcuagac

SEQ ID NO: 3314025 - RNA, 17 nt, Mycobacterium tuberculosis H37Rv
guccgaugcgugccgac

SEQ ID NO: 3314026 - RNA, 21 nt, Mycobacterium tuberculosis H37Rv
guccgaugcgugccgacccgc

SEQ ID NO: 3314027 - RNA, 16 nt, Mycobacterium tuberculosis H37Rv
guccgcaaccucgccg

SEQ ID NO: 3314028 - RNA, 21 nt, Mycobacterium tuberculosis H37Rv
guccgcacgaucugcaggccc

SEQ ID NO: 3314029 - RNA, 16 nt, Mycobacterium tuberculosis H37Rv
guccgcagcaccgucg

SEQ ID NO: 3314030 - RNA, 22 nt, Mycobacterium tuberculosis H37Rv
guccgccaacggcaccucgacg

SEQ ID NO: 3314031 - RNA, 20 nt, Mycobacterium tuberculosis H37Rv
guccgccaaguacugggcca

SEQ ID NO: 3314032 - RNA, 17 nt, Mycobacterium tuberculosis H37Rv
guccgccaccgcgagca

SEQ ID NO: 3314033 - RNA, 22 nt, Mycobacterium tuberculosis H37Rv
guccgccauugucgaucuggua

SEQ ID NO: 3314034 - RNA, 12 nt, Mycobacterium tuberculosis H37Rv
guccgcccagca

SEQ ID NO: 3314035 - RNA, 14 nt, Mycobacterium tuberculosis H37Rv
guccgcccagcacc

SEQ ID NO: 3314036 - RNA, 18 nt, Mycobacterium tuberculosis H37Rv
guccgcccagccgcagca

SEQ ID NO: 3314037 - RNA, 16 nt, Mycobacterium tuberculosis H37Rv
guccgccgcagacgcc

SEQ ID NO: 3314038 - RNA, 15 nt, Mycobacterium tuberculosis H37Rv
guccgccgccugcgc

SEQ ID NO: 3314039 - RNA, 14 nt, Mycobacterium tuberculosis H37Rv
guccgccggugccg

SEQ ID NO: 3314040 - RNA, 18 nt, Mycobacterium tuberculosis H37Rv
guccgccgucgaccacga

SEQ ID NO: 3314041 - RNA, 16 nt, Mycobacterium tuberculosis H37Rv
guccgccguugccgau

SEQ ID NO: 3314042 - RNA, 20 nt, Mycobacterium tuberculosis H37Rv
guccgccguugccgaucccc

SEQ ID NO: 3314043 - RNA, 14 nt, Mycobacterium tuberculosis H37Rv
guccgccugcaccg

SEQ ID NO: 3314044 - RNA, 21 nt, Mycobacterium tuberculosis H37Rv
guccgcgaacgauuucggccc

SEQ ID NO: 3314045 - RNA, 15 nt, Mycobacterium tuberculosis H37Rv
guccgcgauggccgc

SEQ ID NO: 3314046 - RNA, 17 nt, Mycobacterium tuberculosis H37Rv
guccgcgauggccgcgu

SEQ ID NO: 3314047 - RNA, 17 nt, Mycobacterium tuberculosis H37Rv
guccgcgccgacggcca

SEQ ID NO: 3314048 - RNA, 17 nt, Mycobacterium tuberculosis H37Rv
guccgcgcgcaagucga

SEQ ID NO: 3314049 - RNA, 22 nt, Mycobacterium tuberculosis H37Rv
guccgcgcucagcuccggcgac

SEQ ID NO: 3314050 - RNA, 15 nt, Mycobacterium tuberculosis H37Rv
guccgcggaucacca

SEQ ID NO: 3314051 - RNA, 17 nt, Mycobacterium tuberculosis H37Rv
guccgcggaugcauguc

SEQ ID NO: 3314052 - RNA, 12 nt, Mycobacterium tuberculosis H37Rv
guccgcggccac

SEQ ID NO: 3314053 - RNA, 18 nt, Mycobacterium tuberculosis H37Rv
guccgcggguagcgguuc

SEQ ID NO: 3314054 - RNA, 19 nt, Mycobacterium tuberculosis H37Rv
guccgcggucgcagcagac

SEQ ID NO: 3314055 - RNA, 20 nt, Mycobacterium tuberculosis H37Rv
guccgcggucgcagcagacc

SEQ ID NO: 3314056 - RNA, 22 nt, Mycobacterium tuberculosis H37Rv
guccgcggucgcagcagaccac

SEQ ID NO: 3314057 - RNA, 15 nt, Mycobacterium tuberculosis H37Rv
guccgcuacggcguc

SEQ ID NO: 3314058 - RNA, 12 nt, Mycobacterium tuberculosis H37Rv
guccgcucgccg

SEQ ID NO: 3314059 - RNA, 17 nt, Mycobacterium tuberculosis H37Rv
guccggaagcggcguuc

SEQ ID NO: 3314060 - RNA, 17 nt, Mycobacterium tuberculosis H37Rv
guccggaugcgcaaccg

SEQ ID NO: 3314061 - RNA, 19 nt, Mycobacterium tuberculosis H37Rv
guccggcacgcgucuggaa

SEQ ID NO: 3314062 - RNA, 16 nt, Mycobacterium tuberculosis H37Rv
guccggcacugcggcc

SEQ ID NO: 3314063 - RNA, 15 nt, Mycobacterium tuberculosis H37Rv
guccggcccaccagc

SEQ ID NO: 3314064 - RNA, 11 nt, Mycobacterium tuberculosis H37Rv
gucgacaaacc

SEQ ID NO: 3314065 - RNA, 17 nt, Mycobacterium tuberculosis H37Rv
gucgacaagccgucggc

SEQ ID NO: 3314066 - RNA, 15 nt, Mycobacterium tuberculosis H37Rv
gucgacacccgcacg

SEQ ID NO: 3314067 - RNA, 17 nt, Mycobacterium tuberculosis H37Rv
gucgacaccgaggaccu

SEQ ID NO: 3314068 - RNA, 17 nt, Mycobacterium tuberculosis H37Rv
gucgacaccgcggugcc

SEQ ID NO: 3314069 - RNA, 17 nt, Mycobacterium tuberculosis H37Rv
gucgacacgccgaacgu

SEQ ID NO: 3314070 - RNA, 14 nt, Mycobacterium tuberculosis H37Rv
gucgacacggugau

SEQ ID NO: 3314071 - RNA, 22 nt, Mycobacterium tuberculosis H37Rv
gucgacagcgaaggcgccgaac

SEQ ID NO: 3314072 - RNA, 20 nt, Mycobacterium tuberculosis H37Rv
gucgacaguucaacgggccu

SEQ ID NO: 3314073 - RNA, 22 nt, Mycobacterium tuberculosis H37Rv
gucgacaucaaagucgaggucg

SEQ ID NO: 3314074 - RNA, 13 nt, Mycobacterium tuberculosis H37Rv
gucgacaucgaca

SEQ ID NO: 3314075 - RNA, 15 nt, Mycobacterium tuberculosis H37Rv
gucgaccacgaccgu

SEQ ID NO: 3314076 - RNA, 17 nt, Mycobacterium tuberculosis H37Rv
gucgaccacgaccgucu

SEQ ID NO: 3314077 - RNA, 21 nt, Mycobacterium tuberculosis H37Rv
gucgaccaggacgguuggucc

SEQ ID NO: 3314078 - RNA, 12 nt, Mycobacterium tuberculosis H37Rv
gucgaccaggcc

SEQ ID NO: 3314079 - RNA, 15 nt, Mycobacterium tuberculosis H37Rv
gucgaccaggccacu

SEQ ID NO: 3314080 - RNA, 21 nt, Mycobacterium tuberculosis H37Rv
gucgaccaggccacugccgac

SEQ ID NO: 3314081 - RNA, 22 nt, Mycobacterium tuberculosis H37Rv
gucgaccaugagccggcgccgc

SEQ ID NO: 3314082 - RNA, 19 nt, Mycobacterium tuberculosis H37Rv
gucgacccccugccacagc

SEQ ID NO: 3314083 - RNA, 15 nt, Mycobacterium tuberculosis H37Rv
gucgaccccggccag

SEQ ID NO: 3314084 - RNA, 14 nt, Mycobacterium tuberculosis H37Rv
gucgacccggccag

SEQ ID NO: 3314085 - RNA, 21 nt, Mycobacterium tuberculosis H37Rv
gucgaccgaacccgacgucgc

SEQ ID NO: 3314086 - RNA, 21 nt, Mycobacterium tuberculosis H37Rv
gucgaccucggcaaccaccuc

SEQ ID NO: 3314087 - RNA, 20 nt, Mycobacterium tuberculosis H37Rv
gucgaccuuauugccgagcu

SEQ ID NO: 3314088 - RNA, 14 nt, Mycobacterium tuberculosis H37Rv
gucgacgacaacga

SEQ ID NO: 3314089 - RNA, 17 nt, Mycobacterium tuberculosis H37Rv
gucgacgacaacgaugu

SEQ ID NO: 3314090 - RNA, 17 nt, Mycobacterium tuberculosis H37Rv
gucgacgacgucgcgca

SEQ ID NO: 3314091 - RNA, 13 nt, Mycobacterium tuberculosis H37Rv
gucgacgagaucc

SEQ ID NO: 3314092 - RNA, 17 nt, Mycobacterium tuberculosis H37Rv
gucgacgagcaccgcgc

SEQ ID NO: 3314093 - RNA, 14 nt, Mycobacterium tuberculosis H37Rv
gucgacgagcgccu

SEQ ID NO: 3314094 - RNA, 15 nt, Mycobacterium tuberculosis H37Rv
gucgacgaucagcga

SEQ ID NO: 3314095 - RNA, 20 nt, Mycobacterium tuberculosis H37Rv
gucgacgcagugcccgaucg

SEQ ID NO: 3314096 - RNA, 20 nt, Mycobacterium tuberculosis H37Rv
gucgacgcccauggcgucga

SEQ ID NO: 3314097 - RNA, 19 nt, Mycobacterium tuberculosis H37Rv
gucgacgcccgauacgcca

SEQ ID NO: 3314098 - RNA, 13 nt, Mycobacterium tuberculosis H37Rv
gucgacgccgauc

SEQ ID NO: 3314099 - RNA, 18 nt, Mycobacterium tuberculosis H37Rv
gucgacgccgcagcgucc

SEQ ID NO: 3314100 - RNA, 21 nt, Mycobacterium tuberculosis H37Rv
gucgacggcgauggcgcgcaa

SEQ ID NO: 3314101 - RNA, 16 nt, Mycobacterium tuberculosis H37Rv
gucgacggcuccuccg

SEQ ID NO: 3314102 - RNA, 22 nt, Mycobacterium tuberculosis H37Rv
gucgacgggucggcgccgagca

SEQ ID NO: 3314103 - RNA, 20 nt, Mycobacterium tuberculosis H37Rv
gucgacggucuggcccgcga

SEQ ID NO: 3314104 - RNA, 21 nt, Mycobacterium tuberculosis H37Rv
gucgacgguuugcaccgcggc

SEQ ID NO: 3314105 - RNA, 15 nt, Mycobacterium tuberculosis H37Rv
gucgacgucgauggu

SEQ ID NO: 3314106 - RNA, 16 nt, Mycobacterium tuberculosis H37Rv
gucgacgucggcaauc

SEQ ID NO: 3314107 - RNA, 23 nt, Mycobacterium tuberculosis H37Rv
gucgacgucucuggugcagguga

SEQ ID NO: 3314108 - RNA, 23 nt, Mycobacterium tuberculosis H37Rv
gucgacuacacauucauccaccc

SEQ ID NO: 3314109 - RNA, 19 nt, Mycobacterium tuberculosis H37Rv
gucgacuccagcaccagca

SEQ ID NO: 3314110 - RNA, 21 nt, Mycobacterium tuberculosis H37Rv
gucgacuccagcaccagcacg

SEQ ID NO: 3314111 - RNA, 15 nt, Mycobacterium tuberculosis H37Rv
gucgacucggcggcg

SEQ ID NO: 3314112 - RNA, 18 nt, Mycobacterium tuberculosis H37Rv
gucgacuguugucuacuc

SEQ ID NO: 3314113 - RNA, 17 nt, Mycobacterium tuberculosis H37Rv
gucgacuucagcggccg

SEQ ID NO: 3314114 - RNA, 13 nt, Mycobacterium tuberculosis H37Rv
gucgacuugcagg

SEQ ID NO: 3314115 - RNA, 16 nt, Mycobacterium tuberculosis H37Rv
gucgagaaucggcauu

SEQ ID NO: 3314116 - RNA, 22 nt, Mycobacterium tuberculosis H37Rv
gucgagacgcuuuccgccgcac

SEQ ID NO: 3314117 - RNA, 17 nt, Mycobacterium tuberculosis H37Rv
gucgagagguucgccgu

SEQ ID NO: 3314118 - RNA, 18 nt, Mycobacterium tuberculosis H37Rv
gucgagagguucgccguc

SEQ ID NO: 3314119 - RNA, 17 nt, Mycobacterium tuberculosis H37Rv
gucgagauagccgacgu

SEQ ID NO: 3314120 - RNA, 22 nt, Mycobacterium tuberculosis H37Rv
gucgagauagccgacgucgccg

SEQ ID NO: 3314121 - RNA, 16 nt, Mycobacterium tuberculosis H37Rv
gucgagauccucgucg

SEQ ID NO: 3314122 - RNA, 21 nt, Mycobacterium tuberculosis H37Rv
gucgagauccucgucgagguc

SEQ ID NO: 3314123 - RNA, 23 nt, Mycobacterium tuberculosis H37Rv
gucgagauccucgucgagguccu

SEQ ID NO: 3314124 - RNA, 20 nt, Mycobacterium tuberculosis H37Rv
gucgagcaacgugacccgga

SEQ ID NO: 3314125 - RNA, 20 nt, Mycobacterium tuberculosis H37Rv
gucgagcacaccgaggucgc

SEQ ID NO: 3314126 - RNA, 19 nt, Mycobacterium tuberculosis H37Rv
gucgagcaccuuggggugg

SEQ ID NO: 3314127 - RNA, 21 nt, Mycobacterium tuberculosis H37Rv
gucgagcacgaugucgaugcc

SEQ ID NO: 3314128 - RNA, 19 nt, Mycobacterium tuberculosis H37Rv
gucgagcacguccucgacc

SEQ ID NO: 3314129 - RNA, 11 nt, Mycobacterium tuberculosis H37Rv
gucgagcagcc

SEQ ID NO: 3314130 - RNA, 13 nt, Mycobacterium tuberculosis H37Rv
gucgagcagccgc

SEQ ID NO: 3314131 - RNA, 14 nt, Mycobacterium tuberculosis H37Rv
gucgagcagcgcca

SEQ ID NO: 3314132 - RNA, 14 nt, Mycobacterium tuberculosis H37Rv
gucgagcaugcgau

SEQ ID NO: 3314133 - RNA, 20 nt, Mycobacterium tuberculosis H37Rv
gucgagccacccaccgacau

SEQ ID NO: 3314134 - RNA, 23 nt, Mycobacterium tuberculosis H37Rv
gucgagccgccagauugccugac

SEQ ID NO: 3314135 - RNA, 14 nt, Mycobacterium tuberculosis H37Rv
gucgagccggugcc

SEQ ID NO: 3314136 - RNA, 16 nt, Mycobacterium tuberculosis H37Rv
gucgagccggugccgc

SEQ ID NO: 3314137 - RNA, 19 nt, Mycobacterium tuberculosis H37Rv
gucgagcgaccccacacgc

SEQ ID NO: 3314138 - RNA, 15 nt, Mycobacterium tuberculosis H37Rv
gucgagcgcccacug

SEQ ID NO: 3314139 - RNA, 14 nt, Mycobacterium tuberculosis H37Rv
gucgagcgccgcgg

SEQ ID NO: 3314140 - RNA, 15 nt, Mycobacterium tuberculosis H37Rv
gucgagcgcgucggu

SEQ ID NO: 3314141 - RNA, 19 nt, Mycobacterium tuberculosis H37Rv
gucgagcguggcgacggga

SEQ ID NO: 3314142 - RNA, 21 nt, Mycobacterium tuberculosis H37Rv
gucgagcucccacaggaccga

SEQ ID NO: 3314143 - RNA, 21 nt, Mycobacterium tuberculosis H37Rv
gucgagggcuuuagugucugc

SEQ ID NO: 3314144 - RNA, 14 nt, Mycobacterium tuberculosis H37Rv
gucgaggucacgcg

SEQ ID NO: 3314145 - RNA, 16 nt, Mycobacterium tuberculosis H37Rv
gucgaggucagcuccc

SEQ ID NO: 3314146 - RNA, 17 nt, Mycobacterium tuberculosis H37Rv
gucgaggucagugggcg

SEQ ID NO: 3314147 - RNA, 13 nt, Mycobacterium tuberculosis H37Rv
gucgaggucccga

SEQ ID NO: 3314148 - RNA, 18 nt, Mycobacterium tuberculosis H37Rv
gucgagguccucgagguc

SEQ ID NO: 3314149 - RNA, 15 nt, Mycobacterium tuberculosis H37Rv
gucgagguggggugg

SEQ ID NO: 3314150 - RNA, 18 nt, Mycobacterium tuberculosis H37Rv
gucgaggugggguggugg

SEQ ID NO: 3314151 - RNA, 22 nt, Mycobacterium tuberculosis H37Rv
gucgaguagccguagccgccgu

SEQ ID NO: 3314152 - RNA, 14 nt, Mycobacterium tuberculosis H37Rv
gucgaguccaggcc

SEQ ID NO: 3314153 - RNA, 19 nt, Mycobacterium tuberculosis H37Rv
gucgaguccaggccggcag

SEQ ID NO: 3314154 - RNA, 14 nt, Mycobacterium tuberculosis H37Rv
gucgagucgccgag

SEQ ID NO: 3314155 - RNA, 18 nt, Mycobacterium tuberculosis H37Rv
gucgagucgccgaggacg

SEQ ID NO: 3314156 - RNA, 17 nt, Mycobacterium tuberculosis H37Rv
gucgagugccucgaccu

SEQ ID NO: 3314157 - RNA, 22 nt, Mycobacterium tuberculosis H37Rv
gucgagugcggacuucgccgcc

SEQ ID NO: 3314158 - RNA, 19 nt, Mycobacterium tuberculosis H37Rv
gucgaguguggcgacgcac

SEQ ID NO: 3314159 - RNA, 20 nt, Mycobacterium tuberculosis H37Rv
gucgaguucgcagucgauga

SEQ ID NO: 3314160 - RNA, 12 nt, Mycobacterium tuberculosis H37Rv
gucgccgcccgu

SEQ ID NO: 3314161 - RNA, 16 nt, Mycobacterium tuberculosis H37Rv
gucgccgccgcgggcg

SEQ ID NO: 3314162 - RNA, 16 nt, Mycobacterium tuberculosis H37Rv
gucgccgccggcgccg

SEQ ID NO: 3314163 - RNA, 13 nt, Mycobacterium tuberculosis H37Rv
gucgccgccguug

SEQ ID NO: 3314164 - RNA, 20 nt, Mycobacterium tuberculosis H37Rv
gucgccgccuuacgcaccga

SEQ ID NO: 3314165 - RNA, 14 nt, Mycobacterium tuberculosis H37Rv
gucgccgccuucuu

SEQ ID NO: 3314166 - RNA, 13 nt, Mycobacterium tuberculosis H37Rv
gucgccgcgcguu

SEQ ID NO: 3314167 - RNA, 21 nt, Mycobacterium tuberculosis H37Rv
gucgccgcgcguuccagcaca

SEQ ID NO: 3314168 - RNA, 14 nt, Mycobacterium tuberculosis H37Rv
gucgccgcggcagc

SEQ ID NO: 3314169 - RNA, 17 nt, Mycobacterium tuberculosis H37Rv
gucgccgcggcggcagc

SEQ ID NO: 3314170 - RNA, 16 nt, Mycobacterium tuberculosis H37Rv
gucgccgcgggcagcg

SEQ ID NO: 3314171 - RNA, 22 nt, Mycobacterium tuberculosis H37Rv
gucgccgcuuucuuggcgggcg

SEQ ID NO: 3314172 - RNA, 19 nt, Mycobacterium tuberculosis H37Rv
gucgccgcuuuggaggugc

SEQ ID NO: 3314173 - RNA, 15 nt, Mycobacterium tuberculosis H37Rv
gucgccggaccagag

SEQ ID NO: 3314174 - RNA, 18 nt, Mycobacterium tuberculosis H37Rv
gucgccggaccagagcca

SEQ ID NO: 3314175 - RNA, 18 nt, Mycobacterium tuberculosis H37Rv
gucgccggauagcgcagc

SEQ ID NO: 3314176 - RNA, 14 nt, Mycobacterium tuberculosis H37Rv
gucgccggaugcug

SEQ ID NO: 3314177 - RNA, 20 nt, Mycobacterium tuberculosis H37Rv
gucgccggaugcugucagca

SEQ ID NO: 3314178 - RNA, 15 nt, Mycobacterium tuberculosis H37Rv
gucgccggccggccc

SEQ ID NO: 3314179 - RNA, 13 nt, Mycobacterium tuberculosis H37Rv
gucgccggcggcg

SEQ ID NO: 3314180 - RNA, 15 nt, Mycobacterium tuberculosis H37Rv
gucgccggcggcggu

SEQ ID NO: 3314181 - RNA, 13 nt, Mycobacterium tuberculosis H37Rv
gucgccggcgucg

SEQ ID NO: 3314182 - RNA, 21 nt, Mycobacterium tuberculosis H37Rv
gucgccggcgucgagccggau

SEQ ID NO: 3314183 - RNA, 14 nt, Mycobacterium tuberculosis H37Rv
gucgccgggcggcg

SEQ ID NO: 3314184 - RNA, 20 nt, Mycobacterium tuberculosis H37Rv
gucgccggucaggccgccgc

SEQ ID NO: 3314185 - RNA, 16 nt, Mycobacterium tuberculosis H37Rv
gucgccggucaucgcc

SEQ ID NO: 3314186 - RNA, 13 nt, Mycobacterium tuberculosis H37Rv
gucgccggugacg

SEQ ID NO: 3314187 - RNA, 18 nt, Mycobacterium tuberculosis H37Rv
gucgccggugacgacguc

SEQ ID NO: 3314188 - RNA, 15 nt, Mycobacterium tuberculosis H37Rv
gucgccguacagcgc

SEQ ID NO: 3314189 - RNA, 19 nt, Mycobacterium tuberculosis H37Rv
gucgccgucgauguugccg

SEQ ID NO: 3314190 - RNA, 16 nt, Mycobacterium tuberculosis H37Rv
gucgccgucggugccg

SEQ ID NO: 3314191 - RNA, 19 nt, Mycobacterium tuberculosis H37Rv
gucgccgucggugccgccg

SEQ ID NO: 3314192 - RNA, 18 nt, Mycobacterium tuberculosis H37Rv
gucgccgugcuguuccag

SEQ ID NO: 3314193 - RNA, 21 nt, Mycobacterium tuberculosis H37Rv
gucgccgugcuguuccagcgu

SEQ ID NO: 3314194 - RNA, 23 nt, Mycobacterium tuberculosis H37Rv
gucgccugacgaaguccaccacg

SEQ ID NO: 3314195 - RNA, 22 nt, Mycobacterium tuberculosis H37Rv
gucgccugcccccgcgcgcacg

SEQ ID NO: 3314196 - RNA, 17 nt, Mycobacterium tuberculosis H37Rv
gucgccuucccagccga

SEQ ID NO: 3314197 - RNA, 19 nt, Mycobacterium tuberculosis H37Rv
gucgccuucguaaccacga

SEQ ID NO: 3314198 - RNA, 21 nt, Mycobacterium tuberculosis H37Rv
gucgccuuugagggcgacgac

SEQ ID NO: 3314199 - RNA, 18 nt, Mycobacterium tuberculosis H37Rv
gucgcgaaauagcugcgg

SEQ ID NO: 3314200 - RNA, 20 nt, Mycobacterium tuberculosis H37Rv
gucgcgacgacguagauggu

SEQ ID NO: 3314201 - RNA, 19 nt, Mycobacterium tuberculosis H37Rv
gucgcgagcccgccacagc

SEQ ID NO: 3314202 - RNA, 15 nt, Mycobacterium tuberculosis H37Rv
gucgcgaguagcuga

SEQ ID NO: 3314203 - RNA, 22 nt, Mycobacterium tuberculosis H37Rv
gucgcgaguagcugacccgcgg

SEQ ID NO: 3314204 - RNA, 16 nt, Mycobacterium tuberculosis H37Rv
gucgcgauagccgccg

SEQ ID NO: 3314205 - RNA, 21 nt, Mycobacterium tuberculosis H37Rv
gucgcgauccacuccggcgau

SEQ ID NO: 3314206 - RNA, 14 nt, Mycobacterium tuberculosis H37Rv
gucgcgaugacgau

SEQ ID NO: 3314207 - RNA, 22 nt, Mycobacterium tuberculosis H37Rv
gucgcgcaccggaucgccgucg

SEQ ID NO: 3314208 - RNA, 23 nt, Mycobacterium tuberculosis H37Rv
gucgcgcaucgccuccucgacgu

SEQ ID NO: 3314209 - RNA, 19 nt, Mycobacterium tuberculosis H37Rv
gucgcgcauuucguggcgc

SEQ ID NO: 3314210 - RNA, 17 nt, Mycobacterium tuberculosis H37Rv
gucgcgccaggcgcgau

SEQ ID NO: 3314211 - RNA, 21 nt, Mycobacterium tuberculosis H37Rv
gucgcgccaggcuugcggcac

SEQ ID NO: 3314212 - RNA, 13 nt, Mycobacterium tuberculosis H37Rv
gucgcgccugccc

SEQ ID NO: 3314213 - RNA, 21 nt, Mycobacterium tuberculosis H37Rv
gucgcgcgccuuggccagcgc

SEQ ID NO: 3314214 - RNA, 16 nt, Mycobacterium tuberculosis H37Rv
gucgcgcugcugucga

SEQ ID NO: 3314215 - RNA, 14 nt, Mycobacterium tuberculosis H37Rv
gucgcggacggugc

SEQ ID NO: 3314216 - RNA, 19 nt, Mycobacterium tuberculosis H37Rv
gucgcggacggugcgguca

SEQ ID NO: 3314217 - RNA, 20 nt, Mycobacterium tuberculosis H37Rv
gucgcggaguagccgcagcu

SEQ ID NO: 3314218 - RNA, 19 nt, Mycobacterium tuberculosis H37Rv
gucgcggaucagcccgcgc

SEQ ID NO: 3314219 - RNA, 22 nt, Mycobacterium tuberculosis H37Rv
gucgcggaucagcccgcgcagc

SEQ ID NO: 3314220 - RNA, 14 nt, Mycobacterium tuberculosis H37Rv
gucgcggcccgcga

SEQ ID NO: 3314221 - RNA, 22 nt, Mycobacterium tuberculosis H37Rv
gucgcggccgcggccucccgca

SEQ ID NO: 3314222 - RNA, 13 nt, Mycobacterium tuberculosis H37Rv
gucgcggcguucg

SEQ ID NO: 3314223 - RNA, 13 nt, Mycobacterium tuberculosis H37Rv
gucgcgggccaag

SEQ ID NO: 3314224 - RNA, 15 nt, Mycobacterium tuberculosis H37Rv
gucgcgggccaccgc

SEQ ID NO: 3314225 - RNA, 19 nt, Mycobacterium tuberculosis H37Rv
gucgcgggcgauggcgagc

SEQ ID NO: 3314226 - RNA, 18 nt, Mycobacterium tuberculosis H37Rv
gucgcggguccaggcguu

SEQ ID NO: 3314227 - RNA, 13 nt, Mycobacterium tuberculosis H37Rv
gucgcgggugccg

SEQ ID NO: 3314228 - RNA, 21 nt, Mycobacterium tuberculosis H37Rv
gucgcgguaggcguuggacgc

SEQ ID NO: 3314229 - RNA, 15 nt, Mycobacterium tuberculosis H37Rv
gucgcggucgcccgc

SEQ ID NO: 3314230 - RNA, 18 nt, Mycobacterium tuberculosis H37Rv
gucgcgguggcggcggug

SEQ ID NO: 3314231 - RNA, 21 nt, Mycobacterium tuberculosis H37Rv
gucgcguaccaacaggauggu

SEQ ID NO: 3314232 - RNA, 15 nt, Mycobacterium tuberculosis H37Rv
gucgcguucggccga

SEQ ID NO: 3314233 - RNA, 17 nt, Mycobacterium tuberculosis H37Rv
gucgcguuguggcugaa

SEQ ID NO: 3314234 - RNA, 15 nt, Mycobacterium tuberculosis H37Rv
gucgcuaaagccccc

SEQ ID NO: 3314235 - RNA, 18 nt, Mycobacterium tuberculosis H37Rv
gucgcucacggcccgagc

SEQ ID NO: 3314236 - RNA, 17 nt, Mycobacterium tuberculosis H37Rv
gucgcucgacgaccacg

SEQ ID NO: 3314237 - RNA, 19 nt, Mycobacterium tuberculosis H37Rv
gucgcugacgcccuccugg

SEQ ID NO: 3314238 - RNA, 17 nt, Mycobacterium tuberculosis H37Rv
gucgcugagcacggcgc

SEQ ID NO: 3314239 - RNA, 18 nt, Mycobacterium tuberculosis H37Rv
gucgcugagcagcgccgc

SEQ ID NO: 3314240 - RNA, 18 nt, Mycobacterium tuberculosis H37Rv
gucgcugaugagcucgua

SEQ ID NO: 3314241 - RNA, 14 nt, Mycobacterium tuberculosis H37Rv
gucgcugccgccgc

SEQ ID NO: 3314242 - RNA, 19 nt, Mycobacterium tuberculosis H37Rv
gucgcugccgccgccggcg

SEQ ID NO: 3314243 - RNA, 15 nt, Mycobacterium tuberculosis H37Rv
gucgcugcggcgcug

SEQ ID NO: 3314244 - RNA, 21 nt, Mycobacterium tuberculosis H37Rv
gucgcugcggcgcuggccagc

SEQ ID NO: 3314245 - RNA, 16 nt, Mycobacterium tuberculosis H37Rv
gucgcugcugccgcac

SEQ ID NO: 3314246 - RNA, 19 nt, Mycobacterium tuberculosis H37Rv
gucgcugcugccgcaccgg

SEQ ID NO: 3314247 - RNA, 21 nt, Mycobacterium tuberculosis H37Rv
gucgcugcugccgcaccggug

SEQ ID NO: 3314248 - RNA, 15 nt, Mycobacterium tuberculosis H37Rv
gucgcugggaggcgc

SEQ ID NO: 3314249 - RNA, 15 nt, Mycobacterium tuberculosis H37Rv
gucgcuguccacugc

SEQ ID NO: 3314250 - RNA, 15 nt, Mycobacterium tuberculosis H37Rv
gucgcuucagcgcca

SEQ ID NO: 3314251 - RNA, 17 nt, Mycobacterium tuberculosis H37Rv
gucgcuucugauuacgg

SEQ ID NO: 3314252 - RNA, 18 nt, Mycobacterium tuberculosis H37Rv
gucggaauacaacagcug

SEQ ID NO: 3314253 - RNA, 14 nt, Mycobacterium tuberculosis H37Rv
gucggaaugggcgc

SEQ ID NO: 3314254 - RNA, 17 nt, Mycobacterium tuberculosis H37Rv
gucggaaugggcgccac

SEQ ID NO: 3314255 - RNA, 14 nt, Mycobacterium tuberculosis H37Rv
gucggaccagcugc

SEQ ID NO: 3314256 - RNA, 15 nt, Mycobacterium tuberculosis H37Rv
gucggcugguccucc

SEQ ID NO: 3314257 - RNA, 22 nt, Mycobacterium tuberculosis H37Rv
gucggcugucgugccucucggg

SEQ ID NO: 3314258 - RNA, 16 nt, Mycobacterium tuberculosis H37Rv
gucggcuuccggugcc

SEQ ID NO: 3314259 - RNA, 19 nt, Mycobacterium tuberculosis H37Rv
gucggcuuccggugccggg

SEQ ID NO: 3314260 - RNA, 14 nt, Mycobacterium tuberculosis H37Rv
gucggcuuccuccu

SEQ ID NO: 3314261 - RNA, 16 nt, Mycobacterium tuberculosis H37Rv
gucgggaacgccgaac

SEQ ID NO: 3314262 - RNA, 17 nt, Mycobacterium tuberculosis H37Rv
gucgggacgccgccccc

SEQ ID NO: 3314263 - RNA, 18 nt, Mycobacterium tuberculosis H37Rv
gucgggacgcugccgguc

SEQ ID NO: 3314264 - RNA, 21 nt, Mycobacterium tuberculosis H37Rv
gucgggagagugguugcgccc

SEQ ID NO: 3314265 - RNA, 18 nt, Mycobacterium tuberculosis H37Rv
gucgggauccaugcgggu

SEQ ID NO: 3314266 - RNA, 17 nt, Mycobacterium tuberculosis H37Rv
gucgggcacaccgacgc

SEQ ID NO: 3314267 - RNA, 20 nt, Mycobacterium tuberculosis H37Rv
gucgggcacaccgacgccgc

SEQ ID NO: 3314268 - RNA, 21 nt, Mycobacterium tuberculosis H37Rv
gucgggcacaccgacgccgcc

SEQ ID NO: 3314269 - RNA, 14 nt, Mycobacterium tuberculosis H37Rv
gucgggcaccgcgc

SEQ ID NO: 3314270 - RNA, 20 nt, Mycobacterium tuberculosis H37Rv
gucgggcagauaugacggca

SEQ ID NO: 3314271 - RNA, 21 nt, Mycobacterium tuberculosis H37Rv
gucgggcagauucuucaccca

SEQ ID NO: 3314272 - RNA, 17 nt, Mycobacterium tuberculosis H37Rv
gucgggcaugcucuggc

SEQ ID NO: 3314273 - RNA, 13 nt, Mycobacterium tuberculosis H37Rv
gucgggccaggcg

SEQ ID NO: 3314274 - RNA, 22 nt, Mycobacterium tuberculosis H37Rv
gucgggcccacuugugacccgg

SEQ ID NO: 3314275 - RNA, 18 nt, Mycobacterium tuberculosis H37Rv
gucgggcccccggcagca

SEQ ID NO: 3314276 - RNA, 16 nt, Mycobacterium tuberculosis H37Rv
gucgggccgcaacugc

SEQ ID NO: 3314277 - RNA, 14 nt, Mycobacterium tuberculosis H37Rv
gucgggcggcgacc

SEQ ID NO: 3314278 - RNA, 18 nt, Mycobacterium tuberculosis H37Rv
gucgggcgugucgggaac

SEQ ID NO: 3314279 - RNA, 17 nt, Mycobacterium tuberculosis H37Rv
gucgggcuccgugguug

SEQ ID NO: 3314280 - RNA, 19 nt, Mycobacterium tuberculosis H37Rv
gucgggcuggguggccaac

SEQ ID NO: 3314281 - RNA, 23 nt, Mycobacterium tuberculosis H37Rv
gucgggcuugacccuugggcacc

SEQ ID NO: 3314282 - RNA, 16 nt, Mycobacterium tuberculosis H37Rv
gucggggaugccgaac

SEQ ID NO: 3314283 - RNA, 16 nt, Mycobacterium tuberculosis H37Rv
gucggggccgucgucg

SEQ ID NO: 3314284 - RNA, 20 nt, Mycobacterium tuberculosis H37Rv
gucggggccgucgucgguca

SEQ ID NO: 3314285 - RNA, 22 nt, Mycobacterium tuberculosis H37Rv
gucggggccgucgucggucacc

SEQ ID NO: 3314286 - RNA, 15 nt, Mycobacterium tuberculosis H37Rv
gucgggggucgcacc

SEQ ID NO: 3314287 - RNA, 16 nt, Mycobacterium tuberculosis H37Rv
gucgggguccgcggca

SEQ ID NO: 3314288 - RNA, 19 nt, Mycobacterium tuberculosis H37Rv
gucgggguccgcggcauga

SEQ ID NO: 3314289 - RNA, 24 nt, Mycobacterium tuberculosis H37Rv
gucggggucguugaggccggugaa

SEQ ID NO: 3314290 - RNA, 20 nt, Mycobacterium tuberculosis H37Rv
gucggggugggacaggucgg

SEQ ID NO: 3314291 - RNA, 22 nt, Mycobacterium tuberculosis H37Rv
gucgggguguucgaugggugca

SEQ ID NO: 3314292 - RNA, 20 nt, Mycobacterium tuberculosis H37Rv
gucgggguuucaggcggcag

SEQ ID NO: 3314293 - RNA, 22 nt, Mycobacterium tuberculosis H37Rv
gucggguaaauauugcgcccgg

SEQ ID NO: 3314294 - RNA, 18 nt, Mycobacterium tuberculosis H37Rv
gucggguaccacgcuggc

SEQ ID NO: 3314295 - RNA, 17 nt, Mycobacterium tuberculosis H37Rv
gucggguccaacgccgc

SEQ ID NO: 3314296 - RNA, 20 nt, Mycobacterium tuberculosis H37Rv
gucgggucccuuguggucug

SEQ ID NO: 3314297 - RNA, 13 nt, Mycobacterium tuberculosis H37Rv
gucgggucgcacc

SEQ ID NO: 3314298 - RNA, 12 nt, Mycobacterium tuberculosis H37Rv
gucgggugcuga

SEQ ID NO: 3314299 - RNA, 15 nt, Mycobacterium tuberculosis H37Rv
gucggguggcugcug

SEQ ID NO: 3314300 - RNA, 18 nt, Mycobacterium tuberculosis H37Rv
gucgggugugcaggccgc

SEQ ID NO: 3314301 - RNA, 14 nt, Mycobacterium tuberculosis H37Rv
gucggguuggccgg

SEQ ID NO: 3314302 - RNA, 18 nt, Mycobacterium tuberculosis H37Rv
gucggguugguuggcucg

SEQ ID NO: 3314303 - RNA, 16 nt, Mycobacterium tuberculosis H37Rv
gucgguaccccagcgc

SEQ ID NO: 3314304 - RNA, 18 nt, Mycobacterium tuberculosis H37Rv
gucggucaaugcgcgcug

SEQ ID NO: 3314305 - RNA, 14 nt, Mycobacterium tuberculosis H37Rv
gucggucaccaugg

SEQ ID NO: 3314306 - RNA, 15 nt, Mycobacterium tuberculosis H37Rv
gucggucaccauggc

SEQ ID NO: 3314307 - RNA, 18 nt, Mycobacterium tuberculosis H37Rv
gucggucaccauggcgcc

SEQ ID NO: 3314308 - RNA, 13 nt, Mycobacterium tuberculosis H37Rv
gucggucaccugg

SEQ ID NO: 3314309 - RNA, 23 nt, Mycobacterium tuberculosis H37Rv
gucggucggguggaucuucaccu

SEQ ID NO: 3314310 - RNA, 15 nt, Mycobacterium tuberculosis H37Rv
gucggucuggcuggu

SEQ ID NO: 3314311 - RNA, 20 nt, Mycobacterium tuberculosis H37Rv
gucggugaaaugacggcuga

SEQ ID NO: 3314312 - RNA, 21 nt, Mycobacterium tuberculosis H37Rv
gucggugaaauucgcggcggu

SEQ ID NO: 3314313 - RNA, 22 nt, Mycobacterium tuberculosis H37Rv
gucggugaccguucggcggucg

SEQ ID NO: 3314314 - RNA, 11 nt, Mycobacterium tuberculosis H37Rv
gucggugaccu

SEQ ID NO: 3314315 - RNA, 12 nt, Mycobacterium tuberculosis H37Rv
gucggugaccug

SEQ ID NO: 3314316 - RNA, 15 nt, Mycobacterium tuberculosis H37Rv
gucggugaccuguuu

SEQ ID NO: 3314317 - RNA, 18 nt, Mycobacterium tuberculosis H37Rv
gucggugaucacggucgg

SEQ ID NO: 3314318 - RNA, 23 nt, Mycobacterium tuberculosis H37Rv
gucggugauggucagcuggccgc

SEQ ID NO: 3314319 - RNA, 22 nt, Mycobacterium tuberculosis H37Rv
gucggugaugguuucggcggga

SEQ ID NO: 3314320 - RNA, 14 nt, Mycobacterium tuberculosis H37Rv
gucggugccgcgga

SEQ ID NO: 3314321 - RNA, 16 nt, Mycobacterium tuberculosis H37Rv
gucggugccgcggacg

SEQ ID NO: 3314322 - RNA, 15 nt, Mycobacterium tuberculosis H37Rv
gucggugcgccacga

SEQ ID NO: 3314323 - RNA, 12 nt, Mycobacterium tuberculosis H37Rv
gucggugcgcgc

SEQ ID NO: 3314324 - RNA, 14 nt, Mycobacterium tuberculosis H37Rv
gucggugcgcggca

SEQ ID NO: 3314325 - RNA, 19 nt, Mycobacterium tuberculosis H37Rv
gucgguggcagcgguggcc

SEQ ID NO: 3314326 - RNA, 15 nt, Mycobacterium tuberculosis H37Rv
gucgguggcggggaa

SEQ ID NO: 3314327 - RNA, 20 nt, Mycobacterium tuberculosis H37Rv
gucggugggcggcgagcgcg

SEQ ID NO: 3314328 - RNA, 22 nt, Mycobacterium tuberculosis H37Rv
gucggugggugccagccggucg

SEQ ID NO: 3314329 - RNA, 23 nt, Mycobacterium tuberculosis H37Rv
gucggugguuuucccgucgccgc

SEQ ID NO: 3314330 - RNA, 15 nt, Mycobacterium tuberculosis H37Rv
gucggugucggugac

SEQ ID NO: 3314331 - RNA, 22 nt, Mycobacterium tuberculosis H37Rv
gucggugugcaucgccggcacg

SEQ ID NO: 3314332 - RNA, 20 nt, Mycobacterium tuberculosis H37Rv
gucgguguucggugguccug

SEQ ID NO: 3314333 - RNA, 17 nt, Mycobacterium tuberculosis H37Rv
gucgguguuuggccgcc

SEQ ID NO: 3314334 - RNA, 22 nt, Mycobacterium tuberculosis H37Rv
gucgguguuuggccgccgaauc

SEQ ID NO: 3314335 - RNA, 21 nt, Mycobacterium tuberculosis H37Rv
gucgguucagccacgcagcac

SEQ ID NO: 3314336 - RNA, 22 nt, Mycobacterium tuberculosis H37Rv
gucgguucagccacgcagcacg

SEQ ID NO: 3314337 - RNA, 20 nt, Mycobacterium tuberculosis H37Rv
gucgguucggccggagccgc

SEQ ID NO: 3314338 - RNA, 22 nt, Mycobacterium tuberculosis H37Rv
gucguacccggcaacgggaucu

SEQ ID NO: 3314339 - RNA, 18 nt, Mycobacterium tuberculosis H37Rv
gucguaccgcucggcggc

SEQ ID NO: 3314340 - RNA, 20 nt, Mycobacterium tuberculosis H37Rv
gucguaccuaaggcucacca

SEQ ID NO: 3314341 - RNA, 21 nt, Mycobacterium tuberculosis H37Rv
gucguacucccaggccgccgc

SEQ ID NO: 3314342 - RNA, 15 nt, Mycobacterium tuberculosis H37Rv
gucguacucggcggc

SEQ ID NO: 3314343 - RNA, 18 nt, Mycobacterium tuberculosis H37Rv
gucguacucggcggccac

SEQ ID NO: 3314344 - RNA, 15 nt, Mycobacterium tuberculosis H37Rv
gucguagacagucug

SEQ ID NO: 3314345 - RNA, 19 nt, Mycobacterium tuberculosis H37Rv
gucguagacagucugcgac

SEQ ID NO: 3314346 - RNA, 14 nt, Mycobacterium tuberculosis H37Rv
gucguagagauacg

SEQ ID NO: 3314347 - RNA, 21 nt, Mycobacterium tuberculosis H37Rv
gucguagaggacugcggucug

SEQ ID NO: 3314348 - RNA, 23 nt, Mycobacterium tuberculosis H37Rv
gucguagccacgcaugggccagg

SEQ ID NO: 3314349 - RNA, 23 nt, Mycobacterium tuberculosis H37Rv
gucguagccgaacccgccgucac

SEQ ID NO: 3314350 - RNA, 17 nt, Mycobacterium tuberculosis H37Rv
gucguagcgacgccauc

SEQ ID NO: 3314351 - RNA, 16 nt, Mycobacterium tuberculosis H37Rv
gucugccaggcgcagc

SEQ ID NO: 3314352 - RNA, 21 nt, Mycobacterium tuberculosis H37Rv
gucugcccaguguccggcgac

SEQ ID NO: 3314353 - RNA, 15 nt, Mycobacterium tuberculosis H37Rv
gucugcccgaggucc

SEQ ID NO: 3314354 - RNA, 15 nt, Mycobacterium tuberculosis H37Rv
gucugcgacuggauc

SEQ ID NO: 3314355 - RNA, 14 nt, Mycobacterium tuberculosis H37Rv
gucugcgccgccgg

SEQ ID NO: 3314356 - RNA, 16 nt, Mycobacterium tuberculosis H37Rv
gucugcgcggugcccg

SEQ ID NO: 3314357 - RNA, 16 nt, Mycobacterium tuberculosis H37Rv
gucugcggggugagug

SEQ ID NO: 3314358 - RNA, 13 nt, Mycobacterium tuberculosis H37Rv
gucugcucaccag

SEQ ID NO: 3314359 - RNA, 13 nt, Mycobacterium tuberculosis H37Rv
gucugcucgccag

SEQ ID NO: 3314360 - RNA, 15 nt, Mycobacterium tuberculosis H37Rv
gucugcucgccaggc

SEQ ID NO: 3314361 - RNA, 16 nt, Mycobacterium tuberculosis H37Rv
gucugcucgccaggca

SEQ ID NO: 3314362 - RNA, 16 nt, Mycobacterium tuberculosis H37Rv
gucugcucgccaggcc

SEQ ID NO: 3314363 - RNA, 13 nt, Mycobacterium tuberculosis H37Rv
gucugcucgccgu

SEQ ID NO: 3314364 - RNA, 17 nt, Mycobacterium tuberculosis H37Rv
gucugcucgcgcagccg

SEQ ID NO: 3314365 - RNA, 16 nt, Mycobacterium tuberculosis H37Rv
gucugcucgcgcccgc

SEQ ID NO: 3314366 - RNA, 23 nt, Mycobacterium tuberculosis H37Rv
gucugcucgcgccggugaggcga

SEQ ID NO: 3314367 - RNA, 19 nt, Mycobacterium tuberculosis H37Rv
gucugcucggcgcgguggg

SEQ ID NO: 3314368 - RNA, 20 nt, Mycobacterium tuberculosis H37Rv
gucugcucggcggagaaaag

SEQ ID NO: 3314369 - RNA, 16 nt, Mycobacterium tuberculosis H37Rv
gucuggacugcagccc

SEQ ID NO: 3314370 - RNA, 15 nt, Mycobacterium tuberculosis H37Rv
gucuggcaggccagc

SEQ ID NO: 3314371 - RNA, 17 nt, Mycobacterium tuberculosis H37Rv
gucuggcgaacagugac

SEQ ID NO: 3314372 - RNA, 15 nt, Mycobacterium tuberculosis H37Rv
gucuggcgaugacga

SEQ ID NO: 3314373 - RNA, 15 nt, Mycobacterium tuberculosis H37Rv
gucuggcgguaucga

SEQ ID NO: 3314374 - RNA, 18 nt, Mycobacterium tuberculosis H37Rv
gucugggugagcaccugg

SEQ ID NO: 3314375 - RNA, 14 nt, Mycobacterium tuberculosis H37Rv
gucugggugcaggu

SEQ ID NO: 3314376 - RNA, 14 nt, Mycobacterium tuberculosis H37Rv
gucuggguggacag

SEQ ID NO: 3314377 - RNA, 21 nt, Mycobacterium tuberculosis H37Rv
gucugguauuuguccggcgga

SEQ ID NO: 3314378 - RNA, 23 nt, Mycobacterium tuberculosis H37Rv
gucuggucggcuacggccagugc

SEQ ID NO: 3314379 - RNA, 20 nt, Mycobacterium tuberculosis H37Rv
gucugguugggccagcuccu

SEQ ID NO: 3314380 - RNA, 21 nt, Mycobacterium tuberculosis H37Rv
gucuguacaacgacacgccgc

SEQ ID NO: 3314381 - RNA, 22 nt, Mycobacterium tuberculosis H37Rv
gucugugcucacggcggcgaac

SEQ ID NO: 3314382 - RNA, 15 nt, Mycobacterium tuberculosis H37Rv
gucuguuggugacag

SEQ ID NO: 3314383 - RNA, 16 nt, Mycobacterium tuberculosis H37Rv
gucuuaucggcgucgu

SEQ ID NO: 3314384 - RNA, 16 nt, Mycobacterium tuberculosis H37Rv
gucuuccagccaggcc

SEQ ID NO: 3314385 - RNA, 19 nt, Mycobacterium tuberculosis H37Rv
gucuuccucggccacccgc

SEQ ID NO: 3314386 - RNA, 21 nt, Mycobacterium tuberculosis H37Rv
gucuuccucggccacccgcag

SEQ ID NO: 3314387 - RNA, 21 nt, Mycobacterium tuberculosis H37Rv
gucuucgauaccgaccgaaag

SEQ ID NO: 3314388 - RNA, 19 nt, Mycobacterium tuberculosis H37Rv
gucuucgggcucguccagc

SEQ ID NO: 3314389 - RNA, 21 nt, Mycobacterium tuberculosis H37Rv
gucuucgguuaaggugcgauc

SEQ ID NO: 3314390 - RNA, 19 nt, Mycobacterium tuberculosis H37Rv
gucuucgucauggccggcc

SEQ ID NO: 3314391 - RNA, 19 nt, Mycobacterium tuberculosis H37Rv
gucuucgucggagucuucg

SEQ ID NO: 3314392 - RNA, 18 nt, Mycobacterium tuberculosis H37Rv
gucuugcaguaacuucac

SEQ ID NO: 3314393 - RNA, 14 nt, Mycobacterium tuberculosis H37Rv
gucuugccggccag

SEQ ID NO: 3314394 - RNA, 21 nt, Mycobacterium tuberculosis H37Rv
gucuugcguccauccgcagca

SEQ ID NO: 3314395 - RNA, 17 nt, Mycobacterium tuberculosis H37Rv
gucuuggaacacggccg

SEQ ID NO: 3314396 - RNA, 14 nt, Mycobacterium tuberculosis H37Rv
gucuuggcccggcg

SEQ ID NO: 3314397 - RNA, 18 nt, Mycobacterium tuberculosis H37Rv
gucuuggcggcggugcag

SEQ ID NO: 3314398 - RNA, 16 nt, Mycobacterium tuberculosis H37Rv
gucuugguuguggagg

SEQ ID NO: 3314399 - RNA, 15 nt, Mycobacterium tuberculosis H37Rv
gucuugugcugcaag

SEQ ID NO: 3314400 - RNA, 12 nt, Mycobacterium tuberculosis H37Rv
gucuuguggugg

SEQ ID NO: 3314401 - RNA, 23 nt, Mycobacterium tuberculosis H37Rv
gucuuugguacccagcgcggcca

SEQ ID NO: 3314402 - RNA, 22 nt, Mycobacterium tuberculosis H37Rv
gucuuugguuguuggugccagc

SEQ ID NO: 3314403 - RNA, 14 nt, Mycobacterium tuberculosis H37Rv
gugaaaaucgccau

SEQ ID NO: 3314404 - RNA, 15 nt, Mycobacterium tuberculosis H37Rv
gugaaaccggccuuc

SEQ ID NO: 3314405 - RNA, 18 nt, Mycobacterium tuberculosis H37Rv
gugaaaugcgcgaucguc

SEQ ID NO: 3314406 - RNA, 17 nt, Mycobacterium tuberculosis H37Rv
gugaaauucgcggcggu

SEQ ID NO: 3314407 - RNA, 19 nt, Mycobacterium tuberculosis H37Rv
gugaacaaaugccggugca

SEQ ID NO: 3314408 - RNA, 22 nt, Mycobacterium tuberculosis H37Rv
gugaacagcagguuggcgagcu

SEQ ID NO: 3314409 - RNA, 21 nt, Mycobacterium tuberculosis H37Rv
gugaacaggccgaggcgaguu

SEQ ID NO: 3314410 - RNA, 22 nt, Mycobacterium tuberculosis H37Rv
gugaaccaacgcgaccgcaucu

SEQ ID NO: 3314411 - RNA, 16 nt, Mycobacterium tuberculosis H37Rv
gugaaccacucgguga

SEQ ID NO: 3314412 - RNA, 12 nt, Mycobacterium tuberculosis H37Rv
gugaaccgcgcg

SEQ ID NO: 3314413 - RNA, 17 nt, Mycobacterium tuberculosis H37Rv
gugaaccgggcaccacu

SEQ ID NO: 3314414 - RNA, 23 nt, Mycobacterium tuberculosis H37Rv
gugaaccuuacgacgccguaucg

SEQ ID NO: 3314415 - RNA, 23 nt, Mycobacterium tuberculosis H37Rv
gugaacgaagggaaggacgcgca

SEQ ID NO: 3314416 - RNA, 19 nt, Mycobacterium tuberculosis H37Rv
gugaacgagaugccgcgau

SEQ ID NO: 3314417 - RNA, 16 nt, Mycobacterium tuberculosis H37Rv
gugaacgccgccccga

SEQ ID NO: 3314418 - RNA, 14 nt, Mycobacterium tuberculosis H37Rv
gugaacggcaaggu

SEQ ID NO: 3314419 - RNA, 15 nt, Mycobacterium tuberculosis H37Rv
gugaacggcagcacg

SEQ ID NO: 3314420 - RNA, 14 nt, Mycobacterium tuberculosis H37Rv
gugaacggcucggg

SEQ ID NO: 3314421 - RNA, 18 nt, Mycobacterium tuberculosis H37Rv
gugaacguuuccagcuga

SEQ ID NO: 3314422 - RNA, 18 nt, Mycobacterium tuberculosis H37Rv
gugaacucgugacagcgg

SEQ ID NO: 3314423 - RNA, 18 nt, Mycobacterium tuberculosis H37Rv
gugaacuucuccaccagc

SEQ ID NO: 3314424 - RNA, 23 nt, Mycobacterium tuberculosis H37Rv
gugaagaaguucggguagccggg

SEQ ID NO: 3314425 - RNA, 16 nt, Mycobacterium tuberculosis H37Rv
gugaagccgagcgccc

SEQ ID NO: 3314426 - RNA, 22 nt, Mycobacterium tuberculosis H37Rv
gugaaggcaaacaccagcccgg

SEQ ID NO: 3314427 - RNA, 23 nt, Mycobacterium tuberculosis H37Rv
gugaaggucaccgucgagucgac

SEQ ID NO: 3314428 - RNA, 16 nt, Mycobacterium tuberculosis H37Rv
gugaaguugccgguca

SEQ ID NO: 3314429 - RNA, 19 nt, Mycobacterium tuberculosis H37Rv
gugaaguugccggucaggc

SEQ ID NO: 3314430 - RNA, 19 nt, Mycobacterium tuberculosis H37Rv
gugaaguuguuggccagac

SEQ ID NO: 3314431 - RNA, 16 nt, Mycobacterium tuberculosis H37Rv
gugaauccgugcaggg

SEQ ID NO: 3314432 - RNA, 13 nt, Mycobacterium tuberculosis H37Rv
gugaaucgcacga

SEQ ID NO: 3314433 - RNA, 18 nt, Mycobacterium tuberculosis H37Rv
gugaaucgcggaugccag

SEQ ID NO: 3314434 - RNA, 20 nt, Mycobacterium tuberculosis H37Rv
gugaaucugacgacgcgaca

SEQ ID NO: 3314435 - RNA, 12 nt, Mycobacterium tuberculosis H37Rv
gugaaugccguc

SEQ ID NO: 3314436 - RNA, 16 nt, Mycobacterium tuberculosis H37Rv
gugacaaauggggugu

SEQ ID NO: 3314437 - RNA, 23 nt, Mycobacterium tuberculosis H37Rv
gugacaaccguuguaccccagca

SEQ ID NO: 3314438 - RNA, 20 nt, Mycobacterium tuberculosis H37Rv
gugacaacugcgccggugcc

SEQ ID NO: 3314439 - RNA, 19 nt, Mycobacterium tuberculosis H37Rv
gugacagcccgcuggccgu

SEQ ID NO: 3314440 - RNA, 16 nt, Mycobacterium tuberculosis H37Rv
gugacauagacguugc

SEQ ID NO: 3314441 - RNA, 13 nt, Mycobacterium tuberculosis H37Rv
gugacauucugca

SEQ ID NO: 3314442 - RNA, 22 nt, Mycobacterium tuberculosis H37Rv
gugaccaacaccccccccaccc

SEQ ID NO: 3314443 - RNA, 14 nt, Mycobacterium tuberculosis H37Rv
gugaccaacggugc

SEQ ID NO: 3314444 - RNA, 19 nt, Mycobacterium tuberculosis H37Rv
gugaccacgcugcugguga

SEQ ID NO: 3314445 - RNA, 13 nt, Mycobacterium tuberculosis H37Rv
gugaccaggugcc

SEQ ID NO: 3314446 - RNA, 17 nt, Mycobacterium tuberculosis H37Rv
gugacccacucggggac

SEQ ID NO: 3314447 - RNA, 13 nt, Mycobacterium tuberculosis H37Rv
gugaugccgccgu

SEQ ID NO: 3314448 - RNA, 15 nt, Mycobacterium tuberculosis H37Rv
gugaugcggucgcgg

SEQ ID NO: 3314449 - RNA, 18 nt, Mycobacterium tuberculosis H37Rv
gugaugcguucggccggg

SEQ ID NO: 3314450 - RNA, 17 nt, Mycobacterium tuberculosis H37Rv
gugauggccgaccagcc

SEQ ID NO: 3314451 - RNA, 15 nt, Mycobacterium tuberculosis H37Rv
gugaugggccaggcg

SEQ ID NO: 3314452 - RNA, 14 nt, Mycobacterium tuberculosis H37Rv
gugaugggggagcc

SEQ ID NO: 3314453 - RNA, 22 nt, Mycobacterium tuberculosis H37Rv
gugauggugacuucgguggcgg

SEQ ID NO: 3314454 - RNA, 17 nt, Mycobacterium tuberculosis H37Rv
gugauggugugcagcag

SEQ ID NO: 3314455 - RNA, 17 nt, Mycobacterium tuberculosis H37Rv
gugauguagggcugcuc

SEQ ID NO: 3314456 - RNA, 19 nt, Mycobacterium tuberculosis H37Rv
gugauguagggcugcuccu

SEQ ID NO: 3314457 - RNA, 14 nt, Mycobacterium tuberculosis H37Rv
gugaugucggugcg

SEQ ID NO: 3314458 - RNA, 22 nt, Mycobacterium tuberculosis H37Rv
gugauguucagcgccacgucca

SEQ ID NO: 3314459 - RNA, 19 nt, Mycobacterium tuberculosis H37Rv
gugauuccgggucggcgaa

SEQ ID NO: 3314460 - RNA, 15 nt, Mycobacterium tuberculosis H37Rv
gugauucggccugag

SEQ ID NO: 3314461 - RNA, 23 nt, Mycobacterium tuberculosis H37Rv
gugauugcggccgccgagucaaa

SEQ ID NO: 3314462 - RNA, 13 nt, Mycobacterium tuberculosis H37Rv
gugauugucggcg

SEQ ID NO: 3314463 - RNA, 22 nt, Mycobacterium tuberculosis H37Rv
gugcaaccauggcggcuccgcc

SEQ ID NO: 3314464 - RNA, 22 nt, Mycobacterium tuberculosis H37Rv
gugcaaccccaaguccagcagc

SEQ ID NO: 3314465 - RNA, 16 nt, Mycobacterium tuberculosis H37Rv
gugcaagaccguuaca

SEQ ID NO: 3314466 - RNA, 22 nt, Mycobacterium tuberculosis H37Rv
gugcaagaccguuacaccauca

SEQ ID NO: 3314467 - RNA, 14 nt, Mycobacterium tuberculosis H37Rv
gugcacaacgccca

SEQ ID NO: 3314468 - RNA, 21 nt, Mycobacterium tuberculosis H37Rv
gugcacacaauucgggcguga

SEQ ID NO: 3314469 - RNA, 19 nt, Mycobacterium tuberculosis H37Rv
gugcacaccgucgcaccca

SEQ ID NO: 3314470 - RNA, 14 nt, Mycobacterium tuberculosis H37Rv
gugcaccaucauca

SEQ ID NO: 3314471 - RNA, 20 nt, Mycobacterium tuberculosis H37Rv
gugcaccaucaucaccucuc

SEQ ID NO: 3314472 - RNA, 20 nt, Mycobacterium tuberculosis H37Rv
gugcacccgggccgccucga

SEQ ID NO: 3314473 - RNA, 19 nt, Mycobacterium tuberculosis H37Rv
gugcaccgaagauggccag

SEQ ID NO: 3314474 - RNA, 21 nt, Mycobacterium tuberculosis H37Rv
gugcaccgaagauggccagcg

SEQ ID NO: 3314475 - RNA, 18 nt, Mycobacterium tuberculosis H37Rv
gugcaccgaagcggucgc

SEQ ID NO: 3314476 - RNA, 20 nt, Mycobacterium tuberculosis H37Rv
gugcaccgcgucguagccac

SEQ ID NO: 3314477 - RNA, 19 nt, Mycobacterium tuberculosis H37Rv
gugcaccuggaucagggcu

SEQ ID NO: 3314478 - RNA, 21 nt, Mycobacterium tuberculosis H37Rv
gugcacgaaguccuggcagac

SEQ ID NO: 3314479 - RNA, 21 nt, Mycobacterium tuberculosis H37Rv
gugcacgacgacaucgagcca

SEQ ID NO: 3314480 - RNA, 14 nt, Mycobacterium tuberculosis H37Rv
gugcacgagcggac

SEQ ID NO: 3314481 - RNA, 16 nt, Mycobacterium tuberculosis H37Rv
gugcacgaucgcggug

SEQ ID NO: 3314482 - RNA, 15 nt, Mycobacterium tuberculosis H37Rv
gugcacgcugagccg

SEQ ID NO: 3314483 - RNA, 20 nt, Mycobacterium tuberculosis H37Rv
gugcacggcgaggccgaacu

SEQ ID NO: 3314484 - RNA, 20 nt, Mycobacterium tuberculosis H37Rv
gugcacggcgaggugcucgg

SEQ ID NO: 3314485 - RNA, 21 nt, Mycobacterium tuberculosis H37Rv
gugcacucgguaaccgcgcgu

SEQ ID NO: 3314486 - RNA, 22 nt, Mycobacterium tuberculosis H37Rv
gugcagaauucggcgcgacagc

SEQ ID NO: 3314487 - RNA, 22 nt, Mycobacterium tuberculosis H37Rv
gugcagacaggcggcggccugg

SEQ ID NO: 3314488 - RNA, 19 nt, Mycobacterium tuberculosis H37Rv
gugcagaccaccgccugga

SEQ ID NO: 3314489 - RNA, 19 nt, Mycobacterium tuberculosis H37Rv
gugcagaucggcucaccga

SEQ ID NO: 3314490 - RNA, 20 nt, Mycobacterium tuberculosis H37Rv
gugcagcaccagccaaauca

SEQ ID NO: 3314491 - RNA, 16 nt, Mycobacterium tuberculosis H37Rv
gugcagcaccagccac

SEQ ID NO: 3314492 - RNA, 14 nt, Mycobacterium tuberculosis H37Rv
gugcagcacggcgc

SEQ ID NO: 3314493 - RNA, 21 nt, Mycobacterium tuberculosis H37Rv
gugcagcacguccgcggagcu

SEQ ID NO: 3314494 - RNA, 19 nt, Mycobacterium tuberculosis H37Rv
gugcagcccaaggcgacga

SEQ ID NO: 3314495 - RNA, 14 nt, Mycobacterium tuberculosis H37Rv
gugcagcccgccgg

SEQ ID NO: 3314496 - RNA, 21 nt, Mycobacterium tuberculosis H37Rv
gugcagcgacuccguaccggg

SEQ ID NO: 3314497 - RNA, 17 nt, Mycobacterium tuberculosis H37Rv
gugcagcgugcagcggc

SEQ ID NO: 3314498 - RNA, 16 nt, Mycobacterium tuberculosis H37Rv
gugcagcgugggcagc

SEQ ID NO: 3314499 - RNA, 21 nt, Mycobacterium tuberculosis H37Rv
gugcagcuccgggugcagauc

SEQ ID NO: 3314500 - RNA, 20 nt, Mycobacterium tuberculosis H37Rv
gugcagcugcaaugacugga

SEQ ID NO: 3314501 - RNA, 21 nt, Mycobacterium tuberculosis H37Rv
gugcagcugcaaugacuggac

SEQ ID NO: 3314502 - RNA, 14 nt, Mycobacterium tuberculosis H37Rv
gugcaggaccagaa

SEQ ID NO: 3314503 - RNA, 13 nt, Mycobacterium tuberculosis H37Rv
gugcaggaccagc

SEQ ID NO: 3314504 - RNA, 14 nt, Mycobacterium tuberculosis H37Rv
gugcaggaucggcu

SEQ ID NO: 3314505 - RNA, 15 nt, Mycobacterium tuberculosis H37Rv
gugcaggcgacggcu

SEQ ID NO: 3314506 - RNA, 19 nt, Mycobacterium tuberculosis H37Rv
gugcagggcauugcggccc

SEQ ID NO: 3314507 - RNA, 20 nt, Mycobacterium tuberculosis H37Rv
gugcagggcauugcggcccg

SEQ ID NO: 3314508 - RNA, 18 nt, Mycobacterium tuberculosis H37Rv
gugcagggugagcacgua

SEQ ID NO: 3314509 - RNA, 15 nt, Mycobacterium tuberculosis H37Rv
gugcaggucguccau

SEQ ID NO: 3314510 - RNA, 17 nt, Mycobacterium tuberculosis H37Rv
gugcaggucguccaucg

SEQ ID NO: 3314511 - RNA, 20 nt, Mycobacterium tuberculosis H37Rv
gugcaggugcccggccaaaa

SEQ ID NO: 3314512 - RNA, 13 nt, Mycobacterium tuberculosis H37Rv
gugcaggugcggg

SEQ ID NO: 3314513 - RNA, 18 nt, Mycobacterium tuberculosis H37Rv
gugcagguuggccugcuu

SEQ ID NO: 3314514 - RNA, 21 nt, Mycobacterium tuberculosis H37Rv
gugcauaccgcaauggcggcc

SEQ ID NO: 3314515 - RNA, 21 nt, Mycobacterium tuberculosis H37Rv
gugcauagcaauccgcacagc

SEQ ID NO: 3314516 - RNA, 15 nt, Mycobacterium tuberculosis H37Rv
gugcauaggccgcgu

SEQ ID NO: 3314517 - RNA, 18 nt, Mycobacterium tuberculosis H37Rv
gugcaucgacucacggau

SEQ ID NO: 3314518 - RNA, 16 nt, Mycobacterium tuberculosis H37Rv
gugcaucgaucaccgc

SEQ ID NO: 3314519 - RNA, 19 nt, Mycobacterium tuberculosis H37Rv
gugcauugucauaggagcu

SEQ ID NO: 3314520 - RNA, 12 nt, Mycobacterium tuberculosis H37Rv
gugccaaccgcg

SEQ ID NO: 3314521 - RNA, 12 nt, Mycobacterium tuberculosis H37Rv
gugccaacgggc

SEQ ID NO: 3314522 - RNA, 17 nt, Mycobacterium tuberculosis H37Rv
gugccaacugcgccguu

SEQ ID NO: 3314523 - RNA, 18 nt, Mycobacterium tuberculosis H37Rv
gugccaacugcgccguuc

SEQ ID NO: 3314524 - RNA, 17 nt, Mycobacterium tuberculosis H37Rv
gugccaauuccagcccc

SEQ ID NO: 3314525 - RNA, 19 nt, Mycobacterium tuberculosis H37Rv
gugccacagcucgccguga

SEQ ID NO: 3314526 - RNA, 13 nt, Mycobacterium tuberculosis H37Rv
gugccaccacgcu

SEQ ID NO: 3314527 - RNA, 15 nt, Mycobacterium tuberculosis H37Rv
gugccaccggcuggu

SEQ ID NO: 3314528 - RNA, 20 nt, Mycobacterium tuberculosis H37Rv
gugccaccugacuaccguca

SEQ ID NO: 3314529 - RNA, 17 nt, Mycobacterium tuberculosis H37Rv
gugccaccugggcgggc

SEQ ID NO: 3314530 - RNA, 18 nt, Mycobacterium tuberculosis H37Rv
gugccaccugggcgggcu

SEQ ID NO: 3314531 - RNA, 15 nt, Mycobacterium tuberculosis H37Rv
gugccacgccugagc

SEQ ID NO: 3314532 - RNA, 13 nt, Mycobacterium tuberculosis H37Rv
gugccacguucgc

SEQ ID NO: 3314533 - RNA, 18 nt, Mycobacterium tuberculosis H37Rv
gugccacuuccacggcgu

SEQ ID NO: 3314534 - RNA, 16 nt, Mycobacterium tuberculosis H37Rv
gugccacuucuucacu

SEQ ID NO: 3314535 - RNA, 20 nt, Mycobacterium tuberculosis H37Rv
gugccacuucuucacuggcg

SEQ ID NO: 3314536 - RNA, 15 nt, Mycobacterium tuberculosis H37Rv
gugccagcacuccac

SEQ ID NO: 3314537 - RNA, 21 nt, Mycobacterium tuberculosis H37Rv
gugccagcagcagcgccgcgu

SEQ ID NO: 3314538 - RNA, 11 nt, Mycobacterium tuberculosis H37Rv
gugccagcagg

SEQ ID NO: 3314539 - RNA, 20 nt, Mycobacterium tuberculosis H37Rv
gugccagcaggccgaagaaa

SEQ ID NO: 3314540 - RNA, 19 nt, Mycobacterium tuberculosis H37Rv
gugccagcccguugcagga

SEQ ID NO: 3314541 - RNA, 14 nt, Mycobacterium tuberculosis H37Rv
gugccagccggucg

SEQ ID NO: 3314542 - RNA, 21 nt, Mycobacterium tuberculosis H37Rv
gugccagcguggugaagucgg

SEQ ID NO: 3314543 - RNA, 19 nt, Mycobacterium tuberculosis H37Rv
gugccgggguggcgcgcca

SEQ ID NO: 3314544 - RNA, 12 nt, Mycobacterium tuberculosis H37Rv
gugccggucacc

SEQ ID NO: 3314545 - RNA, 20 nt, Mycobacterium tuberculosis H37Rv
gugccggucaccucgccggc

SEQ ID NO: 3314546 - RNA, 15 nt, Mycobacterium tuberculosis H37Rv
gugccggucgaugac

SEQ ID NO: 3314547 - RNA, 17 nt, Mycobacterium tuberculosis H37Rv
gugccggugcuccucgg

SEQ ID NO: 3314548 - RNA, 17 nt, Mycobacterium tuberculosis H37Rv
gugccguccccggccga

SEQ ID NO: 3314549 - RNA, 18 nt, Mycobacterium tuberculosis H37Rv
gugccgucggcgugcagc

SEQ ID NO: 3314550 - RNA, 13 nt, Mycobacterium tuberculosis H37Rv
gugccgucggugc

SEQ ID NO: 3314551 - RNA, 18 nt, Mycobacterium tuberculosis H37Rv
gugccgugaucgcuggcg

SEQ ID NO: 3314552 - RNA, 13 nt, Mycobacterium tuberculosis H37Rv
gugccguggugaa

SEQ ID NO: 3314553 - RNA, 13 nt, Mycobacterium tuberculosis H37Rv
gugccguggugga

SEQ ID NO: 3314554 - RNA, 14 nt, Mycobacterium tuberculosis H37Rv
gugccguguccagc

SEQ ID NO: 3314555 - RNA, 23 nt, Mycobacterium tuberculosis H37Rv
gugccgugugcuucgagcaccga

SEQ ID NO: 3314556 - RNA, 22 nt, Mycobacterium tuberculosis H37Rv
gugccguugcgucugcucggcg

SEQ ID NO: 3314557 - RNA, 14 nt, Mycobacterium tuberculosis H37Rv
gugccguuggagcc

SEQ ID NO: 3314558 - RNA, 15 nt, Mycobacterium tuberculosis H37Rv
gugccuacaccggca

SEQ ID NO: 3314559 - RNA, 19 nt, Mycobacterium tuberculosis H37Rv
gugccuacaccggcaagcc

SEQ ID NO: 3314560 - RNA, 17 nt, Mycobacterium tuberculosis H37Rv
gugccucgaggacggcg

SEQ ID NO: 3314561 - RNA, 19 nt, Mycobacterium tuberculosis H37Rv
gugccucgauuguggccag

SEQ ID NO: 3314562 - RNA, 20 nt, Mycobacterium tuberculosis H37Rv
gugccucgauuguggccagc

SEQ ID NO: 3314563 - RNA, 23 nt, Mycobacterium tuberculosis H37Rv
gugccucgauuguggccagcgcu

SEQ ID NO: 3314564 - RNA, 22 nt, Mycobacterium tuberculosis H37Rv
gugccucgcguucgcugguccu

SEQ ID NO: 3314565 - RNA, 16 nt, Mycobacterium tuberculosis H37Rv
gugccuggccggugcg

SEQ ID NO: 3314566 - RNA, 16 nt, Mycobacterium tuberculosis H37Rv
gugccuucaccgccgu

SEQ ID NO: 3314567 - RNA, 22 nt, Mycobacterium tuberculosis H37Rv
gugccuucuucgcuaccuucuu

SEQ ID NO: 3314568 - RNA, 17 nt, Mycobacterium tuberculosis H37Rv
gugccuuucggcagacc

SEQ ID NO: 3314569 - RNA, 19 nt, Mycobacterium tuberculosis H37Rv
gugcgacaacacgaccucu

SEQ ID NO: 3314570 - RNA, 20 nt, Mycobacterium tuberculosis H37Rv
gugcgacaacacgaccucuu

SEQ ID NO: 3314571 - RNA, 20 nt, Mycobacterium tuberculosis H37Rv
gugcgacgcaggaucacacu

SEQ ID NO: 3314572 - RNA, 15 nt, Mycobacterium tuberculosis H37Rv
gugcgacgcgaccgc

SEQ ID NO: 3314573 - RNA, 14 nt, Mycobacterium tuberculosis H37Rv
gugcgacggcguug

SEQ ID NO: 3314574 - RNA, 21 nt, Mycobacterium tuberculosis H37Rv
gugcgacguaaagggcgucgu

SEQ ID NO: 3314575 - RNA, 18 nt, Mycobacterium tuberculosis H37Rv
gugcgacucugcgucugc

SEQ ID NO: 3314576 - RNA, 20 nt, Mycobacterium tuberculosis H37Rv
gugcgacucugcgucugcuc

SEQ ID NO: 3314577 - RNA, 21 nt, Mycobacterium tuberculosis H37Rv
gugcgacugcgaaugcugggc

SEQ ID NO: 3314578 - RNA, 22 nt, Mycobacterium tuberculosis H37Rv
gugcgacuucgagauugccgag

SEQ ID NO: 3314579 - RNA, 16 nt, Mycobacterium tuberculosis H37Rv
gugcgagaagcaggga

SEQ ID NO: 3314580 - RNA, 15 nt, Mycobacterium tuberculosis H37Rv
gugcgauaccuagcc

SEQ ID NO: 3314581 - RNA, 17 nt, Mycobacterium tuberculosis H37Rv
gugcgauaccuagcccc

SEQ ID NO: 3314582 - RNA, 17 nt, Mycobacterium tuberculosis H37Rv
gugcgauccagggccga

SEQ ID NO: 3314583 - RNA, 13 nt, Mycobacterium tuberculosis H37Rv
gugcgauccccaa

SEQ ID NO: 3314584 - RNA, 19 nt, Mycobacterium tuberculosis H37Rv
gugcgauuccgcgucugcu

SEQ ID NO: 3314585 - RNA, 19 nt, Mycobacterium tuberculosis H37Rv
gugcgauuuugugucugcu

SEQ ID NO: 3314586 - RNA, 21 nt, Mycobacterium tuberculosis H37Rv
gugcgauuuugugucugcucg

SEQ ID NO: 3314587 - RNA, 15 nt, Mycobacterium tuberculosis H37Rv
gugcgcaacccagcc

SEQ ID NO: 3314588 - RNA, 22 nt, Mycobacterium tuberculosis H37Rv
gugcgcaacccagccgcgccag

SEQ ID NO: 3314589 - RNA, 14 nt, Mycobacterium tuberculosis H37Rv
gugcgcaccaccga

SEQ ID NO: 3314590 - RNA, 20 nt, Mycobacterium tuberculosis H37Rv
gugcgcacugaggcucaggu

SEQ ID NO: 3314591 - RNA, 23 nt, Mycobacterium tuberculosis H37Rv
gugcgcacugaggcucaggugcu

SEQ ID NO: 3314592 - RNA, 22 nt, Mycobacterium tuberculosis H37Rv
gugcgcagaacaccaccgccag

SEQ ID NO: 3314593 - RNA, 17 nt, Mycobacterium tuberculosis H37Rv
gugcgcaucagcgguac

SEQ ID NO: 3314594 - RNA, 20 nt, Mycobacterium tuberculosis H37Rv
gugcgccaaggucugccggg

SEQ ID NO: 3314595 - RNA, 21 nt, Mycobacterium tuberculosis H37Rv
gugcgccaaggucugccgggc

SEQ ID NO: 3314596 - RNA, 15 nt, Mycobacterium tuberculosis H37Rv
gugcgccacgaccgc

SEQ ID NO: 3314597 - RNA, 12 nt, Mycobacterium tuberculosis H37Rv
gugcgccagcga

SEQ ID NO: 3314598 - RNA, 18 nt, Mycobacterium tuberculosis H37Rv
gugcgcccaauccaccga

SEQ ID NO: 3314599 - RNA, 13 nt, Mycobacterium tuberculosis H37Rv
gugcgcccaucau

SEQ ID NO: 3314600 - RNA, 13 nt, Mycobacterium tuberculosis H37Rv
gugcgccgcagca

SEQ ID NO: 3314601 - RNA, 13 nt, Mycobacterium tuberculosis H37Rv
gugcgccgcagcc

SEQ ID NO: 3314602 - RNA, 22 nt, Mycobacterium tuberculosis H37Rv
gugcgccgccaucacgcacuga

SEQ ID NO: 3314603 - RNA, 19 nt, Mycobacterium tuberculosis H37Rv
gugcgccggcuggcggccu

SEQ ID NO: 3314604 - RNA, 16 nt, Mycobacterium tuberculosis H37Rv
gugcgccgucagccca

SEQ ID NO: 3314605 - RNA, 14 nt, Mycobacterium tuberculosis H37Rv
gugcgccgugcgau

SEQ ID NO: 3314606 - RNA, 19 nt, Mycobacterium tuberculosis H37Rv
gugcgccgugcgaucguca

SEQ ID NO: 3314607 - RNA, 20 nt, Mycobacterium tuberculosis H37Rv
gugcgccuugaccacagcgg

SEQ ID NO: 3314608 - RNA, 13 nt, Mycobacterium tuberculosis H37Rv
gugcgcgaccagg

SEQ ID NO: 3314609 - RNA, 12 nt, Mycobacterium tuberculosis H37Rv
gugcgcgcggcg

SEQ ID NO: 3314610 - RNA, 13 nt, Mycobacterium tuberculosis H37Rv
gugcgcgucgcgc

SEQ ID NO: 3314611 - RNA, 20 nt, Mycobacterium tuberculosis H37Rv
gugcgcugaugacgcggggc

SEQ ID NO: 3314612 - RNA, 23 nt, Mycobacterium tuberculosis H37Rv
gugcgcuggaugugggcgcucgc

SEQ ID NO: 3314613 - RNA, 19 nt, Mycobacterium tuberculosis H37Rv
gugcgcuggcugacaccga

SEQ ID NO: 3314614 - RNA, 17 nt, Mycobacterium tuberculosis H37Rv
gugcggaacaccgcccg

SEQ ID NO: 3314615 - RNA, 18 nt, Mycobacterium tuberculosis H37Rv
gugcggaacacgaugcgc

SEQ ID NO: 3314616 - RNA, 18 nt, Mycobacterium tuberculosis H37Rv
gugcggaagcaucggcug

SEQ ID NO: 3314617 - RNA, 19 nt, Mycobacterium tuberculosis H37Rv
gugcggaauggucagguuc

SEQ ID NO: 3314618 - RNA, 22 nt, Mycobacterium tuberculosis H37Rv
gugcggaucacucccccacaca

SEQ ID NO: 3314619 - RNA, 18 nt, Mycobacterium tuberculosis H37Rv
gugcggcaccgccgccca

SEQ ID NO: 3314620 - RNA, 20 nt, Mycobacterium tuberculosis H37Rv
gugcggcagauacucggcga

SEQ ID NO: 3314621 - RNA, 13 nt, Mycobacterium tuberculosis H37Rv
gugcggcagcccg

SEQ ID NO: 3314622 - RNA, 15 nt, Mycobacterium tuberculosis H37Rv
gugcggcagcccgcu

SEQ ID NO: 3314623 - RNA, 19 nt, Mycobacterium tuberculosis H37Rv
gugcggcagcgguggcuug

SEQ ID NO: 3314624 - RNA, 17 nt, Mycobacterium tuberculosis H37Rv
gugcggcauugguaccg

SEQ ID NO: 3314625 - RNA, 14 nt, Mycobacterium tuberculosis H37Rv
gugcggccaccucc

SEQ ID NO: 3314626 - RNA, 22 nt, Mycobacterium tuberculosis H37Rv
gugcggcccaaccggucguggu

SEQ ID NO: 3314627 - RNA, 22 nt, Mycobacterium tuberculosis H37Rv
gugcggccccgacauacgucgg

SEQ ID NO: 3314628 - RNA, 21 nt, Mycobacterium tuberculosis H37Rv
gugcggccguggcguggcuug

SEQ ID NO: 3314629 - RNA, 17 nt, Mycobacterium tuberculosis H37Rv
gugcggcgaagguagua

SEQ ID NO: 3314630 - RNA, 15 nt, Mycobacterium tuberculosis H37Rv
gugcggcgcaugcaa

SEQ ID NO: 3314631 - RNA, 12 nt, Mycobacterium tuberculosis H37Rv
gugcggcggcug

SEQ ID NO: 3314632 - RNA, 22 nt, Mycobacterium tuberculosis H37Rv
gugcggcguuaucgucggcuug

SEQ ID NO: 3314633 - RNA, 24 nt, Mycobacterium tuberculosis H37Rv
gugcggcguuaucgucggcuugcu

SEQ ID NO: 3314634 - RNA, 19 nt, Mycobacterium tuberculosis H37Rv
gugcgggcuucaacacacu

SEQ ID NO: 3314635 - RNA, 19 nt, Mycobacterium tuberculosis H37Rv
gugcggguaauacggcgcc

SEQ ID NO: 3314636 - RNA, 18 nt, Mycobacterium tuberculosis H37Rv
gugcggguucacugccgg

SEQ ID NO: 3314637 - RNA, 17 nt, Mycobacterium tuberculosis H37Rv
gugcgguacaucgacca

SEQ ID NO: 3314638 - RNA, 18 nt, Mycobacterium tuberculosis H37Rv
gugcgguacaucgaccac

SEQ ID NO: 3314639 - RNA, 15 nt, Mycobacterium tuberculosis H37Rv
guggcagcgcacccg

SEQ ID NO: 3314640 - RNA, 19 nt, Mycobacterium tuberculosis H37Rv
guggcagcgguggcccgcc

SEQ ID NO: 3314641 - RNA, 18 nt, Mycobacterium tuberculosis H37Rv
guggcaggugaucccgau

SEQ ID NO: 3314642 - RNA, 19 nt, Mycobacterium tuberculosis H37Rv
guggcaguacaccggcgug

SEQ ID NO: 3314643 - RNA, 19 nt, Mycobacterium tuberculosis H37Rv
guggcagucgcacggugcc

SEQ ID NO: 3314644 - RNA, 16 nt, Mycobacterium tuberculosis H37Rv
guggcauaaccgcuga

SEQ ID NO: 3314645 - RNA, 15 nt, Mycobacterium tuberculosis H37Rv
guggcauccagcagc

SEQ ID NO: 3314646 - RNA, 16 nt, Mycobacterium tuberculosis H37Rv
guggcaucggcggccu

SEQ ID NO: 3314647 - RNA, 21 nt, Mycobacterium tuberculosis H37Rv
guggcaucggcggccugcucg

SEQ ID NO: 3314648 - RNA, 13 nt, Mycobacterium tuberculosis H37Rv
guggcaugcgaca

SEQ ID NO: 3314649 - RNA, 20 nt, Mycobacterium tuberculosis H37Rv
guggccaccaaacgcugcug

SEQ ID NO: 3314650 - RNA, 23 nt, Mycobacterium tuberculosis H37Rv
guggccagaucgaacgcagccag

SEQ ID NO: 3314651 - RNA, 18 nt, Mycobacterium tuberculosis H37Rv
guggccagcaggcggcug

SEQ ID NO: 3314652 - RNA, 20 nt, Mycobacterium tuberculosis H37Rv
guggccagcaggcggcugaa

SEQ ID NO: 3314653 - RNA, 17 nt, Mycobacterium tuberculosis H37Rv
guggccagcgucgcgau

SEQ ID NO: 3314654 - RNA, 21 nt, Mycobacterium tuberculosis H37Rv
guggccaucgaucccuugucg

SEQ ID NO: 3314655 - RNA, 22 nt, Mycobacterium tuberculosis H37Rv
guggcccacauguccagcgucc

SEQ ID NO: 3314656 - RNA, 19 nt, Mycobacterium tuberculosis H37Rv
guggcccgaccgggaacca

SEQ ID NO: 3314657 - RNA, 18 nt, Mycobacterium tuberculosis H37Rv
guggcccgccggcaguga

SEQ ID NO: 3314658 - RNA, 22 nt, Mycobacterium tuberculosis H37Rv
guggcccggcgaaagcuugggc

SEQ ID NO: 3314659 - RNA, 17 nt, Mycobacterium tuberculosis H37Rv
guggcccguagcgucga

SEQ ID NO: 3314660 - RNA, 21 nt, Mycobacterium tuberculosis H37Rv
guggcccgucauacucgacac

SEQ ID NO: 3314661 - RNA, 15 nt, Mycobacterium tuberculosis H37Rv
guggccgcaucgacg

SEQ ID NO: 3314662 - RNA, 18 nt, Mycobacterium tuberculosis H37Rv
guggccgccaccucccag

SEQ ID NO: 3314663 - RNA, 23 nt, Mycobacterium tuberculosis H37Rv
guggccgccuucgccgccgccga

SEQ ID NO: 3314664 - RNA, 16 nt, Mycobacterium tuberculosis H37Rv
guggccgcgcugguca

SEQ ID NO: 3314665 - RNA, 20 nt, Mycobacterium tuberculosis H37Rv
guggccgggcgguaggcuug

SEQ ID NO: 3314666 - RNA, 20 nt, Mycobacterium tuberculosis H37Rv
guggccggggugccggcgau

SEQ ID NO: 3314667 - RNA, 14 nt, Mycobacterium tuberculosis H37Rv
guggccgugggugu

SEQ ID NO: 3314668 - RNA, 19 nt, Mycobacterium tuberculosis H37Rv
guggccguuuaggccggaa

SEQ ID NO: 3314669 - RNA, 14 nt, Mycobacterium tuberculosis H37Rv
guggccucauccac

SEQ ID NO: 3314670 - RNA, 19 nt, Mycobacterium tuberculosis H37Rv
guggccucauccaccgaug

SEQ ID NO: 3314671 - RNA, 15 nt, Mycobacterium tuberculosis H37Rv
guggccucguccagc

SEQ ID NO: 3314672 - RNA, 20 nt, Mycobacterium tuberculosis H37Rv
guggccugaaacggcugcag

SEQ ID NO: 3314673 - RNA, 21 nt, Mycobacterium tuberculosis H37Rv
guggccuugacagcuuucuug

SEQ ID NO: 3314674 - RNA, 17 nt, Mycobacterium tuberculosis H37Rv
guggccuugcgucaucg

SEQ ID NO: 3314675 - RNA, 15 nt, Mycobacterium tuberculosis H37Rv
guggcgaaaucgucg

SEQ ID NO: 3314676 - RNA, 20 nt, Mycobacterium tuberculosis H37Rv
guggcgaaaucgucgaaccg

SEQ ID NO: 3314677 - RNA, 17 nt, Mycobacterium tuberculosis H37Rv
guggcgaacccggucaa

SEQ ID NO: 3314678 - RNA, 22 nt, Mycobacterium tuberculosis H37Rv
guggcgaaucuuugguagucug

SEQ ID NO: 3314679 - RNA, 17 nt, Mycobacterium tuberculosis H37Rv
guggcgaccggcgaccg

SEQ ID NO: 3314680 - RNA, 22 nt, Mycobacterium tuberculosis H37Rv
guggcgauuucggcgccuggcg

SEQ ID NO: 3314681 - RNA, 18 nt, Mycobacterium tuberculosis H37Rv
guggcgcacaucgcgaaa

SEQ ID NO: 3314682 - RNA, 20 nt, Mycobacterium tuberculosis H37Rv
guggcgccacggcagcgccc

SEQ ID NO: 3314683 - RNA, 22 nt, Mycobacterium tuberculosis H37Rv
guggcgccaguucggcgggagc

SEQ ID NO: 3314684 - RNA, 21 nt, Mycobacterium tuberculosis H37Rv
guggcgcccgcguucagggca

SEQ ID NO: 3314685 - RNA, 22 nt, Mycobacterium tuberculosis H37Rv
guggcgcccgucuccagcacca

SEQ ID NO: 3314686 - RNA, 20 nt, Mycobacterium tuberculosis H37Rv
guggcgccgaacgccagcag

SEQ ID NO: 3314687 - RNA, 22 nt, Mycobacterium tuberculosis H37Rv
guggcgccgccggcaccgccgg

SEQ ID NO: 3314688 - RNA, 20 nt, Mycobacterium tuberculosis H37Rv
guggcgccggggccgccgau

SEQ ID NO: 3314689 - RNA, 12 nt, Mycobacterium tuberculosis H37Rv
guggcgccguug

SEQ ID NO: 3314690 - RNA, 14 nt, Mycobacterium tuberculosis H37Rv
guggcgcgccgcau

SEQ ID NO: 3314691 - RNA, 20 nt, Mycobacterium tuberculosis H37Rv
guggcgcgccgcaucggcga

SEQ ID NO: 3314692 - RNA, 20 nt, Mycobacterium tuberculosis H37Rv
guggcgcgcggcgccgcaau

SEQ ID NO: 3314693 - RNA, 12 nt, Mycobacterium tuberculosis H37Rv
guggcgcgggcc

SEQ ID NO: 3314694 - RNA, 16 nt, Mycobacterium tuberculosis H37Rv
guggcgcggugccggc

SEQ ID NO: 3314695 - RNA, 20 nt, Mycobacterium tuberculosis H37Rv
guggcgcugaagccgacgau

SEQ ID NO: 3314696 - RNA, 14 nt, Mycobacterium tuberculosis H37Rv
guggcgcugaucgg

SEQ ID NO: 3314697 - RNA, 14 nt, Mycobacterium tuberculosis H37Rv
guggcggaucgcga

SEQ ID NO: 3314698 - RNA, 21 nt, Mycobacterium tuberculosis H37Rv
guggcggaucgcgagcgccgc

SEQ ID NO: 3314699 - RNA, 20 nt, Mycobacterium tuberculosis H37Rv
guggcggcagcagcgccgua

SEQ ID NO: 3314700 - RNA, 14 nt, Mycobacterium tuberculosis H37Rv
guggcggcaggugu

SEQ ID NO: 3314701 - RNA, 12 nt, Mycobacterium tuberculosis H37Rv
guggcggccagu

SEQ ID NO: 3314702 - RNA, 14 nt, Mycobacterium tuberculosis H37Rv
guggcggcgcgcgc

SEQ ID NO: 3314703 - RNA, 14 nt, Mycobacterium tuberculosis H37Rv
guggcggcggcgga

SEQ ID NO: 3314704 - RNA, 19 nt, Mycobacterium tuberculosis H37Rv
guggcggcggugccacgau

SEQ ID NO: 3314705 - RNA, 16 nt, Mycobacterium tuberculosis H37Rv
guggcgggaucaccau

SEQ ID NO: 3314706 - RNA, 14 nt, Mycobacterium tuberculosis H37Rv
guggcgggccggau

SEQ ID NO: 3314707 - RNA, 20 nt, Mycobacterium tuberculosis H37Rv
guggcgggguugaucaccga

SEQ ID NO: 3314708 - RNA, 14 nt, Mycobacterium tuberculosis H37Rv
guggcgggucagcg

SEQ ID NO: 3314709 - RNA, 16 nt, Mycobacterium tuberculosis H37Rv
guggcgggucagcgcg

SEQ ID NO: 3314710 - RNA, 15 nt, Mycobacterium tuberculosis H37Rv
guggcgguacaccga

SEQ ID NO: 3314711 - RNA, 21 nt, Mycobacterium tuberculosis H37Rv
guggcgguaccuagccgcaga

SEQ ID NO: 3314712 - RNA, 18 nt, Mycobacterium tuberculosis H37Rv
guggcgguggccgucggg

SEQ ID NO: 3314713 - RNA, 20 nt, Mycobacterium tuberculosis H37Rv
guggcgucaugcccaggugc

SEQ ID NO: 3314714 - RNA, 16 nt, Mycobacterium tuberculosis H37Rv
guggcgucgcucgucg

SEQ ID NO: 3314715 - RNA, 10 nt, Mycobacterium tuberculosis H37Rv
guggcgucgu

SEQ ID NO: 3314716 - RNA, 14 nt, Mycobacterium tuberculosis H37Rv
guggcguggucucg

SEQ ID NO: 3314717 - RNA, 15 nt, Mycobacterium tuberculosis H37Rv
guggcguguucgacg

SEQ ID NO: 3314718 - RNA, 18 nt, Mycobacterium tuberculosis H37Rv
guggcguuacgcucggcg

SEQ ID NO: 3314719 - RNA, 16 nt, Mycobacterium tuberculosis H37Rv
guggcuaccgcaggug

SEQ ID NO: 3314720 - RNA, 20 nt, Mycobacterium tuberculosis H37Rv
guggcuauuccgacucgagu

SEQ ID NO: 3314721 - RNA, 19 nt, Mycobacterium tuberculosis H37Rv
guggcuccaucgucuggug

SEQ ID NO: 3314722 - RNA, 12 nt, Mycobacterium tuberculosis H37Rv
guggcucgacga

SEQ ID NO: 3314723 - RNA, 20 nt, Mycobacterium tuberculosis H37Rv
guggcucgacgaugcgguca

SEQ ID NO: 3314724 - RNA, 20 nt, Mycobacterium tuberculosis H37Rv
guggcugaacaccgcgggca

SEQ ID NO: 3314725 - RNA, 18 nt, Mycobacterium tuberculosis H37Rv
guggcugaucccggccag

SEQ ID NO: 3314726 - RNA, 23 nt, Mycobacterium tuberculosis H37Rv
guggcugcgccggaaccccucga

SEQ ID NO: 3314727 - RNA, 21 nt, Mycobacterium tuberculosis H37Rv
guggcuggacccgcauggcgc

SEQ ID NO: 3314728 - RNA, 16 nt, Mycobacterium tuberculosis H37Rv
guggcuggcaugccgg

SEQ ID NO: 3314729 - RNA, 17 nt, Mycobacterium tuberculosis H37Rv
guggcuggcaugccggc

SEQ ID NO: 3314730 - RNA, 13 nt, Mycobacterium tuberculosis H37Rv
guggcuggcugug

SEQ ID NO: 3314731 - RNA, 13 nt, Mycobacterium tuberculosis H37Rv
guggcugugcggg

SEQ ID NO: 3314732 - RNA, 20 nt, Mycobacterium tuberculosis H37Rv
guggcuuugacugcuggggg

SEQ ID NO: 3314733 - RNA, 20 nt, Mycobacterium tuberculosis H37Rv
guggcuuuugcgucugcucg

SEQ ID NO: 3314734 - RNA, 22 nt, Mycobacterium tuberculosis H37Rv
guggcuuuugcgucugcucgcg

SEQ ID NO: 3314735 - RNA, 15 nt, Mycobacterium tuberculosis H37Rv
guggugggcguggcu

SEQ ID NO: 3314736 - RNA, 14 nt, Mycobacterium tuberculosis H37Rv
guggugguagccau

SEQ ID NO: 3314737 - RNA, 16 nt, Mycobacterium tuberculosis H37Rv
gugguggugaugggca

SEQ ID NO: 3314738 - RNA, 20 nt, Mycobacterium tuberculosis H37Rv
gugguguaucgacggcggcc

SEQ ID NO: 3314739 - RNA, 16 nt, Mycobacterium tuberculosis H37Rv
guggugugucaccgga

SEQ ID NO: 3314740 - RNA, 22 nt, Mycobacterium tuberculosis H37Rv
gugguuacagaugaaggugacg

SEQ ID NO: 3314741 - RNA, 18 nt, Mycobacterium tuberculosis H37Rv
gugguuccggcugguggg

SEQ ID NO: 3314742 - RNA, 15 nt, Mycobacterium tuberculosis H37Rv
gugguucggcggcgc

SEQ ID NO: 3314743 - RNA, 12 nt, Mycobacterium tuberculosis H37Rv
gugguugccgaa

SEQ ID NO: 3314744 - RNA, 21 nt, Mycobacterium tuberculosis H37Rv
gugguuguccacggcguuacg

SEQ ID NO: 3314745 - RNA, 19 nt, Mycobacterium tuberculosis H37Rv
gugguuuucccgucgccgc

SEQ ID NO: 3314746 - RNA, 12 nt, Mycobacterium tuberculosis H37Rv
gugguuuugggc

SEQ ID NO: 3314747 - RNA, 22 nt, Mycobacterium tuberculosis H37Rv
guguacaccgcgcccgccgauc

SEQ ID NO: 3314748 - RNA, 15 nt, Mycobacterium tuberculosis H37Rv
guguaccagcccagc

SEQ ID NO: 3314749 - RNA, 13 nt, Mycobacterium tuberculosis H37Rv
guguacuggucug

SEQ ID NO: 3314750 - RNA, 17 nt, Mycobacterium tuberculosis H37Rv
guguagcaagucgccga

SEQ ID NO: 3314751 - RNA, 14 nt, Mycobacterium tuberculosis H37Rv
guguagcagcgcca

SEQ ID NO: 3314752 - RNA, 22 nt, Mycobacterium tuberculosis H37Rv
guguagccaaccguguaggcca

SEQ ID NO: 3314753 - RNA, 12 nt, Mycobacterium tuberculosis H37Rv
guguagcccagc

SEQ ID NO: 3314754 - RNA, 18 nt, Mycobacterium tuberculosis H37Rv
guguagcccuccgagcac

SEQ ID NO: 3314755 - RNA, 16 nt, Mycobacterium tuberculosis H37Rv
guguagccgagcacgg

SEQ ID NO: 3314756 - RNA, 18 nt, Mycobacterium tuberculosis H37Rv
guguagcgaugccguuga

SEQ ID NO: 3314757 - RNA, 20 nt, Mycobacterium tuberculosis H37Rv
guguagcuucgaugggcauc

SEQ ID NO: 3314758 - RNA, 20 nt, Mycobacterium tuberculosis H37Rv
guguaggccucggcagcaaa

SEQ ID NO: 3314759 - RNA, 23 nt, Mycobacterium tuberculosis H37Rv
guguaggccugcccccggcgcgg

SEQ ID NO: 3314760 - RNA, 19 nt, Mycobacterium tuberculosis H37Rv
guguaguggcccgcgggca

SEQ ID NO: 3314761 - RNA, 13 nt, Mycobacterium tuberculosis H37Rv
guguauuggggug

SEQ ID NO: 3314762 - RNA, 14 nt, Mycobacterium tuberculosis H37Rv
gugucaaugacacc

SEQ ID NO: 3314763 - RNA, 17 nt, Mycobacterium tuberculosis H37Rv
gugucaaugacaccggg

SEQ ID NO: 3314764 - RNA, 13 nt, Mycobacterium tuberculosis H37Rv
gugucaccgccgg

SEQ ID NO: 3314765 - RNA, 15 nt, Mycobacterium tuberculosis H37Rv
gugucacgcgaccac

SEQ ID NO: 3314766 - RNA, 18 nt, Mycobacterium tuberculosis H37Rv
gugucagcaagaucggca

SEQ ID NO: 3314767 - RNA, 22 nt, Mycobacterium tuberculosis H37Rv
gugucagcaagaucggcagcgu

SEQ ID NO: 3314768 - RNA, 22 nt, Mycobacterium tuberculosis H37Rv
gugucagcugauuaccgacacc

SEQ ID NO: 3314769 - RNA, 18 nt, Mycobacterium tuberculosis H37Rv
gugucccaagccugccga

SEQ ID NO: 3314770 - RNA, 15 nt, Mycobacterium tuberculosis H37Rv
guguccccgcccggc

SEQ ID NO: 3314771 - RNA, 17 nt, Mycobacterium tuberculosis H37Rv
guguccggggaccucgg

SEQ ID NO: 3314772 - RNA, 16 nt, Mycobacterium tuberculosis H37Rv
guguccucgguguccu

SEQ ID NO: 3314773 - RNA, 18 nt, Mycobacterium tuberculosis H37Rv
guguccucgucgagguca

SEQ ID NO: 3314774 - RNA, 15 nt, Mycobacterium tuberculosis H37Rv
guguccuggcccgau

SEQ ID NO: 3314775 - RNA, 17 nt, Mycobacterium tuberculosis H37Rv
gugucgacggucauccc

SEQ ID NO: 3314776 - RNA, 14 nt, Mycobacterium tuberculosis H37Rv
gugucgaugcgcgc

SEQ ID NO: 3314777 - RNA, 19 nt, Mycobacterium tuberculosis H37Rv
gugucgccgaucaccgcau

SEQ ID NO: 3314778 - RNA, 20 nt, Mycobacterium tuberculosis H37Rv
gugucggaaugggcgccaca

SEQ ID NO: 3314779 - RNA, 19 nt, Mycobacterium tuberculosis H37Rv
gugucggcgcggcugccgc

SEQ ID NO: 3314780 - RNA, 17 nt, Mycobacterium tuberculosis H37Rv
gugucggcucgagucgc

SEQ ID NO: 3314781 - RNA, 21 nt, Mycobacterium tuberculosis H37Rv
gugucggcuggucgcugcugc

SEQ ID NO: 3314782 - RNA, 22 nt, Mycobacterium tuberculosis H37Rv
gugucgggaacgaguacgggca

SEQ ID NO: 3314783 - RNA, 16 nt, Mycobacterium tuberculosis H37Rv
gugucgggugugcagg

SEQ ID NO: 3314784 - RNA, 14 nt, Mycobacterium tuberculosis H37Rv
gugucggugcgcgc

SEQ ID NO: 3314785 - RNA, 17 nt, Mycobacterium tuberculosis H37Rv
gugucguaacugcccgc

SEQ ID NO: 3314786 - RNA, 16 nt, Mycobacterium tuberculosis H37Rv
gugucguacccggcaa

SEQ ID NO: 3314787 - RNA, 14 nt, Mycobacterium tuberculosis H37Rv
gugucgucgaccac

SEQ ID NO: 3314788 - RNA, 18 nt, Mycobacterium tuberculosis H37Rv
gugucguggucgugggug

SEQ ID NO: 3314789 - RNA, 22 nt, Mycobacterium tuberculosis H37Rv
gugucugcccgagguccgcccu

SEQ ID NO: 3314790 - RNA, 13 nt, Mycobacterium tuberculosis H37Rv
gugucugcucgcg

SEQ ID NO: 3314791 - RNA, 21 nt, Mycobacterium tuberculosis H37Rv
gugucugggaccccgcugcga

SEQ ID NO: 3314792 - RNA, 22 nt, Mycobacterium tuberculosis H37Rv
gugucugggaccccgcugcgac

SEQ ID NO: 3314793 - RNA, 21 nt, Mycobacterium tuberculosis H37Rv
gugugaacuggucgacgucgg

SEQ ID NO: 3314794 - RNA, 17 nt, Mycobacterium tuberculosis H37Rv
gugugagcugcucacgg

SEQ ID NO: 3314795 - RNA, 19 nt, Mycobacterium tuberculosis H37Rv
gugugagucccacgccagc

SEQ ID NO: 3314796 - RNA, 13 nt, Mycobacterium tuberculosis H37Rv
gugugcccgggug

SEQ ID NO: 3314797 - RNA, 23 nt, Mycobacterium tuberculosis H37Rv
gugugcccgggugacccgugcgg

SEQ ID NO: 3314798 - RNA, 17 nt, Mycobacterium tuberculosis H37Rv
gugugcgucgcacgagc

SEQ ID NO: 3314799 - RNA, 15 nt, Mycobacterium tuberculosis H37Rv
gugugcgucuccagc

SEQ ID NO: 3314800 - RNA, 12 nt, Mycobacterium tuberculosis H37Rv
gugugcgugcgg

SEQ ID NO: 3314801 - RNA, 13 nt, Mycobacterium tuberculosis H37Rv
gugugcucggcca

SEQ ID NO: 3314802 - RNA, 10 nt, Mycobacterium tuberculosis H37Rv
gugugcugca

SEQ ID NO: 3314803 - RNA, 16 nt, Mycobacterium tuberculosis H37Rv
gugugcugccaccggc

SEQ ID NO: 3314804 - RNA, 20 nt, Mycobacterium tuberculosis H37Rv
guguggaauacgcugcuggu

SEQ ID NO: 3314805 - RNA, 19 nt, Mycobacterium tuberculosis H37Rv
guguggaauggaccagcgc

SEQ ID NO: 3314806 - RNA, 12 nt, Mycobacterium tuberculosis H37Rv
guguggcagccc

SEQ ID NO: 3314807 - RNA, 18 nt, Mycobacterium tuberculosis H37Rv
guguggccuugcgucauc

SEQ ID NO: 3314808 - RNA, 23 nt, Mycobacterium tuberculosis H37Rv
guguggcuugacgcccgggcacc

SEQ ID NO: 3314809 - RNA, 21 nt, Mycobacterium tuberculosis H37Rv
guguggcuuugacugcugggg

SEQ ID NO: 3314810 - RNA, 22 nt, Mycobacterium tuberculosis H37Rv
guguggcuuugacugcuggggg

SEQ ID NO: 3314811 - RNA, 16 nt, Mycobacterium tuberculosis H37Rv
gugugggccccgccga

SEQ ID NO: 3314812 - RNA, 18 nt, Mycobacterium tuberculosis H37Rv
gugugggcguugucuagc

SEQ ID NO: 3314813 - RNA, 17 nt, Mycobacterium tuberculosis H37Rv
guguggucauuggggug

SEQ ID NO: 3314814 - RNA, 13 nt, Mycobacterium tuberculosis H37Rv
guguggucgagcg

SEQ ID NO: 3314815 - RNA, 16 nt, Mycobacterium tuberculosis H37Rv
guguggucgguggcgg

SEQ ID NO: 3314816 - RNA, 16 nt, Mycobacterium tuberculosis H37Rv
guguggugacagagcg

SEQ ID NO: 3314817 - RNA, 20 nt, Mycobacterium tuberculosis H37Rv
guguguacacacgaugacgu

SEQ ID NO: 3314818 - RNA, 20 nt, Mycobacterium tuberculosis H37Rv
guguguggcgccggggacca

SEQ ID NO: 3314819 - RNA, 15 nt, Mycobacterium tuberculosis H37Rv
guguguuuggugguu

SEQ ID NO: 3314820 - RNA, 14 nt, Mycobacterium tuberculosis H37Rv
guguuaaagaagcc

SEQ ID NO: 3314821 - RNA, 15 nt, Mycobacterium tuberculosis H37Rv
guguuaggcccgcac

SEQ ID NO: 3314822 - RNA, 17 nt, Mycobacterium tuberculosis H37Rv
guguuauugaugcccga

SEQ ID NO: 3314823 - RNA, 22 nt, Mycobacterium tuberculosis H37Rv
guguucgacgagguugccgcac

SEQ ID NO: 3314824 - RNA, 13 nt, Mycobacterium tuberculosis H37Rv
guguucgacggca

SEQ ID NO: 3314825 - RNA, 13 nt, Mycobacterium tuberculosis H37Rv
guguucgccacac

SEQ ID NO: 3314826 - RNA, 15 nt, Mycobacterium tuberculosis H37Rv
guguucgcggcaucg

SEQ ID NO: 3314827 - RNA, 15 nt, Mycobacterium tuberculosis H37Rv
guguucggcccgcac

SEQ ID NO: 3314828 - RNA, 20 nt, Mycobacterium tuberculosis H37Rv
guguucuaccugcacccagg

SEQ ID NO: 3314829 - RNA, 13 nt, Mycobacterium tuberculosis H37Rv
guguucuccugcc

SEQ ID NO: 3314830 - RNA, 14 nt, Mycobacterium tuberculosis H37Rv
guguugaccggguc

SEQ ID NO: 3314831 - RNA, 16 nt, Mycobacterium tuberculosis H37Rv
guguugagaucgcccg

SEQ ID NO: 3314832 - RNA, 21 nt, Mycobacterium tuberculosis H37Rv
guuccguugaugccgccggag

SEQ ID NO: 3314833 - RNA, 13 nt, Mycobacterium tuberculosis H37Rv
guuccucagcggc

SEQ ID NO: 3314834 - RNA, 14 nt, Mycobacterium tuberculosis H37Rv
guuccucagcggcc

SEQ ID NO: 3314835 - RNA, 15 nt, Mycobacterium tuberculosis H37Rv
guuccuccagcagcg

SEQ ID NO: 3314836 - RNA, 15 nt, Mycobacterium tuberculosis H37Rv
guuccugcacgguca

SEQ ID NO: 3314837 - RNA, 17 nt, Mycobacterium tuberculosis H37Rv
guuccugguagucgccc

SEQ ID NO: 3314838 - RNA, 14 nt, Mycobacterium tuberculosis H37Rv
guucgaacgcgauc

SEQ ID NO: 3314839 - RNA, 17 nt, Mycobacterium tuberculosis H37Rv
guucgaacgcgaucgac

SEQ ID NO: 3314840 - RNA, 14 nt, Mycobacterium tuberculosis H37Rv
guucgaaggccacc

SEQ ID NO: 3314841 - RNA, 21 nt, Mycobacterium tuberculosis H37Rv
guucgaccaucaucucggugg

SEQ ID NO: 3314842 - RNA, 15 nt, Mycobacterium tuberculosis H37Rv
guucgacggcgucaa

SEQ ID NO: 3314843 - RNA, 14 nt, Mycobacterium tuberculosis H37Rv
guucgagggugacc

SEQ ID NO: 3314844 - RNA, 17 nt, Mycobacterium tuberculosis H37Rv
guucgaggucggcgauc

SEQ ID NO: 3314845 - RNA, 18 nt, Mycobacterium tuberculosis H37Rv
guucgauaagcagcucgg

SEQ ID NO: 3314846 - RNA, 22 nt, Mycobacterium tuberculosis H37Rv
guucgauaagcagcucgguggc

SEQ ID NO: 3314847 - RNA, 14 nt, Mycobacterium tuberculosis H37Rv
guucgauagcggcg

SEQ ID NO: 3314848 - RNA, 16 nt, Mycobacterium tuberculosis H37Rv
guucgaucccguccgc

SEQ ID NO: 3314849 - RNA, 21 nt, Mycobacterium tuberculosis H37Rv
guucgaugggugcaccgaaga

SEQ ID NO: 3314850 - RNA, 18 nt, Mycobacterium tuberculosis H37Rv
guucgcccacaugccggu

SEQ ID NO: 3314851 - RNA, 20 nt, Mycobacterium tuberculosis H37Rv
guucgccggaucgaaacuca

SEQ ID NO: 3314852 - RNA, 15 nt, Mycobacterium tuberculosis H37Rv
guucgcgcaaaugcc

SEQ ID NO: 3314853 - RNA, 16 nt, Mycobacterium tuberculosis H37Rv
guucgcgcgccgcgac

SEQ ID NO: 3314854 - RNA, 13 nt, Mycobacterium tuberculosis H37Rv
guucgcgcuggca

SEQ ID NO: 3314855 - RNA, 19 nt, Mycobacterium tuberculosis H37Rv
guucgcggcaucgucgcca

SEQ ID NO: 3314856 - RNA, 19 nt, Mycobacterium tuberculosis H37Rv
guucgcgggugcgcugcag

SEQ ID NO: 3314857 - RNA, 14 nt, Mycobacterium tuberculosis H37Rv
guucgcucccccgc

SEQ ID NO: 3314858 - RNA, 15 nt, Mycobacterium tuberculosis H37Rv
guucgcucccccgcu

SEQ ID NO: 3314859 - RNA, 14 nt, Mycobacterium tuberculosis H37Rv
guucgcugacggcc

SEQ ID NO: 3314860 - RNA, 15 nt, Mycobacterium tuberculosis H37Rv
guucgcugacggcca

SEQ ID NO: 3314861 - RNA, 15 nt, Mycobacterium tuberculosis H37Rv
guucggacgagguca

SEQ ID NO: 3314862 - RNA, 15 nt, Mycobacterium tuberculosis H37Rv
guucggccuugaucg

SEQ ID NO: 3314863 - RNA, 20 nt, Mycobacterium tuberculosis H37Rv
guucggcgagcacaugcugc

SEQ ID NO: 3314864 - RNA, 15 nt, Mycobacterium tuberculosis H37Rv
guucggcgaucuccg

SEQ ID NO: 3314865 - RNA, 15 nt, Mycobacterium tuberculosis H37Rv
guucggcgcccgcuc

SEQ ID NO: 3314866 - RNA, 16 nt, Mycobacterium tuberculosis H37Rv
guucggcggcgccccg

SEQ ID NO: 3314867 - RNA, 19 nt, Mycobacterium tuberculosis H37Rv
guucggcgucguugccggg

SEQ ID NO: 3314868 - RNA, 15 nt, Mycobacterium tuberculosis H37Rv
guucggcgugucggg

SEQ ID NO: 3314869 - RNA, 21 nt, Mycobacterium tuberculosis H37Rv
guucggcugccgcgcgcugcc

SEQ ID NO: 3314870 - RNA, 11 nt, Mycobacterium tuberculosis H37Rv
guucggcuggc

SEQ ID NO: 3314871 - RNA, 12 nt, Mycobacterium tuberculosis H37Rv
guucgggacgcg

SEQ ID NO: 3314872 - RNA, 14 nt, Mycobacterium tuberculosis H37Rv
guucgggcaacggc

SEQ ID NO: 3314873 - RNA, 22 nt, Mycobacterium tuberculosis H37Rv
guucgggcugccaggagcacgg

SEQ ID NO: 3314874 - RNA, 17 nt, Mycobacterium tuberculosis H37Rv
guucggggcgcgguacc

SEQ ID NO: 3314875 - RNA, 14 nt, Mycobacterium tuberculosis H37Rv
guucgggguggugg

SEQ ID NO: 3314876 - RNA, 22 nt, Mycobacterium tuberculosis H37Rv
guucgggugagcacccagcggc

SEQ ID NO: 3314877 - RNA, 23 nt, Mycobacterium tuberculosis H37Rv
guucgggugagcacccagcggcg

SEQ ID NO: 3314878 - RNA, 14 nt, Mycobacterium tuberculosis H37Rv
guucggucggggag

SEQ ID NO: 3314879 - RNA, 15 nt, Mycobacterium tuberculosis H37Rv
guucggugagguccu

SEQ ID NO: 3314880 - RNA, 18 nt, Mycobacterium tuberculosis H37Rv
guucgguucgcgagucac

SEQ ID NO: 3314881 - RNA, 14 nt, Mycobacterium tuberculosis H37Rv
guucguagcgggca

SEQ ID NO: 3314882 - RNA, 19 nt, Mycobacterium tuberculosis H37Rv
guucgucggcugcggcguc

SEQ ID NO: 3314883 - RNA, 15 nt, Mycobacterium tuberculosis H37Rv
guucgucgggcaugc

SEQ ID NO: 3314884 - RNA, 17 nt, Mycobacterium tuberculosis H37Rv
guucgucgucgcugaau

SEQ ID NO: 3314885 - RNA, 16 nt, Mycobacterium tuberculosis H37Rv
guucgugagcggccag

SEQ ID NO: 3314886 - RNA, 15 nt, Mycobacterium tuberculosis H37Rv
guucgugcacggcga

SEQ ID NO: 3314887 - RNA, 19 nt, Mycobacterium tuberculosis H37Rv
guucguggcuggcaugccg

SEQ ID NO: 3314888 - RNA, 18 nt, Mycobacterium tuberculosis H37Rv
guucuccauccgcacugc

SEQ ID NO: 3314889 - RNA, 15 nt, Mycobacterium tuberculosis H37Rv
guucuccucgugcag

SEQ ID NO: 3314890 - RNA, 21 nt, Mycobacterium tuberculosis H37Rv
guucucgcgcaggucgccuuc

SEQ ID NO: 3314891 - RNA, 15 nt, Mycobacterium tuberculosis H37Rv
guucuggaaccccga

SEQ ID NO: 3314892 - RNA, 19 nt, Mycobacterium tuberculosis H37Rv
guucuggauacccagcgcc

SEQ ID NO: 3314893 - RNA, 17 nt, Mycobacterium tuberculosis H37Rv
guucuggauccccugau

SEQ ID NO: 3314894 - RNA, 23 nt, Mycobacterium tuberculosis H37Rv
guucugggaccgauaaguucggc

SEQ ID NO: 3314895 - RNA, 21 nt, Mycobacterium tuberculosis H37Rv
guucuuuugcgucugcuggcg

SEQ ID NO: 3314896 - RNA, 23 nt, Mycobacterium tuberculosis H37Rv
guugaaauugaugaucugcagcu

SEQ ID NO: 3314897 - RNA, 14 nt, Mycobacterium tuberculosis H37Rv
guugaacgcgugcu

SEQ ID NO: 3314898 - RNA, 23 nt, Mycobacterium tuberculosis H37Rv
guugaacucgaguugcucgacac

SEQ ID NO: 3314899 - RNA, 17 nt, Mycobacterium tuberculosis H37Rv
guugaagaaagcgaccg

SEQ ID NO: 3314900 - RNA, 21 nt, Mycobacterium tuberculosis H37Rv
guugaagaaagcgaccgucgg

SEQ ID NO: 3314901 - RNA, 17 nt, Mycobacterium tuberculosis H37Rv
guugaagccgcccgagu

SEQ ID NO: 3314902 - RNA, 20 nt, Mycobacterium tuberculosis H37Rv
guugaaggugccggcguuag

SEQ ID NO: 3314903 - RNA, 21 nt, Mycobacterium tuberculosis H37Rv
guugaaucccagauaugcagg

SEQ ID NO: 3314904 - RNA, 21 nt, Mycobacterium tuberculosis H37Rv
guugacaccagggggcgagag

SEQ ID NO: 3314905 - RNA, 20 nt, Mycobacterium tuberculosis H37Rv
guugaccaaugucagugccc

SEQ ID NO: 3314906 - RNA, 13 nt, Mycobacterium tuberculosis H37Rv
guugaccagcacg

SEQ ID NO: 3314907 - RNA, 15 nt, Mycobacterium tuberculosis H37Rv
guugaccaggccgac

SEQ ID NO: 3314908 - RNA, 15 nt, Mycobacterium tuberculosis H37Rv
guugaccggccggac

SEQ ID NO: 3314909 - RNA, 20 nt, Mycobacterium tuberculosis H37Rv
guugaccucgcgcaccggcu

SEQ ID NO: 3314910 - RNA, 22 nt, Mycobacterium tuberculosis H37Rv
guugaccucuucgggcagcgcg

SEQ ID NO: 3314911 - RNA, 15 nt, Mycobacterium tuberculosis H37Rv
guugacgccacgacg

SEQ ID NO: 3314912 - RNA, 20 nt, Mycobacterium tuberculosis H37Rv
guugacgguugccccggcga

SEQ ID NO: 3314913 - RNA, 16 nt, Mycobacterium tuberculosis H37Rv
guugacgucgagcagc

SEQ ID NO: 3314914 - RNA, 20 nt, Mycobacterium tuberculosis H37Rv
guugagaacaacgcgucgau

SEQ ID NO: 3314915 - RNA, 21 nt, Mycobacterium tuberculosis H37Rv
guugagaaccggcucaccacg

SEQ ID NO: 3314916 - RNA, 14 nt, Mycobacterium tuberculosis H37Rv
guugagaucgcccg

SEQ ID NO: 3314917 - RNA, 21 nt, Mycobacterium tuberculosis H37Rv
guugagcaagugggugccggc

SEQ ID NO: 3314918 - RNA, 15 nt, Mycobacterium tuberculosis H37Rv
guugagcauaugacg

SEQ ID NO: 3314919 - RNA, 14 nt, Mycobacterium tuberculosis H37Rv
guugagcaucaccg

SEQ ID NO: 3314920 - RNA, 21 nt, Mycobacterium tuberculosis H37Rv
guugagcggcagccaagcgag

SEQ ID NO: 3314921 - RNA, 17 nt, Mycobacterium tuberculosis H37Rv
guugagcugucgcaacg

SEQ ID NO: 3314922 - RNA, 23 nt, Mycobacterium tuberculosis H37Rv
guugaggacgagguucugccgcg

SEQ ID NO: 3314923 - RNA, 18 nt, Mycobacterium tuberculosis H37Rv
guugaggaugacgacggu

SEQ ID NO: 3314924 - RNA, 22 nt, Mycobacterium tuberculosis H37Rv
guugaggaugacgacggugacc

SEQ ID NO: 3314925 - RNA, 14 nt, Mycobacterium tuberculosis H37Rv
guugaggccgguga

SEQ ID NO: 3314926 - RNA, 20 nt, Mycobacterium tuberculosis H37Rv
guugaggccggugaacggua

SEQ ID NO: 3314927 - RNA, 20 nt, Mycobacterium tuberculosis H37Rv
guugaggccgucgaacggua

SEQ ID NO: 3314928 - RNA, 17 nt, Mycobacterium tuberculosis H37Rv
guuggcgaucucgacgg

SEQ ID NO: 3314929 - RNA, 14 nt, Mycobacterium tuberculosis H37Rv
guuggcgccaccag

SEQ ID NO: 3314930 - RNA, 20 nt, Mycobacterium tuberculosis H37Rv
guuggcgccguuaccgccgu

SEQ ID NO: 3314931 - RNA, 17 nt, Mycobacterium tuberculosis H37Rv
guuggcgggagcaccga

SEQ ID NO: 3314932 - RNA, 20 nt, Mycobacterium tuberculosis H37Rv
guuggcggugaacaccgcca

SEQ ID NO: 3314933 - RNA, 18 nt, Mycobacterium tuberculosis H37Rv
guuggcgguggucccgau

SEQ ID NO: 3314934 - RNA, 13 nt, Mycobacterium tuberculosis H37Rv
guuggcucggcgc

SEQ ID NO: 3314935 - RNA, 17 nt, Mycobacterium tuberculosis H37Rv
guuggcucgugcccgac

SEQ ID NO: 3314936 - RNA, 18 nt, Mycobacterium tuberculosis H37Rv
guuggcuugcgcgcaggu

SEQ ID NO: 3314937 - RNA, 20 nt, Mycobacterium tuberculosis H37Rv
guugggaaccgacuugguug

SEQ ID NO: 3314938 - RNA, 17 nt, Mycobacterium tuberculosis H37Rv
guugggaagugcgguga

SEQ ID NO: 3314939 - RNA, 17 nt, Mycobacterium tuberculosis H37Rv
guugggcagcuccacca

SEQ ID NO: 3314940 - RNA, 21 nt, Mycobacterium tuberculosis H37Rv
guugggcgcgaaacgccgcaa

SEQ ID NO: 3314941 - RNA, 22 nt, Mycobacterium tuberculosis H37Rv
guugggcgcgaaacgccgcaau

SEQ ID NO: 3314942 - RNA, 21 nt, Mycobacterium tuberculosis H37Rv
guugggcggagcacuucgucg

SEQ ID NO: 3314943 - RNA, 15 nt, Mycobacterium tuberculosis H37Rv
guuggggcacgacgc

SEQ ID NO: 3314944 - RNA, 14 nt, Mycobacterium tuberculosis H37Rv
guuggguggcaccg

SEQ ID NO: 3314945 - RNA, 14 nt, Mycobacterium tuberculosis H37Rv
guugggugugcccg

SEQ ID NO: 3314946 - RNA, 16 nt, Mycobacterium tuberculosis H37Rv
guugguaaucuuggcc

SEQ ID NO: 3314947 - RNA, 17 nt, Mycobacterium tuberculosis H37Rv
guugguauuagggccgg

SEQ ID NO: 3314948 - RNA, 18 nt, Mycobacterium tuberculosis H37Rv
guugguauuagggccggc

SEQ ID NO: 3314949 - RNA, 22 nt, Mycobacterium tuberculosis H37Rv
guugguauuagggccggcguug

SEQ ID NO: 3314950 - RNA, 18 nt, Mycobacterium tuberculosis H37Rv
guuggucaccaccuggug

SEQ ID NO: 3314951 - RNA, 21 nt, Mycobacterium tuberculosis H37Rv
guuggucaucaacgccacgau

SEQ ID NO: 3314952 - RNA, 14 nt, Mycobacterium tuberculosis H37Rv
guuggucggugcug

SEQ ID NO: 3314953 - RNA, 13 nt, Mycobacterium tuberculosis H37Rv
guuggucguggcu

SEQ ID NO: 3314954 - RNA, 20 nt, Mycobacterium tuberculosis H37Rv
guuggucguggcugugcggg

SEQ ID NO: 3314955 - RNA, 13 nt, Mycobacterium tuberculosis H37Rv
guuggugaugccg

SEQ ID NO: 3314956 - RNA, 19 nt, Mycobacterium tuberculosis H37Rv
guuggugcagaccaccgcc

SEQ ID NO: 3314957 - RNA, 17 nt, Mycobacterium tuberculosis H37Rv
guuggugcgggguuggc

SEQ ID NO: 3314958 - RNA, 20 nt, Mycobacterium tuberculosis H37Rv
guugguggucggcccuccac

SEQ ID NO: 3314959 - RNA, 16 nt, Mycobacterium tuberculosis H37Rv
guugguguugcggacg

SEQ ID NO: 3314960 - RNA, 21 nt, Mycobacterium tuberculosis H37Rv
guugguucagcucgaggacca

SEQ ID NO: 3314961 - RNA, 16 nt, Mycobacterium tuberculosis H37Rv
guugguuggcucgcug

SEQ ID NO: 3314962 - RNA, 18 nt, Mycobacterium tuberculosis H37Rv
guuguaaaucuccucgga

SEQ ID NO: 3314963 - RNA, 16 nt, Mycobacterium tuberculosis H37Rv
guuguaccccagcauc

SEQ ID NO: 3314964 - RNA, 17 nt, Mycobacterium tuberculosis H37Rv
guuguagacggcggcau

SEQ ID NO: 3314965 - RNA, 23 nt, Mycobacterium tuberculosis H37Rv
guuguagcccaaaaacggcagca

SEQ ID NO: 3314966 - RNA, 21 nt, Mycobacterium tuberculosis H37Rv
guuguaggccgggccggccac

SEQ ID NO: 3314967 - RNA, 15 nt, Mycobacterium tuberculosis H37Rv
guuguaucgcagcau

SEQ ID NO: 3314968 - RNA, 20 nt, Mycobacterium tuberculosis H37Rv
guugucagcgaacggccagg

SEQ ID NO: 3314969 - RNA, 12 nt, Mycobacterium tuberculosis H37Rv
guuguccaccgc

SEQ ID NO: 3314970 - RNA, 23 nt, Mycobacterium tuberculosis H37Rv
guuguccaggaauuccccaccgu

SEQ ID NO: 3314971 - RNA, 23 nt, Mycobacterium tuberculosis H37Rv
guuguccuucagccaguccagcg

SEQ ID NO: 3314972 - RNA, 21 nt, Mycobacterium tuberculosis H37Rv
guugucgacgaagguggcgaa

SEQ ID NO: 3314973 - RNA, 13 nt, Mycobacterium tuberculosis H37Rv
guugucgucggug

SEQ ID NO: 3314974 - RNA, 17 nt, Mycobacterium tuberculosis H37Rv
guugucguugcuggugu

SEQ ID NO: 3314975 - RNA, 18 nt, Mycobacterium tuberculosis H37Rv
guugucuagcugguggug

SEQ ID NO: 3314976 - RNA, 15 nt, Mycobacterium tuberculosis H37Rv
guugucuuucacaug

SEQ ID NO: 3314977 - RNA, 16 nt, Mycobacterium tuberculosis H37Rv
guugugagccacgcgc

SEQ ID NO: 3314978 - RNA, 23 nt, Mycobacterium tuberculosis H37Rv
guugugcgcacucuuuccuuccg

SEQ ID NO: 3314979 - RNA, 14 nt, Mycobacterium tuberculosis H37Rv
guugugcucgguga

SEQ ID NO: 3314980 - RNA, 15 nt, Mycobacterium tuberculosis H37Rv
guugugcuguggucg

SEQ ID NO: 3314981 - RNA, 16 nt, Mycobacterium tuberculosis H37Rv
guuguggcacccggcu

SEQ ID NO: 3314982 - RNA, 15 nt, Mycobacterium tuberculosis H37Rv
guugugucggccugg

SEQ ID NO: 3314983 - RNA, 18 nt, Mycobacterium tuberculosis H37Rv
guugugucggccuggcag

SEQ ID NO: 3314984 - RNA, 16 nt, Mycobacterium tuberculosis H37Rv
guugugugcucgucgc

SEQ ID NO: 3314985 - RNA, 14 nt, Mycobacterium tuberculosis H37Rv
guuguucaccgacg

SEQ ID NO: 3314986 - RNA, 21 nt, Mycobacterium tuberculosis H37Rv
guuguucgggcugccaggagc

SEQ ID NO: 3314987 - RNA, 22 nt, Mycobacterium tuberculosis H37Rv
guuguugggcgagggugaagac

SEQ ID NO: 3314988 - RNA, 16 nt, Mycobacterium tuberculosis H37Rv
guuguuggugccagcc

SEQ ID NO: 3314989 - RNA, 20 nt, Mycobacterium tuberculosis H37Rv
guuuacccgcauggacgcga

SEQ ID NO: 3314990 - RNA, 22 nt, Mycobacterium tuberculosis H37Rv
guuuagcaacuacucauccaga

SEQ ID NO: 3314991 - RNA, 16 nt, Mycobacterium tuberculosis H37Rv
guuuagcggcugaggg

SEQ ID NO: 3314992 - RNA, 14 nt, Mycobacterium tuberculosis H37Rv
guuuccgaagcccg

SEQ ID NO: 3314993 - RNA, 15 nt, Mycobacterium tuberculosis H37Rv
guuuccucagcugcu

SEQ ID NO: 3314994 - RNA, 19 nt, Mycobacterium tuberculosis H37Rv
guuuccuccggcagcagca

SEQ ID NO: 3314995 - RNA, 18 nt, Mycobacterium tuberculosis H37Rv
guuuccucgagccagcuc

SEQ ID NO: 3314996 - RNA, 19 nt, Mycobacterium tuberculosis H37Rv
guuuccucgagccagcucc

SEQ ID NO: 3314997 - RNA, 22 nt, Mycobacterium tuberculosis H37Rv
guuucgacaucacucgcgccag

SEQ ID NO: 3314998 - RNA, 19 nt, Mycobacterium tuberculosis H37Rv
guuucgaccugcgggaucg

SEQ ID NO: 3314999 - RNA, 18 nt, Mycobacterium tuberculosis H37Rv
guuucgcagccgcaccgg

SEQ ID NO: 3315000 - RNA, 21 nt, Mycobacterium tuberculosis H37Rv
guuucgccagauggccacgga

SEQ ID NO: 3315001 - RNA, 14 nt, Mycobacterium tuberculosis H37Rv
guuucugaagcccg

SEQ ID NO: 3315002 - RNA, 15 nt, Mycobacterium tuberculosis H37Rv
guuucugaagcccga

SEQ ID NO: 3315003 - RNA, 20 nt, Mycobacterium tuberculosis H37Rv
guuucugagcgcgcuggcca

SEQ ID NO: 3315004 - RNA, 16 nt, Mycobacterium tuberculosis H37Rv
guuugaacgcaugcga

SEQ ID NO: 3315005 - RNA, 14 nt, Mycobacterium tuberculosis H37Rv
guuugacgccgaug

SEQ ID NO: 3315006 - RNA, 15 nt, Mycobacterium tuberculosis H37Rv
guuugacgccgauga

SEQ ID NO: 3315007 - RNA, 17 nt, Mycobacterium tuberculosis H37Rv
guuugacgcgcucgcgc

SEQ ID NO: 3315008 - RNA, 19 nt, Mycobacterium tuberculosis H37Rv
guuugacguccagggccac

SEQ ID NO: 3315009 - RNA, 21 nt, Mycobacterium tuberculosis H37Rv
guuugacugcgaccgguucgg

SEQ ID NO: 3315010 - RNA, 16 nt, Mycobacterium tuberculosis H37Rv
guuugaucgcaacgau

SEQ ID NO: 3315011 - RNA, 19 nt, Mycobacterium tuberculosis H37Rv
guuugaugcgggcggcaag

SEQ ID NO: 3315012 - RNA, 22 nt, Mycobacterium tuberculosis H37Rv
guuugccgauggaugggcugcg

SEQ ID NO: 3315013 - RNA, 13 nt, Mycobacterium tuberculosis H37Rv
guuugccggugcg

SEQ ID NO: 3315014 - RNA, 15 nt, Mycobacterium tuberculosis H37Rv
guuugcgaagcccac

SEQ ID NO: 3315015 - RNA, 14 nt, Mycobacterium tuberculosis H37Rv
guuugcgaugccca

SEQ ID NO: 3315016 - RNA, 11 nt, Mycobacterium tuberculosis H37Rv
guuuggccagu

SEQ ID NO: 3315017 - RNA, 12 nt, Mycobacterium tuberculosis H37Rv
guuuggcggcag

SEQ ID NO: 3315018 - RNA, 15 nt, Mycobacterium tuberculosis H37Rv
guuuggguuuuguuu

SEQ ID NO: 3315019 - RNA, 23 nt, Mycobacterium tuberculosis H37Rv
guuugucgucgucgucuugguug

SEQ ID NO: 3315020 - RNA, 15 nt, Mycobacterium tuberculosis H37Rv
guuuguuccgugcgg

SEQ ID NO: 3315021 - RNA, 12 nt, Mycobacterium tuberculosis H37Rv
guuuguuuuguc

SEQ ID NO: 3315022 - RNA, 20 nt, Mycobacterium tuberculosis H37Rv
guuuucagagccgggcuggc

SEQ ID NO: 3315023 - RNA, 15 nt, Mycobacterium tuberculosis H37Rv
guuuucgaucuggcu

SEQ ID NO: 3315024 - RNA, 12 nt, Mycobacterium tuberculosis H37Rv
uacccagcgccc

SEQ ID NO: 3315025 - RNA, 17 nt, Mycobacterium tuberculosis H37Rv
uacccaucgccacaccc

SEQ ID NO: 3315026 - RNA, 18 nt, Mycobacterium tuberculosis H37Rv
uaccccagaccgccacac

SEQ ID NO: 3315027 - RNA, 20 nt, Mycobacterium tuberculosis H37Rv
uaccccagaccgccacacgg

SEQ ID NO: 3315028 - RNA, 15 nt, Mycobacterium tuberculosis H37Rv
uaccccagcgcuguc

SEQ ID NO: 3315029 - RNA, 15 nt, Mycobacterium tuberculosis H37Rv
uacccccgauggcgu

SEQ ID NO: 3315030 - RNA, 21 nt, Mycobacterium tuberculosis H37Rv
uacccgaccagcaccagaacc

SEQ ID NO: 3315031 - RNA, 23 nt, Mycobacterium tuberculosis H37Rv
uacccgcccacggcaccaccaag

SEQ ID NO: 3315032 - RNA, 12 nt, Mycobacterium tuberculosis H37Rv
uacccggcgacg

SEQ ID NO: 3315033 - RNA, 14 nt, Mycobacterium tuberculosis H37Rv
uacccgggccaggc

SEQ ID NO: 3315034 - RNA, 16 nt, Mycobacterium tuberculosis H37Rv
uacccgggccaggcug

SEQ ID NO: 3315035 - RNA, 15 nt, Mycobacterium tuberculosis H37Rv
uacccguagcaccac

SEQ ID NO: 3315036 - RNA, 11 nt, Mycobacterium tuberculosis H37Rv
uacccuuugca

SEQ ID NO: 3315037 - RNA, 13 nt, Mycobacterium tuberculosis H37Rv
uaccgaacagugg

SEQ ID NO: 3315038 - RNA, 14 nt, Mycobacterium tuberculosis H37Rv
uaccgaagcggauc

SEQ ID NO: 3315039 - RNA, 14 nt, Mycobacterium tuberculosis H37Rv
uaccgacaccgugu

SEQ ID NO: 3315040 - RNA, 17 nt, Mycobacterium tuberculosis H37Rv
uaccgagaucaccgcca

SEQ ID NO: 3315041 - RNA, 19 nt, Mycobacterium tuberculosis H37Rv
uaccgagauugggcuggga

SEQ ID NO: 3315042 - RNA, 23 nt, Mycobacterium tuberculosis H37Rv
uaccgagcacaucgccacaacgc

SEQ ID NO: 3315043 - RNA, 13 nt, Mycobacterium tuberculosis H37Rv
uaccgagcagcag

SEQ ID NO: 3315044 - RNA, 14 nt, Mycobacterium tuberculosis H37Rv
uaccgaucagcagg

SEQ ID NO: 3315045 - RNA, 19 nt, Mycobacterium tuberculosis H37Rv
uaccgaugguggugccaac

SEQ ID NO: 3315046 - RNA, 18 nt, Mycobacterium tuberculosis H37Rv
uaccgcaauggcggccuu

SEQ ID NO: 3315047 - RNA, 14 nt, Mycobacterium tuberculosis H37Rv
uaccgcacccuggg

SEQ ID NO: 3315048 - RNA, 14 nt, Mycobacterium tuberculosis H37Rv
uaccgccagcgcca

SEQ ID NO: 3315049 - RNA, 15 nt, Mycobacterium tuberculosis H37Rv
uaccgcccgcaccgu

SEQ ID NO: 3315050 - RNA, 18 nt, Mycobacterium tuberculosis H37Rv
uaccgcccgcgccaccgg

SEQ ID NO: 3315051 - RNA, 14 nt, Mycobacterium tuberculosis H37Rv
uaccgccgcgaccg

SEQ ID NO: 3315052 - RNA, 18 nt, Mycobacterium tuberculosis H37Rv
uaccgccggccccaccgg

SEQ ID NO: 3315053 - RNA, 21 nt, Mycobacterium tuberculosis H37Rv
uaccgccggcgccggugccgc

SEQ ID NO: 3315054 - RNA, 20 nt, Mycobacterium tuberculosis H37Rv
uaccgccgucgccgaacagc

SEQ ID NO: 3315055 - RNA, 16 nt, Mycobacterium tuberculosis H37Rv
uaccgccguugccgau

SEQ ID NO: 3315056 - RNA, 20 nt, Mycobacterium tuberculosis H37Rv
uaccgcgugcgccggggaca

SEQ ID NO: 3315057 - RNA, 17 nt, Mycobacterium tuberculosis H37Rv
uaccgcucagggugcgc

SEQ ID NO: 3315058 - RNA, 18 nt, Mycobacterium tuberculosis H37Rv
uaccgcuggaaaaucggg

SEQ ID NO: 3315059 - RNA, 18 nt, Mycobacterium tuberculosis H37Rv
uaccggacccgcugaucu

SEQ ID NO: 3315060 - RNA, 17 nt, Mycobacterium tuberculosis H37Rv
uaccggccuuuccagca

SEQ ID NO: 3315061 - RNA, 20 nt, Mycobacterium tuberculosis H37Rv
uaccggccuuuccagcaccc

SEQ ID NO: 3315062 - RNA, 20 nt, Mycobacterium tuberculosis H37Rv
uaccggcgccgcgcggcuug

SEQ ID NO: 3315063 - RNA, 16 nt, Mycobacterium tuberculosis H37Rv
uaccggcuggccaggu

SEQ ID NO: 3315064 - RNA, 15 nt, Mycobacterium tuberculosis H37Rv
uaccgggaucccacg

SEQ ID NO: 3315065 - RNA, 15 nt, Mycobacterium tuberculosis H37Rv
uaccggucagcaccu

SEQ ID NO: 3315066 - RNA, 20 nt, Mycobacterium tuberculosis H37Rv
uaccggucagcaccuccacc

SEQ ID NO: 3315067 - RNA, 14 nt, Mycobacterium tuberculosis H37Rv
uaccgucagcgccg

SEQ ID NO: 3315068 - RNA, 23 nt, Mycobacterium tuberculosis H37Rv
uaccgucaguagccacgcccaca

SEQ ID NO: 3315069 - RNA, 22 nt, Mycobacterium tuberculosis H37Rv
uaccgucgaccacuagcccagu

SEQ ID NO: 3315070 - RNA, 21 nt, Mycobacterium tuberculosis H37Rv
uaccgucgugcgugcggcgaa

SEQ ID NO: 3315071 - RNA, 16 nt, Mycobacterium tuberculosis H37Rv
uaccgugccgcccggu

SEQ ID NO: 3315072 - RNA, 19 nt, Mycobacterium tuberculosis H37Rv
uaccguguaugcauccacu

SEQ ID NO: 3315073 - RNA, 12 nt, Mycobacterium tuberculosis H37Rv
uaccucaccgaa

SEQ ID NO: 3315074 - RNA, 19 nt, Mycobacterium tuberculosis H37Rv
uaccucggccgccagcccc

SEQ ID NO: 3315075 - RNA, 15 nt, Mycobacterium tuberculosis H37Rv
uaccugguucgacuc

SEQ ID NO: 3315076 - RNA, 19 nt, Mycobacterium tuberculosis H37Rv
uaccuuggcgucgacaccc

SEQ ID NO: 3315077 - RNA, 16 nt, Mycobacterium tuberculosis H37Rv
uacgaacucaccgcca

SEQ ID NO: 3315078 - RNA, 19 nt, Mycobacterium tuberculosis H37Rv
uacgaagccgccgcgacca

SEQ ID NO: 3315079 - RNA, 16 nt, Mycobacterium tuberculosis H37Rv
uacgaccgucgcgcug

SEQ ID NO: 3315080 - RNA, 22 nt, Mycobacterium tuberculosis H37Rv
uacgacgucgcuguaggccagc

SEQ ID NO: 3315081 - RNA, 16 nt, Mycobacterium tuberculosis H37Rv
uacgacuuggugcagc

SEQ ID NO: 3315082 - RNA, 21 nt, Mycobacterium tuberculosis H37Rv
uacgacuuggugcagcgcagg

SEQ ID NO: 3315083 - RNA, 18 nt, Mycobacterium tuberculosis H37Rv
uacgaugcucagcugguc

SEQ ID NO: 3315084 - RNA, 15 nt, Mycobacterium tuberculosis H37Rv
uacgcagcaccgcug

SEQ ID NO: 3315085 - RNA, 23 nt, Mycobacterium tuberculosis H37Rv
uacgccaccggcaaucggcggca

SEQ ID NO: 3315086 - RNA, 17 nt, Mycobacterium tuberculosis H37Rv
uacgcccacuccagcag

SEQ ID NO: 3315087 - RNA, 19 nt, Mycobacterium tuberculosis H37Rv
uacgcccacuccagcagcu

SEQ ID NO: 3315088 - RNA, 14 nt, Mycobacterium tuberculosis H37Rv
uacgccuccuucgu

SEQ ID NO: 3315089 - RNA, 22 nt, Mycobacterium tuberculosis H37Rv
uacgcgacgguguagcccaucg

SEQ ID NO: 3315090 - RNA, 16 nt, Mycobacterium tuberculosis H37Rv
uacgcgcugacccgcc

SEQ ID NO: 3315091 - RNA, 13 nt, Mycobacterium tuberculosis H37Rv
uacgcggcugacg

SEQ ID NO: 3315092 - RNA, 15 nt, Mycobacterium tuberculosis H37Rv
uacgcggcugcgucg

SEQ ID NO: 3315093 - RNA, 13 nt, Mycobacterium tuberculosis H37Rv
uacggccacaccg

SEQ ID NO: 3315094 - RNA, 15 nt, Mycobacterium tuberculosis H37Rv
uacggccaccaggug

SEQ ID NO: 3315095 - RNA, 14 nt, Mycobacterium tuberculosis H37Rv
uacggcccgcaucg

SEQ ID NO: 3315096 - RNA, 13 nt, Mycobacterium tuberculosis H37Rv
uacggcgacaccc

SEQ ID NO: 3315097 - RNA, 21 nt, Mycobacterium tuberculosis H37Rv
uacggcgaugcggucggccac

SEQ ID NO: 3315098 - RNA, 12 nt, Mycobacterium tuberculosis H37Rv
uacgggcaggcc

SEQ ID NO: 3315099 - RNA, 12 nt, Mycobacterium tuberculosis H37Rv
uacgggcaguga

SEQ ID NO: 3315100 - RNA, 15 nt, Mycobacterium tuberculosis H37Rv
uacgggcagugaaca

SEQ ID NO: 3315101 - RNA, 18 nt, Mycobacterium tuberculosis H37Rv
uacgggcugacgaucucc

SEQ ID NO: 3315102 - RNA, 18 nt, Mycobacterium tuberculosis H37Rv
uacggggccgucucgccg

SEQ ID NO: 3315103 - RNA, 20 nt, Mycobacterium tuberculosis H37Rv
uacgggucggcgacgaaccg

SEQ ID NO: 3315104 - RNA, 21 nt, Mycobacterium tuberculosis H37Rv
uacgggugccgacucggccac

SEQ ID NO: 3315105 - RNA, 13 nt, Mycobacterium tuberculosis H37Rv
uacgggugucggg

SEQ ID NO: 3315106 - RNA, 19 nt, Mycobacterium tuberculosis H37Rv
uacgguagacguugccaac

SEQ ID NO: 3315107 - RNA, 15 nt, Mycobacterium tuberculosis H37Rv
uacggugaucgccgg

SEQ ID NO: 3315108 - RNA, 20 nt, Mycobacterium tuberculosis H37Rv
uacguaccacugcucgaugu

SEQ ID NO: 3315109 - RNA, 21 nt, Mycobacterium tuberculosis H37Rv
uacgucgaccgacgggucgua

SEQ ID NO: 3315110 - RNA, 21 nt, Mycobacterium tuberculosis H37Rv
uacgucgagggugaccaacgu

SEQ ID NO: 3315111 - RNA, 16 nt, Mycobacterium tuberculosis H37Rv
uacgucugcucgcgca

SEQ ID NO: 3315112 - RNA, 21 nt, Mycobacterium tuberculosis H37Rv
uacuaggcccagcacggucaa

SEQ ID NO: 3315113 - RNA, 15 nt, Mycobacterium tuberculosis H37Rv
uacuccacccaggcc

SEQ ID NO: 3315114 - RNA, 16 nt, Mycobacterium tuberculosis H37Rv
uacuccgacggcccgg

SEQ ID NO: 3315115 - RNA, 21 nt, Mycobacterium tuberculosis H37Rv
uacuccgacggcccggugagc

SEQ ID NO: 3315116 - RNA, 17 nt, Mycobacterium tuberculosis H37Rv
uacucgcggcgcggccg

SEQ ID NO: 3315117 - RNA, 22 nt, Mycobacterium tuberculosis H37Rv
uacucgcggcgcggccgcagcc

SEQ ID NO: 3315118 - RNA, 23 nt, Mycobacterium tuberculosis H37Rv
uacucggcauccaggcugucgcg

SEQ ID NO: 3315119 - RNA, 18 nt, Mycobacterium tuberculosis H37Rv
uacucggcgacugcgucg

SEQ ID NO: 3315120 - RNA, 21 nt, Mycobacterium tuberculosis H37Rv
uagccgugggccacgaugauc

SEQ ID NO: 3315121 - RNA, 14 nt, Mycobacterium tuberculosis H37Rv
uagccguucggcug

SEQ ID NO: 3315122 - RNA, 23 nt, Mycobacterium tuberculosis H37Rv
uagccguugccgccgaacagcug

SEQ ID NO: 3315123 - RNA, 19 nt, Mycobacterium tuberculosis H37Rv
uagccugcguggagcgcuu

SEQ ID NO: 3315124 - RNA, 15 nt, Mycobacterium tuberculosis H37Rv
uagccugguguacca

SEQ ID NO: 3315125 - RNA, 14 nt, Mycobacterium tuberculosis H37Rv
uagcgacagcagcg

SEQ ID NO: 3315126 - RNA, 17 nt, Mycobacterium tuberculosis H37Rv
uagcgacgccaucugcu

SEQ ID NO: 3315127 - RNA, 21 nt, Mycobacterium tuberculosis H37Rv
uagcgcaccacacuggcagug

SEQ ID NO: 3315128 - RNA, 22 nt, Mycobacterium tuberculosis H37Rv
uagcgcaccaccgucucgccgc

SEQ ID NO: 3315129 - RNA, 13 nt, Mycobacterium tuberculosis H37Rv
uagcgcacugccg

SEQ ID NO: 3315130 - RNA, 18 nt, Mycobacterium tuberculosis H37Rv
uagcgcacugccgggugg

SEQ ID NO: 3315131 - RNA, 12 nt, Mycobacterium tuberculosis H37Rv
uagcgcaucgcc

SEQ ID NO: 3315132 - RNA, 13 nt, Mycobacterium tuberculosis H37Rv
uagcgcggccagc

SEQ ID NO: 3315133 - RNA, 15 nt, Mycobacterium tuberculosis H37Rv
uagcgcggccagcag

SEQ ID NO: 3315134 - RNA, 17 nt, Mycobacterium tuberculosis H37Rv
uagcgcgggcucacaug

SEQ ID NO: 3315135 - RNA, 21 nt, Mycobacterium tuberculosis H37Rv
uagcgcuugccgcugagcccu

SEQ ID NO: 3315136 - RNA, 20 nt, Mycobacterium tuberculosis H37Rv
uagcgcuugcgaccccggcu

SEQ ID NO: 3315137 - RNA, 22 nt, Mycobacterium tuberculosis H37Rv
uagcggaccgaugacgaucggc

SEQ ID NO: 3315138 - RNA, 19 nt, Mycobacterium tuberculosis H37Rv
uagcggauucagcgucgcc

SEQ ID NO: 3315139 - RNA, 21 nt, Mycobacterium tuberculosis H37Rv
uagcggcccuucgacgaggac

SEQ ID NO: 3315140 - RNA, 23 nt, Mycobacterium tuberculosis H37Rv
uagcggcgcagcgugagugcagc

SEQ ID NO: 3315141 - RNA, 19 nt, Mycobacterium tuberculosis H37Rv
uagcggcgcccgccaccgg

SEQ ID NO: 3315142 - RNA, 14 nt, Mycobacterium tuberculosis H37Rv
uagcggcucaccgc

SEQ ID NO: 3315143 - RNA, 13 nt, Mycobacterium tuberculosis H37Rv
uagcggcugaggg

SEQ ID NO: 3315144 - RNA, 22 nt, Mycobacterium tuberculosis H37Rv
uagcggcuugaacagcugaucc

SEQ ID NO: 3315145 - RNA, 13 nt, Mycobacterium tuberculosis H37Rv
uagcggcuuggcc

SEQ ID NO: 3315146 - RNA, 17 nt, Mycobacterium tuberculosis H37Rv
uagcgggucagcugacg

SEQ ID NO: 3315147 - RNA, 16 nt, Mycobacterium tuberculosis H37Rv
uagcggucccgcggac

SEQ ID NO: 3315148 - RNA, 17 nt, Mycobacterium tuberculosis H37Rv
uagcggugugggaugag

SEQ ID NO: 3315149 - RNA, 20 nt, Mycobacterium tuberculosis H37Rv
uagcgguucaucaccgucag

SEQ ID NO: 3315150 - RNA, 19 nt, Mycobacterium tuberculosis H37Rv
uagcgguuuagccgcuugg

SEQ ID NO: 3315151 - RNA, 15 nt, Mycobacterium tuberculosis H37Rv
uagcgucuggcgaca

SEQ ID NO: 3315152 - RNA, 22 nt, Mycobacterium tuberculosis H37Rv
uagcgugguacuuucacgcucg

SEQ ID NO: 3315153 - RNA, 19 nt, Mycobacterium tuberculosis H37Rv
uagcucgcugaccuuguug

SEQ ID NO: 3315154 - RNA, 23 nt, Mycobacterium tuberculosis H37Rv
uagcucgucgaggaagaucaccu

SEQ ID NO: 3315155 - RNA, 21 nt, Mycobacterium tuberculosis H37Rv
uagcugacaccgaaccgccgc

SEQ ID NO: 3315156 - RNA, 12 nt, Mycobacterium tuberculosis H37Rv
uagcugccggcc

SEQ ID NO: 3315157 - RNA, 13 nt, Mycobacterium tuberculosis H37Rv
uagcugccggccc

SEQ ID NO: 3315158 - RNA, 12 nt, Mycobacterium tuberculosis H37Rv
uagcugcugaug

SEQ ID NO: 3315159 - RNA, 19 nt, Mycobacterium tuberculosis H37Rv
uagcuggaguaggugugcg

SEQ ID NO: 3315160 - RNA, 22 nt, Mycobacterium tuberculosis H37Rv
uagcuguuggccagccgacaac

SEQ ID NO: 3315161 - RNA, 13 nt, Mycobacterium tuberculosis H37Rv
uagcuuagcugcc

SEQ ID NO: 3315162 - RNA, 13 nt, Mycobacterium tuberculosis H37Rv
uaggacaccggca

SEQ ID NO: 3315163 - RNA, 19 nt, Mycobacterium tuberculosis H37Rv
uaggacaccgucaugccgu

SEQ ID NO: 3315164 - RNA, 13 nt, Mycobacterium tuberculosis H37Rv
uaggaccaccagc

SEQ ID NO: 3315165 - RNA, 22 nt, Mycobacterium tuberculosis H37Rv
uaggaccaccagcgcuccagca

SEQ ID NO: 3315166 - RNA, 16 nt, Mycobacterium tuberculosis H37Rv
uaggacccagccagcu

SEQ ID NO: 3315167 - RNA, 19 nt, Mycobacterium tuberculosis H37Rv
uaggacuugauaucggcgg

SEQ ID NO: 3315168 - RNA, 22 nt, Mycobacterium tuberculosis H37Rv
uaggccaagccgcggcuaggcc

SEQ ID NO: 3315169 - RNA, 16 nt, Mycobacterium tuberculosis H37Rv
uaggccaccggcgacc

SEQ ID NO: 3315170 - RNA, 14 nt, Mycobacterium tuberculosis H37Rv
uaggccaccuccga

SEQ ID NO: 3315171 - RNA, 14 nt, Mycobacterium tuberculosis H37Rv
uaggccgcgcggcg

SEQ ID NO: 3315172 - RNA, 20 nt, Mycobacterium tuberculosis H37Rv
uaggccggcggucagcagcg

SEQ ID NO: 3315173 - RNA, 22 nt, Mycobacterium tuberculosis H37Rv
uaggccguugaucgucucggcu

SEQ ID NO: 3315174 - RNA, 14 nt, Mycobacterium tuberculosis H37Rv
uaggccucggcagc

SEQ ID NO: 3315175 - RNA, 13 nt, Mycobacterium tuberculosis H37Rv
uaggcgaccagau

SEQ ID NO: 3315176 - RNA, 14 nt, Mycobacterium tuberculosis H37Rv
uaggcgaccagaua

SEQ ID NO: 3315177 - RNA, 23 nt, Mycobacterium tuberculosis H37Rv
uaggcgaccagauagaacaacgu

SEQ ID NO: 3315178 - RNA, 18 nt, Mycobacterium tuberculosis H37Rv
uaggcgauccagacgguc

SEQ ID NO: 3315179 - RNA, 16 nt, Mycobacterium tuberculosis H37Rv
uaggcgaucucacgca

SEQ ID NO: 3315180 - RNA, 23 nt, Mycobacterium tuberculosis H37Rv
uaggcggccaugucagcggccug

SEQ ID NO: 3315181 - RNA, 13 nt, Mycobacterium tuberculosis H37Rv
uaggcguugaucg

SEQ ID NO: 3315182 - RNA, 14 nt, Mycobacterium tuberculosis H37Rv
uaggcucccacucc

SEQ ID NO: 3315183 - RNA, 12 nt, Mycobacterium tuberculosis H37Rv
uagggcagcgcc

SEQ ID NO: 3315184 - RNA, 16 nt, Mycobacterium tuberculosis H37Rv
uagggccgccaucccc

SEQ ID NO: 3315185 - RNA, 18 nt, Mycobacterium tuberculosis H37Rv
uagggcgauuuccaucgc

SEQ ID NO: 3315186 - RNA, 14 nt, Mycobacterium tuberculosis H37Rv
uagggcuccaccgu

SEQ ID NO: 3315187 - RNA, 21 nt, Mycobacterium tuberculosis H37Rv
uagggcugaccgaagaagccc

SEQ ID NO: 3315188 - RNA, 18 nt, Mycobacterium tuberculosis H37Rv
uaggggcuuuugcgucug

SEQ ID NO: 3315189 - RNA, 20 nt, Mycobacterium tuberculosis H37Rv
uaggggcuuuugcgucugcu

SEQ ID NO: 3315190 - RNA, 13 nt, Mycobacterium tuberculosis H37Rv
uagggggcaaggc

SEQ ID NO: 3315191 - RNA, 17 nt, Mycobacterium tuberculosis H37Rv
uaggggucgaggucuuu

SEQ ID NO: 3315192 - RNA, 19 nt, Mycobacterium tuberculosis H37Rv
uagggugaguuccaugugc

SEQ ID NO: 3315193 - RNA, 22 nt, Mycobacterium tuberculosis H37Rv
uaggguggcgauccacaggcug

SEQ ID NO: 3315194 - RNA, 18 nt, Mycobacterium tuberculosis H37Rv
uaggucagcgggcuugcc

SEQ ID NO: 3315195 - RNA, 22 nt, Mycobacterium tuberculosis H37Rv
uaggucgcugcccgcggugugc

SEQ ID NO: 3315196 - RNA, 23 nt, Mycobacterium tuberculosis H37Rv
uaggugcucgcgaucugcucgua

SEQ ID NO: 3315197 - RNA, 18 nt, Mycobacterium tuberculosis H37Rv
uagguucaguuccaccgc

SEQ ID NO: 3315198 - RNA, 16 nt, Mycobacterium tuberculosis H37Rv
uagguugccaugccaa

SEQ ID NO: 3315199 - RNA, 20 nt, Mycobacterium tuberculosis H37Rv
uagguuuucggcggcucuag

SEQ ID NO: 3315200 - RNA, 20 nt, Mycobacterium tuberculosis H37Rv
uaguacgccgagcagacgca

SEQ ID NO: 3315201 - RNA, 21 nt, Mycobacterium tuberculosis H37Rv
uaguagugagaaaucaaaucc

SEQ ID NO: 3315202 - RNA, 17 nt, Mycobacterium tuberculosis H37Rv
uaguccccgaaccgagc

SEQ ID NO: 3315203 - RNA, 20 nt, Mycobacterium tuberculosis H37Rv
uaguccgagggcgucgccgc

SEQ ID NO: 3315204 - RNA, 16 nt, Mycobacterium tuberculosis H37Rv
uaguccgcauccgcga

SEQ ID NO: 3315205 - RNA, 16 nt, Mycobacterium tuberculosis H37Rv
uaguccgcgccgacgg

SEQ ID NO: 3315206 - RNA, 21 nt, Mycobacterium tuberculosis H37Rv
uaguccgcgccgacggccagc

SEQ ID NO: 3315207 - RNA, 22 nt, Mycobacterium tuberculosis H37Rv
uaguccggcacugcggccaguc

SEQ ID NO: 3315208 - RNA, 18 nt, Mycobacterium tuberculosis H37Rv
uagucgaauggcaacaca

SEQ ID NO: 3315209 - RNA, 23 nt, Mycobacterium tuberculosis H37Rv
uagucgacgucgauuucggcgac

SEQ ID NO: 3315210 - RNA, 16 nt, Mycobacterium tuberculosis H37Rv
uagucgccggucaggc

SEQ ID NO: 3315211 - RNA, 15 nt, Mycobacterium tuberculosis H37Rv
uagucgcgaccgcgg

SEQ ID NO: 3315212 - RNA, 15 nt, Mycobacterium tuberculosis H37Rv
uagucgcgguaggcg

SEQ ID NO: 3315213 - RNA, 17 nt, Mycobacterium tuberculosis H37Rv
uagucggccuccucguc

SEQ ID NO: 3315214 - RNA, 14 nt, Mycobacterium tuberculosis H37Rv
uagucgggcaaggc

SEQ ID NO: 3315215 - RNA, 19 nt, Mycobacterium tuberculosis H37Rv
uagucucgacaaagcggcu

SEQ ID NO: 3315216 - RNA, 20 nt, Mycobacterium tuberculosis H37Rv
ucaagcgaagagcgcacuga

SEQ ID NO: 3315217 - RNA, 16 nt, Mycobacterium tuberculosis H37Rv
ucaagcgggcuggcgu

SEQ ID NO: 3315218 - RNA, 12 nt, Mycobacterium tuberculosis H37Rv
ucaaggaagccg

SEQ ID NO: 3315219 - RNA, 18 nt, Mycobacterium tuberculosis H37Rv
ucaaggacgcaccgccag

SEQ ID NO: 3315220 - RNA, 18 nt, Mycobacterium tuberculosis H37Rv
ucaaggccaccucuucga

SEQ ID NO: 3315221 - RNA, 21 nt, Mycobacterium tuberculosis H37Rv
ucaaggccaccucuucgaucu

SEQ ID NO: 3315222 - RNA, 19 nt, Mycobacterium tuberculosis H37Rv
ucaaggcgugcacccccau

SEQ ID NO: 3315223 - RNA, 20 nt, Mycobacterium tuberculosis H37Rv
ucaagguuucgacaucacuc

SEQ ID NO: 3315224 - RNA, 20 nt, Mycobacterium tuberculosis H37Rv
ucaaguugguucaccgcgau

SEQ ID NO: 3315225 - RNA, 16 nt, Mycobacterium tuberculosis H37Rv
ucaauaguguguuugg

SEQ ID NO: 3315226 - RNA, 21 nt, Mycobacterium tuberculosis H37Rv
ucaaucgucaagaacgccacg

SEQ ID NO: 3315227 - RNA, 18 nt, Mycobacterium tuberculosis H37Rv
ucaaugaacgcgcuuggu

SEQ ID NO: 3315228 - RNA, 16 nt, Mycobacterium tuberculosis H37Rv
ucaaugcgcgcuggga

SEQ ID NO: 3315229 - RNA, 19 nt, Mycobacterium tuberculosis H37Rv
ucaaugcgcgcugggaggc

SEQ ID NO: 3315230 - RNA, 14 nt, Mycobacterium tuberculosis H37Rv
ucaaugcuggcagc

SEQ ID NO: 3315231 - RNA, 23 nt, Mycobacterium tuberculosis H37Rv
ucaauuccgcgaguagaucaucg

SEQ ID NO: 3315232 - RNA, 18 nt, Mycobacterium tuberculosis H37Rv
ucacaacgugcccaccaa

SEQ ID NO: 3315233 - RNA, 23 nt, Mycobacterium tuberculosis H37Rv
ucacaacugcccgacgaccauuc

SEQ ID NO: 3315234 - RNA, 21 nt, Mycobacterium tuberculosis H37Rv
ucacaagccccgcgcguucgg

SEQ ID NO: 3315235 - RNA, 13 nt, Mycobacterium tuberculosis H37Rv
ucacaagccugcc

SEQ ID NO: 3315236 - RNA, 15 nt, Mycobacterium tuberculosis H37Rv
ucacaccacgguugg

SEQ ID NO: 3315237 - RNA, 23 nt, Mycobacterium tuberculosis H37Rv
ucacacguuggcagcccucuggu

SEQ ID NO: 3315238 - RNA, 12 nt, Mycobacterium tuberculosis H37Rv
ucacacuggcuu

SEQ ID NO: 3315239 - RNA, 17 nt, Mycobacterium tuberculosis H37Rv
ucacaggccgccugggg

SEQ ID NO: 3315240 - RNA, 18 nt, Mycobacterium tuberculosis H37Rv
ucacaggccgccuggggg

SEQ ID NO: 3315241 - RNA, 19 nt, Mycobacterium tuberculosis H37Rv
ucacaggccgccugggggu

SEQ ID NO: 3315242 - RNA, 15 nt, Mycobacterium tuberculosis H37Rv
ucacaguucugccuu

SEQ ID NO: 3315243 - RNA, 15 nt, Mycobacterium tuberculosis H37Rv
ucacauacagcaggc

SEQ ID NO: 3315244 - RNA, 15 nt, Mycobacterium tuberculosis H37Rv
ucacauccacgcacu

SEQ ID NO: 3315245 - RNA, 19 nt, Mycobacterium tuberculosis H37Rv
ucacauccgacagcagccg

SEQ ID NO: 3315246 - RNA, 16 nt, Mycobacterium tuberculosis H37Rv
ucacaugcccgcaccg

SEQ ID NO: 3315247 - RNA, 15 nt, Mycobacterium tuberculosis H37Rv
ucacaugcgccgaaa

SEQ ID NO: 3315248 - RNA, 21 nt, Mycobacterium tuberculosis H37Rv
ucacaugcgccgaaacucaag

SEQ ID NO: 3315249 - RNA, 14 nt, Mycobacterium tuberculosis H37Rv
ucacauucagcacg

SEQ ID NO: 3315250 - RNA, 22 nt, Mycobacterium tuberculosis H37Rv
ucacauuggccaggucggccac

SEQ ID NO: 3315251 - RNA, 23 nt, Mycobacterium tuberculosis H37Rv
ucaccaaaaacccggugaccagc

SEQ ID NO: 3315252 - RNA, 15 nt, Mycobacterium tuberculosis H37Rv
ucaccaacgcgggaa

SEQ ID NO: 3315253 - RNA, 15 nt, Mycobacterium tuberculosis H37Rv
ucaccaaucugcggg

SEQ ID NO: 3315254 - RNA, 22 nt, Mycobacterium tuberculosis H37Rv
ucaccaaucugcgggccgguga

SEQ ID NO: 3315255 - RNA, 14 nt, Mycobacterium tuberculosis H37Rv
ucaccacaccggca

SEQ ID NO: 3315256 - RNA, 14 nt, Mycobacterium tuberculosis H37Rv
ucaccaccgcaccg

SEQ ID NO: 3315257 - RNA, 21 nt, Mycobacterium tuberculosis H37Rv
ucaccaccgccgccaccaccg

SEQ ID NO: 3315258 - RNA, 11 nt, Mycobacterium tuberculosis H37Rv
ucaccaccgga

SEQ ID NO: 3315259 - RNA, 12 nt, Mycobacterium tuberculosis H37Rv
ucaccaccggca

SEQ ID NO: 3315260 - RNA, 13 nt, Mycobacterium tuberculosis H37Rv
ucaccaccggcac

SEQ ID NO: 3315261 - RNA, 15 nt, Mycobacterium tuberculosis H37Rv
ucaccaccggcaccg

SEQ ID NO: 3315262 - RNA, 13 nt, Mycobacterium tuberculosis H37Rv
ucaccaccggcag

SEQ ID NO: 3315263 - RNA, 14 nt, Mycobacterium tuberculosis H37Rv
ucaccaccguggcg

SEQ ID NO: 3315264 - RNA, 17 nt, Mycobacterium tuberculosis H37Rv
ucaccacgccggucgag

SEQ ID NO: 3315265 - RNA, 13 nt, Mycobacterium tuberculosis H37Rv
ucaccacgucguc

SEQ ID NO: 3315266 - RNA, 15 nt, Mycobacterium tuberculosis H37Rv
ucaccagacgcugcc

SEQ ID NO: 3315267 - RNA, 20 nt, Mycobacterium tuberculosis H37Rv
ucaccauggcgccgcgccga

SEQ ID NO: 3315268 - RNA, 17 nt, Mycobacterium tuberculosis H37Rv
ucacccacauggugauc

SEQ ID NO: 3315269 - RNA, 17 nt, Mycobacterium tuberculosis H37Rv
ucacccacccgcaccgc

SEQ ID NO: 3315270 - RNA, 18 nt, Mycobacterium tuberculosis H37Rv
ucacccacccgcaccgcg

SEQ ID NO: 3315271 - RNA, 22 nt, Mycobacterium tuberculosis H37Rv
ucacccacccgcaccgcgguac

SEQ ID NO: 3315272 - RNA, 14 nt, Mycobacterium tuberculosis H37Rv
ucacccagccggaa

SEQ ID NO: 3315273 - RNA, 16 nt, Mycobacterium tuberculosis H37Rv
ucacccagcgccgacc

SEQ ID NO: 3315274 - RNA, 22 nt, Mycobacterium tuberculosis H37Rv
ucacccagcucgcgcacccagc

SEQ ID NO: 3315275 - RNA, 21 nt, Mycobacterium tuberculosis H37Rv
ucacccagcugggucccgcug

SEQ ID NO: 3315276 - RNA, 19 nt, Mycobacterium tuberculosis H37Rv
ucacccccuggacuucggg

SEQ ID NO: 3315277 - RNA, 20 nt, Mycobacterium tuberculosis H37Rv
ucaccccggcggccaucccg

SEQ ID NO: 3315278 - RNA, 12 nt, Mycobacterium tuberculosis H37Rv
ucaccccggugg

SEQ ID NO: 3315279 - RNA, 14 nt, Mycobacterium tuberculosis H37Rv
ucaccccuucgcca

SEQ ID NO: 3315280 - RNA, 16 nt, Mycobacterium tuberculosis H37Rv
ucaccccuucgccagc

SEQ ID NO: 3315281 - RNA, 13 nt, Mycobacterium tuberculosis H37Rv
ucacccgcaucgg

SEQ ID NO: 3315282 - RNA, 14 nt, Mycobacterium tuberculosis H37Rv
ucacccgcaucggc

SEQ ID NO: 3315283 - RNA, 14 nt, Mycobacterium tuberculosis H37Rv
ucacccgcccggaa

SEQ ID NO: 3315284 - RNA, 13 nt, Mycobacterium tuberculosis H37Rv
ucacccgcgagau

SEQ ID NO: 3315285 - RNA, 14 nt, Mycobacterium tuberculosis H37Rv
ucacccggucaacg

SEQ ID NO: 3315286 - RNA, 20 nt, Mycobacterium tuberculosis H37Rv
ucacccggucaacgugaacu

SEQ ID NO: 3315287 - RNA, 21 nt, Mycobacterium tuberculosis H37Rv
ucacccgguguccagugcauu

SEQ ID NO: 3315288 - RNA, 21 nt, Mycobacterium tuberculosis H37Rv
ucacccguguucgccacaccc

SEQ ID NO: 3315289 - RNA, 13 nt, Mycobacterium tuberculosis H37Rv
ucacccucccgca

SEQ ID NO: 3315290 - RNA, 17 nt, Mycobacterium tuberculosis H37Rv
ucacccugucgcgcacc

SEQ ID NO: 3315291 - RNA, 19 nt, Mycobacterium tuberculosis H37Rv
ucacccugucgcgcaccgg

SEQ ID NO: 3315292 - RNA, 20 nt, Mycobacterium tuberculosis H37Rv
ucaccgaaacgaugcggccu

SEQ ID NO: 3315293 - RNA, 19 nt, Mycobacterium tuberculosis H37Rv
ucaccgaacgacccuggcc

SEQ ID NO: 3315294 - RNA, 16 nt, Mycobacterium tuberculosis H37Rv
ucaccgaauaccgccg

SEQ ID NO: 3315295 - RNA, 22 nt, Mycobacterium tuberculosis H37Rv
ucaccgaaugcgggucugcggu

SEQ ID NO: 3315296 - RNA, 12 nt, Mycobacterium tuberculosis H37Rv
ucaccgacaccg

SEQ ID NO: 3315297 - RNA, 15 nt, Mycobacterium tuberculosis H37Rv
ucaccgacgacgcgc

SEQ ID NO: 3315298 - RNA, 19 nt, Mycobacterium tuberculosis H37Rv
ucaccgagucgacggccag

SEQ ID NO: 3315299 - RNA, 22 nt, Mycobacterium tuberculosis H37Rv
ucaccgaucccgcggccgggcc

SEQ ID NO: 3315300 - RNA, 17 nt, Mycobacterium tuberculosis H37Rv
ucaccgccaccaccagg

SEQ ID NO: 3315301 - RNA, 19 nt, Mycobacterium tuberculosis H37Rv
ucaccgccaccaccagggc

SEQ ID NO: 3315302 - RNA, 14 nt, Mycobacterium tuberculosis H37Rv
ucaccgccagcccc

SEQ ID NO: 3315303 - RNA, 17 nt, Mycobacterium tuberculosis H37Rv
ucaccgccauugccacc

SEQ ID NO: 3315304 - RNA, 18 nt, Mycobacterium tuberculosis H37Rv
ucaccgccgcgaccgccu

SEQ ID NO: 3315305 - RNA, 17 nt, Mycobacterium tuberculosis H37Rv
ucaccgccggcaccgcc

SEQ ID NO: 3315306 - RNA, 18 nt, Mycobacterium tuberculosis H37Rv
ucaccgccgggaugccgg

SEQ ID NO: 3315307 - RNA, 15 nt, Mycobacterium tuberculosis H37Rv
ucaccgccgucaccg

SEQ ID NO: 3315308 - RNA, 19 nt, Mycobacterium tuberculosis H37Rv
ucaccgccgucaccgccau

SEQ ID NO: 3315309 - RNA, 17 nt, Mycobacterium tuberculosis H37Rv
ucaccgccguugccgcc

SEQ ID NO: 3315310 - RNA, 17 nt, Mycobacterium tuberculosis H37Rv
ucaccgccuuugccgcc

SEQ ID NO: 3315311 - RNA, 21 nt, Mycobacterium tuberculosis H37Rv
ucaccgccuuugccgccggca

SEQ ID NO: 3315312 - RNA, 22 nt, Mycobacterium tuberculosis H37Rv
ucagaaggaucagcgcacuggc

SEQ ID NO: 3315313 - RNA, 22 nt, Mycobacterium tuberculosis H37Rv
ucagaaucaggcucgccgaugc

SEQ ID NO: 3315314 - RNA, 13 nt, Mycobacterium tuberculosis H37Rv
ucagaaucugccu

SEQ ID NO: 3315315 - RNA, 18 nt, Mycobacterium tuberculosis H37Rv
ucagaauugugugcagca

SEQ ID NO: 3315316 - RNA, 14 nt, Mycobacterium tuberculosis H37Rv
ucagacaacaacac

SEQ ID NO: 3315317 - RNA, 19 nt, Mycobacterium tuberculosis H37Rv
ucagacccagcgcggcaac

SEQ ID NO: 3315318 - RNA, 12 nt, Mycobacterium tuberculosis H37Rv
ucagaccgcgaa

SEQ ID NO: 3315319 - RNA, 13 nt, Mycobacterium tuberculosis H37Rv
ucagacgauucgg

SEQ ID NO: 3315320 - RNA, 18 nt, Mycobacterium tuberculosis H37Rv
ucagacgauucggcggcc

SEQ ID NO: 3315321 - RNA, 15 nt, Mycobacterium tuberculosis H37Rv
ucagacggcgucugc

SEQ ID NO: 3315322 - RNA, 13 nt, Mycobacterium tuberculosis H37Rv
ucagacucugccg

SEQ ID NO: 3315323 - RNA, 15 nt, Mycobacterium tuberculosis H37Rv
ucagagacagcagcg

SEQ ID NO: 3315324 - RNA, 19 nt, Mycobacterium tuberculosis H37Rv
ucagaggucgccggcacac

SEQ ID NO: 3315325 - RNA, 13 nt, Mycobacterium tuberculosis H37Rv
ucagauagucgcc

SEQ ID NO: 3315326 - RNA, 12 nt, Mycobacterium tuberculosis H37Rv
ucagauccggcc

SEQ ID NO: 3315327 - RNA, 13 nt, Mycobacterium tuberculosis H37Rv
ucagaugcgcggg

SEQ ID NO: 3315328 - RNA, 13 nt, Mycobacterium tuberculosis H37Rv
ucagauggccacc

SEQ ID NO: 3315329 - RNA, 20 nt, Mycobacterium tuberculosis H37Rv
ucagauggccacccgcggaa

SEQ ID NO: 3315330 - RNA, 18 nt, Mycobacterium tuberculosis H37Rv
ucagcaacaacgucugca

SEQ ID NO: 3315331 - RNA, 21 nt, Mycobacterium tuberculosis H37Rv
ucagcaacaacgucugcagcc

SEQ ID NO: 3315332 - RNA, 19 nt, Mycobacterium tuberculosis H37Rv
ucagcaacucggccacggc

SEQ ID NO: 3315333 - RNA, 20 nt, Mycobacterium tuberculosis H37Rv
ucagcaagaucggcagcgug

SEQ ID NO: 3315334 - RNA, 21 nt, Mycobacterium tuberculosis H37Rv
ucagcaagaucggcagcgugg

SEQ ID NO: 3315335 - RNA, 22 nt, Mycobacterium tuberculosis H37Rv
ucagcaauacggcggcgccgcc

SEQ ID NO: 3315336 - RNA, 15 nt, Mycobacterium tuberculosis H37Rv
ucagcaccaccagca

SEQ ID NO: 3315337 - RNA, 16 nt, Mycobacterium tuberculosis H37Rv
ucagcaccaccagcag

SEQ ID NO: 3315338 - RNA, 16 nt, Mycobacterium tuberculosis H37Rv
ucagcacccaccgaag

SEQ ID NO: 3315339 - RNA, 21 nt, Mycobacterium tuberculosis H37Rv
ucagcaccccauggccaccga

SEQ ID NO: 3315340 - RNA, 22 nt, Mycobacterium tuberculosis H37Rv
ucagcaccgcuacgaccaauag

SEQ ID NO: 3315341 - RNA, 17 nt, Mycobacterium tuberculosis H37Rv
ucagcacgccgggugcc

SEQ ID NO: 3315342 - RNA, 22 nt, Mycobacterium tuberculosis H37Rv
ucagcacguuguucagcccgcc

SEQ ID NO: 3315343 - RNA, 20 nt, Mycobacterium tuberculosis H37Rv
ucagcagaauccugcgcugc

SEQ ID NO: 3315344 - RNA, 12 nt, Mycobacterium tuberculosis H37Rv
ucagcagcagcg

SEQ ID NO: 3315345 - RNA, 14 nt, Mycobacterium tuberculosis H37Rv
ucagcagcgccagc

SEQ ID NO: 3315346 - RNA, 12 nt, Mycobacterium tuberculosis H37Rv
ucagcagcgccg

SEQ ID NO: 3315347 - RNA, 22 nt, Mycobacterium tuberculosis H37Rv
ucagcaggagaucaacauccug

SEQ ID NO: 3315348 - RNA, 14 nt, Mycobacterium tuberculosis H37Rv
ucagcaggcccagc

SEQ ID NO: 3315349 - RNA, 21 nt, Mycobacterium tuberculosis H37Rv
ucagcaggcccuucaguucga

SEQ ID NO: 3315350 - RNA, 23 nt, Mycobacterium tuberculosis H37Rv
ucagcagugggaugaagaacgcg

SEQ ID NO: 3315351 - RNA, 17 nt, Mycobacterium tuberculosis H37Rv
ucagcaugguccacagc

SEQ ID NO: 3315352 - RNA, 18 nt, Mycobacterium tuberculosis H37Rv
ucagcaugguccacagcc

SEQ ID NO: 3315353 - RNA, 19 nt, Mycobacterium tuberculosis H37Rv
ucagccaccaucuggaugg

SEQ ID NO: 3315354 - RNA, 22 nt, Mycobacterium tuberculosis H37Rv
ucagccaccgcaugugggaacu

SEQ ID NO: 3315355 - RNA, 12 nt, Mycobacterium tuberculosis H37Rv
ucagccaccggu

SEQ ID NO: 3315356 - RNA, 13 nt, Mycobacterium tuberculosis H37Rv
ucagccaccggug

SEQ ID NO: 3315357 - RNA, 14 nt, Mycobacterium tuberculosis H37Rv
ucagccaccgguga

SEQ ID NO: 3315358 - RNA, 19 nt, Mycobacterium tuberculosis H37Rv
ucagccacgcagcacggca

SEQ ID NO: 3315359 - RNA, 21 nt, Mycobacterium tuberculosis H37Rv
ucagccaggccagugccaccu

SEQ ID NO: 3315360 - RNA, 22 nt, Mycobacterium tuberculosis H37Rv
ucagccagggucccgccgccug

SEQ ID NO: 3315361 - RNA, 12 nt, Mycobacterium tuberculosis H37Rv
ucagccaggugu

SEQ ID NO: 3315362 - RNA, 21 nt, Mycobacterium tuberculosis H37Rv
ucagcccagccaacucaggcc

SEQ ID NO: 3315363 - RNA, 18 nt, Mycobacterium tuberculosis H37Rv
ucagccccgacugcgccc

SEQ ID NO: 3315364 - RNA, 14 nt, Mycobacterium tuberculosis H37Rv
ucagcccgccggac

SEQ ID NO: 3315365 - RNA, 16 nt, Mycobacterium tuberculosis H37Rv
ucagcccgccggaccc

SEQ ID NO: 3315366 - RNA, 23 nt, Mycobacterium tuberculosis H37Rv
ucagcccggccuugccgccggcu

SEQ ID NO: 3315367 - RNA, 17 nt, Mycobacterium tuberculosis H37Rv
ucagcccggcgcgaucc

SEQ ID NO: 3315368 - RNA, 18 nt, Mycobacterium tuberculosis H37Rv
ucagcccggcgcgccgag

SEQ ID NO: 3315369 - RNA, 18 nt, Mycobacterium tuberculosis H37Rv
ucagcccgucagccgaug

SEQ ID NO: 3315370 - RNA, 16 nt, Mycobacterium tuberculosis H37Rv
ucagccgaccgaccug

SEQ ID NO: 3315371 - RNA, 14 nt, Mycobacterium tuberculosis H37Rv
ucagccgcgccggg

SEQ ID NO: 3315372 - RNA, 18 nt, Mycobacterium tuberculosis H37Rv
ucagccgcgccggguccg

SEQ ID NO: 3315373 - RNA, 13 nt, Mycobacterium tuberculosis H37Rv
ucagccgcgcgcc

SEQ ID NO: 3315374 - RNA, 22 nt, Mycobacterium tuberculosis H37Rv
ucagccgcgcgggucacgaccu

SEQ ID NO: 3315375 - RNA, 21 nt, Mycobacterium tuberculosis H37Rv
ucagccgcggcggcagcaccc

SEQ ID NO: 3315376 - RNA, 15 nt, Mycobacterium tuberculosis H37Rv
ucagccggaccacca

SEQ ID NO: 3315377 - RNA, 16 nt, Mycobacterium tuberculosis H37Rv
ucagccggaccaccag

SEQ ID NO: 3315378 - RNA, 22 nt, Mycobacterium tuberculosis H37Rv
ucagccggcggcuggucucugg

SEQ ID NO: 3315379 - RNA, 21 nt, Mycobacterium tuberculosis H37Rv
ucagccgggugcgcacccggg

SEQ ID NO: 3315380 - RNA, 22 nt, Mycobacterium tuberculosis H37Rv
ucagccggugacaaguggugcc

SEQ ID NO: 3315381 - RNA, 16 nt, Mycobacterium tuberculosis H37Rv
ucagccgguggucugc

SEQ ID NO: 3315382 - RNA, 17 nt, Mycobacterium tuberculosis H37Rv
ucagccgguggucugcg

SEQ ID NO: 3315383 - RNA, 16 nt, Mycobacterium tuberculosis H37Rv
ucagccguacgccgua

SEQ ID NO: 3315384 - RNA, 15 nt, Mycobacterium tuberculosis H37Rv
ucagccguggcaguc

SEQ ID NO: 3315385 - RNA, 21 nt, Mycobacterium tuberculosis H37Rv
ucagccugauauccgcggauc

SEQ ID NO: 3315386 - RNA, 14 nt, Mycobacterium tuberculosis H37Rv
ucagcgaaccaccg

SEQ ID NO: 3315387 - RNA, 17 nt, Mycobacterium tuberculosis H37Rv
ucagcgaaccaccggcg

SEQ ID NO: 3315388 - RNA, 22 nt, Mycobacterium tuberculosis H37Rv
ucagcgaaccaccggcgccgcc

SEQ ID NO: 3315389 - RNA, 22 nt, Mycobacterium tuberculosis H37Rv
ucagcgaccacgucaagaagaa

SEQ ID NO: 3315390 - RNA, 22 nt, Mycobacterium tuberculosis H37Rv
ucagcgaccucacugcggcgcc

SEQ ID NO: 3315391 - RNA, 16 nt, Mycobacterium tuberculosis H37Rv
ucagcgauccucgccg

SEQ ID NO: 3315392 - RNA, 16 nt, Mycobacterium tuberculosis H37Rv
ucagcgauuccacggc

SEQ ID NO: 3315393 - RNA, 21 nt, Mycobacterium tuberculosis H37Rv
ucagcgcacuggccgcuaucc

SEQ ID NO: 3315394 - RNA, 14 nt, Mycobacterium tuberculosis H37Rv
ucagcgcagcaucg

SEQ ID NO: 3315395 - RNA, 20 nt, Mycobacterium tuberculosis H37Rv
ucagcgcaucgccgcuggcc

SEQ ID NO: 3315396 - RNA, 14 nt, Mycobacterium tuberculosis H37Rv
ucagcgccagcgcc

SEQ ID NO: 3315397 - RNA, 22 nt, Mycobacterium tuberculosis H37Rv
ucagcgccgcauucgcgacaac

SEQ ID NO: 3315398 - RNA, 21 nt, Mycobacterium tuberculosis H37Rv
ucagcgccgcgccccagacgc

SEQ ID NO: 3315399 - RNA, 21 nt, Mycobacterium tuberculosis H37Rv
ucagcgcgaccgucaggguca

SEQ ID NO: 3315400 - RNA, 17 nt, Mycobacterium tuberculosis H37Rv
ucagcgcgcacacggcu

SEQ ID NO: 3315401 - RNA, 21 nt, Mycobacterium tuberculosis H37Rv
ucagcgcgcgccgcuggguga

SEQ ID NO: 3315402 - RNA, 23 nt, Mycobacterium tuberculosis H37Rv
ucagcgcggcacggugugcggca

SEQ ID NO: 3315403 - RNA, 16 nt, Mycobacterium tuberculosis H37Rv
ucagcgcgguccaucc

SEQ ID NO: 3315404 - RNA, 12 nt, Mycobacterium tuberculosis H37Rv
ucagcgcuggca

SEQ ID NO: 3315405 - RNA, 18 nt, Mycobacterium tuberculosis H37Rv
ucagcggauccagaaacu

SEQ ID NO: 3315406 - RNA, 18 nt, Mycobacterium tuberculosis H37Rv
ucagcggcaacgaucgac

SEQ ID NO: 3315407 - RNA, 15 nt, Mycobacterium tuberculosis H37Rv
ucagcggccaaccca

SEQ ID NO: 3315408 - RNA, 19 nt, Mycobacterium tuberculosis H37Rv
ucaucgauccucgcccgca

SEQ ID NO: 3315409 - RNA, 15 nt, Mycobacterium tuberculosis H37Rv
ucaucgccagcggca

SEQ ID NO: 3315410 - RNA, 15 nt, Mycobacterium tuberculosis H37Rv
ucaucgcgcacgccc

SEQ ID NO: 3315411 - RNA, 16 nt, Mycobacterium tuberculosis H37Rv
ucaucgcgcacgcccu

SEQ ID NO: 3315412 - RNA, 22 nt, Mycobacterium tuberculosis H37Rv
ucaucgcggcgaacaucaccgu

SEQ ID NO: 3315413 - RNA, 20 nt, Mycobacterium tuberculosis H37Rv
ucaucggcaucgacugccag

SEQ ID NO: 3315414 - RNA, 15 nt, Mycobacterium tuberculosis H37Rv
ucaucggcuggccgc

SEQ ID NO: 3315415 - RNA, 20 nt, Mycobacterium tuberculosis H37Rv
ucaucgggguggccaccagc

SEQ ID NO: 3315416 - RNA, 13 nt, Mycobacterium tuberculosis H37Rv
ucaucguggggau

SEQ ID NO: 3315417 - RNA, 22 nt, Mycobacterium tuberculosis H37Rv
ucaucucgguggacggcaggcg

SEQ ID NO: 3315418 - RNA, 20 nt, Mycobacterium tuberculosis H37Rv
ucaucucggugguggccaug

SEQ ID NO: 3315419 - RNA, 13 nt, Mycobacterium tuberculosis H37Rv
ucaugaacaucgg

SEQ ID NO: 3315420 - RNA, 18 nt, Mycobacterium tuberculosis H37Rv
ucaugaacgccagcagcg

SEQ ID NO: 3315421 - RNA, 18 nt, Mycobacterium tuberculosis H37Rv
ucaugacgagccgagccu

SEQ ID NO: 3315422 - RNA, 17 nt, Mycobacterium tuberculosis H37Rv
ucaugcaaaagccgcga

SEQ ID NO: 3315423 - RNA, 23 nt, Mycobacterium tuberculosis H37Rv
ucaugccgacgacaacagccagc

SEQ ID NO: 3315424 - RNA, 19 nt, Mycobacterium tuberculosis H37Rv
ucaugcuaggccaccggcg

SEQ ID NO: 3315425 - RNA, 21 nt, Mycobacterium tuberculosis H37Rv
ucaugcuggaaguugugcgca

SEQ ID NO: 3315426 - RNA, 17 nt, Mycobacterium tuberculosis H37Rv
ucauggcgaaccgucag

SEQ ID NO: 3315427 - RNA, 18 nt, Mycobacterium tuberculosis H37Rv
ucauggcgaguacggccu

SEQ ID NO: 3315428 - RNA, 12 nt, Mycobacterium tuberculosis H37Rv
ucaugggaucag

SEQ ID NO: 3315429 - RNA, 14 nt, Mycobacterium tuberculosis H37Rv
ucaugggaucaggc

SEQ ID NO: 3315430 - RNA, 14 nt, Mycobacterium tuberculosis H37Rv
ucauggucagcaga

SEQ ID NO: 3315431 - RNA, 18 nt, Mycobacterium tuberculosis H37Rv
ucaugguggggaccgcga

SEQ ID NO: 3315432 - RNA, 19 nt, Mycobacterium tuberculosis H37Rv
ucauguccauagccggcau

SEQ ID NO: 3315433 - RNA, 24 nt, Mycobacterium tuberculosis H37Rv
ucaugucgaagaaccggccgacga

SEQ ID NO: 3315434 - RNA, 14 nt, Mycobacterium tuberculosis H37Rv
ucauguucggccac

SEQ ID NO: 3315435 - RNA, 23 nt, Mycobacterium tuberculosis H37Rv
ucauucgugggaaccaccagcac

SEQ ID NO: 3315436 - RNA, 16 nt, Mycobacterium tuberculosis H37Rv
ucauugcaucugccaa

SEQ ID NO: 3315437 - RNA, 12 nt, Mycobacterium tuberculosis H37Rv
ucauugcccuug

SEQ ID NO: 3315438 - RNA, 16 nt, Mycobacterium tuberculosis H37Rv
uccaaaaaguagcugc

SEQ ID NO: 3315439 - RNA, 17 nt, Mycobacterium tuberculosis H37Rv
uccaaaagccucagccg

SEQ ID NO: 3315440 - RNA, 14 nt, Mycobacterium tuberculosis H37Rv
uccaaaucgguggc

SEQ ID NO: 3315441 - RNA, 19 nt, Mycobacterium tuberculosis H37Rv
uccaacaacuccagcaggu

SEQ ID NO: 3315442 - RNA, 21 nt, Mycobacterium tuberculosis H37Rv
uccaacaggccuaggucgacg

SEQ ID NO: 3315443 - RNA, 18 nt, Mycobacterium tuberculosis H37Rv
uccaacccaggguggcga

SEQ ID NO: 3315444 - RNA, 13 nt, Mycobacterium tuberculosis H37Rv
uccaaccccagcg

SEQ ID NO: 3315445 - RNA, 22 nt, Mycobacterium tuberculosis H37Rv
uccaacgcacacaccguaccga

SEQ ID NO: 3315446 - RNA, 14 nt, Mycobacterium tuberculosis H37Rv
uccaacgcggcgcg

SEQ ID NO: 3315447 - RNA, 13 nt, Mycobacterium tuberculosis H37Rv
uccaacucggcca

SEQ ID NO: 3315448 - RNA, 15 nt, Mycobacterium tuberculosis H37Rv
uccaacuggccgcgu

SEQ ID NO: 3315449 - RNA, 19 nt, Mycobacterium tuberculosis H37Rv
uccaacuggccgcgucgcu

SEQ ID NO: 3315450 - RNA, 16 nt, Mycobacterium tuberculosis H37Rv
uccaagcaauuccacc

SEQ ID NO: 3315451 - RNA, 23 nt, Mycobacterium tuberculosis H37Rv
uccaagccgggugggagcagccg

SEQ ID NO: 3315452 - RNA, 23 nt, Mycobacterium tuberculosis H37Rv
uccaagcggagacugguugcgga

SEQ ID NO: 3315453 - RNA, 17 nt, Mycobacterium tuberculosis H37Rv
uccaaggcucagcagcg

SEQ ID NO: 3315454 - RNA, 15 nt, Mycobacterium tuberculosis H37Rv
uccaagugggccggc

SEQ ID NO: 3315455 - RNA, 22 nt, Mycobacterium tuberculosis H37Rv
uccaauaucgcuuucgaagaac

SEQ ID NO: 3315456 - RNA, 17 nt, Mycobacterium tuberculosis H37Rv
uccaaugcuguggcccg

SEQ ID NO: 3315457 - RNA, 19 nt, Mycobacterium tuberculosis H37Rv
uccacaauccgcucggucg

SEQ ID NO: 3315458 - RNA, 14 nt, Mycobacterium tuberculosis H37Rv
uccacaauccugaa

SEQ ID NO: 3315459 - RNA, 19 nt, Mycobacterium tuberculosis H37Rv
uccacaucaaaacggcggu

SEQ ID NO: 3315460 - RNA, 14 nt, Mycobacterium tuberculosis H37Rv
uccaccaccggcac

SEQ ID NO: 3315461 - RNA, 15 nt, Mycobacterium tuberculosis H37Rv
uccaccaccuggccg

SEQ ID NO: 3315462 - RNA, 16 nt, Mycobacterium tuberculosis H37Rv
uccaccacgcaaaagu

SEQ ID NO: 3315463 - RNA, 13 nt, Mycobacterium tuberculosis H37Rv
uccaccacgucgg

SEQ ID NO: 3315464 - RNA, 19 nt, Mycobacterium tuberculosis H37Rv
uccaccacgucgggaugcc

SEQ ID NO: 3315465 - RNA, 17 nt, Mycobacterium tuberculosis H37Rv
uccaccagccgguagcc

SEQ ID NO: 3315466 - RNA, 17 nt, Mycobacterium tuberculosis H37Rv
uccaccaggucgugccc

SEQ ID NO: 3315467 - RNA, 16 nt, Mycobacterium tuberculosis H37Rv
uccaccgaccuaccgu

SEQ ID NO: 3315468 - RNA, 19 nt, Mycobacterium tuberculosis H37Rv
uccaccgacguggccagcc

SEQ ID NO: 3315469 - RNA, 22 nt, Mycobacterium tuberculosis H37Rv
uccaccgacguggccagcccgc

SEQ ID NO: 3315470 - RNA, 21 nt, Mycobacterium tuberculosis H37Rv
uccaccgcagauccccgccac

SEQ ID NO: 3315471 - RNA, 13 nt, Mycobacterium tuberculosis H37Rv
uccaccgccgaca

SEQ ID NO: 3315472 - RNA, 17 nt, Mycobacterium tuberculosis H37Rv
uccaccgcgccgucguc

SEQ ID NO: 3315473 - RNA, 20 nt, Mycobacterium tuberculosis H37Rv
uccaccgcggcgucgccgug

SEQ ID NO: 3315474 - RNA, 21 nt, Mycobacterium tuberculosis H37Rv
uccaccgcggcgucgccgugc

SEQ ID NO: 3315475 - RNA, 13 nt, Mycobacterium tuberculosis H37Rv
uccaccggaccga

SEQ ID NO: 3315476 - RNA, 19 nt, Mycobacterium tuberculosis H37Rv
uccaccggaccgaccaccg

SEQ ID NO: 3315477 - RNA, 17 nt, Mycobacterium tuberculosis H37Rv
uccaccgggcccgccgu

SEQ ID NO: 3315478 - RNA, 16 nt, Mycobacterium tuberculosis H37Rv
uccaccgggcgucguc

SEQ ID NO: 3315479 - RNA, 14 nt, Mycobacterium tuberculosis H37Rv
uccaccgucgccgc

SEQ ID NO: 3315480 - RNA, 16 nt, Mycobacterium tuberculosis H37Rv
uccaccguuagccagg

SEQ ID NO: 3315481 - RNA, 17 nt, Mycobacterium tuberculosis H37Rv
uccaccguuagccaggu

SEQ ID NO: 3315482 - RNA, 16 nt, Mycobacterium tuberculosis H37Rv
uccacgaucacccgga

SEQ ID NO: 3315483 - RNA, 21 nt, Mycobacterium tuberculosis H37Rv
uccacgaugacgucgacaacg

SEQ ID NO: 3315484 - RNA, 21 nt, Mycobacterium tuberculosis H37Rv
uccacgcaccacgagcagccg

SEQ ID NO: 3315485 - RNA, 24 nt, Mycobacterium tuberculosis H37Rv
uccacgcaccacgagcagccgaug

SEQ ID NO: 3315486 - RNA, 18 nt, Mycobacterium tuberculosis H37Rv
uccacgccgugcuugcga

SEQ ID NO: 3315487 - RNA, 20 nt, Mycobacterium tuberculosis H37Rv
uccacgcguagcggucccgc

SEQ ID NO: 3315488 - RNA, 16 nt, Mycobacterium tuberculosis H37Rv
uccacggacggucggg

SEQ ID NO: 3315489 - RNA, 14 nt, Mycobacterium tuberculosis H37Rv
uccacggagucaac

SEQ ID NO: 3315490 - RNA, 17 nt, Mycobacterium tuberculosis H37Rv
uccacggagucaacuuc

SEQ ID NO: 3315491 - RNA, 18 nt, Mycobacterium tuberculosis H37Rv
uccacggcagcaccggug

SEQ ID NO: 3315492 - RNA, 13 nt, Mycobacterium tuberculosis H37Rv
uccacggccaggu

SEQ ID NO: 3315493 - RNA, 18 nt, Mycobacterium tuberculosis H37Rv
uccacggccaggucgacg

SEQ ID NO: 3315494 - RNA, 23 nt, Mycobacterium tuberculosis H37Rv
uccacggcgggaacggugccgau

SEQ ID NO: 3315495 - RNA, 17 nt, Mycobacterium tuberculosis H37Rv
uccacgggccgggcggu

SEQ ID NO: 3315496 - RNA, 14 nt, Mycobacterium tuberculosis H37Rv
uccacgucuccugu

SEQ ID NO: 3315497 - RNA, 17 nt, Mycobacterium tuberculosis H37Rv
uccacguucggcugcga

SEQ ID NO: 3315498 - RNA, 16 nt, Mycobacterium tuberculosis H37Rv
uccacucgaccugaug

SEQ ID NO: 3315499 - RNA, 21 nt, Mycobacterium tuberculosis H37Rv
uccacuggucaacgggaugcc

SEQ ID NO: 3315500 - RNA, 20 nt, Mycobacterium tuberculosis H37Rv
uccacuuguuguccgucgau

SEQ ID NO: 3315501 - RNA, 22 nt, Mycobacterium tuberculosis H37Rv
uccagaaccgaagccucggcau

SEQ ID NO: 3315502 - RNA, 23 nt, Mycobacterium tuberculosis H37Rv
uccagaagaagaugaucgcgaac

SEQ ID NO: 3315503 - RNA, 19 nt, Mycobacterium tuberculosis H37Rv
uccagaaggccgcaccgcc

SEQ ID NO: 3315504 - RNA, 21 nt, Mycobacterium tuberculosis H37Rv
ucccgcaaugcgagcgcgccg

SEQ ID NO: 3315505 - RNA, 17 nt, Mycobacterium tuberculosis H37Rv
ucccgcaauucgcgguc

SEQ ID NO: 3315506 - RNA, 18 nt, Mycobacterium tuberculosis H37Rv
ucccgcacggccgggucg

SEQ ID NO: 3315507 - RNA, 23 nt, Mycobacterium tuberculosis H37Rv
ucccgcaugcacgucaucggcug

SEQ ID NO: 3315508 - RNA, 13 nt, Mycobacterium tuberculosis H37Rv
ucccgcccagcag

SEQ ID NO: 3315509 - RNA, 18 nt, Mycobacterium tuberculosis H37Rv
ucccgcccagcagcaccu

SEQ ID NO: 3315510 - RNA, 19 nt, Mycobacterium tuberculosis H37Rv
ucccgccgaucgaaccgcu

SEQ ID NO: 3315511 - RNA, 13 nt, Mycobacterium tuberculosis H37Rv
ucccgccgcaccg

SEQ ID NO: 3315512 - RNA, 14 nt, Mycobacterium tuberculosis H37Rv
ucccgccgcugccg

SEQ ID NO: 3315513 - RNA, 21 nt, Mycobacterium tuberculosis H37Rv
ucccgccggcagcgucggccg

SEQ ID NO: 3315514 - RNA, 17 nt, Mycobacterium tuberculosis H37Rv
ucccgccggcuccgcca

SEQ ID NO: 3315515 - RNA, 21 nt, Mycobacterium tuberculosis H37Rv
ucccgccggcuccgccacugg

SEQ ID NO: 3315516 - RNA, 15 nt, Mycobacterium tuberculosis H37Rv
ucccgccggucacga

SEQ ID NO: 3315517 - RNA, 17 nt, Mycobacterium tuberculosis H37Rv
ucccgccgugcugcggc

SEQ ID NO: 3315518 - RNA, 15 nt, Mycobacterium tuberculosis H37Rv
ucccgccguugccgc

SEQ ID NO: 3315519 - RNA, 15 nt, Mycobacterium tuberculosis H37Rv
ucccgccuucucccg

SEQ ID NO: 3315520 - RNA, 15 nt, Mycobacterium tuberculosis H37Rv
ucccgcgagcggaug

SEQ ID NO: 3315521 - RNA, 21 nt, Mycobacterium tuberculosis H37Rv
ucccgcgaugcgcaccagcgg

SEQ ID NO: 3315522 - RNA, 15 nt, Mycobacterium tuberculosis H37Rv
ucccgcgccggcguu

SEQ ID NO: 3315523 - RNA, 13 nt, Mycobacterium tuberculosis H37Rv
ucccgcgcgggcg

SEQ ID NO: 3315524 - RNA, 19 nt, Mycobacterium tuberculosis H37Rv
ucccgcgcgggcggaucgc

SEQ ID NO: 3315525 - RNA, 18 nt, Mycobacterium tuberculosis H37Rv
ucccgcggacagcccgga

SEQ ID NO: 3315526 - RNA, 21 nt, Mycobacterium tuberculosis H37Rv
ucccgcggcaacgcggucugc

SEQ ID NO: 3315527 - RNA, 14 nt, Mycobacterium tuberculosis H37Rv
ucccgcggcaccuu

SEQ ID NO: 3315528 - RNA, 20 nt, Mycobacterium tuberculosis H37Rv
ucccgcggucgaucaggccg

SEQ ID NO: 3315529 - RNA, 19 nt, Mycobacterium tuberculosis H37Rv
ucccgcgugccacucgaug

SEQ ID NO: 3315530 - RNA, 15 nt, Mycobacterium tuberculosis H37Rv
ucccgcucgcaggcc

SEQ ID NO: 3315531 - RNA, 16 nt, Mycobacterium tuberculosis H37Rv
ucccgcucgcaggccg

SEQ ID NO: 3315532 - RNA, 20 nt, Mycobacterium tuberculosis H37Rv
ucccgcucgcaggccggcgg

SEQ ID NO: 3315533 - RNA, 20 nt, Mycobacterium tuberculosis H37Rv
ucccggauauugccaucccu

SEQ ID NO: 3315534 - RNA, 21 nt, Mycobacterium tuberculosis H37Rv
ucccggauauugccaucccuc

SEQ ID NO: 3315535 - RNA, 13 nt, Mycobacterium tuberculosis H37Rv
ucccggaugccga

SEQ ID NO: 3315536 - RNA, 13 nt, Mycobacterium tuberculosis H37Rv
ucccggccaggcc

SEQ ID NO: 3315537 - RNA, 12 nt, Mycobacterium tuberculosis H37Rv
ucccggccaggg

SEQ ID NO: 3315538 - RNA, 19 nt, Mycobacterium tuberculosis H37Rv
ucccggccaggggcgcagc

SEQ ID NO: 3315539 - RNA, 21 nt, Mycobacterium tuberculosis H37Rv
ucccggccgggucuuccggug

SEQ ID NO: 3315540 - RNA, 13 nt, Mycobacterium tuberculosis H37Rv
ucccggcgaccgg

SEQ ID NO: 3315541 - RNA, 18 nt, Mycobacterium tuberculosis H37Rv
ucccggcgaccggguccg

SEQ ID NO: 3315542 - RNA, 24 nt, Mycobacterium tuberculosis H37Rv
ucccggcgagcacccgcuggucga

SEQ ID NO: 3315543 - RNA, 14 nt, Mycobacterium tuberculosis H37Rv
ucccggcgccgcgg

SEQ ID NO: 3315544 - RNA, 16 nt, Mycobacterium tuberculosis H37Rv
ucccggcggucagcgg

SEQ ID NO: 3315545 - RNA, 19 nt, Mycobacterium tuberculosis H37Rv
ucccggcggucagcggcuc

SEQ ID NO: 3315546 - RNA, 23 nt, Mycobacterium tuberculosis H37Rv
ucccggcggucagcggcucggcg

SEQ ID NO: 3315547 - RNA, 16 nt, Mycobacterium tuberculosis H37Rv
ucccggcucggccagc

SEQ ID NO: 3315548 - RNA, 18 nt, Mycobacterium tuberculosis H37Rv
ucccgggcaguccaggca

SEQ ID NO: 3315549 - RNA, 23 nt, Mycobacterium tuberculosis H37Rv
ucccgggcccgcugggcuugggg

SEQ ID NO: 3315550 - RNA, 14 nt, Mycobacterium tuberculosis H37Rv
ucccgggccgccgc

SEQ ID NO: 3315551 - RNA, 13 nt, Mycobacterium tuberculosis H37Rv
ucccgguagcggc

SEQ ID NO: 3315552 - RNA, 14 nt, Mycobacterium tuberculosis H37Rv
ucccgguccagccc

SEQ ID NO: 3315553 - RNA, 20 nt, Mycobacterium tuberculosis H37Rv
ucccggugagggguugcggu

SEQ ID NO: 3315554 - RNA, 16 nt, Mycobacterium tuberculosis H37Rv
ucccguacgccggcgg

SEQ ID NO: 3315555 - RNA, 17 nt, Mycobacterium tuberculosis H37Rv
ucccgucgaugugcggu

SEQ ID NO: 3315556 - RNA, 14 nt, Mycobacterium tuberculosis H37Rv
ucccgucgccgccc

SEQ ID NO: 3315557 - RNA, 18 nt, Mycobacterium tuberculosis H37Rv
ucccgugcgcgcgcagcu

SEQ ID NO: 3315558 - RNA, 22 nt, Mycobacterium tuberculosis H37Rv
ucccguucggggccccgcggcg

SEQ ID NO: 3315559 - RNA, 18 nt, Mycobacterium tuberculosis H37Rv
ucccguugccgcccacua

SEQ ID NO: 3315560 - RNA, 22 nt, Mycobacterium tuberculosis H37Rv
ucccuccgacuaacggugcggu

SEQ ID NO: 3315561 - RNA, 12 nt, Mycobacterium tuberculosis H37Rv
ucccucgaucac

SEQ ID NO: 3315562 - RNA, 23 nt, Mycobacterium tuberculosis H37Rv
ucccucgguguacaccgcgcccg

SEQ ID NO: 3315563 - RNA, 17 nt, Mycobacterium tuberculosis H37Rv
ucccugaaauaccaguc

SEQ ID NO: 3315564 - RNA, 19 nt, Mycobacterium tuberculosis H37Rv
ucccugaucaaggaccgcu

SEQ ID NO: 3315565 - RNA, 20 nt, Mycobacterium tuberculosis H37Rv
ucccuggcggggaucagcga

SEQ ID NO: 3315566 - RNA, 22 nt, Mycobacterium tuberculosis H37Rv
ucccugugccagcagcagcgcc

SEQ ID NO: 3315567 - RNA, 23 nt, Mycobacterium tuberculosis H37Rv
ucccuuguggucugccagcaccc

SEQ ID NO: 3315568 - RNA, 13 nt, Mycobacterium tuberculosis H37Rv
ucccuuguucccg

SEQ ID NO: 3315569 - RNA, 16 nt, Mycobacterium tuberculosis H37Rv
ucccuuguucccgaaa

SEQ ID NO: 3315570 - RNA, 18 nt, Mycobacterium tuberculosis H37Rv
uccgaacauggccagcau

SEQ ID NO: 3315571 - RNA, 20 nt, Mycobacterium tuberculosis H37Rv
uccgaaccaccuguccggug

SEQ ID NO: 3315572 - RNA, 19 nt, Mycobacterium tuberculosis H37Rv
uccgaacggguagacccac

SEQ ID NO: 3315573 - RNA, 20 nt, Mycobacterium tuberculosis H37Rv
uccgaacucgcgggcgacca

SEQ ID NO: 3315574 - RNA, 17 nt, Mycobacterium tuberculosis H37Rv
uccgaagagccagcaac

SEQ ID NO: 3315575 - RNA, 20 nt, Mycobacterium tuberculosis H37Rv
uccgaagagccagcaacggu

SEQ ID NO: 3315576 - RNA, 11 nt, Mycobacterium tuberculosis H37Rv
uccgacaccgg

SEQ ID NO: 3315577 - RNA, 16 nt, Mycobacterium tuberculosis H37Rv
uccgacaccggcggca

SEQ ID NO: 3315578 - RNA, 19 nt, Mycobacterium tuberculosis H37Rv
uccgacaguggcucacccu

SEQ ID NO: 3315579 - RNA, 23 nt, Mycobacterium tuberculosis H37Rv
uccgacauuggccgucaucgccg

SEQ ID NO: 3315580 - RNA, 23 nt, Mycobacterium tuberculosis H37Rv
uccgaccgauaacacccgggcca

SEQ ID NO: 3315581 - RNA, 14 nt, Mycobacterium tuberculosis H37Rv
uccgacgaaccggg

SEQ ID NO: 3315582 - RNA, 15 nt, Mycobacterium tuberculosis H37Rv
uccgacgaaccggga

SEQ ID NO: 3315583 - RNA, 14 nt, Mycobacterium tuberculosis H37Rv
uccgacggccgcgg

SEQ ID NO: 3315584 - RNA, 13 nt, Mycobacterium tuberculosis H37Rv
uccgacggcggau

SEQ ID NO: 3315585 - RNA, 20 nt, Mycobacterium tuberculosis H37Rv
uccgacggcggauaaccggc

SEQ ID NO: 3315586 - RNA, 14 nt, Mycobacterium tuberculosis H37Rv
uccgacgucgacga

SEQ ID NO: 3315587 - RNA, 13 nt, Mycobacterium tuberculosis H37Rv
uccgagccgcgau

SEQ ID NO: 3315588 - RNA, 13 nt, Mycobacterium tuberculosis H37Rv
uccgagcuuggcc

SEQ ID NO: 3315589 - RNA, 16 nt, Mycobacterium tuberculosis H37Rv
uccgagcuuggccgcc

SEQ ID NO: 3315590 - RNA, 22 nt, Mycobacterium tuberculosis H37Rv
uccgaggagggccgcgaucgac

SEQ ID NO: 3315591 - RNA, 15 nt, Mycobacterium tuberculosis H37Rv
uccgaggccgccauc

SEQ ID NO: 3315592 - RNA, 14 nt, Mycobacterium tuberculosis H37Rv
uccgauaccgcgau

SEQ ID NO: 3315593 - RNA, 19 nt, Mycobacterium tuberculosis H37Rv
uccgaucaugucggccggg

SEQ ID NO: 3315594 - RNA, 20 nt, Mycobacterium tuberculosis H37Rv
uccgaucaugucggccgggg

SEQ ID NO: 3315595 - RNA, 16 nt, Mycobacterium tuberculosis H37Rv
uccgauccgcacagca

SEQ ID NO: 3315596 - RNA, 12 nt, Mycobacterium tuberculosis H37Rv
uccgauccggug

SEQ ID NO: 3315597 - RNA, 20 nt, Mycobacterium tuberculosis H37Rv
uccgaucgcguuagccaggu

SEQ ID NO: 3315598 - RNA, 14 nt, Mycobacterium tuberculosis H37Rv
uccgaucggcaauc

SEQ ID NO: 3315599 - RNA, 21 nt, Mycobacterium tuberculosis H37Rv
uccgaugaccagggucugcuc

SEQ ID NO: 3315600 - RNA, 21 nt, Mycobacterium tuberculosis H37Rv
uccggaaccgguaucgccaaa

SEQ ID NO: 3315601 - RNA, 13 nt, Mycobacterium tuberculosis H37Rv
uccggaagcggcg

SEQ ID NO: 3315602 - RNA, 14 nt, Mycobacterium tuberculosis H37Rv
uccggaaucgcccg

SEQ ID NO: 3315603 - RNA, 21 nt, Mycobacterium tuberculosis H37Rv
uccggagacucucugaucuga

SEQ ID NO: 3315604 - RNA, 23 nt, Mycobacterium tuberculosis H37Rv
uccggaucacuuucgaagaaccg

SEQ ID NO: 3315605 - RNA, 16 nt, Mycobacterium tuberculosis H37Rv
uccggaucccaccacc

SEQ ID NO: 3315606 - RNA, 20 nt, Mycobacterium tuberculosis H37Rv
uccggaucccaccaccgcuc

SEQ ID NO: 3315607 - RNA, 15 nt, Mycobacterium tuberculosis H37Rv
uccggaugcagugac

SEQ ID NO: 3315608 - RNA, 19 nt, Mycobacterium tuberculosis H37Rv
uccggauucggacucgccg

SEQ ID NO: 3315609 - RNA, 18 nt, Mycobacterium tuberculosis H37Rv
uccggauugaagucgucg

SEQ ID NO: 3315610 - RNA, 19 nt, Mycobacterium tuberculosis H37Rv
uccggauugaagucgucgg

SEQ ID NO: 3315611 - RNA, 17 nt, Mycobacterium tuberculosis H37Rv
uccggcaacagcaccag

SEQ ID NO: 3315612 - RNA, 17 nt, Mycobacterium tuberculosis H37Rv
uccggcaaccaccggcc

SEQ ID NO: 3315613 - RNA, 16 nt, Mycobacterium tuberculosis H37Rv
uccggcaagcacaccg

SEQ ID NO: 3315614 - RNA, 14 nt, Mycobacterium tuberculosis H37Rv
uccggcaccaacgc

SEQ ID NO: 3315615 - RNA, 21 nt, Mycobacterium tuberculosis H37Rv
uccggcaccaacgccaccguc

SEQ ID NO: 3315616 - RNA, 12 nt, Mycobacterium tuberculosis H37Rv
uccggcaccgcc

SEQ ID NO: 3315617 - RNA, 13 nt, Mycobacterium tuberculosis H37Rv
uccggcaccgccc

SEQ ID NO: 3315618 - RNA, 18 nt, Mycobacterium tuberculosis H37Rv
uccggcaccgcccuugcc

SEQ ID NO: 3315619 - RNA, 21 nt, Mycobacterium tuberculosis H37Rv
uccggcaccgcccuugccgcc

SEQ ID NO: 3315620 - RNA, 21 nt, Mycobacterium tuberculosis H37Rv
uccggcacugcggccagucag

SEQ ID NO: 3315621 - RNA, 11 nt, Mycobacterium tuberculosis H37Rv
uccggcagacc

SEQ ID NO: 3315622 - RNA, 22 nt, Mycobacterium tuberculosis H37Rv
uccggcagaccggugcugucga

SEQ ID NO: 3315623 - RNA, 22 nt, Mycobacterium tuberculosis H37Rv
uccggcauaccgaacagcaccu

SEQ ID NO: 3315624 - RNA, 13 nt, Mycobacterium tuberculosis H37Rv
uccggccacacuc

SEQ ID NO: 3315625 - RNA, 18 nt, Mycobacterium tuberculosis H37Rv
uccggccacacucgccag

SEQ ID NO: 3315626 - RNA, 23 nt, Mycobacterium tuberculosis H37Rv
uccggccaggggaucaccggcug

SEQ ID NO: 3315627 - RNA, 15 nt, Mycobacterium tuberculosis H37Rv
uccggcccaccgguc

SEQ ID NO: 3315628 - RNA, 19 nt, Mycobacterium tuberculosis H37Rv
uccggcccguagcugcgca

SEQ ID NO: 3315629 - RNA, 23 nt, Mycobacterium tuberculosis H37Rv
uccggcccuacgcagcgcggcug

SEQ ID NO: 3315630 - RNA, 17 nt, Mycobacterium tuberculosis H37Rv
uccggccgaugcgaccc

SEQ ID NO: 3315631 - RNA, 20 nt, Mycobacterium tuberculosis H37Rv
uccggccggccuagccgaug

SEQ ID NO: 3315632 - RNA, 19 nt, Mycobacterium tuberculosis H37Rv
uccggccgguccgggaagu

SEQ ID NO: 3315633 - RNA, 18 nt, Mycobacterium tuberculosis H37Rv
uccggccgucaucuggaa

SEQ ID NO: 3315634 - RNA, 23 nt, Mycobacterium tuberculosis H37Rv
uccggcgacucugugacgggcac

SEQ ID NO: 3315635 - RNA, 17 nt, Mycobacterium tuberculosis H37Rv
uccggcgaucucgaccg

SEQ ID NO: 3315636 - RNA, 17 nt, Mycobacterium tuberculosis H37Rv
uccggcgcacgaaaccg

SEQ ID NO: 3315637 - RNA, 20 nt, Mycobacterium tuberculosis H37Rv
uccggcgcacgaaaccgcag

SEQ ID NO: 3315638 - RNA, 20 nt, Mycobacterium tuberculosis H37Rv
uccggcgcagcgaccgguaa

SEQ ID NO: 3315639 - RNA, 22 nt, Mycobacterium tuberculosis H37Rv
uccggcgccaccgccgcugccg

SEQ ID NO: 3315640 - RNA, 14 nt, Mycobacterium tuberculosis H37Rv
uccggcgccagcag

SEQ ID NO: 3315641 - RNA, 15 nt, Mycobacterium tuberculosis H37Rv
uccggcgccagcagu

SEQ ID NO: 3315642 - RNA, 15 nt, Mycobacterium tuberculosis H37Rv
uccggcgccauucgc

SEQ ID NO: 3315643 - RNA, 14 nt, Mycobacterium tuberculosis H37Rv
uccggcgcgacgcc

SEQ ID NO: 3315644 - RNA, 23 nt, Mycobacterium tuberculosis H37Rv
uccggcgcuaugaagucgaucuc

SEQ ID NO: 3315645 - RNA, 15 nt, Mycobacterium tuberculosis H37Rv
uccggcggaucuggg

SEQ ID NO: 3315646 - RNA, 14 nt, Mycobacterium tuberculosis H37Rv
uccggcggcaggaa

SEQ ID NO: 3315647 - RNA, 15 nt, Mycobacterium tuberculosis H37Rv
uccggcggcagguag

SEQ ID NO: 3315648 - RNA, 17 nt, Mycobacterium tuberculosis H37Rv
uccggcggccacgccgg

SEQ ID NO: 3315649 - RNA, 23 nt, Mycobacterium tuberculosis H37Rv
uccggcggcgaagaagccggcaa

SEQ ID NO: 3315650 - RNA, 12 nt, Mycobacterium tuberculosis H37Rv
uccggcggggau

SEQ ID NO: 3315651 - RNA, 16 nt, Mycobacterium tuberculosis H37Rv
uccggcguacgccgua

SEQ ID NO: 3315652 - RNA, 19 nt, Mycobacterium tuberculosis H37Rv
uccggcgugcagcaccccc

SEQ ID NO: 3315653 - RNA, 22 nt, Mycobacterium tuberculosis H37Rv
uccggcguucccgccauugccg

SEQ ID NO: 3315654 - RNA, 13 nt, Mycobacterium tuberculosis H37Rv
uccggcuccaccc

SEQ ID NO: 3315655 - RNA, 14 nt, Mycobacterium tuberculosis H37Rv
uccggcuccacccc

SEQ ID NO: 3315656 - RNA, 12 nt, Mycobacterium tuberculosis H37Rv
uccggcugcggu

SEQ ID NO: 3315657 - RNA, 17 nt, Mycobacterium tuberculosis H37Rv
uccggcuggaagcggcg

SEQ ID NO: 3315658 - RNA, 17 nt, Mycobacterium tuberculosis H37Rv
uccggcuucguccaccg

SEQ ID NO: 3315659 - RNA, 18 nt, Mycobacterium tuberculosis H37Rv
uccggcuucguccaccgc

SEQ ID NO: 3315660 - RNA, 16 nt, Mycobacterium tuberculosis H37Rv
uccggcuuggcggcga

SEQ ID NO: 3315661 - RNA, 19 nt, Mycobacterium tuberculosis H37Rv
uccgggaccaggccaacgg

SEQ ID NO: 3315662 - RNA, 14 nt, Mycobacterium tuberculosis H37Rv
uccgggacggugaa

SEQ ID NO: 3315663 - RNA, 14 nt, Mycobacterium tuberculosis H37Rv
uccgggcagaugau

SEQ ID NO: 3315664 - RNA, 18 nt, Mycobacterium tuberculosis H37Rv
uccgggccgagcgcacca

SEQ ID NO: 3315665 - RNA, 20 nt, Mycobacterium tuberculosis H37Rv
uccgggccgagcgcaccacg

SEQ ID NO: 3315666 - RNA, 22 nt, Mycobacterium tuberculosis H37Rv
uccgggccgccgccccggcgcu

SEQ ID NO: 3315667 - RNA, 22 nt, Mycobacterium tuberculosis H37Rv
uccgggccgcggccacaucgcc

SEQ ID NO: 3315668 - RNA, 18 nt, Mycobacterium tuberculosis H37Rv
uccgggcgaccaccaccg

SEQ ID NO: 3315669 - RNA, 18 nt, Mycobacterium tuberculosis H37Rv
uccgggcucggcgucgcc

SEQ ID NO: 3315670 - RNA, 15 nt, Mycobacterium tuberculosis H37Rv
uccgggcugcaugcg

SEQ ID NO: 3315671 - RNA, 14 nt, Mycobacterium tuberculosis H37Rv
uccgggguggacgg

SEQ ID NO: 3315672 - RNA, 20 nt, Mycobacterium tuberculosis H37Rv
uccggguagcggcgccgccc

SEQ ID NO: 3315673 - RNA, 19 nt, Mycobacterium tuberculosis H37Rv
uccgggucaccagcgcauc

SEQ ID NO: 3315674 - RNA, 14 nt, Mycobacterium tuberculosis H37Rv
uccggguccaggaa

SEQ ID NO: 3315675 - RNA, 17 nt, Mycobacterium tuberculosis H37Rv
uccgggucgacgacguc

SEQ ID NO: 3315676 - RNA, 17 nt, Mycobacterium tuberculosis H37Rv
uccgggugcagaucgcc

SEQ ID NO: 3315677 - RNA, 17 nt, Mycobacterium tuberculosis H37Rv
uccggguuuugcgcggc

SEQ ID NO: 3315678 - RNA, 19 nt, Mycobacterium tuberculosis H37Rv
uccggguuuugcgcggcca

SEQ ID NO: 3315679 - RNA, 22 nt, Mycobacterium tuberculosis H37Rv
uccgguaaacaagacaugcuga

SEQ ID NO: 3315680 - RNA, 17 nt, Mycobacterium tuberculosis H37Rv
uccgguagcuguggugg

SEQ ID NO: 3315681 - RNA, 17 nt, Mycobacterium tuberculosis H37Rv
uccggucaacacccgcc

SEQ ID NO: 3315682 - RNA, 16 nt, Mycobacterium tuberculosis H37Rv
uccggucagcgcggcg

SEQ ID NO: 3315683 - RNA, 13 nt, Mycobacterium tuberculosis H37Rv
uccggucccgccg

SEQ ID NO: 3315684 - RNA, 23 nt, Mycobacterium tuberculosis H37Rv
uccggucgacuccagcaccagca

SEQ ID NO: 3315685 - RNA, 14 nt, Mycobacterium tuberculosis H37Rv
uccggucgcucgau

SEQ ID NO: 3315686 - RNA, 16 nt, Mycobacterium tuberculosis H37Rv
uccggucggccaggcc

SEQ ID NO: 3315687 - RNA, 15 nt, Mycobacterium tuberculosis H37Rv
uccggucggucucgg

SEQ ID NO: 3315688 - RNA, 23 nt, Mycobacterium tuberculosis H37Rv
uccggugaaccgggacagcagcc

SEQ ID NO: 3315689 - RNA, 21 nt, Mycobacterium tuberculosis H37Rv
uccggugcgccgaucccgccc

SEQ ID NO: 3315690 - RNA, 20 nt, Mycobacterium tuberculosis H37Rv
uccgguggaauccaccagcc

SEQ ID NO: 3315691 - RNA, 14 nt, Mycobacterium tuberculosis H37Rv
uccgguggaccgcc

SEQ ID NO: 3315692 - RNA, 21 nt, Mycobacterium tuberculosis H37Rv
uccgguggaccgccgaucggc

SEQ ID NO: 3315693 - RNA, 21 nt, Mycobacterium tuberculosis H37Rv
uccgguguaggccugcccccg

SEQ ID NO: 3315694 - RNA, 12 nt, Mycobacterium tuberculosis H37Rv
uccggugucgcg

SEQ ID NO: 3315695 - RNA, 22 nt, Mycobacterium tuberculosis H37Rv
uccgguguggcgcugaucggca

SEQ ID NO: 3315696 - RNA, 13 nt, Mycobacterium tuberculosis H37Rv
ucgaaaacagcga

SEQ ID NO: 3315697 - RNA, 18 nt, Mycobacterium tuberculosis H37Rv
ucgaaaaggugcaccauu

SEQ ID NO: 3315698 - RNA, 16 nt, Mycobacterium tuberculosis H37Rv
ucgaaaccgcccguau

SEQ ID NO: 3315699 - RNA, 21 nt, Mycobacterium tuberculosis H37Rv
ucgaaaccgcccguauugaug

SEQ ID NO: 3315700 - RNA, 20 nt, Mycobacterium tuberculosis H37Rv
ucgaaagcgauauuggaugc

SEQ ID NO: 3315701 - RNA, 19 nt, Mycobacterium tuberculosis H37Rv
ucgaaauccugguggcaga

SEQ ID NO: 3315702 - RNA, 17 nt, Mycobacterium tuberculosis H37Rv
ucgaaaucgcacagcgc

SEQ ID NO: 3315703 - RNA, 18 nt, Mycobacterium tuberculosis H37Rv
ucgaacaaccccgguuga

SEQ ID NO: 3315704 - RNA, 19 nt, Mycobacterium tuberculosis H37Rv
ucgaacaagaccgcggcgu

SEQ ID NO: 3315705 - RNA, 15 nt, Mycobacterium tuberculosis H37Rv
ucgaacagcaccgcc

SEQ ID NO: 3315706 - RNA, 15 nt, Mycobacterium tuberculosis H37Rv
ucgaacaggccggcc

SEQ ID NO: 3315707 - RNA, 15 nt, Mycobacterium tuberculosis H37Rv
ucgaaccgacgcguc

SEQ ID NO: 3315708 - RNA, 22 nt, Mycobacterium tuberculosis H37Rv
ucgaaccugucgaucacggccg

SEQ ID NO: 3315709 - RNA, 14 nt, Mycobacterium tuberculosis H37Rv
ucgaacgcccugac

SEQ ID NO: 3315710 - RNA, 14 nt, Mycobacterium tuberculosis H37Rv
ucgaacgcugagga

SEQ ID NO: 3315711 - RNA, 15 nt, Mycobacterium tuberculosis H37Rv
ucgaacggcuuggcg

SEQ ID NO: 3315712 - RNA, 13 nt, Mycobacterium tuberculosis H37Rv
ucgaacucggcgg

SEQ ID NO: 3315713 - RNA, 20 nt, Mycobacterium tuberculosis H37Rv
ucgaacugguuucgcaccgu

SEQ ID NO: 3315714 - RNA, 15 nt, Mycobacterium tuberculosis H37Rv
ucgaagaaccgccac

SEQ ID NO: 3315715 - RNA, 19 nt, Mycobacterium tuberculosis H37Rv
ucgaagaucgccugggggu

SEQ ID NO: 3315716 - RNA, 22 nt, Mycobacterium tuberculosis H37Rv
ucgaagcccgaguugaaggugc

SEQ ID NO: 3315717 - RNA, 12 nt, Mycobacterium tuberculosis H37Rv
ucgaagcccgga

SEQ ID NO: 3315718 - RNA, 13 nt, Mycobacterium tuberculosis H37Rv
ucgaagcgaucgc

SEQ ID NO: 3315719 - RNA, 14 nt, Mycobacterium tuberculosis H37Rv
ucgaagcggcugcu

SEQ ID NO: 3315720 - RNA, 19 nt, Mycobacterium tuberculosis H37Rv
ucgaaggaccggcaccugg

SEQ ID NO: 3315721 - RNA, 15 nt, Mycobacterium tuberculosis H37Rv
ucgaaggcacugcga

SEQ ID NO: 3315722 - RNA, 13 nt, Mycobacterium tuberculosis H37Rv
ucgaaguaauagc

SEQ ID NO: 3315723 - RNA, 16 nt, Mycobacterium tuberculosis H37Rv
ucgaaguagccgacgu

SEQ ID NO: 3315724 - RNA, 20 nt, Mycobacterium tuberculosis H37Rv
ucgaaguccgcuugggcggu

SEQ ID NO: 3315725 - RNA, 14 nt, Mycobacterium tuberculosis H37Rv
ucgaauacaccugc

SEQ ID NO: 3315726 - RNA, 14 nt, Mycobacterium tuberculosis H37Rv
ucgaauuccggcuc

SEQ ID NO: 3315727 - RNA, 14 nt, Mycobacterium tuberculosis H37Rv
ucgacaaacagcgc

SEQ ID NO: 3315728 - RNA, 15 nt, Mycobacterium tuberculosis H37Rv
ucgacaaccgcugcc

SEQ ID NO: 3315729 - RNA, 22 nt, Mycobacterium tuberculosis H37Rv
ucgacaaccgcugccgcaucgg

SEQ ID NO: 3315730 - RNA, 18 nt, Mycobacterium tuberculosis H37Rv
ucgacaacugcccgauga

SEQ ID NO: 3315731 - RNA, 16 nt, Mycobacterium tuberculosis H37Rv
ucgacacccauccucg

SEQ ID NO: 3315732 - RNA, 13 nt, Mycobacterium tuberculosis H37Rv
ucgacacccucgg

SEQ ID NO: 3315733 - RNA, 18 nt, Mycobacterium tuberculosis H37Rv
ucgacaccgagccacgac

SEQ ID NO: 3315734 - RNA, 23 nt, Mycobacterium tuberculosis H37Rv
ucgacaccgagccacgacccagc

SEQ ID NO: 3315735 - RNA, 20 nt, Mycobacterium tuberculosis H37Rv
ucgacaccgaggaccucguc

SEQ ID NO: 3315736 - RNA, 16 nt, Mycobacterium tuberculosis H37Rv
ucgacaccgcggugcc

SEQ ID NO: 3315737 - RNA, 17 nt, Mycobacterium tuberculosis H37Rv
ucgacagcagcgcgaca

SEQ ID NO: 3315738 - RNA, 16 nt, Mycobacterium tuberculosis H37Rv
ucgacagcaucacgcc

SEQ ID NO: 3315739 - RNA, 21 nt, Mycobacterium tuberculosis H37Rv
ucgacagcaucacgcccacga

SEQ ID NO: 3315740 - RNA, 17 nt, Mycobacterium tuberculosis H37Rv
ucgacaggccaccgcag

SEQ ID NO: 3315741 - RNA, 18 nt, Mycobacterium tuberculosis H37Rv
ucgacaggugccagacca

SEQ ID NO: 3315742 - RNA, 19 nt, Mycobacterium tuberculosis H37Rv
ucgacaguugcgccagcgu

SEQ ID NO: 3315743 - RNA, 16 nt, Mycobacterium tuberculosis H37Rv
ucgacauccucgaugg

SEQ ID NO: 3315744 - RNA, 13 nt, Mycobacterium tuberculosis H37Rv
ucgacaucgacaa

SEQ ID NO: 3315745 - RNA, 13 nt, Mycobacterium tuberculosis H37Rv
ucgacaucggcga

SEQ ID NO: 3315746 - RNA, 21 nt, Mycobacterium tuberculosis H37Rv
ucgacaucugagcccggucgc

SEQ ID NO: 3315747 - RNA, 22 nt, Mycobacterium tuberculosis H37Rv
ucgaccaagguguccagcaccu

SEQ ID NO: 3315748 - RNA, 17 nt, Mycobacterium tuberculosis H37Rv
ucgaccaccacccggaa

SEQ ID NO: 3315749 - RNA, 13 nt, Mycobacterium tuberculosis H37Rv
ucgaccaccgccg

SEQ ID NO: 3315750 - RNA, 14 nt, Mycobacterium tuberculosis H37Rv
ucgaccaccucgau

SEQ ID NO: 3315751 - RNA, 15 nt, Mycobacterium tuberculosis H37Rv
ucgaccacgaccguc

SEQ ID NO: 3315752 - RNA, 16 nt, Mycobacterium tuberculosis H37Rv
ucgaccagaaucgggu

SEQ ID NO: 3315753 - RNA, 18 nt, Mycobacterium tuberculosis H37Rv
ucgaccaucaucucggug

SEQ ID NO: 3315754 - RNA, 17 nt, Mycobacterium tuberculosis H37Rv
ucgaccaugccgucguc

SEQ ID NO: 3315755 - RNA, 16 nt, Mycobacterium tuberculosis H37Rv
ucgacccccgcaucgg

SEQ ID NO: 3315756 - RNA, 15 nt, Mycobacterium tuberculosis H37Rv
ucgaccgaacgccag

SEQ ID NO: 3315757 - RNA, 17 nt, Mycobacterium tuberculosis H37Rv
ucgaccgccagccgcga

SEQ ID NO: 3315758 - RNA, 15 nt, Mycobacterium tuberculosis H37Rv
ucgaccgcccgccag

SEQ ID NO: 3315759 - RNA, 16 nt, Mycobacterium tuberculosis H37Rv
ucgaccgcgacggcaa

SEQ ID NO: 3315760 - RNA, 22 nt, Mycobacterium tuberculosis H37Rv
ucgaccgcgccauagcagagcc

SEQ ID NO: 3315761 - RNA, 13 nt, Mycobacterium tuberculosis H37Rv
ucgaccgcggccc

SEQ ID NO: 3315762 - RNA, 24 nt, Mycobacterium tuberculosis H37Rv
ucgaccgcggcccggacgucggcg

SEQ ID NO: 3315763 - RNA, 22 nt, Mycobacterium tuberculosis H37Rv
ucgaccgcggccggguggcccg

SEQ ID NO: 3315764 - RNA, 19 nt, Mycobacterium tuberculosis H37Rv
ucgaccggacaaagcugcu

SEQ ID NO: 3315765 - RNA, 18 nt, Mycobacterium tuberculosis H37Rv
ucgaccguauugaccagc

SEQ ID NO: 3315766 - RNA, 19 nt, Mycobacterium tuberculosis H37Rv
ucgaccguccgggucacca

SEQ ID NO: 3315767 - RNA, 20 nt, Mycobacterium tuberculosis H37Rv
ucgaccguccgggucaccag

SEQ ID NO: 3315768 - RNA, 10 nt, Mycobacterium tuberculosis H37Rv
ucgaccgugu

SEQ ID NO: 3315769 - RNA, 17 nt, Mycobacterium tuberculosis H37Rv
ucgaccgugucaccgcc

SEQ ID NO: 3315770 - RNA, 18 nt, Mycobacterium tuberculosis H37Rv
ucgaccgugucaccgccg

SEQ ID NO: 3315771 - RNA, 16 nt, Mycobacterium tuberculosis H37Rv
ucgaccucagacagcu

SEQ ID NO: 3315772 - RNA, 16 nt, Mycobacterium tuberculosis H37Rv
ucgaccucgcgggcga

SEQ ID NO: 3315773 - RNA, 19 nt, Mycobacterium tuberculosis H37Rv
ucgaccucgucggccgaca

SEQ ID NO: 3315774 - RNA, 23 nt, Mycobacterium tuberculosis H37Rv
ucgaccugaggcaccucggccuu

SEQ ID NO: 3315775 - RNA, 16 nt, Mycobacterium tuberculosis H37Rv
ucgaccuuauugccga

SEQ ID NO: 3315776 - RNA, 15 nt, Mycobacterium tuberculosis H37Rv
ucgaccuucaccgcg

SEQ ID NO: 3315777 - RNA, 15 nt, Mycobacterium tuberculosis H37Rv
ucgaccuucgggaca

SEQ ID NO: 3315778 - RNA, 19 nt, Mycobacterium tuberculosis H37Rv
ucgacgaacaccccgggcg

SEQ ID NO: 3315779 - RNA, 15 nt, Mycobacterium tuberculosis H37Rv
ucgacgaagguggcg

SEQ ID NO: 3315780 - RNA, 15 nt, Mycobacterium tuberculosis H37Rv
ucgacgacaacgaug

SEQ ID NO: 3315781 - RNA, 22 nt, Mycobacterium tuberculosis H37Rv
ucgacgacaacgaugucacccu

SEQ ID NO: 3315782 - RNA, 21 nt, Mycobacterium tuberculosis H37Rv
ucgacgacgcccucacaacga

SEQ ID NO: 3315783 - RNA, 20 nt, Mycobacterium tuberculosis H37Rv
ucgacgagaagacaccgcgc

SEQ ID NO: 3315784 - RNA, 17 nt, Mycobacterium tuberculosis H37Rv
ucgacgagauccagcgc

SEQ ID NO: 3315785 - RNA, 13 nt, Mycobacterium tuberculosis H37Rv
ucgacgagcaccg

SEQ ID NO: 3315786 - RNA, 13 nt, Mycobacterium tuberculosis H37Rv
ucgacgagcgaua

SEQ ID NO: 3315787 - RNA, 19 nt, Mycobacterium tuberculosis H37Rv
ucgacgagcgccucaagcu

SEQ ID NO: 3315788 - RNA, 13 nt, Mycobacterium tuberculosis H37Rv
ucgacgaucucgc

SEQ ID NO: 3315789 - RNA, 16 nt, Mycobacterium tuberculosis H37Rv
ucgacgaucucuccug

SEQ ID NO: 3315790 - RNA, 20 nt, Mycobacterium tuberculosis H37Rv
ucgacgaugccguagagucg

SEQ ID NO: 3315791 - RNA, 23 nt, Mycobacterium tuberculosis H37Rv
ucgacgaugucgaagaucgagcc

SEQ ID NO: 3315792 - RNA, 13 nt, Mycobacterium tuberculosis H37Rv
ucgacgcacaccc

SEQ ID NO: 3315793 - RNA, 18 nt, Mycobacterium tuberculosis H37Rv
ucgaguaacaccccgaca

SEQ ID NO: 3315794 - RNA, 19 nt, Mycobacterium tuberculosis H37Rv
ucgaguaucucggcuccac

SEQ ID NO: 3315795 - RNA, 21 nt, Mycobacterium tuberculosis H37Rv
ucgaguauugcaggaaaucgu

SEQ ID NO: 3315796 - RNA, 22 nt, Mycobacterium tuberculosis H37Rv
ucgaguccugguaccccagcac

SEQ ID NO: 3315797 - RNA, 12 nt, Mycobacterium tuberculosis H37Rv
ucgagucgcagc

SEQ ID NO: 3315798 - RNA, 21 nt, Mycobacterium tuberculosis H37Rv
ucgaguguggcgacgcacucg

SEQ ID NO: 3315799 - RNA, 14 nt, Mycobacterium tuberculosis H37Rv
ucgaguuccggccg

SEQ ID NO: 3315800 - RNA, 18 nt, Mycobacterium tuberculosis H37Rv
ucgaguucgcagucgaug

SEQ ID NO: 3315801 - RNA, 19 nt, Mycobacterium tuberculosis H37Rv
ucgaguugcucgacacugg

SEQ ID NO: 3315802 - RNA, 19 nt, Mycobacterium tuberculosis H37Rv
ucgauaaccucagcgcggu

SEQ ID NO: 3315803 - RNA, 16 nt, Mycobacterium tuberculosis H37Rv
ucgauaaccuggcggu

SEQ ID NO: 3315804 - RNA, 16 nt, Mycobacterium tuberculosis H37Rv
ucgauacccaggaugu

SEQ ID NO: 3315805 - RNA, 17 nt, Mycobacterium tuberculosis H37Rv
ucgauagcccgccaccc

SEQ ID NO: 3315806 - RNA, 23 nt, Mycobacterium tuberculosis H37Rv
ucgaucaacaccaacgacagcga

SEQ ID NO: 3315807 - RNA, 12 nt, Mycobacterium tuberculosis H37Rv
ucgaucaccgac

SEQ ID NO: 3315808 - RNA, 12 nt, Mycobacterium tuberculosis H37Rv
ucgaucaccgcu

SEQ ID NO: 3315809 - RNA, 13 nt, Mycobacterium tuberculosis H37Rv
ucgaucaccugca

SEQ ID NO: 3315810 - RNA, 23 nt, Mycobacterium tuberculosis H37Rv
ucgaucacuguuccgggugccgc

SEQ ID NO: 3315811 - RNA, 18 nt, Mycobacterium tuberculosis H37Rv
ucgaucagaaucugccuc

SEQ ID NO: 3315812 - RNA, 21 nt, Mycobacterium tuberculosis H37Rv
ucgaucagcuccuguaacugc

SEQ ID NO: 3315813 - RNA, 15 nt, Mycobacterium tuberculosis H37Rv
ucgaucaggccuugg

SEQ ID NO: 3315814 - RNA, 17 nt, Mycobacterium tuberculosis H37Rv
ucgaucaggggcccacc

SEQ ID NO: 3315815 - RNA, 18 nt, Mycobacterium tuberculosis H37Rv
ucgaucaggggcccaccc

SEQ ID NO: 3315816 - RNA, 19 nt, Mycobacterium tuberculosis H37Rv
ucgaucaucgaccuggcca

SEQ ID NO: 3315817 - RNA, 12 nt, Mycobacterium tuberculosis H37Rv
ucgauccggcuc

SEQ ID NO: 3315818 - RNA, 22 nt, Mycobacterium tuberculosis H37Rv
ucgauccucgcccgcaccagcu

SEQ ID NO: 3315819 - RNA, 23 nt, Mycobacterium tuberculosis H37Rv
ucgaucgacccggucgacggguc

SEQ ID NO: 3315820 - RNA, 14 nt, Mycobacterium tuberculosis H37Rv
ucgaucuccaggcc

SEQ ID NO: 3315821 - RNA, 22 nt, Mycobacterium tuberculosis H37Rv
ucgaucuccucuugcaccaggg

SEQ ID NO: 3315822 - RNA, 18 nt, Mycobacterium tuberculosis H37Rv
ucgaucugcacgagugcg

SEQ ID NO: 3315823 - RNA, 15 nt, Mycobacterium tuberculosis H37Rv
ucgaucuucuccucg

SEQ ID NO: 3315824 - RNA, 21 nt, Mycobacterium tuberculosis H37Rv
ucgaugaagcgucguugcucg

SEQ ID NO: 3315825 - RNA, 23 nt, Mycobacterium tuberculosis H37Rv
ucgaugagcgcgaaguacgacga

SEQ ID NO: 3315826 - RNA, 17 nt, Mycobacterium tuberculosis H37Rv
ucgaugagugacggucc

SEQ ID NO: 3315827 - RNA, 22 nt, Mycobacterium tuberculosis H37Rv
ucgaugagugacgguccguucg

SEQ ID NO: 3315828 - RNA, 14 nt, Mycobacterium tuberculosis H37Rv
ucgaugaucugcuu

SEQ ID NO: 3315829 - RNA, 20 nt, Mycobacterium tuberculosis H37Rv
ucgaugccgcguagcugguc

SEQ ID NO: 3315830 - RNA, 17 nt, Mycobacterium tuberculosis H37Rv
ucgaugcgcgccggcuu

SEQ ID NO: 3315831 - RNA, 18 nt, Mycobacterium tuberculosis H37Rv
ucgauggaaaacgccaug

SEQ ID NO: 3315832 - RNA, 15 nt, Mycobacterium tuberculosis H37Rv
ucgauggaccgccag

SEQ ID NO: 3315833 - RNA, 19 nt, Mycobacterium tuberculosis H37Rv
ucgauggcggccaccagcg

SEQ ID NO: 3315834 - RNA, 18 nt, Mycobacterium tuberculosis H37Rv
ucgauggcguacagcacc

SEQ ID NO: 3315835 - RNA, 20 nt, Mycobacterium tuberculosis H37Rv
ucgauggcguagggcugucc

SEQ ID NO: 3315836 - RNA, 13 nt, Mycobacterium tuberculosis H37Rv
ucgauggugugcc

SEQ ID NO: 3315837 - RNA, 15 nt, Mycobacterium tuberculosis H37Rv
ucgauggugugcccg

SEQ ID NO: 3315838 - RNA, 15 nt, Mycobacterium tuberculosis H37Rv
ucgauguacaccgug

SEQ ID NO: 3315839 - RNA, 17 nt, Mycobacterium tuberculosis H37Rv
ucgauguccacgccgug

SEQ ID NO: 3315840 - RNA, 18 nt, Mycobacterium tuberculosis H37Rv
ucgauguccucgacaccc

SEQ ID NO: 3315841 - RNA, 17 nt, Mycobacterium tuberculosis H37Rv
ucgaugugaucaccgau

SEQ ID NO: 3315842 - RNA, 20 nt, Mycobacterium tuberculosis H37Rv
ucgauugaugcgugguuggc

SEQ ID NO: 3315843 - RNA, 15 nt, Mycobacterium tuberculosis H37Rv
ucgauugccaccgag

SEQ ID NO: 3315844 - RNA, 15 nt, Mycobacterium tuberculosis H37Rv
ucgauuguggccagc

SEQ ID NO: 3315845 - RNA, 13 nt, Mycobacterium tuberculosis H37Rv
ucgcaaaagcccc

SEQ ID NO: 3315846 - RNA, 22 nt, Mycobacterium tuberculosis H37Rv
ucgcaaacagauucggugccag

SEQ ID NO: 3315847 - RNA, 16 nt, Mycobacterium tuberculosis H37Rv
ucgcaaccgccgccau

SEQ ID NO: 3315848 - RNA, 12 nt, Mycobacterium tuberculosis H37Rv
ucgcaaccggcg

SEQ ID NO: 3315849 - RNA, 23 nt, Mycobacterium tuberculosis H37Rv
ucgcaacgauuuuagcggcugcc

SEQ ID NO: 3315850 - RNA, 14 nt, Mycobacterium tuberculosis H37Rv
ucgcaacgcaucga

SEQ ID NO: 3315851 - RNA, 22 nt, Mycobacterium tuberculosis H37Rv
ucgcaacgcaucgaugcgugcc

SEQ ID NO: 3315852 - RNA, 22 nt, Mycobacterium tuberculosis H37Rv
ucgcaacggucacaugugucac

SEQ ID NO: 3315853 - RNA, 15 nt, Mycobacterium tuberculosis H37Rv
ucgcaagcgcggcga

SEQ ID NO: 3315854 - RNA, 17 nt, Mycobacterium tuberculosis H37Rv
ucgcaaggcccgcaccg

SEQ ID NO: 3315855 - RNA, 17 nt, Mycobacterium tuberculosis H37Rv
ucgcaagucuccucgaa

SEQ ID NO: 3315856 - RNA, 16 nt, Mycobacterium tuberculosis H37Rv
ucgcaauauccggccg

SEQ ID NO: 3315857 - RNA, 16 nt, Mycobacterium tuberculosis H37Rv
ucgcaauaugccacag

SEQ ID NO: 3315858 - RNA, 14 nt, Mycobacterium tuberculosis H37Rv
ucgcaaucagcugg

SEQ ID NO: 3315859 - RNA, 15 nt, Mycobacterium tuberculosis H37Rv
ucgcaaucagcuggu

SEQ ID NO: 3315860 - RNA, 19 nt, Mycobacterium tuberculosis H37Rv
ucgcaaucguuggccaugc

SEQ ID NO: 3315861 - RNA, 18 nt, Mycobacterium tuberculosis H37Rv
ucgcacaacugcgccagc

SEQ ID NO: 3315862 - RNA, 16 nt, Mycobacterium tuberculosis H37Rv
ucgcacaccaacaccg

SEQ ID NO: 3315863 - RNA, 14 nt, Mycobacterium tuberculosis H37Rv
ucgcacagcaccac

SEQ ID NO: 3315864 - RNA, 13 nt, Mycobacterium tuberculosis H37Rv
ucgcacagcgcga

SEQ ID NO: 3315865 - RNA, 21 nt, Mycobacterium tuberculosis H37Rv
ucgcaccaccacgugaucaga

SEQ ID NO: 3315866 - RNA, 18 nt, Mycobacterium tuberculosis H37Rv
ucgcaccagaucagguga

SEQ ID NO: 3315867 - RNA, 18 nt, Mycobacterium tuberculosis H37Rv
ucgcaccccggcggcguc

SEQ ID NO: 3315868 - RNA, 16 nt, Mycobacterium tuberculosis H37Rv
ucgcacccgcucggcg

SEQ ID NO: 3315869 - RNA, 16 nt, Mycobacterium tuberculosis H37Rv
ucgcaccggagucggc

SEQ ID NO: 3315870 - RNA, 19 nt, Mycobacterium tuberculosis H37Rv
ucgcaccggagucggcguc

SEQ ID NO: 3315871 - RNA, 20 nt, Mycobacterium tuberculosis H37Rv
ucgcacgacgcgacacgccg

SEQ ID NO: 3315872 - RNA, 17 nt, Mycobacterium tuberculosis H37Rv
ucgcacgagccaacaag

SEQ ID NO: 3315873 - RNA, 18 nt, Mycobacterium tuberculosis H37Rv
ucgcacggugccgccguc

SEQ ID NO: 3315874 - RNA, 22 nt, Mycobacterium tuberculosis H37Rv
ucgcagacggcugccacgcguc

SEQ ID NO: 3315875 - RNA, 19 nt, Mycobacterium tuberculosis H37Rv
ucgcagaucaggacgcgau

SEQ ID NO: 3315876 - RNA, 15 nt, Mycobacterium tuberculosis H37Rv
ucgcagauugugagc

SEQ ID NO: 3315877 - RNA, 14 nt, Mycobacterium tuberculosis H37Rv
ucgcagcagaccac

SEQ ID NO: 3315878 - RNA, 11 nt, Mycobacterium tuberculosis H37Rv
ucgcagcaugu

SEQ ID NO: 3315879 - RNA, 20 nt, Mycobacterium tuberculosis H37Rv
ucgcagccacguuacgcucg

SEQ ID NO: 3315880 - RNA, 15 nt, Mycobacterium tuberculosis H37Rv
ucgcagccaggcacg

SEQ ID NO: 3315881 - RNA, 16 nt, Mycobacterium tuberculosis H37Rv
ucgcagccgguccagc

SEQ ID NO: 3315882 - RNA, 20 nt, Mycobacterium tuberculosis H37Rv
ucgcagccgguccagcgccg

SEQ ID NO: 3315883 - RNA, 13 nt, Mycobacterium tuberculosis H37Rv
ucgcagcgacacg

SEQ ID NO: 3315884 - RNA, 21 nt, Mycobacterium tuberculosis H37Rv
ucgcagcgcacacuaccgccg

SEQ ID NO: 3315885 - RNA, 22 nt, Mycobacterium tuberculosis H37Rv
ucgcagcgccauuccaagacgu

SEQ ID NO: 3315886 - RNA, 19 nt, Mycobacterium tuberculosis H37Rv
ucgcagcgguggucggcgc

SEQ ID NO: 3315887 - RNA, 21 nt, Mycobacterium tuberculosis H37Rv
ucgcagcucgucgugagucac

SEQ ID NO: 3315888 - RNA, 14 nt, Mycobacterium tuberculosis H37Rv
ucgcaggauuccca

SEQ ID NO: 3315889 - RNA, 20 nt, Mycobacterium tuberculosis H37Rv
ucgccgaggccucggccagc

SEQ ID NO: 3315890 - RNA, 15 nt, Mycobacterium tuberculosis H37Rv
ucgccgaguccggcg

SEQ ID NO: 3315891 - RNA, 16 nt, Mycobacterium tuberculosis H37Rv
ucgccgaguccggcga

SEQ ID NO: 3315892 - RNA, 14 nt, Mycobacterium tuberculosis H37Rv
ucgccgaguugacc

SEQ ID NO: 3315893 - RNA, 17 nt, Mycobacterium tuberculosis H37Rv
ucgccgauagacguguc

SEQ ID NO: 3315894 - RNA, 18 nt, Mycobacterium tuberculosis H37Rv
ucgccgauaucugccacg

SEQ ID NO: 3315895 - RNA, 21 nt, Mycobacterium tuberculosis H37Rv
ucgccgauaucugccacguug

SEQ ID NO: 3315896 - RNA, 20 nt, Mycobacterium tuberculosis H37Rv
ucgccgaucagcugcgcauc

SEQ ID NO: 3315897 - RNA, 14 nt, Mycobacterium tuberculosis H37Rv
ucgccgaugcggga

SEQ ID NO: 3315898 - RNA, 16 nt, Mycobacterium tuberculosis H37Rv
ucgccgcacagcggcc

SEQ ID NO: 3315899 - RNA, 24 nt, Mycobacterium tuberculosis H37Rv
ucgccgccauugccgccggugccg

SEQ ID NO: 3315900 - RNA, 22 nt, Mycobacterium tuberculosis H37Rv
ucgccgcccccguuuacggccc

SEQ ID NO: 3315901 - RNA, 13 nt, Mycobacterium tuberculosis H37Rv
ucgccgcccggcg

SEQ ID NO: 3315902 - RNA, 21 nt, Mycobacterium tuberculosis H37Rv
ucgccgccgaaaaccucgccc

SEQ ID NO: 3315903 - RNA, 13 nt, Mycobacterium tuberculosis H37Rv
ucgccgccgcuac

SEQ ID NO: 3315904 - RNA, 22 nt, Mycobacterium tuberculosis H37Rv
ucgccgccggcgccaucggguc

SEQ ID NO: 3315905 - RNA, 15 nt, Mycobacterium tuberculosis H37Rv
ucgccgccggcgccg

SEQ ID NO: 3315906 - RNA, 18 nt, Mycobacterium tuberculosis H37Rv
ucgccgccgucggguugc

SEQ ID NO: 3315907 - RNA, 14 nt, Mycobacterium tuberculosis H37Rv
ucgccgccgucgug

SEQ ID NO: 3315908 - RNA, 24 nt, Mycobacterium tuberculosis H37Rv
ucgccgccguugccgccaucaccg

SEQ ID NO: 3315909 - RNA, 23 nt, Mycobacterium tuberculosis H37Rv
ucgccgccguugccgccgguguu

SEQ ID NO: 3315910 - RNA, 20 nt, Mycobacterium tuberculosis H37Rv
ucgccgccguugccgccguc

SEQ ID NO: 3315911 - RNA, 23 nt, Mycobacterium tuberculosis H37Rv
ucgccgccguugccgccgucguu

SEQ ID NO: 3315912 - RNA, 17 nt, Mycobacterium tuberculosis H37Rv
ucgccgccuuacgcacc

SEQ ID NO: 3315913 - RNA, 21 nt, Mycobacterium tuberculosis H37Rv
ucgccgccuuacgcaccgaug

SEQ ID NO: 3315914 - RNA, 23 nt, Mycobacterium tuberculosis H37Rv
ucgccgccuucuucucggcgagc

SEQ ID NO: 3315915 - RNA, 16 nt, Mycobacterium tuberculosis H37Rv
ucgccgcgauggcggu

SEQ ID NO: 3315916 - RNA, 14 nt, Mycobacterium tuberculosis H37Rv
ucgccgcgcagccu

SEQ ID NO: 3315917 - RNA, 12 nt, Mycobacterium tuberculosis H37Rv
ucgccgcgccgu

SEQ ID NO: 3315918 - RNA, 14 nt, Mycobacterium tuberculosis H37Rv
ucgccgcgccguag

SEQ ID NO: 3315919 - RNA, 14 nt, Mycobacterium tuberculosis H37Rv
ucgccgcgcggaac

SEQ ID NO: 3315920 - RNA, 14 nt, Mycobacterium tuberculosis H37Rv
ucgccgcgggcagc

SEQ ID NO: 3315921 - RNA, 15 nt, Mycobacterium tuberculosis H37Rv
ucgccgcuacgccgg

SEQ ID NO: 3315922 - RNA, 18 nt, Mycobacterium tuberculosis H37Rv
ucgccgcucgguccccgc

SEQ ID NO: 3315923 - RNA, 18 nt, Mycobacterium tuberculosis H37Rv
ucgccgcuggcaaucccg

SEQ ID NO: 3315924 - RNA, 19 nt, Mycobacterium tuberculosis H37Rv
ucgccggaauacaccagcg

SEQ ID NO: 3315925 - RNA, 18 nt, Mycobacterium tuberculosis H37Rv
ucgccggaccccgagacc

SEQ ID NO: 3315926 - RNA, 21 nt, Mycobacterium tuberculosis H37Rv
ucgccggacgacaacaggccg

SEQ ID NO: 3315927 - RNA, 21 nt, Mycobacterium tuberculosis H37Rv
ucgccggaucguucgcgugcc

SEQ ID NO: 3315928 - RNA, 14 nt, Mycobacterium tuberculosis H37Rv
ucgccggcaccgga

SEQ ID NO: 3315929 - RNA, 16 nt, Mycobacterium tuberculosis H37Rv
ucgccggcaccggaug

SEQ ID NO: 3315930 - RNA, 17 nt, Mycobacterium tuberculosis H37Rv
ucgccggcaccggaugc

SEQ ID NO: 3315931 - RNA, 18 nt, Mycobacterium tuberculosis H37Rv
ucgccggcauacaccgug

SEQ ID NO: 3315932 - RNA, 17 nt, Mycobacterium tuberculosis H37Rv
ucgccggccaacugggc

SEQ ID NO: 3315933 - RNA, 13 nt, Mycobacterium tuberculosis H37Rv
ucgccggccaccc

SEQ ID NO: 3315934 - RNA, 14 nt, Mycobacterium tuberculosis H37Rv
ucgccggccacccg

SEQ ID NO: 3315935 - RNA, 14 nt, Mycobacterium tuberculosis H37Rv
ucgccggccggccc

SEQ ID NO: 3315936 - RNA, 13 nt, Mycobacterium tuberculosis H37Rv
ucgccggccguca

SEQ ID NO: 3315937 - RNA, 17 nt, Mycobacterium tuberculosis H37Rv
ucgccggcgaacugauc

SEQ ID NO: 3315938 - RNA, 14 nt, Mycobacterium tuberculosis H37Rv
ucgccggcgccagc

SEQ ID NO: 3315939 - RNA, 17 nt, Mycobacterium tuberculosis H37Rv
ucgccggcgcgccgaug

SEQ ID NO: 3315940 - RNA, 18 nt, Mycobacterium tuberculosis H37Rv
ucgccggcgcgccgauga

SEQ ID NO: 3315941 - RNA, 23 nt, Mycobacterium tuberculosis H37Rv
ucgccggcgcgccgggcggcgcg

SEQ ID NO: 3315942 - RNA, 17 nt, Mycobacterium tuberculosis H37Rv
ucgccggcgcucaucgc

SEQ ID NO: 3315943 - RNA, 19 nt, Mycobacterium tuberculosis H37Rv
ucgccggcgcucaucgcgu

SEQ ID NO: 3315944 - RNA, 21 nt, Mycobacterium tuberculosis H37Rv
ucgccgggcggccgcggcgcg

SEQ ID NO: 3315945 - RNA, 19 nt, Mycobacterium tuberculosis H37Rv
ucgccgggcugcaaaucgu

SEQ ID NO: 3315946 - RNA, 16 nt, Mycobacterium tuberculosis H37Rv
ucgccggggacgccgc

SEQ ID NO: 3315947 - RNA, 19 nt, Mycobacterium tuberculosis H37Rv
ucgccggggccgcuggcgg

SEQ ID NO: 3315948 - RNA, 13 nt, Mycobacterium tuberculosis H37Rv
ucgccgggucagc

SEQ ID NO: 3315949 - RNA, 23 nt, Mycobacterium tuberculosis H37Rv
ucgccgguaggcggccagcgcgc

SEQ ID NO: 3315950 - RNA, 17 nt, Mycobacterium tuberculosis H37Rv
ucgccggugacgacguc

SEQ ID NO: 3315951 - RNA, 18 nt, Mycobacterium tuberculosis H37Rv
ucgccggugacgggguug

SEQ ID NO: 3315952 - RNA, 16 nt, Mycobacterium tuberculosis H37Rv
ucgccguaagcaccag

SEQ ID NO: 3315953 - RNA, 15 nt, Mycobacterium tuberculosis H37Rv
ucgccguccagcaau

SEQ ID NO: 3315954 - RNA, 13 nt, Mycobacterium tuberculosis H37Rv
ucgccgucggguc

SEQ ID NO: 3315955 - RNA, 18 nt, Mycobacterium tuberculosis H37Rv
ucgccgucgucgaucgac

SEQ ID NO: 3315956 - RNA, 16 nt, Mycobacterium tuberculosis H37Rv
ucgccgucgugccacc

SEQ ID NO: 3315957 - RNA, 14 nt, Mycobacterium tuberculosis H37Rv
ucgccgugaccagg

SEQ ID NO: 3315958 - RNA, 23 nt, Mycobacterium tuberculosis H37Rv
ucgccgugcgccgugcgaucguc

SEQ ID NO: 3315959 - RNA, 22 nt, Mycobacterium tuberculosis H37Rv
ucgccgugcuguuccagcgucu

SEQ ID NO: 3315960 - RNA, 17 nt, Mycobacterium tuberculosis H37Rv
ucgccguuauccgacga

SEQ ID NO: 3315961 - RNA, 14 nt, Mycobacterium tuberculosis H37Rv
ucgccuaccggccu

SEQ ID NO: 3315962 - RNA, 13 nt, Mycobacterium tuberculosis H37Rv
ucgccuccaggcg

SEQ ID NO: 3315963 - RNA, 11 nt, Mycobacterium tuberculosis H37Rv
ucgccuccgcu

SEQ ID NO: 3315964 - RNA, 21 nt, Mycobacterium tuberculosis H37Rv
ucgccuccggauccucggccg

SEQ ID NO: 3315965 - RNA, 17 nt, Mycobacterium tuberculosis H37Rv
ucgccucgaggaccacc

SEQ ID NO: 3315966 - RNA, 24 nt, Mycobacterium tuberculosis H37Rv
ucgccucgauggcguagggcuguc

SEQ ID NO: 3315967 - RNA, 17 nt, Mycobacterium tuberculosis H37Rv
ucgccucggcguaggcg

SEQ ID NO: 3315968 - RNA, 18 nt, Mycobacterium tuberculosis H37Rv
ucgccugcacccggcgau

SEQ ID NO: 3315969 - RNA, 15 nt, Mycobacterium tuberculosis H37Rv
ucgccugcacgcccg

SEQ ID NO: 3315970 - RNA, 12 nt, Mycobacterium tuberculosis H37Rv
ucgccuggaaga

SEQ ID NO: 3315971 - RNA, 21 nt, Mycobacterium tuberculosis H37Rv
ucgccuggaagaucacgcguc

SEQ ID NO: 3315972 - RNA, 14 nt, Mycobacterium tuberculosis H37Rv
ucgccuucccagcc

SEQ ID NO: 3315973 - RNA, 15 nt, Mycobacterium tuberculosis H37Rv
ucgccuucccagccg

SEQ ID NO: 3315974 - RNA, 14 nt, Mycobacterium tuberculosis H37Rv
ucgcgaaaccgccg

SEQ ID NO: 3315975 - RNA, 14 nt, Mycobacterium tuberculosis H37Rv
ucgcgaacaucgcc

SEQ ID NO: 3315976 - RNA, 16 nt, Mycobacterium tuberculosis H37Rv
ucgcgaacaucgccag

SEQ ID NO: 3315977 - RNA, 18 nt, Mycobacterium tuberculosis H37Rv
ucgcgaacgaagucgacg

SEQ ID NO: 3315978 - RNA, 22 nt, Mycobacterium tuberculosis H37Rv
ucgcgaagaacgacgccaccgc

SEQ ID NO: 3315979 - RNA, 21 nt, Mycobacterium tuberculosis H37Rv
ucgcgaagucguccagaauga

SEQ ID NO: 3315980 - RNA, 18 nt, Mycobacterium tuberculosis H37Rv
ucgcgacagugcgcauca

SEQ ID NO: 3315981 - RNA, 15 nt, Mycobacterium tuberculosis H37Rv
ucgcgacccgaucgc

SEQ ID NO: 3315982 - RNA, 23 nt, Mycobacterium tuberculosis H37Rv
ucgcgacgcgcgagaacacccgu

SEQ ID NO: 3315983 - RNA, 19 nt, Mycobacterium tuberculosis H37Rv
ucgcgagcagacgcggaau

SEQ ID NO: 3315984 - RNA, 22 nt, Mycobacterium tuberculosis H37Rv
ucgcgagccagcugcuccaccc

SEQ ID NO: 3315985 - RNA, 16 nt, Mycobacterium tuberculosis H37Rv
ucgcgagcgagccaac

SEQ ID NO: 3315986 - RNA, 19 nt, Mycobacterium tuberculosis H37Rv
ucgcgaguagcugacccgc

SEQ ID NO: 3315987 - RNA, 21 nt, Mycobacterium tuberculosis H37Rv
ucgcgaguugagaaccggcuc

SEQ ID NO: 3315988 - RNA, 18 nt, Mycobacterium tuberculosis H37Rv
ucgcgaugcucaaugugc

SEQ ID NO: 3315989 - RNA, 16 nt, Mycobacterium tuberculosis H37Rv
ucgcgauguccucgag

SEQ ID NO: 3315990 - RNA, 14 nt, Mycobacterium tuberculosis H37Rv
ucgcgcacccagcc

SEQ ID NO: 3315991 - RNA, 22 nt, Mycobacterium tuberculosis H37Rv
ucgcgcaccggaucgccgucgc

SEQ ID NO: 3315992 - RNA, 14 nt, Mycobacterium tuberculosis H37Rv
ucgcgcacgcccug

SEQ ID NO: 3315993 - RNA, 13 nt, Mycobacterium tuberculosis H37Rv
ucgcgcacgucgg

SEQ ID NO: 3315994 - RNA, 13 nt, Mycobacterium tuberculosis H37Rv
ucgcgcagcgcga

SEQ ID NO: 3315995 - RNA, 17 nt, Mycobacterium tuberculosis H37Rv
ucgcgcagcgcgaucgc

SEQ ID NO: 3315996 - RNA, 18 nt, Mycobacterium tuberculosis H37Rv
ucgcgcagcgcgaucgcg

SEQ ID NO: 3315997 - RNA, 19 nt, Mycobacterium tuberculosis H37Rv
ucgcgcagcgucaucgcgu

SEQ ID NO: 3315998 - RNA, 13 nt, Mycobacterium tuberculosis H37Rv
ucgcgcaggaagc

SEQ ID NO: 3315999 - RNA, 21 nt, Mycobacterium tuberculosis H37Rv
ucgcgcagggaucgcagggau

SEQ ID NO: 3316000 - RNA, 18 nt, Mycobacterium tuberculosis H37Rv
ucgcgcaucgccuccucg

SEQ ID NO: 3316001 - RNA, 19 nt, Mycobacterium tuberculosis H37Rv
ucgcgcaucgccuccucga

SEQ ID NO: 3316002 - RNA, 19 nt, Mycobacterium tuberculosis H37Rv
ucgcgcauugccgacgcgc

SEQ ID NO: 3316003 - RNA, 17 nt, Mycobacterium tuberculosis H37Rv
ucgcgcauugcgcuucc

SEQ ID NO: 3316004 - RNA, 14 nt, Mycobacterium tuberculosis H37Rv
ucgcgccaggccac

SEQ ID NO: 3316005 - RNA, 22 nt, Mycobacterium tuberculosis H37Rv
ucgcgccaggccacguagcagc

SEQ ID NO: 3316006 - RNA, 14 nt, Mycobacterium tuberculosis H37Rv
ucgcgccaggcgcg

SEQ ID NO: 3316007 - RNA, 22 nt, Mycobacterium tuberculosis H37Rv
ucgcgccaggcgcgaucgcgcc

SEQ ID NO: 3316008 - RNA, 19 nt, Mycobacterium tuberculosis H37Rv
ucgcgccaucgucgcgccg

SEQ ID NO: 3316009 - RNA, 19 nt, Mycobacterium tuberculosis H37Rv
ucgcgcccgcugagccagc

SEQ ID NO: 3316010 - RNA, 14 nt, Mycobacterium tuberculosis H37Rv
ucgcgccgggcucg

SEQ ID NO: 3316011 - RNA, 15 nt, Mycobacterium tuberculosis H37Rv
ucgcgccgucgucga

SEQ ID NO: 3316012 - RNA, 16 nt, Mycobacterium tuberculosis H37Rv
ucgcgcgcaccggguu

SEQ ID NO: 3316013 - RNA, 18 nt, Mycobacterium tuberculosis H37Rv
ucgcgcgccuuggccagc

SEQ ID NO: 3316014 - RNA, 20 nt, Mycobacterium tuberculosis H37Rv
ucgcgcgccuuggccagcgc

SEQ ID NO: 3316015 - RNA, 13 nt, Mycobacterium tuberculosis H37Rv
ucgcgcgcggcga

SEQ ID NO: 3316016 - RNA, 14 nt, Mycobacterium tuberculosis H37Rv
ucgcgcgcugggcg

SEQ ID NO: 3316017 - RNA, 23 nt, Mycobacterium tuberculosis H37Rv
ucgcgcggcaccgauggcgcacc

SEQ ID NO: 3316018 - RNA, 20 nt, Mycobacterium tuberculosis H37Rv
ucgcgcggggcggcugcggg

SEQ ID NO: 3316019 - RNA, 21 nt, Mycobacterium tuberculosis H37Rv
ucgcgcgucgucgcgcugaac

SEQ ID NO: 3316020 - RNA, 22 nt, Mycobacterium tuberculosis H37Rv
ucgcgcgucgucgcgcugaacg

SEQ ID NO: 3316021 - RNA, 23 nt, Mycobacterium tuberculosis H37Rv
ucgcgcuaaggugggcacagcga

SEQ ID NO: 3316022 - RNA, 13 nt, Mycobacterium tuberculosis H37Rv
ucgcgcucgcacc

SEQ ID NO: 3316023 - RNA, 20 nt, Mycobacterium tuberculosis H37Rv
ucgcgcucgcucacgccguc

SEQ ID NO: 3316024 - RNA, 17 nt, Mycobacterium tuberculosis H37Rv
ucgcgcugaacgcugua

SEQ ID NO: 3316025 - RNA, 18 nt, Mycobacterium tuberculosis H37Rv
ucgcgcugaagguggcga

SEQ ID NO: 3316026 - RNA, 15 nt, Mycobacterium tuberculosis H37Rv
ucgcgcugccggccg

SEQ ID NO: 3316027 - RNA, 23 nt, Mycobacterium tuberculosis H37Rv
ucgcgcugcggcccacaccagcg

SEQ ID NO: 3316028 - RNA, 15 nt, Mycobacterium tuberculosis H37Rv
ucgcgcugcgggaac

SEQ ID NO: 3316029 - RNA, 22 nt, Mycobacterium tuberculosis H37Rv
ucgcgcugcugucgauuucgcc

SEQ ID NO: 3316030 - RNA, 17 nt, Mycobacterium tuberculosis H37Rv
ucgcggaagugucgucg

SEQ ID NO: 3316031 - RNA, 18 nt, Mycobacterium tuberculosis H37Rv
ucgcggaagugucgucgg

SEQ ID NO: 3316032 - RNA, 17 nt, Mycobacterium tuberculosis H37Rv
ucgcggacccgcgcguc

SEQ ID NO: 3316033 - RNA, 17 nt, Mycobacterium tuberculosis H37Rv
ucgcggaccucggcgac

SEQ ID NO: 3316034 - RNA, 14 nt, Mycobacterium tuberculosis H37Rv
ucgcggacgucgcc

SEQ ID NO: 3316035 - RNA, 18 nt, Mycobacterium tuberculosis H37Rv
ucgcggagccaggacgac

SEQ ID NO: 3316036 - RNA, 15 nt, Mycobacterium tuberculosis H37Rv
ucgcggaucagcccg

SEQ ID NO: 3316037 - RNA, 22 nt, Mycobacterium tuberculosis H37Rv
ucgcggauccgggcguggugga

SEQ ID NO: 3316038 - RNA, 16 nt, Mycobacterium tuberculosis H37Rv
ucgcggaugcguuggc

SEQ ID NO: 3316039 - RNA, 21 nt, Mycobacterium tuberculosis H37Rv
ucgcggauuggcacugucgau

SEQ ID NO: 3316040 - RNA, 16 nt, Mycobacterium tuberculosis H37Rv
ucgcggcacgcccaca

SEQ ID NO: 3316041 - RNA, 17 nt, Mycobacterium tuberculosis H37Rv
ucgcggccgagacggcg

SEQ ID NO: 3316042 - RNA, 19 nt, Mycobacterium tuberculosis H37Rv
ucgcggccgagacggcguu

SEQ ID NO: 3316043 - RNA, 20 nt, Mycobacterium tuberculosis H37Rv
ucgcggccggcgucggcguc

SEQ ID NO: 3316044 - RNA, 20 nt, Mycobacterium tuberculosis H37Rv
ucgcggccguggaugucgcg

SEQ ID NO: 3316045 - RNA, 22 nt, Mycobacterium tuberculosis H37Rv
ucgcggcggcgauccggucggg

SEQ ID NO: 3316046 - RNA, 13 nt, Mycobacterium tuberculosis H37Rv
ucgcggcggcgcu

SEQ ID NO: 3316047 - RNA, 20 nt, Mycobacterium tuberculosis H37Rv
ucgcggcuauggcgccgcgg

SEQ ID NO: 3316048 - RNA, 23 nt, Mycobacterium tuberculosis H37Rv
ucgcgggcagggccucggucgcc

SEQ ID NO: 3316049 - RNA, 23 nt, Mycobacterium tuberculosis H37Rv
ucgcgggcccgcgcggcgguguc

SEQ ID NO: 3316050 - RNA, 15 nt, Mycobacterium tuberculosis H37Rv
ucgcgggcgaucggc

SEQ ID NO: 3316051 - RNA, 14 nt, Mycobacterium tuberculosis H37Rv
ucgcgggcggcgcu

SEQ ID NO: 3316052 - RNA, 20 nt, Mycobacterium tuberculosis H37Rv
ucgcgggcugaccaacucgu

SEQ ID NO: 3316053 - RNA, 20 nt, Mycobacterium tuberculosis H37Rv
ucgcggggcgcaccgcggac

SEQ ID NO: 3316054 - RNA, 22 nt, Mycobacterium tuberculosis H37Rv
ucgcggguguuccacaccaggc

SEQ ID NO: 3316055 - RNA, 15 nt, Mycobacterium tuberculosis H37Rv
ucgcggguucggcug

SEQ ID NO: 3316056 - RNA, 18 nt, Mycobacterium tuberculosis H37Rv
ucgcgguaccaucaccgc

SEQ ID NO: 3316057 - RNA, 15 nt, Mycobacterium tuberculosis H37Rv
ucgcgguagccgcgg

SEQ ID NO: 3316058 - RNA, 22 nt, Mycobacterium tuberculosis H37Rv
ucgcggucaugggaucaggcug

SEQ ID NO: 3316059 - RNA, 17 nt, Mycobacterium tuberculosis H37Rv
ucgcgguccaacagcgc

SEQ ID NO: 3316060 - RNA, 21 nt, Mycobacterium tuberculosis H37Rv
ucgcggucccacggccggccg

SEQ ID NO: 3316061 - RNA, 20 nt, Mycobacterium tuberculosis H37Rv
ucgcggucuugacaccgccg

SEQ ID NO: 3316062 - RNA, 14 nt, Mycobacterium tuberculosis H37Rv
ucgcggugguuggg

SEQ ID NO: 3316063 - RNA, 22 nt, Mycobacterium tuberculosis H37Rv
ucgcggugugcggcagcccgcu

SEQ ID NO: 3316064 - RNA, 21 nt, Mycobacterium tuberculosis H37Rv
ucgcgguuuuggucgcgauga

SEQ ID NO: 3316065 - RNA, 19 nt, Mycobacterium tuberculosis H37Rv
ucgcguaccaacaggaugg

SEQ ID NO: 3316066 - RNA, 17 nt, Mycobacterium tuberculosis H37Rv
ucgcguaucccgugugc

SEQ ID NO: 3316067 - RNA, 16 nt, Mycobacterium tuberculosis H37Rv
ucgcgucacaccagcg

SEQ ID NO: 3316068 - RNA, 13 nt, Mycobacterium tuberculosis H37Rv
ucgcguccuccuc

SEQ ID NO: 3316069 - RNA, 16 nt, Mycobacterium tuberculosis H37Rv
ucgcguccuccucggu

SEQ ID NO: 3316070 - RNA, 16 nt, Mycobacterium tuberculosis H37Rv
ucgcgucgagagaacg

SEQ ID NO: 3316071 - RNA, 14 nt, Mycobacterium tuberculosis H37Rv
ucgcgucgccgaug

SEQ ID NO: 3316072 - RNA, 16 nt, Mycobacterium tuberculosis H37Rv
ucgcgucgccgaugaa

SEQ ID NO: 3316073 - RNA, 22 nt, Mycobacterium tuberculosis H37Rv
ucgcgucugacaucgucgacga

SEQ ID NO: 3316074 - RNA, 14 nt, Mycobacterium tuberculosis H37Rv
ucgcgucugcucgc

SEQ ID NO: 3316075 - RNA, 17 nt, Mycobacterium tuberculosis H37Rv
ucgcgucugggugcagg

SEQ ID NO: 3316076 - RNA, 14 nt, Mycobacterium tuberculosis H37Rv
ucgcgugcaucgcc

SEQ ID NO: 3316077 - RNA, 13 nt, Mycobacterium tuberculosis H37Rv
ucgcgugcggcug

SEQ ID NO: 3316078 - RNA, 14 nt, Mycobacterium tuberculosis H37Rv
ucgcgugcggcugc

SEQ ID NO: 3316079 - RNA, 14 nt, Mycobacterium tuberculosis H37Rv
ucgcguucugcacc

SEQ ID NO: 3316080 - RNA, 14 nt, Mycobacterium tuberculosis H37Rv
ucgcguuguaggcu

SEQ ID NO: 3316081 - RNA, 17 nt, Mycobacterium tuberculosis H37Rv
ucggcacgacccgggaa

SEQ ID NO: 3316082 - RNA, 20 nt, Mycobacterium tuberculosis H37Rv
ucggcacgacccgggaagga

SEQ ID NO: 3316083 - RNA, 22 nt, Mycobacterium tuberculosis H37Rv
ucggcacgucguugggcauguc

SEQ ID NO: 3316084 - RNA, 20 nt, Mycobacterium tuberculosis H37Rv
ucggcagaccgaccucggcg

SEQ ID NO: 3316085 - RNA, 12 nt, Mycobacterium tuberculosis H37Rv
ucggcagcagcg

SEQ ID NO: 3316086 - RNA, 15 nt, Mycobacterium tuberculosis H37Rv
ucggcagcagcgcaa

SEQ ID NO: 3316087 - RNA, 16 nt, Mycobacterium tuberculosis H37Rv
ucggcagcagcgcaac

SEQ ID NO: 3316088 - RNA, 19 nt, Mycobacterium tuberculosis H37Rv
ucggcagcagcggugcagc

SEQ ID NO: 3316089 - RNA, 17 nt, Mycobacterium tuberculosis H37Rv
ucggcagcccggugugc

SEQ ID NO: 3316090 - RNA, 21 nt, Mycobacterium tuberculosis H37Rv
ucggcagccggcuugggcggu

SEQ ID NO: 3316091 - RNA, 16 nt, Mycobacterium tuberculosis H37Rv
ucggcagcggcgcggu

SEQ ID NO: 3316092 - RNA, 22 nt, Mycobacterium tuberculosis H37Rv
ucggcagcucccgccacgucgc

SEQ ID NO: 3316093 - RNA, 17 nt, Mycobacterium tuberculosis H37Rv
ucggcagcuucucgccg

SEQ ID NO: 3316094 - RNA, 14 nt, Mycobacterium tuberculosis H37Rv
ucggcaggccgcuu

SEQ ID NO: 3316095 - RNA, 20 nt, Mycobacterium tuberculosis H37Rv
ucggcaggguggccagcagg

SEQ ID NO: 3316096 - RNA, 22 nt, Mycobacterium tuberculosis H37Rv
ucggcaggguggccagcaggcg

SEQ ID NO: 3316097 - RNA, 15 nt, Mycobacterium tuberculosis H37Rv
ucggcauccaggcug

SEQ ID NO: 3316098 - RNA, 18 nt, Mycobacterium tuberculosis H37Rv
ucggcauccaggcugucg

SEQ ID NO: 3316099 - RNA, 13 nt, Mycobacterium tuberculosis H37Rv
ucggcauccgcgg

SEQ ID NO: 3316100 - RNA, 13 nt, Mycobacterium tuberculosis H37Rv
ucggcaucgacgc

SEQ ID NO: 3316101 - RNA, 19 nt, Mycobacterium tuberculosis H37Rv
ucggcauugcgcaggaugu

SEQ ID NO: 3316102 - RNA, 20 nt, Mycobacterium tuberculosis H37Rv
ucggccaacagguccaccgg

SEQ ID NO: 3316103 - RNA, 19 nt, Mycobacterium tuberculosis H37Rv
ucggccaccaacucggcga

SEQ ID NO: 3316104 - RNA, 14 nt, Mycobacterium tuberculosis H37Rv
ucggccaccaucgc

SEQ ID NO: 3316105 - RNA, 13 nt, Mycobacterium tuberculosis H37Rv
ucggccacccggu

SEQ ID NO: 3316106 - RNA, 13 nt, Mycobacterium tuberculosis H37Rv
ucggccaccgccu

SEQ ID NO: 3316107 - RNA, 16 nt, Mycobacterium tuberculosis H37Rv
ucggccaccgccugag

SEQ ID NO: 3316108 - RNA, 15 nt, Mycobacterium tuberculosis H37Rv
ucggccaccggcguc

SEQ ID NO: 3316109 - RNA, 14 nt, Mycobacterium tuberculosis H37Rv
ucggccaccgugga

SEQ ID NO: 3316110 - RNA, 15 nt, Mycobacterium tuberculosis H37Rv
ucggccagcacgccg

SEQ ID NO: 3316111 - RNA, 23 nt, Mycobacterium tuberculosis H37Rv
ucggccagcagcgacuccagcgc

SEQ ID NO: 3316112 - RNA, 15 nt, Mycobacterium tuberculosis H37Rv
ucggccagcgucagc

SEQ ID NO: 3316113 - RNA, 18 nt, Mycobacterium tuberculosis H37Rv
ucggccagcguguccgcc

SEQ ID NO: 3316114 - RNA, 19 nt, Mycobacterium tuberculosis H37Rv
ucggccagcucgugaucuu

SEQ ID NO: 3316115 - RNA, 24 nt, Mycobacterium tuberculosis H37Rv
ucggccagcucgugaucuucggcg

SEQ ID NO: 3316116 - RNA, 17 nt, Mycobacterium tuberculosis H37Rv
ucggccaggaucaaccg

SEQ ID NO: 3316117 - RNA, 13 nt, Mycobacterium tuberculosis H37Rv
ucggccaggauga

SEQ ID NO: 3316118 - RNA, 21 nt, Mycobacterium tuberculosis H37Rv
ucggccagguaauugccgacc

SEQ ID NO: 3316119 - RNA, 15 nt, Mycobacterium tuberculosis H37Rv
ucggccauccaccgc

SEQ ID NO: 3316120 - RNA, 20 nt, Mycobacterium tuberculosis H37Rv
ucggccauccaccgcagauc

SEQ ID NO: 3316121 - RNA, 20 nt, Mycobacterium tuberculosis H37Rv
ucggccaucguccagcagga

SEQ ID NO: 3316122 - RNA, 15 nt, Mycobacterium tuberculosis H37Rv
ucggccaucugcucg

SEQ ID NO: 3316123 - RNA, 21 nt, Mycobacterium tuberculosis H37Rv
ucggccauugcccgggcggga

SEQ ID NO: 3316124 - RNA, 18 nt, Mycobacterium tuberculosis H37Rv
ucggcccauaacagcugg

SEQ ID NO: 3316125 - RNA, 18 nt, Mycobacterium tuberculosis H37Rv
ucggcccccaagcucugc

SEQ ID NO: 3316126 - RNA, 14 nt, Mycobacterium tuberculosis H37Rv
ucggcccuccaccg

SEQ ID NO: 3316127 - RNA, 15 nt, Mycobacterium tuberculosis H37Rv
ucggcccuccaccgg

SEQ ID NO: 3316128 - RNA, 20 nt, Mycobacterium tuberculosis H37Rv
ucggccgacaccgccaccac

SEQ ID NO: 3316129 - RNA, 18 nt, Mycobacterium tuberculosis H37Rv
ucggccgaccgggcucug

SEQ ID NO: 3316130 - RNA, 12 nt, Mycobacterium tuberculosis H37Rv
ucggccgagucg

SEQ ID NO: 3316131 - RNA, 15 nt, Mycobacterium tuberculosis H37Rv
ucggccgaugcgcag

SEQ ID NO: 3316132 - RNA, 18 nt, Mycobacterium tuberculosis H37Rv
ucggccgaugcgcagugc

SEQ ID NO: 3316133 - RNA, 11 nt, Mycobacterium tuberculosis H37Rv
ucggccgccag

SEQ ID NO: 3316134 - RNA, 19 nt, Mycobacterium tuberculosis H37Rv
ucggccgccaucgcccgau

SEQ ID NO: 3316135 - RNA, 18 nt, Mycobacterium tuberculosis H37Rv
ucggccgccucguacgga

SEQ ID NO: 3316136 - RNA, 19 nt, Mycobacterium tuberculosis H37Rv
ucggccgccuucuccggcg

SEQ ID NO: 3316137 - RNA, 20 nt, Mycobacterium tuberculosis H37Rv
ucggccggagccgccggccc

SEQ ID NO: 3316138 - RNA, 21 nt, Mycobacterium tuberculosis H37Rv
ucggccggaugagcgaacgcc

SEQ ID NO: 3316139 - RNA, 16 nt, Mycobacterium tuberculosis H37Rv
ucggccggcaccccac

SEQ ID NO: 3316140 - RNA, 21 nt, Mycobacterium tuberculosis H37Rv
ucggccggcggcgcccaucgc

SEQ ID NO: 3316141 - RNA, 15 nt, Mycobacterium tuberculosis H37Rv
ucggccgggcucuau

SEQ ID NO: 3316142 - RNA, 16 nt, Mycobacterium tuberculosis H37Rv
ucggccggggccaccc

SEQ ID NO: 3316143 - RNA, 17 nt, Mycobacterium tuberculosis H37Rv
ucggccggggccacccg

SEQ ID NO: 3316144 - RNA, 21 nt, Mycobacterium tuberculosis H37Rv
ucggccgguauuucggcgacu

SEQ ID NO: 3316145 - RNA, 15 nt, Mycobacterium tuberculosis H37Rv
ucggccgucucggca

SEQ ID NO: 3316146 - RNA, 12 nt, Mycobacterium tuberculosis H37Rv
ucggccgugugc

SEQ ID NO: 3316147 - RNA, 13 nt, Mycobacterium tuberculosis H37Rv
ucggccugccggc

SEQ ID NO: 3316148 - RNA, 16 nt, Mycobacterium tuberculosis H37Rv
ucggccugccggcagc

SEQ ID NO: 3316149 - RNA, 16 nt, Mycobacterium tuberculosis H37Rv
ucggccugcgccggcg

SEQ ID NO: 3316150 - RNA, 20 nt, Mycobacterium tuberculosis H37Rv
ucggccugcgccggcgcugc

SEQ ID NO: 3316151 - RNA, 19 nt, Mycobacterium tuberculosis H37Rv
ucggccugcggcaccggcu

SEQ ID NO: 3316152 - RNA, 19 nt, Mycobacterium tuberculosis H37Rv
ucggccuggauggguugac

SEQ ID NO: 3316153 - RNA, 18 nt, Mycobacterium tuberculosis H37Rv
ucggccuggcaggguggg

SEQ ID NO: 3316154 - RNA, 24 nt, Mycobacterium tuberculosis H37Rv
ucggccugguacucccgcgaucgc

SEQ ID NO: 3316155 - RNA, 15 nt, Mycobacterium tuberculosis H37Rv
ucggccuguccaccg

SEQ ID NO: 3316156 - RNA, 15 nt, Mycobacterium tuberculosis H37Rv
ucggccuguucgccg

SEQ ID NO: 3316157 - RNA, 22 nt, Mycobacterium tuberculosis H37Rv
ucggccuugaucgugcuggcga

SEQ ID NO: 3316158 - RNA, 17 nt, Mycobacterium tuberculosis H37Rv
ucggcgaacaaccgccg

SEQ ID NO: 3316159 - RNA, 20 nt, Mycobacterium tuberculosis H37Rv
ucggcgaaccacggcagcca

SEQ ID NO: 3316160 - RNA, 15 nt, Mycobacterium tuberculosis H37Rv
ucggcgaacgccgug

SEQ ID NO: 3316161 - RNA, 22 nt, Mycobacterium tuberculosis H37Rv
ucggcgaacgccguggugcgca

SEQ ID NO: 3316162 - RNA, 20 nt, Mycobacterium tuberculosis H37Rv
ucggcgaacgcggcgucgau

SEQ ID NO: 3316163 - RNA, 16 nt, Mycobacterium tuberculosis H37Rv
ucggcgaacgcgucca

SEQ ID NO: 3316164 - RNA, 15 nt, Mycobacterium tuberculosis H37Rv
ucggcgaagcacacc

SEQ ID NO: 3316165 - RNA, 18 nt, Mycobacterium tuberculosis H37Rv
ucggcgaaugcgauugcc

SEQ ID NO: 3316166 - RNA, 22 nt, Mycobacterium tuberculosis H37Rv
ucggcgacaggccgagcagaua

SEQ ID NO: 3316167 - RNA, 15 nt, Mycobacterium tuberculosis H37Rv
ucggcgaccaccagc

SEQ ID NO: 3316168 - RNA, 16 nt, Mycobacterium tuberculosis H37Rv
ucggcgaccaccagcg

SEQ ID NO: 3316169 - RNA, 24 nt, Mycobacterium tuberculosis H37Rv
ucggcgaccgccugcgcggcugcc

SEQ ID NO: 3316170 - RNA, 19 nt, Mycobacterium tuberculosis H37Rv
ucggcgaccugccggaccg

SEQ ID NO: 3316171 - RNA, 20 nt, Mycobacterium tuberculosis H37Rv
ucggcgacgaugucgagcgc

SEQ ID NO: 3316172 - RNA, 13 nt, Mycobacterium tuberculosis H37Rv
ucggcgacgccgu

SEQ ID NO: 3316173 - RNA, 14 nt, Mycobacterium tuberculosis H37Rv
ucggcgacgccguc

SEQ ID NO: 3316174 - RNA, 13 nt, Mycobacterium tuberculosis H37Rv
ucggcgacgcgga

SEQ ID NO: 3316175 - RNA, 18 nt, Mycobacterium tuberculosis H37Rv
ucggcgacgcggaguccg

SEQ ID NO: 3316176 - RNA, 15 nt, Mycobacterium tuberculosis H37Rv
ucggcgagcaccgug

SEQ ID NO: 3316177 - RNA, 14 nt, Mycobacterium tuberculosis H37Rv
ucggcuggacggcg

SEQ ID NO: 3316178 - RNA, 23 nt, Mycobacterium tuberculosis H37Rv
ucggcugguuacucaccaaccgc

SEQ ID NO: 3316179 - RNA, 14 nt, Mycobacterium tuberculosis H37Rv
ucggcuuccggugc

SEQ ID NO: 3316180 - RNA, 15 nt, Mycobacterium tuberculosis H37Rv
ucggcuuggccggcg

SEQ ID NO: 3316181 - RNA, 14 nt, Mycobacterium tuberculosis H37Rv
ucggcuuggcugug

SEQ ID NO: 3316182 - RNA, 20 nt, Mycobacterium tuberculosis H37Rv
ucggcuugggaaacccggcc

SEQ ID NO: 3316183 - RNA, 17 nt, Mycobacterium tuberculosis H37Rv
ucggcuuugccgcugug

SEQ ID NO: 3316184 - RNA, 19 nt, Mycobacterium tuberculosis H37Rv
ucgggaacgcucgucgaca

SEQ ID NO: 3316185 - RNA, 18 nt, Mycobacterium tuberculosis H37Rv
ucgggacaucugcccacc

SEQ ID NO: 3316186 - RNA, 19 nt, Mycobacterium tuberculosis H37Rv
ucgggaccgggaacccgag

SEQ ID NO: 3316187 - RNA, 22 nt, Mycobacterium tuberculosis H37Rv
ucgggaccggggacgcgcccca

SEQ ID NO: 3316188 - RNA, 15 nt, Mycobacterium tuberculosis H37Rv
ucgggacgaaaaaau

SEQ ID NO: 3316189 - RNA, 11 nt, Mycobacterium tuberculosis H37Rv
ucgggagauga

SEQ ID NO: 3316190 - RNA, 13 nt, Mycobacterium tuberculosis H37Rv
ucgggagcggcug

SEQ ID NO: 3316191 - RNA, 19 nt, Mycobacterium tuberculosis H37Rv
ucgggauaagccugggaaa

SEQ ID NO: 3316192 - RNA, 17 nt, Mycobacterium tuberculosis H37Rv
ucgggauaggacaccgu

SEQ ID NO: 3316193 - RNA, 16 nt, Mycobacterium tuberculosis H37Rv
ucgggaucggccggcg

SEQ ID NO: 3316194 - RNA, 17 nt, Mycobacterium tuberculosis H37Rv
ucgggaucugggcucgg

SEQ ID NO: 3316195 - RNA, 12 nt, Mycobacterium tuberculosis H37Rv
ucgggaugcgcg

SEQ ID NO: 3316196 - RNA, 16 nt, Mycobacterium tuberculosis H37Rv
ucgggauggacaccac

SEQ ID NO: 3316197 - RNA, 19 nt, Mycobacterium tuberculosis H37Rv
ucgggauggacaccaccuc

SEQ ID NO: 3316198 - RNA, 21 nt, Mycobacterium tuberculosis H37Rv
ucgggauggacggcagccagc

SEQ ID NO: 3316199 - RNA, 22 nt, Mycobacterium tuberculosis H37Rv
ucgggauggacggcagccagcc

SEQ ID NO: 3316200 - RNA, 14 nt, Mycobacterium tuberculosis H37Rv
ucgggcaaagucgg

SEQ ID NO: 3316201 - RNA, 22 nt, Mycobacterium tuberculosis H37Rv
ucgggcaaccggagaucccggu

SEQ ID NO: 3316202 - RNA, 19 nt, Mycobacterium tuberculosis H37Rv
ucgggcaacgccucgagca

SEQ ID NO: 3316203 - RNA, 13 nt, Mycobacterium tuberculosis H37Rv
ucgggcaacucgg

SEQ ID NO: 3316204 - RNA, 15 nt, Mycobacterium tuberculosis H37Rv
ucgggcaacucggug

SEQ ID NO: 3316205 - RNA, 22 nt, Mycobacterium tuberculosis H37Rv
ucgggcacaccgaacggugugc

SEQ ID NO: 3316206 - RNA, 14 nt, Mycobacterium tuberculosis H37Rv
ucgggcacaccgac

SEQ ID NO: 3316207 - RNA, 20 nt, Mycobacterium tuberculosis H37Rv
ucgggcaccccgaccaccag

SEQ ID NO: 3316208 - RNA, 22 nt, Mycobacterium tuberculosis H37Rv
ucgggcaccuccaauugcgaac

SEQ ID NO: 3316209 - RNA, 11 nt, Mycobacterium tuberculosis H37Rv
ucgggcaccug

SEQ ID NO: 3316210 - RNA, 17 nt, Mycobacterium tuberculosis H37Rv
ucgggcacgggugacga

SEQ ID NO: 3316211 - RNA, 21 nt, Mycobacterium tuberculosis H37Rv
ucgggcacgggugacgauguc

SEQ ID NO: 3316212 - RNA, 14 nt, Mycobacterium tuberculosis H37Rv
ucgggcagcgcggc

SEQ ID NO: 3316213 - RNA, 15 nt, Mycobacterium tuberculosis H37Rv
ucgggcagcgcggcc

SEQ ID NO: 3316214 - RNA, 16 nt, Mycobacterium tuberculosis H37Rv
ucgggcagcgcggcca

SEQ ID NO: 3316215 - RNA, 16 nt, Mycobacterium tuberculosis H37Rv
ucgggcagggaccgca

SEQ ID NO: 3316216 - RNA, 22 nt, Mycobacterium tuberculosis H37Rv
ucgggcaugacgaauugguugc

SEQ ID NO: 3316217 - RNA, 16 nt, Mycobacterium tuberculosis H37Rv
ucgggcaugcucuggc

SEQ ID NO: 3316218 - RNA, 14 nt, Mycobacterium tuberculosis H37Rv
ucgggccaggcgaa

SEQ ID NO: 3316219 - RNA, 12 nt, Mycobacterium tuberculosis H37Rv
ucgggcccagca

SEQ ID NO: 3316220 - RNA, 15 nt, Mycobacterium tuberculosis H37Rv
ucgggcccagcgcgc

SEQ ID NO: 3316221 - RNA, 15 nt, Mycobacterium tuberculosis H37Rv
ucgggcccuccggcg

SEQ ID NO: 3316222 - RNA, 17 nt, Mycobacterium tuberculosis H37Rv
ucgggccgccgagcucg

SEQ ID NO: 3316223 - RNA, 19 nt, Mycobacterium tuberculosis H37Rv
ucgggccguccucccacag

SEQ ID NO: 3316224 - RNA, 19 nt, Mycobacterium tuberculosis H37Rv
ucgggccgucgggugugcg

SEQ ID NO: 3316225 - RNA, 14 nt, Mycobacterium tuberculosis H37Rv
ucgggccguugugc

SEQ ID NO: 3316226 - RNA, 16 nt, Mycobacterium tuberculosis H37Rv
ucgggcgaagcuagcg

SEQ ID NO: 3316227 - RNA, 22 nt, Mycobacterium tuberculosis H37Rv
ucgggcgagaucuuuucaccac

SEQ ID NO: 3316228 - RNA, 17 nt, Mycobacterium tuberculosis H37Rv
ucgggcgcccaugcuga

SEQ ID NO: 3316229 - RNA, 21 nt, Mycobacterium tuberculosis H37Rv
ucgggcgcgaaaccgcauguc

SEQ ID NO: 3316230 - RNA, 21 nt, Mycobacterium tuberculosis H37Rv
ucgggcgcgaggacgcugauc

SEQ ID NO: 3316231 - RNA, 22 nt, Mycobacterium tuberculosis H37Rv
ucgggcgcgcggcgagccucgc

SEQ ID NO: 3316232 - RNA, 13 nt, Mycobacterium tuberculosis H37Rv
ucgggcgcgcugc

SEQ ID NO: 3316233 - RNA, 16 nt, Mycobacterium tuberculosis H37Rv
ucgggcgcgggugacc

SEQ ID NO: 3316234 - RNA, 17 nt, Mycobacterium tuberculosis H37Rv
ucgggcgcgguaaccac

SEQ ID NO: 3316235 - RNA, 14 nt, Mycobacterium tuberculosis H37Rv
ucgggcggcgucgc

SEQ ID NO: 3316236 - RNA, 17 nt, Mycobacterium tuberculosis H37Rv
ucgggcgggucggcggc

SEQ ID NO: 3316237 - RNA, 15 nt, Mycobacterium tuberculosis H37Rv
ucgggcgucccggcg

SEQ ID NO: 3316238 - RNA, 18 nt, Mycobacterium tuberculosis H37Rv
ucgggcgugaucccgccc

SEQ ID NO: 3316239 - RNA, 16 nt, Mycobacterium tuberculosis H37Rv
ucgggcucguccagca

SEQ ID NO: 3316240 - RNA, 19 nt, Mycobacterium tuberculosis H37Rv
ucgggcucguccagcaacc

SEQ ID NO: 3316241 - RNA, 17 nt, Mycobacterium tuberculosis H37Rv
ucgggcugccgcaugcg

SEQ ID NO: 3316242 - RNA, 21 nt, Mycobacterium tuberculosis H37Rv
ucgggcugccgcaugcgcucc

SEQ ID NO: 3316243 - RNA, 20 nt, Mycobacterium tuberculosis H37Rv
ucgggcugucaggcucacac

SEQ ID NO: 3316244 - RNA, 19 nt, Mycobacterium tuberculosis H37Rv
ucgggcuugcgcagcagcg

SEQ ID NO: 3316245 - RNA, 11 nt, Mycobacterium tuberculosis H37Rv
ucggggaacac

SEQ ID NO: 3316246 - RNA, 15 nt, Mycobacterium tuberculosis H37Rv
ucggggaacgcggcg

SEQ ID NO: 3316247 - RNA, 16 nt, Mycobacterium tuberculosis H37Rv
ucggggagcugcggcg

SEQ ID NO: 3316248 - RNA, 14 nt, Mycobacterium tuberculosis H37Rv
ucggggccacugag

SEQ ID NO: 3316249 - RNA, 19 nt, Mycobacterium tuberculosis H37Rv
ucggggccgcaggccaggg

SEQ ID NO: 3316250 - RNA, 14 nt, Mycobacterium tuberculosis H37Rv
ucggggcgaugagc

SEQ ID NO: 3316251 - RNA, 23 nt, Mycobacterium tuberculosis H37Rv
ucggggcgcgguaccggugucag

SEQ ID NO: 3316252 - RNA, 16 nt, Mycobacterium tuberculosis H37Rv
ucggggcgucguucgc

SEQ ID NO: 3316253 - RNA, 19 nt, Mycobacterium tuberculosis H37Rv
ucgggggauuucgcgucug

SEQ ID NO: 3316254 - RNA, 20 nt, Mycobacterium tuberculosis H37Rv
ucgggggauuucgcgucugc

SEQ ID NO: 3316255 - RNA, 14 nt, Mycobacterium tuberculosis H37Rv
ucgggggcagcgcc

SEQ ID NO: 3316256 - RNA, 16 nt, Mycobacterium tuberculosis H37Rv
ucgggggcggucgcgu

SEQ ID NO: 3316257 - RNA, 18 nt, Mycobacterium tuberculosis H37Rv
ucgggggcugcacgcucg

SEQ ID NO: 3316258 - RNA, 20 nt, Mycobacterium tuberculosis H37Rv
ucgggggcuuaugcgucugc

SEQ ID NO: 3316259 - RNA, 20 nt, Mycobacterium tuberculosis H37Rv
ucggggggcaggucgagcgc

SEQ ID NO: 3316260 - RNA, 21 nt, Mycobacterium tuberculosis H37Rv
ucggggggcaggucgagcgcc

SEQ ID NO: 3316261 - RNA, 21 nt, Mycobacterium tuberculosis H37Rv
ucggggggccggacugaagcc

SEQ ID NO: 3316262 - RNA, 13 nt, Mycobacterium tuberculosis H37Rv
ucggggguccagu

SEQ ID NO: 3316263 - RNA, 22 nt, Mycobacterium tuberculosis H37Rv
ucggggucgaacaugauccgcc

SEQ ID NO: 3316264 - RNA, 20 nt, Mycobacterium tuberculosis H37Rv
ucgggguggucgcaccgccg

SEQ ID NO: 3316265 - RNA, 16 nt, Mycobacterium tuberculosis H37Rv
ucgggguggugguauc

SEQ ID NO: 3316266 - RNA, 14 nt, Mycobacterium tuberculosis H37Rv
ucgggguuacguug

SEQ ID NO: 3316267 - RNA, 13 nt, Mycobacterium tuberculosis H37Rv
ucgggguugacug

SEQ ID NO: 3316268 - RNA, 13 nt, Mycobacterium tuberculosis H37Rv
ucgggguugcgga

SEQ ID NO: 3316269 - RNA, 23 nt, Mycobacterium tuberculosis H37Rv
ucgggguuuaguuuaucggccgu

SEQ ID NO: 3316270 - RNA, 22 nt, Mycobacterium tuberculosis H37Rv
ucggguaccggcggcaaagcgu

SEQ ID NO: 3316271 - RNA, 15 nt, Mycobacterium tuberculosis H37Rv
ucggguagccgggaa

SEQ ID NO: 3316272 - RNA, 22 nt, Mycobacterium tuberculosis H37Rv
ucggguagggcaucgucgccga

SEQ ID NO: 3316273 - RNA, 16 nt, Mycobacterium tuberculosis H37Rv
ucguaugcggugacga

SEQ ID NO: 3316274 - RNA, 16 nt, Mycobacterium tuberculosis H37Rv
ucgucaaaucuggcug

SEQ ID NO: 3316275 - RNA, 21 nt, Mycobacterium tuberculosis H37Rv
ucgucaaaucuggcuggacca

SEQ ID NO: 3316276 - RNA, 17 nt, Mycobacterium tuberculosis H37Rv
ucgucaaccugcgcauc

SEQ ID NO: 3316277 - RNA, 14 nt, Mycobacterium tuberculosis H37Rv
ucgucacauugcca

SEQ ID NO: 3316278 - RNA, 16 nt, Mycobacterium tuberculosis H37Rv
ucgucacauugccacc

SEQ ID NO: 3316279 - RNA, 17 nt, Mycobacterium tuberculosis H37Rv
ucgucaccgaugcgccg

SEQ ID NO: 3316280 - RNA, 18 nt, Mycobacterium tuberculosis H37Rv
ucgucaccguacgggacg

SEQ ID NO: 3316281 - RNA, 21 nt, Mycobacterium tuberculosis H37Rv
ucgucacgcggguugcgcggc

SEQ ID NO: 3316282 - RNA, 11 nt, Mycobacterium tuberculosis H37Rv
ucgucaggccc

SEQ ID NO: 3316283 - RNA, 15 nt, Mycobacterium tuberculosis H37Rv
ucgucagucaacuca

SEQ ID NO: 3316284 - RNA, 14 nt, Mycobacterium tuberculosis H37Rv
ucguccaccgcgau

SEQ ID NO: 3316285 - RNA, 14 nt, Mycobacterium tuberculosis H37Rv
ucgucccacugcgc

SEQ ID NO: 3316286 - RNA, 18 nt, Mycobacterium tuberculosis H37Rv
ucgucccagaagucguca

SEQ ID NO: 3316287 - RNA, 11 nt, Mycobacterium tuberculosis H37Rv
ucguccccaga

SEQ ID NO: 3316288 - RNA, 17 nt, Mycobacterium tuberculosis H37Rv
ucguccccagaccggcg

SEQ ID NO: 3316289 - RNA, 15 nt, Mycobacterium tuberculosis H37Rv
ucguccgacgggccg

SEQ ID NO: 3316290 - RNA, 20 nt, Mycobacterium tuberculosis H37Rv
ucguccgccgcagcgcaacc

SEQ ID NO: 3316291 - RNA, 21 nt, Mycobacterium tuberculosis H37Rv
ucguccgcggucucagugcuc

SEQ ID NO: 3316292 - RNA, 14 nt, Mycobacterium tuberculosis H37Rv
ucguccggugcgau

SEQ ID NO: 3316293 - RNA, 18 nt, Mycobacterium tuberculosis H37Rv
ucguccuguccgggcugc

SEQ ID NO: 3316294 - RNA, 21 nt, Mycobacterium tuberculosis H37Rv
ucguccuguccgggcugcaug

SEQ ID NO: 3316295 - RNA, 14 nt, Mycobacterium tuberculosis H37Rv
ucgucgaaagccug

SEQ ID NO: 3316296 - RNA, 16 nt, Mycobacterium tuberculosis H37Rv
ucgucgaaagccugga

SEQ ID NO: 3316297 - RNA, 15 nt, Mycobacterium tuberculosis H37Rv
ucgucgacacgguga

SEQ ID NO: 3316298 - RNA, 17 nt, Mycobacterium tuberculosis H37Rv
ucgucgaccacgacguu

SEQ ID NO: 3316299 - RNA, 18 nt, Mycobacterium tuberculosis H37Rv
ucgucgagaagaucucgu

SEQ ID NO: 3316300 - RNA, 23 nt, Mycobacterium tuberculosis H37Rv
ucgucgagagguucgccgucggu

SEQ ID NO: 3316301 - RNA, 19 nt, Mycobacterium tuberculosis H37Rv
ucgucgagcaccacccggg

SEQ ID NO: 3316302 - RNA, 21 nt, Mycobacterium tuberculosis H37Rv
ucgucgagcaccacccgggcc

SEQ ID NO: 3316303 - RNA, 16 nt, Mycobacterium tuberculosis H37Rv
ucgucgagccgaucgc

SEQ ID NO: 3316304 - RNA, 16 nt, Mycobacterium tuberculosis H37Rv
ucgucgagguccucga

SEQ ID NO: 3316305 - RNA, 22 nt, Mycobacterium tuberculosis H37Rv
ucgucgaucgacucacacaccg

SEQ ID NO: 3316306 - RNA, 18 nt, Mycobacterium tuberculosis H37Rv
ucgucgaucgccgcgccg

SEQ ID NO: 3316307 - RNA, 16 nt, Mycobacterium tuberculosis H37Rv
ucgucgaugaagcguc

SEQ ID NO: 3316308 - RNA, 21 nt, Mycobacterium tuberculosis H37Rv
ucgucgauuagcccacccaug

SEQ ID NO: 3316309 - RNA, 15 nt, Mycobacterium tuberculosis H37Rv
ucgucgccagggccg

SEQ ID NO: 3316310 - RNA, 19 nt, Mycobacterium tuberculosis H37Rv
ucgucgccccguucacgcu

SEQ ID NO: 3316311 - RNA, 20 nt, Mycobacterium tuberculosis H37Rv
ucgucgccccguucacgcuc

SEQ ID NO: 3316312 - RNA, 13 nt, Mycobacterium tuberculosis H37Rv
ucgucgccgaccg

SEQ ID NO: 3316313 - RNA, 22 nt, Mycobacterium tuberculosis H37Rv
ucgucgccgucggugccgccgc

SEQ ID NO: 3316314 - RNA, 22 nt, Mycobacterium tuberculosis H37Rv
ucgucgccugcgacuaagggca

SEQ ID NO: 3316315 - RNA, 20 nt, Mycobacterium tuberculosis H37Rv
ucgucgcgauccacuccggc

SEQ ID NO: 3316316 - RNA, 19 nt, Mycobacterium tuberculosis H37Rv
ucgucgcgggccaccgcug

SEQ ID NO: 3316317 - RNA, 17 nt, Mycobacterium tuberculosis H37Rv
ucgucgcggguguucca

SEQ ID NO: 3316318 - RNA, 20 nt, Mycobacterium tuberculosis H37Rv
ucgucgcgugcaucgccugc

SEQ ID NO: 3316319 - RNA, 15 nt, Mycobacterium tuberculosis H37Rv
ucgucgcugagcagc

SEQ ID NO: 3316320 - RNA, 20 nt, Mycobacterium tuberculosis H37Rv
ucgucgcugagcagcgccgc

SEQ ID NO: 3316321 - RNA, 21 nt, Mycobacterium tuberculosis H37Rv
ucgucgcugccgccaccgcug

SEQ ID NO: 3316322 - RNA, 15 nt, Mycobacterium tuberculosis H37Rv
ucgucggacucgucc

SEQ ID NO: 3316323 - RNA, 16 nt, Mycobacterium tuberculosis H37Rv
ucgucggcaacgcugg

SEQ ID NO: 3316324 - RNA, 19 nt, Mycobacterium tuberculosis H37Rv
ucgucggccaugguguucg

SEQ ID NO: 3316325 - RNA, 16 nt, Mycobacterium tuberculosis H37Rv
ucgucggccgacaccg

SEQ ID NO: 3316326 - RNA, 17 nt, Mycobacterium tuberculosis H37Rv
ucgucggccggcacccc

SEQ ID NO: 3316327 - RNA, 18 nt, Mycobacterium tuberculosis H37Rv
ucgucggcgacggccagc

SEQ ID NO: 3316328 - RNA, 16 nt, Mycobacterium tuberculosis H37Rv
ucgucggcgccggcgg

SEQ ID NO: 3316329 - RNA, 20 nt, Mycobacterium tuberculosis H37Rv
ucgucggcgcggcugucgug

SEQ ID NO: 3316330 - RNA, 22 nt, Mycobacterium tuberculosis H37Rv
ucgucggcggcgaacagcccca

SEQ ID NO: 3316331 - RNA, 15 nt, Mycobacterium tuberculosis H37Rv
ucgucggcggcgacg

SEQ ID NO: 3316332 - RNA, 15 nt, Mycobacterium tuberculosis H37Rv
ucgucggcgggcugc

SEQ ID NO: 3316333 - RNA, 11 nt, Mycobacterium tuberculosis H37Rv
ucgucggcguc

SEQ ID NO: 3316334 - RNA, 13 nt, Mycobacterium tuberculosis H37Rv
ucgucggcgucgc

SEQ ID NO: 3316335 - RNA, 20 nt, Mycobacterium tuberculosis H37Rv
ucgucggcuuuggacagguc

SEQ ID NO: 3316336 - RNA, 17 nt, Mycobacterium tuberculosis H37Rv
ucgucgggacgccgccc

SEQ ID NO: 3316337 - RNA, 11 nt, Mycobacterium tuberculosis H37Rv
ucgucgggagc

SEQ ID NO: 3316338 - RNA, 17 nt, Mycobacterium tuberculosis H37Rv
ucgucgggcaugcucug

SEQ ID NO: 3316339 - RNA, 22 nt, Mycobacterium tuberculosis H37Rv
ucgucggguagggcaucgucgc

SEQ ID NO: 3316340 - RNA, 18 nt, Mycobacterium tuberculosis H37Rv
ucgucgggucacccagau

SEQ ID NO: 3316341 - RNA, 21 nt, Mycobacterium tuberculosis H37Rv
ucgucggucaaaccggugccg

SEQ ID NO: 3316342 - RNA, 17 nt, Mycobacterium tuberculosis H37Rv
ucgucggucaccgaaug

SEQ ID NO: 3316343 - RNA, 12 nt, Mycobacterium tuberculosis H37Rv
ucgucggucuca

SEQ ID NO: 3316344 - RNA, 13 nt, Mycobacterium tuberculosis H37Rv
ucgucggucugca

SEQ ID NO: 3316345 - RNA, 13 nt, Mycobacterium tuberculosis H37Rv
ucgucggugauca

SEQ ID NO: 3316346 - RNA, 17 nt, Mycobacterium tuberculosis H37Rv
ucgucgguguccucggu

SEQ ID NO: 3316347 - RNA, 16 nt, Mycobacterium tuberculosis H37Rv
ucgucgguuccgggcg

SEQ ID NO: 3316348 - RNA, 17 nt, Mycobacterium tuberculosis H37Rv
ucgucguacaugggcag

SEQ ID NO: 3316349 - RNA, 20 nt, Mycobacterium tuberculosis H37Rv
ucgucguaccguucgggccg

SEQ ID NO: 3316350 - RNA, 18 nt, Mycobacterium tuberculosis H37Rv
ucgucguaguccaggccg

SEQ ID NO: 3316351 - RNA, 15 nt, Mycobacterium tuberculosis H37Rv
ucgucgucaccgaug

SEQ ID NO: 3316352 - RNA, 19 nt, Mycobacterium tuberculosis H37Rv
ucgucgucaucgagcggga

SEQ ID NO: 3316353 - RNA, 13 nt, Mycobacterium tuberculosis H37Rv
ucgucgucgacgg

SEQ ID NO: 3316354 - RNA, 21 nt, Mycobacterium tuberculosis H37Rv
ucgucgucggcaggcagcucg

SEQ ID NO: 3316355 - RNA, 14 nt, Mycobacterium tuberculosis H37Rv
ucgucgucggcgua

SEQ ID NO: 3316356 - RNA, 20 nt, Mycobacterium tuberculosis H37Rv
ucgucgucggcguagucgcu

SEQ ID NO: 3316357 - RNA, 20 nt, Mycobacterium tuberculosis H37Rv
ucgucgucucgaugcauggc

SEQ ID NO: 3316358 - RNA, 14 nt, Mycobacterium tuberculosis H37Rv
ucgucgugucgccg

SEQ ID NO: 3316359 - RNA, 17 nt, Mycobacterium tuberculosis H37Rv
ucgucgugucgccgccg

SEQ ID NO: 3316360 - RNA, 20 nt, Mycobacterium tuberculosis H37Rv
ucgucguguuggccgggucg

SEQ ID NO: 3316361 - RNA, 20 nt, Mycobacterium tuberculosis H37Rv
ucgucguugagcaucaccgu

SEQ ID NO: 3316362 - RNA, 20 nt, Mycobacterium tuberculosis H37Rv
ucgucguugugugccagcgu

SEQ ID NO: 3316363 - RNA, 22 nt, Mycobacterium tuberculosis H37Rv
ucgucguugugugccagcgugg

SEQ ID NO: 3316364 - RNA, 14 nt, Mycobacterium tuberculosis H37Rv
ucgucucggccacg

SEQ ID NO: 3316365 - RNA, 13 nt, Mycobacterium tuberculosis H37Rv
ucgugaaaccaca

SEQ ID NO: 3316366 - RNA, 16 nt, Mycobacterium tuberculosis H37Rv
ucgugaacacgucgcg

SEQ ID NO: 3316367 - RNA, 21 nt, Mycobacterium tuberculosis H37Rv
ucgugacguuguaggagaacg

SEQ ID NO: 3316368 - RNA, 23 nt, Mycobacterium tuberculosis H37Rv
ucgugagacugggcgcuggaggc

SEQ ID NO: 3316369 - RNA, 16 nt, Mycobacterium tuberculosis H37Rv
ucucgccgggaaacac

SEQ ID NO: 3316370 - RNA, 20 nt, Mycobacterium tuberculosis H37Rv
ucucgccgggaaacaccggc

SEQ ID NO: 3316371 - RNA, 22 nt, Mycobacterium tuberculosis H37Rv
ucucgccuucggggugcacgcg

SEQ ID NO: 3316372 - RNA, 14 nt, Mycobacterium tuberculosis H37Rv
ucucgcgcgcggcg

SEQ ID NO: 3316373 - RNA, 23 nt, Mycobacterium tuberculosis H37Rv
ucucggaccacaucuggucacgg

SEQ ID NO: 3316374 - RNA, 13 nt, Mycobacterium tuberculosis H37Rv
ucucggcaccaca

SEQ ID NO: 3316375 - RNA, 12 nt, Mycobacterium tuberculosis H37Rv
ucucggccaggg

SEQ ID NO: 3316376 - RNA, 19 nt, Mycobacterium tuberculosis H37Rv
ucucggcgcagccggugag

SEQ ID NO: 3316377 - RNA, 21 nt, Mycobacterium tuberculosis H37Rv
ucucggcgggucaggccaggg

SEQ ID NO: 3316378 - RNA, 16 nt, Mycobacterium tuberculosis H37Rv
ucucggcguugccgcc

SEQ ID NO: 3316379 - RNA, 18 nt, Mycobacterium tuberculosis H37Rv
ucucgggcgggucggcgg

SEQ ID NO: 3316380 - RNA, 22 nt, Mycobacterium tuberculosis H37Rv
ucucgguaccaccggcacggug

SEQ ID NO: 3316381 - RNA, 13 nt, Mycobacterium tuberculosis H37Rv
ucucggucccgcc

SEQ ID NO: 3316382 - RNA, 12 nt, Mycobacterium tuberculosis H37Rv
ucucggugcugg

SEQ ID NO: 3316383 - RNA, 18 nt, Mycobacterium tuberculosis H37Rv
ucucggugguccagcgcu

SEQ ID NO: 3316384 - RNA, 14 nt, Mycobacterium tuberculosis H37Rv
ucucgguggugagu

SEQ ID NO: 3316385 - RNA, 17 nt, Mycobacterium tuberculosis H37Rv
ucucgguggugcgcucg

SEQ ID NO: 3316386 - RNA, 23 nt, Mycobacterium tuberculosis H37Rv
ucucgucgccccguucacgcucg

SEQ ID NO: 3316387 - RNA, 12 nt, Mycobacterium tuberculosis H37Rv
ucucgucgucgg

SEQ ID NO: 3316388 - RNA, 22 nt, Mycobacterium tuberculosis H37Rv
ucucguggauggccgccaggcg

SEQ ID NO: 3316389 - RNA, 21 nt, Mycobacterium tuberculosis H37Rv
ucucguuugcuuucagcagga

SEQ ID NO: 3316390 - RNA, 16 nt, Mycobacterium tuberculosis H37Rv
ucucugcgccaggcgg

SEQ ID NO: 3316391 - RNA, 18 nt, Mycobacterium tuberculosis H37Rv
ucugaaaauugacccccu

SEQ ID NO: 3316392 - RNA, 13 nt, Mycobacterium tuberculosis H37Rv
ucugaagcccgac

SEQ ID NO: 3316393 - RNA, 14 nt, Mycobacterium tuberculosis H37Rv
ucugaagguguccg

SEQ ID NO: 3316394 - RNA, 17 nt, Mycobacterium tuberculosis H37Rv
ucugaagucuaaguguu

SEQ ID NO: 3316395 - RNA, 15 nt, Mycobacterium tuberculosis H37Rv
ucugacccaccgccc

SEQ ID NO: 3316396 - RNA, 15 nt, Mycobacterium tuberculosis H37Rv
ucugacccccgaccc

SEQ ID NO: 3316397 - RNA, 17 nt, Mycobacterium tuberculosis H37Rv
ucugacgacgcgacacg

SEQ ID NO: 3316398 - RNA, 20 nt, Mycobacterium tuberculosis H37Rv
ucugacgcuacgacaguguu

SEQ ID NO: 3316399 - RNA, 19 nt, Mycobacterium tuberculosis H37Rv
ucugagacugccgccgcuu

SEQ ID NO: 3316400 - RNA, 21 nt, Mycobacterium tuberculosis H37Rv
ucugagcgcggguggcagcgg

SEQ ID NO: 3316401 - RNA, 23 nt, Mycobacterium tuberculosis H37Rv
ucugagcgcggguggcagcggcg

SEQ ID NO: 3316402 - RNA, 18 nt, Mycobacterium tuberculosis H37Rv
ucugcacauucagcgccg

SEQ ID NO: 3316403 - RNA, 16 nt, Mycobacterium tuberculosis H37Rv
ucugcaccggcaggcg

SEQ ID NO: 3316404 - RNA, 15 nt, Mycobacterium tuberculosis H37Rv
ucugcacgucggccc

SEQ ID NO: 3316405 - RNA, 23 nt, Mycobacterium tuberculosis H37Rv
ucugcagacgguccgcuacggcg

SEQ ID NO: 3316406 - RNA, 15 nt, Mycobacterium tuberculosis H37Rv
ucugcagcgucgucu

SEQ ID NO: 3316407 - RNA, 18 nt, Mycobacterium tuberculosis H37Rv
ucugcagcgucuccuuga

SEQ ID NO: 3316408 - RNA, 19 nt, Mycobacterium tuberculosis H37Rv
ucugcagcgucuccuugag

SEQ ID NO: 3316409 - RNA, 14 nt, Mycobacterium tuberculosis H37Rv
ucugcagugcagcg

SEQ ID NO: 3316410 - RNA, 16 nt, Mycobacterium tuberculosis H37Rv
ucugccaggcgcagcu

SEQ ID NO: 3316411 - RNA, 16 nt, Mycobacterium tuberculosis H37Rv
ucugccaugugucccg

SEQ ID NO: 3316412 - RNA, 23 nt, Mycobacterium tuberculosis H37Rv
ucugcccgagguccgcccucagu

SEQ ID NO: 3316413 - RNA, 17 nt, Mycobacterium tuberculosis H37Rv
ucugcccgcccagcccg

SEQ ID NO: 3316414 - RNA, 20 nt, Mycobacterium tuberculosis H37Rv
ucugcccgcccagcccggcg

SEQ ID NO: 3316415 - RNA, 14 nt, Mycobacterium tuberculosis H37Rv
ucugccggccggcg

SEQ ID NO: 3316416 - RNA, 14 nt, Mycobacterium tuberculosis H37Rv
ucugccgggagacg

SEQ ID NO: 3316417 - RNA, 16 nt, Mycobacterium tuberculosis H37Rv
ucugccggucgauguc

SEQ ID NO: 3316418 - RNA, 20 nt, Mycobacterium tuberculosis H37Rv
ucugccggucgaugucggcg

SEQ ID NO: 3316419 - RNA, 14 nt, Mycobacterium tuberculosis H37Rv
ucugccuuaccaac

SEQ ID NO: 3316420 - RNA, 17 nt, Mycobacterium tuberculosis H37Rv
ucugccuuggccggcuu

SEQ ID NO: 3316421 - RNA, 15 nt, Mycobacterium tuberculosis H37Rv
ucugcgacccgggcc

SEQ ID NO: 3316422 - RNA, 20 nt, Mycobacterium tuberculosis H37Rv
ucugcgagauguccucccau

SEQ ID NO: 3316423 - RNA, 20 nt, Mycobacterium tuberculosis H37Rv
ucugcgcagguggucgauca

SEQ ID NO: 3316424 - RNA, 14 nt, Mycobacterium tuberculosis H37Rv
ucugcgccaaaauc

SEQ ID NO: 3316425 - RNA, 14 nt, Mycobacterium tuberculosis H37Rv
ucugcgccacagca

SEQ ID NO: 3316426 - RNA, 17 nt, Mycobacterium tuberculosis H37Rv
ucugcgccacagcagcg

SEQ ID NO: 3316427 - RNA, 18 nt, Mycobacterium tuberculosis H37Rv
ucugcgccacagcagcgu

SEQ ID NO: 3316428 - RNA, 18 nt, Mycobacterium tuberculosis H37Rv
ucugcgccacgucgacgg

SEQ ID NO: 3316429 - RNA, 19 nt, Mycobacterium tuberculosis H37Rv
ucugcgccuucgccagcgg

SEQ ID NO: 3316430 - RNA, 20 nt, Mycobacterium tuberculosis H37Rv
ucugcgcggugcccgcgaac

SEQ ID NO: 3316431 - RNA, 13 nt, Mycobacterium tuberculosis H37Rv
ucugcggccacgc

SEQ ID NO: 3316432 - RNA, 21 nt, Mycobacterium tuberculosis H37Rv
ucugcggccgcgugccgcccg

SEQ ID NO: 3316433 - RNA, 18 nt, Mycobacterium tuberculosis H37Rv
ucugcggggugagugacc

SEQ ID NO: 3316434 - RNA, 17 nt, Mycobacterium tuberculosis H37Rv
ucugcguauaggucaga

SEQ ID NO: 3316435 - RNA, 14 nt, Mycobacterium tuberculosis H37Rv
ucugcguccaccgg

SEQ ID NO: 3316436 - RNA, 14 nt, Mycobacterium tuberculosis H37Rv
ucugcgugggccug

SEQ ID NO: 3316437 - RNA, 21 nt, Mycobacterium tuberculosis H37Rv
ucugcucacgcggucaacgcu

SEQ ID NO: 3316438 - RNA, 13 nt, Mycobacterium tuberculosis H37Rv
ucugcuccaggcg

SEQ ID NO: 3316439 - RNA, 13 nt, Mycobacterium tuberculosis H37Rv
ucugcucgccagc

SEQ ID NO: 3316440 - RNA, 17 nt, Mycobacterium tuberculosis H37Rv
ucugcucgccagccggc

SEQ ID NO: 3316441 - RNA, 15 nt, Mycobacterium tuberculosis H37Rv
ucugcucgccagcgg

SEQ ID NO: 3316442 - RNA, 21 nt, Mycobacterium tuberculosis H37Rv
ucugcucgcccuauacgcaac

SEQ ID NO: 3316443 - RNA, 22 nt, Mycobacterium tuberculosis H37Rv
ucugcucgccgggcuuaggccg

SEQ ID NO: 3316444 - RNA, 17 nt, Mycobacterium tuberculosis H37Rv
ucugcucggcaucggaa

SEQ ID NO: 3316445 - RNA, 23 nt, Mycobacterium tuberculosis H37Rv
ucugcuggccgaaccgguagucg

SEQ ID NO: 3316446 - RNA, 14 nt, Mycobacterium tuberculosis H37Rv
ucugcuucaguggc

SEQ ID NO: 3316447 - RNA, 16 nt, Mycobacterium tuberculosis H37Rv
ucuggaaccccgagcu

SEQ ID NO: 3316448 - RNA, 21 nt, Mycobacterium tuberculosis H37Rv
ucuggaaccccgagcugccaa

SEQ ID NO: 3316449 - RNA, 13 nt, Mycobacterium tuberculosis H37Rv
ucuggcaggccag

SEQ ID NO: 3316450 - RNA, 22 nt, Mycobacterium tuberculosis H37Rv
ucuggcaggugaacugguugac

SEQ ID NO: 3316451 - RNA, 14 nt, Mycobacterium tuberculosis H37Rv
ucuggccgaagccc

SEQ ID NO: 3316452 - RNA, 14 nt, Mycobacterium tuberculosis H37Rv
ucuggccugcccca

SEQ ID NO: 3316453 - RNA, 21 nt, Mycobacterium tuberculosis H37Rv
ucuggcgacucgugucugccu

SEQ ID NO: 3316454 - RNA, 24 nt, Mycobacterium tuberculosis H37Rv
ucuggcgagggcuaccggcgccgc

SEQ ID NO: 3316455 - RNA, 12 nt, Mycobacterium tuberculosis H37Rv
ucuggcgcagca

SEQ ID NO: 3316456 - RNA, 23 nt, Mycobacterium tuberculosis H37Rv
ucuggcgcgccaccgugguucgg

SEQ ID NO: 3316457 - RNA, 17 nt, Mycobacterium tuberculosis H37Rv
ucuggcgcugcuggcag

SEQ ID NO: 3316458 - RNA, 19 nt, Mycobacterium tuberculosis H37Rv
ucuggcguagugcucgccg

SEQ ID NO: 3316459 - RNA, 18 nt, Mycobacterium tuberculosis H37Rv
ucuggcuacgggccgcgg

SEQ ID NO: 3316460 - RNA, 17 nt, Mycobacterium tuberculosis H37Rv
ucuggcuccggccaggg

SEQ ID NO: 3316461 - RNA, 19 nt, Mycobacterium tuberculosis H37Rv
ucuggcuccggccagggga

SEQ ID NO: 3316462 - RNA, 18 nt, Mycobacterium tuberculosis H37Rv
ucuggcuggaccacucgc

SEQ ID NO: 3316463 - RNA, 18 nt, Mycobacterium tuberculosis H37Rv
ucugggcggugaaggccc

SEQ ID NO: 3316464 - RNA, 12 nt, Mycobacterium tuberculosis H37Rv
ucugggcuggca

SEQ ID NO: 3316465 - RNA, 15 nt, Mycobacterium tuberculosis H37Rv
ugaagguguccgcug

SEQ ID NO: 3316466 - RNA, 19 nt, Mycobacterium tuberculosis H37Rv
ugaagucggugccgagcgc

SEQ ID NO: 3316467 - RNA, 15 nt, Mycobacterium tuberculosis H37Rv
ugaagucuaaguguu

SEQ ID NO: 3316468 - RNA, 18 nt, Mycobacterium tuberculosis H37Rv
ugaagucuuucgcuucgc

SEQ ID NO: 3316469 - RNA, 21 nt, Mycobacterium tuberculosis H37Rv
ugaaguggcgucagugcagaa

SEQ ID NO: 3316470 - RNA, 18 nt, Mycobacterium tuberculosis H37Rv
ugaaguucgggcaacggc

SEQ ID NO: 3316471 - RNA, 17 nt, Mycobacterium tuberculosis H37Rv
ugaaucgcggaugccag

SEQ ID NO: 3316472 - RNA, 18 nt, Mycobacterium tuberculosis H37Rv
ugaaucggaccgaccggc

SEQ ID NO: 3316473 - RNA, 19 nt, Mycobacterium tuberculosis H37Rv
ugaaucggaccgaccggcu

SEQ ID NO: 3316474 - RNA, 18 nt, Mycobacterium tuberculosis H37Rv
ugaaucucacgacgccuu

SEQ ID NO: 3316475 - RNA, 13 nt, Mycobacterium tuberculosis H37Rv
ugaauggugaccg

SEQ ID NO: 3316476 - RNA, 16 nt, Mycobacterium tuberculosis H37Rv
ugaaugugcauagcaa

SEQ ID NO: 3316477 - RNA, 20 nt, Mycobacterium tuberculosis H37Rv
ugaauucgccgaacgguugc

SEQ ID NO: 3316478 - RNA, 16 nt, Mycobacterium tuberculosis H37Rv
ugaauucgcuugcagc

SEQ ID NO: 3316479 - RNA, 14 nt, Mycobacterium tuberculosis H37Rv
ugacaaggaugguc

SEQ ID NO: 3316480 - RNA, 14 nt, Mycobacterium tuberculosis H37Rv
ugacacccaccucg

SEQ ID NO: 3316481 - RNA, 17 nt, Mycobacterium tuberculosis H37Rv
ugacacccaccucgcca

SEQ ID NO: 3316482 - RNA, 20 nt, Mycobacterium tuberculosis H37Rv
ugacaccgaggucggccagc

SEQ ID NO: 3316483 - RNA, 15 nt, Mycobacterium tuberculosis H37Rv
ugacaccggccacca

SEQ ID NO: 3316484 - RNA, 20 nt, Mycobacterium tuberculosis H37Rv
ugacaccggccaccagcccg

SEQ ID NO: 3316485 - RNA, 15 nt, Mycobacterium tuberculosis H37Rv
ugacacgcgcugcgu

SEQ ID NO: 3316486 - RNA, 23 nt, Mycobacterium tuberculosis H37Rv
ugacacgcgcugcgucgucgacg

SEQ ID NO: 3316487 - RNA, 20 nt, Mycobacterium tuberculosis H37Rv
ugacacugccuuaaccgagc

SEQ ID NO: 3316488 - RNA, 17 nt, Mycobacterium tuberculosis H37Rv
ugacacuggggugcugc

SEQ ID NO: 3316489 - RNA, 17 nt, Mycobacterium tuberculosis H37Rv
ugacagcccgcuggccg

SEQ ID NO: 3316490 - RNA, 20 nt, Mycobacterium tuberculosis H37Rv
ugacaggucacgguagcguu

SEQ ID NO: 3316491 - RNA, 13 nt, Mycobacterium tuberculosis H37Rv
ugacagugaccug

SEQ ID NO: 3316492 - RNA, 14 nt, Mycobacterium tuberculosis H37Rv
ugacaucgggccgc

SEQ ID NO: 3316493 - RNA, 13 nt, Mycobacterium tuberculosis H37Rv
ugaccaacccucg

SEQ ID NO: 3316494 - RNA, 22 nt, Mycobacterium tuberculosis H37Rv
ugaccaacgucgcuccgaugug

SEQ ID NO: 3316495 - RNA, 15 nt, Mycobacterium tuberculosis H37Rv
ugaccacaaccguga

SEQ ID NO: 3316496 - RNA, 20 nt, Mycobacterium tuberculosis H37Rv
ugaccacaaccgugagcacc

SEQ ID NO: 3316497 - RNA, 22 nt, Mycobacterium tuberculosis H37Rv
ugaccaccacgaugaccgggga

SEQ ID NO: 3316498 - RNA, 12 nt, Mycobacterium tuberculosis H37Rv
ugaccaccgccg

SEQ ID NO: 3316499 - RNA, 15 nt, Mycobacterium tuberculosis H37Rv
ugaccaccgccgaca

SEQ ID NO: 3316500 - RNA, 19 nt, Mycobacterium tuberculosis H37Rv
ugaccaccgccgacaggcc

SEQ ID NO: 3316501 - RNA, 20 nt, Mycobacterium tuberculosis H37Rv
ugaccaccgggcgcugcuug

SEQ ID NO: 3316502 - RNA, 22 nt, Mycobacterium tuberculosis H37Rv
ugaccacgaacgcgcgcagccg

SEQ ID NO: 3316503 - RNA, 17 nt, Mycobacterium tuberculosis H37Rv
ugaccagaaccuggagc

SEQ ID NO: 3316504 - RNA, 14 nt, Mycobacterium tuberculosis H37Rv
ugaccagcaaccac

SEQ ID NO: 3316505 - RNA, 19 nt, Mycobacterium tuberculosis H37Rv
ugaccagcaaccaccccag

SEQ ID NO: 3316506 - RNA, 16 nt, Mycobacterium tuberculosis H37Rv
ugaccagcacgacggc

SEQ ID NO: 3316507 - RNA, 15 nt, Mycobacterium tuberculosis H37Rv
ugaccagcagcucgu

SEQ ID NO: 3316508 - RNA, 14 nt, Mycobacterium tuberculosis H37Rv
ugaccagcagcuga

SEQ ID NO: 3316509 - RNA, 18 nt, Mycobacterium tuberculosis H37Rv
ugaccagccuuaugcagu

SEQ ID NO: 3316510 - RNA, 19 nt, Mycobacterium tuberculosis H37Rv
ugaccaggaaugucuccag

SEQ ID NO: 3316511 - RNA, 15 nt, Mycobacterium tuberculosis H37Rv
ugaccaggccgacac

SEQ ID NO: 3316512 - RNA, 11 nt, Mycobacterium tuberculosis H37Rv
ugaccaggcgg

SEQ ID NO: 3316513 - RNA, 23 nt, Mycobacterium tuberculosis H37Rv
ugaccaggcggcgcgggucggcg

SEQ ID NO: 3316514 - RNA, 17 nt, Mycobacterium tuberculosis H37Rv
ugaccagggucugcuca

SEQ ID NO: 3316515 - RNA, 23 nt, Mycobacterium tuberculosis H37Rv
ugaccagggugacggaguuggcc

SEQ ID NO: 3316516 - RNA, 16 nt, Mycobacterium tuberculosis H37Rv
ugaccagucgcggcgu

SEQ ID NO: 3316517 - RNA, 23 nt, Mycobacterium tuberculosis H37Rv
ugaccagugaucagcgcaucgcc

SEQ ID NO: 3316518 - RNA, 21 nt, Mycobacterium tuberculosis H37Rv
ugaccaucguguacuggucug

SEQ ID NO: 3316519 - RNA, 23 nt, Mycobacterium tuberculosis H37Rv
ugaccaucguguacuggucugga

SEQ ID NO: 3316520 - RNA, 15 nt, Mycobacterium tuberculosis H37Rv
ugacccacgagagcg

SEQ ID NO: 3316521 - RNA, 21 nt, Mycobacterium tuberculosis H37Rv
ugacccacgagagcgcugucc

SEQ ID NO: 3316522 - RNA, 15 nt, Mycobacterium tuberculosis H37Rv
ugacccacugcaggc

SEQ ID NO: 3316523 - RNA, 22 nt, Mycobacterium tuberculosis H37Rv
ugacccaucaugguccgggccu

SEQ ID NO: 3316524 - RNA, 19 nt, Mycobacterium tuberculosis H37Rv
ugacccauggcuccgccca

SEQ ID NO: 3316525 - RNA, 16 nt, Mycobacterium tuberculosis H37Rv
ugacccauggucacca

SEQ ID NO: 3316526 - RNA, 19 nt, Mycobacterium tuberculosis H37Rv
ugacccauggucaccagcu

SEQ ID NO: 3316527 - RNA, 18 nt, Mycobacterium tuberculosis H37Rv
ugacccccagcagggugu

SEQ ID NO: 3316528 - RNA, 19 nt, Mycobacterium tuberculosis H37Rv
ugacccccgaccccgacgg

SEQ ID NO: 3316529 - RNA, 22 nt, Mycobacterium tuberculosis H37Rv
ugacccccggguagaccaccug

SEQ ID NO: 3316530 - RNA, 22 nt, Mycobacterium tuberculosis H37Rv
ugaccccgcgugaccgacugcg

SEQ ID NO: 3316531 - RNA, 13 nt, Mycobacterium tuberculosis H37Rv
ugaccccggcguu

SEQ ID NO: 3316532 - RNA, 18 nt, Mycobacterium tuberculosis H37Rv
ugaccccggcguugccgc

SEQ ID NO: 3316533 - RNA, 21 nt, Mycobacterium tuberculosis H37Rv
ugacccgacgaugccggcccg

SEQ ID NO: 3316534 - RNA, 15 nt, Mycobacterium tuberculosis H37Rv
ugacccgcaagucga

SEQ ID NO: 3316535 - RNA, 23 nt, Mycobacterium tuberculosis H37Rv
ugacccgccgacgaccgccugca

SEQ ID NO: 3316536 - RNA, 15 nt, Mycobacterium tuberculosis H37Rv
ugacccgcugggccg

SEQ ID NO: 3316537 - RNA, 16 nt, Mycobacterium tuberculosis H37Rv
ugacccgggcggcguu

SEQ ID NO: 3316538 - RNA, 16 nt, Mycobacterium tuberculosis H37Rv
ugacccguuccacgcc

SEQ ID NO: 3316539 - RNA, 15 nt, Mycobacterium tuberculosis H37Rv
ugacccucagcaccg

SEQ ID NO: 3316540 - RNA, 12 nt, Mycobacterium tuberculosis H37Rv
ugacccuggggu

SEQ ID NO: 3316541 - RNA, 21 nt, Mycobacterium tuberculosis H37Rv
ugacccuugugccccgagcug

SEQ ID NO: 3316542 - RNA, 17 nt, Mycobacterium tuberculosis H37Rv
ugaccgaagaagcccga

SEQ ID NO: 3316543 - RNA, 23 nt, Mycobacterium tuberculosis H37Rv
ugaccgaagaagcccgacugguc

SEQ ID NO: 3316544 - RNA, 17 nt, Mycobacterium tuberculosis H37Rv
ugaccgaagucugcaga

SEQ ID NO: 3316545 - RNA, 15 nt, Mycobacterium tuberculosis H37Rv
ugaccgaccacgcga

SEQ ID NO: 3316546 - RNA, 14 nt, Mycobacterium tuberculosis H37Rv
ugaccgaccgccau

SEQ ID NO: 3316547 - RNA, 13 nt, Mycobacterium tuberculosis H37Rv
ugaccgacgccgu

SEQ ID NO: 3316548 - RNA, 20 nt, Mycobacterium tuberculosis H37Rv
ugaccgagaucgucgcgacc

SEQ ID NO: 3316549 - RNA, 14 nt, Mycobacterium tuberculosis H37Rv
ugaccgagccgcga

SEQ ID NO: 3316550 - RNA, 13 nt, Mycobacterium tuberculosis H37Rv
ugaccgaguugaa

SEQ ID NO: 3316551 - RNA, 15 nt, Mycobacterium tuberculosis H37Rv
ugaccgcagucccag

SEQ ID NO: 3316552 - RNA, 13 nt, Mycobacterium tuberculosis H37Rv
ugaccgccagcag

SEQ ID NO: 3316553 - RNA, 18 nt, Mycobacterium tuberculosis H37Rv
ugaccgccaucgccaaca

SEQ ID NO: 3316554 - RNA, 14 nt, Mycobacterium tuberculosis H37Rv
ugaccgccgccgga

SEQ ID NO: 3316555 - RNA, 14 nt, Mycobacterium tuberculosis H37Rv
ugaccgccgcgccg

SEQ ID NO: 3316556 - RNA, 14 nt, Mycobacterium tuberculosis H37Rv
ugaccgcgaucgcc

SEQ ID NO: 3316557 - RNA, 21 nt, Mycobacterium tuberculosis H37Rv
ugaccgcgaugaucgcaucga

SEQ ID NO: 3316558 - RNA, 19 nt, Mycobacterium tuberculosis H37Rv
ugaccgcggucuucuucac

SEQ ID NO: 3316559 - RNA, 17 nt, Mycobacterium tuberculosis H37Rv
ugaccgcguagaccagu

SEQ ID NO: 3316560 - RNA, 21 nt, Mycobacterium tuberculosis H37Rv
ugaccgcguagagcagcagau

SEQ ID NO: 3316561 - RNA, 21 nt, Mycobacterium tuberculosis H37Rv
ugacucugcguccaccggacg

SEQ ID NO: 3316562 - RNA, 15 nt, Mycobacterium tuberculosis H37Rv
ugacugcacaccacc

SEQ ID NO: 3316563 - RNA, 19 nt, Mycobacterium tuberculosis H37Rv
ugacugcgaccgguucggc

SEQ ID NO: 3316564 - RNA, 17 nt, Mycobacterium tuberculosis H37Rv
ugagaaccggcucacca

SEQ ID NO: 3316565 - RNA, 12 nt, Mycobacterium tuberculosis H37Rv
ugagaagaagcc

SEQ ID NO: 3316566 - RNA, 13 nt, Mycobacterium tuberculosis H37Rv
ugagaagaagccc

SEQ ID NO: 3316567 - RNA, 17 nt, Mycobacterium tuberculosis H37Rv
ugagaccagguucucgg

SEQ ID NO: 3316568 - RNA, 22 nt, Mycobacterium tuberculosis H37Rv
ugagaccucagccggcggcugg

SEQ ID NO: 3316569 - RNA, 16 nt, Mycobacterium tuberculosis H37Rv
ugagacgccggggaac

SEQ ID NO: 3316570 - RNA, 19 nt, Mycobacterium tuberculosis H37Rv
ugagaucaugaggugagcu

SEQ ID NO: 3316571 - RNA, 20 nt, Mycobacterium tuberculosis H37Rv
ugagaucaugaggugagcug

SEQ ID NO: 3316572 - RNA, 19 nt, Mycobacterium tuberculosis H37Rv
ugagauggcggugagcacu

SEQ ID NO: 3316573 - RNA, 18 nt, Mycobacterium tuberculosis H37Rv
ugagauugguggcccggg

SEQ ID NO: 3316574 - RNA, 21 nt, Mycobacterium tuberculosis H37Rv
ugagcaagaaguacgugcaca

SEQ ID NO: 3316575 - RNA, 14 nt, Mycobacterium tuberculosis H37Rv
ugagcaaguccugc

SEQ ID NO: 3316576 - RNA, 22 nt, Mycobacterium tuberculosis H37Rv
ugagcaauggcgcgaccgauga

SEQ ID NO: 3316577 - RNA, 17 nt, Mycobacterium tuberculosis H37Rv
ugagcacaccgacagca

SEQ ID NO: 3316578 - RNA, 20 nt, Mycobacterium tuberculosis H37Rv
ugagcacaccgacagcaccc

SEQ ID NO: 3316579 - RNA, 15 nt, Mycobacterium tuberculosis H37Rv
ugagcaccagcagca

SEQ ID NO: 3316580 - RNA, 20 nt, Mycobacterium tuberculosis H37Rv
ugagcaccagcagcaccaac

SEQ ID NO: 3316581 - RNA, 14 nt, Mycobacterium tuberculosis H37Rv
ugagcaccugggcg

SEQ ID NO: 3316582 - RNA, 21 nt, Mycobacterium tuberculosis H37Rv
ugagcaccugggcgcgcuggc

SEQ ID NO: 3316583 - RNA, 16 nt, Mycobacterium tuberculosis H37Rv
ugagcagacccagucc

SEQ ID NO: 3316584 - RNA, 18 nt, Mycobacterium tuberculosis H37Rv
ugagcagacgcaaaagaa

SEQ ID NO: 3316585 - RNA, 15 nt, Mycobacterium tuberculosis H37Rv
ugagcagcacgucau

SEQ ID NO: 3316586 - RNA, 17 nt, Mycobacterium tuberculosis H37Rv
ugagcagcuuagucagg

SEQ ID NO: 3316587 - RNA, 21 nt, Mycobacterium tuberculosis H37Rv
ugagcagcuuagucagggccg

SEQ ID NO: 3316588 - RNA, 17 nt, Mycobacterium tuberculosis H37Rv
ugagcagggcggcgaac

SEQ ID NO: 3316589 - RNA, 22 nt, Mycobacterium tuberculosis H37Rv
ugagcaguucguuccagaugag

SEQ ID NO: 3316590 - RNA, 16 nt, Mycobacterium tuberculosis H37Rv
ugagcauggcuagggc

SEQ ID NO: 3316591 - RNA, 20 nt, Mycobacterium tuberculosis H37Rv
ugagccaccaacaccgcguc

SEQ ID NO: 3316592 - RNA, 18 nt, Mycobacterium tuberculosis H37Rv
ugagccauacgcgcugac

SEQ ID NO: 3316593 - RNA, 20 nt, Mycobacterium tuberculosis H37Rv
ugagccauacgcgcugaccc

SEQ ID NO: 3316594 - RNA, 21 nt, Mycobacterium tuberculosis H37Rv
ugagccauacgcgcugacccg

SEQ ID NO: 3316595 - RNA, 22 nt, Mycobacterium tuberculosis H37Rv
ugagccauacgcgcugacccgc

SEQ ID NO: 3316596 - RNA, 16 nt, Mycobacterium tuberculosis H37Rv
ugagccccccgagccc

SEQ ID NO: 3316597 - RNA, 18 nt, Mycobacterium tuberculosis H37Rv
ugagccccccgagcccgc

SEQ ID NO: 3316598 - RNA, 20 nt, Mycobacterium tuberculosis H37Rv
ugagccccccgagcccgcca

SEQ ID NO: 3316599 - RNA, 20 nt, Mycobacterium tuberculosis H37Rv
ugagcccgcgaucaccauag

SEQ ID NO: 3316600 - RNA, 21 nt, Mycobacterium tuberculosis H37Rv
ugagcccgggauaccgcucag

SEQ ID NO: 3316601 - RNA, 14 nt, Mycobacterium tuberculosis H37Rv
ugagccgagccagc

SEQ ID NO: 3316602 - RNA, 21 nt, Mycobacterium tuberculosis H37Rv
ugagccgcagaugcaccugcg

SEQ ID NO: 3316603 - RNA, 15 nt, Mycobacterium tuberculosis H37Rv
ugagccgcagcaccu

SEQ ID NO: 3316604 - RNA, 18 nt, Mycobacterium tuberculosis H37Rv
ugagccgcgaaaucaccg

SEQ ID NO: 3316605 - RNA, 16 nt, Mycobacterium tuberculosis H37Rv
ugagccgggaucgaag

SEQ ID NO: 3316606 - RNA, 17 nt, Mycobacterium tuberculosis H37Rv
ugagccggucuugcauc

SEQ ID NO: 3316607 - RNA, 16 nt, Mycobacterium tuberculosis H37Rv
ugagccgugccgccag

SEQ ID NO: 3316608 - RNA, 13 nt, Mycobacterium tuberculosis H37Rv
ugagcgaccuggg

SEQ ID NO: 3316609 - RNA, 15 nt, Mycobacterium tuberculosis H37Rv
ugagcgagcgcgcgu

SEQ ID NO: 3316610 - RNA, 17 nt, Mycobacterium tuberculosis H37Rv
ugagcgagcucccgggc

SEQ ID NO: 3316611 - RNA, 15 nt, Mycobacterium tuberculosis H37Rv
ugagcgccacgccga

SEQ ID NO: 3316612 - RNA, 18 nt, Mycobacterium tuberculosis H37Rv
ugagcgccacgccgaggc

SEQ ID NO: 3316613 - RNA, 22 nt, Mycobacterium tuberculosis H37Rv
ugagcgccgauguggccggcga

SEQ ID NO: 3316614 - RNA, 14 nt, Mycobacterium tuberculosis H37Rv
ugagcgccgcggcg

SEQ ID NO: 3316615 - RNA, 20 nt, Mycobacterium tuberculosis H37Rv
ugagcgccggcaucgcgcaa

SEQ ID NO: 3316616 - RNA, 20 nt, Mycobacterium tuberculosis H37Rv
ugagcgcgaaguacgacgac

SEQ ID NO: 3316617 - RNA, 13 nt, Mycobacterium tuberculosis H37Rv
ugagcgcgcucag

SEQ ID NO: 3316618 - RNA, 13 nt, Mycobacterium tuberculosis H37Rv
ugagcgcgcuggc

SEQ ID NO: 3316619 - RNA, 23 nt, Mycobacterium tuberculosis H37Rv
ugagcgcggcuacggucgcagua

SEQ ID NO: 3316620 - RNA, 20 nt, Mycobacterium tuberculosis H37Rv
ugagcgcucgaaagagccgc

SEQ ID NO: 3316621 - RNA, 21 nt, Mycobacterium tuberculosis H37Rv
ugagcgcuucgagguggcugc

SEQ ID NO: 3316622 - RNA, 19 nt, Mycobacterium tuberculosis H37Rv
ugagcggacucgagucugc

SEQ ID NO: 3316623 - RNA, 12 nt, Mycobacterium tuberculosis H37Rv
ugagcggccagc

SEQ ID NO: 3316624 - RNA, 24 nt, Mycobacterium tuberculosis H37Rv
ugagcggccggcaugcuggcgauc

SEQ ID NO: 3316625 - RNA, 22 nt, Mycobacterium tuberculosis H37Rv
ugagcgggcaacugcagcaugg

SEQ ID NO: 3316626 - RNA, 22 nt, Mycobacterium tuberculosis H37Rv
ugagcggggauguccgcggcca

SEQ ID NO: 3316627 - RNA, 17 nt, Mycobacterium tuberculosis H37Rv
ugagcguaguaggcagc

SEQ ID NO: 3316628 - RNA, 16 nt, Mycobacterium tuberculosis H37Rv
ugagcgugagcgccgc

SEQ ID NO: 3316629 - RNA, 16 nt, Mycobacterium tuberculosis H37Rv
ugagcgugccgcagcg

SEQ ID NO: 3316630 - RNA, 21 nt, Mycobacterium tuberculosis H37Rv
ugagcuagccguucggcugcc

SEQ ID NO: 3316631 - RNA, 22 nt, Mycobacterium tuberculosis H37Rv
ugagcucaauggcuucgaagcg

SEQ ID NO: 3316632 - RNA, 20 nt, Mycobacterium tuberculosis H37Rv
ugagcucuucggacacagcc

SEQ ID NO: 3316633 - RNA, 16 nt, Mycobacterium tuberculosis H37Rv
ugagcuuccgcgcgca

SEQ ID NO: 3316634 - RNA, 17 nt, Mycobacterium tuberculosis H37Rv
ugagcuuggucgccggg

SEQ ID NO: 3316635 - RNA, 19 nt, Mycobacterium tuberculosis H37Rv
ugagcuugguggccaccac

SEQ ID NO: 3316636 - RNA, 16 nt, Mycobacterium tuberculosis H37Rv
ugagcuuuaucugcau

SEQ ID NO: 3316637 - RNA, 20 nt, Mycobacterium tuberculosis H37Rv
ugaggaacgccggcaucgcg

SEQ ID NO: 3316638 - RNA, 11 nt, Mycobacterium tuberculosis H37Rv
ugaggaagccc

SEQ ID NO: 3316639 - RNA, 14 nt, Mycobacterium tuberculosis H37Rv
ugaggacauccggc

SEQ ID NO: 3316640 - RNA, 22 nt, Mycobacterium tuberculosis H37Rv
ugaggacuugcacgucggcugc

SEQ ID NO: 3316641 - RNA, 18 nt, Mycobacterium tuberculosis H37Rv
ugaggagaugagcaccaa

SEQ ID NO: 3316642 - RNA, 15 nt, Mycobacterium tuberculosis H37Rv
ugaggaucauggcgu

SEQ ID NO: 3316643 - RNA, 14 nt, Mycobacterium tuberculosis H37Rv
ugaggaucaugucc

SEQ ID NO: 3316644 - RNA, 19 nt, Mycobacterium tuberculosis H37Rv
ugaggaucccggccggguc

SEQ ID NO: 3316645 - RNA, 21 nt, Mycobacterium tuberculosis H37Rv
ugaggaucccggccgggucga

SEQ ID NO: 3316646 - RNA, 16 nt, Mycobacterium tuberculosis H37Rv
ugaggauggcugcggg

SEQ ID NO: 3316647 - RNA, 13 nt, Mycobacterium tuberculosis H37Rv
ugaggccggugaa

SEQ ID NO: 3316648 - RNA, 22 nt, Mycobacterium tuberculosis H37Rv
ugaggccggugaacggcagcac

SEQ ID NO: 3316649 - RNA, 15 nt, Mycobacterium tuberculosis H37Rv
ugaggcgcagcgcca

SEQ ID NO: 3316650 - RNA, 18 nt, Mycobacterium tuberculosis H37Rv
ugaggcgcagcgccagcg

SEQ ID NO: 3316651 - RNA, 17 nt, Mycobacterium tuberculosis H37Rv
ugaggcugccgaaguug

SEQ ID NO: 3316652 - RNA, 13 nt, Mycobacterium tuberculosis H37Rv
ugaggcuggucug

SEQ ID NO: 3316653 - RNA, 16 nt, Mycobacterium tuberculosis H37Rv
ugaggcugugccccag

SEQ ID NO: 3316654 - RNA, 21 nt, Mycobacterium tuberculosis H37Rv
ugagggcgucgucgaguuggc

SEQ ID NO: 3316655 - RNA, 20 nt, Mycobacterium tuberculosis H37Rv
ugagggugagccgagccagc

SEQ ID NO: 3316656 - RNA, 20 nt, Mycobacterium tuberculosis H37Rv
ugagguaauucgcggcccga

SEQ ID NO: 3316657 - RNA, 18 nt, Mycobacterium tuberculosis H37Rv
ugaugguguacacgucgc

SEQ ID NO: 3316658 - RNA, 18 nt, Mycobacterium tuberculosis H37Rv
ugaugguguccucgucga

SEQ ID NO: 3316659 - RNA, 17 nt, Mycobacterium tuberculosis H37Rv
ugauggugugcagcagc

SEQ ID NO: 3316660 - RNA, 18 nt, Mycobacterium tuberculosis H37Rv
ugauguacccggcgacgu

SEQ ID NO: 3316661 - RNA, 21 nt, Mycobacterium tuberculosis H37Rv
ugauguagcggcguuccgggc

SEQ ID NO: 3316662 - RNA, 18 nt, Mycobacterium tuberculosis H37Rv
ugauguagggcugcuccu

SEQ ID NO: 3316663 - RNA, 22 nt, Mycobacterium tuberculosis H37Rv
ugauguuuuccccgcccuugcc

SEQ ID NO: 3316664 - RNA, 14 nt, Mycobacterium tuberculosis H37Rv
ugauuccacugggc

SEQ ID NO: 3316665 - RNA, 11 nt, Mycobacterium tuberculosis H37Rv
ugauuccaggu

SEQ ID NO: 3316666 - RNA, 13 nt, Mycobacterium tuberculosis H37Rv
ugauucggcgacg

SEQ ID NO: 3316667 - RNA, 14 nt, Mycobacterium tuberculosis H37Rv
ugauucggcgacga

SEQ ID NO: 3316668 - RNA, 22 nt, Mycobacterium tuberculosis H37Rv
ugauucugguucagccauucua

SEQ ID NO: 3316669 - RNA, 13 nt, Mycobacterium tuberculosis H37Rv
ugauugacugcuu

SEQ ID NO: 3316670 - RNA, 22 nt, Mycobacterium tuberculosis H37Rv
ugauugcgaccgcgccaacaga

SEQ ID NO: 3316671 - RNA, 13 nt, Mycobacterium tuberculosis H37Rv
ugauugugcccag

SEQ ID NO: 3316672 - RNA, 19 nt, Mycobacterium tuberculosis H37Rv
ugauuuuucgcagugacgu

SEQ ID NO: 3316673 - RNA, 18 nt, Mycobacterium tuberculosis H37Rv
ugcaaauuuguucuggug

SEQ ID NO: 3316674 - RNA, 15 nt, Mycobacterium tuberculosis H37Rv
ugcaacaccgcaccg

SEQ ID NO: 3316675 - RNA, 14 nt, Mycobacterium tuberculosis H37Rv
ugcaaccagcggca

SEQ ID NO: 3316676 - RNA, 21 nt, Mycobacterium tuberculosis H37Rv
ugcaacccggucggcagcugg

SEQ ID NO: 3316677 - RNA, 18 nt, Mycobacterium tuberculosis H37Rv
ugcaaccgccggugccga

SEQ ID NO: 3316678 - RNA, 21 nt, Mycobacterium tuberculosis H37Rv
ugcaaccgugccgcaucaccc

SEQ ID NO: 3316679 - RNA, 15 nt, Mycobacterium tuberculosis H37Rv
ugcaacgccaaaaug

SEQ ID NO: 3316680 - RNA, 11 nt, Mycobacterium tuberculosis H37Rv
ugcaacucggc

SEQ ID NO: 3316681 - RNA, 15 nt, Mycobacterium tuberculosis H37Rv
ugcaacucggcagau

SEQ ID NO: 3316682 - RNA, 22 nt, Mycobacterium tuberculosis H37Rv
ugcaagacaaagccgucgacgc

SEQ ID NO: 3316683 - RNA, 18 nt, Mycobacterium tuberculosis H37Rv
ugcaaggaauuccggcug

SEQ ID NO: 3316684 - RNA, 14 nt, Mycobacterium tuberculosis H37Rv
ugcaaugacuggac

SEQ ID NO: 3316685 - RNA, 14 nt, Mycobacterium tuberculosis H37Rv
ugcaaugcuggcgg

SEQ ID NO: 3316686 - RNA, 14 nt, Mycobacterium tuberculosis H37Rv
ugcaauuucagccu

SEQ ID NO: 3316687 - RNA, 22 nt, Mycobacterium tuberculosis H37Rv
ugcacaaaauacuccgcgagcc

SEQ ID NO: 3316688 - RNA, 17 nt, Mycobacterium tuberculosis H37Rv
ugcacaaccgcugcugc

SEQ ID NO: 3316689 - RNA, 15 nt, Mycobacterium tuberculosis H37Rv
ugcacaacgcccacc

SEQ ID NO: 3316690 - RNA, 17 nt, Mycobacterium tuberculosis H37Rv
ugcacaacgcccaccac

SEQ ID NO: 3316691 - RNA, 19 nt, Mycobacterium tuberculosis H37Rv
ugcacacagaggucgguca

SEQ ID NO: 3316692 - RNA, 19 nt, Mycobacterium tuberculosis H37Rv
ugcacaccgggcaccaguc

SEQ ID NO: 3316693 - RNA, 13 nt, Mycobacterium tuberculosis H37Rv
ugcacaccgucgc

SEQ ID NO: 3316694 - RNA, 16 nt, Mycobacterium tuberculosis H37Rv
ugcacaccgucgcacc

SEQ ID NO: 3316695 - RNA, 14 nt, Mycobacterium tuberculosis H37Rv
ugcacagcagcggu

SEQ ID NO: 3316696 - RNA, 17 nt, Mycobacterium tuberculosis H37Rv
ugcacagcagcgguuga

SEQ ID NO: 3316697 - RNA, 20 nt, Mycobacterium tuberculosis H37Rv
ugcacagcagcgucaucagg

SEQ ID NO: 3316698 - RNA, 18 nt, Mycobacterium tuberculosis H37Rv
ugcacagcagugaacgua

SEQ ID NO: 3316699 - RNA, 21 nt, Mycobacterium tuberculosis H37Rv
ugcacagcggcaucgcgggcg

SEQ ID NO: 3316700 - RNA, 14 nt, Mycobacterium tuberculosis H37Rv
ugcacaggauuggc

SEQ ID NO: 3316701 - RNA, 13 nt, Mycobacterium tuberculosis H37Rv
ugcacaggucagc

SEQ ID NO: 3316702 - RNA, 22 nt, Mycobacterium tuberculosis H37Rv
ugcacaucggugguuagguggc

SEQ ID NO: 3316703 - RNA, 21 nt, Mycobacterium tuberculosis H37Rv
ugcaccacauuggcgaucagc

SEQ ID NO: 3316704 - RNA, 23 nt, Mycobacterium tuberculosis H37Rv
ugcaccagcucggugaucaccau

SEQ ID NO: 3316705 - RNA, 18 nt, Mycobacterium tuberculosis H37Rv
ugcaccagguugcaaccu

SEQ ID NO: 3316706 - RNA, 22 nt, Mycobacterium tuberculosis H37Rv
ugcacccaccccgaagaugccu

SEQ ID NO: 3316707 - RNA, 14 nt, Mycobacterium tuberculosis H37Rv
ugcacccagccgug

SEQ ID NO: 3316708 - RNA, 22 nt, Mycobacterium tuberculosis H37Rv
ugcacccagccgugcccaagcu

SEQ ID NO: 3316709 - RNA, 22 nt, Mycobacterium tuberculosis H37Rv
ugcacccaggcaucggugagcc

SEQ ID NO: 3316710 - RNA, 15 nt, Mycobacterium tuberculosis H37Rv
ugcacccgaucgacg

SEQ ID NO: 3316711 - RNA, 15 nt, Mycobacterium tuberculosis H37Rv
ugcacccgccagggc

SEQ ID NO: 3316712 - RNA, 18 nt, Mycobacterium tuberculosis H37Rv
ugcacccggagaaucggu

SEQ ID NO: 3316713 - RNA, 13 nt, Mycobacterium tuberculosis H37Rv
ugcacccgggccg

SEQ ID NO: 3316714 - RNA, 19 nt, Mycobacterium tuberculosis H37Rv
ugcaccgaagauggccagc

SEQ ID NO: 3316715 - RNA, 17 nt, Mycobacterium tuberculosis H37Rv
ugcaccgagccgucguc

SEQ ID NO: 3316716 - RNA, 20 nt, Mycobacterium tuberculosis H37Rv
ugcaccgcauuguugaagaa

SEQ ID NO: 3316717 - RNA, 16 nt, Mycobacterium tuberculosis H37Rv
ugcaccgccaggucga

SEQ ID NO: 3316718 - RNA, 14 nt, Mycobacterium tuberculosis H37Rv
ugcaccgcgaccgc

SEQ ID NO: 3316719 - RNA, 16 nt, Mycobacterium tuberculosis H37Rv
ugcaccguuguaugcu

SEQ ID NO: 3316720 - RNA, 15 nt, Mycobacterium tuberculosis H37Rv
ugcaccuccagguag

SEQ ID NO: 3316721 - RNA, 17 nt, Mycobacterium tuberculosis H37Rv
ugcaccuccgacggccg

SEQ ID NO: 3316722 - RNA, 19 nt, Mycobacterium tuberculosis H37Rv
ugcaccucguguccgggga

SEQ ID NO: 3316723 - RNA, 19 nt, Mycobacterium tuberculosis H37Rv
ugcaccugcgaggugccgg

SEQ ID NO: 3316724 - RNA, 20 nt, Mycobacterium tuberculosis H37Rv
ugcaccuggaucagggcuuu

SEQ ID NO: 3316725 - RNA, 14 nt, Mycobacterium tuberculosis H37Rv
ugcacgaacgccug

SEQ ID NO: 3316726 - RNA, 19 nt, Mycobacterium tuberculosis H37Rv
ugcacgagcggacagggag

SEQ ID NO: 3316727 - RNA, 17 nt, Mycobacterium tuberculosis H37Rv
ugcacgauacucaccga

SEQ ID NO: 3316728 - RNA, 14 nt, Mycobacterium tuberculosis H37Rv
ugcacgaucgcggu

SEQ ID NO: 3316729 - RNA, 20 nt, Mycobacterium tuberculosis H37Rv
ugcacgcaccacaauccacg

SEQ ID NO: 3316730 - RNA, 16 nt, Mycobacterium tuberculosis H37Rv
ugcacgccggcgcugg

SEQ ID NO: 3316731 - RNA, 19 nt, Mycobacterium tuberculosis H37Rv
ugcacgccucaaaaaucgu

SEQ ID NO: 3316732 - RNA, 20 nt, Mycobacterium tuberculosis H37Rv
ugcacgcgggcguuggccag

SEQ ID NO: 3316733 - RNA, 22 nt, Mycobacterium tuberculosis H37Rv
ugcacgcgggcguuggccagca

SEQ ID NO: 3316734 - RNA, 20 nt, Mycobacterium tuberculosis H37Rv
ugcacgcgggugccgacguc

SEQ ID NO: 3316735 - RNA, 17 nt, Mycobacterium tuberculosis H37Rv
ugcacgcucggcgccgu

SEQ ID NO: 3316736 - RNA, 20 nt, Mycobacterium tuberculosis H37Rv
ugcacgcucugcgccacagc

SEQ ID NO: 3316737 - RNA, 20 nt, Mycobacterium tuberculosis H37Rv
ugcacgcugagccggucgcg

SEQ ID NO: 3316738 - RNA, 22 nt, Mycobacterium tuberculosis H37Rv
ugcacgcugagccggucgcgca

SEQ ID NO: 3316739 - RNA, 21 nt, Mycobacterium tuberculosis H37Rv
ugcacggccaugaucacaccg

SEQ ID NO: 3316740 - RNA, 23 nt, Mycobacterium tuberculosis H37Rv
ugcacggccgucauuuccacauc

SEQ ID NO: 3316741 - RNA, 14 nt, Mycobacterium tuberculosis H37Rv
ugcacggcgauugc

SEQ ID NO: 3316742 - RNA, 16 nt, Mycobacterium tuberculosis H37Rv
ugcacggcgcuaccag

SEQ ID NO: 3316743 - RNA, 21 nt, Mycobacterium tuberculosis H37Rv
ugcacgguaucggugcugguc

SEQ ID NO: 3316744 - RNA, 13 nt, Mycobacterium tuberculosis H37Rv
ugcacggucaacg

SEQ ID NO: 3316745 - RNA, 21 nt, Mycobacterium tuberculosis H37Rv
ugcacggucaacgaucccggg

SEQ ID NO: 3316746 - RNA, 18 nt, Mycobacterium tuberculosis H37Rv
ugcacggucaugccgccg

SEQ ID NO: 3316747 - RNA, 14 nt, Mycobacterium tuberculosis H37Rv
ugcacggugcccag

SEQ ID NO: 3316748 - RNA, 15 nt, Mycobacterium tuberculosis H37Rv
ugcacggugcccagg

SEQ ID NO: 3316749 - RNA, 16 nt, Mycobacterium tuberculosis H37Rv
ugcacguacucggcca

SEQ ID NO: 3316750 - RNA, 23 nt, Mycobacterium tuberculosis H37Rv
ugcacgucaucggcuggccgcgc

SEQ ID NO: 3316751 - RNA, 15 nt, Mycobacterium tuberculosis H37Rv
ugcacgucgagcagg

SEQ ID NO: 3316752 - RNA, 20 nt, Mycobacterium tuberculosis H37Rv
ugcacguggccacggcauuc

SEQ ID NO: 3316753 - RNA, 14 nt, Mycobacterium tuberculosis H37Rv
ugccaccacgcucc

SEQ ID NO: 3316754 - RNA, 13 nt, Mycobacterium tuberculosis H37Rv
ugccacccuugcc

SEQ ID NO: 3316755 - RNA, 14 nt, Mycobacterium tuberculosis H37Rv
ugccaccgccgccg

SEQ ID NO: 3316756 - RNA, 14 nt, Mycobacterium tuberculosis H37Rv
ugccaccgcggccg

SEQ ID NO: 3316757 - RNA, 22 nt, Mycobacterium tuberculosis H37Rv
ugccaccgcggccgcggucgau

SEQ ID NO: 3316758 - RNA, 22 nt, Mycobacterium tuberculosis H37Rv
ugccaccgcuugaccccuggcc

SEQ ID NO: 3316759 - RNA, 12 nt, Mycobacterium tuberculosis H37Rv
ugccaccggcug

SEQ ID NO: 3316760 - RNA, 12 nt, Mycobacterium tuberculosis H37Rv
ugccaccgugca

SEQ ID NO: 3316761 - RNA, 18 nt, Mycobacterium tuberculosis H37Rv
ugccaccucgacgcaccu

SEQ ID NO: 3316762 - RNA, 20 nt, Mycobacterium tuberculosis H37Rv
ugccaccugacuaccgucau

SEQ ID NO: 3316763 - RNA, 21 nt, Mycobacterium tuberculosis H37Rv
ugccaccugacuaccgucauc

SEQ ID NO: 3316764 - RNA, 23 nt, Mycobacterium tuberculosis H37Rv
ugccacgaacgcuuccagcgugu

SEQ ID NO: 3316765 - RNA, 22 nt, Mycobacterium tuberculosis H37Rv
ugccacgacgaacaccagcgcg

SEQ ID NO: 3316766 - RNA, 23 nt, Mycobacterium tuberculosis H37Rv
ugccacgacgaacaccagcgcgc

SEQ ID NO: 3316767 - RNA, 19 nt, Mycobacterium tuberculosis H37Rv
ugccacgaucggcgggggu

SEQ ID NO: 3316768 - RNA, 13 nt, Mycobacterium tuberculosis H37Rv
ugccacgccgccg

SEQ ID NO: 3316769 - RNA, 21 nt, Mycobacterium tuberculosis H37Rv
ugccacgcguuccuccagcag

SEQ ID NO: 3316770 - RNA, 18 nt, Mycobacterium tuberculosis H37Rv
ugccacgcucggugcugc

SEQ ID NO: 3316771 - RNA, 22 nt, Mycobacterium tuberculosis H37Rv
ugccacgcucggugcugcgccg

SEQ ID NO: 3316772 - RNA, 15 nt, Mycobacterium tuberculosis H37Rv
ugccacggccuucag

SEQ ID NO: 3316773 - RNA, 21 nt, Mycobacterium tuberculosis H37Rv
ugccacggugacccugguggu

SEQ ID NO: 3316774 - RNA, 23 nt, Mycobacterium tuberculosis H37Rv
ugccacggugacccugguggugc

SEQ ID NO: 3316775 - RNA, 17 nt, Mycobacterium tuberculosis H37Rv
ugccacguucgcgggcg

SEQ ID NO: 3316776 - RNA, 21 nt, Mycobacterium tuberculosis H37Rv
ugccacuccaggagccgagga

SEQ ID NO: 3316777 - RNA, 18 nt, Mycobacterium tuberculosis H37Rv
ugccacugccguugccgc

SEQ ID NO: 3316778 - RNA, 19 nt, Mycobacterium tuberculosis H37Rv
ugccacugccguugccgcc

SEQ ID NO: 3316779 - RNA, 15 nt, Mycobacterium tuberculosis H37Rv
ugccagaccagggca

SEQ ID NO: 3316780 - RNA, 14 nt, Mycobacterium tuberculosis H37Rv
ugccagaucagcac

SEQ ID NO: 3316781 - RNA, 19 nt, Mycobacterium tuberculosis H37Rv
ugccagaucagcaccgaca

SEQ ID NO: 3316782 - RNA, 18 nt, Mycobacterium tuberculosis H37Rv
ugccagaucggcgggugg

SEQ ID NO: 3316783 - RNA, 19 nt, Mycobacterium tuberculosis H37Rv
ugccagcaccacgucgacg

SEQ ID NO: 3316784 - RNA, 17 nt, Mycobacterium tuberculosis H37Rv
ugccagcaggccgaaga

SEQ ID NO: 3316785 - RNA, 19 nt, Mycobacterium tuberculosis H37Rv
ugccagcaggccgaagaaa

SEQ ID NO: 3316786 - RNA, 17 nt, Mycobacterium tuberculosis H37Rv
ugccagccacgaacuga

SEQ ID NO: 3316787 - RNA, 15 nt, Mycobacterium tuberculosis H37Rv
ugccagccggucgau

SEQ ID NO: 3316788 - RNA, 19 nt, Mycobacterium tuberculosis H37Rv
ugccagccgucaccgcgac

SEQ ID NO: 3316789 - RNA, 20 nt, Mycobacterium tuberculosis H37Rv
ugccagccgucaccgcgacc

SEQ ID NO: 3316790 - RNA, 21 nt, Mycobacterium tuberculosis H37Rv
ugccagccgucaccgcgaccc

SEQ ID NO: 3316791 - RNA, 21 nt, Mycobacterium tuberculosis H37Rv
ugccagccgucgucagguggc

SEQ ID NO: 3316792 - RNA, 13 nt, Mycobacterium tuberculosis H37Rv
ugccagccgugca

SEQ ID NO: 3316793 - RNA, 15 nt, Mycobacterium tuberculosis H37Rv
ugccagccgugcagg

SEQ ID NO: 3316794 - RNA, 16 nt, Mycobacterium tuberculosis H37Rv
ugccagcggcacaccc

SEQ ID NO: 3316795 - RNA, 16 nt, Mycobacterium tuberculosis H37Rv
ugccagcggccgggcg

SEQ ID NO: 3316796 - RNA, 14 nt, Mycobacterium tuberculosis H37Rv
ugccaggaccgcgc

SEQ ID NO: 3316797 - RNA, 20 nt, Mycobacterium tuberculosis H37Rv
ugccaggacuggcaccgcca

SEQ ID NO: 3316798 - RNA, 16 nt, Mycobacterium tuberculosis H37Rv
ugccaggcgcagcugg

SEQ ID NO: 3316799 - RNA, 19 nt, Mycobacterium tuberculosis H37Rv
ugccaggugcggugaucga

SEQ ID NO: 3316800 - RNA, 18 nt, Mycobacterium tuberculosis H37Rv
ugccaggugcuguuuggu

SEQ ID NO: 3316801 - RNA, 14 nt, Mycobacterium tuberculosis H37Rv
ugccaguacucggc

SEQ ID NO: 3316802 - RNA, 18 nt, Mycobacterium tuberculosis H37Rv
ugccaguacucggccagc

SEQ ID NO: 3316803 - RNA, 22 nt, Mycobacterium tuberculosis H37Rv
ugccaguacucggccagcgccu

SEQ ID NO: 3316804 - RNA, 23 nt, Mycobacterium tuberculosis H37Rv
ugccaguagucgccgggcggccg

SEQ ID NO: 3316805 - RNA, 15 nt, Mycobacterium tuberculosis H37Rv
ugccagucgaucgcg

SEQ ID NO: 3316806 - RNA, 17 nt, Mycobacterium tuberculosis H37Rv
ugccagugauggcgcgg

SEQ ID NO: 3316807 - RNA, 20 nt, Mycobacterium tuberculosis H37Rv
ugccagugccgcccaccaca

SEQ ID NO: 3316808 - RNA, 15 nt, Mycobacterium tuberculosis H37Rv
ugccagugcugcacc

SEQ ID NO: 3316809 - RNA, 15 nt, Mycobacterium tuberculosis H37Rv
ugccauacagcaccc

SEQ ID NO: 3316810 - RNA, 17 nt, Mycobacterium tuberculosis H37Rv
ugccaucaaggccaccu

SEQ ID NO: 3316811 - RNA, 19 nt, Mycobacterium tuberculosis H37Rv
ugccauccuuaugcgcggu

SEQ ID NO: 3316812 - RNA, 18 nt, Mycobacterium tuberculosis H37Rv
ugccaucgggaccgggga

SEQ ID NO: 3316813 - RNA, 16 nt, Mycobacterium tuberculosis H37Rv
ugccaucgggcgcggu

SEQ ID NO: 3316814 - RNA, 19 nt, Mycobacterium tuberculosis H37Rv
ugccaucgggcgcgguaac

SEQ ID NO: 3316815 - RNA, 22 nt, Mycobacterium tuberculosis H37Rv
ugccaucgggcgcgguaaccac

SEQ ID NO: 3316816 - RNA, 13 nt, Mycobacterium tuberculosis H37Rv
ugccaucuacauc

SEQ ID NO: 3316817 - RNA, 17 nt, Mycobacterium tuberculosis H37Rv
ugccauggauguaggcu

SEQ ID NO: 3316818 - RNA, 18 nt, Mycobacterium tuberculosis H37Rv
ugcccaagcucagggugg

SEQ ID NO: 3316819 - RNA, 21 nt, Mycobacterium tuberculosis H37Rv
ugcccaccaccgacagcaccc

SEQ ID NO: 3316820 - RNA, 20 nt, Mycobacterium tuberculosis H37Rv
ugcccaccuucgaguuuggu

SEQ ID NO: 3316821 - RNA, 18 nt, Mycobacterium tuberculosis H37Rv
ugcccacgcacagcaacg

SEQ ID NO: 3316822 - RNA, 20 nt, Mycobacterium tuberculosis H37Rv
ugcccacgcacagcaacgcc

SEQ ID NO: 3316823 - RNA, 15 nt, Mycobacterium tuberculosis H37Rv
ugcccacgcgcagaa

SEQ ID NO: 3316824 - RNA, 20 nt, Mycobacterium tuberculosis H37Rv
ugcccacggagggcaggaga

SEQ ID NO: 3316825 - RNA, 19 nt, Mycobacterium tuberculosis H37Rv
ugcccacggcgaccacgcc

SEQ ID NO: 3316826 - RNA, 22 nt, Mycobacterium tuberculosis H37Rv
ugcccacggugccggcacccga

SEQ ID NO: 3316827 - RNA, 19 nt, Mycobacterium tuberculosis H37Rv
ugcccacguuggccaggcc

SEQ ID NO: 3316828 - RNA, 19 nt, Mycobacterium tuberculosis H37Rv
ugcccagaaaaccgccgca

SEQ ID NO: 3316829 - RNA, 19 nt, Mycobacterium tuberculosis H37Rv
ugcccagcacccccugcac

SEQ ID NO: 3316830 - RNA, 23 nt, Mycobacterium tuberculosis H37Rv
ugcccagcacccccugcaccguc

SEQ ID NO: 3316831 - RNA, 18 nt, Mycobacterium tuberculosis H37Rv
ugcccagcaugaaguccc

SEQ ID NO: 3316832 - RNA, 20 nt, Mycobacterium tuberculosis H37Rv
ugcccagcgaauccaggccg

SEQ ID NO: 3316833 - RNA, 19 nt, Mycobacterium tuberculosis H37Rv
ugcccagcgcacggaccau

SEQ ID NO: 3316834 - RNA, 21 nt, Mycobacterium tuberculosis H37Rv
ugcccaggaaggcgacgccga

SEQ ID NO: 3316835 - RNA, 22 nt, Mycobacterium tuberculosis H37Rv
ugcccaggaaggcgacgccgaa

SEQ ID NO: 3316836 - RNA, 23 nt, Mycobacterium tuberculosis H37Rv
ugcccaggaaggcgacgccgaaa

SEQ ID NO: 3316837 - RNA, 17 nt, Mycobacterium tuberculosis H37Rv
ugcccaggcucgcaccg

SEQ ID NO: 3316838 - RNA, 18 nt, Mycobacterium tuberculosis H37Rv
ugcccaggucuccaucaa

SEQ ID NO: 3316839 - RNA, 23 nt, Mycobacterium tuberculosis H37Rv
ugcccaggugcguccaggccagg

SEQ ID NO: 3316840 - RNA, 16 nt, Mycobacterium tuberculosis H37Rv
ugcccaguguccggcg

SEQ ID NO: 3316841 - RNA, 19 nt, Mycobacterium tuberculosis H37Rv
ugcccaguguccggcgacg

SEQ ID NO: 3316842 - RNA, 13 nt, Mycobacterium tuberculosis H37Rv
ugcccaucaccag

SEQ ID NO: 3316843 - RNA, 16 nt, Mycobacterium tuberculosis H37Rv
ugcccaucacgcccca

SEQ ID NO: 3316844 - RNA, 13 nt, Mycobacterium tuberculosis H37Rv
ugcccaucuccaa

SEQ ID NO: 3316845 - RNA, 20 nt, Mycobacterium tuberculosis H37Rv
ugcccaugauggccgcggcu

SEQ ID NO: 3316846 - RNA, 16 nt, Mycobacterium tuberculosis H37Rv
ugccccacccgcggcg

SEQ ID NO: 3316847 - RNA, 23 nt, Mycobacterium tuberculosis H37Rv
ugccccaguccgaagcugcugcu

SEQ ID NO: 3316848 - RNA, 16 nt, Mycobacterium tuberculosis H37Rv
ugccgacgcgcggcca

SEQ ID NO: 3316849 - RNA, 19 nt, Mycobacterium tuberculosis H37Rv
ugccgacgcucacgcugcu

SEQ ID NO: 3316850 - RNA, 18 nt, Mycobacterium tuberculosis H37Rv
ugccgacggcgccgaacc

SEQ ID NO: 3316851 - RNA, 14 nt, Mycobacterium tuberculosis H37Rv
ugccgacucagguc

SEQ ID NO: 3316852 - RNA, 16 nt, Mycobacterium tuberculosis H37Rv
ugccgacucaucggcc

SEQ ID NO: 3316853 - RNA, 15 nt, Mycobacterium tuberculosis H37Rv
ugccgagaacaccgg

SEQ ID NO: 3316854 - RNA, 19 nt, Mycobacterium tuberculosis H37Rv
ugccgagaagugggcggua

SEQ ID NO: 3316855 - RNA, 23 nt, Mycobacterium tuberculosis H37Rv
ugccgagaauuccccagccgcau

SEQ ID NO: 3316856 - RNA, 18 nt, Mycobacterium tuberculosis H37Rv
ugccgagagccucguuca

SEQ ID NO: 3316857 - RNA, 15 nt, Mycobacterium tuberculosis H37Rv
ugccgagaucccagc

SEQ ID NO: 3316858 - RNA, 17 nt, Mycobacterium tuberculosis H37Rv
ugccgagcacucggcca

SEQ ID NO: 3316859 - RNA, 20 nt, Mycobacterium tuberculosis H37Rv
ugccgagcacucggccacga

SEQ ID NO: 3316860 - RNA, 12 nt, Mycobacterium tuberculosis H37Rv
ugccgagcagac

SEQ ID NO: 3316861 - RNA, 18 nt, Mycobacterium tuberculosis H37Rv
ugccgagcuucagcgcgc

SEQ ID NO: 3316862 - RNA, 18 nt, Mycobacterium tuberculosis H37Rv
ugccgaggcggaugcggu

SEQ ID NO: 3316863 - RNA, 17 nt, Mycobacterium tuberculosis H37Rv
ugccgagguugcggacg

SEQ ID NO: 3316864 - RNA, 17 nt, Mycobacterium tuberculosis H37Rv
ugccgaguuccugcacg

SEQ ID NO: 3316865 - RNA, 15 nt, Mycobacterium tuberculosis H37Rv
ugccgauagcgcggc

SEQ ID NO: 3316866 - RNA, 16 nt, Mycobacterium tuberculosis H37Rv
ugccgaucagcccggc

SEQ ID NO: 3316867 - RNA, 17 nt, Mycobacterium tuberculosis H37Rv
ugccgaucagcccggcc

SEQ ID NO: 3316868 - RNA, 13 nt, Mycobacterium tuberculosis H37Rv
ugccgaucgccga

SEQ ID NO: 3316869 - RNA, 17 nt, Mycobacterium tuberculosis H37Rv
ugccgaugcccaucacg

SEQ ID NO: 3316870 - RNA, 15 nt, Mycobacterium tuberculosis H37Rv
ugccgaugccggcga

SEQ ID NO: 3316871 - RNA, 18 nt, Mycobacterium tuberculosis H37Rv
ugccgaugcgacgcagac

SEQ ID NO: 3316872 - RNA, 22 nt, Mycobacterium tuberculosis H37Rv
ugccgauggaugggcugcgcgu

SEQ ID NO: 3316873 - RNA, 16 nt, Mycobacterium tuberculosis H37Rv
ugccgauggugauggg

SEQ ID NO: 3316874 - RNA, 22 nt, Mycobacterium tuberculosis H37Rv
ugccgauggugaugggggagcc

SEQ ID NO: 3316875 - RNA, 21 nt, Mycobacterium tuberculosis H37Rv
ugccgaugucaacgcccagcu

SEQ ID NO: 3316876 - RNA, 18 nt, Mycobacterium tuberculosis H37Rv
ugccgauuacggugaucg

SEQ ID NO: 3316877 - RNA, 20 nt, Mycobacterium tuberculosis H37Rv
ugccgauuacggugaucgcc

SEQ ID NO: 3316878 - RNA, 15 nt, Mycobacterium tuberculosis H37Rv
ugccgcaaccggcga

SEQ ID NO: 3316879 - RNA, 21 nt, Mycobacterium tuberculosis H37Rv
ugccgcacagcggauucggcg

SEQ ID NO: 3316880 - RNA, 21 nt, Mycobacterium tuberculosis H37Rv
ugccgcaccagucgcgcagcg

SEQ ID NO: 3316881 - RNA, 15 nt, Mycobacterium tuberculosis H37Rv
ugccgcacccccucc

SEQ ID NO: 3316882 - RNA, 15 nt, Mycobacterium tuberculosis H37Rv
ugccgcaccggugcu

SEQ ID NO: 3316883 - RNA, 18 nt, Mycobacterium tuberculosis H37Rv
ugccgcaccggugcucgu

SEQ ID NO: 3316884 - RNA, 17 nt, Mycobacterium tuberculosis H37Rv
ugccgcagcauccccgc

SEQ ID NO: 3316885 - RNA, 16 nt, Mycobacterium tuberculosis H37Rv
ugccgcagcggcggca

SEQ ID NO: 3316886 - RNA, 22 nt, Mycobacterium tuberculosis H37Rv
ugccgcagcggcggcaacccug

SEQ ID NO: 3316887 - RNA, 16 nt, Mycobacterium tuberculosis H37Rv
ugccgcauacgcggcu

SEQ ID NO: 3316888 - RNA, 19 nt, Mycobacterium tuberculosis H37Rv
ugccgcaugcgcuccggcg

SEQ ID NO: 3316889 - RNA, 23 nt, Mycobacterium tuberculosis H37Rv
ugccgccaccgccaccgcggccu

SEQ ID NO: 3316890 - RNA, 23 nt, Mycobacterium tuberculosis H37Rv
ugccgccaccgcugucgauggac

SEQ ID NO: 3316891 - RNA, 15 nt, Mycobacterium tuberculosis H37Rv
ugccgccaccggcgu

SEQ ID NO: 3316892 - RNA, 16 nt, Mycobacterium tuberculosis H37Rv
ugccgccagcgccacc

SEQ ID NO: 3316893 - RNA, 18 nt, Mycobacterium tuberculosis H37Rv
ugccgccagcgccaccgu

SEQ ID NO: 3316894 - RNA, 15 nt, Mycobacterium tuberculosis H37Rv
ugccgccaucaccgc

SEQ ID NO: 3316895 - RNA, 17 nt, Mycobacterium tuberculosis H37Rv
ugccgccaucgccgccg

SEQ ID NO: 3316896 - RNA, 19 nt, Mycobacterium tuberculosis H37Rv
ugccgccauggccgccguu

SEQ ID NO: 3316897 - RNA, 13 nt, Mycobacterium tuberculosis H37Rv
ugccgccauucca

SEQ ID NO: 3316898 - RNA, 14 nt, Mycobacterium tuberculosis H37Rv
ugccgccauuggca

SEQ ID NO: 3316899 - RNA, 19 nt, Mycobacterium tuberculosis H37Rv
ugccgccauuggcaggcau

SEQ ID NO: 3316900 - RNA, 19 nt, Mycobacterium tuberculosis H37Rv
ugccgcccaccacacagcc

SEQ ID NO: 3316901 - RNA, 20 nt, Mycobacterium tuberculosis H37Rv
ugccgcccaccacacagccg

SEQ ID NO: 3316902 - RNA, 14 nt, Mycobacterium tuberculosis H37Rv
ugccgcccgccucu

SEQ ID NO: 3316903 - RNA, 14 nt, Mycobacterium tuberculosis H37Rv
ugccgcccgcgccg

SEQ ID NO: 3316904 - RNA, 17 nt, Mycobacterium tuberculosis H37Rv
ugccgcccgcgccgccc

SEQ ID NO: 3316905 - RNA, 19 nt, Mycobacterium tuberculosis H37Rv
ugccgcccgcgccgccgcu

SEQ ID NO: 3316906 - RNA, 19 nt, Mycobacterium tuberculosis H37Rv
ugccgcccgcgccgccgga

SEQ ID NO: 3316907 - RNA, 17 nt, Mycobacterium tuberculosis H37Rv
ugccgcccgcgccuccg

SEQ ID NO: 3316908 - RNA, 23 nt, Mycobacterium tuberculosis H37Rv
ugccgcccgcuccugcucgucga

SEQ ID NO: 3316909 - RNA, 17 nt, Mycobacterium tuberculosis H37Rv
ugccgcccuugccgccc

SEQ ID NO: 3316910 - RNA, 18 nt, Mycobacterium tuberculosis H37Rv
ugccgccgaagccgacga

SEQ ID NO: 3316911 - RNA, 17 nt, Mycobacterium tuberculosis H37Rv
ugccgccgacaccaccg

SEQ ID NO: 3316912 - RNA, 12 nt, Mycobacterium tuberculosis H37Rv
ugccgccgacgc

SEQ ID NO: 3316913 - RNA, 17 nt, Mycobacterium tuberculosis H37Rv
ugccgccgacgggaacc

SEQ ID NO: 3316914 - RNA, 14 nt, Mycobacterium tuberculosis H37Rv
ugccgccgagcugg

SEQ ID NO: 3316915 - RNA, 19 nt, Mycobacterium tuberculosis H37Rv
ugccgccgagggcgccggg

SEQ ID NO: 3316916 - RNA, 21 nt, Mycobacterium tuberculosis H37Rv
ugccgccgauaccgccggccc

SEQ ID NO: 3316917 - RNA, 20 nt, Mycobacterium tuberculosis H37Rv
ugccgccgaugccgccggca

SEQ ID NO: 3316918 - RNA, 14 nt, Mycobacterium tuberculosis H37Rv
ugccgccgccgccg

SEQ ID NO: 3316919 - RNA, 17 nt, Mycobacterium tuberculosis H37Rv
ugccgccgccggcgccg

SEQ ID NO: 3316920 - RNA, 23 nt, Mycobacterium tuberculosis H37Rv
ugccgccgccuccgccgaggccg

SEQ ID NO: 3316921 - RNA, 13 nt, Mycobacterium tuberculosis H37Rv
ugccgccgcgccg

SEQ ID NO: 3316922 - RNA, 20 nt, Mycobacterium tuberculosis H37Rv
ugccgccgcggccaccaccg

SEQ ID NO: 3316923 - RNA, 13 nt, Mycobacterium tuberculosis H37Rv
ugccgccgcggcg

SEQ ID NO: 3316924 - RNA, 21 nt, Mycobacterium tuberculosis H37Rv
ugccgccgcggcgcccggcgg

SEQ ID NO: 3316925 - RNA, 14 nt, Mycobacterium tuberculosis H37Rv
ugccgccggcagcg

SEQ ID NO: 3316926 - RNA, 17 nt, Mycobacterium tuberculosis H37Rv
ugccgccggcagcgcgg

SEQ ID NO: 3316927 - RNA, 16 nt, Mycobacterium tuberculosis H37Rv
ugccgccggccagucc

SEQ ID NO: 3316928 - RNA, 22 nt, Mycobacterium tuberculosis H37Rv
ugccgccggccccgccgucacc

SEQ ID NO: 3316929 - RNA, 19 nt, Mycobacterium tuberculosis H37Rv
ugccgccggccccgccguu

SEQ ID NO: 3316930 - RNA, 17 nt, Mycobacterium tuberculosis H37Rv
ugccgccggcgccaccc

SEQ ID NO: 3316931 - RNA, 18 nt, Mycobacterium tuberculosis H37Rv
ugccgccggcgccacccg

SEQ ID NO: 3316932 - RNA, 17 nt, Mycobacterium tuberculosis H37Rv
ugccgccggcgccggca

SEQ ID NO: 3316933 - RNA, 20 nt, Mycobacterium tuberculosis H37Rv
ugccgccggcuccgccagcg

SEQ ID NO: 3316934 - RNA, 13 nt, Mycobacterium tuberculosis H37Rv
ugccgccggugcc

SEQ ID NO: 3316935 - RNA, 14 nt, Mycobacterium tuberculosis H37Rv
ugccgccggugccg

SEQ ID NO: 3316936 - RNA, 23 nt, Mycobacterium tuberculosis H37Rv
ugccgccgguggugccggcgccg

SEQ ID NO: 3316937 - RNA, 23 nt, Mycobacterium tuberculosis H37Rv
ugccgccgguguugccguuaccg

SEQ ID NO: 3316938 - RNA, 15 nt, Mycobacterium tuberculosis H37Rv
ugccgccgucaccgc

SEQ ID NO: 3316939 - RNA, 20 nt, Mycobacterium tuberculosis H37Rv
ugccgccgucaccgccgacc

SEQ ID NO: 3316940 - RNA, 21 nt, Mycobacterium tuberculosis H37Rv
ugccgccgucaccgccgacca

SEQ ID NO: 3316941 - RNA, 19 nt, Mycobacterium tuberculosis H37Rv
ugccgccgucaccgccguu

SEQ ID NO: 3316942 - RNA, 15 nt, Mycobacterium tuberculosis H37Rv
ugccgccgucgccac

SEQ ID NO: 3316943 - RNA, 21 nt, Mycobacterium tuberculosis H37Rv
ugccgccgucgccacgcccag

SEQ ID NO: 3316944 - RNA, 17 nt, Mycobacterium tuberculosis H37Rv
ugccggucauccgggcg

SEQ ID NO: 3316945 - RNA, 24 nt, Mycobacterium tuberculosis H37Rv
ugccggucgagugccucgaccugg

SEQ ID NO: 3316946 - RNA, 21 nt, Mycobacterium tuberculosis H37Rv
ugccggucgcauggucgacga

SEQ ID NO: 3316947 - RNA, 19 nt, Mycobacterium tuberculosis H37Rv
ugccggugugcgccaaggu

SEQ ID NO: 3316948 - RNA, 19 nt, Mycobacterium tuberculosis H37Rv
ugccgguguugauuccggc

SEQ ID NO: 3316949 - RNA, 21 nt, Mycobacterium tuberculosis H37Rv
ugccgguguuguaggccgggc

SEQ ID NO: 3316950 - RNA, 14 nt, Mycobacterium tuberculosis H37Rv
ugccgguugccacc

SEQ ID NO: 3316951 - RNA, 18 nt, Mycobacterium tuberculosis H37Rv
ugccgguugcggcugcgu

SEQ ID NO: 3316952 - RNA, 16 nt, Mycobacterium tuberculosis H37Rv
ugccgguuuccgucug

SEQ ID NO: 3316953 - RNA, 17 nt, Mycobacterium tuberculosis H37Rv
ugccgguuuccgucuga

SEQ ID NO: 3316954 - RNA, 14 nt, Mycobacterium tuberculosis H37Rv
ugccgguuuucggg

SEQ ID NO: 3316955 - RNA, 20 nt, Mycobacterium tuberculosis H37Rv
ugccgguuuugccgugccac

SEQ ID NO: 3316956 - RNA, 23 nt, Mycobacterium tuberculosis H37Rv
ugccguaguaaggagccgggccg

SEQ ID NO: 3316957 - RNA, 15 nt, Mycobacterium tuberculosis H37Rv
ugccguauccaggcg

SEQ ID NO: 3316958 - RNA, 16 nt, Mycobacterium tuberculosis H37Rv
ugccgucagggucagc

SEQ ID NO: 3316959 - RNA, 14 nt, Mycobacterium tuberculosis H37Rv
ugccguccggcgcu

SEQ ID NO: 3316960 - RNA, 19 nt, Mycobacterium tuberculosis H37Rv
ugccgucgccggucaggcc

SEQ ID NO: 3316961 - RNA, 19 nt, Mycobacterium tuberculosis H37Rv
ugccgucgccuccagcagg

SEQ ID NO: 3316962 - RNA, 15 nt, Mycobacterium tuberculosis H37Rv
ugccgucgcugacgc

SEQ ID NO: 3316963 - RNA, 13 nt, Mycobacterium tuberculosis H37Rv
ugccgucggcgua

SEQ ID NO: 3316964 - RNA, 21 nt, Mycobacterium tuberculosis H37Rv
ugccgucggcguacagcgccu

SEQ ID NO: 3316965 - RNA, 23 nt, Mycobacterium tuberculosis H37Rv
ugccgucggcgugcagcagcuug

SEQ ID NO: 3316966 - RNA, 15 nt, Mycobacterium tuberculosis H37Rv
ugccgucggugccgc

SEQ ID NO: 3316967 - RNA, 21 nt, Mycobacterium tuberculosis H37Rv
ugccgucggugccggggcugc

SEQ ID NO: 3316968 - RNA, 13 nt, Mycobacterium tuberculosis H37Rv
ugccgugcccggu

SEQ ID NO: 3316969 - RNA, 21 nt, Mycobacterium tuberculosis H37Rv
ugccgugccgaaguggagccc

SEQ ID NO: 3316970 - RNA, 23 nt, Mycobacterium tuberculosis H37Rv
ugccgugcucaccggcgcccagc

SEQ ID NO: 3316971 - RNA, 15 nt, Mycobacterium tuberculosis H37Rv
ugccgugcugggccg

SEQ ID NO: 3316972 - RNA, 23 nt, Mycobacterium tuberculosis H37Rv
ugccguggaagacgucgagguug

SEQ ID NO: 3316973 - RNA, 14 nt, Mycobacterium tuberculosis H37Rv
ugccguggccgcca

SEQ ID NO: 3316974 - RNA, 21 nt, Mycobacterium tuberculosis H37Rv
ugccguggugaaaugccgaga

SEQ ID NO: 3316975 - RNA, 21 nt, Mycobacterium tuberculosis H37Rv
ugccgugguggacgaugcggu

SEQ ID NO: 3316976 - RNA, 15 nt, Mycobacterium tuberculosis H37Rv
ugccguuaccgccaa

SEQ ID NO: 3316977 - RNA, 23 nt, Mycobacterium tuberculosis H37Rv
ugccguucaugccauggauguag

SEQ ID NO: 3316978 - RNA, 13 nt, Mycobacterium tuberculosis H37Rv
ugccguucggacc

SEQ ID NO: 3316979 - RNA, 15 nt, Mycobacterium tuberculosis H37Rv
ugccguucucgucga

SEQ ID NO: 3316980 - RNA, 19 nt, Mycobacterium tuberculosis H37Rv
ugccguugagugggagcua

SEQ ID NO: 3316981 - RNA, 16 nt, Mycobacterium tuberculosis H37Rv
ugccguugcgaucgcg

SEQ ID NO: 3316982 - RNA, 23 nt, Mycobacterium tuberculosis H37Rv
ugccuacaccggcaagccacgcc

SEQ ID NO: 3316983 - RNA, 16 nt, Mycobacterium tuberculosis H37Rv
ugccucaccgccgcua

SEQ ID NO: 3316984 - RNA, 11 nt, Mycobacterium tuberculosis H37Rv
ugccuccagaa

SEQ ID NO: 3316985 - RNA, 14 nt, Mycobacterium tuberculosis H37Rv
ugccucccgcgccg

SEQ ID NO: 3316986 - RNA, 17 nt, Mycobacterium tuberculosis H37Rv
ugccuccggcgccgccc

SEQ ID NO: 3316987 - RNA, 21 nt, Mycobacterium tuberculosis H37Rv
ugccucgcgggaagucccgag

SEQ ID NO: 3316988 - RNA, 19 nt, Mycobacterium tuberculosis H37Rv
ugccucgcggggucugucg

SEQ ID NO: 3316989 - RNA, 22 nt, Mycobacterium tuberculosis H37Rv
ugccucggcgaggucagagaaa

SEQ ID NO: 3316990 - RNA, 22 nt, Mycobacterium tuberculosis H37Rv
ugccucgucgccgcgguagacg

SEQ ID NO: 3316991 - RNA, 14 nt, Mycobacterium tuberculosis H37Rv
ugccugaccggcgg

SEQ ID NO: 3316992 - RNA, 12 nt, Mycobacterium tuberculosis H37Rv
ugccugcaacgc

SEQ ID NO: 3316993 - RNA, 11 nt, Mycobacterium tuberculosis H37Rv
ugccugccacc

SEQ ID NO: 3316994 - RNA, 12 nt, Mycobacterium tuberculosis H37Rv
ugccugcgcacg

SEQ ID NO: 3316995 - RNA, 16 nt, Mycobacterium tuberculosis H37Rv
ugccugcgcacgaccc

SEQ ID NO: 3316996 - RNA, 21 nt, Mycobacterium tuberculosis H37Rv
ugccugcgcgagugccagucc

SEQ ID NO: 3316997 - RNA, 15 nt, Mycobacterium tuberculosis H37Rv
ugccugcuagcagca

SEQ ID NO: 3316998 - RNA, 22 nt, Mycobacterium tuberculosis H37Rv
ugccugcuggucggugaugguc

SEQ ID NO: 3316999 - RNA, 19 nt, Mycobacterium tuberculosis H37Rv
ugccuggaaucgcggagcc

SEQ ID NO: 3317000 - RNA, 11 nt, Mycobacterium tuberculosis H37Rv
ugccuggcccg

SEQ ID NO: 3317001 - RNA, 21 nt, Mycobacterium tuberculosis H37Rv
ugccugucagaaggaucagcg

SEQ ID NO: 3317002 - RNA, 22 nt, Mycobacterium tuberculosis H37Rv
ugccuuccucggcaagucgacg

SEQ ID NO: 3317003 - RNA, 17 nt, Mycobacterium tuberculosis H37Rv
ugccuucguagaaggac

SEQ ID NO: 3317004 - RNA, 17 nt, Mycobacterium tuberculosis H37Rv
ugccuucguagcggccg

SEQ ID NO: 3317005 - RNA, 19 nt, Mycobacterium tuberculosis H37Rv
ugccuucuuggcgggagcc

SEQ ID NO: 3317006 - RNA, 12 nt, Mycobacterium tuberculosis H37Rv
ugccuucuuugc

SEQ ID NO: 3317007 - RNA, 23 nt, Mycobacterium tuberculosis H37Rv
ugccuugaccgcggucuucuuca

SEQ ID NO: 3317008 - RNA, 13 nt, Mycobacterium tuberculosis H37Rv
ugccuugagcaaa

SEQ ID NO: 3317009 - RNA, 19 nt, Mycobacterium tuberculosis H37Rv
ugccuugagccgccccggc

SEQ ID NO: 3317010 - RNA, 17 nt, Mycobacterium tuberculosis H37Rv
ugccuugaucugagcgc

SEQ ID NO: 3317011 - RNA, 14 nt, Mycobacterium tuberculosis H37Rv
ugccuuggcagccc

SEQ ID NO: 3317012 - RNA, 17 nt, Mycobacterium tuberculosis H37Rv
ugccuuggcagcccagu

SEQ ID NO: 3317013 - RNA, 20 nt, Mycobacterium tuberculosis H37Rv
ugcgaaaauccgugccgaaa

SEQ ID NO: 3317014 - RNA, 17 nt, Mycobacterium tuberculosis H37Rv
ugcgaaacaucucggcg

SEQ ID NO: 3317015 - RNA, 17 nt, Mycobacterium tuberculosis H37Rv
ugcgaaacgcuggccac

SEQ ID NO: 3317016 - RNA, 17 nt, Mycobacterium tuberculosis H37Rv
ugcgaacaaguggccag

SEQ ID NO: 3317017 - RNA, 19 nt, Mycobacterium tuberculosis H37Rv
ugcgaacagcgaagcaacg

SEQ ID NO: 3317018 - RNA, 23 nt, Mycobacterium tuberculosis H37Rv
ugcgaacucggccgugugcucga

SEQ ID NO: 3317019 - RNA, 22 nt, Mycobacterium tuberculosis H37Rv
ugcgaagcauucaggccgagga

SEQ ID NO: 3317020 - RNA, 20 nt, Mycobacterium tuberculosis H37Rv
ugcgaaggaccagagcucga

SEQ ID NO: 3317021 - RNA, 22 nt, Mycobacterium tuberculosis H37Rv
ugcgaaucggcccgugccacag

SEQ ID NO: 3317022 - RNA, 14 nt, Mycobacterium tuberculosis H37Rv
ugcgaaugcugggc

SEQ ID NO: 3317023 - RNA, 23 nt, Mycobacterium tuberculosis H37Rv
ugcgaaugcugggcccgccagcc

SEQ ID NO: 3317024 - RNA, 19 nt, Mycobacterium tuberculosis H37Rv
ugcgaauggugcaacgcgc

SEQ ID NO: 3317025 - RNA, 20 nt, Mycobacterium tuberculosis H37Rv
ugcgacaggacgucggcgaa

SEQ ID NO: 3317026 - RNA, 14 nt, Mycobacterium tuberculosis H37Rv
ugcgaccacaucau

SEQ ID NO: 3317027 - RNA, 18 nt, Mycobacterium tuberculosis H37Rv
ugcgaccacaucaugcca

SEQ ID NO: 3317028 - RNA, 14 nt, Mycobacterium tuberculosis H37Rv
ugcgaccccggcug

SEQ ID NO: 3317029 - RNA, 22 nt, Mycobacterium tuberculosis H37Rv
ugcgacccgcagaccgccaccg

SEQ ID NO: 3317030 - RNA, 13 nt, Mycobacterium tuberculosis H37Rv
ugcgacccgggcg

SEQ ID NO: 3317031 - RNA, 19 nt, Mycobacterium tuberculosis H37Rv
ugcgaccgcgccaacagau

SEQ ID NO: 3317032 - RNA, 17 nt, Mycobacterium tuberculosis H37Rv
ugcgaccggcuccggac

SEQ ID NO: 3317033 - RNA, 14 nt, Mycobacterium tuberculosis H37Rv
ugcgacgaaccgga

SEQ ID NO: 3317034 - RNA, 15 nt, Mycobacterium tuberculosis H37Rv
ugcgacgaaccggau

SEQ ID NO: 3317035 - RNA, 18 nt, Mycobacterium tuberculosis H37Rv
ugcgacgacgccaaugcc

SEQ ID NO: 3317036 - RNA, 21 nt, Mycobacterium tuberculosis H37Rv
ugcgacgcagaccguccagca

SEQ ID NO: 3317037 - RNA, 16 nt, Mycobacterium tuberculosis H37Rv
ugcgacgcccgccuuc

SEQ ID NO: 3317038 - RNA, 18 nt, Mycobacterium tuberculosis H37Rv
ugcgacggccggcaagca

SEQ ID NO: 3317039 - RNA, 20 nt, Mycobacterium tuberculosis H37Rv
ugcgacguugguugcguccg

SEQ ID NO: 3317040 - RNA, 20 nt, Mycobacterium tuberculosis H37Rv
ugcgccguguuccagguaca

SEQ ID NO: 3317041 - RNA, 20 nt, Mycobacterium tuberculosis H37Rv
ugcgccguucgcucccccgc

SEQ ID NO: 3317042 - RNA, 15 nt, Mycobacterium tuberculosis H37Rv
ugcgccguugccgcc

SEQ ID NO: 3317043 - RNA, 22 nt, Mycobacterium tuberculosis H37Rv
ugcgccuaaccccggcucgacg

SEQ ID NO: 3317044 - RNA, 18 nt, Mycobacterium tuberculosis H37Rv
ugcgccucggcggccagc

SEQ ID NO: 3317045 - RNA, 17 nt, Mycobacterium tuberculosis H37Rv
ugcgccuggcuggccag

SEQ ID NO: 3317046 - RNA, 15 nt, Mycobacterium tuberculosis H37Rv
ugcgccuucgccagc

SEQ ID NO: 3317047 - RNA, 22 nt, Mycobacterium tuberculosis H37Rv
ugcgcgaaggauuugauaggcg

SEQ ID NO: 3317048 - RNA, 23 nt, Mycobacterium tuberculosis H37Rv
ugcgcgacggucaaggugcgccg

SEQ ID NO: 3317049 - RNA, 19 nt, Mycobacterium tuberculosis H37Rv
ugcgcgacugauccucgau

SEQ ID NO: 3317050 - RNA, 17 nt, Mycobacterium tuberculosis H37Rv
ugcgcgaggucggcggc

SEQ ID NO: 3317051 - RNA, 16 nt, Mycobacterium tuberculosis H37Rv
ugcgcgauaggugcuc

SEQ ID NO: 3317052 - RNA, 18 nt, Mycobacterium tuberculosis H37Rv
ugcgcgaucccaacgccc

SEQ ID NO: 3317053 - RNA, 21 nt, Mycobacterium tuberculosis H37Rv
ugcgcgaugcgauucugcguc

SEQ ID NO: 3317054 - RNA, 12 nt, Mycobacterium tuberculosis H37Rv
ugcgcgcagacu

SEQ ID NO: 3317055 - RNA, 21 nt, Mycobacterium tuberculosis H37Rv
ugcgcgccauuggcgccgccg

SEQ ID NO: 3317056 - RNA, 22 nt, Mycobacterium tuberculosis H37Rv
ugcgcgcgcagaucguccaccg

SEQ ID NO: 3317057 - RNA, 15 nt, Mycobacterium tuberculosis H37Rv
ugcgcgcgcagcuga

SEQ ID NO: 3317058 - RNA, 14 nt, Mycobacterium tuberculosis H37Rv
ugcgcgcggcgacc

SEQ ID NO: 3317059 - RNA, 16 nt, Mycobacterium tuberculosis H37Rv
ugcgcgcucggccagc

SEQ ID NO: 3317060 - RNA, 20 nt, Mycobacterium tuberculosis H37Rv
ugcgcgcucggccagcauca

SEQ ID NO: 3317061 - RNA, 16 nt, Mycobacterium tuberculosis H37Rv
ugcgcggcaucccgcc

SEQ ID NO: 3317062 - RNA, 16 nt, Mycobacterium tuberculosis H37Rv
ugcgcggcccgcaucg

SEQ ID NO: 3317063 - RNA, 13 nt, Mycobacterium tuberculosis H37Rv
ugcgcggccgccc

SEQ ID NO: 3317064 - RNA, 23 nt, Mycobacterium tuberculosis H37Rv
ugcgcggcgcgggucacgccguc

SEQ ID NO: 3317065 - RNA, 16 nt, Mycobacterium tuberculosis H37Rv
ugcgcggcuugucgcg

SEQ ID NO: 3317066 - RNA, 23 nt, Mycobacterium tuberculosis H37Rv
ugcgcggcuugucgcggugcggc

SEQ ID NO: 3317067 - RNA, 17 nt, Mycobacterium tuberculosis H37Rv
ugcgcgguagcucgucg

SEQ ID NO: 3317068 - RNA, 16 nt, Mycobacterium tuberculosis H37Rv
ugcgcggucgcgcgau

SEQ ID NO: 3317069 - RNA, 15 nt, Mycobacterium tuberculosis H37Rv
ugcgcggugaugguu

SEQ ID NO: 3317070 - RNA, 17 nt, Mycobacterium tuberculosis H37Rv
ugcgcggugcgcgugac

SEQ ID NO: 3317071 - RNA, 20 nt, Mycobacterium tuberculosis H37Rv
ugcgcgguugugacggugaa

SEQ ID NO: 3317072 - RNA, 17 nt, Mycobacterium tuberculosis H37Rv
ugcgcgucgagcgaccc

SEQ ID NO: 3317073 - RNA, 15 nt, Mycobacterium tuberculosis H37Rv
ugcgcgucgcgcgcg

SEQ ID NO: 3317074 - RNA, 20 nt, Mycobacterium tuberculosis H37Rv
ugcgcgucucgagcgcgccg

SEQ ID NO: 3317075 - RNA, 17 nt, Mycobacterium tuberculosis H37Rv
ugcgcgugacgaccagc

SEQ ID NO: 3317076 - RNA, 16 nt, Mycobacterium tuberculosis H37Rv
ugcgcguggcagugca

SEQ ID NO: 3317077 - RNA, 13 nt, Mycobacterium tuberculosis H37Rv
ugcgcuaggugcg

SEQ ID NO: 3317078 - RNA, 14 nt, Mycobacterium tuberculosis H37Rv
ugcgcucacuggcg

SEQ ID NO: 3317079 - RNA, 12 nt, Mycobacterium tuberculosis H37Rv
ugcgcucauccg

SEQ ID NO: 3317080 - RNA, 14 nt, Mycobacterium tuberculosis H37Rv
ugcgcugcagcuga

SEQ ID NO: 3317081 - RNA, 24 nt, Mycobacterium tuberculosis H37Rv
ugcgcuggaggacccgcuacgacg

SEQ ID NO: 3317082 - RNA, 15 nt, Mycobacterium tuberculosis H37Rv
ugcgcuggcacacuc

SEQ ID NO: 3317083 - RNA, 12 nt, Mycobacterium tuberculosis H37Rv
ugcgcuggcggc

SEQ ID NO: 3317084 - RNA, 20 nt, Mycobacterium tuberculosis H37Rv
ugcgcuggcugacaccgauc

SEQ ID NO: 3317085 - RNA, 19 nt, Mycobacterium tuberculosis H37Rv
ugcgcuuccaacaccaacg

SEQ ID NO: 3317086 - RNA, 14 nt, Mycobacterium tuberculosis H37Rv
ugcgcuuccaucgc

SEQ ID NO: 3317087 - RNA, 16 nt, Mycobacterium tuberculosis H37Rv
ugcgcuuggucgaccg

SEQ ID NO: 3317088 - RNA, 20 nt, Mycobacterium tuberculosis H37Rv
ugcgcuuggucgaccgccga

SEQ ID NO: 3317089 - RNA, 17 nt, Mycobacterium tuberculosis H37Rv
ugcggaaacccggccgc

SEQ ID NO: 3317090 - RNA, 17 nt, Mycobacterium tuberculosis H37Rv
ugcggaaaccgcugggg

SEQ ID NO: 3317091 - RNA, 19 nt, Mycobacterium tuberculosis H37Rv
ugcggaaagccccuccggc

SEQ ID NO: 3317092 - RNA, 18 nt, Mycobacterium tuberculosis H37Rv
ugcggaacaccaccaggc

SEQ ID NO: 3317093 - RNA, 22 nt, Mycobacterium tuberculosis H37Rv
ugcggaacaccaccaggcuguc

SEQ ID NO: 3317094 - RNA, 18 nt, Mycobacterium tuberculosis H37Rv
ugcggaacaccagcaggc

SEQ ID NO: 3317095 - RNA, 14 nt, Mycobacterium tuberculosis H37Rv
ugcggaacaccgcc

SEQ ID NO: 3317096 - RNA, 20 nt, Mycobacterium tuberculosis H37Rv
ugcggaacacgaugcgcggu

SEQ ID NO: 3317097 - RNA, 17 nt, Mycobacterium tuberculosis H37Rv
ugcggaagcaucggcug

SEQ ID NO: 3317098 - RNA, 15 nt, Mycobacterium tuberculosis H37Rv
ugcggaaucagcacc

SEQ ID NO: 3317099 - RNA, 19 nt, Mycobacterium tuberculosis H37Rv
ugcggaaucagcaccccau

SEQ ID NO: 3317100 - RNA, 18 nt, Mycobacterium tuberculosis H37Rv
ugcggacaguucccggcc

SEQ ID NO: 3317101 - RNA, 16 nt, Mycobacterium tuberculosis H37Rv
ugcggacucagcggcg

SEQ ID NO: 3317102 - RNA, 14 nt, Mycobacterium tuberculosis H37Rv
ugcggacugacguc

SEQ ID NO: 3317103 - RNA, 19 nt, Mycobacterium tuberculosis H37Rv
ugcggacuggcauccgccc

SEQ ID NO: 3317104 - RNA, 17 nt, Mycobacterium tuberculosis H37Rv
ugcggacuucgccgccc

SEQ ID NO: 3317105 - RNA, 18 nt, Mycobacterium tuberculosis H37Rv
ugcggaggcgggugcggc

SEQ ID NO: 3317106 - RNA, 23 nt, Mycobacterium tuberculosis H37Rv
ugcggaucacucccccacacacc

SEQ ID NO: 3317107 - RNA, 18 nt, Mycobacterium tuberculosis H37Rv
ugcggaucggcggaccgc

SEQ ID NO: 3317108 - RNA, 19 nt, Mycobacterium tuberculosis H37Rv
ugcggauguccuugcgguc

SEQ ID NO: 3317109 - RNA, 15 nt, Mycobacterium tuberculosis H37Rv
ugcggaugucgucga

SEQ ID NO: 3317110 - RNA, 23 nt, Mycobacterium tuberculosis H37Rv
ugcggauuucgugucgcugcggc

SEQ ID NO: 3317111 - RNA, 15 nt, Mycobacterium tuberculosis H37Rv
ugcggcaacagcgcc

SEQ ID NO: 3317112 - RNA, 18 nt, Mycobacterium tuberculosis H37Rv
ugcggcaacgaggucugc

SEQ ID NO: 3317113 - RNA, 16 nt, Mycobacterium tuberculosis H37Rv
ugcggcaccgccgccc

SEQ ID NO: 3317114 - RNA, 16 nt, Mycobacterium tuberculosis H37Rv
ugcggcacgccggccg

SEQ ID NO: 3317115 - RNA, 15 nt, Mycobacterium tuberculosis H37Rv
ugcggcagaccaagc

SEQ ID NO: 3317116 - RNA, 13 nt, Mycobacterium tuberculosis H37Rv
ugcggcagcgcgg

SEQ ID NO: 3317117 - RNA, 15 nt, Mycobacterium tuberculosis H37Rv
ugcggcaggugcggu

SEQ ID NO: 3317118 - RNA, 15 nt, Mycobacterium tuberculosis H37Rv
ugcggccagcgcggc

SEQ ID NO: 3317119 - RNA, 23 nt, Mycobacterium tuberculosis H37Rv
ugcggccaggcgguacgggucgc

SEQ ID NO: 3317120 - RNA, 11 nt, Mycobacterium tuberculosis H37Rv
ugcggccaggg

SEQ ID NO: 3317121 - RNA, 19 nt, Mycobacterium tuberculosis H37Rv
ugcggccagggagcggcuu

SEQ ID NO: 3317122 - RNA, 16 nt, Mycobacterium tuberculosis H37Rv
ugcggcccaaccgguc

SEQ ID NO: 3317123 - RNA, 15 nt, Mycobacterium tuberculosis H37Rv
ugcggcccacaccag

SEQ ID NO: 3317124 - RNA, 20 nt, Mycobacterium tuberculosis H37Rv
ugcggcccacaccagcgcag

SEQ ID NO: 3317125 - RNA, 20 nt, Mycobacterium tuberculosis H37Rv
ugcggcccaugaucucggcg

SEQ ID NO: 3317126 - RNA, 14 nt, Mycobacterium tuberculosis H37Rv
ugcggccccgagga

SEQ ID NO: 3317127 - RNA, 20 nt, Mycobacterium tuberculosis H37Rv
ugcggcccgggcucggcgaa

SEQ ID NO: 3317128 - RNA, 23 nt, Mycobacterium tuberculosis H37Rv
ugcggcccucgagcagugccgug

SEQ ID NO: 3317129 - RNA, 19 nt, Mycobacterium tuberculosis H37Rv
ugcggccgaauuccucaag

SEQ ID NO: 3317130 - RNA, 11 nt, Mycobacterium tuberculosis H37Rv
ugcggccgcgc

SEQ ID NO: 3317131 - RNA, 21 nt, Mycobacterium tuberculosis H37Rv
ugcggccgcugaucaacagac

SEQ ID NO: 3317132 - RNA, 17 nt, Mycobacterium tuberculosis H37Rv
ugcggccugcucgacca

SEQ ID NO: 3317133 - RNA, 14 nt, Mycobacterium tuberculosis H37Rv
ugcggcgaccaggu

SEQ ID NO: 3317134 - RNA, 22 nt, Mycobacterium tuberculosis H37Rv
ugcggcgcccggucgagccagc

SEQ ID NO: 3317135 - RNA, 19 nt, Mycobacterium tuberculosis H37Rv
ugcggcggcccaucgaccg

SEQ ID NO: 3317136 - RNA, 16 nt, Mycobacterium tuberculosis H37Rv
ugcgugcauaggccgc

SEQ ID NO: 3317137 - RNA, 15 nt, Mycobacterium tuberculosis H37Rv
ugcgugccgacccgc

SEQ ID NO: 3317138 - RNA, 18 nt, Mycobacterium tuberculosis H37Rv
ugcgugccgacccgcuuc

SEQ ID NO: 3317139 - RNA, 19 nt, Mycobacterium tuberculosis H37Rv
ugcgugccgacccgcuucg

SEQ ID NO: 3317140 - RNA, 14 nt, Mycobacterium tuberculosis H37Rv
ugcgugccggcagc

SEQ ID NO: 3317141 - RNA, 17 nt, Mycobacterium tuberculosis H37Rv
ugcgugcggucgauccg

SEQ ID NO: 3317142 - RNA, 20 nt, Mycobacterium tuberculosis H37Rv
ugcguggcguugguggucug

SEQ ID NO: 3317143 - RNA, 12 nt, Mycobacterium tuberculosis H37Rv
ugcguuacgccg

SEQ ID NO: 3317144 - RNA, 16 nt, Mycobacterium tuberculosis H37Rv
ugcguucaucauccac

SEQ ID NO: 3317145 - RNA, 13 nt, Mycobacterium tuberculosis H37Rv
ugcguuccaucgc

SEQ ID NO: 3317146 - RNA, 16 nt, Mycobacterium tuberculosis H37Rv
ugcguuccaucgccga

SEQ ID NO: 3317147 - RNA, 17 nt, Mycobacterium tuberculosis H37Rv
ugcguuccgcgacagcg

SEQ ID NO: 3317148 - RNA, 14 nt, Mycobacterium tuberculosis H37Rv
ugcguucgccgccc

SEQ ID NO: 3317149 - RNA, 14 nt, Mycobacterium tuberculosis H37Rv
ugcguucggccggg

SEQ ID NO: 3317150 - RNA, 17 nt, Mycobacterium tuberculosis H37Rv
ugcguucggccgggccg

SEQ ID NO: 3317151 - RNA, 20 nt, Mycobacterium tuberculosis H37Rv
ugcguucgggcccguagccg

SEQ ID NO: 3317152 - RNA, 15 nt, Mycobacterium tuberculosis H37Rv
ugcguuggaugaagu

SEQ ID NO: 3317153 - RNA, 21 nt, Mycobacterium tuberculosis H37Rv
ugcguuggggcacgacgccgg

SEQ ID NO: 3317154 - RNA, 17 nt, Mycobacterium tuberculosis H37Rv
ugcuaaacuccgugccg

SEQ ID NO: 3317155 - RNA, 13 nt, Mycobacterium tuberculosis H37Rv
ugcuacucugcaa

SEQ ID NO: 3317156 - RNA, 16 nt, Mycobacterium tuberculosis H37Rv
ugcuagcagcagcccg

SEQ ID NO: 3317157 - RNA, 14 nt, Mycobacterium tuberculosis H37Rv
ugcuagcgccgcca

SEQ ID NO: 3317158 - RNA, 17 nt, Mycobacterium tuberculosis H37Rv
ugcuaggaccaccagcg

SEQ ID NO: 3317159 - RNA, 19 nt, Mycobacterium tuberculosis H37Rv
ugcuaggaccaccagcgcu

SEQ ID NO: 3317160 - RNA, 18 nt, Mycobacterium tuberculosis H37Rv
ugcuauucgccagcgccg

SEQ ID NO: 3317161 - RNA, 15 nt, Mycobacterium tuberculosis H37Rv
ugcucacauccgguc

SEQ ID NO: 3317162 - RNA, 21 nt, Mycobacterium tuberculosis H37Rv
ugcucaccaaucugcgggccg

SEQ ID NO: 3317163 - RNA, 16 nt, Mycobacterium tuberculosis H37Rv
ugcucacccgucguca

SEQ ID NO: 3317164 - RNA, 14 nt, Mycobacterium tuberculosis H37Rv
ugcucacgcaucgc

SEQ ID NO: 3317165 - RNA, 21 nt, Mycobacterium tuberculosis H37Rv
ugcucagccguucgcagcuga

SEQ ID NO: 3317166 - RNA, 15 nt, Mycobacterium tuberculosis H37Rv
ugcucagcgcggccc

SEQ ID NO: 3317167 - RNA, 16 nt, Mycobacterium tuberculosis H37Rv
ugcucagcggcucgcc

SEQ ID NO: 3317168 - RNA, 17 nt, Mycobacterium tuberculosis H37Rv
ugcucaggucgcagacc

SEQ ID NO: 3317169 - RNA, 16 nt, Mycobacterium tuberculosis H37Rv
ugcuccaggcgcgccg

SEQ ID NO: 3317170 - RNA, 18 nt, Mycobacterium tuberculosis H37Rv
ugcuccaggcgcgccgca

SEQ ID NO: 3317171 - RNA, 13 nt, Mycobacterium tuberculosis H37Rv
ugcucccacguga

SEQ ID NO: 3317172 - RNA, 17 nt, Mycobacterium tuberculosis H37Rv
ugcucccggccgccgag

SEQ ID NO: 3317173 - RNA, 19 nt, Mycobacterium tuberculosis H37Rv
ugcucccuauugcugcggu

SEQ ID NO: 3317174 - RNA, 17 nt, Mycobacterium tuberculosis H37Rv
ugcuccgguuggcgcgg

SEQ ID NO: 3317175 - RNA, 20 nt, Mycobacterium tuberculosis H37Rv
ugcuccgguuggcgcgggcg

SEQ ID NO: 3317176 - RNA, 21 nt, Mycobacterium tuberculosis H37Rv
ugcuccucgcgguaguugucc

SEQ ID NO: 3317177 - RNA, 20 nt, Mycobacterium tuberculosis H37Rv
ugcuccuugggucggucacg

SEQ ID NO: 3317178 - RNA, 16 nt, Mycobacterium tuberculosis H37Rv
ugcucgacaaccacgg

SEQ ID NO: 3317179 - RNA, 20 nt, Mycobacterium tuberculosis H37Rv
ugcucgacaaccgcccgcca

SEQ ID NO: 3317180 - RNA, 14 nt, Mycobacterium tuberculosis H37Rv
ugcucgaccgucau

SEQ ID NO: 3317181 - RNA, 16 nt, Mycobacterium tuberculosis H37Rv
ugcucgacggcuccga

SEQ ID NO: 3317182 - RNA, 19 nt, Mycobacterium tuberculosis H37Rv
ugcucgagcaccucggccu

SEQ ID NO: 3317183 - RNA, 16 nt, Mycobacterium tuberculosis H37Rv
ugcucgauccacugcc

SEQ ID NO: 3317184 - RNA, 15 nt, Mycobacterium tuberculosis H37Rv
ugcucgaucugucgc

SEQ ID NO: 3317185 - RNA, 14 nt, Mycobacterium tuberculosis H37Rv
ugcucgaugaucag

SEQ ID NO: 3317186 - RNA, 22 nt, Mycobacterium tuberculosis H37Rv
ugcucgaugcgacgaaccucgg

SEQ ID NO: 3317187 - RNA, 15 nt, Mycobacterium tuberculosis H37Rv
ugcucgauguccucg

SEQ ID NO: 3317188 - RNA, 22 nt, Mycobacterium tuberculosis H37Rv
ugcucgcaaucguuggccaugc

SEQ ID NO: 3317189 - RNA, 16 nt, Mycobacterium tuberculosis H37Rv
ugcucgcacagcacca

SEQ ID NO: 3317190 - RNA, 23 nt, Mycobacterium tuberculosis H37Rv
ugcucgcacagcaccacgugcga

SEQ ID NO: 3317191 - RNA, 14 nt, Mycobacterium tuberculosis H37Rv
ugcucgccaggcaa

SEQ ID NO: 3317192 - RNA, 23 nt, Mycobacterium tuberculosis H37Rv
ugcucgccgggucagcccggcgc

SEQ ID NO: 3317193 - RNA, 23 nt, Mycobacterium tuberculosis H37Rv
ugcucgccguugaugucggcagg

SEQ ID NO: 3317194 - RNA, 23 nt, Mycobacterium tuberculosis H37Rv
ugcucgcgaggcucgcguggccg

SEQ ID NO: 3317195 - RNA, 20 nt, Mycobacterium tuberculosis H37Rv
ugcucgcgccggugaggcga

SEQ ID NO: 3317196 - RNA, 14 nt, Mycobacterium tuberculosis H37Rv
ugcucggccugcuu

SEQ ID NO: 3317197 - RNA, 20 nt, Mycobacterium tuberculosis H37Rv
ugcucgggggccgaccaguc

SEQ ID NO: 3317198 - RNA, 21 nt, Mycobacterium tuberculosis H37Rv
ugcucggugaugcccagcgcc

SEQ ID NO: 3317199 - RNA, 22 nt, Mycobacterium tuberculosis H37Rv
ugcucguagacuugcugcuccu

SEQ ID NO: 3317200 - RNA, 19 nt, Mycobacterium tuberculosis H37Rv
ugcucguagcccaggucga

SEQ ID NO: 3317201 - RNA, 15 nt, Mycobacterium tuberculosis H37Rv
ugcucguaggugccg

SEQ ID NO: 3317202 - RNA, 16 nt, Mycobacterium tuberculosis H37Rv
ugcucguaggugccga

SEQ ID NO: 3317203 - RNA, 22 nt, Mycobacterium tuberculosis H37Rv
ugcucgucauccauccgggccg

SEQ ID NO: 3317204 - RNA, 23 nt, Mycobacterium tuberculosis H37Rv
ugcucgucauccauccgggccgc

SEQ ID NO: 3317205 - RNA, 14 nt, Mycobacterium tuberculosis H37Rv
ugcucguccaagcc

SEQ ID NO: 3317206 - RNA, 20 nt, Mycobacterium tuberculosis H37Rv
ugcucguccaggucggccgc

SEQ ID NO: 3317207 - RNA, 20 nt, Mycobacterium tuberculosis H37Rv
ugcucgucccagaaccggcu

SEQ ID NO: 3317208 - RNA, 16 nt, Mycobacterium tuberculosis H37Rv
ugcucgucgagcaugc

SEQ ID NO: 3317209 - RNA, 21 nt, Mycobacterium tuberculosis H37Rv
ugcucgucggccaccgcggcg

SEQ ID NO: 3317210 - RNA, 19 nt, Mycobacterium tuberculosis H37Rv
ugcucgucggcgccggcgg

SEQ ID NO: 3317211 - RNA, 22 nt, Mycobacterium tuberculosis H37Rv
ugcucgucggcgccggcggccg

SEQ ID NO: 3317212 - RNA, 16 nt, Mycobacterium tuberculosis H37Rv
ugcucgucggucaccg

SEQ ID NO: 3317213 - RNA, 18 nt, Mycobacterium tuberculosis H37Rv
ugcucgucuuggcggcgg

SEQ ID NO: 3317214 - RNA, 22 nt, Mycobacterium tuberculosis H37Rv
ugcucguguuguugaagcccga

SEQ ID NO: 3317215 - RNA, 20 nt, Mycobacterium tuberculosis H37Rv
ugcucucgcucgugcacgcu

SEQ ID NO: 3317216 - RNA, 22 nt, Mycobacterium tuberculosis H37Rv
ugcucugcgcaucgguccaaag

SEQ ID NO: 3317217 - RNA, 15 nt, Mycobacterium tuberculosis H37Rv
ugcugaccggaguuc

SEQ ID NO: 3317218 - RNA, 20 nt, Mycobacterium tuberculosis H37Rv
ugcugacgacgagggccagc

SEQ ID NO: 3317219 - RNA, 21 nt, Mycobacterium tuberculosis H37Rv
ugcugacgaugcggucgacgg

SEQ ID NO: 3317220 - RNA, 17 nt, Mycobacterium tuberculosis H37Rv
ugcugagcguaggccag

SEQ ID NO: 3317221 - RNA, 18 nt, Mycobacterium tuberculosis H37Rv
ugcugagcguaggccagc

SEQ ID NO: 3317222 - RNA, 20 nt, Mycobacterium tuberculosis H37Rv
ugcugagcguaggccagcga

SEQ ID NO: 3317223 - RNA, 12 nt, Mycobacterium tuberculosis H37Rv
ugcugcaaggaa

SEQ ID NO: 3317224 - RNA, 21 nt, Mycobacterium tuberculosis H37Rv
ugcugcaccguuuccggcgcu

SEQ ID NO: 3317225 - RNA, 12 nt, Mycobacterium tuberculosis H37Rv
ugcugcaccugg

SEQ ID NO: 3317226 - RNA, 22 nt, Mycobacterium tuberculosis H37Rv
ugcugcacggccaugaucacac

SEQ ID NO: 3317227 - RNA, 17 nt, Mycobacterium tuberculosis H37Rv
ugcugcagaucggccgg

SEQ ID NO: 3317228 - RNA, 17 nt, Mycobacterium tuberculosis H37Rv
ugcugcagcaauugcac

SEQ ID NO: 3317229 - RNA, 17 nt, Mycobacterium tuberculosis H37Rv
ugcugcagcgucaaggg

SEQ ID NO: 3317230 - RNA, 14 nt, Mycobacterium tuberculosis H37Rv
ugcugcaugccgac

SEQ ID NO: 3317231 - RNA, 13 nt, Mycobacterium tuberculosis H37Rv
ugcugcauguccu

SEQ ID NO: 3317232 - RNA, 19 nt, Mycobacterium tuberculosis H37Rv
uggccagcagguuggucac

SEQ ID NO: 3317233 - RNA, 18 nt, Mycobacterium tuberculosis H37Rv
uggccagccacagccgac

SEQ ID NO: 3317234 - RNA, 19 nt, Mycobacterium tuberculosis H37Rv
uggccagccacagccgacc

SEQ ID NO: 3317235 - RNA, 17 nt, Mycobacterium tuberculosis H37Rv
uggccagccacuccucg

SEQ ID NO: 3317236 - RNA, 14 nt, Mycobacterium tuberculosis H37Rv
uggccagccgacaa

SEQ ID NO: 3317237 - RNA, 19 nt, Mycobacterium tuberculosis H37Rv
uggccagcgccaacucgag

SEQ ID NO: 3317238 - RNA, 12 nt, Mycobacterium tuberculosis H37Rv
uggccagcgcgu

SEQ ID NO: 3317239 - RNA, 14 nt, Mycobacterium tuberculosis H37Rv
uggccagcgcguug

SEQ ID NO: 3317240 - RNA, 12 nt, Mycobacterium tuberculosis H37Rv
uggccagcugcg

SEQ ID NO: 3317241 - RNA, 15 nt, Mycobacterium tuberculosis H37Rv
uggccaggaaguccc

SEQ ID NO: 3317242 - RNA, 17 nt, Mycobacterium tuberculosis H37Rv
uggccaggcuggcguca

SEQ ID NO: 3317243 - RNA, 22 nt, Mycobacterium tuberculosis H37Rv
uggccaguccgaaagccgccga

SEQ ID NO: 3317244 - RNA, 17 nt, Mycobacterium tuberculosis H37Rv
uggccaucagcucgcca

SEQ ID NO: 3317245 - RNA, 20 nt, Mycobacterium tuberculosis H37Rv
uggccaucaucgacggugau

SEQ ID NO: 3317246 - RNA, 14 nt, Mycobacterium tuberculosis H37Rv
uggccaugccacaa

SEQ ID NO: 3317247 - RNA, 14 nt, Mycobacterium tuberculosis H37Rv
uggccaugcucuug

SEQ ID NO: 3317248 - RNA, 15 nt, Mycobacterium tuberculosis H37Rv
uggccaugguggaga

SEQ ID NO: 3317249 - RNA, 17 nt, Mycobacterium tuberculosis H37Rv
uggccauguccaccagc

SEQ ID NO: 3317250 - RNA, 13 nt, Mycobacterium tuberculosis H37Rv
uggcccaaccgca

SEQ ID NO: 3317251 - RNA, 16 nt, Mycobacterium tuberculosis H37Rv
uggcccaccgccguug

SEQ ID NO: 3317252 - RNA, 13 nt, Mycobacterium tuberculosis H37Rv
uggcccagcggua

SEQ ID NO: 3317253 - RNA, 21 nt, Mycobacterium tuberculosis H37Rv
uggcccaguccgcuggccaug

SEQ ID NO: 3317254 - RNA, 23 nt, Mycobacterium tuberculosis H37Rv
uggccccaccgaacgugugggcc

SEQ ID NO: 3317255 - RNA, 22 nt, Mycobacterium tuberculosis H37Rv
uggcccccgacggugaaccacc

SEQ ID NO: 3317256 - RNA, 19 nt, Mycobacterium tuberculosis H37Rv
uggccccgccagcggcagc

SEQ ID NO: 3317257 - RNA, 13 nt, Mycobacterium tuberculosis H37Rv
uggccccggcucu

SEQ ID NO: 3317258 - RNA, 12 nt, Mycobacterium tuberculosis H37Rv
uggccccgggcg

SEQ ID NO: 3317259 - RNA, 16 nt, Mycobacterium tuberculosis H37Rv
uggccccgguggugcu

SEQ ID NO: 3317260 - RNA, 17 nt, Mycobacterium tuberculosis H37Rv
uggccccgguggugcug

SEQ ID NO: 3317261 - RNA, 18 nt, Mycobacterium tuberculosis H37Rv
uggccccgguggugcugc

SEQ ID NO: 3317262 - RNA, 19 nt, Mycobacterium tuberculosis H37Rv
uggccccuuucugaagcug

SEQ ID NO: 3317263 - RNA, 14 nt, Mycobacterium tuberculosis H37Rv
uggcccgacgcagc

SEQ ID NO: 3317264 - RNA, 19 nt, Mycobacterium tuberculosis H37Rv
uggcccgcacgaaccgguc

SEQ ID NO: 3317265 - RNA, 23 nt, Mycobacterium tuberculosis H37Rv
uggcccgcacgaaccggucgaag

SEQ ID NO: 3317266 - RNA, 20 nt, Mycobacterium tuberculosis H37Rv
uggcccgccagaacggcguc

SEQ ID NO: 3317267 - RNA, 17 nt, Mycobacterium tuberculosis H37Rv
uggcccgccggcaguga

SEQ ID NO: 3317268 - RNA, 18 nt, Mycobacterium tuberculosis H37Rv
uggcccgcucccugcacc

SEQ ID NO: 3317269 - RNA, 20 nt, Mycobacterium tuberculosis H37Rv
uggcccggaacaccgacguc

SEQ ID NO: 3317270 - RNA, 17 nt, Mycobacterium tuberculosis H37Rv
uggcccgggccaccgga

SEQ ID NO: 3317271 - RNA, 15 nt, Mycobacterium tuberculosis H37Rv
uggcccgggccgaag

SEQ ID NO: 3317272 - RNA, 17 nt, Mycobacterium tuberculosis H37Rv
uggcccggugcagcagu

SEQ ID NO: 3317273 - RNA, 22 nt, Mycobacterium tuberculosis H37Rv
uggcccguucgaccguguaacc

SEQ ID NO: 3317274 - RNA, 17 nt, Mycobacterium tuberculosis H37Rv
uggcccguuggcagcac

SEQ ID NO: 3317275 - RNA, 18 nt, Mycobacterium tuberculosis H37Rv
uggcccguuggcagcaca

SEQ ID NO: 3317276 - RNA, 22 nt, Mycobacterium tuberculosis H37Rv
uggcccuccucggugagguagc

SEQ ID NO: 3317277 - RNA, 13 nt, Mycobacterium tuberculosis H37Rv
uggcccugcuccu

SEQ ID NO: 3317278 - RNA, 18 nt, Mycobacterium tuberculosis H37Rv
uggcccuuccggccgaca

SEQ ID NO: 3317279 - RNA, 18 nt, Mycobacterium tuberculosis H37Rv
uggccgaacgacgggucc

SEQ ID NO: 3317280 - RNA, 15 nt, Mycobacterium tuberculosis H37Rv
uggccgaagcccgau

SEQ ID NO: 3317281 - RNA, 12 nt, Mycobacterium tuberculosis H37Rv
uggccgacagcc

SEQ ID NO: 3317282 - RNA, 15 nt, Mycobacterium tuberculosis H37Rv
uggccgacagccacc

SEQ ID NO: 3317283 - RNA, 17 nt, Mycobacterium tuberculosis H37Rv
uggccgacagccaccgc

SEQ ID NO: 3317284 - RNA, 16 nt, Mycobacterium tuberculosis H37Rv
uggccgacgcugcuga

SEQ ID NO: 3317285 - RNA, 22 nt, Mycobacterium tuberculosis H37Rv
uggccgacgucugguuggcugg

SEQ ID NO: 3317286 - RNA, 21 nt, Mycobacterium tuberculosis H37Rv
uggccgacuuguacgcaucgc

SEQ ID NO: 3317287 - RNA, 17 nt, Mycobacterium tuberculosis H37Rv
uggccgauuccgcgcgu

SEQ ID NO: 3317288 - RNA, 20 nt, Mycobacterium tuberculosis H37Rv
uggccgauuccgcgcguccg

SEQ ID NO: 3317289 - RNA, 14 nt, Mycobacterium tuberculosis H37Rv
uggccgcaccgauu

SEQ ID NO: 3317290 - RNA, 13 nt, Mycobacterium tuberculosis H37Rv
uggccgcagggcc

SEQ ID NO: 3317291 - RNA, 16 nt, Mycobacterium tuberculosis H37Rv
uggccgccacaccgcc

SEQ ID NO: 3317292 - RNA, 16 nt, Mycobacterium tuberculosis H37Rv
uggccgccaccgcgac

SEQ ID NO: 3317293 - RNA, 24 nt, Mycobacterium tuberculosis H37Rv
uggccgccaugaaaucacccaucg

SEQ ID NO: 3317294 - RNA, 19 nt, Mycobacterium tuberculosis H37Rv
uggccgcccagaccgccga

SEQ ID NO: 3317295 - RNA, 22 nt, Mycobacterium tuberculosis H37Rv
uggccgcccagaccgccgacgc

SEQ ID NO: 3317296 - RNA, 15 nt, Mycobacterium tuberculosis H37Rv
uggccgccccggccg

SEQ ID NO: 3317297 - RNA, 22 nt, Mycobacterium tuberculosis H37Rv
uggccgccgaauccgacgucga

SEQ ID NO: 3317298 - RNA, 13 nt, Mycobacterium tuberculosis H37Rv
uggccgccgacaa

SEQ ID NO: 3317299 - RNA, 22 nt, Mycobacterium tuberculosis H37Rv
uggccgccgcagcuccccgacc

SEQ ID NO: 3317300 - RNA, 13 nt, Mycobacterium tuberculosis H37Rv
uggccgccgcgag

SEQ ID NO: 3317301 - RNA, 21 nt, Mycobacterium tuberculosis H37Rv
uggccgccgcgaggaugcuga

SEQ ID NO: 3317302 - RNA, 15 nt, Mycobacterium tuberculosis H37Rv
uggccgccggcgccg

SEQ ID NO: 3317303 - RNA, 17 nt, Mycobacterium tuberculosis H37Rv
uggccgccggcgcuggc

SEQ ID NO: 3317304 - RNA, 13 nt, Mycobacterium tuberculosis H37Rv
uggccgccgucga

SEQ ID NO: 3317305 - RNA, 14 nt, Mycobacterium tuberculosis H37Rv
uggccgccgucgac

SEQ ID NO: 3317306 - RNA, 22 nt, Mycobacterium tuberculosis H37Rv
uggccgccuccgcggcauuggc

SEQ ID NO: 3317307 - RNA, 18 nt, Mycobacterium tuberculosis H37Rv
uggccgccuucgccgccg

SEQ ID NO: 3317308 - RNA, 20 nt, Mycobacterium tuberculosis H37Rv
uggccgcgagguacccaucg

SEQ ID NO: 3317309 - RNA, 13 nt, Mycobacterium tuberculosis H37Rv
uggccgcgaugac

SEQ ID NO: 3317310 - RNA, 21 nt, Mycobacterium tuberculosis H37Rv
uggccgcgaugacgaccgauc

SEQ ID NO: 3317311 - RNA, 19 nt, Mycobacterium tuberculosis H37Rv
uggccgcgcaggggcggcg

SEQ ID NO: 3317312 - RNA, 19 nt, Mycobacterium tuberculosis H37Rv
uggccgcgccucggucugc

SEQ ID NO: 3317313 - RNA, 14 nt, Mycobacterium tuberculosis H37Rv
uggccgcgcggucg

SEQ ID NO: 3317314 - RNA, 16 nt, Mycobacterium tuberculosis H37Rv
uggccgcgcuggucaa

SEQ ID NO: 3317315 - RNA, 22 nt, Mycobacterium tuberculosis H37Rv
uggccgcggcggucugggugag

SEQ ID NO: 3317316 - RNA, 18 nt, Mycobacterium tuberculosis H37Rv
uggccgcucuccaccccg

SEQ ID NO: 3317317 - RNA, 14 nt, Mycobacterium tuberculosis H37Rv
uggccgcugccagc

SEQ ID NO: 3317318 - RNA, 15 nt, Mycobacterium tuberculosis H37Rv
uggccgcugccagcc

SEQ ID NO: 3317319 - RNA, 21 nt, Mycobacterium tuberculosis H37Rv
uggccgcugucguaccgcucg

SEQ ID NO: 3317320 - RNA, 17 nt, Mycobacterium tuberculosis H37Rv
uggccgcuuugcgcggu

SEQ ID NO: 3317321 - RNA, 23 nt, Mycobacterium tuberculosis H37Rv
uggccggaauacccgcuggcccg

SEQ ID NO: 3317322 - RNA, 23 nt, Mycobacterium tuberculosis H37Rv
uggccggcaacggcgcgccgacc

SEQ ID NO: 3317323 - RNA, 17 nt, Mycobacterium tuberculosis H37Rv
uggccggcgagggugag

SEQ ID NO: 3317324 - RNA, 17 nt, Mycobacterium tuberculosis H37Rv
uggccggcgccaccgag

SEQ ID NO: 3317325 - RNA, 21 nt, Mycobacterium tuberculosis H37Rv
uggccggcgcugcccgggcug

SEQ ID NO: 3317326 - RNA, 14 nt, Mycobacterium tuberculosis H37Rv
uggccgggcuggcg

SEQ ID NO: 3317327 - RNA, 17 nt, Mycobacterium tuberculosis H37Rv
uggccgggcuggcgacg

SEQ ID NO: 3317328 - RNA, 14 nt, Mycobacterium tuberculosis H37Rv
uggcgcggacccgc

SEQ ID NO: 3317329 - RNA, 16 nt, Mycobacterium tuberculosis H37Rv
uggcgcggcacccggu

SEQ ID NO: 3317330 - RNA, 17 nt, Mycobacterium tuberculosis H37Rv
uggcgcggcgagcacgc

SEQ ID NO: 3317331 - RNA, 18 nt, Mycobacterium tuberculosis H37Rv
uggcgcgggccggcgacu

SEQ ID NO: 3317332 - RNA, 15 nt, Mycobacterium tuberculosis H37Rv
uggcgcggggccgcc

SEQ ID NO: 3317333 - RNA, 23 nt, Mycobacterium tuberculosis H37Rv
uggcgcguggucgggaacccggu

SEQ ID NO: 3317334 - RNA, 15 nt, Mycobacterium tuberculosis H37Rv
uggcgcugaagccga

SEQ ID NO: 3317335 - RNA, 19 nt, Mycobacterium tuberculosis H37Rv
uggcgcugagggugcucuc

SEQ ID NO: 3317336 - RNA, 15 nt, Mycobacterium tuberculosis H37Rv
uggcgcugcuggcag

SEQ ID NO: 3317337 - RNA, 18 nt, Mycobacterium tuberculosis H37Rv
uggcgcuugcugcauguc

SEQ ID NO: 3317338 - RNA, 22 nt, Mycobacterium tuberculosis H37Rv
uggcggaacagcuucgcgcagc

SEQ ID NO: 3317339 - RNA, 20 nt, Mycobacterium tuberculosis H37Rv
uggcggaauucaggaagggc

SEQ ID NO: 3317340 - RNA, 18 nt, Mycobacterium tuberculosis H37Rv
uggcggaucgcgagcgcc

SEQ ID NO: 3317341 - RNA, 20 nt, Mycobacterium tuberculosis H37Rv
uggcggaucgcgagcgccgc

SEQ ID NO: 3317342 - RNA, 23 nt, Mycobacterium tuberculosis H37Rv
uggcggaucuggcuccggccagg

SEQ ID NO: 3317343 - RNA, 13 nt, Mycobacterium tuberculosis H37Rv
uggcggcacuggc

SEQ ID NO: 3317344 - RNA, 14 nt, Mycobacterium tuberculosis H37Rv
uggcggcagcagcg

SEQ ID NO: 3317345 - RNA, 12 nt, Mycobacterium tuberculosis H37Rv
uggcggcaggug

SEQ ID NO: 3317346 - RNA, 21 nt, Mycobacterium tuberculosis H37Rv
uggcggcagguguuggugcgg

SEQ ID NO: 3317347 - RNA, 22 nt, Mycobacterium tuberculosis H37Rv
uggcggccaacggcuccgggcg

SEQ ID NO: 3317348 - RNA, 15 nt, Mycobacterium tuberculosis H37Rv
uggcggccagcgcac

SEQ ID NO: 3317349 - RNA, 16 nt, Mycobacterium tuberculosis H37Rv
uggcggccagcgcacc

SEQ ID NO: 3317350 - RNA, 19 nt, Mycobacterium tuberculosis H37Rv
uggcggccagcgcaccgcc

SEQ ID NO: 3317351 - RNA, 21 nt, Mycobacterium tuberculosis H37Rv
uggcggccaguucggcggccg

SEQ ID NO: 3317352 - RNA, 15 nt, Mycobacterium tuberculosis H37Rv
uggcggcccggguug

SEQ ID NO: 3317353 - RNA, 12 nt, Mycobacterium tuberculosis H37Rv
uggcggcccggu

SEQ ID NO: 3317354 - RNA, 20 nt, Mycobacterium tuberculosis H37Rv
uggcggccgggucggugacg

SEQ ID NO: 3317355 - RNA, 17 nt, Mycobacterium tuberculosis H37Rv
uggcggccuaacucgcc

SEQ ID NO: 3317356 - RNA, 19 nt, Mycobacterium tuberculosis H37Rv
uggcggccuccuccccgac

SEQ ID NO: 3317357 - RNA, 18 nt, Mycobacterium tuberculosis H37Rv
uggcggccuugcucagca

SEQ ID NO: 3317358 - RNA, 14 nt, Mycobacterium tuberculosis H37Rv
uggcggcgagcagc

SEQ ID NO: 3317359 - RNA, 18 nt, Mycobacterium tuberculosis H37Rv
uggcggcgagcggacaca

SEQ ID NO: 3317360 - RNA, 23 nt, Mycobacterium tuberculosis H37Rv
uggcggcgaucaacucgggcagc

SEQ ID NO: 3317361 - RNA, 14 nt, Mycobacterium tuberculosis H37Rv
uggcggcggcggag

SEQ ID NO: 3317362 - RNA, 21 nt, Mycobacterium tuberculosis H37Rv
uggcggcgggccucggcgacc

SEQ ID NO: 3317363 - RNA, 16 nt, Mycobacterium tuberculosis H37Rv
uggcggcggugcagca

SEQ ID NO: 3317364 - RNA, 17 nt, Mycobacterium tuberculosis H37Rv
uggcggcggugccacga

SEQ ID NO: 3317365 - RNA, 22 nt, Mycobacterium tuberculosis H37Rv
uggcggcggugccacgaucggc

SEQ ID NO: 3317366 - RNA, 14 nt, Mycobacterium tuberculosis H37Rv
uggcggcugcagcc

SEQ ID NO: 3317367 - RNA, 12 nt, Mycobacterium tuberculosis H37Rv
uggcgggaccgu

SEQ ID NO: 3317368 - RNA, 17 nt, Mycobacterium tuberculosis H37Rv
uggcgggagaucgucgc

SEQ ID NO: 3317369 - RNA, 19 nt, Mycobacterium tuberculosis H37Rv
uggcgggagcaccgaccag

SEQ ID NO: 3317370 - RNA, 22 nt, Mycobacterium tuberculosis H37Rv
uggcgggaucgagagccgaccg

SEQ ID NO: 3317371 - RNA, 17 nt, Mycobacterium tuberculosis H37Rv
uggcgggcagcuguucg

SEQ ID NO: 3317372 - RNA, 16 nt, Mycobacterium tuberculosis H37Rv
uggcgggcgccuuggu

SEQ ID NO: 3317373 - RNA, 19 nt, Mycobacterium tuberculosis H37Rv
uggcggggaaaccggccag

SEQ ID NO: 3317374 - RNA, 18 nt, Mycobacterium tuberculosis H37Rv
uggcggggaucagcgagu

SEQ ID NO: 3317375 - RNA, 20 nt, Mycobacterium tuberculosis H37Rv
uggcgggguugaucaccgac

SEQ ID NO: 3317376 - RNA, 17 nt, Mycobacterium tuberculosis H37Rv
uggcgguaagcgaaaca

SEQ ID NO: 3317377 - RNA, 13 nt, Mycobacterium tuberculosis H37Rv
uggcgguccaccg

SEQ ID NO: 3317378 - RNA, 18 nt, Mycobacterium tuberculosis H37Rv
uggcggucccgcauaucc

SEQ ID NO: 3317379 - RNA, 20 nt, Mycobacterium tuberculosis H37Rv
uggcgguccggaaauuccgg

SEQ ID NO: 3317380 - RNA, 20 nt, Mycobacterium tuberculosis H37Rv
uggcggucggcagaccgacc

SEQ ID NO: 3317381 - RNA, 15 nt, Mycobacterium tuberculosis H37Rv
uggcggucgguuccg

SEQ ID NO: 3317382 - RNA, 20 nt, Mycobacterium tuberculosis H37Rv
uggcggucgguuccggugua

SEQ ID NO: 3317383 - RNA, 17 nt, Mycobacterium tuberculosis H37Rv
uggcggugaacaccgcc

SEQ ID NO: 3317384 - RNA, 19 nt, Mycobacterium tuberculosis H37Rv
uggcggugaacaccgccag

SEQ ID NO: 3317385 - RNA, 14 nt, Mycobacterium tuberculosis H37Rv
uggcggugagccgc

SEQ ID NO: 3317386 - RNA, 12 nt, Mycobacterium tuberculosis H37Rv
uggcggugcugc

SEQ ID NO: 3317387 - RNA, 14 nt, Mycobacterium tuberculosis H37Rv
uggcgguggugccg

SEQ ID NO: 3317388 - RNA, 21 nt, Mycobacterium tuberculosis H37Rv
uggcgguguugcucccggccg

SEQ ID NO: 3317389 - RNA, 15 nt, Mycobacterium tuberculosis H37Rv
uggcgguuccggccg

SEQ ID NO: 3317390 - RNA, 12 nt, Mycobacterium tuberculosis H37Rv
uggcguagcaac

SEQ ID NO: 3317391 - RNA, 15 nt, Mycobacterium tuberculosis H37Rv
uggcguagugcagcu

SEQ ID NO: 3317392 - RNA, 19 nt, Mycobacterium tuberculosis H37Rv
uggcguauccuugcgacgu

SEQ ID NO: 3317393 - RNA, 19 nt, Mycobacterium tuberculosis H37Rv
uggcgucacguaauucccc

SEQ ID NO: 3317394 - RNA, 14 nt, Mycobacterium tuberculosis H37Rv
uggcgucagcagca

SEQ ID NO: 3317395 - RNA, 15 nt, Mycobacterium tuberculosis H37Rv
uggcgucagcagcaa

SEQ ID NO: 3317396 - RNA, 15 nt, Mycobacterium tuberculosis H37Rv
uggcgucagugcaga

SEQ ID NO: 3317397 - RNA, 23 nt, Mycobacterium tuberculosis H37Rv
uggcgucgacaacacgccgucga

SEQ ID NO: 3317398 - RNA, 16 nt, Mycobacterium tuberculosis H37Rv
uggcgucgaugccggc

SEQ ID NO: 3317399 - RNA, 18 nt, Mycobacterium tuberculosis H37Rv
uggcgucgaugcgggcca

SEQ ID NO: 3317400 - RNA, 14 nt, Mycobacterium tuberculosis H37Rv
uggcgucgcgguug

SEQ ID NO: 3317401 - RNA, 14 nt, Mycobacterium tuberculosis H37Rv
uggcgucggccagg

SEQ ID NO: 3317402 - RNA, 15 nt, Mycobacterium tuberculosis H37Rv
uggcgucggccagga

SEQ ID NO: 3317403 - RNA, 13 nt, Mycobacterium tuberculosis H37Rv
uggcgucggcguc

SEQ ID NO: 3317404 - RNA, 12 nt, Mycobacterium tuberculosis H37Rv
uggcgugcaccg

SEQ ID NO: 3317405 - RNA, 11 nt, Mycobacterium tuberculosis H37Rv
uggcgugcaga

SEQ ID NO: 3317406 - RNA, 11 nt, Mycobacterium tuberculosis H37Rv
uggcgugcagc

SEQ ID NO: 3317407 - RNA, 15 nt, Mycobacterium tuberculosis H37Rv
uggcgugccgucgcc

SEQ ID NO: 3317408 - RNA, 16 nt, Mycobacterium tuberculosis H37Rv
uggcguggcccucggc

SEQ ID NO: 3317409 - RNA, 19 nt, Mycobacterium tuberculosis H37Rv
uggcguggcccucggcgau

SEQ ID NO: 3317410 - RNA, 20 nt, Mycobacterium tuberculosis H37Rv
uggcguggucucggucagcc

SEQ ID NO: 3317411 - RNA, 16 nt, Mycobacterium tuberculosis H37Rv
uggcguguucgacggc

SEQ ID NO: 3317412 - RNA, 20 nt, Mycobacterium tuberculosis H37Rv
uggcguucagcggccagcag

SEQ ID NO: 3317413 - RNA, 15 nt, Mycobacterium tuberculosis H37Rv
uggcguucggugagg

SEQ ID NO: 3317414 - RNA, 15 nt, Mycobacterium tuberculosis H37Rv
uggcguucgucggcu

SEQ ID NO: 3317415 - RNA, 16 nt, Mycobacterium tuberculosis H37Rv
uggcguugccaccgga

SEQ ID NO: 3317416 - RNA, 14 nt, Mycobacterium tuberculosis H37Rv
uggcguugggcagc

SEQ ID NO: 3317417 - RNA, 17 nt, Mycobacterium tuberculosis H37Rv
uggcguugguggucugc

SEQ ID NO: 3317418 - RNA, 18 nt, Mycobacterium tuberculosis H37Rv
uggcguuugccggccgau

SEQ ID NO: 3317419 - RNA, 20 nt, Mycobacterium tuberculosis H37Rv
uggcuaacaccgcaggcaca

SEQ ID NO: 3317420 - RNA, 22 nt, Mycobacterium tuberculosis H37Rv
uggcuagcagguacucgcccca

SEQ ID NO: 3317421 - RNA, 22 nt, Mycobacterium tuberculosis H37Rv
uggcuauaaaccacgcuggugu

SEQ ID NO: 3317422 - RNA, 18 nt, Mycobacterium tuberculosis H37Rv
uggcucaccgacaugacg

SEQ ID NO: 3317423 - RNA, 14 nt, Mycobacterium tuberculosis H37Rv
uggcucaucgaugc

SEQ ID NO: 3317424 - RNA, 16 nt, Mycobacterium tuberculosis H37Rv
uggcuccggccagggg

SEQ ID NO: 3317425 - RNA, 20 nt, Mycobacterium tuberculosis H37Rv
ugggcgcguagcucagcggu

SEQ ID NO: 3317426 - RNA, 16 nt, Mycobacterium tuberculosis H37Rv
ugggcgcucgcaucau

SEQ ID NO: 3317427 - RNA, 15 nt, Mycobacterium tuberculosis H37Rv
ugggcgcugucacgu

SEQ ID NO: 3317428 - RNA, 22 nt, Mycobacterium tuberculosis H37Rv
ugggcgcugucacguagcgagc

SEQ ID NO: 3317429 - RNA, 20 nt, Mycobacterium tuberculosis H37Rv
ugggcgcuuaugcgucugcu

SEQ ID NO: 3317430 - RNA, 22 nt, Mycobacterium tuberculosis H37Rv
ugggcggaacgaugccggcaag

SEQ ID NO: 3317431 - RNA, 13 nt, Mycobacterium tuberculosis H37Rv
ugggcggcacugg

SEQ ID NO: 3317432 - RNA, 21 nt, Mycobacterium tuberculosis H37Rv
ugggcggcacuggauccggga

SEQ ID NO: 3317433 - RNA, 17 nt, Mycobacterium tuberculosis H37Rv
ugggcggcccaccggcc

SEQ ID NO: 3317434 - RNA, 19 nt, Mycobacterium tuberculosis H37Rv
ugggcggccgggcucccca

SEQ ID NO: 3317435 - RNA, 22 nt, Mycobacterium tuberculosis H37Rv
ugggcggccuggucggccaggu

SEQ ID NO: 3317436 - RNA, 18 nt, Mycobacterium tuberculosis H37Rv
ugggcggcucgucgauug

SEQ ID NO: 3317437 - RNA, 16 nt, Mycobacterium tuberculosis H37Rv
ugggcgggauggccgc

SEQ ID NO: 3317438 - RNA, 20 nt, Mycobacterium tuberculosis H37Rv
ugggcgggauggccgccgac

SEQ ID NO: 3317439 - RNA, 22 nt, Mycobacterium tuberculosis H37Rv
ugggcgggcuuggcgucgacgu

SEQ ID NO: 3317440 - RNA, 21 nt, Mycobacterium tuberculosis H37Rv
ugggcggguucggacgagguc

SEQ ID NO: 3317441 - RNA, 17 nt, Mycobacterium tuberculosis H37Rv
ugggcgguagccgacga

SEQ ID NO: 3317442 - RNA, 14 nt, Mycobacterium tuberculosis H37Rv
ugggcgguagcuuc

SEQ ID NO: 3317443 - RNA, 18 nt, Mycobacterium tuberculosis H37Rv
ugggcgguccgcgucugg

SEQ ID NO: 3317444 - RNA, 19 nt, Mycobacterium tuberculosis H37Rv
ugggcggugucgucgaggu

SEQ ID NO: 3317445 - RNA, 21 nt, Mycobacterium tuberculosis H37Rv
ugggcguacucggcgcgcagc

SEQ ID NO: 3317446 - RNA, 13 nt, Mycobacterium tuberculosis H37Rv
ugggcgucaagca

SEQ ID NO: 3317447 - RNA, 15 nt, Mycobacterium tuberculosis H37Rv
ugggcgucaagcaag

SEQ ID NO: 3317448 - RNA, 21 nt, Mycobacterium tuberculosis H37Rv
ugggcgugacguagugcaccg

SEQ ID NO: 3317449 - RNA, 16 nt, Mycobacterium tuberculosis H37Rv
ugggcgugcaggcugg

SEQ ID NO: 3317450 - RNA, 15 nt, Mycobacterium tuberculosis H37Rv
ugggcguggcugguc

SEQ ID NO: 3317451 - RNA, 16 nt, Mycobacterium tuberculosis H37Rv
ugggcguuggcgacga

SEQ ID NO: 3317452 - RNA, 21 nt, Mycobacterium tuberculosis H37Rv
ugggcuaccgagauugggcug

SEQ ID NO: 3317453 - RNA, 21 nt, Mycobacterium tuberculosis H37Rv
ugggcugggauagcgcgguug

SEQ ID NO: 3317454 - RNA, 20 nt, Mycobacterium tuberculosis H37Rv
ugggcuguccuccugaacga

SEQ ID NO: 3317455 - RNA, 13 nt, Mycobacterium tuberculosis H37Rv
ugggcuuggcugu

SEQ ID NO: 3317456 - RNA, 12 nt, Mycobacterium tuberculosis H37Rv
ugggcuuggugc

SEQ ID NO: 3317457 - RNA, 19 nt, Mycobacterium tuberculosis H37Rv
ugggcuuuugcgucugcuc

SEQ ID NO: 3317458 - RNA, 18 nt, Mycobacterium tuberculosis H37Rv
uggggauagccgcgucgc

SEQ ID NO: 3317459 - RNA, 22 nt, Mycobacterium tuberculosis H37Rv
uggggaucgaccauggucgauu

SEQ ID NO: 3317460 - RNA, 22 nt, Mycobacterium tuberculosis H37Rv
uggggaucgcaccgugggcccu

SEQ ID NO: 3317461 - RNA, 16 nt, Mycobacterium tuberculosis H37Rv
uggggaugcgauggcc

SEQ ID NO: 3317462 - RNA, 15 nt, Mycobacterium tuberculosis H37Rv
uggggauuccgcacc

SEQ ID NO: 3317463 - RNA, 21 nt, Mycobacterium tuberculosis H37Rv
uggggcagccgggcgucgcug

SEQ ID NO: 3317464 - RNA, 23 nt, Mycobacterium tuberculosis H37Rv
uggggcagucccggugggcggcu

SEQ ID NO: 3317465 - RNA, 12 nt, Mycobacterium tuberculosis H37Rv
uggggcgccggg

SEQ ID NO: 3317466 - RNA, 14 nt, Mycobacterium tuberculosis H37Rv
uggggcgcgccggc

SEQ ID NO: 3317467 - RNA, 21 nt, Mycobacterium tuberculosis H37Rv
uggggcgcgugggcgugcagg

SEQ ID NO: 3317468 - RNA, 18 nt, Mycobacterium tuberculosis H37Rv
uggggcggcaugcucacc

SEQ ID NO: 3317469 - RNA, 16 nt, Mycobacterium tuberculosis H37Rv
uggggcuauggcgcag

SEQ ID NO: 3317470 - RNA, 13 nt, Mycobacterium tuberculosis H37Rv
uggggcucgagug

SEQ ID NO: 3317471 - RNA, 16 nt, Mycobacterium tuberculosis H37Rv
ugggggagccggugac

SEQ ID NO: 3317472 - RNA, 16 nt, Mycobacterium tuberculosis H37Rv
ugggggccggcagcgg

SEQ ID NO: 3317473 - RNA, 18 nt, Mycobacterium tuberculosis H37Rv
ugggggcuucugcgucug

SEQ ID NO: 3317474 - RNA, 13 nt, Mycobacterium tuberculosis H37Rv
uggggguggcagc

SEQ ID NO: 3317475 - RNA, 15 nt, Mycobacterium tuberculosis H37Rv
uggggucgacgcagu

SEQ ID NO: 3317476 - RNA, 20 nt, Mycobacterium tuberculosis H37Rv
uggggucgacgcagugcccg

SEQ ID NO: 3317477 - RNA, 19 nt, Mycobacterium tuberculosis H37Rv
ugggguggcaucgaacgcc

SEQ ID NO: 3317478 - RNA, 14 nt, Mycobacterium tuberculosis H37Rv
ugggguuguuggcg

SEQ ID NO: 3317479 - RNA, 23 nt, Mycobacterium tuberculosis H37Rv
uggguagcugacgugucggcugc

SEQ ID NO: 3317480 - RNA, 11 nt, Mycobacterium tuberculosis H37Rv
uggguaggcuc

SEQ ID NO: 3317481 - RNA, 14 nt, Mycobacterium tuberculosis H37Rv
uggguauccaccgc

SEQ ID NO: 3317482 - RNA, 17 nt, Mycobacterium tuberculosis H37Rv
uggguauccaccgcgag

SEQ ID NO: 3317483 - RNA, 16 nt, Mycobacterium tuberculosis H37Rv
uggguaugcacccagg

SEQ ID NO: 3317484 - RNA, 19 nt, Mycobacterium tuberculosis H37Rv
ugggucaacgucaggcccu

SEQ ID NO: 3317485 - RNA, 20 nt, Mycobacterium tuberculosis H37Rv
ugggucagguugucggcgau

SEQ ID NO: 3317486 - RNA, 21 nt, Mycobacterium tuberculosis H37Rv
ugggucaucgagucgaagaac

SEQ ID NO: 3317487 - RNA, 20 nt, Mycobacterium tuberculosis H37Rv
uggguccccucccaccagcg

SEQ ID NO: 3317488 - RNA, 18 nt, Mycobacterium tuberculosis H37Rv
ugggucgauccggugccg

SEQ ID NO: 3317489 - RNA, 20 nt, Mycobacterium tuberculosis H37Rv
ugggucgcaauauccggccg

SEQ ID NO: 3317490 - RNA, 20 nt, Mycobacterium tuberculosis H37Rv
ugggucggcuuccggugccg

SEQ ID NO: 3317491 - RNA, 13 nt, Mycobacterium tuberculosis H37Rv
ugggucgugcagg

SEQ ID NO: 3317492 - RNA, 21 nt, Mycobacterium tuberculosis H37Rv
ugggucuuugcccgccacgcu

SEQ ID NO: 3317493 - RNA, 22 nt, Mycobacterium tuberculosis H37Rv
ugggugaccucgucgaccggga

SEQ ID NO: 3317494 - RNA, 14 nt, Mycobacterium tuberculosis H37Rv
ugggugacgguggc

SEQ ID NO: 3317495 - RNA, 20 nt, Mycobacterium tuberculosis H37Rv
ugggugccguugcgucugcu

SEQ ID NO: 3317496 - RNA, 23 nt, Mycobacterium tuberculosis H37Rv
ugggugcgacacauagugcggca

SEQ ID NO: 3317497 - RNA, 21 nt, Mycobacterium tuberculosis H37Rv
ugggugcgccgucagcccagg

SEQ ID NO: 3317498 - RNA, 22 nt, Mycobacterium tuberculosis H37Rv
ugggugcgccgucagcccaggu

SEQ ID NO: 3317499 - RNA, 17 nt, Mycobacterium tuberculosis H37Rv
ugggugcgucgacccag

SEQ ID NO: 3317500 - RNA, 18 nt, Mycobacterium tuberculosis H37Rv
ugggugcgucgacccagc

SEQ ID NO: 3317501 - RNA, 15 nt, Mycobacterium tuberculosis H37Rv
uggguggugcucacc

SEQ ID NO: 3317502 - RNA, 18 nt, Mycobacterium tuberculosis H37Rv
ugggugucaaugugguuc

SEQ ID NO: 3317503 - RNA, 12 nt, Mycobacterium tuberculosis H37Rv
ugggugugcccg

SEQ ID NO: 3317504 - RNA, 16 nt, Mycobacterium tuberculosis H37Rv
ugggugugcugccacc

SEQ ID NO: 3317505 - RNA, 20 nt, Mycobacterium tuberculosis H37Rv
uggguguugcuggccgcgau

SEQ ID NO: 3317506 - RNA, 16 nt, Mycobacterium tuberculosis H37Rv
uggguguugucgucga

SEQ ID NO: 3317507 - RNA, 14 nt, Mycobacterium tuberculosis H37Rv
uggguucgcgguug

SEQ ID NO: 3317508 - RNA, 20 nt, Mycobacterium tuberculosis H37Rv
uggguugaaaacgcccggca

SEQ ID NO: 3317509 - RNA, 14 nt, Mycobacterium tuberculosis H37Rv
uggguuggauaaag

SEQ ID NO: 3317510 - RNA, 13 nt, Mycobacterium tuberculosis H37Rv
ugguaaccagggc

SEQ ID NO: 3317511 - RNA, 16 nt, Mycobacterium tuberculosis H37Rv
ugguaaccagggcagc

SEQ ID NO: 3317512 - RNA, 14 nt, Mycobacterium tuberculosis H37Rv
ugguacaccaggcc

SEQ ID NO: 3317513 - RNA, 15 nt, Mycobacterium tuberculosis H37Rv
ugguacagggugugc

SEQ ID NO: 3317514 - RNA, 18 nt, Mycobacterium tuberculosis H37Rv
ugguaccagcccgccguc

SEQ ID NO: 3317515 - RNA, 15 nt, Mycobacterium tuberculosis H37Rv
ugguacccagcgcgg

SEQ ID NO: 3317516 - RNA, 13 nt, Mycobacterium tuberculosis H37Rv
ugguaccccagca

SEQ ID NO: 3317517 - RNA, 18 nt, Mycobacterium tuberculosis H37Rv
ugguacccgcgccgcgca

SEQ ID NO: 3317518 - RNA, 16 nt, Mycobacterium tuberculosis H37Rv
ugguaccggcgccgca

SEQ ID NO: 3317519 - RNA, 23 nt, Mycobacterium tuberculosis H37Rv
ugguacgugaauuaaggugacca

SEQ ID NO: 3317520 - RNA, 16 nt, Mycobacterium tuberculosis H37Rv
ugguacuuucacgcuc

SEQ ID NO: 3317521 - RNA, 23 nt, Mycobacterium tuberculosis H37Rv
uggugcccaaggcagacccccag

SEQ ID NO: 3317522 - RNA, 16 nt, Mycobacterium tuberculosis H37Rv
uggugcccuugaagaa

SEQ ID NO: 3317523 - RNA, 12 nt, Mycobacterium tuberculosis H37Rv
uggugccgaccc

SEQ ID NO: 3317524 - RNA, 16 nt, Mycobacterium tuberculosis H37Rv
uggugccgccaccacc

SEQ ID NO: 3317525 - RNA, 20 nt, Mycobacterium tuberculosis H37Rv
uggugccgccaccaccggcg

SEQ ID NO: 3317526 - RNA, 16 nt, Mycobacterium tuberculosis H37Rv
uggugccgccugugcc

SEQ ID NO: 3317527 - RNA, 16 nt, Mycobacterium tuberculosis H37Rv
uggugccgcggccacc

SEQ ID NO: 3317528 - RNA, 17 nt, Mycobacterium tuberculosis H37Rv
uggugccgcggccaccg

SEQ ID NO: 3317529 - RNA, 19 nt, Mycobacterium tuberculosis H37Rv
uggugccggucaccucgcc

SEQ ID NO: 3317530 - RNA, 18 nt, Mycobacterium tuberculosis H37Rv
uggugccuacaccggcaa

SEQ ID NO: 3317531 - RNA, 15 nt, Mycobacterium tuberculosis H37Rv
uggugcgccacgcca

SEQ ID NO: 3317532 - RNA, 18 nt, Mycobacterium tuberculosis H37Rv
uggugcgccgggcguccg

SEQ ID NO: 3317533 - RNA, 19 nt, Mycobacterium tuberculosis H37Rv
uggugcgccgggcguccgc

SEQ ID NO: 3317534 - RNA, 14 nt, Mycobacterium tuberculosis H37Rv
uggugcgcgucagc

SEQ ID NO: 3317535 - RNA, 19 nt, Mycobacterium tuberculosis H37Rv
uggugcggucuggcgacuc

SEQ ID NO: 3317536 - RNA, 20 nt, Mycobacterium tuberculosis H37Rv
uggugcguagcccacccggg

SEQ ID NO: 3317537 - RNA, 17 nt, Mycobacterium tuberculosis H37Rv
uggugcuagcgccgcca

SEQ ID NO: 3317538 - RNA, 21 nt, Mycobacterium tuberculosis H37Rv
uggugcugacauuuccaccac

SEQ ID NO: 3317539 - RNA, 14 nt, Mycobacterium tuberculosis H37Rv
ugguggaacuccgg

SEQ ID NO: 3317540 - RNA, 23 nt, Mycobacterium tuberculosis H37Rv
ugguggaccucacugugguaggc

SEQ ID NO: 3317541 - RNA, 17 nt, Mycobacterium tuberculosis H37Rv
ugguggacgaugcggua

SEQ ID NO: 3317542 - RNA, 19 nt, Mycobacterium tuberculosis H37Rv
ugguggacgcagagucaac

SEQ ID NO: 3317543 - RNA, 23 nt, Mycobacterium tuberculosis H37Rv
ugguggagcggcgcggggguggg

SEQ ID NO: 3317544 - RNA, 19 nt, Mycobacterium tuberculosis H37Rv
ugguggaguucgcgcuggc

SEQ ID NO: 3317545 - RNA, 14 nt, Mycobacterium tuberculosis H37Rv
ugguggcagcgcac

SEQ ID NO: 3317546 - RNA, 15 nt, Mycobacterium tuberculosis H37Rv
ugguggcagcgcacc

SEQ ID NO: 3317547 - RNA, 12 nt, Mycobacterium tuberculosis H37Rv
ugguggcccggc

SEQ ID NO: 3317548 - RNA, 13 nt, Mycobacterium tuberculosis H37Rv
ugguggcccggcu

SEQ ID NO: 3317549 - RNA, 13 nt, Mycobacterium tuberculosis H37Rv
ugguggcccgggc

SEQ ID NO: 3317550 - RNA, 17 nt, Mycobacterium tuberculosis H37Rv
ugguggcccgggccacc

SEQ ID NO: 3317551 - RNA, 23 nt, Mycobacterium tuberculosis H37Rv
ugguggccgaacgggucggcgac

SEQ ID NO: 3317552 - RNA, 15 nt, Mycobacterium tuberculosis H37Rv
ugguggcgaccccgc

SEQ ID NO: 3317553 - RNA, 22 nt, Mycobacterium tuberculosis H37Rv
ugguggcgaucaucggccccga

SEQ ID NO: 3317554 - RNA, 14 nt, Mycobacterium tuberculosis H37Rv
ugguggcgggguug

SEQ ID NO: 3317555 - RNA, 16 nt, Mycobacterium tuberculosis H37Rv
ugguggcgguuccggc

SEQ ID NO: 3317556 - RNA, 23 nt, Mycobacterium tuberculosis H37Rv
uggugggaggggacccagcggcg

SEQ ID NO: 3317557 - RNA, 18 nt, Mycobacterium tuberculosis H37Rv
uggugggaucgcagcgcc

SEQ ID NO: 3317558 - RNA, 17 nt, Mycobacterium tuberculosis H37Rv
uggugggccagcagcaa

SEQ ID NO: 3317559 - RNA, 19 nt, Mycobacterium tuberculosis H37Rv
uggugggccgugggugucg

SEQ ID NO: 3317560 - RNA, 19 nt, Mycobacterium tuberculosis H37Rv
uggugggcgcagagucaac

SEQ ID NO: 3317561 - RNA, 22 nt, Mycobacterium tuberculosis H37Rv
uggugggcgggaucgacuccgg

SEQ ID NO: 3317562 - RNA, 21 nt, Mycobacterium tuberculosis H37Rv
uggugggggagcggccgccgc

SEQ ID NO: 3317563 - RNA, 17 nt, Mycobacterium tuberculosis H37Rv
ugguggguugaucgcgc

SEQ ID NO: 3317564 - RNA, 12 nt, Mycobacterium tuberculosis H37Rv
ugguggucagca

SEQ ID NO: 3317565 - RNA, 14 nt, Mycobacterium tuberculosis H37Rv
ugguggugccaacc

SEQ ID NO: 3317566 - RNA, 18 nt, Mycobacterium tuberculosis H37Rv
ugguggugccaaccuggg

SEQ ID NO: 3317567 - RNA, 14 nt, Mycobacterium tuberculosis H37Rv
ugguggugccaacg

SEQ ID NO: 3317568 - RNA, 13 nt, Mycobacterium tuberculosis H37Rv
ugguggugcccgg

SEQ ID NO: 3317569 - RNA, 12 nt, Mycobacterium tuberculosis H37Rv
uggugguggagu

SEQ ID NO: 3317570 - RNA, 19 nt, Mycobacterium tuberculosis H37Rv
ugguguagccgagcacggg

SEQ ID NO: 3317571 - RNA, 13 nt, Mycobacterium tuberculosis H37Rv
ugguguagcuucg

SEQ ID NO: 3317572 - RNA, 14 nt, Mycobacterium tuberculosis H37Rv
ugguguauucgcgg

SEQ ID NO: 3317573 - RNA, 12 nt, Mycobacterium tuberculosis H37Rv
ugguguccacca

SEQ ID NO: 3317574 - RNA, 18 nt, Mycobacterium tuberculosis H37Rv
ugguguccaccaccggca

SEQ ID NO: 3317575 - RNA, 13 nt, Mycobacterium tuberculosis H37Rv
ugguguccaccgc

SEQ ID NO: 3317576 - RNA, 18 nt, Mycobacterium tuberculosis H37Rv
ugguguccucgucgaggu

SEQ ID NO: 3317577 - RNA, 15 nt, Mycobacterium tuberculosis H37Rv
uggugucgcucaguu

SEQ ID NO: 3317578 - RNA, 16 nt, Mycobacterium tuberculosis H37Rv
uggugucguagguugc

SEQ ID NO: 3317579 - RNA, 12 nt, Mycobacterium tuberculosis H37Rv
uggugugcagca

SEQ ID NO: 3317580 - RNA, 14 nt, Mycobacterium tuberculosis H37Rv
uggugugcccgcac

SEQ ID NO: 3317581 - RNA, 17 nt, Mycobacterium tuberculosis H37Rv
uggugugucaccggauu

SEQ ID NO: 3317582 - RNA, 15 nt, Mycobacterium tuberculosis H37Rv
uggugugucggguug

SEQ ID NO: 3317583 - RNA, 14 nt, Mycobacterium tuberculosis H37Rv
ugguguugaugagc

SEQ ID NO: 3317584 - RNA, 23 nt, Mycobacterium tuberculosis H37Rv
ugguguugaugagccgauccagg

SEQ ID NO: 3317585 - RNA, 18 nt, Mycobacterium tuberculosis H37Rv
ugguguugguguagacga

SEQ ID NO: 3317586 - RNA, 16 nt, Mycobacterium tuberculosis H37Rv
ugguguuucaggcagc

SEQ ID NO: 3317587 - RNA, 21 nt, Mycobacterium tuberculosis H37Rv
ugguuagaggauggucagcag

SEQ ID NO: 3317588 - RNA, 16 nt, Mycobacterium tuberculosis H37Rv
ugguuccagaggcccg

SEQ ID NO: 3317589 - RNA, 19 nt, Mycobacterium tuberculosis H37Rv
ugguucccgacgucggccu

SEQ ID NO: 3317590 - RNA, 23 nt, Mycobacterium tuberculosis H37Rv
ugguucgaauuggugcgcaucga

SEQ ID NO: 3317591 - RNA, 22 nt, Mycobacterium tuberculosis H37Rv
ugguucgacucaugccgagcga

SEQ ID NO: 3317592 - RNA, 14 nt, Mycobacterium tuberculosis H37Rv
ugguucgcacaccu

SEQ ID NO: 3317593 - RNA, 19 nt, Mycobacterium tuberculosis H37Rv
ugguucgcacaccuccucg

SEQ ID NO: 3317594 - RNA, 19 nt, Mycobacterium tuberculosis H37Rv
ugguucggcgucgacccag

SEQ ID NO: 3317595 - RNA, 23 nt, Mycobacterium tuberculosis H37Rv
ugguucggcgucgacccagaaca

SEQ ID NO: 3317596 - RNA, 18 nt, Mycobacterium tuberculosis H37Rv
ugguucggguuggagaag

SEQ ID NO: 3317597 - RNA, 22 nt, Mycobacterium tuberculosis H37Rv
ugguugaaccagucgacccagc

SEQ ID NO: 3317598 - RNA, 14 nt, Mycobacterium tuberculosis H37Rv
ugguugaaccggua

SEQ ID NO: 3317599 - RNA, 21 nt, Mycobacterium tuberculosis H37Rv
ugguugacggcgaagucgagu

SEQ ID NO: 3317600 - RNA, 18 nt, Mycobacterium tuberculosis H37Rv
ugguugcgccaggaaccg

SEQ ID NO: 3317601 - RNA, 15 nt, Mycobacterium tuberculosis H37Rv
ugguuggugcuggcc

SEQ ID NO: 3317602 - RNA, 15 nt, Mycobacterium tuberculosis H37Rv
ugguugugucggccu

SEQ ID NO: 3317603 - RNA, 16 nt, Mycobacterium tuberculosis H37Rv
ugguuucgacucgguu

SEQ ID NO: 3317604 - RNA, 21 nt, Mycobacterium tuberculosis H37Rv
ugguuucggccgcauccccgg

SEQ ID NO: 3317605 - RNA, 14 nt, Mycobacterium tuberculosis H37Rv
uguaaacaacgcga

SEQ ID NO: 3317606 - RNA, 21 nt, Mycobacterium tuberculosis H37Rv
uguaacccguuaccgauuggc

SEQ ID NO: 3317607 - RNA, 20 nt, Mycobacterium tuberculosis H37Rv
uguacaccgcgcccgccgau

SEQ ID NO: 3317608 - RNA, 22 nt, Mycobacterium tuberculosis H37Rv
uguacaccgucgcguuggcggu

SEQ ID NO: 3317609 - RNA, 16 nt, Mycobacterium tuberculosis H37Rv
uguacauugccgaccc

SEQ ID NO: 3317610 - RNA, 18 nt, Mycobacterium tuberculosis H37Rv
uguacccgaccagcacca

SEQ ID NO: 3317611 - RNA, 14 nt, Mycobacterium tuberculosis H37Rv
uguacccggcgacg

SEQ ID NO: 3317612 - RNA, 14 nt, Mycobacterium tuberculosis H37Rv
uguacgcccgcucg

SEQ ID NO: 3317613 - RNA, 22 nt, Mycobacterium tuberculosis H37Rv
uguacugcggugccacggugac

SEQ ID NO: 3317614 - RNA, 13 nt, Mycobacterium tuberculosis H37Rv
uguacugcugcuu

SEQ ID NO: 3317615 - RNA, 21 nt, Mycobacterium tuberculosis H37Rv
uguacuggucuggacugcagc

SEQ ID NO: 3317616 - RNA, 16 nt, Mycobacterium tuberculosis H37Rv
uguagaucugggcugg

SEQ ID NO: 3317617 - RNA, 15 nt, Mycobacterium tuberculosis H37Rv
ugucgcgaucgcggc

SEQ ID NO: 3317618 - RNA, 14 nt, Mycobacterium tuberculosis H37Rv
ugucgcgcaccgga

SEQ ID NO: 3317619 - RNA, 17 nt, Mycobacterium tuberculosis H37Rv
ugucgcggucgcccgcu

SEQ ID NO: 3317620 - RNA, 13 nt, Mycobacterium tuberculosis H37Rv
ugucgcggugcgg

SEQ ID NO: 3317621 - RNA, 23 nt, Mycobacterium tuberculosis H37Rv
ugucgcuaugccccggagccaga

SEQ ID NO: 3317622 - RNA, 17 nt, Mycobacterium tuberculosis H37Rv
ugucgcugccgccgccg

SEQ ID NO: 3317623 - RNA, 15 nt, Mycobacterium tuberculosis H37Rv
ugucggccccggccg

SEQ ID NO: 3317624 - RNA, 10 nt, Mycobacterium tuberculosis H37Rv
ugucggcgau

SEQ ID NO: 3317625 - RNA, 13 nt, Mycobacterium tuberculosis H37Rv
ugucgggauuggc

SEQ ID NO: 3317626 - RNA, 14 nt, Mycobacterium tuberculosis H37Rv
ugucgggccaggcg

SEQ ID NO: 3317627 - RNA, 16 nt, Mycobacterium tuberculosis H37Rv
ugucggggauucgucg

SEQ ID NO: 3317628 - RNA, 20 nt, Mycobacterium tuberculosis H37Rv
ugucgggggcuuaugcgucu

SEQ ID NO: 3317629 - RNA, 20 nt, Mycobacterium tuberculosis H37Rv
ugucggggugcacaccgucg

SEQ ID NO: 3317630 - RNA, 20 nt, Mycobacterium tuberculosis H37Rv
ugucgggguuucaggcggca

SEQ ID NO: 3317631 - RNA, 14 nt, Mycobacterium tuberculosis H37Rv
ugucggugccgucg

SEQ ID NO: 3317632 - RNA, 15 nt, Mycobacterium tuberculosis H37Rv
ugucggugccgucga

SEQ ID NO: 3317633 - RNA, 19 nt, Mycobacterium tuberculosis H37Rv
ugucguaccgcggaucgga

SEQ ID NO: 3317634 - RNA, 14 nt, Mycobacterium tuberculosis H37Rv
ugucguccauguaa

SEQ ID NO: 3317635 - RNA, 23 nt, Mycobacterium tuberculosis H37Rv
ugucgucggcggcgaacagcccc

SEQ ID NO: 3317636 - RNA, 17 nt, Mycobacterium tuberculosis H37Rv
ugucuacgccgggaauu

SEQ ID NO: 3317637 - RNA, 19 nt, Mycobacterium tuberculosis H37Rv
ugucuagcugguggugcgg

SEQ ID NO: 3317638 - RNA, 17 nt, Mycobacterium tuberculosis H37Rv
ugucucccuugccgcca

SEQ ID NO: 3317639 - RNA, 21 nt, Mycobacterium tuberculosis H37Rv
ugucucgggcgcgggugacca

SEQ ID NO: 3317640 - RNA, 12 nt, Mycobacterium tuberculosis H37Rv
ugucugcccgag

SEQ ID NO: 3317641 - RNA, 15 nt, Mycobacterium tuberculosis H37Rv
ugucugcucgcgccg

SEQ ID NO: 3317642 - RNA, 19 nt, Mycobacterium tuberculosis H37Rv
ugucuuagccagcagcaca

SEQ ID NO: 3317643 - RNA, 17 nt, Mycobacterium tuberculosis H37Rv
ugugaaagacaacccgc

SEQ ID NO: 3317644 - RNA, 17 nt, Mycobacterium tuberculosis H37Rv
ugugaacuggucgacgu

SEQ ID NO: 3317645 - RNA, 20 nt, Mycobacterium tuberculosis H37Rv
ugugacacaacgaucugcug

SEQ ID NO: 3317646 - RNA, 13 nt, Mycobacterium tuberculosis H37Rv
ugugaccgucagc

SEQ ID NO: 3317647 - RNA, 15 nt, Mycobacterium tuberculosis H37Rv
ugugacgccgggcug

SEQ ID NO: 3317648 - RNA, 17 nt, Mycobacterium tuberculosis H37Rv
ugugacgggcacaacca

SEQ ID NO: 3317649 - RNA, 19 nt, Mycobacterium tuberculosis H37Rv
ugugacgggcacaaccaga

SEQ ID NO: 3317650 - RNA, 21 nt, Mycobacterium tuberculosis H37Rv
ugugacuuauccggccaguga

SEQ ID NO: 3317651 - RNA, 11 nt, Mycobacterium tuberculosis H37Rv
ugugagcagac

SEQ ID NO: 3317652 - RNA, 22 nt, Mycobacterium tuberculosis H37Rv
ugugaguagcccgcgucgacga

SEQ ID NO: 3317653 - RNA, 13 nt, Mycobacterium tuberculosis H37Rv
ugugaguccagcc

SEQ ID NO: 3317654 - RNA, 15 nt, Mycobacterium tuberculosis H37Rv
ugugcaccaucauca

SEQ ID NO: 3317655 - RNA, 22 nt, Mycobacterium tuberculosis H37Rv
ugugcaucgccggcacggugaa

SEQ ID NO: 3317656 - RNA, 21 nt, Mycobacterium tuberculosis H37Rv
ugugccacuucuucacuggcg

SEQ ID NO: 3317657 - RNA, 13 nt, Mycobacterium tuberculosis H37Rv
ugugcccaugaug

SEQ ID NO: 3317658 - RNA, 21 nt, Mycobacterium tuberculosis H37Rv
ugugcccucaacgucccagcc

SEQ ID NO: 3317659 - RNA, 19 nt, Mycobacterium tuberculosis H37Rv
ugugccgauuggccugcca

SEQ ID NO: 3317660 - RNA, 16 nt, Mycobacterium tuberculosis H37Rv
ugugccgcugugaauu

SEQ ID NO: 3317661 - RNA, 19 nt, Mycobacterium tuberculosis H37Rv
ugugccgggcgaugcuggg

SEQ ID NO: 3317662 - RNA, 20 nt, Mycobacterium tuberculosis H37Rv
ugugccgggcgaugcugggc

SEQ ID NO: 3317663 - RNA, 17 nt, Mycobacterium tuberculosis H37Rv
ugugccuacuugcucga

SEQ ID NO: 3317664 - RNA, 23 nt, Mycobacterium tuberculosis H37Rv
ugugcgaccacaucaugccagcc

SEQ ID NO: 3317665 - RNA, 16 nt, Mycobacterium tuberculosis H37Rv
ugugcgagcugcgggu

SEQ ID NO: 3317666 - RNA, 15 nt, Mycobacterium tuberculosis H37Rv
ugugcgauccagggc

SEQ ID NO: 3317667 - RNA, 13 nt, Mycobacterium tuberculosis H37Rv
ugugcggcagccc

SEQ ID NO: 3317668 - RNA, 13 nt, Mycobacterium tuberculosis H37Rv
ugugcggccaggc

SEQ ID NO: 3317669 - RNA, 14 nt, Mycobacterium tuberculosis H37Rv
ugugcggccaggcg

SEQ ID NO: 3317670 - RNA, 13 nt, Mycobacterium tuberculosis H37Rv
ugugcggugaccg

SEQ ID NO: 3317671 - RNA, 15 nt, Mycobacterium tuberculosis H37Rv
ugugcgucuccagcu

SEQ ID NO: 3317672 - RNA, 17 nt, Mycobacterium tuberculosis H37Rv
ugugcgucuccagcugg

SEQ ID NO: 3317673 - RNA, 17 nt, Mycobacterium tuberculosis H37Rv
ugugcgugucacccaau

SEQ ID NO: 3317674 - RNA, 17 nt, Mycobacterium tuberculosis H37Rv
ugugcguuccugaucga

SEQ ID NO: 3317675 - RNA, 15 nt, Mycobacterium tuberculosis H37Rv
ugugcucacgcaucg

SEQ ID NO: 3317676 - RNA, 13 nt, Mycobacterium tuberculosis H37Rv
ugugcucggugac

SEQ ID NO: 3317677 - RNA, 15 nt, Mycobacterium tuberculosis H37Rv
ugugcucggugacgu

SEQ ID NO: 3317678 - RNA, 19 nt, Mycobacterium tuberculosis H37Rv
uguggacggcauagcagcc

SEQ ID NO: 3317679 - RNA, 19 nt, Mycobacterium tuberculosis H37Rv
uguggcccaacaccgccag

SEQ ID NO: 3317680 - RNA, 20 nt, Mycobacterium tuberculosis H37Rv
uguggccguggguuugagcc

SEQ ID NO: 3317681 - RNA, 11 nt, Mycobacterium tuberculosis H37Rv
uguggcgauga

SEQ ID NO: 3317682 - RNA, 15 nt, Mycobacterium tuberculosis H37Rv
uguggcgcuccggcg

SEQ ID NO: 3317683 - RNA, 16 nt, Mycobacterium tuberculosis H37Rv
uguggcugagcagguc

SEQ ID NO: 3317684 - RNA, 20 nt, Mycobacterium tuberculosis H37Rv
ugugggccauguggacggca

SEQ ID NO: 3317685 - RNA, 21 nt, Mycobacterium tuberculosis H37Rv
ugugggccccgccgaugcgau

SEQ ID NO: 3317686 - RNA, 13 nt, Mycobacterium tuberculosis H37Rv
uguggggccgggc

SEQ ID NO: 3317687 - RNA, 13 nt, Mycobacterium tuberculosis H37Rv
uguggggcggcuu

SEQ ID NO: 3317688 - RNA, 21 nt, Mycobacterium tuberculosis H37Rv
ugugggugguugugucggccu

SEQ ID NO: 3317689 - RNA, 14 nt, Mycobacterium tuberculosis H37Rv
uguggucaccaggc

SEQ ID NO: 3317690 - RNA, 15 nt, Mycobacterium tuberculosis H37Rv
uguggucacccgcag

SEQ ID NO: 3317691 - RNA, 19 nt, Mycobacterium tuberculosis H37Rv
uguggucgaguugaagaau

SEQ ID NO: 3317692 - RNA, 16 nt, Mycobacterium tuberculosis H37Rv
uguggucgcugcugcc

SEQ ID NO: 3317693 - RNA, 19 nt, Mycobacterium tuberculosis H37Rv
uguggucggugccagcacc

SEQ ID NO: 3317694 - RNA, 18 nt, Mycobacterium tuberculosis H37Rv
ugugguuggugcuggccu

SEQ ID NO: 3317695 - RNA, 16 nt, Mycobacterium tuberculosis H37Rv
uguguaucaacagauu

SEQ ID NO: 3317696 - RNA, 20 nt, Mycobacterium tuberculosis H37Rv
ugugugcaagccgaacaccg

SEQ ID NO: 3317697 - RNA, 15 nt, Mycobacterium tuberculosis H37Rv
ugugugcggcgguaa

SEQ ID NO: 3317698 - RNA, 22 nt, Mycobacterium tuberculosis H37Rv
uguguuccaacuccugcagccc

SEQ ID NO: 3317699 - RNA, 13 nt, Mycobacterium tuberculosis H37Rv
uguuaaagaagcc

SEQ ID NO: 3317700 - RNA, 19 nt, Mycobacterium tuberculosis H37Rv
uguuagugaggcccgaguu

SEQ ID NO: 3317701 - RNA, 15 nt, Mycobacterium tuberculosis H37Rv
uguuauugaugcccg

SEQ ID NO: 3317702 - RNA, 21 nt, Mycobacterium tuberculosis H37Rv
uguuauuuuuggccaugcucu

SEQ ID NO: 3317703 - RNA, 20 nt, Mycobacterium tuberculosis H37Rv
uguucacccacuccgccgau

SEQ ID NO: 3317704 - RNA, 19 nt, Mycobacterium tuberculosis H37Rv
uguucagcaacaacgucug

SEQ ID NO: 3317705 - RNA, 13 nt, Mycobacterium tuberculosis H37Rv
uguucagcccgcc

SEQ ID NO: 3317706 - RNA, 18 nt, Mycobacterium tuberculosis H37Rv
uguucagcccgccgacga

SEQ ID NO: 3317707 - RNA, 21 nt, Mycobacterium tuberculosis H37Rv
uguuccacaccaggccgagcc

SEQ ID NO: 3317708 - RNA, 19 nt, Mycobacterium tuberculosis H37Rv
uguuccuugugaccccggc

SEQ ID NO: 3317709 - RNA, 15 nt, Mycobacterium tuberculosis H37Rv
uguucgacacccucg

SEQ ID NO: 3317710 - RNA, 15 nt, Mycobacterium tuberculosis H37Rv
uguucgccggagacc

SEQ ID NO: 3317711 - RNA, 15 nt, Mycobacterium tuberculosis H37Rv
uguucgcgcgcgacu

SEQ ID NO: 3317712 - RNA, 18 nt, Mycobacterium tuberculosis H37Rv
uguucggugguccuggcg

SEQ ID NO: 3317713 - RNA, 20 nt, Mycobacterium tuberculosis H37Rv
uguucggugguccuggcgaa

SEQ ID NO: 3317714 - RNA, 20 nt, Mycobacterium tuberculosis H37Rv
uuccaaagggaguguuuggg

SEQ ID NO: 3317715 - RNA, 19 nt, Mycobacterium tuberculosis H37Rv
uuccaacuccugcagcccg

SEQ ID NO: 3317716 - RNA, 19 nt, Mycobacterium tuberculosis H37Rv
uuccacaggggccagcgcg

SEQ ID NO: 3317717 - RNA, 15 nt, Mycobacterium tuberculosis H37Rv
uuccaccguuagcca

SEQ ID NO: 3317718 - RNA, 21 nt, Mycobacterium tuberculosis H37Rv
uuccacgaguccgcggaucac

SEQ ID NO: 3317719 - RNA, 21 nt, Mycobacterium tuberculosis H37Rv
uuccacggguggugccagguc

SEQ ID NO: 3317720 - RNA, 22 nt, Mycobacterium tuberculosis H37Rv
uuccagaguucccgaaacccga

SEQ ID NO: 3317721 - RNA, 21 nt, Mycobacterium tuberculosis H37Rv
uuccagcaucaguuugacgcc

SEQ ID NO: 3317722 - RNA, 14 nt, Mycobacterium tuberculosis H37Rv
uuccagccaggccu

SEQ ID NO: 3317723 - RNA, 16 nt, Mycobacterium tuberculosis H37Rv
uuccagcccgagcaga

SEQ ID NO: 3317724 - RNA, 14 nt, Mycobacterium tuberculosis H37Rv
uuccagccggugcc

SEQ ID NO: 3317725 - RNA, 21 nt, Mycobacterium tuberculosis H37Rv
uuccagcggguggccaucacc

SEQ ID NO: 3317726 - RNA, 20 nt, Mycobacterium tuberculosis H37Rv
uuccagguacacguaccggu

SEQ ID NO: 3317727 - RNA, 16 nt, Mycobacterium tuberculosis H37Rv
uuccauacagccgccg

SEQ ID NO: 3317728 - RNA, 17 nt, Mycobacterium tuberculosis H37Rv
uuccaugcgacuucauc

SEQ ID NO: 3317729 - RNA, 14 nt, Mycobacterium tuberculosis H37Rv
uucccaacacagcc

SEQ ID NO: 3317730 - RNA, 17 nt, Mycobacterium tuberculosis H37Rv
uucccaccaccaccgcc

SEQ ID NO: 3317731 - RNA, 18 nt, Mycobacterium tuberculosis H37Rv
uucccaccaccaccgccg

SEQ ID NO: 3317732 - RNA, 16 nt, Mycobacterium tuberculosis H37Rv
uucccacccacgccga

SEQ ID NO: 3317733 - RNA, 17 nt, Mycobacterium tuberculosis H37Rv
uucccacccacgccgac

SEQ ID NO: 3317734 - RNA, 21 nt, Mycobacterium tuberculosis H37Rv
uucccaggaacgggacgccgu

SEQ ID NO: 3317735 - RNA, 20 nt, Mycobacterium tuberculosis H37Rv
uucccaucccucgguguaca

SEQ ID NO: 3317736 - RNA, 19 nt, Mycobacterium tuberculosis H37Rv
uucccaugcgggucugaca

SEQ ID NO: 3317737 - RNA, 17 nt, Mycobacterium tuberculosis H37Rv
uucccccggcaccgccg

SEQ ID NO: 3317738 - RNA, 18 nt, Mycobacterium tuberculosis H37Rv
uuccccgcccuugccgcc

SEQ ID NO: 3317739 - RNA, 15 nt, Mycobacterium tuberculosis H37Rv
uuccccuguugcccc

SEQ ID NO: 3317740 - RNA, 14 nt, Mycobacterium tuberculosis H37Rv
uucccgaaacccga

SEQ ID NO: 3317741 - RNA, 17 nt, Mycobacterium tuberculosis H37Rv
uucccgccauugccgcc

SEQ ID NO: 3317742 - RNA, 22 nt, Mycobacterium tuberculosis H37Rv
uucccgcggacagcccggacgc

SEQ ID NO: 3317743 - RNA, 15 nt, Mycobacterium tuberculosis H37Rv
uucccgcuugagcag

SEQ ID NO: 3317744 - RNA, 15 nt, Mycobacterium tuberculosis H37Rv
uucccggaagcgccg

SEQ ID NO: 3317745 - RNA, 18 nt, Mycobacterium tuberculosis H37Rv
uucccggccacuccauga

SEQ ID NO: 3317746 - RNA, 12 nt, Mycobacterium tuberculosis H37Rv
uucccggcucga

SEQ ID NO: 3317747 - RNA, 15 nt, Mycobacterium tuberculosis H37Rv
uucccggcucgaugg

SEQ ID NO: 3317748 - RNA, 15 nt, Mycobacterium tuberculosis H37Rv
uucccgguagcggcg

SEQ ID NO: 3317749 - RNA, 13 nt, Mycobacterium tuberculosis H37Rv
uucccggugacca

SEQ ID NO: 3317750 - RNA, 17 nt, Mycobacterium tuberculosis H37Rv
uucccuuguucccgaaa

SEQ ID NO: 3317751 - RNA, 18 nt, Mycobacterium tuberculosis H37Rv
uuccgcaaugaccuggcc

SEQ ID NO: 3317752 - RNA, 17 nt, Mycobacterium tuberculosis H37Rv
uuccgcacccccgucga

SEQ ID NO: 3317753 - RNA, 14 nt, Mycobacterium tuberculosis H37Rv
uuccgcagcgccac

SEQ ID NO: 3317754 - RNA, 13 nt, Mycobacterium tuberculosis H37Rv
uuccgcaucggcc

SEQ ID NO: 3317755 - RNA, 20 nt, Mycobacterium tuberculosis H37Rv
uuccgccgccgccaucgccg

SEQ ID NO: 3317756 - RNA, 21 nt, Mycobacterium tuberculosis H37Rv
uuccgccgccgccaucgccga

SEQ ID NO: 3317757 - RNA, 19 nt, Mycobacterium tuberculosis H37Rv
uuccgccggccccaccggu

SEQ ID NO: 3317758 - RNA, 18 nt, Mycobacterium tuberculosis H37Rv
uuccggauucggacucgc

SEQ ID NO: 3317759 - RNA, 16 nt, Mycobacterium tuberculosis H37Rv
uuccggcggccacgcc

SEQ ID NO: 3317760 - RNA, 23 nt, Mycobacterium tuberculosis H37Rv
uuccgggccggcgagcucgacga

SEQ ID NO: 3317761 - RNA, 22 nt, Mycobacterium tuberculosis H37Rv
uuccggucgacuccagcaccag

SEQ ID NO: 3317762 - RNA, 17 nt, Mycobacterium tuberculosis H37Rv
uuccggugugcucgaua

SEQ ID NO: 3317763 - RNA, 19 nt, Mycobacterium tuberculosis H37Rv
uuccgucugacccaccgcc

SEQ ID NO: 3317764 - RNA, 14 nt, Mycobacterium tuberculosis H37Rv
uuccgugccgacca

SEQ ID NO: 3317765 - RNA, 16 nt, Mycobacterium tuberculosis H37Rv
uuccguggauggacca

SEQ ID NO: 3317766 - RNA, 14 nt, Mycobacterium tuberculosis H37Rv
uuccuccgacgcga

SEQ ID NO: 3317767 - RNA, 14 nt, Mycobacterium tuberculosis H37Rv
uuccuccggcagca

SEQ ID NO: 3317768 - RNA, 17 nt, Mycobacterium tuberculosis H37Rv
uuccucgagccagcucc

SEQ ID NO: 3317769 - RNA, 20 nt, Mycobacterium tuberculosis H37Rv
uuccucguaggcguacacca

SEQ ID NO: 3317770 - RNA, 22 nt, Mycobacterium tuberculosis H37Rv
uuccucugggcuguccuccuga

SEQ ID NO: 3317771 - RNA, 15 nt, Mycobacterium tuberculosis H37Rv
uuccucuucaggccc

SEQ ID NO: 3317772 - RNA, 16 nt, Mycobacterium tuberculosis H37Rv
uuccugaggguuucca

SEQ ID NO: 3317773 - RNA, 17 nt, Mycobacterium tuberculosis H37Rv
uuccuggcgcagcgccu

SEQ ID NO: 3317774 - RNA, 16 nt, Mycobacterium tuberculosis H37Rv
uuccuggguugugccg

SEQ ID NO: 3317775 - RNA, 13 nt, Mycobacterium tuberculosis H37Rv
uucgacccagcgg

SEQ ID NO: 3317776 - RNA, 18 nt, Mycobacterium tuberculosis H37Rv
uucgaccgcgcggaucuc

SEQ ID NO: 3317777 - RNA, 16 nt, Mycobacterium tuberculosis H37Rv
uucgacgacagcaccg

SEQ ID NO: 3317778 - RNA, 23 nt, Mycobacterium tuberculosis H37Rv
uucgacucggccucuagcuugac

SEQ ID NO: 3317779 - RNA, 23 nt, Mycobacterium tuberculosis H37Rv
uucgagcaacugcucgacgaggc

SEQ ID NO: 3317780 - RNA, 20 nt, Mycobacterium tuberculosis H37Rv
uucgagcaccgacaccggcc

SEQ ID NO: 3317781 - RNA, 15 nt, Mycobacterium tuberculosis H37Rv
uucgaggucggcgau

SEQ ID NO: 3317782 - RNA, 13 nt, Mycobacterium tuberculosis H37Rv
uucgaucaggccu

SEQ ID NO: 3317783 - RNA, 17 nt, Mycobacterium tuberculosis H37Rv
uucgaucagucgugggc

SEQ ID NO: 3317784 - RNA, 15 nt, Mycobacterium tuberculosis H37Rv
uucgaugccagugca

SEQ ID NO: 3317785 - RNA, 18 nt, Mycobacterium tuberculosis H37Rv
uucgauugcgcugcaccg

SEQ ID NO: 3317786 - RNA, 17 nt, Mycobacterium tuberculosis H37Rv
uucgcaagucuccucga

SEQ ID NO: 3317787 - RNA, 18 nt, Mycobacterium tuberculosis H37Rv
uucgcacccguucgugag

SEQ ID NO: 3317788 - RNA, 17 nt, Mycobacterium tuberculosis H37Rv
uucgcagccgcaccggg

SEQ ID NO: 3317789 - RNA, 14 nt, Mycobacterium tuberculosis H37Rv
uucgccaacuucaa

SEQ ID NO: 3317790 - RNA, 14 nt, Mycobacterium tuberculosis H37Rv
uucgccacaccaug

SEQ ID NO: 3317791 - RNA, 21 nt, Mycobacterium tuberculosis H37Rv
uucgccaccgcaagaaucagc

SEQ ID NO: 3317792 - RNA, 11 nt, Mycobacterium tuberculosis H37Rv
uucgccagcgc

SEQ ID NO: 3317793 - RNA, 15 nt, Mycobacterium tuberculosis H37Rv
uucgccagguggccg

SEQ ID NO: 3317794 - RNA, 19 nt, Mycobacterium tuberculosis H37Rv
uucgccccgaggaugccga

SEQ ID NO: 3317795 - RNA, 18 nt, Mycobacterium tuberculosis H37Rv
uucgccccugcacagcag

SEQ ID NO: 3317796 - RNA, 22 nt, Mycobacterium tuberculosis H37Rv
uucgccccugcacagcaggcuc

SEQ ID NO: 3317797 - RNA, 17 nt, Mycobacterium tuberculosis H37Rv
uucgcccggggaaccgu

SEQ ID NO: 3317798 - RNA, 14 nt, Mycobacterium tuberculosis H37Rv
uucgcccuugccgc

SEQ ID NO: 3317799 - RNA, 20 nt, Mycobacterium tuberculosis H37Rv
uucgccgacuagcugggguc

SEQ ID NO: 3317800 - RNA, 16 nt, Mycobacterium tuberculosis H37Rv
uucgccgaguugaccg

SEQ ID NO: 3317801 - RNA, 17 nt, Mycobacterium tuberculosis H37Rv
uucgccgccaccggcga

SEQ ID NO: 3317802 - RNA, 23 nt, Mycobacterium tuberculosis H37Rv
uucgccgccaccggcgacgccgg

SEQ ID NO: 3317803 - RNA, 21 nt, Mycobacterium tuberculosis H37Rv
uucgccgcgaaugucgccgcc

SEQ ID NO: 3317804 - RNA, 19 nt, Mycobacterium tuberculosis H37Rv
uucgccggaacgcacgccc

SEQ ID NO: 3317805 - RNA, 16 nt, Mycobacterium tuberculosis H37Rv
uucgccggaauacacc

SEQ ID NO: 3317806 - RNA, 18 nt, Mycobacterium tuberculosis H37Rv
uucgccgggcaacgcgaa

SEQ ID NO: 3317807 - RNA, 19 nt, Mycobacterium tuberculosis H37Rv
uucgcgacgucugccaggc

SEQ ID NO: 3317808 - RNA, 18 nt, Mycobacterium tuberculosis H37Rv
uucgcgagcagacgcgga

SEQ ID NO: 3317809 - RNA, 23 nt, Mycobacterium tuberculosis H37Rv
uucgcgagucaccaaaggcgucu

SEQ ID NO: 3317810 - RNA, 19 nt, Mycobacterium tuberculosis H37Rv
uugacgccguugccgccgu

SEQ ID NO: 3317811 - RNA, 15 nt, Mycobacterium tuberculosis H37Rv
uugacguccagggcc

SEQ ID NO: 3317812 - RNA, 18 nt, Mycobacterium tuberculosis H37Rv
uugacucugcguccaccg

SEQ ID NO: 3317813 - RNA, 19 nt, Mycobacterium tuberculosis H37Rv
uugacugaacucaacacca

SEQ ID NO: 3317814 - RNA, 15 nt, Mycobacterium tuberculosis H37Rv
uugacugcugggggu

SEQ ID NO: 3317815 - RNA, 22 nt, Mycobacterium tuberculosis H37Rv
uugagccgggcaaccagcagca

SEQ ID NO: 3317816 - RNA, 16 nt, Mycobacterium tuberculosis H37Rv
uugagcgcggccacca

SEQ ID NO: 3317817 - RNA, 17 nt, Mycobacterium tuberculosis H37Rv
uugagcucagguucagc

SEQ ID NO: 3317818 - RNA, 13 nt, Mycobacterium tuberculosis H37Rv
uugaggaagcccg

SEQ ID NO: 3317819 - RNA, 14 nt, Mycobacterium tuberculosis H37Rv
uugaggccggugaa

SEQ ID NO: 3317820 - RNA, 21 nt, Mycobacterium tuberculosis H37Rv
uugaucgcccgguucagcgcu

SEQ ID NO: 3317821 - RNA, 16 nt, Mycobacterium tuberculosis H37Rv
uugaucgccggccugc

SEQ ID NO: 3317822 - RNA, 12 nt, Mycobacterium tuberculosis H37Rv
uugaucggcgag

SEQ ID NO: 3317823 - RNA, 16 nt, Mycobacterium tuberculosis H37Rv
uugaucuccaccuucu

SEQ ID NO: 3317824 - RNA, 22 nt, Mycobacterium tuberculosis H37Rv
uugaucuccaccuucuggucca

SEQ ID NO: 3317825 - RNA, 15 nt, Mycobacterium tuberculosis H37Rv
uugaucugcccuguu

SEQ ID NO: 3317826 - RNA, 22 nt, Mycobacterium tuberculosis H37Rv
uugaugaagauggcgcgcagcu

SEQ ID NO: 3317827 - RNA, 22 nt, Mycobacterium tuberculosis H37Rv
uugaugcauccagaaguaggcg

SEQ ID NO: 3317828 - RNA, 16 nt, Mycobacterium tuberculosis H37Rv
uugaugcgugguuggc

SEQ ID NO: 3317829 - RNA, 15 nt, Mycobacterium tuberculosis H37Rv
uugaugcuucgaacc

SEQ ID NO: 3317830 - RNA, 12 nt, Mycobacterium tuberculosis H37Rv
uugauugaccaa

SEQ ID NO: 3317831 - RNA, 17 nt, Mycobacterium tuberculosis H37Rv
uugcacuguggaagaac

SEQ ID NO: 3317832 - RNA, 11 nt, Mycobacterium tuberculosis H37Rv
uugcagcagca

SEQ ID NO: 3317833 - RNA, 23 nt, Mycobacterium tuberculosis H37Rv
uugcagccggcauagcggcccau

SEQ ID NO: 3317834 - RNA, 21 nt, Mycobacterium tuberculosis H37Rv
uugcagcgggccacugagcca

SEQ ID NO: 3317835 - RNA, 16 nt, Mycobacterium tuberculosis H37Rv
uugcaggcgcagcugg

SEQ ID NO: 3317836 - RNA, 19 nt, Mycobacterium tuberculosis H37Rv
uugcaguggcgacgagcaa

SEQ ID NO: 3317837 - RNA, 13 nt, Mycobacterium tuberculosis H37Rv
uugcaucaugccg

SEQ ID NO: 3317838 - RNA, 20 nt, Mycobacterium tuberculosis H37Rv
uugccaacgaaccgcucagc

SEQ ID NO: 3317839 - RNA, 19 nt, Mycobacterium tuberculosis H37Rv
uugccaccgagaucaugcc

SEQ ID NO: 3317840 - RNA, 18 nt, Mycobacterium tuberculosis H37Rv
uugccaccgguaccgccg

SEQ ID NO: 3317841 - RNA, 19 nt, Mycobacterium tuberculosis H37Rv
uugccacggcccgguuggg

SEQ ID NO: 3317842 - RNA, 23 nt, Mycobacterium tuberculosis H37Rv
uugccaggugcuguuugguugcg

SEQ ID NO: 3317843 - RNA, 19 nt, Mycobacterium tuberculosis H37Rv
uugccaucaaggccaccuc

SEQ ID NO: 3317844 - RNA, 19 nt, Mycobacterium tuberculosis H37Rv
uugcccaagcgcguuguug

SEQ ID NO: 3317845 - RNA, 22 nt, Mycobacterium tuberculosis H37Rv
uugcccacggcgaccacgccgc

SEQ ID NO: 3317846 - RNA, 21 nt, Mycobacterium tuberculosis H37Rv
uugcccagcaugaagucccgg

SEQ ID NO: 3317847 - RNA, 12 nt, Mycobacterium tuberculosis H37Rv
uugcccagguga

SEQ ID NO: 3317848 - RNA, 13 nt, Mycobacterium tuberculosis H37Rv
uugccccgccuug

SEQ ID NO: 3317849 - RNA, 16 nt, Mycobacterium tuberculosis H37Rv
uugccccgccuuggcc

SEQ ID NO: 3317850 - RNA, 18 nt, Mycobacterium tuberculosis H37Rv
uugcccgacggcgucuuc

SEQ ID NO: 3317851 - RNA, 23 nt, Mycobacterium tuberculosis H37Rv
uugcccgguuguggaaccacggc

SEQ ID NO: 3317852 - RNA, 21 nt, Mycobacterium tuberculosis H37Rv
uugcccguguuaaagaagccu

SEQ ID NO: 3317853 - RNA, 23 nt, Mycobacterium tuberculosis H37Rv
uugcccguguuaaagaagccuga

SEQ ID NO: 3317854 - RNA, 12 nt, Mycobacterium tuberculosis H37Rv
uugcccugcaac

SEQ ID NO: 3317855 - RNA, 13 nt, Mycobacterium tuberculosis H37Rv
uugccgaagcccg

SEQ ID NO: 3317856 - RNA, 22 nt, Mycobacterium tuberculosis H37Rv
uugccgacgcuaaguccccgcu

SEQ ID NO: 3317857 - RNA, 17 nt, Mycobacterium tuberculosis H37Rv
uugccgagcccaggugg

SEQ ID NO: 3317858 - RNA, 22 nt, Mycobacterium tuberculosis H37Rv
uugccgaucaaccccccgggcc

SEQ ID NO: 3317859 - RNA, 21 nt, Mycobacterium tuberculosis H37Rv
uugccgcaccagucgcgcagc

SEQ ID NO: 3317860 - RNA, 15 nt, Mycobacterium tuberculosis H37Rv
uugccgccagcccca

SEQ ID NO: 3317861 - RNA, 17 nt, Mycobacterium tuberculosis H37Rv
uugccgccaucaccgcc

SEQ ID NO: 3317862 - RNA, 18 nt, Mycobacterium tuberculosis H37Rv
uugccgccaucaccgccg

SEQ ID NO: 3317863 - RNA, 11 nt, Mycobacterium tuberculosis H37Rv
uugccgcccac

SEQ ID NO: 3317864 - RNA, 23 nt, Mycobacterium tuberculosis H37Rv
uugccgccgccuccgccgaggcc

SEQ ID NO: 3317865 - RNA, 10 nt, Mycobacterium tuberculosis H37Rv
uugccgccgg

SEQ ID NO: 3317866 - RNA, 19 nt, Mycobacterium tuberculosis H37Rv
uugccgccggccaugugca

SEQ ID NO: 3317867 - RNA, 19 nt, Mycobacterium tuberculosis H37Rv
uugccgccggucaucccaa

SEQ ID NO: 3317868 - RNA, 18 nt, Mycobacterium tuberculosis H37Rv
uugccgccgucaccgccg

SEQ ID NO: 3317869 - RNA, 23 nt, Mycobacterium tuberculosis H37Rv
uugccgccgucaccgccguugcc

SEQ ID NO: 3317870 - RNA, 20 nt, Mycobacterium tuberculosis H37Rv
uugccgccgucgccgccgcu

SEQ ID NO: 3317871 - RNA, 23 nt, Mycobacterium tuberculosis H37Rv
uugccgccgucgccgccguugcc

SEQ ID NO: 3317872 - RNA, 23 nt, Mycobacterium tuberculosis H37Rv
uugccgccguugccaccguagcc

SEQ ID NO: 3317873 - RNA, 15 nt, Mycobacterium tuberculosis H37Rv
uugccgccuuggccc

SEQ ID NO: 3317874 - RNA, 17 nt, Mycobacterium tuberculosis H37Rv
uugccggagacgucgcc

SEQ ID NO: 3317875 - RNA, 13 nt, Mycobacterium tuberculosis H37Rv
uugccggccagga

SEQ ID NO: 3317876 - RNA, 16 nt, Mycobacterium tuberculosis H37Rv
uugccggcccaccgcc

SEQ ID NO: 3317877 - RNA, 14 nt, Mycobacterium tuberculosis H37Rv
uugccggcgccuug

SEQ ID NO: 3317878 - RNA, 20 nt, Mycobacterium tuberculosis H37Rv
uugccggcggcgacgucugc

SEQ ID NO: 3317879 - RNA, 17 nt, Mycobacterium tuberculosis H37Rv
uugccggcguugccgcc

SEQ ID NO: 3317880 - RNA, 20 nt, Mycobacterium tuberculosis H37Rv
uugccgucgugaucggcgaa

SEQ ID NO: 3317881 - RNA, 20 nt, Mycobacterium tuberculosis H37Rv
uugccguuaccgccaaacgc

SEQ ID NO: 3317882 - RNA, 17 nt, Mycobacterium tuberculosis H37Rv
uugccucccuuuuccaa

SEQ ID NO: 3317883 - RNA, 17 nt, Mycobacterium tuberculosis H37Rv
uugccucggcgagguca

SEQ ID NO: 3317884 - RNA, 17 nt, Mycobacterium tuberculosis H37Rv
uugccuuguuccagcgc

SEQ ID NO: 3317885 - RNA, 19 nt, Mycobacterium tuberculosis H37Rv
uugcgaaacgaauccgcca

SEQ ID NO: 3317886 - RNA, 12 nt, Mycobacterium tuberculosis H37Rv
uugcgaagccca

SEQ ID NO: 3317887 - RNA, 13 nt, Mycobacterium tuberculosis H37Rv
uugcgaagcccac

SEQ ID NO: 3317888 - RNA, 19 nt, Mycobacterium tuberculosis H37Rv
uugcgagugagcucagcaa

SEQ ID NO: 3317889 - RNA, 20 nt, Mycobacterium tuberculosis H37Rv
uugcgaucggcacuuagccc

SEQ ID NO: 3317890 - RNA, 16 nt, Mycobacterium tuberculosis H37Rv
uugcgcaaccggugga

SEQ ID NO: 3317891 - RNA, 14 nt, Mycobacterium tuberculosis H37Rv
uugcgcagcaccag

SEQ ID NO: 3317892 - RNA, 13 nt, Mycobacterium tuberculosis H37Rv
uugcgcagccgca

SEQ ID NO: 3317893 - RNA, 23 nt, Mycobacterium tuberculosis H37Rv
uugcgcaggauguucaaucccuc

SEQ ID NO: 3317894 - RNA, 12 nt, Mycobacterium tuberculosis H37Rv
uugcgccagcgg

SEQ ID NO: 3317895 - RNA, 18 nt, Mycobacterium tuberculosis H37Rv
uugcgccgacaccgggcc

SEQ ID NO: 3317896 - RNA, 23 nt, Mycobacterium tuberculosis H37Rv
uugcgcgcgcagaucguccaccg

SEQ ID NO: 3317897 - RNA, 21 nt, Mycobacterium tuberculosis H37Rv
uugcgcuacuacugcaguccc

SEQ ID NO: 3317898 - RNA, 11 nt, Mycobacterium tuberculosis H37Rv
uugcggaucga

SEQ ID NO: 3317899 - RNA, 11 nt, Mycobacterium tuberculosis H37Rv
uugcggcccgg

SEQ ID NO: 3317900 - RNA, 18 nt, Mycobacterium tuberculosis H37Rv
uugcggccgaauuccuca

SEQ ID NO: 3317901 - RNA, 21 nt, Mycobacterium tuberculosis H37Rv
uugcggcuggcgccccaggug

SEQ ID NO: 3317902 - RNA, 18 nt, Mycobacterium tuberculosis H37Rv
uugcggggugcucagcga

SEQ ID NO: 3317903 - RNA, 23 nt, Mycobacterium tuberculosis H37Rv
uugcguccauccgcagcagguga

SEQ ID NO: 3317904 - RNA, 17 nt, Mycobacterium tuberculosis H37Rv
uugcuagguucgcgacg

SEQ ID NO: 3317905 - RNA, 16 nt, Mycobacterium tuberculosis H37Rv
uugcuccacaucggcu

SEQ ID NO: 3317906 - RNA, 18 nt, Mycobacterium tuberculosis H37Rv
uugugcgcacucuuuccu

SEQ ID NO: 3317907 - RNA, 14 nt, Mycobacterium tuberculosis H37Rv
uugugcugggugcc

SEQ ID NO: 3317908 - RNA, 14 nt, Mycobacterium tuberculosis H37Rv
uuguggccagcgcu

SEQ ID NO: 3317909 - RNA, 22 nt, Mycobacterium tuberculosis H37Rv
uuguggccgccuucgccgccgc

SEQ ID NO: 3317910 - RNA, 16 nt, Mycobacterium tuberculosis H37Rv
uuguuaucgaagcccg

SEQ ID NO: 3317911 - RNA, 22 nt, Mycobacterium tuberculosis H37Rv
uuguucccgaguuggucguggc

SEQ ID NO: 3317912 - RNA, 13 nt, Mycobacterium tuberculosis H37Rv
uuguucuuggcca

SEQ ID NO: 3317913 - RNA, 13 nt, Mycobacterium tuberculosis H37Rv
uuguugaagcccg

SEQ ID NO: 3317914 - RNA, 18 nt, Mycobacterium tuberculosis H37Rv
uuguuggauccggccacc

SEQ ID NO: 3317915 - RNA, 12 nt, Mycobacterium tuberculosis H37Rv
uuuaggcagccc

SEQ ID NO: 3317916 - RNA, 23 nt, Mycobacterium tuberculosis H37Rv
uuuagggugcccgcguugccaaa

SEQ ID NO: 3317917 - RNA, 20 nt, Mycobacterium tuberculosis H37Rv
uuuccaccguuagccagguc

SEQ ID NO: 3317918 - RNA, 12 nt, Mycobacterium tuberculosis H37Rv
uuuccagccgac

SEQ ID NO: 3317919 - RNA, 15 nt, Mycobacterium tuberculosis H37Rv
uuuccaucgcgaccu

SEQ ID NO: 3317920 - RNA, 16 nt, Mycobacterium tuberculosis H37Rv
uuuccccgcccuugcc

SEQ ID NO: 3317921 - RNA, 16 nt, Mycobacterium tuberculosis H37Rv
uuuccgccgccgccau

SEQ ID NO: 3317922 - RNA, 15 nt, Mycobacterium tuberculosis H37Rv
uuuccgugccgacca

SEQ ID NO: 3317923 - RNA, 14 nt, Mycobacterium tuberculosis H37Rv
uuuccuugcgcgcc

SEQ ID NO: 3317924 - RNA, 16 nt, Mycobacterium tuberculosis H37Rv
uuuccuugcgcgccau

SEQ ID NO: 3317925 - RNA, 16 nt, Mycobacterium tuberculosis H37Rv
uuucgauauagccgcc

SEQ ID NO: 3317926 - RNA, 18 nt, Mycobacterium tuberculosis H37Rv
uuucgauauagccgccgg

SEQ ID NO: 3317927 - RNA, 20 nt, Mycobacterium tuberculosis H37Rv
uuucgauauagccgccggug

SEQ ID NO: 3317928 - RNA, 20 nt, Mycobacterium tuberculosis H37Rv
uuucgccagcugacacccgc

SEQ ID NO: 3317929 - RNA, 17 nt, Mycobacterium tuberculosis H37Rv
uuucgccgugaugaugu

SEQ ID NO: 3317930 - RNA, 21 nt, Mycobacterium tuberculosis H37Rv
uuucgcgacgucugccaggcg

SEQ ID NO: 3317931 - RNA, 12 nt, Mycobacterium tuberculosis H37Rv
uuucggcugccg

SEQ ID NO: 3317932 - RNA, 15 nt, Mycobacterium tuberculosis H37Rv
uuucgucgucgcagu

SEQ ID NO: 3317933 - RNA, 16 nt, Mycobacterium tuberculosis H37Rv
uuugaccaccugguuu

SEQ ID NO: 3317934 - RNA, 20 nt, Mycobacterium tuberculosis H37Rv
uuugacguccagggccacga

SEQ ID NO: 3317935 - RNA, 13 nt, Mycobacterium tuberculosis H37Rv
uuugagaacaacg

SEQ ID NO: 3317936 - RNA, 14 nt, Mycobacterium tuberculosis H37Rv
uuugagcgcacuca

SEQ ID NO: 3317937 - RNA, 13 nt, Mycobacterium tuberculosis H37Rv
uuugagcggccac

SEQ ID NO: 3317938 - RNA, 16 nt, Mycobacterium tuberculosis H37Rv
uuugauuccaggucau

SEQ ID NO: 3317939 - RNA, 21 nt, Mycobacterium tuberculosis H37Rv
uuugcacgcaccacaauccac

SEQ ID NO: 3317940 - RNA, 18 nt, Mycobacterium tuberculosis H37Rv
uuugcagccuucgacgca

SEQ ID NO: 3317941 - RNA, 20 nt, Mycobacterium tuberculosis H37Rv
uuugcaggcccgaguuguug

SEQ ID NO: 3317942 - RNA, 11 nt, Mycobacterium tuberculosis H37Rv
uuugccgccgg

SEQ ID NO: 3317943 - RNA, 22 nt, Mycobacterium tuberculosis H37Rv
uuugccggaggaucgcugguug

SEQ ID NO: 3317944 - RNA, 20 nt, Mycobacterium tuberculosis H37Rv
uuugcgaaucggcccgugcc

SEQ ID NO: 3317945 - RNA, 21 nt, Mycobacterium tuberculosis H37Rv
uuugcgaugcccacggugccg

SEQ ID NO: 3317946 - RNA, 16 nt, Mycobacterium tuberculosis H37Rv
uuugcguacaacgccg

SEQ ID NO: 3317947 - RNA, 19 nt, Mycobacterium tuberculosis H37Rv
uuugcgucugcucgccagg

SEQ ID NO: 3317948 - RNA, 22 nt, Mycobacterium tuberculosis H37Rv
uuugcgucugcucgcgccggug

SEQ ID NO: 3317949 - RNA, 15 nt, Mycobacterium tuberculosis H37Rv
uuuggccgccguggc

SEQ ID NO: 3317950 - RNA, 14 nt, Mycobacterium tuberculosis H37Rv
uuuggcgccgccga

SEQ ID NO: 3317951 - RNA, 14 nt, Mycobacterium tuberculosis H37Rv
uuugggcgccggug

SEQ ID NO: 3317952 - RNA, 17 nt, Mycobacterium tuberculosis H37Rv
uuuggguucgucgacac

SEQ ID NO: 3317953 - RNA, 13 nt, Mycobacterium tuberculosis H37Rv
uuuggguuuuguu

SEQ ID NO: 3317954 - RNA, 22 nt, Mycobacterium tuberculosis H37Rv
uuugguugcccgcauugccaac

SEQ ID NO: 3317955 - RNA, 14 nt, Mycobacterium tuberculosis H37Rv
uuugucgccuucuu

SEQ ID NO: 3317956 - RNA, 13 nt, Mycobacterium tuberculosis H37Rv
uuugugucugcuc

SEQ ID NO: 3317957 - RNA, 15 nt, Mycobacterium tuberculosis H37Rv
uuuuacgucugcucg

SEQ ID NO: 3317958 - RNA, 21 nt, Mycobacterium tuberculosis H37Rv
uuuuccgcguguacggcggcu

SEQ ID NO: 3317959 - RNA, 15 nt, Mycobacterium tuberculosis H37Rv
uuuucggcggcucua

SEQ ID NO: 3317960 - RNA, 20 nt, Mycobacterium tuberculosis H37Rv
uuuugcgucugcucggcgca

SEQ ID NO: 3317961 - RNA, 21 nt, Mycobacterium tuberculosis H37Rv
uuuugggaucgugccggcgaa

SEQ ID NO: 3317962 - RNA, 21 nt, Mycobacterium tuberculosis H37Rv
aucaaggugaucagcaggauc

SEQ ID NO: 3317963 - RNA, 17 nt, Mycobacterium tuberculosis H37Rv
aucaagugcgguccggc

SEQ ID NO: 3317964 - RNA, 15 nt, Mycobacterium tuberculosis H37Rv
aucaauggcagcuga

SEQ ID NO: 3317965 - RNA, 15 nt, Mycobacterium tuberculosis H37Rv
aucaauugcccggca

SEQ ID NO: 3317966 - RNA, 20 nt, Mycobacterium tuberculosis H37Rv
aucacaccgagcgcaaucga

SEQ ID NO: 3317967 - RNA, 12 nt, Mycobacterium tuberculosis H37Rv
aucacaccgcug

SEQ ID NO: 3317968 - RNA, 16 nt, Mycobacterium tuberculosis H37Rv
aucacauagccgguca

SEQ ID NO: 3317969 - RNA, 13 nt, Mycobacterium tuberculosis H37Rv
aucacauccacgc

SEQ ID NO: 3317970 - RNA, 13 nt, Mycobacterium tuberculosis H37Rv
aucacaucgcccg

SEQ ID NO: 3317971 - RNA, 17 nt, Mycobacterium tuberculosis H37Rv
aucaccacuggacccgc

SEQ ID NO: 3317972 - RNA, 19 nt, Mycobacterium tuberculosis H37Rv
aucaccacuggacccgccc

SEQ ID NO: 3317973 - RNA, 20 nt, Mycobacterium tuberculosis H37Rv
aucaccaggguguauggcca

SEQ ID NO: 3317974 - RNA, 15 nt, Mycobacterium tuberculosis H37Rv
aucaccauaggcaag

SEQ ID NO: 3317975 - RNA, 23 nt, Mycobacterium tuberculosis H37Rv
aucaccaugugggugaucgcggu

SEQ ID NO: 3317976 - RNA, 13 nt, Mycobacterium tuberculosis H37Rv
aucacccagcgcc

SEQ ID NO: 3317977 - RNA, 14 nt, Mycobacterium tuberculosis H37Rv
aucacccccuggac

SEQ ID NO: 3317978 - RNA, 12 nt, Mycobacterium tuberculosis H37Rv
aucaccccgcca

SEQ ID NO: 3317979 - RNA, 14 nt, Mycobacterium tuberculosis H37Rv
aucaccgacaccgu

SEQ ID NO: 3317980 - RNA, 20 nt, Mycobacterium tuberculosis H37Rv
aucaccgagucgacggccag

SEQ ID NO: 3317981 - RNA, 16 nt, Mycobacterium tuberculosis H37Rv
aucaccgaugagccga

SEQ ID NO: 3317982 - RNA, 23 nt, Mycobacterium tuberculosis H37Rv
aucaccgccagcugggcagccag

SEQ ID NO: 3317983 - RNA, 20 nt, Mycobacterium tuberculosis H37Rv
aucaccgccgcggccgccgu

SEQ ID NO: 3317984 - RNA, 17 nt, Mycobacterium tuberculosis H37Rv
aucaccgccguuaccgc

SEQ ID NO: 3317985 - RNA, 13 nt, Mycobacterium tuberculosis H37Rv
aucaccgcggcgg

SEQ ID NO: 3317986 - RNA, 20 nt, Mycobacterium tuberculosis H37Rv
aucaccggcaauuacccgac

SEQ ID NO: 3317987 - RNA, 13 nt, Mycobacterium tuberculosis H37Rv
aucaccggcugcu

SEQ ID NO: 3317988 - RNA, 15 nt, Mycobacterium tuberculosis H37Rv
aucaccgucagggga

SEQ ID NO: 3317989 - RNA, 22 nt, Mycobacterium tuberculosis H37Rv
aucaccucgaugccgcccguga

SEQ ID NO: 3317990 - RNA, 21 nt, Mycobacterium tuberculosis H37Rv
aucaccuggcgugucgccgcc

SEQ ID NO: 3317991 - RNA, 19 nt, Mycobacterium tuberculosis H37Rv
aucaccuugccuagccgca

SEQ ID NO: 3317992 - RNA, 13 nt, Mycobacterium tuberculosis H37Rv
aucacgaccgcgc

SEQ ID NO: 3317993 - RNA, 19 nt, Mycobacterium tuberculosis H37Rv
aucacgauguccucgaugc

SEQ ID NO: 3317994 - RNA, 16 nt, Mycobacterium tuberculosis H37Rv
aucacgcacucgcguc

SEQ ID NO: 3317995 - RNA, 14 nt, Mycobacterium tuberculosis H37Rv
aucacgccgggcga

SEQ ID NO: 3317996 - RNA, 15 nt, Mycobacterium tuberculosis H37Rv
aucacgcgaaugacg

SEQ ID NO: 3317997 - RNA, 17 nt, Mycobacterium tuberculosis H37Rv
aucacggcaccgaagug

SEQ ID NO: 3317998 - RNA, 14 nt, Mycobacterium tuberculosis H37Rv
aucacggccgucga

SEQ ID NO: 3317999 - RNA, 15 nt, Mycobacterium tuberculosis H37Rv
aucacggcggggauc

SEQ ID NO: 3318000 - RNA, 14 nt, Mycobacterium tuberculosis H37Rv
aucacggucagcuc

SEQ ID NO: 3318001 - RNA, 17 nt, Mycobacterium tuberculosis H37Rv
aucacguggaccacggc

SEQ ID NO: 3318002 - RNA, 17 nt, Mycobacterium tuberculosis H37Rv
aucacguugcgcuggau

SEQ ID NO: 3318003 - RNA, 22 nt, Mycobacterium tuberculosis H37Rv
aucacucccccacacacccgac

SEQ ID NO: 3318004 - RNA, 22 nt, Mycobacterium tuberculosis H37Rv
aucacugaggcugcggguggga

SEQ ID NO: 3318005 - RNA, 13 nt, Mycobacterium tuberculosis H37Rv
aucagaucgccga

SEQ ID NO: 3318006 - RNA, 21 nt, Mycobacterium tuberculosis H37Rv
aucagcaagagccgcagccac

SEQ ID NO: 3318007 - RNA, 14 nt, Mycobacterium tuberculosis H37Rv
aucagcaccgacag

SEQ ID NO: 3318008 - RNA, 17 nt, Mycobacterium tuberculosis H37Rv
aucagcaccgacagccc

SEQ ID NO: 3318009 - RNA, 22 nt, Mycobacterium tuberculosis H37Rv
aucagcaccgugacagcggcau

SEQ ID NO: 3318010 - RNA, 16 nt, Mycobacterium tuberculosis H37Rv
aucagcagcagcguga

SEQ ID NO: 3318011 - RNA, 15 nt, Mycobacterium tuberculosis H37Rv
aucagcagccgccga

SEQ ID NO: 3318012 - RNA, 22 nt, Mycobacterium tuberculosis H37Rv
aucagcccgacaccguccagca

SEQ ID NO: 3318013 - RNA, 13 nt, Mycobacterium tuberculosis H37Rv
aucagcccgccca

SEQ ID NO: 3318014 - RNA, 16 nt, Mycobacterium tuberculosis H37Rv
aucagcccgcgcagca

SEQ ID NO: 3318015 - RNA, 22 nt, Mycobacterium tuberculosis H37Rv
aucagcccggccuugccgccgg

SEQ ID NO: 3318016 - RNA, 22 nt, Mycobacterium tuberculosis H37Rv
aucagcccuucagcgaagccgg

SEQ ID NO: 3318017 - RNA, 15 nt, Mycobacterium tuberculosis H37Rv
aucagccgcugcgua

SEQ ID NO: 3318018 - RNA, 12 nt, Mycobacterium tuberculosis H37Rv
aucagccgugcg

SEQ ID NO: 3318019 - RNA, 15 nt, Mycobacterium tuberculosis H37Rv
aucagcgaaccaccg

SEQ ID NO: 3318020 - RNA, 15 nt, Mycobacterium tuberculosis H37Rv
aucagcgacuugcug

SEQ ID NO: 3318021 - RNA, 16 nt, Mycobacterium tuberculosis H37Rv
aucagcgccagcgagc

SEQ ID NO: 3318022 - RNA, 17 nt, Mycobacterium tuberculosis H37Rv
aucagcggauccagaaa

SEQ ID NO: 3318023 - RNA, 19 nt, Mycobacterium tuberculosis H37Rv
aucagcggcagcaccgcac

SEQ ID NO: 3318024 - RNA, 22 nt, Mycobacterium tuberculosis H37Rv
aucagcggcaguuccugacgcc

SEQ ID NO: 3318025 - RNA, 21 nt, Mycobacterium tuberculosis H37Rv
aucagcgugucgccgauaucg

SEQ ID NO: 3318026 - RNA, 13 nt, Mycobacterium tuberculosis H37Rv
aucagcucgaugc

SEQ ID NO: 3318027 - RNA, 21 nt, Mycobacterium tuberculosis H37Rv
aucagcugcgcaucgccacca

SEQ ID NO: 3318028 - RNA, 22 nt, Mycobacterium tuberculosis H37Rv
aucaggccuugggauaggccgu

SEQ ID NO: 3318029 - RNA, 21 nt, Mycobacterium tuberculosis H37Rv
aucaggcugggcagaccgauc

SEQ ID NO: 3318030 - RNA, 16 nt, Mycobacterium tuberculosis H37Rv
aucagggugucgaaga

SEQ ID NO: 3318031 - RNA, 18 nt, Mycobacterium tuberculosis H37Rv
aucagguacgccaggugc

SEQ ID NO: 3318032 - RNA, 21 nt, Mycobacterium tuberculosis H37Rv
aucaggucgccgagaccggcc

SEQ ID NO: 3318033 - RNA, 15 nt, Mycobacterium tuberculosis H37Rv
aucaggucgucacgc

SEQ ID NO: 3318034 - RNA, 21 nt, Mycobacterium tuberculosis H37Rv
aucaggucuucgauggccaug

SEQ ID NO: 3318035 - RNA, 20 nt, Mycobacterium tuberculosis H37Rv
aucaguccggcguucccgcc

SEQ ID NO: 3318036 - RNA, 15 nt, Mycobacterium tuberculosis H37Rv
aucagugaagacacc

SEQ ID NO: 3318037 - RNA, 14 nt, Mycobacterium tuberculosis H37Rv
auccgacgaccgca

SEQ ID NO: 3318038 - RNA, 15 nt, Mycobacterium tuberculosis H37Rv
auccgacgaccgcau

SEQ ID NO: 3318039 - RNA, 15 nt, Mycobacterium tuberculosis H37Rv
auccgacgucgacga

SEQ ID NO: 3318040 - RNA, 19 nt, Mycobacterium tuberculosis H37Rv
auccgacgucggugaccuc

SEQ ID NO: 3318041 - RNA, 14 nt, Mycobacterium tuberculosis H37Rv
auccgagcgguggu

SEQ ID NO: 3318042 - RNA, 16 nt, Mycobacterium tuberculosis H37Rv
auccgagugaucgggu

SEQ ID NO: 3318043 - RNA, 19 nt, Mycobacterium tuberculosis H37Rv
auccgcaccacgcccgacg

SEQ ID NO: 3318044 - RNA, 23 nt, Mycobacterium tuberculosis H37Rv
auccgcaccccauacucggcggc

SEQ ID NO: 3318045 - RNA, 15 nt, Mycobacterium tuberculosis H37Rv
auccgcaggcccgcc

SEQ ID NO: 3318046 - RNA, 18 nt, Mycobacterium tuberculosis H37Rv
auccgcagugagcaaugc

SEQ ID NO: 3318047 - RNA, 18 nt, Mycobacterium tuberculosis H37Rv
auccgccccagcugcggu

SEQ ID NO: 3318048 - RNA, 15 nt, Mycobacterium tuberculosis H37Rv
auccgccccgcccgc

SEQ ID NO: 3318049 - RNA, 19 nt, Mycobacterium tuberculosis H37Rv
auccgcccuaaugaagccg

SEQ ID NO: 3318050 - RNA, 13 nt, Mycobacterium tuberculosis H37Rv
auccgcccuugcc

SEQ ID NO: 3318051 - RNA, 20 nt, Mycobacterium tuberculosis H37Rv
auccgccgggcgccgugccc

SEQ ID NO: 3318052 - RNA, 13 nt, Mycobacterium tuberculosis H37Rv
auccgcggcaugc

SEQ ID NO: 3318053 - RNA, 19 nt, Mycobacterium tuberculosis H37Rv
auccgcggcaugcaaugcu

SEQ ID NO: 3318054 - RNA, 18 nt, Mycobacterium tuberculosis H37Rv
auccgcgguuggcagugg

SEQ ID NO: 3318055 - RNA, 14 nt, Mycobacterium tuberculosis H37Rv
auccgcuguuccuc

SEQ ID NO: 3318056 - RNA, 22 nt, Mycobacterium tuberculosis H37Rv
auccggaauagcaacgcugcag

SEQ ID NO: 3318057 - RNA, 19 nt, Mycobacterium tuberculosis H37Rv
auccggaucccaccaccgc

SEQ ID NO: 3318058 - RNA, 21 nt, Mycobacterium tuberculosis H37Rv
auccggaucccaccaccgcuc

SEQ ID NO: 3318059 - RNA, 13 nt, Mycobacterium tuberculosis H37Rv
auccggaucggcc

SEQ ID NO: 3318060 - RNA, 17 nt, Mycobacterium tuberculosis H37Rv
auccggaucggccuguc

SEQ ID NO: 3318061 - RNA, 16 nt, Mycobacterium tuberculosis H37Rv
auccggcaaccaccgg

SEQ ID NO: 3318062 - RNA, 17 nt, Mycobacterium tuberculosis H37Rv
auccggcauacaucgcc

SEQ ID NO: 3318063 - RNA, 12 nt, Mycobacterium tuberculosis H37Rv
auccggccacca

SEQ ID NO: 3318064 - RNA, 18 nt, Mycobacterium tuberculosis H37Rv
auccggcccaccggucgc

SEQ ID NO: 3318065 - RNA, 19 nt, Mycobacterium tuberculosis H37Rv
auccggcgggugccgagcu

SEQ ID NO: 3318066 - RNA, 21 nt, Mycobacterium tuberculosis H37Rv
auccggcgggugccgagcugg

SEQ ID NO: 3318067 - RNA, 23 nt, Mycobacterium tuberculosis H37Rv
auccggcgggugccgagcuggcg

SEQ ID NO: 3318068 - RNA, 22 nt, Mycobacterium tuberculosis H37Rv
auccgggagugcgccggcuggc

SEQ ID NO: 3318069 - RNA, 15 nt, Mycobacterium tuberculosis H37Rv
auccgggcaaccgau

SEQ ID NO: 3318070 - RNA, 19 nt, Mycobacterium tuberculosis H37Rv
auccgggcaaccgaugacg

SEQ ID NO: 3318071 - RNA, 17 nt, Mycobacterium tuberculosis H37Rv
auccgggcgaccaccac

SEQ ID NO: 3318072 - RNA, 17 nt, Mycobacterium tuberculosis H37Rv
auccgggucaguaggcg

SEQ ID NO: 3318073 - RNA, 14 nt, Mycobacterium tuberculosis H37Rv
auccggguggcguc

SEQ ID NO: 3318074 - RNA, 19 nt, Mycobacterium tuberculosis H37Rv
auccggguggcgucaccgc

SEQ ID NO: 3318075 - RNA, 13 nt, Mycobacterium tuberculosis H37Rv
auccggucagcgc

SEQ ID NO: 3318076 - RNA, 15 nt, Mycobacterium tuberculosis H37Rv
auccggucgaugacc

SEQ ID NO: 3318077 - RNA, 13 nt, Mycobacterium tuberculosis H37Rv
auccggucggcca

SEQ ID NO: 3318078 - RNA, 16 nt, Mycobacterium tuberculosis H37Rv
auccggucggccaggc

SEQ ID NO: 3318079 - RNA, 17 nt, Mycobacterium tuberculosis H37Rv
auccggucggccaggcc

SEQ ID NO: 3318080 - RNA, 19 nt, Mycobacterium tuberculosis H37Rv
auccggucggucucggcga

SEQ ID NO: 3318081 - RNA, 21 nt, Mycobacterium tuberculosis H37Rv
auccggucguagcuucggguc

SEQ ID NO: 3318082 - RNA, 19 nt, Mycobacterium tuberculosis H37Rv
auccggucuccgcugauga

SEQ ID NO: 3318083 - RNA, 18 nt, Mycobacterium tuberculosis H37Rv
auccggugaugaccgcgu

SEQ ID NO: 3318084 - RNA, 18 nt, Mycobacterium tuberculosis H37Rv
auccgguggugcucgucg

SEQ ID NO: 3318085 - RNA, 13 nt, Mycobacterium tuberculosis H37Rv
auccgguguugag

SEQ ID NO: 3318086 - RNA, 16 nt, Mycobacterium tuberculosis H37Rv
auccgguucugggccu

SEQ ID NO: 3318087 - RNA, 12 nt, Mycobacterium tuberculosis H37Rv
auccgucccagg

SEQ ID NO: 3318088 - RNA, 20 nt, Mycobacterium tuberculosis H37Rv
auccgugaaucgagcaccgc

SEQ ID NO: 3318089 - RNA, 17 nt, Mycobacterium tuberculosis H37Rv
auccgugaauggcagca

SEQ ID NO: 3318090 - RNA, 16 nt, Mycobacterium tuberculosis H37Rv
auccgugucgagaucu

SEQ ID NO: 3318091 - RNA, 20 nt, Mycobacterium tuberculosis H37Rv
auccguguuucgaacaccgu

SEQ ID NO: 3318092 - RNA, 23 nt, Mycobacterium tuberculosis H37Rv
auccguguuucgaacaccgucca

SEQ ID NO: 3318093 - RNA, 22 nt, Mycobacterium tuberculosis H37Rv
auccuaggguggcgauccacag

SEQ ID NO: 3318094 - RNA, 19 nt, Mycobacterium tuberculosis H37Rv
auccuccggguuggcgacg

SEQ ID NO: 3318095 - RNA, 17 nt, Mycobacterium tuberculosis H37Rv
auccuccucgucgacgu

SEQ ID NO: 3318096 - RNA, 18 nt, Mycobacterium tuberculosis H37Rv
auccuccucgucgacguc

SEQ ID NO: 3318097 - RNA, 17 nt, Mycobacterium tuberculosis H37Rv
auccugcaguacggcca

SEQ ID NO: 3318098 - RNA, 13 nt, Mycobacterium tuberculosis H37Rv
auccuggacaagu

SEQ ID NO: 3318099 - RNA, 19 nt, Mycobacterium tuberculosis H37Rv
auccuggcggcugcagccg

SEQ ID NO: 3318100 - RNA, 12 nt, Mycobacterium tuberculosis H37Rv
auccuggucacc

SEQ ID NO: 3318101 - RNA, 15 nt, Mycobacterium tuberculosis H37Rv
auccuggucaccagc

SEQ ID NO: 3318102 - RNA, 20 nt, Mycobacterium tuberculosis H37Rv
auccuggucaccagccaccg

SEQ ID NO: 3318103 - RNA, 21 nt, Mycobacterium tuberculosis H37Rv
auccuucgccggcgccagcag

SEQ ID NO: 3318104 - RNA, 18 nt, Mycobacterium tuberculosis H37Rv
auccuugacgcggccaca

SEQ ID NO: 3318105 - RNA, 13 nt, Mycobacterium tuberculosis H37Rv
auccuugccaauc

SEQ ID NO: 3318106 - RNA, 15 nt, Mycobacterium tuberculosis H37Rv
auccuuugccgccga

SEQ ID NO: 3318107 - RNA, 17 nt, Mycobacterium tuberculosis H37Rv
aucgaaagccaacucga

SEQ ID NO: 3318108 - RNA, 15 nt, Mycobacterium tuberculosis H37Rv
aucgaagcggcugcu

SEQ ID NO: 3318109 - RNA, 19 nt, Mycobacterium tuberculosis H37Rv
aucgaauuaaagccaccag

SEQ ID NO: 3318110 - RNA, 12 nt, Mycobacterium tuberculosis H37Rv
aucgacacccuu

SEQ ID NO: 3318111 - RNA, 15 nt, Mycobacterium tuberculosis H37Rv
aucgacaccgcccga

SEQ ID NO: 3318112 - RNA, 19 nt, Mycobacterium tuberculosis H37Rv
aucgacaccgugaccgccg

SEQ ID NO: 3318113 - RNA, 13 nt, Mycobacterium tuberculosis H37Rv
aucgacagccccg

SEQ ID NO: 3318114 - RNA, 22 nt, Mycobacterium tuberculosis H37Rv
aucgacagugugaagaccaccg

SEQ ID NO: 3318115 - RNA, 16 nt, Mycobacterium tuberculosis H37Rv
aucgacaucaccaccg

SEQ ID NO: 3318116 - RNA, 12 nt, Mycobacterium tuberculosis H37Rv
aucgacaucguu

SEQ ID NO: 3318117 - RNA, 18 nt, Mycobacterium tuberculosis H37Rv
aucgaccaauucgaccgc

SEQ ID NO: 3318118 - RNA, 20 nt, Mycobacterium tuberculosis H37Rv
aucgaccaauucgaccgcgc

SEQ ID NO: 3318119 - RNA, 20 nt, Mycobacterium tuberculosis H37Rv
aucgaccaccucgaugccgc

SEQ ID NO: 3318120 - RNA, 14 nt, Mycobacterium tuberculosis H37Rv
aucgaccauggucg

SEQ ID NO: 3318121 - RNA, 18 nt, Mycobacterium tuberculosis H37Rv
aucgacccuccagcacgc

SEQ ID NO: 3318122 - RNA, 20 nt, Mycobacterium tuberculosis H37Rv
aucgaccgaacgccagguca

SEQ ID NO: 3318123 - RNA, 12 nt, Mycobacterium tuberculosis H37Rv
aucgaccgcccg

SEQ ID NO: 3318124 - RNA, 21 nt, Mycobacterium tuberculosis H37Rv
aucgaccgccuccucgauagc

SEQ ID NO: 3318125 - RNA, 19 nt, Mycobacterium tuberculosis H37Rv
aucgacgagcgauacgucg

SEQ ID NO: 3318126 - RNA, 19 nt, Mycobacterium tuberculosis H37Rv
aucgacggccagcccagca

SEQ ID NO: 3318127 - RNA, 20 nt, Mycobacterium tuberculosis H37Rv
aucgacgucgcggcgccuga

SEQ ID NO: 3318128 - RNA, 15 nt, Mycobacterium tuberculosis H37Rv
aucgacucacacacc

SEQ ID NO: 3318129 - RNA, 22 nt, Mycobacterium tuberculosis H37Rv
aucgacuccggauggaacugga

SEQ ID NO: 3318130 - RNA, 17 nt, Mycobacterium tuberculosis H37Rv
aucgacugaucgccacc

SEQ ID NO: 3318131 - RNA, 21 nt, Mycobacterium tuberculosis H37Rv
aucgacugaucgccacccggu

SEQ ID NO: 3318132 - RNA, 21 nt, Mycobacterium tuberculosis H37Rv
aucgagaguugaauccgggaa

SEQ ID NO: 3318133 - RNA, 22 nt, Mycobacterium tuberculosis H37Rv
aucgagcaguucucggucccgc

SEQ ID NO: 3318134 - RNA, 16 nt, Mycobacterium tuberculosis H37Rv
aucgagccgacccgac

SEQ ID NO: 3318135 - RNA, 19 nt, Mycobacterium tuberculosis H37Rv
aucgagcuaguucggcguc

SEQ ID NO: 3318136 - RNA, 16 nt, Mycobacterium tuberculosis H37Rv
aucgagcugaccuggu

SEQ ID NO: 3318137 - RNA, 21 nt, Mycobacterium tuberculosis H37Rv
aucgaggaacucggacccacc

SEQ ID NO: 3318138 - RNA, 20 nt, Mycobacterium tuberculosis H37Rv
aucgaggaggcggucgauca

SEQ ID NO: 3318139 - RNA, 21 nt, Mycobacterium tuberculosis H37Rv
aucgaggauauggaucaacgc

SEQ ID NO: 3318140 - RNA, 17 nt, Mycobacterium tuberculosis H37Rv
aucgaggcgaaagaugg

SEQ ID NO: 3318141 - RNA, 17 nt, Mycobacterium tuberculosis H37Rv
aucgaggcgaucaccgc

SEQ ID NO: 3318142 - RNA, 22 nt, Mycobacterium tuberculosis H37Rv
aucgagggggacgcugaucgaa

SEQ ID NO: 3318143 - RNA, 22 nt, Mycobacterium tuberculosis H37Rv
aucgaggugauguuggccgcca

SEQ ID NO: 3318144 - RNA, 12 nt, Mycobacterium tuberculosis H37Rv
aucgagguugac

SEQ ID NO: 3318145 - RNA, 13 nt, Mycobacterium tuberculosis H37Rv
aucgaguccacca

SEQ ID NO: 3318146 - RNA, 14 nt, Mycobacterium tuberculosis H37Rv
aucgaguccaccac

SEQ ID NO: 3318147 - RNA, 15 nt, Mycobacterium tuberculosis H37Rv
aucgaguuccgcauc

SEQ ID NO: 3318148 - RNA, 12 nt, Mycobacterium tuberculosis H37Rv
aucgaguucggc

SEQ ID NO: 3318149 - RNA, 14 nt, Mycobacterium tuberculosis H37Rv
aucgaguucggccc

SEQ ID NO: 3318150 - RNA, 21 nt, Mycobacterium tuberculosis H37Rv
aucgaguugucucgcaucggc

SEQ ID NO: 3318151 - RNA, 22 nt, Mycobacterium tuberculosis H37Rv
aucgaugaccuuugagucgaga

SEQ ID NO: 3318152 - RNA, 19 nt, Mycobacterium tuberculosis H37Rv
aucgaugcggugaauccgu

SEQ ID NO: 3318153 - RNA, 17 nt, Mycobacterium tuberculosis H37Rv
aucgauguguacugaga

SEQ ID NO: 3318154 - RNA, 17 nt, Mycobacterium tuberculosis H37Rv
aucgauuccgccgcacu

SEQ ID NO: 3318155 - RNA, 19 nt, Mycobacterium tuberculosis H37Rv
aucgauugcguagcggguc

SEQ ID NO: 3318156 - RNA, 11 nt, Mycobacterium tuberculosis H37Rv
aucgauuugga

SEQ ID NO: 3318157 - RNA, 19 nt, Mycobacterium tuberculosis H37Rv
aucgcacaaaaucagcgau

SEQ ID NO: 3318158 - RNA, 14 nt, Mycobacterium tuberculosis H37Rv
aucgcacaaaccgg

SEQ ID NO: 3318159 - RNA, 18 nt, Mycobacterium tuberculosis H37Rv
aucgcacaccaacaccgc

SEQ ID NO: 3318160 - RNA, 15 nt, Mycobacterium tuberculosis H37Rv
aucgcacagcgcgau

SEQ ID NO: 3318161 - RNA, 13 nt, Mycobacterium tuberculosis H37Rv
aucgcacccacca

SEQ ID NO: 3318162 - RNA, 22 nt, Mycobacterium tuberculosis H37Rv
aucgcaccgugugggccccgcc

SEQ ID NO: 3318163 - RNA, 20 nt, Mycobacterium tuberculosis H37Rv
aucgcacgaaaucagcccgc

SEQ ID NO: 3318164 - RNA, 18 nt, Mycobacterium tuberculosis H37Rv
aucgcagacggcugccac

SEQ ID NO: 3318165 - RNA, 19 nt, Mycobacterium tuberculosis H37Rv
aucgcagacggcugccacg

SEQ ID NO: 3318166 - RNA, 11 nt, Mycobacterium tuberculosis H37Rv
aucgcaggcac

SEQ ID NO: 3318167 - RNA, 18 nt, Mycobacterium tuberculosis H37Rv
aucgcaggcaccccgauc

SEQ ID NO: 3318168 - RNA, 17 nt, Mycobacterium tuberculosis H37Rv
aucgcagucauguccau

SEQ ID NO: 3318169 - RNA, 16 nt, Mycobacterium tuberculosis H37Rv
aucgcauccccagcac

SEQ ID NO: 3318170 - RNA, 14 nt, Mycobacterium tuberculosis H37Rv
aucgcauccgcggu

SEQ ID NO: 3318171 - RNA, 18 nt, Mycobacterium tuberculosis H37Rv
aucgcauugggcgggcug

SEQ ID NO: 3318172 - RNA, 15 nt, Mycobacterium tuberculosis H37Rv
aucgccaaauccggu

SEQ ID NO: 3318173 - RNA, 19 nt, Mycobacterium tuberculosis H37Rv
aucgccaaauccggugccc

SEQ ID NO: 3318174 - RNA, 11 nt, Mycobacterium tuberculosis H37Rv
aucgccacagu

SEQ ID NO: 3318175 - RNA, 21 nt, Mycobacterium tuberculosis H37Rv
aucgccacgccugcucggaga

SEQ ID NO: 3318176 - RNA, 21 nt, Mycobacterium tuberculosis H37Rv
aucgccacuguugaagaagcc

SEQ ID NO: 3318177 - RNA, 22 nt, Mycobacterium tuberculosis H37Rv
aucgccagcaggaagccgaaga

SEQ ID NO: 3318178 - RNA, 17 nt, Mycobacterium tuberculosis H37Rv
aucgccagcgccggcca

SEQ ID NO: 3318179 - RNA, 14 nt, Mycobacterium tuberculosis H37Rv
aucgccaggcccug

SEQ ID NO: 3318180 - RNA, 21 nt, Mycobacterium tuberculosis H37Rv
aucgccaggcccugaaucuug

SEQ ID NO: 3318181 - RNA, 21 nt, Mycobacterium tuberculosis H37Rv
aucgccaggccgagcccggug

SEQ ID NO: 3318182 - RNA, 17 nt, Mycobacterium tuberculosis H37Rv
aucgccaucgguugacc

SEQ ID NO: 3318183 - RNA, 22 nt, Mycobacterium tuberculosis H37Rv
aucgccaugauggacagcugcg

SEQ ID NO: 3318184 - RNA, 16 nt, Mycobacterium tuberculosis H37Rv
aucgcccaacaacgcu

SEQ ID NO: 3318185 - RNA, 11 nt, Mycobacterium tuberculosis H37Rv
aucgcccgguu

SEQ ID NO: 3318186 - RNA, 16 nt, Mycobacterium tuberculosis H37Rv
aucgcccugacccgga

SEQ ID NO: 3318187 - RNA, 13 nt, Mycobacterium tuberculosis H37Rv
aucgcccugggcg

SEQ ID NO: 3318188 - RNA, 16 nt, Mycobacterium tuberculosis H37Rv
aucgccgaaucggcag

SEQ ID NO: 3318189 - RNA, 16 nt, Mycobacterium tuberculosis H37Rv
aucgccgacacccucg

SEQ ID NO: 3318190 - RNA, 16 nt, Mycobacterium tuberculosis H37Rv
aucgccgacagcgccu

SEQ ID NO: 3318191 - RNA, 13 nt, Mycobacterium tuberculosis H37Rv
aucgccgacgccc

SEQ ID NO: 3318192 - RNA, 13 nt, Mycobacterium tuberculosis H37Rv
aucgccgacggcg

SEQ ID NO: 3318193 - RNA, 22 nt, Mycobacterium tuberculosis H37Rv
aucgccgaggccucggccagcg

SEQ ID NO: 3318194 - RNA, 15 nt, Mycobacterium tuberculosis H37Rv
aucgccgaguccggc

SEQ ID NO: 3318195 - RNA, 18 nt, Mycobacterium tuberculosis H37Rv
aucgccgaugcgggaaac

SEQ ID NO: 3318196 - RNA, 11 nt, Mycobacterium tuberculosis H37Rv
aucgccgccgc

SEQ ID NO: 3318197 - RNA, 21 nt, Mycobacterium tuberculosis H37Rv
aucgccgcgaagcgcucggca

SEQ ID NO: 3318198 - RNA, 13 nt, Mycobacterium tuberculosis H37Rv
aucgccgcgauca

SEQ ID NO: 3318199 - RNA, 17 nt, Mycobacterium tuberculosis H37Rv
aucgccgcgauggcggu

SEQ ID NO: 3318200 - RNA, 23 nt, Mycobacterium tuberculosis H37Rv
aucgccgcgcgucaagucugugc

SEQ ID NO: 3318201 - RNA, 23 nt, Mycobacterium tuberculosis H37Rv
aucgccgcgcuggucggagacca

SEQ ID NO: 3318202 - RNA, 13 nt, Mycobacterium tuberculosis H37Rv
aucgccgcgggcg

SEQ ID NO: 3318203 - RNA, 19 nt, Mycobacterium tuberculosis H37Rv
aucgccgcuaccgucagua

SEQ ID NO: 3318204 - RNA, 15 nt, Mycobacterium tuberculosis H37Rv
aucgccgcuggccag

SEQ ID NO: 3318205 - RNA, 20 nt, Mycobacterium tuberculosis H37Rv
aucgccggcuucgcccagag

SEQ ID NO: 3318206 - RNA, 12 nt, Mycobacterium tuberculosis H37Rv
aucgccgggaac

SEQ ID NO: 3318207 - RNA, 20 nt, Mycobacterium tuberculosis H37Rv
aucgccgggaacaucccagc

SEQ ID NO: 3318208 - RNA, 18 nt, Mycobacterium tuberculosis H37Rv
aucgccgggccguagaaa

SEQ ID NO: 3318209 - RNA, 18 nt, Mycobacterium tuberculosis H37Rv
aucgccgggugcaggcga

SEQ ID NO: 3318210 - RNA, 17 nt, Mycobacterium tuberculosis H37Rv
aucgccgucagcaccgc

SEQ ID NO: 3318211 - RNA, 21 nt, Mycobacterium tuberculosis H37Rv
aucgccgucagcaccgcuacg

SEQ ID NO: 3318212 - RNA, 15 nt, Mycobacterium tuberculosis H37Rv
aucgccguccagcaa

SEQ ID NO: 3318213 - RNA, 17 nt, Mycobacterium tuberculosis H37Rv
aucgccguccagcaaua

SEQ ID NO: 3318214 - RNA, 20 nt, Mycobacterium tuberculosis H37Rv
aucgccuaccggccuuucca

SEQ ID NO: 3318215 - RNA, 17 nt, Mycobacterium tuberculosis H37Rv
aucgccuccagccggcg

SEQ ID NO: 3318216 - RNA, 23 nt, Mycobacterium tuberculosis H37Rv
aucgccuccagccggcgaaugcg

SEQ ID NO: 3318217 - RNA, 13 nt, Mycobacterium tuberculosis H37Rv
aucgccucgacgc

SEQ ID NO: 3318218 - RNA, 14 nt, Mycobacterium tuberculosis H37Rv
aucgccucgacgcg

SEQ ID NO: 3318219 - RNA, 19 nt, Mycobacterium tuberculosis H37Rv
aucgccucggcgcugcgca

SEQ ID NO: 3318220 - RNA, 14 nt, Mycobacterium tuberculosis H37Rv
aucgccugagacuc

SEQ ID NO: 3318221 - RNA, 23 nt, Mycobacterium tuberculosis H37Rv
aucgccugauaugacuugcgcgc

SEQ ID NO: 3318222 - RNA, 18 nt, Mycobacterium tuberculosis H37Rv
aucgccuugcccagcgac

SEQ ID NO: 3318223 - RNA, 20 nt, Mycobacterium tuberculosis H37Rv
aucgccuuggcgcccgcgaa

SEQ ID NO: 3318224 - RNA, 20 nt, Mycobacterium tuberculosis H37Rv
aucgcgaacgaagucgacga

SEQ ID NO: 3318225 - RNA, 17 nt, Mycobacterium tuberculosis H37Rv
aucgcgacgaucgucca

SEQ ID NO: 3318226 - RNA, 15 nt, Mycobacterium tuberculosis H37Rv
aucgcgacgaugccc

SEQ ID NO: 3318227 - RNA, 21 nt, Mycobacterium tuberculosis H37Rv
aucgcgagaaggugcugcgcg

SEQ ID NO: 3318228 - RNA, 15 nt, Mycobacterium tuberculosis H37Rv
aucgcgagccagcug

SEQ ID NO: 3318229 - RNA, 17 nt, Mycobacterium tuberculosis H37Rv
aucgcgaggcgucaccc

SEQ ID NO: 3318230 - RNA, 16 nt, Mycobacterium tuberculosis H37Rv
aucgcgaucugaaggu

SEQ ID NO: 3318231 - RNA, 14 nt, Mycobacterium tuberculosis H37Rv
aucgcgauuccggc

SEQ ID NO: 3318232 - RNA, 20 nt, Mycobacterium tuberculosis H37Rv
aucgcgccgggcucggcguu

SEQ ID NO: 3318233 - RNA, 16 nt, Mycobacterium tuberculosis H37Rv
aucgcgccgucgucga

SEQ ID NO: 3318234 - RNA, 17 nt, Mycobacterium tuberculosis H37Rv
aucgcgcggaccagagu

SEQ ID NO: 3318235 - RNA, 21 nt, Mycobacterium tuberculosis H37Rv
aucgcgcggcugugcccgauc

SEQ ID NO: 3318236 - RNA, 23 nt, Mycobacterium tuberculosis H37Rv
aucgcgcucauguucucgaccgc

SEQ ID NO: 3318237 - RNA, 21 nt, Mycobacterium tuberculosis H37Rv
aucgcggagccaggacgacgc

SEQ ID NO: 3318238 - RNA, 12 nt, Mycobacterium tuberculosis H37Rv
aucgcggccaca

SEQ ID NO: 3318239 - RNA, 14 nt, Mycobacterium tuberculosis H37Rv
aucgcggccgcugg

SEQ ID NO: 3318240 - RNA, 17 nt, Mycobacterium tuberculosis H37Rv
aucgcgggcggcgcugg

SEQ ID NO: 3318241 - RNA, 23 nt, Mycobacterium tuberculosis H37Rv
aucgcgggcgugccgaccagcau

SEQ ID NO: 3318242 - RNA, 23 nt, Mycobacterium tuberculosis H37Rv
aucgcggucaaauccagcagcca

SEQ ID NO: 3318243 - RNA, 13 nt, Mycobacterium tuberculosis H37Rv
aucgcggucuuga

SEQ ID NO: 3318244 - RNA, 19 nt, Mycobacterium tuberculosis H37Rv
aucgcggucuugacaccgc

SEQ ID NO: 3318245 - RNA, 15 nt, Mycobacterium tuberculosis H37Rv
aucgcguccuccucg

SEQ ID NO: 3318246 - RNA, 14 nt, Mycobacterium tuberculosis H37Rv
aucgcgucggcgau

SEQ ID NO: 3318247 - RNA, 13 nt, Mycobacterium tuberculosis H37Rv
aucgcgugcugga

SEQ ID NO: 3318248 - RNA, 14 nt, Mycobacterium tuberculosis H37Rv
aucgcguggaucgc

SEQ ID NO: 3318249 - RNA, 17 nt, Mycobacterium tuberculosis H37Rv
aucgcguggaucgcgcu

SEQ ID NO: 3318250 - RNA, 20 nt, Mycobacterium tuberculosis H37Rv
aucgcguggcgcaccaccgc

SEQ ID NO: 3318251 - RNA, 19 nt, Mycobacterium tuberculosis H37Rv
aucgcguuagccaggucga

SEQ ID NO: 3318252 - RNA, 17 nt, Mycobacterium tuberculosis H37Rv
aucgcguucugcaccag

SEQ ID NO: 3318253 - RNA, 21 nt, Mycobacterium tuberculosis H37Rv
aucgcucauucgugcccgggc

SEQ ID NO: 3318254 - RNA, 17 nt, Mycobacterium tuberculosis H37Rv
aucgcuccggcccugcc

SEQ ID NO: 3318255 - RNA, 22 nt, Mycobacterium tuberculosis H37Rv
aucgcuccggcccugccgccgg

SEQ ID NO: 3318256 - RNA, 14 nt, Mycobacterium tuberculosis H37Rv
aucgcucucgguca

SEQ ID NO: 3318257 - RNA, 16 nt, Mycobacterium tuberculosis H37Rv
aucgcucucggucagu

SEQ ID NO: 3318258 - RNA, 21 nt, Mycobacterium tuberculosis H37Rv
aucgcucucggucaguuccuc

SEQ ID NO: 3318259 - RNA, 18 nt, Mycobacterium tuberculosis H37Rv
aucgcucugugucgccga

SEQ ID NO: 3318260 - RNA, 13 nt, Mycobacterium tuberculosis H37Rv
aucgcuguaggca

SEQ ID NO: 3318261 - RNA, 21 nt, Mycobacterium tuberculosis H37Rv
aucggaacgaucauuccugcc

SEQ ID NO: 3318262 - RNA, 12 nt, Mycobacterium tuberculosis H37Rv
aucggaagaaac

SEQ ID NO: 3318263 - RNA, 17 nt, Mycobacterium tuberculosis H37Rv
aucggaagagucgacgc

SEQ ID NO: 3318264 - RNA, 21 nt, Mycobacterium tuberculosis H37Rv
aucggacucggaauucggcgu

SEQ ID NO: 3318265 - RNA, 12 nt, Mycobacterium tuberculosis H37Rv
aucggaggcccg

SEQ ID NO: 3318266 - RNA, 22 nt, Mycobacterium tuberculosis H37Rv
aucggagucuucaacgucgaga

SEQ ID NO: 3318267 - RNA, 23 nt, Mycobacterium tuberculosis H37Rv
aucggagucuucaacgucgagau

SEQ ID NO: 3318268 - RNA, 18 nt, Mycobacterium tuberculosis H37Rv
aucggauacccagccggc

SEQ ID NO: 3318269 - RNA, 14 nt, Mycobacterium tuberculosis H37Rv
aucggaugaccagu

SEQ ID NO: 3318270 - RNA, 17 nt, Mycobacterium tuberculosis H37Rv
aucggauggcggccaca

SEQ ID NO: 3318271 - RNA, 17 nt, Mycobacterium tuberculosis H37Rv
aucggcaacggcggcgu

SEQ ID NO: 3318272 - RNA, 16 nt, Mycobacterium tuberculosis H37Rv
aucggcaaugagcuac

SEQ ID NO: 3318273 - RNA, 17 nt, Mycobacterium tuberculosis H37Rv
aucggcacaggcggcca

SEQ ID NO: 3318274 - RNA, 21 nt, Mycobacterium tuberculosis H37Rv
aucggcaccccacgccugccg

SEQ ID NO: 3318275 - RNA, 13 nt, Mycobacterium tuberculosis H37Rv
aucggcaccccgg

SEQ ID NO: 3318276 - RNA, 18 nt, Mycobacterium tuberculosis H37Rv
aucggcacggucacacgc

SEQ ID NO: 3318277 - RNA, 16 nt, Mycobacterium tuberculosis H37Rv
aucggcagaauccggu

SEQ ID NO: 3318278 - RNA, 20 nt, Mycobacterium tuberculosis H37Rv
aucggcagccagggcgccga

SEQ ID NO: 3318279 - RNA, 20 nt, Mycobacterium tuberculosis H37Rv
aucggcagccccugccgauc

SEQ ID NO: 3318280 - RNA, 17 nt, Mycobacterium tuberculosis H37Rv
aucggcagucccagcgc

SEQ ID NO: 3318281 - RNA, 23 nt, Mycobacterium tuberculosis H37Rv
aucggcagucccagcgccgcaca

SEQ ID NO: 3318282 - RNA, 15 nt, Mycobacterium tuberculosis H37Rv
aucggccaacagguc

SEQ ID NO: 3318283 - RNA, 19 nt, Mycobacterium tuberculosis H37Rv
aucggccaacuugcucagc

SEQ ID NO: 3318284 - RNA, 10 nt, Mycobacterium tuberculosis H37Rv
aucggccacc

SEQ ID NO: 3318285 - RNA, 17 nt, Mycobacterium tuberculosis H37Rv
aucggccaccaucgccc

SEQ ID NO: 3318286 - RNA, 13 nt, Mycobacterium tuberculosis H37Rv
aucggccaccugu

SEQ ID NO: 3318287 - RNA, 18 nt, Mycobacterium tuberculosis H37Rv
aucggccaccuguuggca

SEQ ID NO: 3318288 - RNA, 20 nt, Mycobacterium tuberculosis H37Rv
aucggccaucaugagcgacc

SEQ ID NO: 3318289 - RNA, 22 nt, Mycobacterium tuberculosis H37Rv
aucggcccagcccuucagcguc

SEQ ID NO: 3318290 - RNA, 21 nt, Mycobacterium tuberculosis H37Rv
aucggccggcgucagccccga

SEQ ID NO: 3318291 - RNA, 22 nt, Mycobacterium tuberculosis H37Rv
aucggccggguuaucggcagca

SEQ ID NO: 3318292 - RNA, 18 nt, Mycobacterium tuberculosis H37Rv
aucggccgugaauucgcc

SEQ ID NO: 3318293 - RNA, 21 nt, Mycobacterium tuberculosis H37Rv
aucggccuguccaccgaugcc

SEQ ID NO: 3318294 - RNA, 18 nt, Mycobacterium tuberculosis H37Rv
aucggccuguucgccguc

SEQ ID NO: 3318295 - RNA, 20 nt, Mycobacterium tuberculosis H37Rv
aucggcgaggucccggccga

SEQ ID NO: 3318296 - RNA, 13 nt, Mycobacterium tuberculosis H37Rv
aucggcgcgccga

SEQ ID NO: 3318297 - RNA, 13 nt, Mycobacterium tuberculosis H37Rv
aucggcgcgucga

SEQ ID NO: 3318298 - RNA, 14 nt, Mycobacterium tuberculosis H37Rv
aucggcggaccgca

SEQ ID NO: 3318299 - RNA, 12 nt, Mycobacterium tuberculosis H37Rv
aucggcggaucg

SEQ ID NO: 3318300 - RNA, 17 nt, Mycobacterium tuberculosis H37Rv
aucggcggccggcgccg

SEQ ID NO: 3318301 - RNA, 14 nt, Mycobacterium tuberculosis H37Rv
aucggcggccugcu

SEQ ID NO: 3318302 - RNA, 22 nt, Mycobacterium tuberculosis H37Rv
aucggcggccugcucgcagauc

SEQ ID NO: 3318303 - RNA, 19 nt, Mycobacterium tuberculosis H37Rv
aucggcggcguccagcagc

SEQ ID NO: 3318304 - RNA, 17 nt, Mycobacterium tuberculosis H37Rv
aucggcggggcccacac

SEQ ID NO: 3318305 - RNA, 20 nt, Mycobacterium tuberculosis H37Rv
aucggcguuaucgaaggcga

SEQ ID NO: 3318306 - RNA, 15 nt, Mycobacterium tuberculosis H37Rv
aucggcuaggccggc

SEQ ID NO: 3318307 - RNA, 18 nt, Mycobacterium tuberculosis H37Rv
aucggcuaggccggccgg

SEQ ID NO: 3318308 - RNA, 18 nt, Mycobacterium tuberculosis H37Rv
aucggcuucuucuucuug

SEQ ID NO: 3318309 - RNA, 19 nt, Mycobacterium tuberculosis H37Rv
aucggcuugccugcgccga

SEQ ID NO: 3318310 - RNA, 21 nt, Mycobacterium tuberculosis H37Rv
aucggcuuggcugugauguug

SEQ ID NO: 3318311 - RNA, 19 nt, Mycobacterium tuberculosis H37Rv
aucgggaaguacggcaggc

SEQ ID NO: 3318312 - RNA, 21 nt, Mycobacterium tuberculosis H37Rv
aucgggaauuucgucggccau

SEQ ID NO: 3318313 - RNA, 18 nt, Mycobacterium tuberculosis H37Rv
aucgggacgccuugaucg

SEQ ID NO: 3318314 - RNA, 16 nt, Mycobacterium tuberculosis H37Rv
aucgggaucugggcuc

SEQ ID NO: 3318315 - RNA, 19 nt, Mycobacterium tuberculosis H37Rv
aucgggcaaagucgguguc

SEQ ID NO: 3318316 - RNA, 18 nt, Mycobacterium tuberculosis H37Rv
aucgggccacagcaacgu

SEQ ID NO: 3318317 - RNA, 19 nt, Mycobacterium tuberculosis H37Rv
aucgggcccccuggaucgc

SEQ ID NO: 3318318 - RNA, 14 nt, Mycobacterium tuberculosis H37Rv
aucgggcgagcucg

SEQ ID NO: 3318319 - RNA, 22 nt, Mycobacterium tuberculosis H37Rv
aucgggcgagcucgucgagcgc

SEQ ID NO: 3318320 - RNA, 17 nt, Mycobacterium tuberculosis H37Rv
aucgggcgcgguaacca

SEQ ID NO: 3318321 - RNA, 16 nt, Mycobacterium tuberculosis H37Rv
aucgggcggcaccgcu

SEQ ID NO: 3318322 - RNA, 23 nt, Mycobacterium tuberculosis H37Rv
aucgggcguggugagcaguguga

SEQ ID NO: 3318323 - RNA, 20 nt, Mycobacterium tuberculosis H37Rv
aucgggcuugcgcagcagcg

SEQ ID NO: 3318324 - RNA, 15 nt, Mycobacterium tuberculosis H37Rv
aucggggccacugag

SEQ ID NO: 3318325 - RNA, 20 nt, Mycobacterium tuberculosis H37Rv
aucggggcgacgauccgcac

SEQ ID NO: 3318326 - RNA, 16 nt, Mycobacterium tuberculosis H37Rv
aucggggcgcugcagc

SEQ ID NO: 3318327 - RNA, 22 nt, Mycobacterium tuberculosis H37Rv
aucgggguuggugaacgagaug

SEQ ID NO: 3318328 - RNA, 16 nt, Mycobacterium tuberculosis H37Rv
aucgggucacccccgg

SEQ ID NO: 3318329 - RNA, 17 nt, Mycobacterium tuberculosis H37Rv
aucggguccacgucucc

SEQ ID NO: 3318330 - RNA, 17 nt, Mycobacterium tuberculosis H37Rv
aucgggucgucggcguc

SEQ ID NO: 3318331 - RNA, 20 nt, Mycobacterium tuberculosis H37Rv
aucggguuuccuugggcguc

SEQ ID NO: 3318332 - RNA, 12 nt, Mycobacterium tuberculosis H37Rv
aucggucgacga

SEQ ID NO: 3318333 - RNA, 15 nt, Mycobacterium tuberculosis H37Rv
aucggugaucgaggu

SEQ ID NO: 3318334 - RNA, 19 nt, Mycobacterium tuberculosis H37Rv
aucggugaucgagguugac

SEQ ID NO: 3318335 - RNA, 22 nt, Mycobacterium tuberculosis H37Rv
aucggugcacaacgcccaccac

SEQ ID NO: 3318336 - RNA, 20 nt, Mycobacterium tuberculosis H37Rv
aucggugccgaagcugccca

SEQ ID NO: 3318337 - RNA, 16 nt, Mycobacterium tuberculosis H37Rv
aucggugggcgggcaa

SEQ ID NO: 3318338 - RNA, 20 nt, Mycobacterium tuberculosis H37Rv
aucggugguaacaccggcga

SEQ ID NO: 3318339 - RNA, 15 nt, Mycobacterium tuberculosis H37Rv
aucgguggucgaugg

SEQ ID NO: 3318340 - RNA, 23 nt, Mycobacterium tuberculosis H37Rv
aucgguggucgauggacaacagc

SEQ ID NO: 3318341 - RNA, 21 nt, Mycobacterium tuberculosis H37Rv
aucggugguuagguggcuggc

SEQ ID NO: 3318342 - RNA, 23 nt, Mycobacterium tuberculosis H37Rv
aucgguguggacuucagcaggcc

SEQ ID NO: 3318343 - RNA, 14 nt, Mycobacterium tuberculosis H37Rv
aucgguugaccggu

SEQ ID NO: 3318344 - RNA, 20 nt, Mycobacterium tuberculosis H37Rv
aucgguugaccggucgacca

SEQ ID NO: 3318345 - RNA, 23 nt, Mycobacterium tuberculosis H37Rv
aucgguuguggucagcugcugcc

SEQ ID NO: 3318346 - RNA, 16 nt, Mycobacterium tuberculosis H37Rv
aucgucacggaggccu

SEQ ID NO: 3318347 - RNA, 17 nt, Mycobacterium tuberculosis H37Rv
aucgucacgggguccga

SEQ ID NO: 3318348 - RNA, 12 nt, Mycobacterium tuberculosis H37Rv
aucgucaggccc

SEQ ID NO: 3318349 - RNA, 17 nt, Mycobacterium tuberculosis H37Rv
aucgucauccaggggcg

SEQ ID NO: 3318350 - RNA, 18 nt, Mycobacterium tuberculosis H37Rv
aucgucgaacagcaccgc

SEQ ID NO: 3318351 - RNA, 19 nt, Mycobacterium tuberculosis H37Rv
aucgucgaacagcaccgcc

SEQ ID NO: 3318352 - RNA, 15 nt, Mycobacterium tuberculosis H37Rv
aucgucgaaccggau

SEQ ID NO: 3318353 - RNA, 20 nt, Mycobacterium tuberculosis H37Rv
aucgucgaaccggaugcggu

SEQ ID NO: 3318354 - RNA, 14 nt, Mycobacterium tuberculosis H37Rv
aucgucgagcaccu

SEQ ID NO: 3318355 - RNA, 20 nt, Mycobacterium tuberculosis H37Rv
aucgucgagccgaucgcccg

SEQ ID NO: 3318356 - RNA, 15 nt, Mycobacterium tuberculosis H37Rv
aucgucgagcgcggu

SEQ ID NO: 3318357 - RNA, 14 nt, Mycobacterium tuberculosis H37Rv
aucgucgccacgau

SEQ ID NO: 3318358 - RNA, 19 nt, Mycobacterium tuberculosis H37Rv
aucgucgccacgaugccgg

SEQ ID NO: 3318359 - RNA, 12 nt, Mycobacterium tuberculosis H37Rv
aucgucgccaug

SEQ ID NO: 3318360 - RNA, 17 nt, Mycobacterium tuberculosis H37Rv
aucgucgccgaccguca

SEQ ID NO: 3318361 - RNA, 24 nt, Mycobacterium tuberculosis H37Rv
aucgucgcggccgucgcgggacaa

SEQ ID NO: 3318362 - RNA, 17 nt, Mycobacterium tuberculosis H37Rv
aucgucggccagcagau

SEQ ID NO: 3318363 - RNA, 15 nt, Mycobacterium tuberculosis H37Rv
aucgucgggucaccc

SEQ ID NO: 3318364 - RNA, 18 nt, Mycobacterium tuberculosis H37Rv
aucgucgucgcugccgcc

SEQ ID NO: 3318365 - RNA, 15 nt, Mycobacterium tuberculosis H37Rv
aucgucucggccacg

SEQ ID NO: 3318366 - RNA, 13 nt, Mycobacterium tuberculosis H37Rv
aucgucucggcua

SEQ ID NO: 3318367 - RNA, 19 nt, Mycobacterium tuberculosis H37Rv
aucgucugacgaaauccgc

SEQ ID NO: 3318368 - RNA, 22 nt, Mycobacterium tuberculosis H37Rv
aucgucugacgaaauccgccgg

SEQ ID NO: 3318369 - RNA, 19 nt, Mycobacterium tuberculosis H37Rv
aucgucugguggcagcgca

SEQ ID NO: 3318370 - RNA, 16 nt, Mycobacterium tuberculosis H37Rv
aucgucuugucgccga

SEQ ID NO: 3318371 - RNA, 18 nt, Mycobacterium tuberculosis H37Rv
aucgucuugucgccgagu

SEQ ID NO: 3318372 - RNA, 20 nt, Mycobacterium tuberculosis H37Rv
aucgugacguuguaggagaa

SEQ ID NO: 3318373 - RNA, 21 nt, Mycobacterium tuberculosis H37Rv
aucgugagacgccgucgacgu

SEQ ID NO: 3318374 - RNA, 18 nt, Mycobacterium tuberculosis H37Rv
aucgugcggaaccugcuc

SEQ ID NO: 3318375 - RNA, 21 nt, Mycobacterium tuberculosis H37Rv
aucgugcggaaccugcucggc

SEQ ID NO: 3318376 - RNA, 13 nt, Mycobacterium tuberculosis H37Rv
aucgugcuggcga

SEQ ID NO: 3318377 - RNA, 18 nt, Mycobacterium tuberculosis H37Rv
aucgugggugccggcuca

SEQ ID NO: 3318378 - RNA, 13 nt, Mycobacterium tuberculosis H37Rv
aucgugguucggc

SEQ ID NO: 3318379 - RNA, 16 nt, Mycobacterium tuberculosis H37Rv
aucguguacugcuccu

SEQ ID NO: 3318380 - RNA, 18 nt, Mycobacterium tuberculosis H37Rv
aucguguacuggucugga

SEQ ID NO: 3318381 - RNA, 18 nt, Mycobacterium tuberculosis H37Rv
aucguucaugaucggcag

SEQ ID NO: 3318382 - RNA, 16 nt, Mycobacterium tuberculosis H37Rv
aucguugccgaccguc

SEQ ID NO: 3318383 - RNA, 17 nt, Mycobacterium tuberculosis H37Rv
aucguugccgaccguca

SEQ ID NO: 3318384 - RNA, 21 nt, Mycobacterium tuberculosis H37Rv
aucguugccgaccgucacuga

SEQ ID NO: 3318385 - RNA, 20 nt, Mycobacterium tuberculosis H37Rv
aucguugccggugccgccgc

SEQ ID NO: 3318386 - RNA, 14 nt, Mycobacterium tuberculosis H37Rv
aucguugugcaccc

SEQ ID NO: 3318387 - RNA, 18 nt, Mycobacterium tuberculosis H37Rv
aucguuguugaccaccac

SEQ ID NO: 3318388 - RNA, 16 nt, Mycobacterium tuberculosis H37Rv
aucuaccuuauggcga

SEQ ID NO: 3318389 - RNA, 23 nt, Mycobacterium tuberculosis H37Rv
aucuaguacacaaauccgcacca

SEQ ID NO: 3318390 - RNA, 23 nt, Mycobacterium tuberculosis H37Rv
aucuccaaguagcacuucagcuu

SEQ ID NO: 3318391 - RNA, 20 nt, Mycobacterium tuberculosis H37Rv
aucuccaccgucgccgccgg

SEQ ID NO: 3318392 - RNA, 12 nt, Mycobacterium tuberculosis H37Rv
aucuccaccuuc

SEQ ID NO: 3318393 - RNA, 15 nt, Mycobacterium tuberculosis H37Rv
aucuccaccuucugg

SEQ ID NO: 3318394 - RNA, 23 nt, Mycobacterium tuberculosis H37Rv
aucuccaccuucugguccagcac

SEQ ID NO: 3318395 - RNA, 23 nt, Mycobacterium tuberculosis H37Rv
aucucccgaaucgugcggcgacc

SEQ ID NO: 3318396 - RNA, 23 nt, Mycobacterium tuberculosis H37Rv
aucucccgaccgccgagcggguu

SEQ ID NO: 3318397 - RNA, 21 nt, Mycobacterium tuberculosis H37Rv
aucuccgcgucggucagcugu

SEQ ID NO: 3318398 - RNA, 13 nt, Mycobacterium tuberculosis H37Rv
aucuccggcuggc

SEQ ID NO: 3318399 - RNA, 11 nt, Mycobacterium tuberculosis H37Rv
aucuccuccug

SEQ ID NO: 3318400 - RNA, 13 nt, Mycobacterium tuberculosis H37Rv
aucuccucggcga

SEQ ID NO: 3318401 - RNA, 19 nt, Mycobacterium tuberculosis H37Rv
aucuccucggcgaugccgu

SEQ ID NO: 3318402 - RNA, 22 nt, Mycobacterium tuberculosis H37Rv
aucuccuuggccguucggcgcc

SEQ ID NO: 3318403 - RNA, 18 nt, Mycobacterium tuberculosis H37Rv
aucucgaccggcuugccc

SEQ ID NO: 3318404 - RNA, 20 nt, Mycobacterium tuberculosis H37Rv
aucucgaccucgucggccga

SEQ ID NO: 3318405 - RNA, 17 nt, Mycobacterium tuberculosis H37Rv
aucucgacggccucguc

SEQ ID NO: 3318406 - RNA, 18 nt, Mycobacterium tuberculosis H37Rv
aucucgacggccucgucg

SEQ ID NO: 3318407 - RNA, 20 nt, Mycobacterium tuberculosis H37Rv
aucucgcccaccuccugguu

SEQ ID NO: 3318408 - RNA, 22 nt, Mycobacterium tuberculosis H37Rv
aucucgccggcgaagaccgccg

SEQ ID NO: 3318409 - RNA, 22 nt, Mycobacterium tuberculosis H37Rv
aucucgcgggcccgcgcggcgg

SEQ ID NO: 3318410 - RNA, 16 nt, Mycobacterium tuberculosis H37Rv
aucucggagcgcacga

SEQ ID NO: 3318411 - RNA, 20 nt, Mycobacterium tuberculosis H37Rv
aucucggccagggucacaaa

SEQ ID NO: 3318412 - RNA, 20 nt, Mycobacterium tuberculosis H37Rv
aucucggcgagcaccacccc

SEQ ID NO: 3318413 - RNA, 16 nt, Mycobacterium tuberculosis H37Rv
aucucggcgcagccgg

SEQ ID NO: 3318414 - RNA, 19 nt, Mycobacterium tuberculosis H37Rv
aucucggcguugccgccgu

SEQ ID NO: 3318415 - RNA, 15 nt, Mycobacterium tuberculosis H37Rv
aucucggucagaugc

SEQ ID NO: 3318416 - RNA, 22 nt, Mycobacterium tuberculosis H37Rv
aucucgguggacggcaggcggc

SEQ ID NO: 3318417 - RNA, 16 nt, Mycobacterium tuberculosis H37Rv
aucucguacuccccgc

SEQ ID NO: 3318418 - RNA, 21 nt, Mycobacterium tuberculosis H37Rv
aucucguggaucugccucucg

SEQ ID NO: 3318419 - RNA, 23 nt, Mycobacterium tuberculosis H37Rv
aucucuaccagccgccccggcuu

SEQ ID NO: 3318420 - RNA, 12 nt, Mycobacterium tuberculosis H37Rv
aucucuccugga

SEQ ID NO: 3318421 - RNA, 20 nt, Mycobacterium tuberculosis H37Rv
aucugaaaauugacccccua

SEQ ID NO: 3318422 - RNA, 19 nt, Mycobacterium tuberculosis H37Rv
aucugacgacgcgacacgc

SEQ ID NO: 3318423 - RNA, 23 nt, Mycobacterium tuberculosis H37Rv
aucugcacgagugcggcgaccag

SEQ ID NO: 3318424 - RNA, 18 nt, Mycobacterium tuberculosis H37Rv
aucugcaggcccaggcug

SEQ ID NO: 3318425 - RNA, 16 nt, Mycobacterium tuberculosis H37Rv
aucugccacguugauc

SEQ ID NO: 3318426 - RNA, 15 nt, Mycobacterium tuberculosis H37Rv
aucugcccggugauc

SEQ ID NO: 3318427 - RNA, 16 nt, Mycobacterium tuberculosis H37Rv
aucugcccggugaucc

SEQ ID NO: 3318428 - RNA, 14 nt, Mycobacterium tuberculosis H37Rv
aucugcccuguucg

SEQ ID NO: 3318429 - RNA, 21 nt, Mycobacterium tuberculosis H37Rv
aucugccgccgcggccacaac

SEQ ID NO: 3318430 - RNA, 18 nt, Mycobacterium tuberculosis H37Rv
aucugccgguaccggcga

SEQ ID NO: 3318431 - RNA, 14 nt, Mycobacterium tuberculosis H37Rv
aucugcgccaucac

SEQ ID NO: 3318432 - RNA, 14 nt, Mycobacterium tuberculosis H37Rv
aucugcgcgaugcc

SEQ ID NO: 3318433 - RNA, 13 nt, Mycobacterium tuberculosis H37Rv
aucugcggcgccc

SEQ ID NO: 3318434 - RNA, 18 nt, Mycobacterium tuberculosis H37Rv
aucugcgggacgucgucg

SEQ ID NO: 3318435 - RNA, 22 nt, Mycobacterium tuberculosis H37Rv
aucugcuagcuuggcggccagc

SEQ ID NO: 3318436 - RNA, 13 nt, Mycobacterium tuberculosis H37Rv
aucugcuccucgg

SEQ ID NO: 3318437 - RNA, 14 nt, Mycobacterium tuberculosis H37Rv
aucugcucggcauc

SEQ ID NO: 3318438 - RNA, 16 nt, Mycobacterium tuberculosis H37Rv
aucugcugcgagaucu

SEQ ID NO: 3318439 - RNA, 19 nt, Mycobacterium tuberculosis H37Rv
aucugcuggccgaaccggu

SEQ ID NO: 3318440 - RNA, 19 nt, Mycobacterium tuberculosis H37Rv
aucuggccgaacgacgggu

SEQ ID NO: 3318441 - RNA, 12 nt, Mycobacterium tuberculosis H37Rv
aucuggguuccc

SEQ ID NO: 3318442 - RNA, 17 nt, Mycobacterium tuberculosis H37Rv
aucugguccagugggau

SEQ ID NO: 3318443 - RNA, 13 nt, Mycobacterium tuberculosis H37Rv
aucuggucgacga

SEQ ID NO: 3318444 - RNA, 13 nt, Mycobacterium tuberculosis H37Rv
aucugguggaccu

SEQ ID NO: 3318445 - RNA, 19 nt, Mycobacterium tuberculosis H37Rv
aucuucgacaggccaccgc

SEQ ID NO: 3318446 - RNA, 23 nt, Mycobacterium tuberculosis H37Rv
aucuucuccucgucgguuccggg

SEQ ID NO: 3318447 - RNA, 19 nt, Mycobacterium tuberculosis H37Rv
aucuucucgagccgccgga

SEQ ID NO: 3318448 - RNA, 15 nt, Mycobacterium tuberculosis H37Rv
aucuucugccuuggc

SEQ ID NO: 3318449 - RNA, 12 nt, Mycobacterium tuberculosis H37Rv
aucuugccacuc

SEQ ID NO: 3318450 - RNA, 18 nt, Mycobacterium tuberculosis H37Rv
aucuugccgucggccggc

SEQ ID NO: 3318451 - RNA, 15 nt, Mycobacterium tuberculosis H37Rv
aucuugcgcaaugcc

SEQ ID NO: 3318452 - RNA, 12 nt, Mycobacterium tuberculosis H37Rv
aucuugcgcaug

SEQ ID NO: 3318453 - RNA, 13 nt, Mycobacterium tuberculosis H37Rv
aucuuggccagca

SEQ ID NO: 3318454 - RNA, 15 nt, Mycobacterium tuberculosis H37Rv
aucuuggccagcagc

SEQ ID NO: 3318455 - RNA, 17 nt, Mycobacterium tuberculosis H37Rv
aucuuggccagcagcgc

SEQ ID NO: 3318456 - RNA, 19 nt, Mycobacterium tuberculosis H37Rv
aucuuggcgcccgccggca

SEQ ID NO: 3318457 - RNA, 19 nt, Mycobacterium tuberculosis H37Rv
aucuuggugaagaucgaca

SEQ ID NO: 3318458 - RNA, 18 nt, Mycobacterium tuberculosis H37Rv
aucuugguggccucaucc

SEQ ID NO: 3318459 - RNA, 15 nt, Mycobacterium tuberculosis H37Rv
aucuuggugggaagc

SEQ ID NO: 3318460 - RNA, 12 nt, Mycobacterium tuberculosis H37Rv
aucuugguguug

SEQ ID NO: 3318461 - RNA, 16 nt, Mycobacterium tuberculosis H37Rv
aucuugguguuggugg

SEQ ID NO: 3318462 - RNA, 17 nt, Mycobacterium tuberculosis H37Rv
aucuugucgaucugccc

SEQ ID NO: 3318463 - RNA, 15 nt, Mycobacterium tuberculosis H37Rv
aucuugugccaggcg

SEQ ID NO: 3318464 - RNA, 20 nt, Mycobacterium tuberculosis H37Rv
aucuuuccggcguauagccc

SEQ ID NO: 3318465 - RNA, 15 nt, Mycobacterium tuberculosis H37Rv
aucuuuggcggccgc

SEQ ID NO: 3318466 - RNA, 22 nt, Mycobacterium tuberculosis H37Rv
augaaccacggcaggcagggca

SEQ ID NO: 3318467 - RNA, 17 nt, Mycobacterium tuberculosis H37Rv
augaaccgggcagcaaa

SEQ ID NO: 3318468 - RNA, 16 nt, Mycobacterium tuberculosis H37Rv
augaacgcaaccgagg

SEQ ID NO: 3318469 - RNA, 15 nt, Mycobacterium tuberculosis H37Rv
augaacgccagcagc

SEQ ID NO: 3318470 - RNA, 23 nt, Mycobacterium tuberculosis H37Rv
augaacgccagcagcgcgaucug

SEQ ID NO: 3318471 - RNA, 15 nt, Mycobacterium tuberculosis H37Rv
augaacggaaucuug

SEQ ID NO: 3318472 - RNA, 17 nt, Mycobacterium tuberculosis H37Rv
augaacgggaucgaccc

SEQ ID NO: 3318473 - RNA, 13 nt, Mycobacterium tuberculosis H37Rv
augaagauccaga

SEQ ID NO: 3318474 - RNA, 16 nt, Mycobacterium tuberculosis H37Rv
augaagauggcgcgca

SEQ ID NO: 3318475 - RNA, 12 nt, Mycobacterium tuberculosis H37Rv
augaagccaccc

SEQ ID NO: 3318476 - RNA, 14 nt, Mycobacterium tuberculosis H37Rv
augacaaaccugca

SEQ ID NO: 3318477 - RNA, 21 nt, Mycobacterium tuberculosis H37Rv
augacaaaccugcaugcccag

SEQ ID NO: 3318478 - RNA, 16 nt, Mycobacterium tuberculosis H37Rv
augacaccgaccgggu

SEQ ID NO: 3318479 - RNA, 17 nt, Mycobacterium tuberculosis H37Rv
augaccagggucugcuc

SEQ ID NO: 3318480 - RNA, 15 nt, Mycobacterium tuberculosis H37Rv
augacccgcggguga

SEQ ID NO: 3318481 - RNA, 17 nt, Mycobacterium tuberculosis H37Rv
augaccgaagagcgcgc

SEQ ID NO: 3318482 - RNA, 14 nt, Mycobacterium tuberculosis H37Rv
augaccgacaggug

SEQ ID NO: 3318483 - RNA, 16 nt, Mycobacterium tuberculosis H37Rv
augaccgacaggugcu

SEQ ID NO: 3318484 - RNA, 15 nt, Mycobacterium tuberculosis H37Rv
augaccgcagcacuc

SEQ ID NO: 3318485 - RNA, 20 nt, Mycobacterium tuberculosis H37Rv
augaccgcagcacucccugg

SEQ ID NO: 3318486 - RNA, 14 nt, Mycobacterium tuberculosis H37Rv
augaccgccagcag

SEQ ID NO: 3318487 - RNA, 22 nt, Mycobacterium tuberculosis H37Rv
augaccgccagcagcaggccag

SEQ ID NO: 3318488 - RNA, 14 nt, Mycobacterium tuberculosis H37Rv
augaccgggcuggc

SEQ ID NO: 3318489 - RNA, 13 nt, Mycobacterium tuberculosis H37Rv
augaccucggcga

SEQ ID NO: 3318490 - RNA, 15 nt, Mycobacterium tuberculosis H37Rv
augaccucggcgacg

SEQ ID NO: 3318491 - RNA, 14 nt, Mycobacterium tuberculosis H37Rv
augaccucggcgau

SEQ ID NO: 3318492 - RNA, 14 nt, Mycobacterium tuberculosis H37Rv
augaccuggccgcc

SEQ ID NO: 3318493 - RNA, 21 nt, Mycobacterium tuberculosis H37Rv
augaccuguagaucagcagcg

SEQ ID NO: 3318494 - RNA, 14 nt, Mycobacterium tuberculosis H37Rv
augacgaacggacc

SEQ ID NO: 3318495 - RNA, 16 nt, Mycobacterium tuberculosis H37Rv
augacgacgaaccggu

SEQ ID NO: 3318496 - RNA, 15 nt, Mycobacterium tuberculosis H37Rv
augacgacggugacc

SEQ ID NO: 3318497 - RNA, 18 nt, Mycobacterium tuberculosis H37Rv
augacgagccgagccucg

SEQ ID NO: 3318498 - RNA, 14 nt, Mycobacterium tuberculosis H37Rv
augacgaucgcggc

SEQ ID NO: 3318499 - RNA, 21 nt, Mycobacterium tuberculosis H37Rv
augacgccgucggcgcgcacc

SEQ ID NO: 3318500 - RNA, 23 nt, Mycobacterium tuberculosis H37Rv
augacgguguacucgaagcgggc

SEQ ID NO: 3318501 - RNA, 16 nt, Mycobacterium tuberculosis H37Rv
augacgguuugcagcg

SEQ ID NO: 3318502 - RNA, 23 nt, Mycobacterium tuberculosis H37Rv
augacguacggcugugcgagcga

SEQ ID NO: 3318503 - RNA, 20 nt, Mycobacterium tuberculosis H37Rv
augacgugaguuucaccacu

SEQ ID NO: 3318504 - RNA, 16 nt, Mycobacterium tuberculosis H37Rv
augacguugcagccgg

SEQ ID NO: 3318505 - RNA, 17 nt, Mycobacterium tuberculosis H37Rv
augacguugcagccggc

SEQ ID NO: 3318506 - RNA, 19 nt, Mycobacterium tuberculosis H37Rv
augacugggcaaacccgga

SEQ ID NO: 3318507 - RNA, 23 nt, Mycobacterium tuberculosis H37Rv
augagcaugcccagcgcacggac

SEQ ID NO: 3318508 - RNA, 14 nt, Mycobacterium tuberculosis H37Rv
augagccaacccga

SEQ ID NO: 3318509 - RNA, 17 nt, Mycobacterium tuberculosis H37Rv
augagccgcagaugcac

SEQ ID NO: 3318510 - RNA, 17 nt, Mycobacterium tuberculosis H37Rv
augagccggaugucacg

SEQ ID NO: 3318511 - RNA, 21 nt, Mycobacterium tuberculosis H37Rv
augagcgcucgggcaaccgga

SEQ ID NO: 3318512 - RNA, 14 nt, Mycobacterium tuberculosis H37Rv
augagguucaucgc

SEQ ID NO: 3318513 - RNA, 15 nt, Mycobacterium tuberculosis H37Rv
augagguucaucgcc

SEQ ID NO: 3318514 - RNA, 16 nt, Mycobacterium tuberculosis H37Rv
augauagcggcgcagc

SEQ ID NO: 3318515 - RNA, 15 nt, Mycobacterium tuberculosis H37Rv
augaucccaugaagu

SEQ ID NO: 3318516 - RNA, 19 nt, Mycobacterium tuberculosis H37Rv
augaucccgccaccgaaca

SEQ ID NO: 3318517 - RNA, 12 nt, Mycobacterium tuberculosis H37Rv
augaucgccgac

SEQ ID NO: 3318518 - RNA, 20 nt, Mycobacterium tuberculosis H37Rv
augaucgcgaacaucgccag

SEQ ID NO: 3318519 - RNA, 14 nt, Mycobacterium tuberculosis H37Rv
augaucucaccacg

SEQ ID NO: 3318520 - RNA, 22 nt, Mycobacterium tuberculosis H37Rv
augaucuugccacuccaggagc

SEQ ID NO: 3318521 - RNA, 13 nt, Mycobacterium tuberculosis H37Rv
augaugaccggca

SEQ ID NO: 3318522 - RNA, 23 nt, Mycobacterium tuberculosis H37Rv
augaugccggcgccggcccgcag

SEQ ID NO: 3318523 - RNA, 20 nt, Mycobacterium tuberculosis H37Rv
augaugcggcgcagcgacgc

SEQ ID NO: 3318524 - RNA, 15 nt, Mycobacterium tuberculosis H37Rv
augauggcgcgaucg

SEQ ID NO: 3318525 - RNA, 16 nt, Mycobacterium tuberculosis H37Rv
augauguccucccauc

SEQ ID NO: 3318526 - RNA, 13 nt, Mycobacterium tuberculosis H37Rv
augaugucggccg

SEQ ID NO: 3318527 - RNA, 20 nt, Mycobacterium tuberculosis H37Rv
augauguugagcuggaccuc

SEQ ID NO: 3318528 - RNA, 14 nt, Mycobacterium tuberculosis H37Rv
augauugccaggac

SEQ ID NO: 3318529 - RNA, 15 nt, Mycobacterium tuberculosis H37Rv
augcaaacggauggu

SEQ ID NO: 3318530 - RNA, 16 nt, Mycobacterium tuberculosis H37Rv
augcacaaccgcugcu

SEQ ID NO: 3318531 - RNA, 17 nt, Mycobacterium tuberculosis H37Rv
augcaccucgcccugca

SEQ ID NO: 3318532 - RNA, 14 nt, Mycobacterium tuberculosis H37Rv
augcacgaucgcca

SEQ ID NO: 3318533 - RNA, 12 nt, Mycobacterium tuberculosis H37Rv
augcacgccggg

SEQ ID NO: 3318534 - RNA, 14 nt, Mycobacterium tuberculosis H37Rv
augcacgccgggca

SEQ ID NO: 3318535 - RNA, 20 nt, Mycobacterium tuberculosis H37Rv
augcacgucgagcaggcugg

SEQ ID NO: 3318536 - RNA, 20 nt, Mycobacterium tuberculosis H37Rv
augcagccccacuucgggcg

SEQ ID NO: 3318537 - RNA, 20 nt, Mycobacterium tuberculosis H37Rv
augcagcgggucgccgggcc

SEQ ID NO: 3318538 - RNA, 21 nt, Mycobacterium tuberculosis H37Rv
augcagcgguccagacaucag

SEQ ID NO: 3318539 - RNA, 16 nt, Mycobacterium tuberculosis H37Rv
augcagguggagugca

SEQ ID NO: 3318540 - RNA, 18 nt, Mycobacterium tuberculosis H37Rv
augcauccagcugcugcc

SEQ ID NO: 3318541 - RNA, 23 nt, Mycobacterium tuberculosis H37Rv
augcaucgcaacgagucuuucca

SEQ ID NO: 3318542 - RNA, 17 nt, Mycobacterium tuberculosis H37Rv
augccaagcuccaacca

SEQ ID NO: 3318543 - RNA, 14 nt, Mycobacterium tuberculosis H37Rv
augccacacacugc

SEQ ID NO: 3318544 - RNA, 20 nt, Mycobacterium tuberculosis H37Rv
augccacccagaugcagcgg

SEQ ID NO: 3318545 - RNA, 14 nt, Mycobacterium tuberculosis H37Rv
augccagaucggcc

SEQ ID NO: 3318546 - RNA, 15 nt, Mycobacterium tuberculosis H37Rv
augccagaucggcca

SEQ ID NO: 3318547 - RNA, 20 nt, Mycobacterium tuberculosis H37Rv
augccagcuguugcggggug

SEQ ID NO: 3318548 - RNA, 19 nt, Mycobacterium tuberculosis H37Rv
augccaggacuggcaccgc

SEQ ID NO: 3318549 - RNA, 20 nt, Mycobacterium tuberculosis H37Rv
augccaggacuggcaccgcc

SEQ ID NO: 3318550 - RNA, 19 nt, Mycobacterium tuberculosis H37Rv
augccauaaccggugggga

SEQ ID NO: 3318551 - RNA, 21 nt, Mycobacterium tuberculosis H37Rv
augccauagaugcccgcgauc

SEQ ID NO: 3318552 - RNA, 21 nt, Mycobacterium tuberculosis H37Rv
augccauaugggggaaagcuu

SEQ ID NO: 3318553 - RNA, 16 nt, Mycobacterium tuberculosis H37Rv
augccauuucgucguc

SEQ ID NO: 3318554 - RNA, 19 nt, Mycobacterium tuberculosis H37Rv
augccauuucgucgucgcu

SEQ ID NO: 3318555 - RNA, 20 nt, Mycobacterium tuberculosis H37Rv
augcccaagcccucgacguc

SEQ ID NO: 3318556 - RNA, 22 nt, Mycobacterium tuberculosis H37Rv
augcccacgcugccgcaguuca

SEQ ID NO: 3318557 - RNA, 23 nt, Mycobacterium tuberculosis H37Rv
augccccggagccagaaugcaag

SEQ ID NO: 3318558 - RNA, 19 nt, Mycobacterium tuberculosis H37Rv
augcccgacgagucgccgc

SEQ ID NO: 3318559 - RNA, 16 nt, Mycobacterium tuberculosis H37Rv
augcccgccguagacc

SEQ ID NO: 3318560 - RNA, 19 nt, Mycobacterium tuberculosis H37Rv
augcccgccguagaccagc

SEQ ID NO: 3318561 - RNA, 21 nt, Mycobacterium tuberculosis H37Rv
augcccgcugaucagauccuc

SEQ ID NO: 3318562 - RNA, 19 nt, Mycobacterium tuberculosis H37Rv
augcccuguucgauaagca

SEQ ID NO: 3318563 - RNA, 15 nt, Mycobacterium tuberculosis H37Rv
augcccuuggcgaug

SEQ ID NO: 3318564 - RNA, 15 nt, Mycobacterium tuberculosis H37Rv
augcccuuguaggcc

SEQ ID NO: 3318565 - RNA, 17 nt, Mycobacterium tuberculosis H37Rv
augcccuuguaggccau

SEQ ID NO: 3318566 - RNA, 18 nt, Mycobacterium tuberculosis H37Rv
augcccuuguaggccauc

SEQ ID NO: 3318567 - RNA, 12 nt, Mycobacterium tuberculosis H37Rv
augccgagaaga

SEQ ID NO: 3318568 - RNA, 20 nt, Mycobacterium tuberculosis H37Rv
augccgagaagugggcggua

SEQ ID NO: 3318569 - RNA, 18 nt, Mycobacterium tuberculosis H37Rv
augccgagcgaccguccc

SEQ ID NO: 3318570 - RNA, 13 nt, Mycobacterium tuberculosis H37Rv
augccgaucggcc

SEQ ID NO: 3318571 - RNA, 12 nt, Mycobacterium tuberculosis H37Rv
augccgaugccc

SEQ ID NO: 3318572 - RNA, 23 nt, Mycobacterium tuberculosis H37Rv
augccgccaugcgcaccagucca

SEQ ID NO: 3318573 - RNA, 19 nt, Mycobacterium tuberculosis H37Rv
augccgcccagcgaccgcu

SEQ ID NO: 3318574 - RNA, 15 nt, Mycobacterium tuberculosis H37Rv
augccgcccaucacc

SEQ ID NO: 3318575 - RNA, 19 nt, Mycobacterium tuberculosis H37Rv
augccgcccccauaacugc

SEQ ID NO: 3318576 - RNA, 18 nt, Mycobacterium tuberculosis H37Rv
augccgccccgcagcugc

SEQ ID NO: 3318577 - RNA, 12 nt, Mycobacterium tuberculosis H37Rv
augccgcccgca

SEQ ID NO: 3318578 - RNA, 19 nt, Mycobacterium tuberculosis H37Rv
augccgcccgcagcgucag

SEQ ID NO: 3318579 - RNA, 20 nt, Mycobacterium tuberculosis H37Rv
augccgcccgcagcgucagc

SEQ ID NO: 3318580 - RNA, 19 nt, Mycobacterium tuberculosis H37Rv
augccgcccgcgccgccgg

SEQ ID NO: 3318581 - RNA, 13 nt, Mycobacterium tuberculosis H37Rv
augccgccgaaga

SEQ ID NO: 3318582 - RNA, 10 nt, Mycobacterium tuberculosis H37Rv
augccgccgc

SEQ ID NO: 3318583 - RNA, 14 nt, Mycobacterium tuberculosis H37Rv
augccgccggcacc

SEQ ID NO: 3318584 - RNA, 21 nt, Mycobacterium tuberculosis H37Rv
augccgcgaucgugcagguug

SEQ ID NO: 3318585 - RNA, 20 nt, Mycobacterium tuberculosis H37Rv
augccgcgggacaucaccgc

SEQ ID NO: 3318586 - RNA, 21 nt, Mycobacterium tuberculosis H37Rv
augccgcgggacaucaccgca

SEQ ID NO: 3318587 - RNA, 13 nt, Mycobacterium tuberculosis H37Rv
augccgcggugga

SEQ ID NO: 3318588 - RNA, 18 nt, Mycobacterium tuberculosis H37Rv
augccggacgccaugccc

SEQ ID NO: 3318589 - RNA, 21 nt, Mycobacterium tuberculosis H37Rv
augccggacgccaugcccgca

SEQ ID NO: 3318590 - RNA, 21 nt, Mycobacterium tuberculosis H37Rv
augccggcccccacacaggca

SEQ ID NO: 3318591 - RNA, 18 nt, Mycobacterium tuberculosis H37Rv
augccggcgaaggccagc

SEQ ID NO: 3318592 - RNA, 22 nt, Mycobacterium tuberculosis H37Rv
augccggcgaaggccagcagaa

SEQ ID NO: 3318593 - RNA, 15 nt, Mycobacterium tuberculosis H37Rv
augccggcgagggcc

SEQ ID NO: 3318594 - RNA, 20 nt, Mycobacterium tuberculosis H37Rv
augccgggaaccaacaccag

SEQ ID NO: 3318595 - RNA, 18 nt, Mycobacterium tuberculosis H37Rv
augccggucauccgggcg

SEQ ID NO: 3318596 - RNA, 13 nt, Mycobacterium tuberculosis H37Rv
augccgguguuga

SEQ ID NO: 3318597 - RNA, 13 nt, Mycobacterium tuberculosis H37Rv
augccguagaguc

SEQ ID NO: 3318598 - RNA, 16 nt, Mycobacterium tuberculosis H37Rv
augccgucgccgguca

SEQ ID NO: 3318599 - RNA, 18 nt, Mycobacterium tuberculosis H37Rv
augccgucuuugucacgc

SEQ ID NO: 3318600 - RNA, 15 nt, Mycobacterium tuberculosis H37Rv
augccgugccgggcc

SEQ ID NO: 3318601 - RNA, 17 nt, Mycobacterium tuberculosis H37Rv
augccgugcugggccga

SEQ ID NO: 3318602 - RNA, 17 nt, Mycobacterium tuberculosis H37Rv
augccguggccgccaug

SEQ ID NO: 3318603 - RNA, 20 nt, Mycobacterium tuberculosis H37Rv
augccguugagugggagcua

SEQ ID NO: 3318604 - RNA, 17 nt, Mycobacterium tuberculosis H37Rv
augccguugaucgcaaa

SEQ ID NO: 3318605 - RNA, 14 nt, Mycobacterium tuberculosis H37Rv
augccuaccgggcc

SEQ ID NO: 3318606 - RNA, 12 nt, Mycobacterium tuberculosis H37Rv
augccucggcgg

SEQ ID NO: 3318607 - RNA, 16 nt, Mycobacterium tuberculosis H37Rv
augccugccucggcga

SEQ ID NO: 3318608 - RNA, 22 nt, Mycobacterium tuberculosis H37Rv
augccugcgaaacgcuggccac

SEQ ID NO: 3318609 - RNA, 19 nt, Mycobacterium tuberculosis H37Rv
augccugcgcgaugcgauu

SEQ ID NO: 3318610 - RNA, 16 nt, Mycobacterium tuberculosis H37Rv
augccuugaaacggug

SEQ ID NO: 3318611 - RNA, 15 nt, Mycobacterium tuberculosis H37Rv
augccuugaccgcgg

SEQ ID NO: 3318612 - RNA, 16 nt, Mycobacterium tuberculosis H37Rv
augccuuggcagccca

SEQ ID NO: 3318613 - RNA, 19 nt, Mycobacterium tuberculosis H37Rv
augcgacgaaccucggcgg

SEQ ID NO: 3318614 - RNA, 20 nt, Mycobacterium tuberculosis H37Rv
augcgacgcagaccguccag

SEQ ID NO: 3318615 - RNA, 18 nt, Mycobacterium tuberculosis H37Rv
augcgacgucaggguauc

SEQ ID NO: 3318616 - RNA, 14 nt, Mycobacterium tuberculosis H37Rv
augcgagaacgucg

SEQ ID NO: 3318617 - RNA, 12 nt, Mycobacterium tuberculosis H37Rv
augcgaugcccg

SEQ ID NO: 3318618 - RNA, 15 nt, Mycobacterium tuberculosis H37Rv
augcgaugcgcgccg

SEQ ID NO: 3318619 - RNA, 19 nt, Mycobacterium tuberculosis H37Rv
augcgauuccgcgucugcu

SEQ ID NO: 3318620 - RNA, 20 nt, Mycobacterium tuberculosis H37Rv
augcgauuccgcgucugcuc

SEQ ID NO: 3318621 - RNA, 17 nt, Mycobacterium tuberculosis H37Rv
augcgauucugcgucug

SEQ ID NO: 3318622 - RNA, 19 nt, Mycobacterium tuberculosis H37Rv
augcgauucugcgucugcu

SEQ ID NO: 3318623 - RNA, 20 nt, Mycobacterium tuberculosis H37Rv
augcgauucugcgucugcuc

SEQ ID NO: 3318624 - RNA, 20 nt, Mycobacterium tuberculosis H37Rv
augcgauucugcgucugcuu

SEQ ID NO: 3318625 - RNA, 15 nt, Mycobacterium tuberculosis H37Rv
augcgauugccgucg

SEQ ID NO: 3318626 - RNA, 18 nt, Mycobacterium tuberculosis H37Rv
augcgcaauagaccgcag

SEQ ID NO: 3318627 - RNA, 17 nt, Mycobacterium tuberculosis H37Rv
augcgcagugcaccgcg

SEQ ID NO: 3318628 - RNA, 22 nt, Mycobacterium tuberculosis H37Rv
augcgcagugcaccgcgucgua

SEQ ID NO: 3318629 - RNA, 16 nt, Mycobacterium tuberculosis H37Rv
augcgccagcgagcgc

SEQ ID NO: 3318630 - RNA, 14 nt, Mycobacterium tuberculosis H37Rv
augcgccaggcuga

SEQ ID NO: 3318631 - RNA, 22 nt, Mycobacterium tuberculosis H37Rv
augcgccaucucgacggugacc

SEQ ID NO: 3318632 - RNA, 21 nt, Mycobacterium tuberculosis H37Rv
augcgccauuucgagggcaac

SEQ ID NO: 3318633 - RNA, 17 nt, Mycobacterium tuberculosis H37Rv
augcgcggugaccgggu

SEQ ID NO: 3318634 - RNA, 16 nt, Mycobacterium tuberculosis H37Rv
augcgcguccccagcg

SEQ ID NO: 3318635 - RNA, 20 nt, Mycobacterium tuberculosis H37Rv
augcgcugcucacgcagcag

SEQ ID NO: 3318636 - RNA, 18 nt, Mycobacterium tuberculosis H37Rv
augcgcuggcgccgccgg

SEQ ID NO: 3318637 - RNA, 22 nt, Mycobacterium tuberculosis H37Rv
augcgcugucgcccucgaucgc

SEQ ID NO: 3318638 - RNA, 15 nt, Mycobacterium tuberculosis H37Rv
augcggaaaucggac

SEQ ID NO: 3318639 - RNA, 12 nt, Mycobacterium tuberculosis H37Rv
augcggaacgcc

SEQ ID NO: 3318640 - RNA, 20 nt, Mycobacterium tuberculosis H37Rv
augcggaucacaucggccau

SEQ ID NO: 3318641 - RNA, 13 nt, Mycobacterium tuberculosis H37Rv
augcggcaggugc

SEQ ID NO: 3318642 - RNA, 22 nt, Mycobacterium tuberculosis H37Rv
augcggcaggugcccaucgggu

SEQ ID NO: 3318643 - RNA, 20 nt, Mycobacterium tuberculosis H37Rv
augcggcccggguggcccgg

SEQ ID NO: 3318644 - RNA, 13 nt, Mycobacterium tuberculosis H37Rv
augcggcccucga

SEQ ID NO: 3318645 - RNA, 23 nt, Mycobacterium tuberculosis H37Rv
augcggcccucgaauucggccgg

SEQ ID NO: 3318646 - RNA, 13 nt, Mycobacterium tuberculosis H37Rv
augcggccggaug

SEQ ID NO: 3318647 - RNA, 17 nt, Mycobacterium tuberculosis H37Rv
augcggcggcgcucguc

SEQ ID NO: 3318648 - RNA, 23 nt, Mycobacterium tuberculosis H37Rv
augcggcggcgcucgucgaucuc

SEQ ID NO: 3318649 - RNA, 19 nt, Mycobacterium tuberculosis H37Rv
augcgggccaucaagcgau

SEQ ID NO: 3318650 - RNA, 16 nt, Mycobacterium tuberculosis H37Rv
augcgggccgccaggc

SEQ ID NO: 3318651 - RNA, 19 nt, Mycobacterium tuberculosis H37Rv
augcgggccgccaggcggc

SEQ ID NO: 3318652 - RNA, 19 nt, Mycobacterium tuberculosis H37Rv
augcgggcgaucucgaugu

SEQ ID NO: 3318653 - RNA, 15 nt, Mycobacterium tuberculosis H37Rv
augcgggcgccccac

SEQ ID NO: 3318654 - RNA, 19 nt, Mycobacterium tuberculosis H37Rv
augcggguaaaccaggugg

SEQ ID NO: 3318655 - RNA, 19 nt, Mycobacterium tuberculosis H37Rv
augcgggucugcggucauc

SEQ ID NO: 3318656 - RNA, 16 nt, Mycobacterium tuberculosis H37Rv
augcgguagucgccga

SEQ ID NO: 3318657 - RNA, 13 nt, Mycobacterium tuberculosis H37Rv
augcggucccucc

SEQ ID NO: 3318658 - RNA, 22 nt, Mycobacterium tuberculosis H37Rv
augcggucgucacggaccgcca

SEQ ID NO: 3318659 - RNA, 14 nt, Mycobacterium tuberculosis H37Rv
augcggugcggauc

SEQ ID NO: 3318660 - RNA, 22 nt, Mycobacterium tuberculosis H37Rv
augcggugguaggacgccagca

SEQ ID NO: 3318661 - RNA, 16 nt, Mycobacterium tuberculosis H37Rv
augcgguuagcagccg

SEQ ID NO: 3318662 - RNA, 20 nt, Mycobacterium tuberculosis H37Rv
augcgugaccagucgcggcg

SEQ ID NO: 3318663 - RNA, 13 nt, Mycobacterium tuberculosis H37Rv
augcgugccggca

SEQ ID NO: 3318664 - RNA, 14 nt, Mycobacterium tuberculosis H37Rv
augcguucggccgg

SEQ ID NO: 3318665 - RNA, 17 nt, Mycobacterium tuberculosis H37Rv
augcguucggccgggcc

SEQ ID NO: 3318666 - RNA, 13 nt, Mycobacterium tuberculosis H37Rv
augcucaccggga

SEQ ID NO: 3318667 - RNA, 15 nt, Mycobacterium tuberculosis H37Rv
augcucacgaucacc

SEQ ID NO: 3318668 - RNA, 17 nt, Mycobacterium tuberculosis H37Rv
augcucaggucaccggc

SEQ ID NO: 3318669 - RNA, 15 nt, Mycobacterium tuberculosis H37Rv
augcucgacaaccac

SEQ ID NO: 3318670 - RNA, 14 nt, Mycobacterium tuberculosis H37Rv
augcucgaucgcgu

SEQ ID NO: 3318671 - RNA, 18 nt, Mycobacterium tuberculosis H37Rv
augcucgccguugauguc

SEQ ID NO: 3318672 - RNA, 18 nt, Mycobacterium tuberculosis H37Rv
augcucggaaacagcgau

SEQ ID NO: 3318673 - RNA, 14 nt, Mycobacterium tuberculosis H37Rv
augcucgucccaga

SEQ ID NO: 3318674 - RNA, 16 nt, Mycobacterium tuberculosis H37Rv
augcucgucuugggcc

SEQ ID NO: 3318675 - RNA, 22 nt, Mycobacterium tuberculosis H37Rv
augcucgucuugggccgggaug

SEQ ID NO: 3318676 - RNA, 17 nt, Mycobacterium tuberculosis H37Rv
augcugagcgccaggcc

SEQ ID NO: 3318677 - RNA, 14 nt, Mycobacterium tuberculosis H37Rv
augcugcacccgga

SEQ ID NO: 3318678 - RNA, 18 nt, Mycobacterium tuberculosis H37Rv
augcugccagccauggcc

SEQ ID NO: 3318679 - RNA, 15 nt, Mycobacterium tuberculosis H37Rv
augcugcgcgccguu

SEQ ID NO: 3318680 - RNA, 20 nt, Mycobacterium tuberculosis H37Rv
augcuggcaaaguaucgcag

SEQ ID NO: 3318681 - RNA, 23 nt, Mycobacterium tuberculosis H37Rv
augcuggcagcggccuccgggcc

SEQ ID NO: 3318682 - RNA, 14 nt, Mycobacterium tuberculosis H37Rv
augcuggcagcucg

SEQ ID NO: 3318683 - RNA, 21 nt, Mycobacterium tuberculosis H37Rv
augcugggcccgccagcccag

SEQ ID NO: 3318684 - RNA, 23 nt, Mycobacterium tuberculosis H37Rv
augcugggcccgccagcccagca

SEQ ID NO: 3318685 - RNA, 17 nt, Mycobacterium tuberculosis H37Rv
augcuggucgugccgcc

SEQ ID NO: 3318686 - RNA, 17 nt, Mycobacterium tuberculosis H37Rv
auggaaggcggccaggu

SEQ ID NO: 3318687 - RNA, 16 nt, Mycobacterium tuberculosis H37Rv
auggacaacagcuugg

SEQ ID NO: 3318688 - RNA, 13 nt, Mycobacterium tuberculosis H37Rv
auggacaccaacc

SEQ ID NO: 3318689 - RNA, 17 nt, Mycobacterium tuberculosis H37Rv
auggacaccaacccacc

SEQ ID NO: 3318690 - RNA, 13 nt, Mycobacterium tuberculosis H37Rv
auggacaccaccu

SEQ ID NO: 3318691 - RNA, 15 nt, Mycobacterium tuberculosis H37Rv
auggaccgccagggc

SEQ ID NO: 3318692 - RNA, 22 nt, Mycobacterium tuberculosis H37Rv
auggacgccauggugaacgcga

SEQ ID NO: 3318693 - RNA, 18 nt, Mycobacterium tuberculosis H37Rv
auggagccgcgaccaugg

SEQ ID NO: 3318694 - RNA, 20 nt, Mycobacterium tuberculosis H37Rv
auggaucccacgaguuggcc

SEQ ID NO: 3318695 - RNA, 15 nt, Mycobacterium tuberculosis H37Rv
auggaucucggcguc

SEQ ID NO: 3318696 - RNA, 17 nt, Mycobacterium tuberculosis H37Rv
auggaugggucgaccgg

SEQ ID NO: 3318697 - RNA, 18 nt, Mycobacterium tuberculosis H37Rv
auggaugggucgaccgga

SEQ ID NO: 3318698 - RNA, 21 nt, Mycobacterium tuberculosis H37Rv
auggcaaccagcuucucagca

SEQ ID NO: 3318699 - RNA, 18 nt, Mycobacterium tuberculosis H37Rv
auggcaagggccgacguc

SEQ ID NO: 3318700 - RNA, 16 nt, Mycobacterium tuberculosis H37Rv
auggcaauauccggga

SEQ ID NO: 3318701 - RNA, 17 nt, Mycobacterium tuberculosis H37Rv
auggcacgcgggaagug

SEQ ID NO: 3318702 - RNA, 13 nt, Mycobacterium tuberculosis H37Rv
auggcagcgccga

SEQ ID NO: 3318703 - RNA, 22 nt, Mycobacterium tuberculosis H37Rv
auggcauugcgcccaccgaaac

SEQ ID NO: 3318704 - RNA, 21 nt, Mycobacterium tuberculosis H37Rv
auggccacccgcggaauccgc

SEQ ID NO: 3318705 - RNA, 18 nt, Mycobacterium tuberculosis H37Rv
auggccaccgaacgcggc

SEQ ID NO: 3318706 - RNA, 17 nt, Mycobacterium tuberculosis H37Rv
auggccagcgcggcguc

SEQ ID NO: 3318707 - RNA, 19 nt, Mycobacterium tuberculosis H37Rv
auggccaggcuggcgucac

SEQ ID NO: 3318708 - RNA, 21 nt, Mycobacterium tuberculosis H37Rv
auggccagguuguagacggca

SEQ ID NO: 3318709 - RNA, 23 nt, Mycobacterium tuberculosis H37Rv
auggccagguuguagacggcacc

SEQ ID NO: 3318710 - RNA, 14 nt, Mycobacterium tuberculosis H37Rv
auggccaucuggcc

SEQ ID NO: 3318711 - RNA, 15 nt, Mycobacterium tuberculosis H37Rv
auggccaugguggag

SEQ ID NO: 3318712 - RNA, 17 nt, Mycobacterium tuberculosis H37Rv
auggccccugucauguc

SEQ ID NO: 3318713 - RNA, 23 nt, Mycobacterium tuberculosis H37Rv
auggccccugucauguccugggc

SEQ ID NO: 3318714 - RNA, 18 nt, Mycobacterium tuberculosis H37Rv
auggcccgaucgaccgcu

SEQ ID NO: 3318715 - RNA, 22 nt, Mycobacterium tuberculosis H37Rv
auggcccgcacuugcccuagau

SEQ ID NO: 3318716 - RNA, 19 nt, Mycobacterium tuberculosis H37Rv
auggcccggcucacagcac

SEQ ID NO: 3318717 - RNA, 16 nt, Mycobacterium tuberculosis H37Rv
auggcccgucgugacc

SEQ ID NO: 3318718 - RNA, 20 nt, Mycobacterium tuberculosis H37Rv
auggcccuuccggccgacac

SEQ ID NO: 3318719 - RNA, 19 nt, Mycobacterium tuberculosis H37Rv
auggccgaacauucccaug

SEQ ID NO: 3318720 - RNA, 17 nt, Mycobacterium tuberculosis H37Rv
auggccgaccagccgau

SEQ ID NO: 3318721 - RNA, 16 nt, Mycobacterium tuberculosis H37Rv
auggccgccaccgcga

SEQ ID NO: 3318722 - RNA, 11 nt, Mycobacterium tuberculosis H37Rv
auggccgccga

SEQ ID NO: 3318723 - RNA, 18 nt, Mycobacterium tuberculosis H37Rv
auggccgccuugaggccc

SEQ ID NO: 3318724 - RNA, 13 nt, Mycobacterium tuberculosis H37Rv
auggccgcgauga

SEQ ID NO: 3318725 - RNA, 23 nt, Mycobacterium tuberculosis H37Rv
auggccgcgcccgccucgaccgc

SEQ ID NO: 3318726 - RNA, 15 nt, Mycobacterium tuberculosis H37Rv
auggccgcgugcagc

SEQ ID NO: 3318727 - RNA, 12 nt, Mycobacterium tuberculosis H37Rv
auggccgucagc

SEQ ID NO: 3318728 - RNA, 16 nt, Mycobacterium tuberculosis H37Rv
auggccuugcugcgcg

SEQ ID NO: 3318729 - RNA, 20 nt, Mycobacterium tuberculosis H37Rv
auggcgacgaacgccgucag

SEQ ID NO: 3318730 - RNA, 22 nt, Mycobacterium tuberculosis H37Rv
auggcgagcguuuggacgggcg

SEQ ID NO: 3318731 - RNA, 16 nt, Mycobacterium tuberculosis H37Rv
auggcgcaccggcguc

SEQ ID NO: 3318732 - RNA, 18 nt, Mycobacterium tuberculosis H37Rv
auggcgcaccggcgucgg

SEQ ID NO: 3318733 - RNA, 22 nt, Mycobacterium tuberculosis H37Rv
auggcgcgcaacguagccagca

SEQ ID NO: 3318734 - RNA, 24 nt, Mycobacterium tuberculosis H37Rv
auggcggcauagccgaacagcgga

SEQ ID NO: 3318735 - RNA, 12 nt, Mycobacterium tuberculosis H37Rv
auggcggccacc

SEQ ID NO: 3318736 - RNA, 17 nt, Mycobacterium tuberculosis H37Rv
auggcggccaccgucag

SEQ ID NO: 3318737 - RNA, 19 nt, Mycobacterium tuberculosis H37Rv
auggcggccgggucgguga

SEQ ID NO: 3318738 - RNA, 22 nt, Mycobacterium tuberculosis H37Rv
auggcggcuucgacgucggcga

SEQ ID NO: 3318739 - RNA, 14 nt, Mycobacterium tuberculosis H37Rv
auggcggugagcac

SEQ ID NO: 3318740 - RNA, 13 nt, Mycobacterium tuberculosis H37Rv
auggcgucgccgg

SEQ ID NO: 3318741 - RNA, 23 nt, Mycobacterium tuberculosis H37Rv
auggcucaccccguucgaggucg

SEQ ID NO: 3318742 - RNA, 21 nt, Mycobacterium tuberculosis H37Rv
auggcugagcccgccgcgacc

SEQ ID NO: 3318743 - RNA, 13 nt, Mycobacterium tuberculosis H37Rv
auggcuugcucug

SEQ ID NO: 3318744 - RNA, 16 nt, Mycobacterium tuberculosis H37Rv
auggcuugcucugcgc

SEQ ID NO: 3318745 - RNA, 13 nt, Mycobacterium tuberculosis H37Rv
auggcuuggacca

SEQ ID NO: 3318746 - RNA, 17 nt, Mycobacterium tuberculosis H37Rv
augggagucgucguguu

SEQ ID NO: 3318747 - RNA, 23 nt, Mycobacterium tuberculosis H37Rv
augggauucggccagacgcucuu

SEQ ID NO: 3318748 - RNA, 22 nt, Mycobacterium tuberculosis H37Rv
augggcagccgcccgcccaccu

SEQ ID NO: 3318749 - RNA, 11 nt, Mycobacterium tuberculosis H37Rv
augggccaccc

SEQ ID NO: 3318750 - RNA, 20 nt, Mycobacterium tuberculosis H37Rv
augggccgguuccucagcgg

SEQ ID NO: 3318751 - RNA, 23 nt, Mycobacterium tuberculosis H37Rv
augggcgccaucccgccgcccgc

SEQ ID NO: 3318752 - RNA, 18 nt, Mycobacterium tuberculosis H37Rv
augggcgcguagcucagc

SEQ ID NO: 3318753 - RNA, 22 nt, Mycobacterium tuberculosis H37Rv
augggcggauaguucaccacau

SEQ ID NO: 3318754 - RNA, 21 nt, Mycobacterium tuberculosis H37Rv
augggcggguggugcggccgu

SEQ ID NO: 3318755 - RNA, 17 nt, Mycobacterium tuberculosis H37Rv
augggcgguuccacgcu

SEQ ID NO: 3318756 - RNA, 22 nt, Mycobacterium tuberculosis H37Rv
augggcgucggucaccuggcga

SEQ ID NO: 3318757 - RNA, 14 nt, Mycobacterium tuberculosis H37Rv
augggcuaccgaga

SEQ ID NO: 3318758 - RNA, 18 nt, Mycobacterium tuberculosis H37Rv
auggggccaacaccucaa

SEQ ID NO: 3318759 - RNA, 23 nt, Mycobacterium tuberculosis H37Rv
augggggugcuuccucgcgagcu

SEQ ID NO: 3318760 - RNA, 19 nt, Mycobacterium tuberculosis H37Rv
auggggucagcucgccagc

SEQ ID NO: 3318761 - RNA, 21 nt, Mycobacterium tuberculosis H37Rv
augggguguuugucgcggugg

SEQ ID NO: 3318762 - RNA, 13 nt, Mycobacterium tuberculosis H37Rv
auggguagccgcc

SEQ ID NO: 3318763 - RNA, 15 nt, Mycobacterium tuberculosis H37Rv
augggucaccucgga

SEQ ID NO: 3318764 - RNA, 14 nt, Mycobacterium tuberculosis H37Rv
augggucaggccga

SEQ ID NO: 3318765 - RNA, 21 nt, Mycobacterium tuberculosis H37Rv
augguacccgcgccgcgcauc

SEQ ID NO: 3318766 - RNA, 13 nt, Mycobacterium tuberculosis H37Rv
augguaccgccac

SEQ ID NO: 3318767 - RNA, 22 nt, Mycobacterium tuberculosis H37Rv
augguaccgccacuggcgcuga

SEQ ID NO: 3318768 - RNA, 13 nt, Mycobacterium tuberculosis H37Rv
auggucaaccgcg

SEQ ID NO: 3318769 - RNA, 18 nt, Mycobacterium tuberculosis H37Rv
auggucaccagcuggaac

SEQ ID NO: 3318770 - RNA, 16 nt, Mycobacterium tuberculosis H37Rv
auggucacggcgucga

SEQ ID NO: 3318771 - RNA, 11 nt, Mycobacterium tuberculosis H37Rv
auggucagcag

SEQ ID NO: 3318772 - RNA, 13 nt, Mycobacterium tuberculosis H37Rv
auggucagcagaa

SEQ ID NO: 3318773 - RNA, 16 nt, Mycobacterium tuberculosis H37Rv
auggucagcuggccgc

SEQ ID NO: 3318774 - RNA, 18 nt, Mycobacterium tuberculosis H37Rv
auggucgaauaguugacc

SEQ ID NO: 3318775 - RNA, 21 nt, Mycobacterium tuberculosis H37Rv
auggucucccggcugaugccu

SEQ ID NO: 3318776 - RNA, 21 nt, Mycobacterium tuberculosis H37Rv
auggugaacgcgaauaccaga

SEQ ID NO: 3318777 - RNA, 16 nt, Mycobacterium tuberculosis H37Rv
auggugaaguugccgg

SEQ ID NO: 3318778 - RNA, 22 nt, Mycobacterium tuberculosis H37Rv
auggugaaguugccggucaggc

SEQ ID NO: 3318779 - RNA, 20 nt, Mycobacterium tuberculosis H37Rv
auggugaugggggagccggu

SEQ ID NO: 3318780 - RNA, 20 nt, Mycobacterium tuberculosis H37Rv
auggugcaggacgaacgcgu

SEQ ID NO: 3318781 - RNA, 15 nt, Mycobacterium tuberculosis H37Rv
auggugggucgacga

SEQ ID NO: 3318782 - RNA, 14 nt, Mycobacterium tuberculosis H37Rv
augguggugccgac

SEQ ID NO: 3318783 - RNA, 20 nt, Mycobacterium tuberculosis H37Rv
augguggugccgaccugucc

SEQ ID NO: 3318784 - RNA, 15 nt, Mycobacterium tuberculosis H37Rv
auggugguggcccgg

SEQ ID NO: 3318785 - RNA, 16 nt, Mycobacterium tuberculosis H37Rv
auggugguggcccggc

SEQ ID NO: 3318786 - RNA, 15 nt, Mycobacterium tuberculosis H37Rv
augguggugggugau

SEQ ID NO: 3318787 - RNA, 21 nt, Mycobacterium tuberculosis H37Rv
augguggugggugaugguacc

SEQ ID NO: 3318788 - RNA, 22 nt, Mycobacterium tuberculosis H37Rv
auggugugcacggcuucggcga

SEQ ID NO: 3318789 - RNA, 16 nt, Mycobacterium tuberculosis H37Rv
auggugugcagcagca

SEQ ID NO: 3318790 - RNA, 20 nt, Mycobacterium tuberculosis H37Rv
augguucgcacaccuccucg

SEQ ID NO: 3318791 - RNA, 21 nt, Mycobacterium tuberculosis H37Rv
augguucgcacaccuccucga

SEQ ID NO: 3318792 - RNA, 16 nt, Mycobacterium tuberculosis H37Rv
augguugcgacggcgu

SEQ ID NO: 3318793 - RNA, 22 nt, Mycobacterium tuberculosis H37Rv
augguugcucgagcgguggcgu

SEQ ID NO: 3318794 - RNA, 23 nt, Mycobacterium tuberculosis H37Rv
auguaaccguagcccugcucagc

SEQ ID NO: 3318795 - RNA, 15 nt, Mycobacterium tuberculosis H37Rv
auguaggcuucgccg

SEQ ID NO: 3318796 - RNA, 14 nt, Mycobacterium tuberculosis H37Rv
auguaguccagcuc

SEQ ID NO: 3318797 - RNA, 14 nt, Mycobacterium tuberculosis H37Rv
auguauuccaggcg

SEQ ID NO: 3318798 - RNA, 14 nt, Mycobacterium tuberculosis H37Rv
augucacccucccg

SEQ ID NO: 3318799 - RNA, 18 nt, Mycobacterium tuberculosis H37Rv
augucagcggccugcucg

SEQ ID NO: 3318800 - RNA, 20 nt, Mycobacterium tuberculosis H37Rv
augucagugaucaccaaccc

SEQ ID NO: 3318801 - RNA, 17 nt, Mycobacterium tuberculosis H37Rv
augucagugccccgccc

SEQ ID NO: 3318802 - RNA, 20 nt, Mycobacterium tuberculosis H37Rv
auguccaccgcggcgucgcc

SEQ ID NO: 3318803 - RNA, 14 nt, Mycobacterium tuberculosis H37Rv
auguccagguggcg

SEQ ID NO: 3318804 - RNA, 18 nt, Mycobacterium tuberculosis H37Rv
auguccuauuugcagccu

SEQ ID NO: 3318805 - RNA, 15 nt, Mycobacterium tuberculosis H37Rv
auguccucgauccgg

SEQ ID NO: 3318806 - RNA, 20 nt, Mycobacterium tuberculosis H37Rv
auguccugggccgccgcccu

SEQ ID NO: 3318807 - RNA, 19 nt, Mycobacterium tuberculosis H37Rv
auguccuuggagaugucgg

SEQ ID NO: 3318808 - RNA, 21 nt, Mycobacterium tuberculosis H37Rv
augucgaagaaccggccgacg

SEQ ID NO: 3318809 - RNA, 13 nt, Mycobacterium tuberculosis H37Rv
augucgaccgcga

SEQ ID NO: 3318810 - RNA, 17 nt, Mycobacterium tuberculosis H37Rv
augucgacgagcaccgc

SEQ ID NO: 3318811 - RNA, 15 nt, Mycobacterium tuberculosis H37Rv
augucgacggucaga

SEQ ID NO: 3318812 - RNA, 17 nt, Mycobacterium tuberculosis H37Rv
augucgauguccacgcc

SEQ ID NO: 3318813 - RNA, 20 nt, Mycobacterium tuberculosis H37Rv
augucgauuucgaugacgaa

SEQ ID NO: 3318814 - RNA, 16 nt, Mycobacterium tuberculosis H37Rv
augucgccgccuggcu

SEQ ID NO: 3318815 - RNA, 14 nt, Mycobacterium tuberculosis H37Rv
augucgcgccaggc

SEQ ID NO: 3318816 - RNA, 17 nt, Mycobacterium tuberculosis H37Rv
augucgcggucgcccgc

SEQ ID NO: 3318817 - RNA, 16 nt, Mycobacterium tuberculosis H37Rv
augucgcugccgccgc

SEQ ID NO: 3318818 - RNA, 21 nt, Mycobacterium tuberculosis H37Rv
augucgcugccgccgccggcg

SEQ ID NO: 3318819 - RNA, 19 nt, Mycobacterium tuberculosis H37Rv
augucgcugggugcgcgaa

SEQ ID NO: 3318820 - RNA, 13 nt, Mycobacterium tuberculosis H37Rv
augucggcaggua

SEQ ID NO: 3318821 - RNA, 20 nt, Mycobacterium tuberculosis H37Rv
augucggccaccggcgucug

SEQ ID NO: 3318822 - RNA, 17 nt, Mycobacterium tuberculosis H37Rv
augucggcugguggggg

SEQ ID NO: 3318823 - RNA, 14 nt, Mycobacterium tuberculosis H37Rv
augucgggccaggc

SEQ ID NO: 3318824 - RNA, 15 nt, Mycobacterium tuberculosis H37Rv
augucgggccaggcg

SEQ ID NO: 3318825 - RNA, 13 nt, Mycobacterium tuberculosis H37Rv
augucggugauca

SEQ ID NO: 3318826 - RNA, 12 nt, Mycobacterium tuberculosis H37Rv
augucgucgaca

SEQ ID NO: 3318827 - RNA, 17 nt, Mycobacterium tuberculosis H37Rv
augucgucgaccaggcc

SEQ ID NO: 3318828 - RNA, 19 nt, Mycobacterium tuberculosis H37Rv
augucuucgaucuccaggc

SEQ ID NO: 3318829 - RNA, 18 nt, Mycobacterium tuberculosis H37Rv
augugaccgaacaacagc

SEQ ID NO: 3318830 - RNA, 21 nt, Mycobacterium tuberculosis H37Rv
augugcauucgggauucgggc

SEQ ID NO: 3318831 - RNA, 23 nt, Mycobacterium tuberculosis H37Rv
augugccaggugcggugaucgau

SEQ ID NO: 3318832 - RNA, 18 nt, Mycobacterium tuberculosis H37Rv
augugcccaugaugcucg

SEQ ID NO: 3318833 - RNA, 20 nt, Mycobacterium tuberculosis H37Rv
augugccgauuggccugcca

SEQ ID NO: 3318834 - RNA, 14 nt, Mycobacterium tuberculosis H37Rv
augugcgccaccuc

SEQ ID NO: 3318835 - RNA, 21 nt, Mycobacterium tuberculosis H37Rv
augugcggugaccgugaacgg

SEQ ID NO: 3318836 - RNA, 19 nt, Mycobacterium tuberculosis H37Rv
auguggccgccgucgacgu

SEQ ID NO: 3318837 - RNA, 14 nt, Mycobacterium tuberculosis H37Rv
auguggccgugggu

SEQ ID NO: 3318838 - RNA, 15 nt, Mycobacterium tuberculosis H37Rv
auguggcgucggagu

SEQ ID NO: 3318839 - RNA, 14 nt, Mycobacterium tuberculosis H37Rv
auguggucggcugu

SEQ ID NO: 3318840 - RNA, 15 nt, Mycobacterium tuberculosis H37Rv
auguguuugaucacc

SEQ ID NO: 3318841 - RNA, 16 nt, Mycobacterium tuberculosis H37Rv
auguucucgaccgcgu

SEQ ID NO: 3318842 - RNA, 16 nt, Mycobacterium tuberculosis H37Rv
auguucugcgggggua

SEQ ID NO: 3318843 - RNA, 15 nt, Mycobacterium tuberculosis H37Rv
auguucuuggucacc

SEQ ID NO: 3318844 - RNA, 20 nt, Mycobacterium tuberculosis H37Rv
auguugaucguugugcaccc

SEQ ID NO: 3318845 - RNA, 16 nt, Mycobacterium tuberculosis H37Rv
auguugcccugcaacc

SEQ ID NO: 3318846 - RNA, 19 nt, Mycobacterium tuberculosis H37Rv
auguugccggaguugaagu

SEQ ID NO: 3318847 - RNA, 18 nt, Mycobacterium tuberculosis H37Rv
auguuggcagggccagcg

SEQ ID NO: 3318848 - RNA, 21 nt, Mycobacterium tuberculosis H37Rv
auguuggcagggccagcggca

SEQ ID NO: 3318849 - RNA, 16 nt, Mycobacterium tuberculosis H37Rv
auguuggccggcgcca

SEQ ID NO: 3318850 - RNA, 19 nt, Mycobacterium tuberculosis H37Rv
auguuggccguaccgguga

SEQ ID NO: 3318851 - RNA, 16 nt, Mycobacterium tuberculosis H37Rv
auguuguucagcaggc

SEQ ID NO: 3318852 - RNA, 16 nt, Mycobacterium tuberculosis H37Rv
auuaaaaagcccagcg

SEQ ID NO: 3318853 - RNA, 14 nt, Mycobacterium tuberculosis H37Rv
auuaacugcuucca

SEQ ID NO: 3318854 - RNA, 21 nt, Mycobacterium tuberculosis H37Rv
auuacgcaccgaggccgccga

SEQ ID NO: 3318855 - RNA, 12 nt, Mycobacterium tuberculosis H37Rv
auuacggugauc

SEQ ID NO: 3318856 - RNA, 20 nt, Mycobacterium tuberculosis H37Rv
auuaggggcuuuugcgucug

SEQ ID NO: 3318857 - RNA, 20 nt, Mycobacterium tuberculosis H37Rv
auuauugauuacguggauca

SEQ ID NO: 3318858 - RNA, 16 nt, Mycobacterium tuberculosis H37Rv
auucaacagcaccgcg

SEQ ID NO: 3318859 - RNA, 17 nt, Mycobacterium tuberculosis H37Rv
auucacgacgccgagca

SEQ ID NO: 3318860 - RNA, 21 nt, Mycobacterium tuberculosis H37Rv
auucacgagccgcucuagcgu

SEQ ID NO: 3318861 - RNA, 16 nt, Mycobacterium tuberculosis H37Rv
auucacgaugcucgcc

SEQ ID NO: 3318862 - RNA, 14 nt, Mycobacterium tuberculosis H37Rv
auucacgcaccaca

SEQ ID NO: 3318863 - RNA, 23 nt, Mycobacterium tuberculosis H37Rv
auucacgggugcgccacaaccgu

SEQ ID NO: 3318864 - RNA, 20 nt, Mycobacterium tuberculosis H37Rv
auucagauagucgccgccgu

SEQ ID NO: 3318865 - RNA, 22 nt, Mycobacterium tuberculosis H37Rv
auucagcggcaacgaucgacac

SEQ ID NO: 3318866 - RNA, 13 nt, Mycobacterium tuberculosis H37Rv
auucaucacggga

SEQ ID NO: 3318867 - RNA, 14 nt, Mycobacterium tuberculosis H37Rv
auuccacaggggcc

SEQ ID NO: 3318868 - RNA, 13 nt, Mycobacterium tuberculosis H37Rv
auuccaccgccga

SEQ ID NO: 3318869 - RNA, 16 nt, Mycobacterium tuberculosis H37Rv
auuccacgaucggcuc

SEQ ID NO: 3318870 - RNA, 14 nt, Mycobacterium tuberculosis H37Rv
auuccagaucaacg

SEQ ID NO: 3318871 - RNA, 15 nt, Mycobacterium tuberculosis H37Rv
auuccagaucaacgc

SEQ ID NO: 3318872 - RNA, 17 nt, Mycobacterium tuberculosis H37Rv
auuccagaucaacgcgu

SEQ ID NO: 3318873 - RNA, 16 nt, Mycobacterium tuberculosis H37Rv
auuccagccagccgcc

SEQ ID NO: 3318874 - RNA, 14 nt, Mycobacterium tuberculosis H37Rv
auuccagccccccg

SEQ ID NO: 3318875 - RNA, 13 nt, Mycobacterium tuberculosis H37Rv
auuccagccggug

SEQ ID NO: 3318876 - RNA, 20 nt, Mycobacterium tuberculosis H37Rv
auuccagccggugccgccgu

SEQ ID NO: 3318877 - RNA, 23 nt, Mycobacterium tuberculosis H37Rv
auuccaugucgucgacaaacagc

SEQ ID NO: 3318878 - RNA, 22 nt, Mycobacterium tuberculosis H37Rv
auucccaauucagauagucgcc

SEQ ID NO: 3318879 - RNA, 12 nt, Mycobacterium tuberculosis H37Rv
auuccccagccg

SEQ ID NO: 3318880 - RNA, 13 nt, Mycobacterium tuberculosis H37Rv
auuccccagccgc

SEQ ID NO: 3318881 - RNA, 17 nt, Mycobacterium tuberculosis H37Rv
auucccgcccagcagca

SEQ ID NO: 3318882 - RNA, 18 nt, Mycobacterium tuberculosis H37Rv
auucccgcccagcagcac

SEQ ID NO: 3318883 - RNA, 18 nt, Mycobacterium tuberculosis H37Rv
auucccgccuucucccgc

SEQ ID NO: 3318884 - RNA, 21 nt, Mycobacterium tuberculosis H37Rv
auuccgcgcguccgucggcga

SEQ ID NO: 3318885 - RNA, 17 nt, Mycobacterium tuberculosis H37Rv
auuccgcgucugcucgg

SEQ ID NO: 3318886 - RNA, 22 nt, Mycobacterium tuberculosis H37Rv
auuccgcucacgaagaccgcgu

SEQ ID NO: 3318887 - RNA, 21 nt, Mycobacterium tuberculosis H37Rv
auuccggaguucuuguagccg

SEQ ID NO: 3318888 - RNA, 17 nt, Mycobacterium tuberculosis H37Rv
auuccggcgcggccggc

SEQ ID NO: 3318889 - RNA, 21 nt, Mycobacterium tuberculosis H37Rv
auuccggcggagcgggccagc

SEQ ID NO: 3318890 - RNA, 17 nt, Mycobacterium tuberculosis H37Rv
auuccggcggccacgcc

SEQ ID NO: 3318891 - RNA, 17 nt, Mycobacterium tuberculosis H37Rv
auuccggcucaccgauc

SEQ ID NO: 3318892 - RNA, 14 nt, Mycobacterium tuberculosis H37Rv
auuccgggccuggc

SEQ ID NO: 3318893 - RNA, 15 nt, Mycobacterium tuberculosis H37Rv
auuccgguggcaucc

SEQ ID NO: 3318894 - RNA, 15 nt, Mycobacterium tuberculosis H37Rv
auuccuacgccgcca

SEQ ID NO: 3318895 - RNA, 21 nt, Mycobacterium tuberculosis H37Rv
auuccucaaggucggccaggc

SEQ ID NO: 3318896 - RNA, 13 nt, Mycobacterium tuberculosis H37Rv
auuccuugaugcc

SEQ ID NO: 3318897 - RNA, 23 nt, Mycobacterium tuberculosis H37Rv
auucgacucuuucuuugccggag

SEQ ID NO: 3318898 - RNA, 19 nt, Mycobacterium tuberculosis H37Rv
auucgaugccguaggcggc

SEQ ID NO: 3318899 - RNA, 20 nt, Mycobacterium tuberculosis H37Rv
auucgauguccucgacaccc

SEQ ID NO: 3318900 - RNA, 16 nt, Mycobacterium tuberculosis H37Rv
auucgcaaucggcguu

SEQ ID NO: 3318901 - RNA, 18 nt, Mycobacterium tuberculosis H37Rv
auucgcccggccgcagcg

SEQ ID NO: 3318902 - RNA, 12 nt, Mycobacterium tuberculosis H37Rv
auucgccgggcg

SEQ ID NO: 3318903 - RNA, 15 nt, Mycobacterium tuberculosis H37Rv
auucgcgcuggccau

SEQ ID NO: 3318904 - RNA, 17 nt, Mycobacterium tuberculosis H37Rv
auucgcggcagccggcg

SEQ ID NO: 3318905 - RNA, 23 nt, Mycobacterium tuberculosis H37Rv
auucgcucaccaccgaccucgac

SEQ ID NO: 3318906 - RNA, 16 nt, Mycobacterium tuberculosis H37Rv
auucgcuggcgaugcc

SEQ ID NO: 3318907 - RNA, 15 nt, Mycobacterium tuberculosis H37Rv
auucggacucgccga

SEQ ID NO: 3318908 - RNA, 12 nt, Mycobacterium tuberculosis H37Rv
auucggccgcga

SEQ ID NO: 3318909 - RNA, 22 nt, Mycobacterium tuberculosis H37Rv
auucggcggcauguucaucgca

SEQ ID NO: 3318910 - RNA, 16 nt, Mycobacterium tuberculosis H37Rv
auucggcugccaccgc

SEQ ID NO: 3318911 - RNA, 17 nt, Mycobacterium tuberculosis H37Rv
auucggcugccaccgca

SEQ ID NO: 3318912 - RNA, 17 nt, Mycobacterium tuberculosis H37Rv
auucgggaucggccggc

SEQ ID NO: 3318913 - RNA, 18 nt, Mycobacterium tuberculosis H37Rv
auucguggagccggccgu

SEQ ID NO: 3318914 - RNA, 18 nt, Mycobacterium tuberculosis H37Rv
auucguuggcgaacuggu

SEQ ID NO: 3318915 - RNA, 18 nt, Mycobacterium tuberculosis H37Rv
auucguuuguagucacgg

SEQ ID NO: 3318916 - RNA, 19 nt, Mycobacterium tuberculosis H37Rv
auucuccgcccucaguuca

SEQ ID NO: 3318917 - RNA, 20 nt, Mycobacterium tuberculosis H37Rv
auucugcgucugcucgccgu

SEQ ID NO: 3318918 - RNA, 22 nt, Mycobacterium tuberculosis H37Rv
auucugugucugcucgcgccgc

SEQ ID NO: 3318919 - RNA, 20 nt, Mycobacterium tuberculosis H37Rv
auucugugucugcucggcga

SEQ ID NO: 3318920 - RNA, 19 nt, Mycobacterium tuberculosis H37Rv
auucuguugugccgcaagc

SEQ ID NO: 3318921 - RNA, 18 nt, Mycobacterium tuberculosis H37Rv
auucuugacgccgaugug

SEQ ID NO: 3318922 - RNA, 17 nt, Mycobacterium tuberculosis H37Rv
auucuuggugaucgcga

SEQ ID NO: 3318923 - RNA, 14 nt, Mycobacterium tuberculosis H37Rv
auugaacagcggau

SEQ ID NO: 3318924 - RNA, 18 nt, Mycobacterium tuberculosis H37Rv
auugaagccccccgagcu

SEQ ID NO: 3318925 - RNA, 12 nt, Mycobacterium tuberculosis H37Rv
auugacccgacg

SEQ ID NO: 3318926 - RNA, 18 nt, Mycobacterium tuberculosis H37Rv
auugagcagcaagccgcc

SEQ ID NO: 3318927 - RNA, 23 nt, Mycobacterium tuberculosis H37Rv
auugagucaucuggcgcgccacc

SEQ ID NO: 3318928 - RNA, 15 nt, Mycobacterium tuberculosis H37Rv
auugaugaucugcag

SEQ ID NO: 3318929 - RNA, 16 nt, Mycobacterium tuberculosis H37Rv
auugaugcgugguugg

SEQ ID NO: 3318930 - RNA, 17 nt, Mycobacterium tuberculosis H37Rv
auugcaccgcggccagc

SEQ ID NO: 3318931 - RNA, 18 nt, Mycobacterium tuberculosis H37Rv
auugcaccgcggccagca

SEQ ID NO: 3318932 - RNA, 22 nt, Mycobacterium tuberculosis H37Rv
auugcccgacgaugcgggcgau

SEQ ID NO: 3318933 - RNA, 15 nt, Mycobacterium tuberculosis H37Rv
auugcccgcgcucgc

SEQ ID NO: 3318934 - RNA, 23 nt, Mycobacterium tuberculosis H37Rv
auugcccgucagguacgucuugg

SEQ ID NO: 3318935 - RNA, 21 nt, Mycobacterium tuberculosis H37Rv
auugcccguguuaaagaagcc

SEQ ID NO: 3318936 - RNA, 17 nt, Mycobacterium tuberculosis H37Rv
auugcccuugaccaugu

SEQ ID NO: 3318937 - RNA, 16 nt, Mycobacterium tuberculosis H37Rv
auugccgcaugcucag

SEQ ID NO: 3318938 - RNA, 17 nt, Mycobacterium tuberculosis H37Rv
auugccgcaugcucagc

SEQ ID NO: 3318939 - RNA, 11 nt, Mycobacterium tuberculosis H37Rv
auugccgccgc

SEQ ID NO: 3318940 - RNA, 11 nt, Mycobacterium tuberculosis H37Rv
auugccgccgu

SEQ ID NO: 3318941 - RNA, 21 nt, Mycobacterium tuberculosis H37Rv
auugccgccguugccgccaug

SEQ ID NO: 3318942 - RNA, 17 nt, Mycobacterium tuberculosis H37Rv
auugccggcgacgauau

SEQ ID NO: 3318943 - RNA, 21 nt, Mycobacterium tuberculosis H37Rv
auugccgggcgcacgcccgca

SEQ ID NO: 3318944 - RNA, 20 nt, Mycobacterium tuberculosis H37Rv
auugccgucgugaucggcga

SEQ ID NO: 3318945 - RNA, 17 nt, Mycobacterium tuberculosis H37Rv
auugccguucucgucga

SEQ ID NO: 3318946 - RNA, 20 nt, Mycobacterium tuberculosis H37Rv
auugcgaagggcaccggcga

SEQ ID NO: 3318947 - RNA, 13 nt, Mycobacterium tuberculosis H37Rv
auugcgcccggcc

SEQ ID NO: 3318948 - RNA, 13 nt, Mycobacterium tuberculosis H37Rv
auugcgcgggcau

SEQ ID NO: 3318949 - RNA, 12 nt, Mycobacterium tuberculosis H37Rv
auugcgcuucca

SEQ ID NO: 3318950 - RNA, 22 nt, Mycobacterium tuberculosis H37Rv
auugcggaaacccggccgccga

SEQ ID NO: 3318951 - RNA, 14 nt, Mycobacterium tuberculosis H37Rv
auugcggccgccgg

SEQ ID NO: 3318952 - RNA, 23 nt, Mycobacterium tuberculosis H37Rv
auugcggccuguugacccaucau

SEQ ID NO: 3318953 - RNA, 16 nt, Mycobacterium tuberculosis H37Rv
auugcgggagccucgc

SEQ ID NO: 3318954 - RNA, 13 nt, Mycobacterium tuberculosis H37Rv
auugcucgaucug

SEQ ID NO: 3318955 - RNA, 23 nt, Mycobacterium tuberculosis H37Rv
auuggccaaccccauggccagcg

SEQ ID NO: 3318956 - RNA, 11 nt, Mycobacterium tuberculosis H37Rv
auuggccaggu

SEQ ID NO: 3318957 - RNA, 12 nt, Mycobacterium tuberculosis H37Rv
auuggccaggug

SEQ ID NO: 3318958 - RNA, 23 nt, Mycobacterium tuberculosis H37Rv
auuggcccgaguuggcgaagccc

SEQ ID NO: 3318959 - RNA, 22 nt, Mycobacterium tuberculosis H37Rv
auuggcccgucacgcccgcgaa

SEQ ID NO: 3318960 - RNA, 13 nt, Mycobacterium tuberculosis H37Rv
auuggcgccgaug

SEQ ID NO: 3318961 - RNA, 14 nt, Mycobacterium tuberculosis H37Rv
auuggcgccgccga

SEQ ID NO: 3318962 - RNA, 16 nt, Mycobacterium tuberculosis H37Rv
auuggcgccgccgauc

SEQ ID NO: 3318963 - RNA, 24 nt, Mycobacterium tuberculosis H37Rv
auuggcgccgucaccgaucgaaca

SEQ ID NO: 3318964 - RNA, 16 nt, Mycobacterium tuberculosis H37Rv
auuggcgucagcagca

SEQ ID NO: 3318965 - RNA, 17 nt, Mycobacterium tuberculosis H37Rv
auuggcgucagcagcaa

SEQ ID NO: 3318966 - RNA, 14 nt, Mycobacterium tuberculosis H37Rv
auuggcgucgucgc

SEQ ID NO: 3318967 - RNA, 18 nt, Mycobacterium tuberculosis H37Rv
auuggcgucgucggcggc

SEQ ID NO: 3318968 - RNA, 14 nt, Mycobacterium tuberculosis H37Rv
auuggcuccgaaca

SEQ ID NO: 3318969 - RNA, 22 nt, Mycobacterium tuberculosis H37Rv
auuggcuccgaacauggccagc

SEQ ID NO: 3318970 - RNA, 16 nt, Mycobacterium tuberculosis H37Rv
auuggcugggucguca

SEQ ID NO: 3318971 - RNA, 20 nt, Mycobacterium tuberculosis H37Rv
auugggcgauucugcgucug

SEQ ID NO: 3318972 - RNA, 20 nt, Mycobacterium tuberculosis H37Rv
auugggugccguugcgucug

SEQ ID NO: 3318973 - RNA, 13 nt, Mycobacterium tuberculosis H37Rv
auugguaccggcu

SEQ ID NO: 3318974 - RNA, 17 nt, Mycobacterium tuberculosis H37Rv
auuggucgagucgauga

SEQ ID NO: 3318975 - RNA, 21 nt, Mycobacterium tuberculosis H37Rv
auuggugaguagauugcugac

SEQ ID NO: 3318976 - RNA, 20 nt, Mycobacterium tuberculosis H37Rv
auuggugggccagcagcaac

SEQ ID NO: 3318977 - RNA, 14 nt, Mycobacterium tuberculosis H37Rv
auugucgaucuggu

SEQ ID NO: 3318978 - RNA, 14 nt, Mycobacterium tuberculosis H37Rv
auugugcucgccga

SEQ ID NO: 3318979 - RNA, 14 nt, Mycobacterium tuberculosis H37Rv
auugugcugaccug

SEQ ID NO: 3318980 - RNA, 15 nt, Mycobacterium tuberculosis H37Rv
auugugggacgcgau

SEQ ID NO: 3318981 - RNA, 14 nt, Mycobacterium tuberculosis H37Rv
auuguugaagaaag

SEQ ID NO: 3318982 - RNA, 22 nt, Mycobacterium tuberculosis H37Rv
auuguugaagaaagcgaccguc

SEQ ID NO: 3318983 - RNA, 21 nt, Mycobacterium tuberculosis H37Rv
auuuccaccacgcgcguuuag

SEQ ID NO: 3318984 - RNA, 13 nt, Mycobacterium tuberculosis H37Rv
auuuccaugcugg

SEQ ID NO: 3318985 - RNA, 20 nt, Mycobacterium tuberculosis H37Rv
auuuccuacggugcagucga

SEQ ID NO: 3318986 - RNA, 11 nt, Mycobacterium tuberculosis H37Rv
auuuccucugg

SEQ ID NO: 3318987 - RNA, 20 nt, Mycobacterium tuberculosis H37Rv
auuucgacgaccaccuucug

SEQ ID NO: 3318988 - RNA, 16 nt, Mycobacterium tuberculosis H37Rv
auuucggcggcgauga

SEQ ID NO: 3318989 - RNA, 13 nt, Mycobacterium tuberculosis H37Rv
auuucucccagcc

SEQ ID NO: 3318990 - RNA, 15 nt, Mycobacterium tuberculosis H37Rv
auuucucccagccca

SEQ ID NO: 3318991 - RNA, 16 nt, Mycobacterium tuberculosis H37Rv
auuugauaggcgcgca

SEQ ID NO: 3318992 - RNA, 21 nt, Mycobacterium tuberculosis H37Rv
auuuggugaagccguagacgu

SEQ ID NO: 3318993 - RNA, 14 nt, Mycobacterium tuberculosis H37Rv
auuugucggcgccu

SEQ ID NO: 3318994 - RNA, 20 nt, Mycobacterium tuberculosis H37Rv
auuuugcgucugcucggcgc

SEQ ID NO: 3318995 - RNA, 20 nt, Mycobacterium tuberculosis H37Rv
auuuuggcaagcugccccgc

SEQ ID NO: 3318996 - RNA, 22 nt, Mycobacterium tuberculosis H37Rv
auuuuuguuguuauuuuuggcc

SEQ ID NO: 3318997 - RNA, 22 nt, Mycobacterium tuberculosis H37Rv
caaaaaccagcguccaacccag

SEQ ID NO: 3318998 - RNA, 17 nt, Mycobacterium tuberculosis H37Rv
caaaaacccggugacca

SEQ ID NO: 3318999 - RNA, 14 nt, Mycobacterium tuberculosis H37Rv
caaaaccugggaug

SEQ ID NO: 3319000 - RNA, 14 nt, Mycobacterium tuberculosis H37Rv
caaaaggaagaccu

SEQ ID NO: 3319001 - RNA, 15 nt, Mycobacterium tuberculosis H37Rv
caaaauacuccgcga

SEQ ID NO: 3319002 - RNA, 14 nt, Mycobacterium tuberculosis H37Rv
caaaaucagggugc

SEQ ID NO: 3319003 - RNA, 13 nt, Mycobacterium tuberculosis H37Rv
caaaaucaucugc

SEQ ID NO: 3319004 - RNA, 15 nt, Mycobacterium tuberculosis H37Rv
caaaaucgcggccac

SEQ ID NO: 3319005 - RNA, 16 nt, Mycobacterium tuberculosis H37Rv
caaaaucgcggccaca

SEQ ID NO: 3319006 - RNA, 19 nt, Mycobacterium tuberculosis H37Rv
caaaaugccuuggcagccc

SEQ ID NO: 3319007 - RNA, 20 nt, Mycobacterium tuberculosis H37Rv
caaaauggugccguccggcg

SEQ ID NO: 3319008 - RNA, 16 nt, Mycobacterium tuberculosis H37Rv
caaaauucgcuggcga

SEQ ID NO: 3319009 - RNA, 15 nt, Mycobacterium tuberculosis H37Rv
caaacaccccacaca

SEQ ID NO: 3319010 - RNA, 20 nt, Mycobacterium tuberculosis H37Rv
caaacaccccggccuugcca

SEQ ID NO: 3319011 - RNA, 22 nt, Mycobacterium tuberculosis H37Rv
caaacacgccucgccgaagugg

SEQ ID NO: 3319012 - RNA, 16 nt, Mycobacterium tuberculosis H37Rv
caaacauacgccaccc

SEQ ID NO: 3319013 - RNA, 20 nt, Mycobacterium tuberculosis H37Rv
caaacaucuugucgaucugc

SEQ ID NO: 3319014 - RNA, 18 nt, Mycobacterium tuberculosis H37Rv
caaaccacccgcaacaca

SEQ ID NO: 3319015 - RNA, 18 nt, Mycobacterium tuberculosis H37Rv
caaaccauugcgccugaa

SEQ ID NO: 3319016 - RNA, 15 nt, Mycobacterium tuberculosis H37Rv
caaacccagcgacgc

SEQ ID NO: 3319017 - RNA, 17 nt, Mycobacterium tuberculosis H37Rv
caaaccccugcacggug

SEQ ID NO: 3319018 - RNA, 14 nt, Mycobacterium tuberculosis H37Rv
caaacccguugaag

SEQ ID NO: 3319019 - RNA, 21 nt, Mycobacterium tuberculosis H37Rv
caaacccguugaagacggcca

SEQ ID NO: 3319020 - RNA, 21 nt, Mycobacterium tuberculosis H37Rv
caaaccgaucaauccgcccuu

SEQ ID NO: 3319021 - RNA, 19 nt, Mycobacterium tuberculosis H37Rv
caaaccgcuguaaccggua

SEQ ID NO: 3319022 - RNA, 15 nt, Mycobacterium tuberculosis H37Rv
caaaccggaaacagc

SEQ ID NO: 3319023 - RNA, 21 nt, Mycobacterium tuberculosis H37Rv
caaacgacagcccuaucagcc

SEQ ID NO: 3319024 - RNA, 17 nt, Mycobacterium tuberculosis H37Rv
caaacgaccgcugauga

SEQ ID NO: 3319025 - RNA, 14 nt, Mycobacterium tuberculosis H37Rv
caaacgcgcagguc

SEQ ID NO: 3319026 - RNA, 17 nt, Mycobacterium tuberculosis H37Rv
caaacgcgcgcgccauu

SEQ ID NO: 3319027 - RNA, 21 nt, Mycobacterium tuberculosis H37Rv
caaacgcugcgcccggaccac

SEQ ID NO: 3319028 - RNA, 18 nt, Mycobacterium tuberculosis H37Rv
caaacggaugguucugga

SEQ ID NO: 3319029 - RNA, 20 nt, Mycobacterium tuberculosis H37Rv
caaacggcuuggcugccucc

SEQ ID NO: 3319030 - RNA, 19 nt, Mycobacterium tuberculosis H37Rv
caaacgggcgugggccgcu

SEQ ID NO: 3319031 - RNA, 19 nt, Mycobacterium tuberculosis H37Rv
caaacuaacggcagccacc

SEQ ID NO: 3319032 - RNA, 22 nt, Mycobacterium tuberculosis H37Rv
caaacuacccgcccacggcacc

SEQ ID NO: 3319033 - RNA, 15 nt, Mycobacterium tuberculosis H37Rv
caaacuuucgggaca

SEQ ID NO: 3319034 - RNA, 22 nt, Mycobacterium tuberculosis H37Rv
caaagaauucguucagcgccag

SEQ ID NO: 3319035 - RNA, 16 nt, Mycobacterium tuberculosis H37Rv
caaagaucgccucucg

SEQ ID NO: 3319036 - RNA, 22 nt, Mycobacterium tuberculosis H37Rv
caaagcacuucacgaguagcgg

SEQ ID NO: 3319037 - RNA, 21 nt, Mycobacterium tuberculosis H37Rv
caaagccagcgcagccaggcu

SEQ ID NO: 3319038 - RNA, 11 nt, Mycobacterium tuberculosis H37Rv
caaagcccaca

SEQ ID NO: 3319039 - RNA, 14 nt, Mycobacterium tuberculosis H37Rv
caaagccgucagcu

SEQ ID NO: 3319040 - RNA, 15 nt, Mycobacterium tuberculosis H37Rv
caaagccgucgacgc

SEQ ID NO: 3319041 - RNA, 12 nt, Mycobacterium tuberculosis H37Rv
caaagccgugcc

SEQ ID NO: 3319042 - RNA, 22 nt, Mycobacterium tuberculosis H37Rv
caaagcgccagcagccacccga

SEQ ID NO: 3319043 - RNA, 15 nt, Mycobacterium tuberculosis H37Rv
caaagcugcucgucg

SEQ ID NO: 3319044 - RNA, 13 nt, Mycobacterium tuberculosis H37Rv
caaaggccuugac

SEQ ID NO: 3319045 - RNA, 14 nt, Mycobacterium tuberculosis H37Rv
caaagggaguguuu

SEQ ID NO: 3319046 - RNA, 15 nt, Mycobacterium tuberculosis H37Rv
caaaggggugugugc

SEQ ID NO: 3319047 - RNA, 21 nt, Mycobacterium tuberculosis H37Rv
caaaguacgcccuggaaugcc

SEQ ID NO: 3319048 - RNA, 22 nt, Mycobacterium tuberculosis H37Rv
caaaguucggugauuucggcgu

SEQ ID NO: 3319049 - RNA, 18 nt, Mycobacterium tuberculosis H37Rv
caaaguuggccgcccgaa

SEQ ID NO: 3319050 - RNA, 16 nt, Mycobacterium tuberculosis H37Rv
caaauauccugcgguu

SEQ ID NO: 3319051 - RNA, 14 nt, Mycobacterium tuberculosis H37Rv
caaaucaagcacag

SEQ ID NO: 3319052 - RNA, 13 nt, Mycobacterium tuberculosis H37Rv
caaauccagcagc

SEQ ID NO: 3319053 - RNA, 15 nt, Mycobacterium tuberculosis H37Rv
caaaucccagagcau

SEQ ID NO: 3319054 - RNA, 16 nt, Mycobacterium tuberculosis H37Rv
caaauccgcaccagcc

SEQ ID NO: 3319055 - RNA, 14 nt, Mycobacterium tuberculosis H37Rv
caaauccuucggcg

SEQ ID NO: 3319056 - RNA, 23 nt, Mycobacterium tuberculosis H37Rv
caaaugcgggcuuugccaacaaa

SEQ ID NO: 3319057 - RNA, 14 nt, Mycobacterium tuberculosis H37Rv
caaaugggguguuu

SEQ ID NO: 3319058 - RNA, 19 nt, Mycobacterium tuberculosis H37Rv
caaaugugcgagaagcagg

SEQ ID NO: 3319059 - RNA, 16 nt, Mycobacterium tuberculosis H37Rv
caacaacgucugcagc

SEQ ID NO: 3319060 - RNA, 15 nt, Mycobacterium tuberculosis H37Rv
caacaacuccagcag

SEQ ID NO: 3319061 - RNA, 16 nt, Mycobacterium tuberculosis H37Rv
caacaacuccagcagg

SEQ ID NO: 3319062 - RNA, 15 nt, Mycobacterium tuberculosis H37Rv
caacaaggggcagca

SEQ ID NO: 3319063 - RNA, 15 nt, Mycobacterium tuberculosis H37Rv
caacaagucgauggc

SEQ ID NO: 3319064 - RNA, 14 nt, Mycobacterium tuberculosis H37Rv
caacacagccgucg

SEQ ID NO: 3319065 - RNA, 23 nt, Mycobacterium tuberculosis H37Rv
caacacauuucuuugggcggccc

SEQ ID NO: 3319066 - RNA, 17 nt, Mycobacterium tuberculosis H37Rv
caacaccaacgacagcg

SEQ ID NO: 3319067 - RNA, 18 nt, Mycobacterium tuberculosis H37Rv
caacaccaccagcacgcu

SEQ ID NO: 3319068 - RNA, 13 nt, Mycobacterium tuberculosis H37Rv
caacaccaccgcc

SEQ ID NO: 3319069 - RNA, 20 nt, Mycobacterium tuberculosis H37Rv
caacaccagccggucgucgc

SEQ ID NO: 3319070 - RNA, 13 nt, Mycobacterium tuberculosis H37Rv
caacaccagguca

SEQ ID NO: 3319071 - RNA, 11 nt, Mycobacterium tuberculosis H37Rv
caacaccauca

SEQ ID NO: 3319072 - RNA, 19 nt, Mycobacterium tuberculosis H37Rv
caacacccacgugcugccu

SEQ ID NO: 3319073 - RNA, 14 nt, Mycobacterium tuberculosis H37Rv
caacacccccccca

SEQ ID NO: 3319074 - RNA, 22 nt, Mycobacterium tuberculosis H37Rv
caacacccggcuagagugcgca

SEQ ID NO: 3319075 - RNA, 17 nt, Mycobacterium tuberculosis H37Rv
caacacccgggccuugu

SEQ ID NO: 3319076 - RNA, 12 nt, Mycobacterium tuberculosis H37Rv
caacaccgcacc

SEQ ID NO: 3319077 - RNA, 13 nt, Mycobacterium tuberculosis H37Rv
caacaccgcccgc

SEQ ID NO: 3319078 - RNA, 14 nt, Mycobacterium tuberculosis H37Rv
caacaccgcccgca

SEQ ID NO: 3319079 - RNA, 14 nt, Mycobacterium tuberculosis H37Rv
caacaccgcggcgc

SEQ ID NO: 3319080 - RNA, 17 nt, Mycobacterium tuberculosis H37Rv
caacaccgcgucaacgc

SEQ ID NO: 3319081 - RNA, 18 nt, Mycobacterium tuberculosis H37Rv
caacaccggcgaucaccg

SEQ ID NO: 3319082 - RNA, 21 nt, Mycobacterium tuberculosis H37Rv
caacaccgucggcagcagcgg

SEQ ID NO: 3319083 - RNA, 16 nt, Mycobacterium tuberculosis H37Rv
caacaccgugcaccag

SEQ ID NO: 3319084 - RNA, 19 nt, Mycobacterium tuberculosis H37Rv
caacaccucaaacgccugg

SEQ ID NO: 3319085 - RNA, 19 nt, Mycobacterium tuberculosis H37Rv
caacaccucguaugccgug

SEQ ID NO: 3319086 - RNA, 17 nt, Mycobacterium tuberculosis H37Rv
caacacgagcgguacgc

SEQ ID NO: 3319087 - RNA, 14 nt, Mycobacterium tuberculosis H37Rv
caacacgccggccc

SEQ ID NO: 3319088 - RNA, 17 nt, Mycobacterium tuberculosis H37Rv
caacacgucgagcagcc

SEQ ID NO: 3319089 - RNA, 17 nt, Mycobacterium tuberculosis H37Rv
caacagaccuagcaccg

SEQ ID NO: 3319090 - RNA, 22 nt, Mycobacterium tuberculosis H37Rv
caacagauccgacgaccgcauu

SEQ ID NO: 3319091 - RNA, 21 nt, Mycobacterium tuberculosis H37Rv
caacagaugccacccagaugc

SEQ ID NO: 3319092 - RNA, 17 nt, Mycobacterium tuberculosis H37Rv
caacagcaccgcgacga

SEQ ID NO: 3319093 - RNA, 16 nt, Mycobacterium tuberculosis H37Rv
caacagcacguacugc

SEQ ID NO: 3319094 - RNA, 14 nt, Mycobacterium tuberculosis H37Rv
caacagcaugggcg

SEQ ID NO: 3319095 - RNA, 13 nt, Mycobacterium tuberculosis H37Rv
caacagccgaacu

SEQ ID NO: 3319096 - RNA, 17 nt, Mycobacterium tuberculosis H37Rv
caacagccgcagccagg

SEQ ID NO: 3319097 - RNA, 23 nt, Mycobacterium tuberculosis H37Rv
caacagccgcucgcacagccgcu

SEQ ID NO: 3319098 - RNA, 20 nt, Mycobacterium tuberculosis H37Rv
caacagcggcaacgccuccg

SEQ ID NO: 3319099 - RNA, 11 nt, Mycobacterium tuberculosis H37Rv
caacagcgggg

SEQ ID NO: 3319100 - RNA, 19 nt, Mycobacterium tuberculosis H37Rv
caacagcuuggagaucgcc

SEQ ID NO: 3319101 - RNA, 19 nt, Mycobacterium tuberculosis H37Rv
caacaggaacaggcaaagu

SEQ ID NO: 3319102 - RNA, 17 nt, Mycobacterium tuberculosis H37Rv
caacaggccaacuuggc

SEQ ID NO: 3319103 - RNA, 16 nt, Mycobacterium tuberculosis H37Rv
caacaggccggcucgc

SEQ ID NO: 3319104 - RNA, 22 nt, Mycobacterium tuberculosis H37Rv
caacaggccgucgaugaucugc

SEQ ID NO: 3319105 - RNA, 19 nt, Mycobacterium tuberculosis H37Rv
caacagggccaggacaacc

SEQ ID NO: 3319106 - RNA, 22 nt, Mycobacterium tuberculosis H37Rv
caacagggcgccgacgacuccg

SEQ ID NO: 3319107 - RNA, 20 nt, Mycobacterium tuberculosis H37Rv
caacagggugacuucgcugc

SEQ ID NO: 3319108 - RNA, 22 nt, Mycobacterium tuberculosis H37Rv
caacaguucucgcgcuugcgcc

SEQ ID NO: 3319109 - RNA, 14 nt, Mycobacterium tuberculosis H37Rv
caacaucagcaccg

SEQ ID NO: 3319110 - RNA, 14 nt, Mycobacterium tuberculosis H37Rv
caacaucagcagga

SEQ ID NO: 3319111 - RNA, 15 nt, Mycobacterium tuberculosis H37Rv
caacaucagcgacag

SEQ ID NO: 3319112 - RNA, 17 nt, Mycobacterium tuberculosis H37Rv
caacaucgaaaaccgag

SEQ ID NO: 3319113 - RNA, 15 nt, Mycobacterium tuberculosis H37Rv
caacaucgagcgcca

SEQ ID NO: 3319114 - RNA, 17 nt, Mycobacterium tuberculosis H37Rv
caacaucgagcgccagc

SEQ ID NO: 3319115 - RNA, 15 nt, Mycobacterium tuberculosis H37Rv
caacaucggaugacc

SEQ ID NO: 3319116 - RNA, 23 nt, Mycobacterium tuberculosis H37Rv
caacaugccggucauccgggcga

SEQ ID NO: 3319117 - RNA, 15 nt, Mycobacterium tuberculosis H37Rv
caacaugggugaugc

SEQ ID NO: 3319118 - RNA, 18 nt, Mycobacterium tuberculosis H37Rv
caacaugucaccugcauc

SEQ ID NO: 3319119 - RNA, 16 nt, Mycobacterium tuberculosis H37Rv
caacauguugucgucg

SEQ ID NO: 3319120 - RNA, 20 nt, Mycobacterium tuberculosis H37Rv
caacauguugucgucgccgc

SEQ ID NO: 3319121 - RNA, 16 nt, Mycobacterium tuberculosis H37Rv
caacauuggugaggug

SEQ ID NO: 3319122 - RNA, 18 nt, Mycobacterium tuberculosis H37Rv
caacauugugcucgccga

SEQ ID NO: 3319123 - RNA, 16 nt, Mycobacterium tuberculosis H37Rv
caacauuuucgcccgc

SEQ ID NO: 3319124 - RNA, 20 nt, Mycobacterium tuberculosis H37Rv
caaccaauaggugucgacgc

SEQ ID NO: 3319125 - RNA, 22 nt, Mycobacterium tuberculosis H37Rv
caaccacccacccgcaccaccg

SEQ ID NO: 3319126 - RNA, 21 nt, Mycobacterium tuberculosis H37Rv
caaccaccggaucggaacgau

SEQ ID NO: 3319127 - RNA, 20 nt, Mycobacterium tuberculosis H37Rv
caaccaccucgugggccacu

SEQ ID NO: 3319128 - RNA, 18 nt, Mycobacterium tuberculosis H37Rv
caaccacgcacgguggcu

SEQ ID NO: 3319129 - RNA, 23 nt, Mycobacterium tuberculosis H37Rv
agcggcugguugcgccacugcgu

SEQ ID NO: 3319130 - RNA, 19 nt, Mycobacterium tuberculosis H37Rv
agcggcuugcgguggcgga

SEQ ID NO: 3319131 - RNA, 16 nt, Mycobacterium tuberculosis H37Rv
agcgggaacacaccgc

SEQ ID NO: 3319132 - RNA, 23 nt, Mycobacterium tuberculosis H37Rv
agcgggaucaugaccaucgaggc

SEQ ID NO: 3319133 - RNA, 22 nt, Mycobacterium tuberculosis H37Rv
agcgggaucugacccagcagcg

SEQ ID NO: 3319134 - RNA, 13 nt, Mycobacterium tuberculosis H37Rv
agcgggauugccg

SEQ ID NO: 3319135 - RNA, 23 nt, Mycobacterium tuberculosis H37Rv
agcgggauugccgagaacaccgg

SEQ ID NO: 3319136 - RNA, 16 nt, Mycobacterium tuberculosis H37Rv
agcgggcaacugcagc

SEQ ID NO: 3319137 - RNA, 18 nt, Mycobacterium tuberculosis H37Rv
agcgggcaagaugaucgc

SEQ ID NO: 3319138 - RNA, 20 nt, Mycobacterium tuberculosis H37Rv
agcgggcaagaugaucgcgu

SEQ ID NO: 3319139 - RNA, 21 nt, Mycobacterium tuberculosis H37Rv
agcgggcagcaggcgaugcgc

SEQ ID NO: 3319140 - RNA, 19 nt, Mycobacterium tuberculosis H37Rv
agcgggcauaacccgcacc

SEQ ID NO: 3319141 - RNA, 20 nt, Mycobacterium tuberculosis H37Rv
agcgggccacugagccacag

SEQ ID NO: 3319142 - RNA, 15 nt, Mycobacterium tuberculosis H37Rv
agcgggccagcaccc

SEQ ID NO: 3319143 - RNA, 21 nt, Mycobacterium tuberculosis H37Rv
agcgggcgaugagcgcgaucu

SEQ ID NO: 3319144 - RNA, 22 nt, Mycobacterium tuberculosis H37Rv
agcggggauguccgcggccacc

SEQ ID NO: 3319145 - RNA, 22 nt, Mycobacterium tuberculosis H37Rv
agcggggcuagucgggguggga

SEQ ID NO: 3319146 - RNA, 17 nt, Mycobacterium tuberculosis H37Rv
agcgggggagcgaacgg

SEQ ID NO: 3319147 - RNA, 16 nt, Mycobacterium tuberculosis H37Rv
agcggguccccgguca

SEQ ID NO: 3319148 - RNA, 18 nt, Mycobacterium tuberculosis H37Rv
agcggguccccggucagg

SEQ ID NO: 3319149 - RNA, 20 nt, Mycobacterium tuberculosis H37Rv
agcggguccccggucaggac

SEQ ID NO: 3319150 - RNA, 19 nt, Mycobacterium tuberculosis H37Rv
agcggguccgucagcaccc

SEQ ID NO: 3319151 - RNA, 22 nt, Mycobacterium tuberculosis H37Rv
agcgggucgaccccggccagga

SEQ ID NO: 3319152 - RNA, 14 nt, Mycobacterium tuberculosis H37Rv
agcgggugcgggcg

SEQ ID NO: 3319153 - RNA, 17 nt, Mycobacterium tuberculosis H37Rv
agcggguggccaucacc

SEQ ID NO: 3319154 - RNA, 22 nt, Mycobacterium tuberculosis H37Rv
agcggguggccaucaccgcgcu

SEQ ID NO: 3319155 - RNA, 15 nt, Mycobacterium tuberculosis H37Rv
agcggguggccggga

SEQ ID NO: 3319156 - RNA, 16 nt, Mycobacterium tuberculosis H37Rv
agcggguggugccagg

SEQ ID NO: 3319157 - RNA, 15 nt, Mycobacterium tuberculosis H37Rv
agcggguugcgguca

SEQ ID NO: 3319158 - RNA, 20 nt, Mycobacterium tuberculosis H37Rv
agcgguaagcgcaucgagca

SEQ ID NO: 3319159 - RNA, 14 nt, Mycobacterium tuberculosis H37Rv
agcgguaaugccag

SEQ ID NO: 3319160 - RNA, 21 nt, Mycobacterium tuberculosis H37Rv
agcgguaaugccagcggcaca

SEQ ID NO: 3319161 - RNA, 15 nt, Mycobacterium tuberculosis H37Rv
agcgguacgcccgaa

SEQ ID NO: 3319162 - RNA, 22 nt, Mycobacterium tuberculosis H37Rv
agcgguacgcccgaaucgccgg

SEQ ID NO: 3319163 - RNA, 19 nt, Mycobacterium tuberculosis H37Rv
agcgguacguaaucgagcg

SEQ ID NO: 3319164 - RNA, 12 nt, Mycobacterium tuberculosis H37Rv
agcgguagccga

SEQ ID NO: 3319165 - RNA, 21 nt, Mycobacterium tuberculosis H37Rv
agcgguaggcguugaucgccg

SEQ ID NO: 3319166 - RNA, 17 nt, Mycobacterium tuberculosis H37Rv
agcgguauuugaugagc

SEQ ID NO: 3319167 - RNA, 16 nt, Mycobacterium tuberculosis H37Rv
agcgguccagcgucgc

SEQ ID NO: 3319168 - RNA, 19 nt, Mycobacterium tuberculosis H37Rv
agcggucgcgcucgcgaaa

SEQ ID NO: 3319169 - RNA, 19 nt, Mycobacterium tuberculosis H37Rv
agcggucggcgaccaccag

SEQ ID NO: 3319170 - RNA, 13 nt, Mycobacterium tuberculosis H37Rv
agcggucggcggu

SEQ ID NO: 3319171 - RNA, 17 nt, Mycobacterium tuberculosis H37Rv
agcggucggucaccaug

SEQ ID NO: 3319172 - RNA, 18 nt, Mycobacterium tuberculosis H37Rv
agcggucugugcugcgcu

SEQ ID NO: 3319173 - RNA, 13 nt, Mycobacterium tuberculosis H37Rv
agcggugccguca

SEQ ID NO: 3319174 - RNA, 12 nt, Mycobacterium tuberculosis H37Rv
agcggugcuggu

SEQ ID NO: 3319175 - RNA, 18 nt, Mycobacterium tuberculosis H37Rv
agcgguggcccgccggca

SEQ ID NO: 3319176 - RNA, 23 nt, Mycobacterium tuberculosis H37Rv
agcgguggcgucgucggcgggcu

SEQ ID NO: 3319177 - RNA, 14 nt, Mycobacterium tuberculosis H37Rv
agcgguggcguggu

SEQ ID NO: 3319178 - RNA, 20 nt, Mycobacterium tuberculosis H37Rv
agcgguggugagugcgucuc

SEQ ID NO: 3319179 - RNA, 23 nt, Mycobacterium tuberculosis H37Rv
agcgguguugccggagacgucgc

SEQ ID NO: 3319180 - RNA, 16 nt, Mycobacterium tuberculosis H37Rv
agcgguugacccacag

SEQ ID NO: 3319181 - RNA, 22 nt, Mycobacterium tuberculosis H37Rv
agcgguugccuucuuggcggga

SEQ ID NO: 3319182 - RNA, 21 nt, Mycobacterium tuberculosis H37Rv
agcgguuguagaccucuucgg

SEQ ID NO: 3319183 - RNA, 23 nt, Mycobacterium tuberculosis H37Rv
agcgguuuagccgcuugggccug

SEQ ID NO: 3319184 - RNA, 22 nt, Mycobacterium tuberculosis H37Rv
agcgguuuccgcacgaucgccc

SEQ ID NO: 3319185 - RNA, 18 nt, Mycobacterium tuberculosis H37Rv
agcgguuugccagugaug

SEQ ID NO: 3319186 - RNA, 17 nt, Mycobacterium tuberculosis H37Rv
agcguaaugcugcugca

SEQ ID NO: 3319187 - RNA, 19 nt, Mycobacterium tuberculosis H37Rv
agcguacccaacggagugu

SEQ ID NO: 3319188 - RNA, 22 nt, Mycobacterium tuberculosis H37Rv
agcguacucccccgaaccugcg

SEQ ID NO: 3319189 - RNA, 14 nt, Mycobacterium tuberculosis H37Rv
agcguaggccagcg

SEQ ID NO: 3319190 - RNA, 17 nt, Mycobacterium tuberculosis H37Rv
agcguaguaggcagccu

SEQ ID NO: 3319191 - RNA, 12 nt, Mycobacterium tuberculosis H37Rv
agcgucacccug

SEQ ID NO: 3319192 - RNA, 21 nt, Mycobacterium tuberculosis H37Rv
agcguccagcgccugcgccca

SEQ ID NO: 3319193 - RNA, 22 nt, Mycobacterium tuberculosis H37Rv
agcguccauggucgcgccaccc

SEQ ID NO: 3319194 - RNA, 20 nt, Mycobacterium tuberculosis H37Rv
agcguccgacaacgacugcg

SEQ ID NO: 3319195 - RNA, 19 nt, Mycobacterium tuberculosis H37Rv
agcguccgggucgacgcga

SEQ ID NO: 3319196 - RNA, 16 nt, Mycobacterium tuberculosis H37Rv
agcguccgguggucag

SEQ ID NO: 3319197 - RNA, 23 nt, Mycobacterium tuberculosis H37Rv
agcguccuggcguagugcagcug

SEQ ID NO: 3319198 - RNA, 14 nt, Mycobacterium tuberculosis H37Rv
agcgucgccauucc

SEQ ID NO: 3319199 - RNA, 18 nt, Mycobacterium tuberculosis H37Rv
agcgucgcggccacgguc

SEQ ID NO: 3319200 - RNA, 16 nt, Mycobacterium tuberculosis H37Rv
agcgucgcugaccgcg

SEQ ID NO: 3319201 - RNA, 14 nt, Mycobacterium tuberculosis H37Rv
agcgucgggcacau

SEQ ID NO: 3319202 - RNA, 15 nt, Mycobacterium tuberculosis H37Rv
agcgucgggcacauc

SEQ ID NO: 3319203 - RNA, 15 nt, Mycobacterium tuberculosis H37Rv
agcgucggugccacc

SEQ ID NO: 3319204 - RNA, 23 nt, Mycobacterium tuberculosis H37Rv
agcgucgucgccggcgcucaucg

SEQ ID NO: 3319205 - RNA, 15 nt, Mycobacterium tuberculosis H37Rv
agcgucucgaucacc

SEQ ID NO: 3319206 - RNA, 19 nt, Mycobacterium tuberculosis H37Rv
agcgugaccaccgccgaca

SEQ ID NO: 3319207 - RNA, 14 nt, Mycobacterium tuberculosis H37Rv
agcgugcacgggga

SEQ ID NO: 3319208 - RNA, 17 nt, Mycobacterium tuberculosis H37Rv
agcgugcccgccaccgg

SEQ ID NO: 3319209 - RNA, 23 nt, Mycobacterium tuberculosis H37Rv
agcgugccgaacagggaggucgc

SEQ ID NO: 3319210 - RNA, 22 nt, Mycobacterium tuberculosis H37Rv
agcgugccgcagcggcggcaac

SEQ ID NO: 3319211 - RNA, 23 nt, Mycobacterium tuberculosis H37Rv
agcgugccgcagcggcggcaacc

SEQ ID NO: 3319212 - RNA, 20 nt, Mycobacterium tuberculosis H37Rv
aggaccgggaucgucaggcc

SEQ ID NO: 3319213 - RNA, 15 nt, Mycobacterium tuberculosis H37Rv
aggacgaguccuagc

SEQ ID NO: 3319214 - RNA, 13 nt, Mycobacterium tuberculosis H37Rv
aggacgccagcaa

SEQ ID NO: 3319215 - RNA, 16 nt, Mycobacterium tuberculosis H37Rv
aggacgccagcaaugc

SEQ ID NO: 3319216 - RNA, 21 nt, Mycobacterium tuberculosis H37Rv
aggacgcgggcuaucgguuca

SEQ ID NO: 3319217 - RNA, 15 nt, Mycobacterium tuberculosis H37Rv
aggacggagcccaaa

SEQ ID NO: 3319218 - RNA, 17 nt, Mycobacterium tuberculosis H37Rv
aggacggaucgucgugc

SEQ ID NO: 3319219 - RNA, 15 nt, Mycobacterium tuberculosis H37Rv
aggacggcagccacc

SEQ ID NO: 3319220 - RNA, 16 nt, Mycobacterium tuberculosis H37Rv
aggacggcguagacgu

SEQ ID NO: 3319221 - RNA, 20 nt, Mycobacterium tuberculosis H37Rv
aggacggcguagacguccgc

SEQ ID NO: 3319222 - RNA, 16 nt, Mycobacterium tuberculosis H37Rv
aggacggcugccguca

SEQ ID NO: 3319223 - RNA, 19 nt, Mycobacterium tuberculosis H37Rv
aggacggcuugagccgcag

SEQ ID NO: 3319224 - RNA, 23 nt, Mycobacterium tuberculosis H37Rv
aggacgguugagauggucaccgg

SEQ ID NO: 3319225 - RNA, 16 nt, Mycobacterium tuberculosis H37Rv
aggacguggcgcugga

SEQ ID NO: 3319226 - RNA, 13 nt, Mycobacterium tuberculosis H37Rv
aggacucacgcag

SEQ ID NO: 3319227 - RNA, 22 nt, Mycobacterium tuberculosis H37Rv
aggacugaacaguugcacaccg

SEQ ID NO: 3319228 - RNA, 17 nt, Mycobacterium tuberculosis H37Rv
aggacuggaaagcagca

SEQ ID NO: 3319229 - RNA, 23 nt, Mycobacterium tuberculosis H37Rv
aggacuggcaccgccagccacca

SEQ ID NO: 3319230 - RNA, 21 nt, Mycobacterium tuberculosis H37Rv
aggacuucggugagcagggcg

SEQ ID NO: 3319231 - RNA, 17 nt, Mycobacterium tuberculosis H37Rv
aggagaucaacauccug

SEQ ID NO: 3319232 - RNA, 16 nt, Mycobacterium tuberculosis H37Rv
aggagcuggcugacga

SEQ ID NO: 3319233 - RNA, 15 nt, Mycobacterium tuberculosis H37Rv
aggagcuuccgaccg

SEQ ID NO: 3319234 - RNA, 19 nt, Mycobacterium tuberculosis H37Rv
aggagggccgcgaucgacg

SEQ ID NO: 3319235 - RNA, 16 nt, Mycobacterium tuberculosis H37Rv
aggaguuugaccaccu

SEQ ID NO: 3319236 - RNA, 16 nt, Mycobacterium tuberculosis H37Rv
aggaucagcgcacugg

SEQ ID NO: 3319237 - RNA, 18 nt, Mycobacterium tuberculosis H37Rv
aggaucagcgcacuggcc

SEQ ID NO: 3319238 - RNA, 20 nt, Mycobacterium tuberculosis H37Rv
aggaucauguccaucgcgcg

SEQ ID NO: 3319239 - RNA, 22 nt, Mycobacterium tuberculosis H37Rv
aggaucccgcugcacgacaucg

SEQ ID NO: 3319240 - RNA, 21 nt, Mycobacterium tuberculosis H37Rv
aggaucgaggcgucggcaacc

SEQ ID NO: 3319241 - RNA, 15 nt, Mycobacterium tuberculosis H37Rv
aggaucgcguggcgc

SEQ ID NO: 3319242 - RNA, 17 nt, Mycobacterium tuberculosis H37Rv
aggaucggauggcggcc

SEQ ID NO: 3319243 - RNA, 20 nt, Mycobacterium tuberculosis H37Rv
aggaucggcuugggaaaccc

SEQ ID NO: 3319244 - RNA, 13 nt, Mycobacterium tuberculosis H37Rv
aggaucggggcgc

SEQ ID NO: 3319245 - RNA, 21 nt, Mycobacterium tuberculosis H37Rv
aggaucggggcgcugcagcuc

SEQ ID NO: 3319246 - RNA, 15 nt, Mycobacterium tuberculosis H37Rv
aggaucucgcggucc

SEQ ID NO: 3319247 - RNA, 14 nt, Mycobacterium tuberculosis H37Rv
aggaucugguugaa

SEQ ID NO: 3319248 - RNA, 16 nt, Mycobacterium tuberculosis H37Rv
aggaugcaucgcaacg

SEQ ID NO: 3319249 - RNA, 18 nt, Mycobacterium tuberculosis H37Rv
aggaugccgaaccgcgcg

SEQ ID NO: 3319250 - RNA, 23 nt, Mycobacterium tuberculosis H37Rv
aggauggacucgacaauucgcag

SEQ ID NO: 3319251 - RNA, 20 nt, Mycobacterium tuberculosis H37Rv
aggaugugguuggugcuggc

SEQ ID NO: 3319252 - RNA, 23 nt, Mycobacterium tuberculosis H37Rv
aggauucagccgguggucugcgc

SEQ ID NO: 3319253 - RNA, 23 nt, Mycobacterium tuberculosis H37Rv
aggauucccucgacagugcugcc

SEQ ID NO: 3319254 - RNA, 23 nt, Mycobacterium tuberculosis H37Rv
aggauucgcgcgaauguccggca

SEQ ID NO: 3319255 - RNA, 16 nt, Mycobacterium tuberculosis H37Rv
aggauucggcggucgc

SEQ ID NO: 3319256 - RNA, 18 nt, Mycobacterium tuberculosis H37Rv
aggauuugauaggcgcgc

SEQ ID NO: 3319257 - RNA, 13 nt, Mycobacterium tuberculosis H37Rv
aggcaaacaccag

SEQ ID NO: 3319258 - RNA, 16 nt, Mycobacterium tuberculosis H37Rv
aggcaaccggucagcc

SEQ ID NO: 3319259 - RNA, 13 nt, Mycobacterium tuberculosis H37Rv
aggcaagccagca

SEQ ID NO: 3319260 - RNA, 19 nt, Mycobacterium tuberculosis H37Rv
aggcaaggucaacccgcac

SEQ ID NO: 3319261 - RNA, 17 nt, Mycobacterium tuberculosis H37Rv
aggcacaacaucgccgc

SEQ ID NO: 3319262 - RNA, 18 nt, Mycobacterium tuberculosis H37Rv
aggcacaaucaccgccgc

SEQ ID NO: 3319263 - RNA, 16 nt, Mycobacterium tuberculosis H37Rv
aggcaccccgaucacc

SEQ ID NO: 3319264 - RNA, 18 nt, Mycobacterium tuberculosis H37Rv
aggcacccgugccgccga

SEQ ID NO: 3319265 - RNA, 17 nt, Mycobacterium tuberculosis H37Rv
aggcacccuguacgaag

SEQ ID NO: 3319266 - RNA, 21 nt, Mycobacterium tuberculosis H37Rv
aggcaccggaugauguggugu

SEQ ID NO: 3319267 - RNA, 13 nt, Mycobacterium tuberculosis H37Rv
aggcacguucagc

SEQ ID NO: 3319268 - RNA, 20 nt, Mycobacterium tuberculosis H37Rv
aggcacguucagccaggcgu

SEQ ID NO: 3319269 - RNA, 22 nt, Mycobacterium tuberculosis H37Rv
aggcacucccggaguggccagu

SEQ ID NO: 3319270 - RNA, 15 nt, Mycobacterium tuberculosis H37Rv
aggcagcacccgcac

SEQ ID NO: 3319271 - RNA, 19 nt, Mycobacterium tuberculosis H37Rv
aggcagcgugggacgcagu

SEQ ID NO: 3319272 - RNA, 21 nt, Mycobacterium tuberculosis H37Rv
aggcagguuggccaccgccca

SEQ ID NO: 3319273 - RNA, 11 nt, Mycobacterium tuberculosis H37Rv
aggcagugagg

SEQ ID NO: 3319274 - RNA, 14 nt, Mycobacterium tuberculosis H37Rv
aggcaugccacaca

SEQ ID NO: 3319275 - RNA, 17 nt, Mycobacterium tuberculosis H37Rv
aggcauuagcacgcugu

SEQ ID NO: 3319276 - RNA, 15 nt, Mycobacterium tuberculosis H37Rv
aggcauucucccggu

SEQ ID NO: 3319277 - RNA, 13 nt, Mycobacterium tuberculosis H37Rv
aggccaaccgguu

SEQ ID NO: 3319278 - RNA, 13 nt, Mycobacterium tuberculosis H37Rv
aggccaacggcgc

SEQ ID NO: 3319279 - RNA, 18 nt, Mycobacterium tuberculosis H37Rv
aggccaacuuggcggcca

SEQ ID NO: 3319280 - RNA, 18 nt, Mycobacterium tuberculosis H37Rv
aggccaagguggccacca

SEQ ID NO: 3319281 - RNA, 19 nt, Mycobacterium tuberculosis H37Rv
aggccaccacugcgcccgc

SEQ ID NO: 3319282 - RNA, 21 nt, Mycobacterium tuberculosis H37Rv
aggccaccacugcgcccgcca

SEQ ID NO: 3319283 - RNA, 12 nt, Mycobacterium tuberculosis H37Rv
aggccaccgucg

SEQ ID NO: 3319284 - RNA, 18 nt, Mycobacterium tuberculosis H37Rv
aggccacguagcagcgcc

SEQ ID NO: 3319285 - RNA, 12 nt, Mycobacterium tuberculosis H37Rv
aggccacugcgu

SEQ ID NO: 3319286 - RNA, 14 nt, Mycobacterium tuberculosis H37Rv
aggccagagccgcc

SEQ ID NO: 3319287 - RNA, 13 nt, Mycobacterium tuberculosis H37Rv
aggccagagucgc

SEQ ID NO: 3319288 - RNA, 18 nt, Mycobacterium tuberculosis H37Rv
aggccagagucgcccgca

SEQ ID NO: 3319289 - RNA, 20 nt, Mycobacterium tuberculosis H37Rv
aggccagagucgcccgcaca

SEQ ID NO: 3319290 - RNA, 21 nt, Mycobacterium tuberculosis H37Rv
aggccagaguuugcgaugccc

SEQ ID NO: 3319291 - RNA, 23 nt, Mycobacterium tuberculosis H37Rv
aggccagcaugucgggccgcucg

SEQ ID NO: 3319292 - RNA, 13 nt, Mycobacterium tuberculosis H37Rv
aggccagcccggc

SEQ ID NO: 3319293 - RNA, 15 nt, Mycobacterium tuberculosis H37Rv
aggccaggaucuccc

SEQ ID NO: 3319294 - RNA, 13 nt, Mycobacterium tuberculosis H37Rv
aggccagggcggu

SEQ ID NO: 3319295 - RNA, 14 nt, Mycobacterium tuberculosis H37Rv
aggccagggugacc

SEQ ID NO: 3319296 - RNA, 13 nt, Mycobacterium tuberculosis H37Rv
aggccagucgugc

SEQ ID NO: 3319297 - RNA, 19 nt, Mycobacterium tuberculosis H37Rv
aggcccacggcgaccagga

SEQ ID NO: 3319298 - RNA, 14 nt, Mycobacterium tuberculosis H37Rv
aggcccagcacggu

SEQ ID NO: 3319299 - RNA, 18 nt, Mycobacterium tuberculosis H37Rv
aggcccaggucaacgacg

SEQ ID NO: 3319300 - RNA, 19 nt, Mycobacterium tuberculosis H37Rv
aggccccccgcgccugccu

SEQ ID NO: 3319301 - RNA, 22 nt, Mycobacterium tuberculosis H37Rv
aggccccggugccgaccgguug

SEQ ID NO: 3319302 - RNA, 18 nt, Mycobacterium tuberculosis H37Rv
aggcccgaguuugaccag

SEQ ID NO: 3319303 - RNA, 23 nt, Mycobacterium tuberculosis H37Rv
aggcccgcgguggaccgggcaag

SEQ ID NO: 3319304 - RNA, 19 nt, Mycobacterium tuberculosis H37Rv
aggcccgggcggaugcugu

SEQ ID NO: 3319305 - RNA, 15 nt, Mycobacterium tuberculosis H37Rv
aggcccgggcggcca

SEQ ID NO: 3319306 - RNA, 17 nt, Mycobacterium tuberculosis H37Rv
aggcccgggcggccagc

SEQ ID NO: 3319307 - RNA, 21 nt, Mycobacterium tuberculosis H37Rv
aggcccggucuuacggucggc

SEQ ID NO: 3319308 - RNA, 20 nt, Mycobacterium tuberculosis H37Rv
aggcggccaucgacgacacg

SEQ ID NO: 3319309 - RNA, 15 nt, Mycobacterium tuberculosis H37Rv
aggcggccgccggga

SEQ ID NO: 3319310 - RNA, 17 nt, Mycobacterium tuberculosis H37Rv
aggcggcgacgaccguc

SEQ ID NO: 3319311 - RNA, 15 nt, Mycobacterium tuberculosis H37Rv
aggcggcgccagugc

SEQ ID NO: 3319312 - RNA, 14 nt, Mycobacterium tuberculosis H37Rv
aggcggcgccgcac

SEQ ID NO: 3319313 - RNA, 15 nt, Mycobacterium tuberculosis H37Rv
aggcggcggccuggc

SEQ ID NO: 3319314 - RNA, 18 nt, Mycobacterium tuberculosis H37Rv
aggcggcggucgagcucg

SEQ ID NO: 3319315 - RNA, 14 nt, Mycobacterium tuberculosis H37Rv
aggcgggcggcacc

SEQ ID NO: 3319316 - RNA, 14 nt, Mycobacterium tuberculosis H37Rv
aggcgggucgccgc

SEQ ID NO: 3319317 - RNA, 14 nt, Mycobacterium tuberculosis H37Rv
aggcgguguccaga

SEQ ID NO: 3319318 - RNA, 14 nt, Mycobacterium tuberculosis H37Rv
aggcgucccagccg

SEQ ID NO: 3319319 - RNA, 18 nt, Mycobacterium tuberculosis H37Rv
aggcgucccagccgauca

SEQ ID NO: 3319320 - RNA, 19 nt, Mycobacterium tuberculosis H37Rv
aggcgugacgcuaacgucg

SEQ ID NO: 3319321 - RNA, 13 nt, Mycobacterium tuberculosis H37Rv
aggcgugcacagg

SEQ ID NO: 3319322 - RNA, 18 nt, Mycobacterium tuberculosis H37Rv
aggcgugcacaggucagc

SEQ ID NO: 3319323 - RNA, 19 nt, Mycobacterium tuberculosis H37Rv
aggcgugcacccccaucac

SEQ ID NO: 3319324 - RNA, 24 nt, Mycobacterium tuberculosis H37Rv
aggcgugucgucgcggccgguuca

SEQ ID NO: 3319325 - RNA, 23 nt, Mycobacterium tuberculosis H37Rv
aggcguucgacucgaccgcgacg

SEQ ID NO: 3319326 - RNA, 18 nt, Mycobacterium tuberculosis H37Rv
aggcguuggaucccagcc

SEQ ID NO: 3319327 - RNA, 19 nt, Mycobacterium tuberculosis H37Rv
aggcguuguagcgguccag

SEQ ID NO: 3319328 - RNA, 21 nt, Mycobacterium tuberculosis H37Rv
aggcguuguagcgguccagcg

SEQ ID NO: 3319329 - RNA, 15 nt, Mycobacterium tuberculosis H37Rv
aggcuaaucagccag

SEQ ID NO: 3319330 - RNA, 15 nt, Mycobacterium tuberculosis H37Rv
aggcucauccgccgg

SEQ ID NO: 3319331 - RNA, 22 nt, Mycobacterium tuberculosis H37Rv
aggcuccaagcaauuccaccgc

SEQ ID NO: 3319332 - RNA, 23 nt, Mycobacterium tuberculosis H37Rv
aggcuccagcgcgcgccgcagcg

SEQ ID NO: 3319333 - RNA, 16 nt, Mycobacterium tuberculosis H37Rv
aggcucccccaccagg

SEQ ID NO: 3319334 - RNA, 21 nt, Mycobacterium tuberculosis H37Rv
aggcucccccaccagggacga

SEQ ID NO: 3319335 - RNA, 21 nt, Mycobacterium tuberculosis H37Rv
aggcucgagguguagcccucc

SEQ ID NO: 3319336 - RNA, 12 nt, Mycobacterium tuberculosis H37Rv
aggcucgcagga

SEQ ID NO: 3319337 - RNA, 19 nt, Mycobacterium tuberculosis H37Rv
aggcucgcguggccgccgg

SEQ ID NO: 3319338 - RNA, 14 nt, Mycobacterium tuberculosis H37Rv
aggcucucguagcg

SEQ ID NO: 3319339 - RNA, 18 nt, Mycobacterium tuberculosis H37Rv
aggcucucguagcgcuca

SEQ ID NO: 3319340 - RNA, 15 nt, Mycobacterium tuberculosis H37Rv
aggcugaucccgaug

SEQ ID NO: 3319341 - RNA, 21 nt, Mycobacterium tuberculosis H37Rv
aggcugcagugccgcacccag

SEQ ID NO: 3319342 - RNA, 23 nt, Mycobacterium tuberculosis H37Rv
aggcugccgaaguugaagaagcc

SEQ ID NO: 3319343 - RNA, 11 nt, Mycobacterium tuberculosis H37Rv
aggcuggaggu

SEQ ID NO: 3319344 - RNA, 14 nt, Mycobacterium tuberculosis H37Rv
aggcuggaggugaa

SEQ ID NO: 3319345 - RNA, 18 nt, Mycobacterium tuberculosis H37Rv
aggcuggaggugaacucg

SEQ ID NO: 3319346 - RNA, 16 nt, Mycobacterium tuberculosis H37Rv
aggcuggcgagggcug

SEQ ID NO: 3319347 - RNA, 22 nt, Mycobacterium tuberculosis H37Rv
aggcugggcagaccgaucggca

SEQ ID NO: 3319348 - RNA, 16 nt, Mycobacterium tuberculosis H37Rv
aggcuggucugcaggc

SEQ ID NO: 3319349 - RNA, 17 nt, Mycobacterium tuberculosis H37Rv
aggcuggucugcaggcg

SEQ ID NO: 3319350 - RNA, 17 nt, Mycobacterium tuberculosis H37Rv
aggcugguuucggccgc

SEQ ID NO: 3319351 - RNA, 16 nt, Mycobacterium tuberculosis H37Rv
aggcuguaacacccgg

SEQ ID NO: 3319352 - RNA, 17 nt, Mycobacterium tuberculosis H37Rv
aggcuguaacacccggc

SEQ ID NO: 3319353 - RNA, 19 nt, Mycobacterium tuberculosis H37Rv
aggcuguccagcagcgaaa

SEQ ID NO: 3319354 - RNA, 22 nt, Mycobacterium tuberculosis H37Rv
aggcuguccgacuucuccaggc

SEQ ID NO: 3319355 - RNA, 19 nt, Mycobacterium tuberculosis H37Rv
aggcugucgcgggccacca

SEQ ID NO: 3319356 - RNA, 20 nt, Mycobacterium tuberculosis H37Rv
aggcugugccccagggcagu

SEQ ID NO: 3319357 - RNA, 22 nt, Mycobacterium tuberculosis H37Rv
aggcugugccccagggcagugc

SEQ ID NO: 3319358 - RNA, 21 nt, Mycobacterium tuberculosis H37Rv
aggcuguggccagcaucauca

SEQ ID NO: 3319359 - RNA, 12 nt, Mycobacterium tuberculosis H37Rv
aggcuuccagcc

SEQ ID NO: 3319360 - RNA, 17 nt, Mycobacterium tuberculosis H37Rv
aggcuuccagccacagc

SEQ ID NO: 3319361 - RNA, 11 nt, Mycobacterium tuberculosis H37Rv
aggcuucccug

SEQ ID NO: 3319362 - RNA, 18 nt, Mycobacterium tuberculosis H37Rv
aggcuugacugcacacca

SEQ ID NO: 3319363 - RNA, 14 nt, Mycobacterium tuberculosis H37Rv
aggcuugcggcacc

SEQ ID NO: 3319364 - RNA, 17 nt, Mycobacterium tuberculosis H37Rv
aggcuugcggcacccag

SEQ ID NO: 3319365 - RNA, 22 nt, Mycobacterium tuberculosis H37Rv
aggcuuucgauauagccgccgg

SEQ ID NO: 3319366 - RNA, 16 nt, Mycobacterium tuberculosis H37Rv
agggaagccugcgggc

SEQ ID NO: 3319367 - RNA, 15 nt, Mycobacterium tuberculosis H37Rv
agggagcgcagcgcc

SEQ ID NO: 3319368 - RNA, 19 nt, Mycobacterium tuberculosis H37Rv
agggagcgccgcagggucc

SEQ ID NO: 3319369 - RNA, 14 nt, Mycobacterium tuberculosis H37Rv
agggaggggccguc

SEQ ID NO: 3319370 - RNA, 21 nt, Mycobacterium tuberculosis H37Rv
agggauccgaagagccagcaa

SEQ ID NO: 3319371 - RNA, 14 nt, Mycobacterium tuberculosis H37Rv
agggaucgcaggga

SEQ ID NO: 3319372 - RNA, 17 nt, Mycobacterium tuberculosis H37Rv
agggaucgcagggauca

SEQ ID NO: 3319373 - RNA, 19 nt, Mycobacterium tuberculosis H37Rv
agggaucuagaggcggccc

SEQ ID NO: 3319374 - RNA, 20 nt, Mycobacterium tuberculosis H37Rv
agggaucuagaggcggcccc

SEQ ID NO: 3319375 - RNA, 15 nt, Mycobacterium tuberculosis H37Rv
agggaugaucaccgg

SEQ ID NO: 3319376 - RNA, 18 nt, Mycobacterium tuberculosis H37Rv
agggauguagugcugcuc

SEQ ID NO: 3319377 - RNA, 12 nt, Mycobacterium tuberculosis H37Rv
agggcaacagug

SEQ ID NO: 3319378 - RNA, 13 nt, Mycobacterium tuberculosis H37Rv
agggcacaucggg

SEQ ID NO: 3319379 - RNA, 14 nt, Mycobacterium tuberculosis H37Rv
agggcaccggcgau

SEQ ID NO: 3319380 - RNA, 15 nt, Mycobacterium tuberculosis H37Rv
agggcaccggcgauc

SEQ ID NO: 3319381 - RNA, 20 nt, Mycobacterium tuberculosis H37Rv
agggcagcagcccgggcagc

SEQ ID NO: 3319382 - RNA, 19 nt, Mycobacterium tuberculosis H37Rv
agggcagccgcccacccgg

SEQ ID NO: 3319383 - RNA, 16 nt, Mycobacterium tuberculosis H37Rv
agggcagcgccaggcc

SEQ ID NO: 3319384 - RNA, 20 nt, Mycobacterium tuberculosis H37Rv
agggcagcgccaggccguug

SEQ ID NO: 3319385 - RNA, 16 nt, Mycobacterium tuberculosis H37Rv
agggcauacagcaugu

SEQ ID NO: 3319386 - RNA, 14 nt, Mycobacterium tuberculosis H37Rv
agggcauccgagcg

SEQ ID NO: 3319387 - RNA, 13 nt, Mycobacterium tuberculosis H37Rv
agggcaucgagac

SEQ ID NO: 3319388 - RNA, 21 nt, Mycobacterium tuberculosis H37Rv
agggccaccgccgccugcccg

SEQ ID NO: 3319389 - RNA, 14 nt, Mycobacterium tuberculosis H37Rv
agggccagcggcag

SEQ ID NO: 3319390 - RNA, 20 nt, Mycobacterium tuberculosis H37Rv
agggccccaccgagcgguga

SEQ ID NO: 3319391 - RNA, 16 nt, Mycobacterium tuberculosis H37Rv
agggcccuggcggccc

SEQ ID NO: 3319392 - RNA, 13 nt, Mycobacterium tuberculosis H37Rv
agggccgacgucg

SEQ ID NO: 3319393 - RNA, 11 nt, Mycobacterium tuberculosis H37Rv
agggccgccgc

SEQ ID NO: 3319394 - RNA, 23 nt, Mycobacterium tuberculosis H37Rv
agggccgccgcgaacgggucggg

SEQ ID NO: 3319395 - RNA, 18 nt, Mycobacterium tuberculosis H37Rv
agggccgccgcugccgcc

SEQ ID NO: 3319396 - RNA, 20 nt, Mycobacterium tuberculosis H37Rv
agggccgcgaucgacggugu

SEQ ID NO: 3319397 - RNA, 21 nt, Mycobacterium tuberculosis H37Rv
agggccgcucgccucgauggc

SEQ ID NO: 3319398 - RNA, 17 nt, Mycobacterium tuberculosis H37Rv
agggccggcgguggggg

SEQ ID NO: 3319399 - RNA, 17 nt, Mycobacterium tuberculosis H37Rv
agggccggugacucaga

SEQ ID NO: 3319400 - RNA, 18 nt, Mycobacterium tuberculosis H37Rv
agggccuguucgagaucg

SEQ ID NO: 3319401 - RNA, 16 nt, Mycobacterium tuberculosis H37Rv
agggccuguuuaccuu

SEQ ID NO: 3319402 - RNA, 15 nt, Mycobacterium tuberculosis H37Rv
agggccuuggcggga

SEQ ID NO: 3319403 - RNA, 19 nt, Mycobacterium tuberculosis H37Rv
agggcgccacugaccgcga

SEQ ID NO: 3319404 - RNA, 22 nt, Mycobacterium tuberculosis H37Rv
aggucgacaccgcggugccccg

SEQ ID NO: 3319405 - RNA, 24 nt, Mycobacterium tuberculosis H37Rv
aggucgacaccgcggugccccgga

SEQ ID NO: 3319406 - RNA, 14 nt, Mycobacterium tuberculosis H37Rv
aggucgacgggcac

SEQ ID NO: 3319407 - RNA, 17 nt, Mycobacterium tuberculosis H37Rv
aggucgagcgaccccac

SEQ ID NO: 3319408 - RNA, 15 nt, Mycobacterium tuberculosis H37Rv
aggucgagcgccgcg

SEQ ID NO: 3319409 - RNA, 15 nt, Mycobacterium tuberculosis H37Rv
aggucgaugccggcu

SEQ ID NO: 3319410 - RNA, 19 nt, Mycobacterium tuberculosis H37Rv
aggucgccgccgccacggc

SEQ ID NO: 3319411 - RNA, 22 nt, Mycobacterium tuberculosis H37Rv
aggucgccggccacgaccucuu

SEQ ID NO: 3319412 - RNA, 21 nt, Mycobacterium tuberculosis H37Rv
aggucgccuucccagccgacg

SEQ ID NO: 3319413 - RNA, 14 nt, Mycobacterium tuberculosis H37Rv
aggucgcgcaguug

SEQ ID NO: 3319414 - RNA, 15 nt, Mycobacterium tuberculosis H37Rv
aggucgcggucgagc

SEQ ID NO: 3319415 - RNA, 18 nt, Mycobacterium tuberculosis H37Rv
aggucgcggucuuugagc

SEQ ID NO: 3319416 - RNA, 12 nt, Mycobacterium tuberculosis H37Rv
aggucggccacc

SEQ ID NO: 3319417 - RNA, 13 nt, Mycobacterium tuberculosis H37Rv
aggucggccaccg

SEQ ID NO: 3319418 - RNA, 15 nt, Mycobacterium tuberculosis H37Rv
aggucggccaccgug

SEQ ID NO: 3319419 - RNA, 23 nt, Mycobacterium tuberculosis H37Rv
aggucggccagcagcagugccac

SEQ ID NO: 3319420 - RNA, 21 nt, Mycobacterium tuberculosis H37Rv
aggucggcgaacaaccgccgc

SEQ ID NO: 3319421 - RNA, 14 nt, Mycobacterium tuberculosis H37Rv
aggucggcgaucug

SEQ ID NO: 3319422 - RNA, 13 nt, Mycobacterium tuberculosis H37Rv
aggucggcgauga

SEQ ID NO: 3319423 - RNA, 19 nt, Mycobacterium tuberculosis H37Rv
aggucgggcccccggcagc

SEQ ID NO: 3319424 - RNA, 19 nt, Mycobacterium tuberculosis H37Rv
aggucggggaacgcggcga

SEQ ID NO: 3319425 - RNA, 20 nt, Mycobacterium tuberculosis H37Rv
aggucgguaccccagcgcug

SEQ ID NO: 3319426 - RNA, 15 nt, Mycobacterium tuberculosis H37Rv
aggucggugcgguca

SEQ ID NO: 3319427 - RNA, 21 nt, Mycobacterium tuberculosis H37Rv
aggucggugugcaucgccggc

SEQ ID NO: 3319428 - RNA, 20 nt, Mycobacterium tuberculosis H37Rv
aggucuccaucaaccgcgcu

SEQ ID NO: 3319429 - RNA, 21 nt, Mycobacterium tuberculosis H37Rv
aggucucugucauugcugccc

SEQ ID NO: 3319430 - RNA, 23 nt, Mycobacterium tuberculosis H37Rv
aggucucugucauugcugcccaa

SEQ ID NO: 3319431 - RNA, 20 nt, Mycobacterium tuberculosis H37Rv
aggucugacagaccgggcac

SEQ ID NO: 3319432 - RNA, 18 nt, Mycobacterium tuberculosis H37Rv
aggucuggccugccccag

SEQ ID NO: 3319433 - RNA, 22 nt, Mycobacterium tuberculosis H37Rv
aggugaacgccggugcgcugga

SEQ ID NO: 3319434 - RNA, 14 nt, Mycobacterium tuberculosis H37Rv
aggugaacugguug

SEQ ID NO: 3319435 - RNA, 17 nt, Mycobacterium tuberculosis H37Rv
aggugaaucgacugauc

SEQ ID NO: 3319436 - RNA, 17 nt, Mycobacterium tuberculosis H37Rv
aggugacaaaucggcca

SEQ ID NO: 3319437 - RNA, 20 nt, Mycobacterium tuberculosis H37Rv
aggugacgacgagggcggga

SEQ ID NO: 3319438 - RNA, 21 nt, Mycobacterium tuberculosis H37Rv
aggugacgaucaggucgccga

SEQ ID NO: 3319439 - RNA, 17 nt, Mycobacterium tuberculosis H37Rv
aggugacgccgccagca

SEQ ID NO: 3319440 - RNA, 15 nt, Mycobacterium tuberculosis H37Rv
aggugaucagcagga

SEQ ID NO: 3319441 - RNA, 17 nt, Mycobacterium tuberculosis H37Rv
aggugaucggaagaaac

SEQ ID NO: 3319442 - RNA, 23 nt, Mycobacterium tuberculosis H37Rv
aggugaugagugcggacaucguu

SEQ ID NO: 3319443 - RNA, 15 nt, Mycobacterium tuberculosis H37Rv
aggugaugccgccgu

SEQ ID NO: 3319444 - RNA, 21 nt, Mycobacterium tuberculosis H37Rv
aggugauggcuuggaccagcg

SEQ ID NO: 3319445 - RNA, 16 nt, Mycobacterium tuberculosis H37Rv
aggugcacugccgggu

SEQ ID NO: 3319446 - RNA, 15 nt, Mycobacterium tuberculosis H37Rv
aggugcaucgccaca

SEQ ID NO: 3319447 - RNA, 16 nt, Mycobacterium tuberculosis H37Rv
aggugcaugucgauga

SEQ ID NO: 3319448 - RNA, 13 nt, Mycobacterium tuberculosis H37Rv
aggugccaccugu

SEQ ID NO: 3319449 - RNA, 13 nt, Mycobacterium tuberculosis H37Rv
aggugccagacca

SEQ ID NO: 3319450 - RNA, 16 nt, Mycobacterium tuberculosis H37Rv
aggugcccaagcaguc

SEQ ID NO: 3319451 - RNA, 18 nt, Mycobacterium tuberculosis H37Rv
aggugcccaaggccagga

SEQ ID NO: 3319452 - RNA, 11 nt, Mycobacterium tuberculosis H37Rv
aggugccgggg

SEQ ID NO: 3319453 - RNA, 20 nt, Mycobacterium tuberculosis H37Rv
aggugcgccguggcaucgcc

SEQ ID NO: 3319454 - RNA, 17 nt, Mycobacterium tuberculosis H37Rv
aggugcgggccggugga

SEQ ID NO: 3319455 - RNA, 19 nt, Mycobacterium tuberculosis H37Rv
aggugcggugaucgauccg

SEQ ID NO: 3319456 - RNA, 23 nt, Mycobacterium tuberculosis H37Rv
aggugcuggugaucugcugggca

SEQ ID NO: 3319457 - RNA, 17 nt, Mycobacterium tuberculosis H37Rv
aggugcuuggggucacc

SEQ ID NO: 3319458 - RNA, 18 nt, Mycobacterium tuberculosis H37Rv
agguggaagugcaccugg

SEQ ID NO: 3319459 - RNA, 20 nt, Mycobacterium tuberculosis H37Rv
agguggaagugcaccuggau

SEQ ID NO: 3319460 - RNA, 16 nt, Mycobacterium tuberculosis H37Rv
agguggccgcaucgcc

SEQ ID NO: 3319461 - RNA, 21 nt, Mycobacterium tuberculosis H37Rv
agguggccgcgcaggggcggc

SEQ ID NO: 3319462 - RNA, 23 nt, Mycobacterium tuberculosis H37Rv
agguggccgcgcaggggcggcgu

SEQ ID NO: 3319463 - RNA, 17 nt, Mycobacterium tuberculosis H37Rv
agguggccggcuugcag

SEQ ID NO: 3319464 - RNA, 13 nt, Mycobacterium tuberculosis H37Rv
agguggcgagcgc

SEQ ID NO: 3319465 - RNA, 15 nt, Mycobacterium tuberculosis H37Rv
agguggcgcacaucg

SEQ ID NO: 3319466 - RNA, 22 nt, Mycobacterium tuberculosis H37Rv
agguggcuggcugugccgagcu

SEQ ID NO: 3319467 - RNA, 23 nt, Mycobacterium tuberculosis H37Rv
aggugggauugaagcuggccacc

SEQ ID NO: 3319468 - RNA, 15 nt, Mycobacterium tuberculosis H37Rv
aggugggcagcaggc

SEQ ID NO: 3319469 - RNA, 23 nt, Mycobacterium tuberculosis H37Rv
agguggucacgcagucgggcagc

SEQ ID NO: 3319470 - RNA, 15 nt, Mycobacterium tuberculosis H37Rv
aggugucgggcucgc

SEQ ID NO: 3319471 - RNA, 19 nt, Mycobacterium tuberculosis H37Rv
aggugugcgucuccagcug

SEQ ID NO: 3319472 - RNA, 14 nt, Mycobacterium tuberculosis H37Rv
agguguggugacag

SEQ ID NO: 3319473 - RNA, 15 nt, Mycobacterium tuberculosis H37Rv
agguguugcgguggg

SEQ ID NO: 3319474 - RNA, 17 nt, Mycobacterium tuberculosis H37Rv
agguguuggugcggggu

SEQ ID NO: 3319475 - RNA, 22 nt, Mycobacterium tuberculosis H37Rv
agguucgcaccggagucggcgu

SEQ ID NO: 3319476 - RNA, 18 nt, Mycobacterium tuberculosis H37Rv
agguucgugcguugucgg

SEQ ID NO: 3319477 - RNA, 14 nt, Mycobacterium tuberculosis H37Rv
agguugaccaccag

SEQ ID NO: 3319478 - RNA, 21 nt, Mycobacterium tuberculosis H37Rv
agguugauuggggccagguug

SEQ ID NO: 3319479 - RNA, 14 nt, Mycobacterium tuberculosis H37Rv
agguugcggacggu

SEQ ID NO: 3319480 - RNA, 15 nt, Mycobacterium tuberculosis H37Rv
agguugcguugcagg

SEQ ID NO: 3319481 - RNA, 17 nt, Mycobacterium tuberculosis H37Rv
agguugcguugcaggaa

SEQ ID NO: 3319482 - RNA, 18 nt, Mycobacterium tuberculosis H37Rv
agguuguagucagaaccg

SEQ ID NO: 3319483 - RNA, 18 nt, Mycobacterium tuberculosis H37Rv
agguuucccgggucccau

SEQ ID NO: 3319484 - RNA, 15 nt, Mycobacterium tuberculosis H37Rv
agguuugcgccgcgc

SEQ ID NO: 3319485 - RNA, 23 nt, Mycobacterium tuberculosis H37Rv
agguuugcgccgcgcagcgagga

SEQ ID NO: 3319486 - RNA, 15 nt, Mycobacterium tuberculosis H37Rv
aguaaccguccgcgg

SEQ ID NO: 3319487 - RNA, 17 nt, Mycobacterium tuberculosis H37Rv
aguacacaaauccgcac

SEQ ID NO: 3319488 - RNA, 21 nt, Mycobacterium tuberculosis H37Rv
aguaccacuguuacggccaca

SEQ ID NO: 3319489 - RNA, 16 nt, Mycobacterium tuberculosis H37Rv
aguaccccuuggacug

SEQ ID NO: 3319490 - RNA, 11 nt, Mycobacterium tuberculosis H37Rv
aguaccgcgcg

SEQ ID NO: 3319491 - RNA, 13 nt, Mycobacterium tuberculosis H37Rv
aguaccggccagc

SEQ ID NO: 3319492 - RNA, 21 nt, Mycobacterium tuberculosis H37Rv
aguaccgucaucgcggugugc

SEQ ID NO: 3319493 - RNA, 16 nt, Mycobacterium tuberculosis H37Rv
aguacgcaagcucaag

SEQ ID NO: 3319494 - RNA, 13 nt, Mycobacterium tuberculosis H37Rv
aguacgcggcuga

SEQ ID NO: 3319495 - RNA, 16 nt, Mycobacterium tuberculosis H37Rv
aguacgcugcggcuca

SEQ ID NO: 3319496 - RNA, 20 nt, Mycobacterium tuberculosis H37Rv
aguacggcgaugcggucggc

SEQ ID NO: 3319497 - RNA, 22 nt, Mycobacterium tuberculosis H37Rv
aguacgggcaggccgcugggcc

SEQ ID NO: 3319498 - RNA, 13 nt, Mycobacterium tuberculosis H37Rv
aguacgucgauca

SEQ ID NO: 3319499 - RNA, 13 nt, Mycobacterium tuberculosis H37Rv
aguacgugcacag

SEQ ID NO: 3319500 - RNA, 18 nt, Mycobacterium tuberculosis H37Rv
agucgguaucggcagaug

SEQ ID NO: 3319501 - RNA, 19 nt, Mycobacterium tuberculosis H37Rv
agucgguaucggcagaugg

SEQ ID NO: 3319502 - RNA, 13 nt, Mycobacterium tuberculosis H37Rv
agucgguccugcc

SEQ ID NO: 3319503 - RNA, 13 nt, Mycobacterium tuberculosis H37Rv
agucggugaaaug

SEQ ID NO: 3319504 - RNA, 15 nt, Mycobacterium tuberculosis H37Rv
agucggugaaaugac

SEQ ID NO: 3319505 - RNA, 22 nt, Mycobacterium tuberculosis H37Rv
agucggugaaaugacggcugaa

SEQ ID NO: 3319506 - RNA, 19 nt, Mycobacterium tuberculosis H37Rv
agucggugcagcgcacgca

SEQ ID NO: 3319507 - RNA, 19 nt, Mycobacterium tuberculosis H37Rv
agucgguggucucggcauc

SEQ ID NO: 3319508 - RNA, 19 nt, Mycobacterium tuberculosis H37Rv
agucguaguaggcgccgcg

SEQ ID NO: 3319509 - RNA, 18 nt, Mycobacterium tuberculosis H37Rv
agucgucgacuugcaggc

SEQ ID NO: 3319510 - RNA, 14 nt, Mycobacterium tuberculosis H37Rv
agucgucgagcuga

SEQ ID NO: 3319511 - RNA, 17 nt, Mycobacterium tuberculosis H37Rv
agucgucgcuugcuggg

SEQ ID NO: 3319512 - RNA, 15 nt, Mycobacterium tuberculosis H37Rv
agucgucggcaacgc

SEQ ID NO: 3319513 - RNA, 18 nt, Mycobacterium tuberculosis H37Rv
agucgucggcaacgcugg

SEQ ID NO: 3319514 - RNA, 20 nt, Mycobacterium tuberculosis H37Rv
agucgucggcaugggccggc

SEQ ID NO: 3319515 - RNA, 19 nt, Mycobacterium tuberculosis H37Rv
agucgugccgcgucggccg

SEQ ID NO: 3319516 - RNA, 18 nt, Mycobacterium tuberculosis H37Rv
agucucaagguuucgaca

SEQ ID NO: 3319517 - RNA, 15 nt, Mycobacterium tuberculosis H37Rv
agucuccggaaccac

SEQ ID NO: 3319518 - RNA, 15 nt, Mycobacterium tuberculosis H37Rv
agucucgacaaagcg

SEQ ID NO: 3319519 - RNA, 22 nt, Mycobacterium tuberculosis H37Rv
agucucgacaaagcggcugccc

SEQ ID NO: 3319520 - RNA, 17 nt, Mycobacterium tuberculosis H37Rv
agucugauggccucgcg

SEQ ID NO: 3319521 - RNA, 19 nt, Mycobacterium tuberculosis H37Rv
agucuggcgguaucgaaag

SEQ ID NO: 3319522 - RNA, 21 nt, Mycobacterium tuberculosis H37Rv
agucugggcgaucgcuucgca

SEQ ID NO: 3319523 - RNA, 14 nt, Mycobacterium tuberculosis H37Rv
agucuucggcgaca

SEQ ID NO: 3319524 - RNA, 17 nt, Mycobacterium tuberculosis H37Rv
agucuucgucgucggaa

SEQ ID NO: 3319525 - RNA, 21 nt, Mycobacterium tuberculosis H37Rv
agucuugaccgcaccggccgc

SEQ ID NO: 3319526 - RNA, 15 nt, Mycobacterium tuberculosis H37Rv
agugaagacaccagg

SEQ ID NO: 3319527 - RNA, 20 nt, Mycobacterium tuberculosis H37Rv
agugaauaccccagaccgcc

SEQ ID NO: 3319528 - RNA, 13 nt, Mycobacterium tuberculosis H37Rv
agugacagcagga

SEQ ID NO: 3319529 - RNA, 22 nt, Mycobacterium tuberculosis H37Rv
agugacagugcgucgagcauca

SEQ ID NO: 3319530 - RNA, 14 nt, Mycobacterium tuberculosis H37Rv
agugaccacgcugc

SEQ ID NO: 3319531 - RNA, 15 nt, Mycobacterium tuberculosis H37Rv
agugaccacgcugcu

SEQ ID NO: 3319532 - RNA, 18 nt, Mycobacterium tuberculosis H37Rv
agugaccgcagucccagc

SEQ ID NO: 3319533 - RNA, 21 nt, Mycobacterium tuberculosis H37Rv
agugaccgcagucccagcaca

SEQ ID NO: 3319534 - RNA, 13 nt, Mycobacterium tuberculosis H37Rv
agugaccugggcg

SEQ ID NO: 3319535 - RNA, 20 nt, Mycobacterium tuberculosis H37Rv
agugacgccacgaccgccga

SEQ ID NO: 3319536 - RNA, 22 nt, Mycobacterium tuberculosis H37Rv
agugacgguccguucgaugcca

SEQ ID NO: 3319537 - RNA, 15 nt, Mycobacterium tuberculosis H37Rv
agugacucgaucacc

SEQ ID NO: 3319538 - RNA, 16 nt, Mycobacterium tuberculosis H37Rv
agugagcgaucgggug

SEQ ID NO: 3319539 - RNA, 19 nt, Mycobacterium tuberculosis H37Rv
agugaggccgaccagcaca

SEQ ID NO: 3319540 - RNA, 14 nt, Mycobacterium tuberculosis H37Rv
agugagggucccac

SEQ ID NO: 3319541 - RNA, 15 nt, Mycobacterium tuberculosis H37Rv
agugaucaccaaccc

SEQ ID NO: 3319542 - RNA, 14 nt, Mycobacterium tuberculosis H37Rv
agugaugcgccccg

SEQ ID NO: 3319543 - RNA, 15 nt, Mycobacterium tuberculosis H37Rv
agugaugcgccccgg

SEQ ID NO: 3319544 - RNA, 14 nt, Mycobacterium tuberculosis H37Rv
agugauguggcuga

SEQ ID NO: 3319545 - RNA, 19 nt, Mycobacterium tuberculosis H37Rv
agugcacagccgggcucuc

SEQ ID NO: 3319546 - RNA, 17 nt, Mycobacterium tuberculosis H37Rv
agugcacccggaucugg

SEQ ID NO: 3319547 - RNA, 17 nt, Mycobacterium tuberculosis H37Rv
agugcacccgggccgcc

SEQ ID NO: 3319548 - RNA, 14 nt, Mycobacterium tuberculosis H37Rv
agugcaccgccugc

SEQ ID NO: 3319549 - RNA, 20 nt, Mycobacterium tuberculosis H37Rv
agugcaccgcgucguagcca

SEQ ID NO: 3319550 - RNA, 19 nt, Mycobacterium tuberculosis H37Rv
agugcacgcuugaaagcgu

SEQ ID NO: 3319551 - RNA, 22 nt, Mycobacterium tuberculosis H37Rv
agugcagaagacaagugguggu

SEQ ID NO: 3319552 - RNA, 23 nt, Mycobacterium tuberculosis H37Rv
agugcagcacgauccagcuguac

SEQ ID NO: 3319553 - RNA, 23 nt, Mycobacterium tuberculosis H37Rv
agugcaggugcccggccaaaaug

SEQ ID NO: 3319554 - RNA, 18 nt, Mycobacterium tuberculosis H37Rv
agugcagguuggccugcu

SEQ ID NO: 3319555 - RNA, 17 nt, Mycobacterium tuberculosis H37Rv
agugccacgaggacccg

SEQ ID NO: 3319556 - RNA, 21 nt, Mycobacterium tuberculosis H37Rv
agugccacgccugagccacca

SEQ ID NO: 3319557 - RNA, 24 nt, Mycobacterium tuberculosis H37Rv
agugccagcguccgucucgcaggc

SEQ ID NO: 3319558 - RNA, 19 nt, Mycobacterium tuberculosis H37Rv
agugccaggugggugaacg

SEQ ID NO: 3319559 - RNA, 22 nt, Mycobacterium tuberculosis H37Rv
agugcccacaaccgcaccaggu

SEQ ID NO: 3319560 - RNA, 18 nt, Mycobacterium tuberculosis H37Rv
agugcccgcacugccgcc

SEQ ID NO: 3319561 - RNA, 20 nt, Mycobacterium tuberculosis H37Rv
agugcccgcacugccgccgg

SEQ ID NO: 3319562 - RNA, 15 nt, Mycobacterium tuberculosis H37Rv
agugccgcacccaga

SEQ ID NO: 3319563 - RNA, 20 nt, Mycobacterium tuberculosis H37Rv
agugccgcacgauggccguc

SEQ ID NO: 3319564 - RNA, 22 nt, Mycobacterium tuberculosis H37Rv
agugccgccaccgccaccgcgg

SEQ ID NO: 3319565 - RNA, 13 nt, Mycobacterium tuberculosis H37Rv
agugccuccgaca

SEQ ID NO: 3319566 - RNA, 21 nt, Mycobacterium tuberculosis H37Rv
agugccucgauuguggccagc

SEQ ID NO: 3319567 - RNA, 18 nt, Mycobacterium tuberculosis H37Rv
agugcgaaccacgccauc

SEQ ID NO: 3319568 - RNA, 22 nt, Mycobacterium tuberculosis H37Rv
agugcgacguaaagggcgucgu

SEQ ID NO: 3319569 - RNA, 23 nt, Mycobacterium tuberculosis H37Rv
agugcgacugcgaaugcugggcc

SEQ ID NO: 3319570 - RNA, 14 nt, Mycobacterium tuberculosis H37Rv
agugcgauaccuag

SEQ ID NO: 3319571 - RNA, 19 nt, Mycobacterium tuberculosis H37Rv
agugcgcauaauauuuucc

SEQ ID NO: 3319572 - RNA, 13 nt, Mycobacterium tuberculosis H37Rv
agugcgccggcga

SEQ ID NO: 3319573 - RNA, 23 nt, Mycobacterium tuberculosis H37Rv
agugcgcgcuggaucgugcuggu

SEQ ID NO: 3319574 - RNA, 16 nt, Mycobacterium tuberculosis H37Rv
agugcgcggaucaaca

SEQ ID NO: 3319575 - RNA, 18 nt, Mycobacterium tuberculosis H37Rv
agugcggaacggccagga

SEQ ID NO: 3319576 - RNA, 21 nt, Mycobacterium tuberculosis H37Rv
agugcggccuuggcgacgucg

SEQ ID NO: 3319577 - RNA, 15 nt, Mycobacterium tuberculosis H37Rv
agugcggcugcaacg

SEQ ID NO: 3319578 - RNA, 18 nt, Mycobacterium tuberculosis H37Rv
agugcgguggcaggugau

SEQ ID NO: 3319579 - RNA, 20 nt, Mycobacterium tuberculosis H37Rv
agugcggugugugcaagccg

SEQ ID NO: 3319580 - RNA, 22 nt, Mycobacterium tuberculosis H37Rv
agugcgucucgguggcugcgcc

SEQ ID NO: 3319581 - RNA, 19 nt, Mycobacterium tuberculosis H37Rv
agugcguuggcgccggcca

SEQ ID NO: 3319582 - RNA, 12 nt, Mycobacterium tuberculosis H37Rv
agugcuccaccu

SEQ ID NO: 3319583 - RNA, 21 nt, Mycobacterium tuberculosis H37Rv
agugcucgcaaucguuggcca

SEQ ID NO: 3319584 - RNA, 13 nt, Mycobacterium tuberculosis H37Rv
agugcucgcagcc

SEQ ID NO: 3319585 - RNA, 22 nt, Mycobacterium tuberculosis H37Rv
agugcugccuugggaccgcgcc

SEQ ID NO: 3319586 - RNA, 23 nt, Mycobacterium tuberculosis H37Rv
agugcuuuggguccgggcggccg

SEQ ID NO: 3319587 - RNA, 17 nt, Mycobacterium tuberculosis H37Rv
aguggaagccgaccacc

SEQ ID NO: 3319588 - RNA, 14 nt, Mycobacterium tuberculosis H37Rv
aguggcaaucccgc

SEQ ID NO: 3319589 - RNA, 16 nt, Mycobacterium tuberculosis H37Rv
aguggcccgcgggcaa

SEQ ID NO: 3319590 - RNA, 17 nt, Mycobacterium tuberculosis H37Rv
aguggcccgcgggcaag

SEQ ID NO: 3319591 - RNA, 19 nt, Mycobacterium tuberculosis H37Rv
aguggccgcauuagccugc

SEQ ID NO: 3319592 - RNA, 13 nt, Mycobacterium tuberculosis H37Rv
aguggccguggau

SEQ ID NO: 3319593 - RNA, 14 nt, Mycobacterium tuberculosis H37Rv
aguggcgaguggcu

SEQ ID NO: 3319594 - RNA, 13 nt, Mycobacterium tuberculosis H37Rv
agugggacuggcg

SEQ ID NO: 3319595 - RNA, 18 nt, Mycobacterium tuberculosis H37Rv
agugggcuuuugcgucug

SEQ ID NO: 3319596 - RNA, 16 nt, Mycobacterium tuberculosis H37Rv
auaacccaaccgcgcc

SEQ ID NO: 3319597 - RNA, 10 nt, Mycobacterium tuberculosis H37Rv
auaacccagc

SEQ ID NO: 3319598 - RNA, 15 nt, Mycobacterium tuberculosis H37Rv
auaaccggccauguc

SEQ ID NO: 3319599 - RNA, 19 nt, Mycobacterium tuberculosis H37Rv
auaaccguugaccucuucg

SEQ ID NO: 3319600 - RNA, 14 nt, Mycobacterium tuberculosis H37Rv
auaacgcggaguuc

SEQ ID NO: 3319601 - RNA, 19 nt, Mycobacterium tuberculosis H37Rv
auaaggcgucaauguggau

SEQ ID NO: 3319602 - RNA, 17 nt, Mycobacterium tuberculosis H37Rv
auaagguucgugcguug

SEQ ID NO: 3319603 - RNA, 22 nt, Mycobacterium tuberculosis H37Rv
auaauucaacagcaccgcgacg

SEQ ID NO: 3319604 - RNA, 20 nt, Mycobacterium tuberculosis H37Rv
auacacauuuccaacguaug

SEQ ID NO: 3319605 - RNA, 17 nt, Mycobacterium tuberculosis H37Rv
auacagaucuggguucc

SEQ ID NO: 3319606 - RNA, 16 nt, Mycobacterium tuberculosis H37Rv
auacagcaauccgcaa

SEQ ID NO: 3319607 - RNA, 22 nt, Mycobacterium tuberculosis H37Rv
auacagcggaauuagucgccgc

SEQ ID NO: 3319608 - RNA, 22 nt, Mycobacterium tuberculosis H37Rv
auaccacuuugcguucccaucc

SEQ ID NO: 3319609 - RNA, 20 nt, Mycobacterium tuberculosis H37Rv
auaccagaccggccgacgug

SEQ ID NO: 3319610 - RNA, 21 nt, Mycobacterium tuberculosis H37Rv
auaccagcguuugaacgcaug

SEQ ID NO: 3319611 - RNA, 17 nt, Mycobacterium tuberculosis H37Rv
auaccagggcaucagca

SEQ ID NO: 3319612 - RNA, 24 nt, Mycobacterium tuberculosis H37Rv
auaccaguccggcggacgugacca

SEQ ID NO: 3319613 - RNA, 18 nt, Mycobacterium tuberculosis H37Rv
auacccagcgcagcagcg

SEQ ID NO: 3319614 - RNA, 13 nt, Mycobacterium tuberculosis H37Rv
auacccagcgccc

SEQ ID NO: 3319615 - RNA, 13 nt, Mycobacterium tuberculosis H37Rv
auacccaggaugu

SEQ ID NO: 3319616 - RNA, 15 nt, Mycobacterium tuberculosis H37Rv
auacccgcuggcccg

SEQ ID NO: 3319617 - RNA, 23 nt, Mycobacterium tuberculosis H37Rv
auaccgaaccgguguagcagcgc

SEQ ID NO: 3319618 - RNA, 16 nt, Mycobacterium tuberculosis H37Rv
auaccgaggaucucgc

SEQ ID NO: 3319619 - RNA, 14 nt, Mycobacterium tuberculosis H37Rv
auaccgccagcgcc

SEQ ID NO: 3319620 - RNA, 19 nt, Mycobacterium tuberculosis H37Rv
auaccgcugggucgccguu

SEQ ID NO: 3319621 - RNA, 19 nt, Mycobacterium tuberculosis H37Rv
auaccggccgccaucaucg

SEQ ID NO: 3319622 - RNA, 20 nt, Mycobacterium tuberculosis H37Rv
auaccggcggcgagcggccu

SEQ ID NO: 3319623 - RNA, 15 nt, Mycobacterium tuberculosis H37Rv
auaccggcuggccag

SEQ ID NO: 3319624 - RNA, 17 nt, Mycobacterium tuberculosis H37Rv
auaccggcuggccaggu

SEQ ID NO: 3319625 - RNA, 21 nt, Mycobacterium tuberculosis H37Rv
auaccggcuggccagguggcc

SEQ ID NO: 3319626 - RNA, 15 nt, Mycobacterium tuberculosis H37Rv
auaccgguggcagcc

SEQ ID NO: 3319627 - RNA, 21 nt, Mycobacterium tuberculosis H37Rv
auaccgguggcagccugcugc

SEQ ID NO: 3319628 - RNA, 16 nt, Mycobacterium tuberculosis H37Rv
auaccgugcaccucca

SEQ ID NO: 3319629 - RNA, 18 nt, Mycobacterium tuberculosis H37Rv
auaccgugcaccuccagg

SEQ ID NO: 3319630 - RNA, 14 nt, Mycobacterium tuberculosis H37Rv
auaccucgccaucc

SEQ ID NO: 3319631 - RNA, 15 nt, Mycobacterium tuberculosis H37Rv
auaccugccggacca

SEQ ID NO: 3319632 - RNA, 20 nt, Mycobacterium tuberculosis H37Rv
auaccugggacaggacgacu

SEQ ID NO: 3319633 - RNA, 18 nt, Mycobacterium tuberculosis H37Rv
auaccuuccagaucgcgg

SEQ ID NO: 3319634 - RNA, 17 nt, Mycobacterium tuberculosis H37Rv
auacgagcagugaccgc

SEQ ID NO: 3319635 - RNA, 19 nt, Mycobacterium tuberculosis H37Rv
auacgccggccgcgcuggu

SEQ ID NO: 3319636 - RNA, 13 nt, Mycobacterium tuberculosis H37Rv
auacgggcaguga

SEQ ID NO: 3319637 - RNA, 16 nt, Mycobacterium tuberculosis H37Rv
auacggguguggccgu

SEQ ID NO: 3319638 - RNA, 15 nt, Mycobacterium tuberculosis H37Rv
auacucaccgacgcg

SEQ ID NO: 3319639 - RNA, 19 nt, Mycobacterium tuberculosis H37Rv
auacucgaguggcgaacgg

SEQ ID NO: 3319640 - RNA, 21 nt, Mycobacterium tuberculosis H37Rv
auacucgaguggcgaacgggu

SEQ ID NO: 3319641 - RNA, 19 nt, Mycobacterium tuberculosis H37Rv
auacucucgcgacaucacc

SEQ ID NO: 3319642 - RNA, 14 nt, Mycobacterium tuberculosis H37Rv
auagaacucgccgc

SEQ ID NO: 3319643 - RNA, 15 nt, Mycobacterium tuberculosis H37Rv
auagauucccggcuc

SEQ ID NO: 3319644 - RNA, 20 nt, Mycobacterium tuberculosis H37Rv
auagauucccggcucgaugg

SEQ ID NO: 3319645 - RNA, 16 nt, Mycobacterium tuberculosis H37Rv
auagcaacggugcucu

SEQ ID NO: 3319646 - RNA, 17 nt, Mycobacterium tuberculosis H37Rv
auagcaccaguuugugc

SEQ ID NO: 3319647 - RNA, 15 nt, Mycobacterium tuberculosis H37Rv
auagcaccucgauga

SEQ ID NO: 3319648 - RNA, 18 nt, Mycobacterium tuberculosis H37Rv
auagccaucacgacuccc

SEQ ID NO: 3319649 - RNA, 14 nt, Mycobacterium tuberculosis H37Rv
auagcccaagccga

SEQ ID NO: 3319650 - RNA, 13 nt, Mycobacterium tuberculosis H37Rv
auagccgaacagc

SEQ ID NO: 3319651 - RNA, 20 nt, Mycobacterium tuberculosis H37Rv
auagccgaccagguagacca

SEQ ID NO: 3319652 - RNA, 19 nt, Mycobacterium tuberculosis H37Rv
auagccggacaacuggugg

SEQ ID NO: 3319653 - RNA, 21 nt, Mycobacterium tuberculosis H37Rv
auagccgguugucgcagcgca

SEQ ID NO: 3319654 - RNA, 16 nt, Mycobacterium tuberculosis H37Rv
auagccguucggcauc

SEQ ID NO: 3319655 - RNA, 19 nt, Mycobacterium tuberculosis H37Rv
auagcgcggcaccagcacc

SEQ ID NO: 3319656 - RNA, 14 nt, Mycobacterium tuberculosis H37Rv
auagcggcccgauc

SEQ ID NO: 3319657 - RNA, 16 nt, Mycobacterium tuberculosis H37Rv
auagcggcccgaucac

SEQ ID NO: 3319658 - RNA, 17 nt, Mycobacterium tuberculosis H37Rv
auagcgggcgguagcca

SEQ ID NO: 3319659 - RNA, 19 nt, Mycobacterium tuberculosis H37Rv
auagcugcgcgaagccacc

SEQ ID NO: 3319660 - RNA, 20 nt, Mycobacterium tuberculosis H37Rv
auagcugcgcgaagccacca

SEQ ID NO: 3319661 - RNA, 20 nt, Mycobacterium tuberculosis H37Rv
auagcugcguccggaaccaa

SEQ ID NO: 3319662 - RNA, 23 nt, Mycobacterium tuberculosis H37Rv
auagcuuuucgcaagucuccucg

SEQ ID NO: 3319663 - RNA, 17 nt, Mycobacterium tuberculosis H37Rv
auaggaccacgggaugc

SEQ ID NO: 3319664 - RNA, 16 nt, Mycobacterium tuberculosis H37Rv
auaggcaaggucaacc

SEQ ID NO: 3319665 - RNA, 18 nt, Mycobacterium tuberculosis H37Rv
auaggcggccaucgacga

SEQ ID NO: 3319666 - RNA, 22 nt, Mycobacterium tuberculosis H37Rv
auaggucagaauugugugcagc

SEQ ID NO: 3319667 - RNA, 18 nt, Mycobacterium tuberculosis H37Rv
auaggucgggcaugacga

SEQ ID NO: 3319668 - RNA, 18 nt, Mycobacterium tuberculosis H37Rv
auaguccuugcgccagcg

SEQ ID NO: 3319669 - RNA, 22 nt, Mycobacterium tuberculosis H37Rv
auaguccuugcgccagcgggcu

SEQ ID NO: 3319670 - RNA, 17 nt, Mycobacterium tuberculosis H37Rv
auagucgccgucgcccc

SEQ ID NO: 3319671 - RNA, 18 nt, Mycobacterium tuberculosis H37Rv
auaguguguuuggugguu

SEQ ID NO: 3319672 - RNA, 14 nt, Mycobacterium tuberculosis H37Rv
auaguuguuccugg

SEQ ID NO: 3319673 - RNA, 21 nt, Mycobacterium tuberculosis H37Rv
auauagccggugucugggugg

SEQ ID NO: 3319674 - RNA, 19 nt, Mycobacterium tuberculosis H37Rv
auauagggcuccucgugca

SEQ ID NO: 3319675 - RNA, 13 nt, Mycobacterium tuberculosis H37Rv
auaucacaacugc

SEQ ID NO: 3319676 - RNA, 23 nt, Mycobacterium tuberculosis H37Rv
auauccggacuugaccagagcac

SEQ ID NO: 3319677 - RNA, 20 nt, Mycobacterium tuberculosis H37Rv
auauccgggagugcgccggc

SEQ ID NO: 3319678 - RNA, 22 nt, Mycobacterium tuberculosis H37Rv
auauccgugaauggcagcacga

SEQ ID NO: 3319679 - RNA, 22 nt, Mycobacterium tuberculosis H37Rv
auaucgcccaccacgaacacgu

SEQ ID NO: 3319680 - RNA, 22 nt, Mycobacterium tuberculosis H37Rv
auaucggcacggucacacgcca

SEQ ID NO: 3319681 - RNA, 21 nt, Mycobacterium tuberculosis H37Rv
auaucgggagcggcugcggca

SEQ ID NO: 3319682 - RNA, 19 nt, Mycobacterium tuberculosis H37Rv
auaucggugaccguggcgg

SEQ ID NO: 3319683 - RNA, 17 nt, Mycobacterium tuberculosis H37Rv
auaucgucgggagagug

SEQ ID NO: 3319684 - RNA, 20 nt, Mycobacterium tuberculosis H37Rv
auaucucgagcccucguuau

SEQ ID NO: 3319685 - RNA, 16 nt, Mycobacterium tuberculosis H37Rv
auaucucgccguacau

SEQ ID NO: 3319686 - RNA, 11 nt, Mycobacterium tuberculosis H37Rv
auaucugccac

SEQ ID NO: 3319687 - RNA, 19 nt, Mycobacterium tuberculosis H37Rv
auaucuuuagcgcgugcug

SEQ ID NO: 3319688 - RNA, 16 nt, Mycobacterium tuberculosis H37Rv
auaugacggcagacca

SEQ ID NO: 3319689 - RNA, 12 nt, Mycobacterium tuberculosis H37Rv
auaugccgccgg

SEQ ID NO: 3319690 - RNA, 18 nt, Mycobacterium tuberculosis H37Rv
auauggcagugucguggu

SEQ ID NO: 3319691 - RNA, 22 nt, Mycobacterium tuberculosis H37Rv
auauggucaccggacugcgccg

SEQ ID NO: 3319692 - RNA, 20 nt, Mycobacterium tuberculosis H37Rv
aacaugaguggcaaucccgc

SEQ ID NO: 3319693 - RNA, 17 nt, Mycobacterium tuberculosis H37Rv
aacaugcucacgaucac

SEQ ID NO: 3319694 - RNA, 21 nt, Mycobacterium tuberculosis H37Rv
aacaugcuggagaaaccacug

SEQ ID NO: 3319695 - RNA, 23 nt, Mycobacterium tuberculosis H37Rv
aacauuuucgcccgcuccgggac

SEQ ID NO: 3319696 - RNA, 19 nt, Mycobacterium tuberculosis H37Rv
aaccaaccucggaucgcca

SEQ ID NO: 3319697 - RNA, 20 nt, Mycobacterium tuberculosis H37Rv
aaccaaccucggaucgccag

SEQ ID NO: 3319698 - RNA, 18 nt, Mycobacterium tuberculosis H37Rv
aaccaagaaucaccggca

SEQ ID NO: 3319699 - RNA, 14 nt, Mycobacterium tuberculosis H37Rv
aaccacaucaccgg

SEQ ID NO: 3319700 - RNA, 13 nt, Mycobacterium tuberculosis H37Rv
aaccaccagcacg

SEQ ID NO: 3319701 - RNA, 18 nt, Mycobacterium tuberculosis H37Rv
aaccacccacccgcacca

SEQ ID NO: 3319702 - RNA, 16 nt, Mycobacterium tuberculosis H37Rv
aaccacccaccggcca

SEQ ID NO: 3319703 - RNA, 16 nt, Mycobacterium tuberculosis H37Rv
aaccaccggccgcgca

SEQ ID NO: 3319704 - RNA, 19 nt, Mycobacterium tuberculosis H37Rv
aaccacucgcucaggaaca

SEQ ID NO: 3319705 - RNA, 15 nt, Mycobacterium tuberculosis H37Rv
aaccacuguuucuga

SEQ ID NO: 3319706 - RNA, 18 nt, Mycobacterium tuberculosis H37Rv
aaccagaguucggccagc

SEQ ID NO: 3319707 - RNA, 13 nt, Mycobacterium tuberculosis H37Rv
aaccagcagcagg

SEQ ID NO: 3319708 - RNA, 16 nt, Mycobacterium tuberculosis H37Rv
aaccagccaccaccag

SEQ ID NO: 3319709 - RNA, 20 nt, Mycobacterium tuberculosis H37Rv
aaccagccaccaccaggucg

SEQ ID NO: 3319710 - RNA, 17 nt, Mycobacterium tuberculosis H37Rv
aaccagccgcggaucau

SEQ ID NO: 3319711 - RNA, 22 nt, Mycobacterium tuberculosis H37Rv
aaccagcgaaaugcccaucacc

SEQ ID NO: 3319712 - RNA, 18 nt, Mycobacterium tuberculosis H37Rv
aaccagcgaccuagcagc

SEQ ID NO: 3319713 - RNA, 22 nt, Mycobacterium tuberculosis H37Rv
aaccagcgauggguguugcugg

SEQ ID NO: 3319714 - RNA, 22 nt, Mycobacterium tuberculosis H37Rv
aaccagcggucggcgaccacca

SEQ ID NO: 3319715 - RNA, 20 nt, Mycobacterium tuberculosis H37Rv
aaccaggaugguugcgacgg

SEQ ID NO: 3319716 - RNA, 17 nt, Mycobacterium tuberculosis H37Rv
aaccaggcggccgcguc

SEQ ID NO: 3319717 - RNA, 17 nt, Mycobacterium tuberculosis H37Rv
aaccaggugagcgacgc

SEQ ID NO: 3319718 - RNA, 14 nt, Mycobacterium tuberculosis H37Rv
aaccagucgaccca

SEQ ID NO: 3319719 - RNA, 22 nt, Mycobacterium tuberculosis H37Rv
aaccaguugacgaagaacaccu

SEQ ID NO: 3319720 - RNA, 21 nt, Mycobacterium tuberculosis H37Rv
aaccaucguuguugaccacca

SEQ ID NO: 3319721 - RNA, 20 nt, Mycobacterium tuberculosis H37Rv
aacccaaccgcgccaccucc

SEQ ID NO: 3319722 - RNA, 17 nt, Mycobacterium tuberculosis H37Rv
aacccagaucggcgacg

SEQ ID NO: 3319723 - RNA, 15 nt, Mycobacterium tuberculosis H37Rv
aacccagcaccacaa

SEQ ID NO: 3319724 - RNA, 12 nt, Mycobacterium tuberculosis H37Rv
aacccagcacug

SEQ ID NO: 3319725 - RNA, 12 nt, Mycobacterium tuberculosis H37Rv
aacccagccgcg

SEQ ID NO: 3319726 - RNA, 23 nt, Mycobacterium tuberculosis H37Rv
aacccagcgacgcggccagcggc

SEQ ID NO: 3319727 - RNA, 21 nt, Mycobacterium tuberculosis H37Rv
aacccaugucggcgcgccgca

SEQ ID NO: 3319728 - RNA, 18 nt, Mycobacterium tuberculosis H37Rv
aaccccaaguccagcagc

SEQ ID NO: 3319729 - RNA, 19 nt, Mycobacterium tuberculosis H37Rv
aaccccgaagaccuggccu

SEQ ID NO: 3319730 - RNA, 21 nt, Mycobacterium tuberculosis H37Rv
aaccccggccaccagcaugcc

SEQ ID NO: 3319731 - RNA, 14 nt, Mycobacterium tuberculosis H37Rv
aaccccuugccuuc

SEQ ID NO: 3319732 - RNA, 20 nt, Mycobacterium tuberculosis H37Rv
aacccgaaucccacagcagg

SEQ ID NO: 3319733 - RNA, 21 nt, Mycobacterium tuberculosis H37Rv
aacccgagcguguugaaauug

SEQ ID NO: 3319734 - RNA, 11 nt, Mycobacterium tuberculosis H37Rv
aacccgaucag

SEQ ID NO: 3319735 - RNA, 19 nt, Mycobacterium tuberculosis H37Rv
aacccgauguggcgcuguu

SEQ ID NO: 3319736 - RNA, 21 nt, Mycobacterium tuberculosis H37Rv
aacccgauguggcgcuguugu

SEQ ID NO: 3319737 - RNA, 18 nt, Mycobacterium tuberculosis H37Rv
aacccggauacaacacag

SEQ ID NO: 3319738 - RNA, 12 nt, Mycobacterium tuberculosis H37Rv
aacccggcgacc

SEQ ID NO: 3319739 - RNA, 17 nt, Mycobacterium tuberculosis H37Rv
aacccggcuccagcacc

SEQ ID NO: 3319740 - RNA, 18 nt, Mycobacterium tuberculosis H37Rv
aacccggucggcagcugg

SEQ ID NO: 3319741 - RNA, 13 nt, Mycobacterium tuberculosis H37Rv
aacccggugacca

SEQ ID NO: 3319742 - RNA, 19 nt, Mycobacterium tuberculosis H37Rv
aacccggugaccagcaacc

SEQ ID NO: 3319743 - RNA, 23 nt, Mycobacterium tuberculosis H37Rv
aacccgguguuccggucgcccga

SEQ ID NO: 3319744 - RNA, 21 nt, Mycobacterium tuberculosis H37Rv
aacccguaggguggccgacga

SEQ ID NO: 3319745 - RNA, 21 nt, Mycobacterium tuberculosis H37Rv
aacccguauugccaaagcccg

SEQ ID NO: 3319746 - RNA, 22 nt, Mycobacterium tuberculosis H37Rv
aacccguauugccaaagcccga

SEQ ID NO: 3319747 - RNA, 21 nt, Mycobacterium tuberculosis H37Rv
aacccgucgagccgugccucg

SEQ ID NO: 3319748 - RNA, 20 nt, Mycobacterium tuberculosis H37Rv
aacccgugcgacuucgagau

SEQ ID NO: 3319749 - RNA, 23 nt, Mycobacterium tuberculosis H37Rv
aacccuagggcggugccgccgga

SEQ ID NO: 3319750 - RNA, 14 nt, Mycobacterium tuberculosis H37Rv
aacccucagccgcg

SEQ ID NO: 3319751 - RNA, 18 nt, Mycobacterium tuberculosis H37Rv
aacccucagccgcgccgg

SEQ ID NO: 3319752 - RNA, 12 nt, Mycobacterium tuberculosis H37Rv
aacccucgccac

SEQ ID NO: 3319753 - RNA, 12 nt, Mycobacterium tuberculosis H37Rv
aacccugcaccc

SEQ ID NO: 3319754 - RNA, 22 nt, Mycobacterium tuberculosis H37Rv
aacccugccacgcgugacucgg

SEQ ID NO: 3319755 - RNA, 16 nt, Mycobacterium tuberculosis H37Rv
aacccugccgcgauga

SEQ ID NO: 3319756 - RNA, 14 nt, Mycobacterium tuberculosis H37Rv
aaccgaauuguugu

SEQ ID NO: 3319757 - RNA, 11 nt, Mycobacterium tuberculosis H37Rv
aaccgaccgug

SEQ ID NO: 3319758 - RNA, 19 nt, Mycobacterium tuberculosis H37Rv
aaccgagcgcccuccucga

SEQ ID NO: 3319759 - RNA, 17 nt, Mycobacterium tuberculosis H37Rv
aaccgcaccgucccagu

SEQ ID NO: 3319760 - RNA, 18 nt, Mycobacterium tuberculosis H37Rv
aaccgccaacauugguga

SEQ ID NO: 3319761 - RNA, 17 nt, Mycobacterium tuberculosis H37Rv
aaccgccccgugggccu

SEQ ID NO: 3319762 - RNA, 19 nt, Mycobacterium tuberculosis H37Rv
aaccgccccgugggccucg

SEQ ID NO: 3319763 - RNA, 16 nt, Mycobacterium tuberculosis H37Rv
aaccgcccgccaggcc

SEQ ID NO: 3319764 - RNA, 18 nt, Mycobacterium tuberculosis H37Rv
aaccgccggugccgauga

SEQ ID NO: 3319765 - RNA, 15 nt, Mycobacterium tuberculosis H37Rv
aaccgcgaacccgau

SEQ ID NO: 3319766 - RNA, 20 nt, Mycobacterium tuberculosis H37Rv
aaccgcggaucgaccgccag

SEQ ID NO: 3319767 - RNA, 18 nt, Mycobacterium tuberculosis H37Rv
aaccgcgugcgucagcgc

SEQ ID NO: 3319768 - RNA, 22 nt, Mycobacterium tuberculosis H37Rv
aaccgcucagcgcagcaucguc

SEQ ID NO: 3319769 - RNA, 17 nt, Mycobacterium tuberculosis H37Rv
aaccgcugauagcgguc

SEQ ID NO: 3319770 - RNA, 22 nt, Mycobacterium tuberculosis H37Rv
aaccgcugccggugugcggcgu

SEQ ID NO: 3319771 - RNA, 15 nt, Mycobacterium tuberculosis H37Rv
aaccgcuuugaauug

SEQ ID NO: 3319772 - RNA, 16 nt, Mycobacterium tuberculosis H37Rv
aaccggacgcccucac

SEQ ID NO: 3319773 - RNA, 21 nt, Mycobacterium tuberculosis H37Rv
aaccggagucgucggcaacgc

SEQ ID NO: 3319774 - RNA, 15 nt, Mycobacterium tuberculosis H37Rv
aaccggaucaucgcc

SEQ ID NO: 3319775 - RNA, 14 nt, Mycobacterium tuberculosis H37Rv
aaccggcagcggua

SEQ ID NO: 3319776 - RNA, 22 nt, Mycobacterium tuberculosis H37Rv
aaccggcauaacgaucccguga

SEQ ID NO: 3319777 - RNA, 21 nt, Mycobacterium tuberculosis H37Rv
aaccggccaugucuccgacau

SEQ ID NO: 3319778 - RNA, 14 nt, Mycobacterium tuberculosis H37Rv
aaccggccgcgacg

SEQ ID NO: 3319779 - RNA, 18 nt, Mycobacterium tuberculosis H37Rv
aaccggccgcgacgacac

SEQ ID NO: 3319780 - RNA, 16 nt, Mycobacterium tuberculosis H37Rv
aaccggcgugcagcac

SEQ ID NO: 3319781 - RNA, 17 nt, Mycobacterium tuberculosis H37Rv
aaccggcgugucgaggg

SEQ ID NO: 3319782 - RNA, 16 nt, Mycobacterium tuberculosis H37Rv
aaccgggcaaaucaag

SEQ ID NO: 3319783 - RNA, 18 nt, Mycobacterium tuberculosis H37Rv
aaccgggcaaaucaagca

SEQ ID NO: 3319784 - RNA, 20 nt, Mycobacterium tuberculosis H37Rv
aaccgggcagcaaaaaccag

SEQ ID NO: 3319785 - RNA, 14 nt, Mycobacterium tuberculosis H37Rv
aaccgguagucgcc

SEQ ID NO: 3319786 - RNA, 13 nt, Mycobacterium tuberculosis H37Rv
aaccggucagcac

SEQ ID NO: 3319787 - RNA, 12 nt, Mycobacterium tuberculosis H37Rv
aaccggucagcc

SEQ ID NO: 3319788 - RNA, 16 nt, Mycobacterium tuberculosis H37Rv
aacgggaugcggucga

SEQ ID NO: 3319789 - RNA, 23 nt, Mycobacterium tuberculosis H37Rv
aacgggcuuccgacaugaaccgg

SEQ ID NO: 3319790 - RNA, 13 nt, Mycobacterium tuberculosis H37Rv
aacgggguggcac

SEQ ID NO: 3319791 - RNA, 18 nt, Mycobacterium tuberculosis H37Rv
aacgggucggcgaccacc

SEQ ID NO: 3319792 - RNA, 18 nt, Mycobacterium tuberculosis H37Rv
aacgguacgccgccgcga

SEQ ID NO: 3319793 - RNA, 19 nt, Mycobacterium tuberculosis H37Rv
aacgguacgccgccgcgac

SEQ ID NO: 3319794 - RNA, 12 nt, Mycobacterium tuberculosis H37Rv
aacggucagggc

SEQ ID NO: 3319795 - RNA, 14 nt, Mycobacterium tuberculosis H37Rv
aacggucgaccgug

SEQ ID NO: 3319796 - RNA, 18 nt, Mycobacterium tuberculosis H37Rv
aacggucggugaacccgc

SEQ ID NO: 3319797 - RNA, 14 nt, Mycobacterium tuberculosis H37Rv
aacgguugcucguc

SEQ ID NO: 3319798 - RNA, 23 nt, Mycobacterium tuberculosis H37Rv
aacgucaccgccgggaugccggc

SEQ ID NO: 3319799 - RNA, 22 nt, Mycobacterium tuberculosis H37Rv
aacgucacguggucggccaccc

SEQ ID NO: 3319800 - RNA, 13 nt, Mycobacterium tuberculosis H37Rv
aacgucgagaucc

SEQ ID NO: 3319801 - RNA, 18 nt, Mycobacterium tuberculosis H37Rv
aacgucgagauccucguc

SEQ ID NO: 3319802 - RNA, 22 nt, Mycobacterium tuberculosis H37Rv
aacgucgauguccccggcggca

SEQ ID NO: 3319803 - RNA, 21 nt, Mycobacterium tuberculosis H37Rv
aacgucugccacgucggcgaa

SEQ ID NO: 3319804 - RNA, 19 nt, Mycobacterium tuberculosis H37Rv
aacgugaugcguucggccg

SEQ ID NO: 3319805 - RNA, 14 nt, Mycobacterium tuberculosis H37Rv
aacgugccucucuc

SEQ ID NO: 3319806 - RNA, 20 nt, Mycobacterium tuberculosis H37Rv
aacgugcgcaacgcgucguc

SEQ ID NO: 3319807 - RNA, 22 nt, Mycobacterium tuberculosis H37Rv
aacgugguauugacguggccgu

SEQ ID NO: 3319808 - RNA, 13 nt, Mycobacterium tuberculosis H37Rv
aacuaacggcagc

SEQ ID NO: 3319809 - RNA, 15 nt, Mycobacterium tuberculosis H37Rv
aacuacccgccagca

SEQ ID NO: 3319810 - RNA, 18 nt, Mycobacterium tuberculosis H37Rv
aacuacggcguccccgac

SEQ ID NO: 3319811 - RNA, 21 nt, Mycobacterium tuberculosis H37Rv
aacuacucccccgcgaaguug

SEQ ID NO: 3319812 - RNA, 16 nt, Mycobacterium tuberculosis H37Rv
aacucaacgacaccau

SEQ ID NO: 3319813 - RNA, 21 nt, Mycobacterium tuberculosis H37Rv
aacucacgcaggaaaaccccg

SEQ ID NO: 3319814 - RNA, 15 nt, Mycobacterium tuberculosis H37Rv
aacuccaugccgcug

SEQ ID NO: 3319815 - RNA, 22 nt, Mycobacterium tuberculosis H37Rv
aacucccccgcuacgcgcgcuc

SEQ ID NO: 3319816 - RNA, 23 nt, Mycobacterium tuberculosis H37Rv
aacuccgccaccaucgccucggc

SEQ ID NO: 3319817 - RNA, 19 nt, Mycobacterium tuberculosis H37Rv
aacuccgcguugggcaccu

SEQ ID NO: 3319818 - RNA, 19 nt, Mycobacterium tuberculosis H37Rv
aacuccucgcugucgauca

SEQ ID NO: 3319819 - RNA, 17 nt, Mycobacterium tuberculosis H37Rv
aacuccuuaucgucgac

SEQ ID NO: 3319820 - RNA, 22 nt, Mycobacterium tuberculosis H37Rv
aacucgaagcgguguugccgga

SEQ ID NO: 3319821 - RNA, 16 nt, Mycobacterium tuberculosis H37Rv
aacucgacgugaagau

SEQ ID NO: 3319822 - RNA, 22 nt, Mycobacterium tuberculosis H37Rv
aacucgccgcuggcaaucccgc

SEQ ID NO: 3319823 - RNA, 17 nt, Mycobacterium tuberculosis H37Rv
aacucgcgaagcaucgc

SEQ ID NO: 3319824 - RNA, 15 nt, Mycobacterium tuberculosis H37Rv
aacucggccacggcg

SEQ ID NO: 3319825 - RNA, 15 nt, Mycobacterium tuberculosis H37Rv
aacucgggggcugca

SEQ ID NO: 3319826 - RNA, 22 nt, Mycobacterium tuberculosis H37Rv
aacucggugccugucagaagga

SEQ ID NO: 3319827 - RNA, 16 nt, Mycobacterium tuberculosis H37Rv
aacucgucgcugccca

SEQ ID NO: 3319828 - RNA, 15 nt, Mycobacterium tuberculosis H37Rv
aacucuucagcaagc

SEQ ID NO: 3319829 - RNA, 23 nt, Mycobacterium tuberculosis H37Rv
aacugaauggcaccgaggccaag

SEQ ID NO: 3319830 - RNA, 19 nt, Mycobacterium tuberculosis H37Rv
aacugaucgaccgccuccu

SEQ ID NO: 3319831 - RNA, 21 nt, Mycobacterium tuberculosis H37Rv
aacugaugaaccacggcaggc

SEQ ID NO: 3319832 - RNA, 23 nt, Mycobacterium tuberculosis H37Rv
aacugcagguucuugaccagcag

SEQ ID NO: 3319833 - RNA, 16 nt, Mycobacterium tuberculosis H37Rv
aacugcccgcggcgga

SEQ ID NO: 3319834 - RNA, 18 nt, Mycobacterium tuberculosis H37Rv
aacugccgcgccgacgcc

SEQ ID NO: 3319835 - RNA, 14 nt, Mycobacterium tuberculosis H37Rv
aacugccgcggcac

SEQ ID NO: 3319836 - RNA, 16 nt, Mycobacterium tuberculosis H37Rv
aacugccggacuaccg

SEQ ID NO: 3319837 - RNA, 19 nt, Mycobacterium tuberculosis H37Rv
aacugccggacuaccgccg

SEQ ID NO: 3319838 - RNA, 15 nt, Mycobacterium tuberculosis H37Rv
aacugcgccagcaac

SEQ ID NO: 3319839 - RNA, 15 nt, Mycobacterium tuberculosis H37Rv
aacugcgccggugcc

SEQ ID NO: 3319840 - RNA, 12 nt, Mycobacterium tuberculosis H37Rv
aacugcgccguu

SEQ ID NO: 3319841 - RNA, 21 nt, Mycobacterium tuberculosis H37Rv
aacugcgccguucgcuccccc

SEQ ID NO: 3319842 - RNA, 18 nt, Mycobacterium tuberculosis H37Rv
aacugcuugcgcaucgcc

SEQ ID NO: 3319843 - RNA, 14 nt, Mycobacterium tuberculosis H37Rv
aacuggaccggugc

SEQ ID NO: 3319844 - RNA, 21 nt, Mycobacterium tuberculosis H37Rv
aacuggaccggugccagcagu

SEQ ID NO: 3319845 - RNA, 12 nt, Mycobacterium tuberculosis H37Rv
aacuggacuggg

SEQ ID NO: 3319846 - RNA, 17 nt, Mycobacterium tuberculosis H37Rv
aacuggcuugugcccaa

SEQ ID NO: 3319847 - RNA, 13 nt, Mycobacterium tuberculosis H37Rv
aacugggacugca

SEQ ID NO: 3319848 - RNA, 14 nt, Mycobacterium tuberculosis H37Rv
aacugggcaaugac

SEQ ID NO: 3319849 - RNA, 14 nt, Mycobacterium tuberculosis H37Rv
aacugggcggccug

SEQ ID NO: 3319850 - RNA, 18 nt, Mycobacterium tuberculosis H37Rv
aacugggcggccuggucg

SEQ ID NO: 3319851 - RNA, 22 nt, Mycobacterium tuberculosis H37Rv
aacuucgacaacgcauccgaca

SEQ ID NO: 3319852 - RNA, 17 nt, Mycobacterium tuberculosis H37Rv
aacuucgccagcggccc

SEQ ID NO: 3319853 - RNA, 18 nt, Mycobacterium tuberculosis H37Rv
aacuugagcuccucacgg

SEQ ID NO: 3319854 - RNA, 15 nt, Mycobacterium tuberculosis H37Rv
aacuugcugacgaau

SEQ ID NO: 3319855 - RNA, 21 nt, Mycobacterium tuberculosis H37Rv
aacuuggcggccagccgcucc

SEQ ID NO: 3319856 - RNA, 12 nt, Mycobacterium tuberculosis H37Rv
aagaaccggcau

SEQ ID NO: 3319857 - RNA, 16 nt, Mycobacterium tuberculosis H37Rv
aagaaccugagcacca

SEQ ID NO: 3319858 - RNA, 12 nt, Mycobacterium tuberculosis H37Rv
aagaaugccgcc

SEQ ID NO: 3319859 - RNA, 14 nt, Mycobacterium tuberculosis H37Rv
aagacaacccgcuc

SEQ ID NO: 3319860 - RNA, 16 nt, Mycobacterium tuberculosis H37Rv
aagacaccggcgucga

SEQ ID NO: 3319861 - RNA, 14 nt, Mycobacterium tuberculosis H37Rv
aagacagcgcggga

SEQ ID NO: 3319862 - RNA, 15 nt, Mycobacterium tuberculosis H37Rv
aagacaugcugaugg

SEQ ID NO: 3319863 - RNA, 16 nt, Mycobacterium tuberculosis H37Rv
aagaccaagagcgcgc

SEQ ID NO: 3319864 - RNA, 14 nt, Mycobacterium tuberculosis H37Rv
aagaccaccgccca

SEQ ID NO: 3319865 - RNA, 23 nt, Mycobacterium tuberculosis H37Rv
aagaccaccgcccacagcaacga

SEQ ID NO: 3319866 - RNA, 15 nt, Mycobacterium tuberculosis H37Rv
aagacccggcaccca

SEQ ID NO: 3319867 - RNA, 17 nt, Mycobacterium tuberculosis H37Rv
aagaccgaacagcggca

SEQ ID NO: 3319868 - RNA, 16 nt, Mycobacterium tuberculosis H37Rv
aagaccgacagcggca

SEQ ID NO: 3319869 - RNA, 20 nt, Mycobacterium tuberculosis H37Rv
aagaccgcgucggcggccag

SEQ ID NO: 3319870 - RNA, 18 nt, Mycobacterium tuberculosis H37Rv
aagaccggaucgccuugg

SEQ ID NO: 3319871 - RNA, 23 nt, Mycobacterium tuberculosis H37Rv
aagaccgggucguagccgaaccc

SEQ ID NO: 3319872 - RNA, 22 nt, Mycobacterium tuberculosis H37Rv
aagaccucgucgcgucgccaga

SEQ ID NO: 3319873 - RNA, 20 nt, Mycobacterium tuberculosis H37Rv
aagaccuggcggugccggcg

SEQ ID NO: 3319874 - RNA, 17 nt, Mycobacterium tuberculosis H37Rv
aagacgcccgaguuugc

SEQ ID NO: 3319875 - RNA, 15 nt, Mycobacterium tuberculosis H37Rv
aagacgccggcgaug

SEQ ID NO: 3319876 - RNA, 22 nt, Mycobacterium tuberculosis H37Rv
aagacgcggucgacgacgcccu

SEQ ID NO: 3319877 - RNA, 15 nt, Mycobacterium tuberculosis H37Rv
aagacuagcugcuag

SEQ ID NO: 3319878 - RNA, 18 nt, Mycobacterium tuberculosis H37Rv
aagacugcgccgccggcg

SEQ ID NO: 3319879 - RNA, 20 nt, Mycobacterium tuberculosis H37Rv
aagacuuagcgggugccagc

SEQ ID NO: 3319880 - RNA, 11 nt, Mycobacterium tuberculosis H37Rv
aagagaagucu

SEQ ID NO: 3319881 - RNA, 20 nt, Mycobacterium tuberculosis H37Rv
aagagcacgucaacagccag

SEQ ID NO: 3319882 - RNA, 21 nt, Mycobacterium tuberculosis H37Rv
aagagcacgucaacagccagg

SEQ ID NO: 3319883 - RNA, 24 nt, Mycobacterium tuberculosis H37Rv
aagagcacgucaacagccagggca

SEQ ID NO: 3319884 - RNA, 21 nt, Mycobacterium tuberculosis H37Rv
aaggaugcugucagacggcgu

SEQ ID NO: 3319885 - RNA, 16 nt, Mycobacterium tuberculosis H37Rv
aaggauucgaagccga

SEQ ID NO: 3319886 - RNA, 14 nt, Mycobacterium tuberculosis H37Rv
aaggcaaacaccag

SEQ ID NO: 3319887 - RNA, 16 nt, Mycobacterium tuberculosis H37Rv
aaggcaaacaccagcc

SEQ ID NO: 3319888 - RNA, 21 nt, Mycobacterium tuberculosis H37Rv
aaggcaaacaccagcccggcg

SEQ ID NO: 3319889 - RNA, 22 nt, Mycobacterium tuberculosis H37Rv
aaggcaggacugaacaguugca

SEQ ID NO: 3319890 - RNA, 14 nt, Mycobacterium tuberculosis H37Rv
aaggccgagcgcga

SEQ ID NO: 3319891 - RNA, 14 nt, Mycobacterium tuberculosis H37Rv
aaggccgcaccgcc

SEQ ID NO: 3319892 - RNA, 15 nt, Mycobacterium tuberculosis H37Rv
aaggccgcaccgcca

SEQ ID NO: 3319893 - RNA, 14 nt, Mycobacterium tuberculosis H37Rv
aaggccgucgaccc

SEQ ID NO: 3319894 - RNA, 16 nt, Mycobacterium tuberculosis H37Rv
aaggccgucgacccag

SEQ ID NO: 3319895 - RNA, 14 nt, Mycobacterium tuberculosis H37Rv
aaggcgacgaaucg

SEQ ID NO: 3319896 - RNA, 21 nt, Mycobacterium tuberculosis H37Rv
aaggcgacgccgaaaaugccg

SEQ ID NO: 3319897 - RNA, 16 nt, Mycobacterium tuberculosis H37Rv
aaggcgcgggcgacgu

SEQ ID NO: 3319898 - RNA, 14 nt, Mycobacterium tuberculosis H37Rv
aaggcucaccaggc

SEQ ID NO: 3319899 - RNA, 15 nt, Mycobacterium tuberculosis H37Rv
aaggcucaccaggcg

SEQ ID NO: 3319900 - RNA, 22 nt, Mycobacterium tuberculosis H37Rv
aaggcucagcagcgccgcgcgg

SEQ ID NO: 3319901 - RNA, 24 nt, Mycobacterium tuberculosis H37Rv
aagggcaaccgccccuucccagua

SEQ ID NO: 3319902 - RNA, 17 nt, Mycobacterium tuberculosis H37Rv
aagggcuugucgccggc

SEQ ID NO: 3319903 - RNA, 12 nt, Mycobacterium tuberculosis H37Rv
aagguccgugcc

SEQ ID NO: 3319904 - RNA, 22 nt, Mycobacterium tuberculosis H37Rv
aagguccgugccgaugccggcg

SEQ ID NO: 3319905 - RNA, 21 nt, Mycobacterium tuberculosis H37Rv
aaggucugccgggcgcgcgua

SEQ ID NO: 3319906 - RNA, 17 nt, Mycobacterium tuberculosis H37Rv
aaggugaucagcaggau

SEQ ID NO: 3319907 - RNA, 12 nt, Mycobacterium tuberculosis H37Rv
aaggugccggcg

SEQ ID NO: 3319908 - RNA, 14 nt, Mycobacterium tuberculosis H37Rv
aaggugcgccgcca

SEQ ID NO: 3319909 - RNA, 17 nt, Mycobacterium tuberculosis H37Rv
aaggugcgcugggugau

SEQ ID NO: 3319910 - RNA, 19 nt, Mycobacterium tuberculosis H37Rv
aaggugcgcugggugauga

SEQ ID NO: 3319911 - RNA, 11 nt, Mycobacterium tuberculosis H37Rv
aaggugcugcg

SEQ ID NO: 3319912 - RNA, 23 nt, Mycobacterium tuberculosis H37Rv
aaguaauagcuguuggccagccg

SEQ ID NO: 3319913 - RNA, 22 nt, Mycobacterium tuberculosis H37Rv
aaguacgcccuggaaugccgcc

SEQ ID NO: 3319914 - RNA, 22 nt, Mycobacterium tuberculosis H37Rv
aaguagccgaccggcagcgaug

SEQ ID NO: 3319915 - RNA, 19 nt, Mycobacterium tuberculosis H37Rv
aaguagccgacuaucggcc

SEQ ID NO: 3319916 - RNA, 23 nt, Mycobacterium tuberculosis H37Rv
aagucaaacgccgucacggcagu

SEQ ID NO: 3319917 - RNA, 17 nt, Mycobacterium tuberculosis H37Rv
aagucaacaccgcggcc

SEQ ID NO: 3319918 - RNA, 22 nt, Mycobacterium tuberculosis H37Rv
aagucaaucgcgucaucaacgu

SEQ ID NO: 3319919 - RNA, 12 nt, Mycobacterium tuberculosis H37Rv
aagucagcucga

SEQ ID NO: 3319920 - RNA, 24 nt, Mycobacterium tuberculosis H37Rv
aagucauucguagcuucccuccag

SEQ ID NO: 3319921 - RNA, 21 nt, Mycobacterium tuberculosis H37Rv
aaguccgagucggcaaacaac

SEQ ID NO: 3319922 - RNA, 18 nt, Mycobacterium tuberculosis H37Rv
aaguccgccgccugcgca

SEQ ID NO: 3319923 - RNA, 14 nt, Mycobacterium tuberculosis H37Rv
aagucgaucgccga

SEQ ID NO: 3319924 - RNA, 19 nt, Mycobacterium tuberculosis H37Rv
aagucgcggacgucgcccc

SEQ ID NO: 3319925 - RNA, 14 nt, Mycobacterium tuberculosis H37Rv
aagucgggcacugu

SEQ ID NO: 3319926 - RNA, 16 nt, Mycobacterium tuberculosis H37Rv
aagucguaaucggcaa

SEQ ID NO: 3319927 - RNA, 20 nt, Mycobacterium tuberculosis H37Rv
aagucgucggccaucgaguc

SEQ ID NO: 3319928 - RNA, 21 nt, Mycobacterium tuberculosis H37Rv
aagucuggagugaggcugugc

SEQ ID NO: 3319929 - RNA, 20 nt, Mycobacterium tuberculosis H37Rv
aagugaauaccccagaccgc

SEQ ID NO: 3319930 - RNA, 18 nt, Mycobacterium tuberculosis H37Rv
aagugccucgcgggaagu

SEQ ID NO: 3319931 - RNA, 19 nt, Mycobacterium tuberculosis H37Rv
aaguggcgucagugcagaa

SEQ ID NO: 3319932 - RNA, 14 nt, Mycobacterium tuberculosis H37Rv
aagugggugccggc

SEQ ID NO: 3319933 - RNA, 20 nt, Mycobacterium tuberculosis H37Rv
aaguggugcccuugaagaaa

SEQ ID NO: 3319934 - RNA, 20 nt, Mycobacterium tuberculosis H37Rv
aaguguucgacacccucggg

SEQ ID NO: 3319935 - RNA, 11 nt, Mycobacterium tuberculosis H37Rv
aaguugaagaa

SEQ ID NO: 3319936 - RNA, 15 nt, Mycobacterium tuberculosis H37Rv
aaguugaagaagcca

SEQ ID NO: 3319937 - RNA, 15 nt, Mycobacterium tuberculosis H37Rv
aaguuggccgcccga

SEQ ID NO: 3319938 - RNA, 13 nt, Mycobacterium tuberculosis H37Rv
aaguuggcuuucg

SEQ ID NO: 3319939 - RNA, 14 nt, Mycobacterium tuberculosis H37Rv
aaguuguagacguc

SEQ ID NO: 3319940 - RNA, 19 nt, Mycobacterium tuberculosis H37Rv
aaguuguagacgucgaccg

SEQ ID NO: 3319941 - RNA, 15 nt, Mycobacterium tuberculosis H37Rv
aauacacauuuccaa

SEQ ID NO: 3319942 - RNA, 14 nt, Mycobacterium tuberculosis H37Rv
aauacaccugcugg

SEQ ID NO: 3319943 - RNA, 23 nt, Mycobacterium tuberculosis H37Rv
aauacaccuuguggacccgccag

SEQ ID NO: 3319944 - RNA, 13 nt, Mycobacterium tuberculosis H37Rv
aauacagcuugau

SEQ ID NO: 3319945 - RNA, 19 nt, Mycobacterium tuberculosis H37Rv
aauacccagcgcagcagcg

SEQ ID NO: 3319946 - RNA, 13 nt, Mycobacterium tuberculosis H37Rv
aauacggcggcgc

SEQ ID NO: 3319947 - RNA, 20 nt, Mycobacterium tuberculosis H37Rv
aauacgugcgaaucgagacg

SEQ ID NO: 3319948 - RNA, 17 nt, Mycobacterium tuberculosis H37Rv
aauagcccaagccgauc

SEQ ID NO: 3319949 - RNA, 21 nt, Mycobacterium tuberculosis H37Rv
aauagggugaguuccaugugc

SEQ ID NO: 3319950 - RNA, 22 nt, Mycobacterium tuberculosis H37Rv
aauaggucgguccgcacugugc

SEQ ID NO: 3319951 - RNA, 22 nt, Mycobacterium tuberculosis H37Rv
aauagucauagagcucgccggu

SEQ ID NO: 3319952 - RNA, 22 nt, Mycobacterium tuberculosis H37Rv
aauaguccuugcgccagcgggc

SEQ ID NO: 3319953 - RNA, 21 nt, Mycobacterium tuberculosis H37Rv
aauagucuucuuucgccuccg

SEQ ID NO: 3319954 - RNA, 19 nt, Mycobacterium tuberculosis H37Rv
aauauccugcgguugaguu

SEQ ID NO: 3319955 - RNA, 17 nt, Mycobacterium tuberculosis H37Rv
aauaugccacagaccga

SEQ ID NO: 3319956 - RNA, 12 nt, Mycobacterium tuberculosis H37Rv
aaucaagcacag

SEQ ID NO: 3319957 - RNA, 13 nt, Mycobacterium tuberculosis H37Rv
aaucaagcagcgu

SEQ ID NO: 3319958 - RNA, 20 nt, Mycobacterium tuberculosis H37Rv
aaucaaggugaucagcagga

SEQ ID NO: 3319959 - RNA, 21 nt, Mycobacterium tuberculosis H37Rv
aaucaaggugaucagcaggau

SEQ ID NO: 3319960 - RNA, 12 nt, Mycobacterium tuberculosis H37Rv
aaucacaucgcc

SEQ ID NO: 3319961 - RNA, 15 nt, Mycobacterium tuberculosis H37Rv
aaucacggucaucuc

SEQ ID NO: 3319962 - RNA, 21 nt, Mycobacterium tuberculosis H37Rv
aaucagcccgcgcagcggucc

SEQ ID NO: 3319963 - RNA, 19 nt, Mycobacterium tuberculosis H37Rv
aaucagggucugcgccgcc

SEQ ID NO: 3319964 - RNA, 13 nt, Mycobacterium tuberculosis H37Rv
aauccacaaugcc

SEQ ID NO: 3319965 - RNA, 19 nt, Mycobacterium tuberculosis H37Rv
aauccacacacagccggug

SEQ ID NO: 3319966 - RNA, 17 nt, Mycobacterium tuberculosis H37Rv
aauccacgcacucgucg

SEQ ID NO: 3319967 - RNA, 12 nt, Mycobacterium tuberculosis H37Rv
aauccagcgccg

SEQ ID NO: 3319968 - RNA, 16 nt, Mycobacterium tuberculosis H37Rv
aauccagcgccgaccu

SEQ ID NO: 3319969 - RNA, 14 nt, Mycobacterium tuberculosis H37Rv
aauccccgacaucg

SEQ ID NO: 3319970 - RNA, 21 nt, Mycobacterium tuberculosis H37Rv
aauccccugcgcugcagcuga

SEQ ID NO: 3319971 - RNA, 19 nt, Mycobacterium tuberculosis H37Rv
aaucccgcgaugcgcacca

SEQ ID NO: 3319972 - RNA, 16 nt, Mycobacterium tuberculosis H37Rv
aauccgcacagcgacg

SEQ ID NO: 3319973 - RNA, 22 nt, Mycobacterium tuberculosis H37Rv
aauccgcacagcgacgagauca

SEQ ID NO: 3319974 - RNA, 14 nt, Mycobacterium tuberculosis H37Rv
aauccgcaccagcc

SEQ ID NO: 3319975 - RNA, 18 nt, Mycobacterium tuberculosis H37Rv
aauccggaauagcaacgc

SEQ ID NO: 3319976 - RNA, 15 nt, Mycobacterium tuberculosis H37Rv
aauccggugcccgca

SEQ ID NO: 3319977 - RNA, 17 nt, Mycobacterium tuberculosis H37Rv
aauccugcgcugcacca

SEQ ID NO: 3319978 - RNA, 19 nt, Mycobacterium tuberculosis H37Rv
aaucgaaaaggugcaccau

SEQ ID NO: 3319979 - RNA, 17 nt, Mycobacterium tuberculosis H37Rv
aaucgaccgaacgccag

SEQ ID NO: 3319980 - RNA, 20 nt, Mycobacterium tuberculosis H37Rv
acaaccacggcagauugacg

SEQ ID NO: 3319981 - RNA, 18 nt, Mycobacterium tuberculosis H37Rv
acaaccccgaggcaacaa

SEQ ID NO: 3319982 - RNA, 23 nt, Mycobacterium tuberculosis H37Rv
acaacccggcgucgacgauuccc

SEQ ID NO: 3319983 - RNA, 19 nt, Mycobacterium tuberculosis H37Rv
acaaccgacgggucgcggu

SEQ ID NO: 3319984 - RNA, 16 nt, Mycobacterium tuberculosis H37Rv
acaaccgcugcugcug

SEQ ID NO: 3319985 - RNA, 18 nt, Mycobacterium tuberculosis H37Rv
acaaccgugaacucgcgc

SEQ ID NO: 3319986 - RNA, 18 nt, Mycobacterium tuberculosis H37Rv
acaaccgugagcaccagc

SEQ ID NO: 3319987 - RNA, 13 nt, Mycobacterium tuberculosis H37Rv
acaaccuuggcga

SEQ ID NO: 3319988 - RNA, 14 nt, Mycobacterium tuberculosis H37Rv
acaacgacaacacc

SEQ ID NO: 3319989 - RNA, 15 nt, Mycobacterium tuberculosis H37Rv
acaacgaugucaccc

SEQ ID NO: 3319990 - RNA, 16 nt, Mycobacterium tuberculosis H37Rv
acaacgcgacgccgcu

SEQ ID NO: 3319991 - RNA, 18 nt, Mycobacterium tuberculosis H37Rv
acaacgcgugaccagggc

SEQ ID NO: 3319992 - RNA, 19 nt, Mycobacterium tuberculosis H37Rv
acaacgcgugaccagggcc

SEQ ID NO: 3319993 - RNA, 21 nt, Mycobacterium tuberculosis H37Rv
acaacgggccuucagcucacc

SEQ ID NO: 3319994 - RNA, 22 nt, Mycobacterium tuberculosis H37Rv
acaacuaucgucgugucgccgc

SEQ ID NO: 3319995 - RNA, 23 nt, Mycobacterium tuberculosis H37Rv
acaacuaucgucgugucgccgcc

SEQ ID NO: 3319996 - RNA, 12 nt, Mycobacterium tuberculosis H37Rv
acaacuccagca

SEQ ID NO: 3319997 - RNA, 17 nt, Mycobacterium tuberculosis H37Rv
acaacuggugggccauc

SEQ ID NO: 3319998 - RNA, 22 nt, Mycobacterium tuberculosis H37Rv
acaacuggugggccaucgucag

SEQ ID NO: 3319999 - RNA, 18 nt, Mycobacterium tuberculosis H37Rv
acaacuucgccggacccc

SEQ ID NO: 3320000 - RNA, 22 nt, Mycobacterium tuberculosis H37Rv
acaagaucagacccagcgcggc

SEQ ID NO: 3320001 - RNA, 16 nt, Mycobacterium tuberculosis H37Rv
acaagccgugcagcuc

SEQ ID NO: 3320002 - RNA, 17 nt, Mycobacterium tuberculosis H37Rv
acaagcgauggcaccac

SEQ ID NO: 3320003 - RNA, 24 nt, Mycobacterium tuberculosis H37Rv
acaagcggcccgcuguggucuuca

SEQ ID NO: 3320004 - RNA, 12 nt, Mycobacterium tuberculosis H37Rv
acaagcugacac

SEQ ID NO: 3320005 - RNA, 17 nt, Mycobacterium tuberculosis H37Rv
acaaggggcagcacguc

SEQ ID NO: 3320006 - RNA, 22 nt, Mycobacterium tuberculosis H37Rv
acaagucaagauugaccgcggc

SEQ ID NO: 3320007 - RNA, 13 nt, Mycobacterium tuberculosis H37Rv
acaaguccgcgau

SEQ ID NO: 3320008 - RNA, 14 nt, Mycobacterium tuberculosis H37Rv
acaagucgacacgc

SEQ ID NO: 3320009 - RNA, 18 nt, Mycobacterium tuberculosis H37Rv
acaagucgacacgccgaa

SEQ ID NO: 3320010 - RNA, 20 nt, Mycobacterium tuberculosis H37Rv
acaagugcccggccaaccac

SEQ ID NO: 3320011 - RNA, 17 nt, Mycobacterium tuberculosis H37Rv
acaauaggcuccagcgc

SEQ ID NO: 3320012 - RNA, 18 nt, Mycobacterium tuberculosis H37Rv
acaaucacauagccgguc

SEQ ID NO: 3320013 - RNA, 23 nt, Mycobacterium tuberculosis H37Rv
acaaucagcccgacaccguccag

SEQ ID NO: 3320014 - RNA, 20 nt, Mycobacterium tuberculosis H37Rv
acaauccacgucgcggcguu

SEQ ID NO: 3320015 - RNA, 20 nt, Mycobacterium tuberculosis H37Rv
acaauccgguguugagaucg

SEQ ID NO: 3320016 - RNA, 14 nt, Mycobacterium tuberculosis H37Rv
acaaucucggcguu

SEQ ID NO: 3320017 - RNA, 20 nt, Mycobacterium tuberculosis H37Rv
acaaucucggcguugccgcc

SEQ ID NO: 3320018 - RNA, 16 nt, Mycobacterium tuberculosis H37Rv
acaaugacucggccgc

SEQ ID NO: 3320019 - RNA, 14 nt, Mycobacterium tuberculosis H37Rv
acaaugccagcugu

SEQ ID NO: 3320020 - RNA, 13 nt, Mycobacterium tuberculosis H37Rv
acaaugucggcga

SEQ ID NO: 3320021 - RNA, 13 nt, Mycobacterium tuberculosis H37Rv
acacaaacgccgc

SEQ ID NO: 3320022 - RNA, 18 nt, Mycobacterium tuberculosis H37Rv
acacaacgaucugcuggc

SEQ ID NO: 3320023 - RNA, 19 nt, Mycobacterium tuberculosis H37Rv
acacaccgcauaaggccca

SEQ ID NO: 3320024 - RNA, 16 nt, Mycobacterium tuberculosis H37Rv
acacacugaagaucgc

SEQ ID NO: 3320025 - RNA, 18 nt, Mycobacterium tuberculosis H37Rv
acacagcccacaggcggc

SEQ ID NO: 3320026 - RNA, 14 nt, Mycobacterium tuberculosis H37Rv
acacagccgguggc

SEQ ID NO: 3320027 - RNA, 20 nt, Mycobacterium tuberculosis H37Rv
acacagcguaugcacaugau

SEQ ID NO: 3320028 - RNA, 23 nt, Mycobacterium tuberculosis H37Rv
acacagcguccgucgucggcguc

SEQ ID NO: 3320029 - RNA, 18 nt, Mycobacterium tuberculosis H37Rv
acacagucacggaccgcu

SEQ ID NO: 3320030 - RNA, 14 nt, Mycobacterium tuberculosis H37Rv
acacagucggugca

SEQ ID NO: 3320031 - RNA, 20 nt, Mycobacterium tuberculosis H37Rv
acacauccaguaaccguccg

SEQ ID NO: 3320032 - RNA, 18 nt, Mycobacterium tuberculosis H37Rv
acacaugcaucugaucag

SEQ ID NO: 3320033 - RNA, 13 nt, Mycobacterium tuberculosis H37Rv
acacauugaccag

SEQ ID NO: 3320034 - RNA, 14 nt, Mycobacterium tuberculosis H37Rv
acacauugaccagg

SEQ ID NO: 3320035 - RNA, 13 nt, Mycobacterium tuberculosis H37Rv
acaccaccgccag

SEQ ID NO: 3320036 - RNA, 15 nt, Mycobacterium tuberculosis H37Rv
acaccacgacgcgau

SEQ ID NO: 3320037 - RNA, 21 nt, Mycobacterium tuberculosis H37Rv
acaccacgagcguagcgaccu

SEQ ID NO: 3320038 - RNA, 18 nt, Mycobacterium tuberculosis H37Rv
acaccacgauggcggcca

SEQ ID NO: 3320039 - RNA, 21 nt, Mycobacterium tuberculosis H37Rv
acaccacgcuuaacagcgggu

SEQ ID NO: 3320040 - RNA, 19 nt, Mycobacterium tuberculosis H37Rv
acaccacggaccagcgccg

SEQ ID NO: 3320041 - RNA, 21 nt, Mycobacterium tuberculosis H37Rv
acaccacgucccggaaugaga

SEQ ID NO: 3320042 - RNA, 14 nt, Mycobacterium tuberculosis H37Rv
acaccagauggcuc

SEQ ID NO: 3320043 - RNA, 17 nt, Mycobacterium tuberculosis H37Rv
acaccagcaggcggcuc

SEQ ID NO: 3320044 - RNA, 12 nt, Mycobacterium tuberculosis H37Rv
acaccagcgcgu

SEQ ID NO: 3320045 - RNA, 12 nt, Mycobacterium tuberculosis H37Rv
acaccagcucga

SEQ ID NO: 3320046 - RNA, 21 nt, Mycobacterium tuberculosis H37Rv
acaccagcuuguagcgcucgu

SEQ ID NO: 3320047 - RNA, 17 nt, Mycobacterium tuberculosis H37Rv
acaccaggccgagccgc

SEQ ID NO: 3320048 - RNA, 23 nt, Mycobacterium tuberculosis H37Rv
acaccagggggcgagagcgcgga

SEQ ID NO: 3320049 - RNA, 19 nt, Mycobacterium tuberculosis H37Rv
acaccaggucauugccggc

SEQ ID NO: 3320050 - RNA, 22 nt, Mycobacterium tuberculosis H37Rv
acaccaucaaggacucggacgc

SEQ ID NO: 3320051 - RNA, 23 nt, Mycobacterium tuberculosis H37Rv
acacccacgugcugccuuugcga

SEQ ID NO: 3320052 - RNA, 15 nt, Mycobacterium tuberculosis H37Rv
acacccacuggacca

SEQ ID NO: 3320053 - RNA, 14 nt, Mycobacterium tuberculosis H37Rv
acacccaucaccgc

SEQ ID NO: 3320054 - RNA, 21 nt, Mycobacterium tuberculosis H37Rv
acacccauuacugagcuucca

SEQ ID NO: 3320055 - RNA, 14 nt, Mycobacterium tuberculosis H37Rv
acacccgcaccgga

SEQ ID NO: 3320056 - RNA, 13 nt, Mycobacterium tuberculosis H37Rv
acacccgcucgcc

SEQ ID NO: 3320057 - RNA, 21 nt, Mycobacterium tuberculosis H37Rv
acacccgcuuugcacugugga

SEQ ID NO: 3320058 - RNA, 13 nt, Mycobacterium tuberculosis H37Rv
acacccggcacac

SEQ ID NO: 3320059 - RNA, 16 nt, Mycobacterium tuberculosis H37Rv
acaccgaacggugugc

SEQ ID NO: 3320060 - RNA, 13 nt, Mycobacterium tuberculosis H37Rv
acaccgacacgcc

SEQ ID NO: 3320061 - RNA, 14 nt, Mycobacterium tuberculosis H37Rv
acaccgacacgccg

SEQ ID NO: 3320062 - RNA, 18 nt, Mycobacterium tuberculosis H37Rv
acaccgacucgcaauugc

SEQ ID NO: 3320063 - RNA, 19 nt, Mycobacterium tuberculosis H37Rv
acaccgagaagcugugccu

SEQ ID NO: 3320064 - RNA, 24 nt, Mycobacterium tuberculosis H37Rv
acaccgagaagcugugccuucgcc

SEQ ID NO: 3320065 - RNA, 13 nt, Mycobacterium tuberculosis H37Rv
acaccgagcaccu

SEQ ID NO: 3320066 - RNA, 14 nt, Mycobacterium tuberculosis H37Rv
acaccgaguuccuc

SEQ ID NO: 3320067 - RNA, 16 nt, Mycobacterium tuberculosis H37Rv
acaccgcaacgcgugc

SEQ ID NO: 3320068 - RNA, 13 nt, Mycobacterium tuberculosis H37Rv
acaccgcaggugc

SEQ ID NO: 3320069 - RNA, 14 nt, Mycobacterium tuberculosis H37Rv
acaccgccagcaga

SEQ ID NO: 3320070 - RNA, 15 nt, Mycobacterium tuberculosis H37Rv
acaccgccagcagau

SEQ ID NO: 3320071 - RNA, 15 nt, Mycobacterium tuberculosis H37Rv
acaccgccagcauga

SEQ ID NO: 3320072 - RNA, 23 nt, Mycobacterium tuberculosis H37Rv
acaccgccagcggcaauggccag

SEQ ID NO: 3320073 - RNA, 15 nt, Mycobacterium tuberculosis H37Rv
acaccgccagcucac

SEQ ID NO: 3320074 - RNA, 17 nt, Mycobacterium tuberculosis H37Rv
acaccgcccgacccauc

SEQ ID NO: 3320075 - RNA, 19 nt, Mycobacterium tuberculosis H37Rv
acaccgcccgacccaucac

SEQ ID NO: 3320076 - RNA, 22 nt, Mycobacterium tuberculosis H37Rv
acagcauggcgaagaacaacau

SEQ ID NO: 3320077 - RNA, 15 nt, Mycobacterium tuberculosis H37Rv
acagcaugucgcgga

SEQ ID NO: 3320078 - RNA, 15 nt, Mycobacterium tuberculosis H37Rv
acagccaccagccgg

SEQ ID NO: 3320079 - RNA, 13 nt, Mycobacterium tuberculosis H37Rv
acagccacgcaca

SEQ ID NO: 3320080 - RNA, 15 nt, Mycobacterium tuberculosis H37Rv
acagccaguguugca

SEQ ID NO: 3320081 - RNA, 18 nt, Mycobacterium tuberculosis H37Rv
acagccccaucaccaccg

SEQ ID NO: 3320082 - RNA, 22 nt, Mycobacterium tuberculosis H37Rv
acagccccaucaccaccggcac

SEQ ID NO: 3320083 - RNA, 15 nt, Mycobacterium tuberculosis H37Rv
acagccccgcggcca

SEQ ID NO: 3320084 - RNA, 18 nt, Mycobacterium tuberculosis H37Rv
acagccccgcggccagca

SEQ ID NO: 3320085 - RNA, 21 nt, Mycobacterium tuberculosis H37Rv
acagcccgaacgaggcgccca

SEQ ID NO: 3320086 - RNA, 11 nt, Mycobacterium tuberculosis H37Rv
acagcccggcg

SEQ ID NO: 3320087 - RNA, 12 nt, Mycobacterium tuberculosis H37Rv
acagcccggcga

SEQ ID NO: 3320088 - RNA, 16 nt, Mycobacterium tuberculosis H37Rv
acagcccggcgacgac

SEQ ID NO: 3320089 - RNA, 19 nt, Mycobacterium tuberculosis H37Rv
acagccgagccagcagcuu

SEQ ID NO: 3320090 - RNA, 15 nt, Mycobacterium tuberculosis H37Rv
acagccgcagcggcc

SEQ ID NO: 3320091 - RNA, 16 nt, Mycobacterium tuberculosis H37Rv
acagccgcagcggccu

SEQ ID NO: 3320092 - RNA, 15 nt, Mycobacterium tuberculosis H37Rv
acagccgcgcugcga

SEQ ID NO: 3320093 - RNA, 21 nt, Mycobacterium tuberculosis H37Rv
acagccgcuuggcgcggccca

SEQ ID NO: 3320094 - RNA, 15 nt, Mycobacterium tuberculosis H37Rv
acagccgguaggaca

SEQ ID NO: 3320095 - RNA, 14 nt, Mycobacterium tuberculosis H37Rv
acagccgucgcacc

SEQ ID NO: 3320096 - RNA, 12 nt, Mycobacterium tuberculosis H37Rv
acagcgaacaga

SEQ ID NO: 3320097 - RNA, 20 nt, Mycobacterium tuberculosis H37Rv
acagcgaacagacaugcgca

SEQ ID NO: 3320098 - RNA, 23 nt, Mycobacterium tuberculosis H37Rv
acagcgaacagacaugcgcacca

SEQ ID NO: 3320099 - RNA, 15 nt, Mycobacterium tuberculosis H37Rv
acagcgaaccgccgg

SEQ ID NO: 3320100 - RNA, 18 nt, Mycobacterium tuberculosis H37Rv
acagcgaaccggcugggc

SEQ ID NO: 3320101 - RNA, 19 nt, Mycobacterium tuberculosis H37Rv
acagcgaaccggcugggcg

SEQ ID NO: 3320102 - RNA, 13 nt, Mycobacterium tuberculosis H37Rv
acagcgacagcgu

SEQ ID NO: 3320103 - RNA, 14 nt, Mycobacterium tuberculosis H37Rv
acagcgacgagauc

SEQ ID NO: 3320104 - RNA, 13 nt, Mycobacterium tuberculosis H37Rv
acagcgagcacac

SEQ ID NO: 3320105 - RNA, 14 nt, Mycobacterium tuberculosis H37Rv
acagcgagcgguug

SEQ ID NO: 3320106 - RNA, 15 nt, Mycobacterium tuberculosis H37Rv
acagcgccaugcccu

SEQ ID NO: 3320107 - RNA, 17 nt, Mycobacterium tuberculosis H37Rv
acagcgccuuguuggcg

SEQ ID NO: 3320108 - RNA, 16 nt, Mycobacterium tuberculosis H37Rv
acagcgcggcggucga

SEQ ID NO: 3320109 - RNA, 19 nt, Mycobacterium tuberculosis H37Rv
acagcgcgguguucgcggc

SEQ ID NO: 3320110 - RNA, 18 nt, Mycobacterium tuberculosis H37Rv
acagcgcuccagccgcgc

SEQ ID NO: 3320111 - RNA, 13 nt, Mycobacterium tuberculosis H37Rv
acagcgcugggcc

SEQ ID NO: 3320112 - RNA, 20 nt, Mycobacterium tuberculosis H37Rv
acagcggaauuagucgccgc

SEQ ID NO: 3320113 - RNA, 12 nt, Mycobacterium tuberculosis H37Rv
acagcggcagcg

SEQ ID NO: 3320114 - RNA, 20 nt, Mycobacterium tuberculosis H37Rv
acagcggcgauuggcuguga

SEQ ID NO: 3320115 - RNA, 15 nt, Mycobacterium tuberculosis H37Rv
acagcgggggcagcg

SEQ ID NO: 3320116 - RNA, 18 nt, Mycobacterium tuberculosis H37Rv
acagcgguccagccaccg

SEQ ID NO: 3320117 - RNA, 19 nt, Mycobacterium tuberculosis H37Rv
acagcgguccagccaccgc

SEQ ID NO: 3320118 - RNA, 21 nt, Mycobacterium tuberculosis H37Rv
acagcguaugcacaugauccc

SEQ ID NO: 3320119 - RNA, 21 nt, Mycobacterium tuberculosis H37Rv
acagcgucucggaggcgacca

SEQ ID NO: 3320120 - RNA, 17 nt, Mycobacterium tuberculosis H37Rv
acagcguugccaggugc

SEQ ID NO: 3320121 - RNA, 22 nt, Mycobacterium tuberculosis H37Rv
acagcucacgcugaagccgcug

SEQ ID NO: 3320122 - RNA, 23 nt, Mycobacterium tuberculosis H37Rv
acagcucaucgauccucgcccgc

SEQ ID NO: 3320123 - RNA, 16 nt, Mycobacterium tuberculosis H37Rv
acagcucgccgugacc

SEQ ID NO: 3320124 - RNA, 22 nt, Mycobacterium tuberculosis H37Rv
acagcucgccgugaccaggugc

SEQ ID NO: 3320125 - RNA, 15 nt, Mycobacterium tuberculosis H37Rv
acagcucgccuaguu

SEQ ID NO: 3320126 - RNA, 22 nt, Mycobacterium tuberculosis H37Rv
acagcucgcgcucgcucacgcc

SEQ ID NO: 3320127 - RNA, 14 nt, Mycobacterium tuberculosis H37Rv
acagcugacgagcc

SEQ ID NO: 3320128 - RNA, 18 nt, Mycobacterium tuberculosis H37Rv
acagcugacgagccggug

SEQ ID NO: 3320129 - RNA, 14 nt, Mycobacterium tuberculosis H37Rv
acagcugaucccag

SEQ ID NO: 3320130 - RNA, 14 nt, Mycobacterium tuberculosis H37Rv
acagcugcccgcca

SEQ ID NO: 3320131 - RNA, 13 nt, Mycobacterium tuberculosis H37Rv
acagcuggcggca

SEQ ID NO: 3320132 - RNA, 16 nt, Mycobacterium tuberculosis H37Rv
acagcuggcggcagcg

SEQ ID NO: 3320133 - RNA, 16 nt, Mycobacterium tuberculosis H37Rv
acagcugggucggagu

SEQ ID NO: 3320134 - RNA, 15 nt, Mycobacterium tuberculosis H37Rv
acagcuguugauuga

SEQ ID NO: 3320135 - RNA, 18 nt, Mycobacterium tuberculosis H37Rv
acagcuucgcgcagccgg

SEQ ID NO: 3320136 - RNA, 14 nt, Mycobacterium tuberculosis H37Rv
acagcuugaucgcc

SEQ ID NO: 3320137 - RNA, 18 nt, Mycobacterium tuberculosis H37Rv
acagcuugcugcgcacca

SEQ ID NO: 3320138 - RNA, 14 nt, Mycobacterium tuberculosis H37Rv
acaggaagcgaccg

SEQ ID NO: 3320139 - RNA, 15 nt, Mycobacterium tuberculosis H37Rv
acaggaagucgcgga

SEQ ID NO: 3320140 - RNA, 22 nt, Mycobacterium tuberculosis H37Rv
acaggaucagcgacuugcuggc

SEQ ID NO: 3320141 - RNA, 18 nt, Mycobacterium tuberculosis H37Rv
acaggcaucggaggaacc

SEQ ID NO: 3320142 - RNA, 20 nt, Mycobacterium tuberculosis H37Rv
acaggcauuuucacugugcc

SEQ ID NO: 3320143 - RNA, 16 nt, Mycobacterium tuberculosis H37Rv
acaggccacgcaccgg

SEQ ID NO: 3320144 - RNA, 23 nt, Mycobacterium tuberculosis H37Rv
acaggccgaagcucacacuggcu

SEQ ID NO: 3320145 - RNA, 21 nt, Mycobacterium tuberculosis H37Rv
acaggccgagcagauacuugu

SEQ ID NO: 3320146 - RNA, 14 nt, Mycobacterium tuberculosis H37Rv
acaggccggccacc

SEQ ID NO: 3320147 - RNA, 21 nt, Mycobacterium tuberculosis H37Rv
acaggccuaggucgacgccga

SEQ ID NO: 3320148 - RNA, 23 nt, Mycobacterium tuberculosis H37Rv
acaggcgaggcucccgcaauggg

SEQ ID NO: 3320149 - RNA, 16 nt, Mycobacterium tuberculosis H37Rv
acaggcgcccacaaau

SEQ ID NO: 3320150 - RNA, 17 nt, Mycobacterium tuberculosis H37Rv
acaggcgggacaaccgg

SEQ ID NO: 3320151 - RNA, 17 nt, Mycobacterium tuberculosis H37Rv
acaggcguccaucgcca

SEQ ID NO: 3320152 - RNA, 20 nt, Mycobacterium tuberculosis H37Rv
acaggcguccaucgccaccg

SEQ ID NO: 3320153 - RNA, 15 nt, Mycobacterium tuberculosis H37Rv
acaggcuugacugca

SEQ ID NO: 3320154 - RNA, 23 nt, Mycobacterium tuberculosis H37Rv
acaggcuugacugcacaccaccg

SEQ ID NO: 3320155 - RNA, 13 nt, Mycobacterium tuberculosis H37Rv
acaggcuuggcau

SEQ ID NO: 3320156 - RNA, 13 nt, Mycobacterium tuberculosis H37Rv
acagguagucgcc

SEQ ID NO: 3320157 - RNA, 14 nt, Mycobacterium tuberculosis H37Rv
acaggucagcgcug

SEQ ID NO: 3320158 - RNA, 16 nt, Mycobacterium tuberculosis H37Rv
acaggucagcgcugcc

SEQ ID NO: 3320159 - RNA, 23 nt, Mycobacterium tuberculosis H37Rv
acagguccugcgccgcacgccga

SEQ ID NO: 3320160 - RNA, 19 nt, Mycobacterium tuberculosis H37Rv
acaggucgcccaacaccgc

SEQ ID NO: 3320161 - RNA, 22 nt, Mycobacterium tuberculosis H37Rv
acaggugcaggucgugcuccca

SEQ ID NO: 3320162 - RNA, 19 nt, Mycobacterium tuberculosis H37Rv
acaguaggccuccgcugcc

SEQ ID NO: 3320163 - RNA, 16 nt, Mycobacterium tuberculosis H37Rv
acagucgacaauuccc

SEQ ID NO: 3320164 - RNA, 20 nt, Mycobacterium tuberculosis H37Rv
acagucgaccggacacuccu

SEQ ID NO: 3320165 - RNA, 19 nt, Mycobacterium tuberculosis H37Rv
acagucgcagcacggcuuc

SEQ ID NO: 3320166 - RNA, 12 nt, Mycobacterium tuberculosis H37Rv
acagucgcagcc

SEQ ID NO: 3320167 - RNA, 14 nt, Mycobacterium tuberculosis H37Rv
acagucgcgcgcuc

SEQ ID NO: 3320168 - RNA, 20 nt, Mycobacterium tuberculosis H37Rv
acagucgcgcgcucgcggcu

SEQ ID NO: 3320169 - RNA, 23 nt, Mycobacterium tuberculosis H37Rv
acagucggugcagcgcacgcagc

SEQ ID NO: 3320170 - RNA, 17 nt, Mycobacterium tuberculosis H37Rv
acagugacgccacgacc

SEQ ID NO: 3320171 - RNA, 13 nt, Mycobacterium tuberculosis H37Rv
acagugccaccug

SEQ ID NO: 3320172 - RNA, 17 nt, Mycobacterium tuberculosis H37Rv
accaaccucaucgcggu

SEQ ID NO: 3320173 - RNA, 13 nt, Mycobacterium tuberculosis H37Rv
accaacgcgggaa

SEQ ID NO: 3320174 - RNA, 22 nt, Mycobacterium tuberculosis H37Rv
accaacgcgggaacgaugccgc

SEQ ID NO: 3320175 - RNA, 16 nt, Mycobacterium tuberculosis H37Rv
accaacgcuucugccu

SEQ ID NO: 3320176 - RNA, 20 nt, Mycobacterium tuberculosis H37Rv
accaacgcuucugccugcgc

SEQ ID NO: 3320177 - RNA, 18 nt, Mycobacterium tuberculosis H37Rv
accaacgucgacuucagc

SEQ ID NO: 3320178 - RNA, 15 nt, Mycobacterium tuberculosis H37Rv
accaacucggcgacc

SEQ ID NO: 3320179 - RNA, 20 nt, Mycobacterium tuberculosis H37Rv
accaacucguggaacuccgu

SEQ ID NO: 3320180 - RNA, 23 nt, Mycobacterium tuberculosis H37Rv
accaacucucgcgggauggacag

SEQ ID NO: 3320181 - RNA, 18 nt, Mycobacterium tuberculosis H37Rv
accaagcucggccagcac

SEQ ID NO: 3320182 - RNA, 19 nt, Mycobacterium tuberculosis H37Rv
accaagcucggccagcacg

SEQ ID NO: 3320183 - RNA, 18 nt, Mycobacterium tuberculosis H37Rv
accaaggacgaacgcgcc

SEQ ID NO: 3320184 - RNA, 22 nt, Mycobacterium tuberculosis H37Rv
accaaggccgccugcaacaucc

SEQ ID NO: 3320185 - RNA, 20 nt, Mycobacterium tuberculosis H37Rv
accaagguacuugcgcaacc

SEQ ID NO: 3320186 - RNA, 12 nt, Mycobacterium tuberculosis H37Rv
accaaggucggc

SEQ ID NO: 3320187 - RNA, 19 nt, Mycobacterium tuberculosis H37Rv
accaaggucuucaggccgc

SEQ ID NO: 3320188 - RNA, 18 nt, Mycobacterium tuberculosis H37Rv
accaagguguccagcacc

SEQ ID NO: 3320189 - RNA, 19 nt, Mycobacterium tuberculosis H37Rv
accaagguguggccuugcg

SEQ ID NO: 3320190 - RNA, 21 nt, Mycobacterium tuberculosis H37Rv
accaagucaugcccacgcugc

SEQ ID NO: 3320191 - RNA, 17 nt, Mycobacterium tuberculosis H37Rv
accaagucguaaucggc

SEQ ID NO: 3320192 - RNA, 21 nt, Mycobacterium tuberculosis H37Rv
accaaguugaccuucaccugg

SEQ ID NO: 3320193 - RNA, 14 nt, Mycobacterium tuberculosis H37Rv
accaauccaggcca

SEQ ID NO: 3320194 - RNA, 17 nt, Mycobacterium tuberculosis H37Rv
accaaucgcacgccagc

SEQ ID NO: 3320195 - RNA, 18 nt, Mycobacterium tuberculosis H37Rv
accaaugaccgccagcag

SEQ ID NO: 3320196 - RNA, 19 nt, Mycobacterium tuberculosis H37Rv
accaaugaccgccagcagc

SEQ ID NO: 3320197 - RNA, 23 nt, Mycobacterium tuberculosis H37Rv
accaaugcuccugguggcagaaa

SEQ ID NO: 3320198 - RNA, 16 nt, Mycobacterium tuberculosis H37Rv
accaaugucagugccc

SEQ ID NO: 3320199 - RNA, 19 nt, Mycobacterium tuberculosis H37Rv
accaaugucagugccccgc

SEQ ID NO: 3320200 - RNA, 14 nt, Mycobacterium tuberculosis H37Rv
accaauucgaccgc

SEQ ID NO: 3320201 - RNA, 16 nt, Mycobacterium tuberculosis H37Rv
accaauucgaccgcgc

SEQ ID NO: 3320202 - RNA, 22 nt, Mycobacterium tuberculosis H37Rv
accacaaccgugagcaccagca

SEQ ID NO: 3320203 - RNA, 23 nt, Mycobacterium tuberculosis H37Rv
accacaaccgugagcaccagcag

SEQ ID NO: 3320204 - RNA, 13 nt, Mycobacterium tuberculosis H37Rv
accacaacgccag

SEQ ID NO: 3320205 - RNA, 14 nt, Mycobacterium tuberculosis H37Rv
accacaauccacgc

SEQ ID NO: 3320206 - RNA, 13 nt, Mycobacterium tuberculosis H37Rv
accacaccgugac

SEQ ID NO: 3320207 - RNA, 15 nt, Mycobacterium tuberculosis H37Rv
accacagugaaaucc

SEQ ID NO: 3320208 - RNA, 22 nt, Mycobacterium tuberculosis H37Rv
accacagugccaauuccagccc

SEQ ID NO: 3320209 - RNA, 21 nt, Mycobacterium tuberculosis H37Rv
accacauuggcgaucagcagc

SEQ ID NO: 3320210 - RNA, 21 nt, Mycobacterium tuberculosis H37Rv
accaccaagcucggccagcac

SEQ ID NO: 3320211 - RNA, 13 nt, Mycobacterium tuberculosis H37Rv
accaccacccgga

SEQ ID NO: 3320212 - RNA, 14 nt, Mycobacterium tuberculosis H37Rv
accaccaccgccgg

SEQ ID NO: 3320213 - RNA, 15 nt, Mycobacterium tuberculosis H37Rv
accaccaccggcaac

SEQ ID NO: 3320214 - RNA, 14 nt, Mycobacterium tuberculosis H37Rv
accaccacggccag

SEQ ID NO: 3320215 - RNA, 22 nt, Mycobacterium tuberculosis H37Rv
accaccacguggcccuccucgg

SEQ ID NO: 3320216 - RNA, 22 nt, Mycobacterium tuberculosis H37Rv
accaccacuucggcgccgcgcc

SEQ ID NO: 3320217 - RNA, 12 nt, Mycobacterium tuberculosis H37Rv
accaccagcacg

SEQ ID NO: 3320218 - RNA, 20 nt, Mycobacterium tuberculosis H37Rv
accaccagcgugcugccgga

SEQ ID NO: 3320219 - RNA, 15 nt, Mycobacterium tuberculosis H37Rv
accaccagggcaacg

SEQ ID NO: 3320220 - RNA, 20 nt, Mycobacterium tuberculosis H37Rv
accaccagggcaacggccgc

SEQ ID NO: 3320221 - RNA, 21 nt, Mycobacterium tuberculosis H37Rv
accaccaguaccaccggcacc

SEQ ID NO: 3320222 - RNA, 13 nt, Mycobacterium tuberculosis H37Rv
accacccaacagc

SEQ ID NO: 3320223 - RNA, 15 nt, Mycobacterium tuberculosis H37Rv
accacccacccgcac

SEQ ID NO: 3320224 - RNA, 17 nt, Mycobacterium tuberculosis H37Rv
accacccacccgcacca

SEQ ID NO: 3320225 - RNA, 17 nt, Mycobacterium tuberculosis H37Rv
accacccaccggccacc

SEQ ID NO: 3320226 - RNA, 19 nt, Mycobacterium tuberculosis H37Rv
accacccaccggccaccag

SEQ ID NO: 3320227 - RNA, 16 nt, Mycobacterium tuberculosis H37Rv
accacccagauugccu

SEQ ID NO: 3320228 - RNA, 18 nt, Mycobacterium tuberculosis H37Rv
accaccccagcggccacc

SEQ ID NO: 3320229 - RNA, 13 nt, Mycobacterium tuberculosis H37Rv
accacccccaccg

SEQ ID NO: 3320230 - RNA, 15 nt, Mycobacterium tuberculosis H37Rv
accacccccggcagg

SEQ ID NO: 3320231 - RNA, 15 nt, Mycobacterium tuberculosis H37Rv
accacccgcaccuca

SEQ ID NO: 3320232 - RNA, 18 nt, Mycobacterium tuberculosis H37Rv
accacccgcaccucaccg

SEQ ID NO: 3320233 - RNA, 22 nt, Mycobacterium tuberculosis H37Rv
accacccgcacuccaagucaca

SEQ ID NO: 3320234 - RNA, 13 nt, Mycobacterium tuberculosis H37Rv
accacccgccgca

SEQ ID NO: 3320235 - RNA, 21 nt, Mycobacterium tuberculosis H37Rv
accacccggcgaacccagcgg

SEQ ID NO: 3320236 - RNA, 20 nt, Mycobacterium tuberculosis H37Rv
accacccggcgcgaauuccu

SEQ ID NO: 3320237 - RNA, 19 nt, Mycobacterium tuberculosis H37Rv
accacccgguccugcucgc

SEQ ID NO: 3320238 - RNA, 15 nt, Mycobacterium tuberculosis H37Rv
accaccgaccuggac

SEQ ID NO: 3320239 - RNA, 16 nt, Mycobacterium tuberculosis H37Rv
accaccgcaccugcga

SEQ ID NO: 3320240 - RNA, 19 nt, Mycobacterium tuberculosis H37Rv
accaccgcauaacgccagu

SEQ ID NO: 3320241 - RNA, 14 nt, Mycobacterium tuberculosis H37Rv
accaccgcccacag

SEQ ID NO: 3320242 - RNA, 14 nt, Mycobacterium tuberculosis H37Rv
accaccgccgaagc

SEQ ID NO: 3320243 - RNA, 16 nt, Mycobacterium tuberculosis H37Rv
accaccgccgcacgcu

SEQ ID NO: 3320244 - RNA, 22 nt, Mycobacterium tuberculosis H37Rv
accaccgccgccggcaccgccg

SEQ ID NO: 3320245 - RNA, 23 nt, Mycobacterium tuberculosis H37Rv
accaccgccgccggcaccgccgg

SEQ ID NO: 3320246 - RNA, 15 nt, Mycobacterium tuberculosis H37Rv
accaccgccggcccg

SEQ ID NO: 3320247 - RNA, 11 nt, Mycobacterium tuberculosis H37Rv
accaccgccug

SEQ ID NO: 3320248 - RNA, 17 nt, Mycobacterium tuberculosis H37Rv
accaccgccuggaucag

SEQ ID NO: 3320249 - RNA, 18 nt, Mycobacterium tuberculosis H37Rv
accaccgcucgucguccg

SEQ ID NO: 3320250 - RNA, 19 nt, Mycobacterium tuberculosis H37Rv
accaccgcucgucguccgg

SEQ ID NO: 3320251 - RNA, 17 nt, Mycobacterium tuberculosis H37Rv
accaccgcugagccggu

SEQ ID NO: 3320252 - RNA, 14 nt, Mycobacterium tuberculosis H37Rv
accaccggcaccgc

SEQ ID NO: 3320253 - RNA, 15 nt, Mycobacterium tuberculosis H37Rv
accaccggcaccgcu

SEQ ID NO: 3320254 - RNA, 21 nt, Mycobacterium tuberculosis H37Rv
accaccggccccaccggcacc

SEQ ID NO: 3320255 - RNA, 16 nt, Mycobacterium tuberculosis H37Rv
accaccggccgucccg

SEQ ID NO: 3320256 - RNA, 23 nt, Mycobacterium tuberculosis H37Rv
accaccggcgccccugucgaccg

SEQ ID NO: 3320257 - RNA, 16 nt, Mycobacterium tuberculosis H37Rv
accaccgggcgcugcu

SEQ ID NO: 3320258 - RNA, 14 nt, Mycobacterium tuberculosis H37Rv
accaccgucaccgc

SEQ ID NO: 3320259 - RNA, 16 nt, Mycobacterium tuberculosis H37Rv
accaccgucaccgccg

SEQ ID NO: 3320260 - RNA, 14 nt, Mycobacterium tuberculosis H37Rv
accaccgucgagcc

SEQ ID NO: 3320261 - RNA, 16 nt, Mycobacterium tuberculosis H37Rv
accaccgucucgccgc

SEQ ID NO: 3320262 - RNA, 20 nt, Mycobacterium tuberculosis H37Rv
accaccguugccgccgucac

SEQ ID NO: 3320263 - RNA, 23 nt, Mycobacterium tuberculosis H37Rv
accaccguugccgccgucaccgc

SEQ ID NO: 3320264 - RNA, 18 nt, Mycobacterium tuberculosis H37Rv
accaccguuugagcggcc

SEQ ID NO: 3320265 - RNA, 14 nt, Mycobacterium tuberculosis H37Rv
accaccucagcugc

SEQ ID NO: 3320266 - RNA, 15 nt, Mycobacterium tuberculosis H37Rv
accaccuccccgauc

SEQ ID NO: 3320267 - RNA, 15 nt, Mycobacterium tuberculosis H37Rv
accaccucgaugccg

SEQ ID NO: 3320268 - RNA, 17 nt, Mycobacterium tuberculosis H37Rv
accagcccgaugauccc

SEQ ID NO: 3320269 - RNA, 22 nt, Mycobacterium tuberculosis H37Rv
accagcccgaugaucccgccac

SEQ ID NO: 3320270 - RNA, 15 nt, Mycobacterium tuberculosis H37Rv
accagcccgccgucg

SEQ ID NO: 3320271 - RNA, 17 nt, Mycobacterium tuberculosis H37Rv
accagcccggccgccga

SEQ ID NO: 3320272 - RNA, 20 nt, Mycobacterium tuberculosis H37Rv
accagcccggccggucgaga

SEQ ID NO: 3320273 - RNA, 22 nt, Mycobacterium tuberculosis H37Rv
accagcccggccggucgagacg

SEQ ID NO: 3320274 - RNA, 19 nt, Mycobacterium tuberculosis H37Rv
accagccgaucaucaccgg

SEQ ID NO: 3320275 - RNA, 23 nt, Mycobacterium tuberculosis H37Rv
accagccggucuuggacagcagc

SEQ ID NO: 3320276 - RNA, 13 nt, Mycobacterium tuberculosis H37Rv
accagccggugag

SEQ ID NO: 3320277 - RNA, 24 nt, Mycobacterium tuberculosis H37Rv
accagccggugagcgagcgcgcgu

SEQ ID NO: 3320278 - RNA, 16 nt, Mycobacterium tuberculosis H37Rv
accagccgucguccgc

SEQ ID NO: 3320279 - RNA, 21 nt, Mycobacterium tuberculosis H37Rv
accagccgucguccgcugacc

SEQ ID NO: 3320280 - RNA, 20 nt, Mycobacterium tuberculosis H37Rv
accagccucgaggguuucca

SEQ ID NO: 3320281 - RNA, 20 nt, Mycobacterium tuberculosis H37Rv
accagccuuaugcagugaca

SEQ ID NO: 3320282 - RNA, 17 nt, Mycobacterium tuberculosis H37Rv
accagcgaauccagccg

SEQ ID NO: 3320283 - RNA, 20 nt, Mycobacterium tuberculosis H37Rv
accagcgaauccagccgcgc

SEQ ID NO: 3320284 - RNA, 22 nt, Mycobacterium tuberculosis H37Rv
accagcgacgccaugucgaugu

SEQ ID NO: 3320285 - RNA, 16 nt, Mycobacterium tuberculosis H37Rv
accagcgaguugagca

SEQ ID NO: 3320286 - RNA, 17 nt, Mycobacterium tuberculosis H37Rv
accagcgaguugagcau

SEQ ID NO: 3320287 - RNA, 20 nt, Mycobacterium tuberculosis H37Rv
accagcgcaucggccagcag

SEQ ID NO: 3320288 - RNA, 14 nt, Mycobacterium tuberculosis H37Rv
accagcgccccggc

SEQ ID NO: 3320289 - RNA, 16 nt, Mycobacterium tuberculosis H37Rv
accagcgccccggcgc

SEQ ID NO: 3320290 - RNA, 18 nt, Mycobacterium tuberculosis H37Rv
accagcgcccggcccgcc

SEQ ID NO: 3320291 - RNA, 15 nt, Mycobacterium tuberculosis H37Rv
accagcgcccgucgc

SEQ ID NO: 3320292 - RNA, 17 nt, Mycobacterium tuberculosis H37Rv
accagcgccuugacgcc

SEQ ID NO: 3320293 - RNA, 16 nt, Mycobacterium tuberculosis H37Rv
accagcgcgagcccga

SEQ ID NO: 3320294 - RNA, 21 nt, Mycobacterium tuberculosis H37Rv
accagcgcgccguagaccagc

SEQ ID NO: 3320295 - RNA, 16 nt, Mycobacterium tuberculosis H37Rv
accagcgcuccagcac

SEQ ID NO: 3320296 - RNA, 18 nt, Mycobacterium tuberculosis H37Rv
accagcgcuccagcaccc

SEQ ID NO: 3320297 - RNA, 17 nt, Mycobacterium tuberculosis H37Rv
accagcggcacaucaug

SEQ ID NO: 3320298 - RNA, 16 nt, Mycobacterium tuberculosis H37Rv
accagcggccgaccgc

SEQ ID NO: 3320299 - RNA, 18 nt, Mycobacterium tuberculosis H37Rv
accagcggccgaccgcga

SEQ ID NO: 3320300 - RNA, 14 nt, Mycobacterium tuberculosis H37Rv
accagcggcggccc

SEQ ID NO: 3320301 - RNA, 19 nt, Mycobacterium tuberculosis H37Rv
accagcggggucuugacgg

SEQ ID NO: 3320302 - RNA, 13 nt, Mycobacterium tuberculosis H37Rv
accagcggucagc

SEQ ID NO: 3320303 - RNA, 15 nt, Mycobacterium tuberculosis H37Rv
accagcggucagccg

SEQ ID NO: 3320304 - RNA, 17 nt, Mycobacterium tuberculosis H37Rv
accagcggucagccggc

SEQ ID NO: 3320305 - RNA, 21 nt, Mycobacterium tuberculosis H37Rv
accagcggucggcgaccacca

SEQ ID NO: 3320306 - RNA, 23 nt, Mycobacterium tuberculosis H37Rv
accagcggucggcgaccaccagc

SEQ ID NO: 3320307 - RNA, 16 nt, Mycobacterium tuberculosis H37Rv
accagcguccagccgc

SEQ ID NO: 3320308 - RNA, 20 nt, Mycobacterium tuberculosis H37Rv
accagcguggggccgccacc

SEQ ID NO: 3320309 - RNA, 23 nt, Mycobacterium tuberculosis H37Rv
accagcguggggccgccaccagc

SEQ ID NO: 3320310 - RNA, 22 nt, Mycobacterium tuberculosis H37Rv
accagcguguggagcucgcggc

SEQ ID NO: 3320311 - RNA, 15 nt, Mycobacterium tuberculosis H37Rv
accagcucagcugcg

SEQ ID NO: 3320312 - RNA, 13 nt, Mycobacterium tuberculosis H37Rv
accagcuccugca

SEQ ID NO: 3320313 - RNA, 18 nt, Mycobacterium tuberculosis H37Rv
accagcucggugaucacc

SEQ ID NO: 3320314 - RNA, 19 nt, Mycobacterium tuberculosis H37Rv
accagcugcucgucgucga

SEQ ID NO: 3320315 - RNA, 13 nt, Mycobacterium tuberculosis H37Rv
accagcuggcgau

SEQ ID NO: 3320316 - RNA, 15 nt, Mycobacterium tuberculosis H37Rv
accagcugucgggca

SEQ ID NO: 3320317 - RNA, 14 nt, Mycobacterium tuberculosis H37Rv
accaggaccaccgc

SEQ ID NO: 3320318 - RNA, 21 nt, Mycobacterium tuberculosis H37Rv
accaggaccggcugcaggugc

SEQ ID NO: 3320319 - RNA, 22 nt, Mycobacterium tuberculosis H37Rv
accaggaccggcugcaggugcu

SEQ ID NO: 3320320 - RNA, 18 nt, Mycobacterium tuberculosis H37Rv
accaggagccuccagcgc

SEQ ID NO: 3320321 - RNA, 19 nt, Mycobacterium tuberculosis H37Rv
accaggagcggauagcggc

SEQ ID NO: 3320322 - RNA, 22 nt, Mycobacterium tuberculosis H37Rv
accaggaugguugcgacggcgu

SEQ ID NO: 3320323 - RNA, 20 nt, Mycobacterium tuberculosis H37Rv
accaggccaacggcgcugcc

SEQ ID NO: 3320324 - RNA, 13 nt, Mycobacterium tuberculosis H37Rv
accaggcccgguu

SEQ ID NO: 3320325 - RNA, 20 nt, Mycobacterium tuberculosis H37Rv
accaggccgagccgcccgcc

SEQ ID NO: 3320326 - RNA, 17 nt, Mycobacterium tuberculosis H37Rv
accaggccggcccgcaa

SEQ ID NO: 3320327 - RNA, 15 nt, Mycobacterium tuberculosis H37Rv
accaggccggugacg

SEQ ID NO: 3320328 - RNA, 16 nt, Mycobacterium tuberculosis H37Rv
accaggccguccucgg

SEQ ID NO: 3320329 - RNA, 16 nt, Mycobacterium tuberculosis H37Rv
accaggcgagccgcca

SEQ ID NO: 3320330 - RNA, 16 nt, Mycobacterium tuberculosis H37Rv
accaggcggccgcguc

SEQ ID NO: 3320331 - RNA, 22 nt, Mycobacterium tuberculosis H37Rv
accaggcggcgcgggucggcga

SEQ ID NO: 3320332 - RNA, 18 nt, Mycobacterium tuberculosis H37Rv
accaggcguggacgcggu

SEQ ID NO: 3320333 - RNA, 18 nt, Mycobacterium tuberculosis H37Rv
accagggacgaugcccuc

SEQ ID NO: 3320334 - RNA, 16 nt, Mycobacterium tuberculosis H37Rv
accagggcagcggcca

SEQ ID NO: 3320335 - RNA, 12 nt, Mycobacterium tuberculosis H37Rv
accagggccacc

SEQ ID NO: 3320336 - RNA, 17 nt, Mycobacterium tuberculosis H37Rv
accagggccgccgcugc

SEQ ID NO: 3320337 - RNA, 21 nt, Mycobacterium tuberculosis H37Rv
accagggccuccacccgccac

SEQ ID NO: 3320338 - RNA, 12 nt, Mycobacterium tuberculosis H37Rv
accagggccucg

SEQ ID NO: 3320339 - RNA, 15 nt, Mycobacterium tuberculosis H37Rv
accagggccucgacc

SEQ ID NO: 3320340 - RNA, 20 nt, Mycobacterium tuberculosis H37Rv
accagggccucgaccgccag

SEQ ID NO: 3320341 - RNA, 13 nt, Mycobacterium tuberculosis H37Rv
accaggggcgcgu

SEQ ID NO: 3320342 - RNA, 20 nt, Mycobacterium tuberculosis H37Rv
accaggggucgcugugcagc

SEQ ID NO: 3320343 - RNA, 23 nt, Mycobacterium tuberculosis H37Rv
accagggugacggaguuggcccg

SEQ ID NO: 3320344 - RNA, 15 nt, Mycobacterium tuberculosis H37Rv
accagguacgggagc

SEQ ID NO: 3320345 - RNA, 18 nt, Mycobacterium tuberculosis H37Rv
accaggucgauaagggcu

SEQ ID NO: 3320346 - RNA, 19 nt, Mycobacterium tuberculosis H37Rv
accaggucggucaggucga

SEQ ID NO: 3320347 - RNA, 21 nt, Mycobacterium tuberculosis H37Rv
accaggucggugugcaucgcc

SEQ ID NO: 3320348 - RNA, 19 nt, Mycobacterium tuberculosis H37Rv
accaggucgugcccgggac

SEQ ID NO: 3320349 - RNA, 22 nt, Mycobacterium tuberculosis H37Rv
accagguggaccggccuggcuc

SEQ ID NO: 3320350 - RNA, 15 nt, Mycobacterium tuberculosis H37Rv
accagguggccaggc

SEQ ID NO: 3320351 - RNA, 21 nt, Mycobacterium tuberculosis H37Rv
accagguugccguggcugaaa

SEQ ID NO: 3320352 - RNA, 20 nt, Mycobacterium tuberculosis H37Rv
accaguaauacugccguucg

SEQ ID NO: 3320353 - RNA, 13 nt, Mycobacterium tuberculosis H37Rv
accaguccagcgg

SEQ ID NO: 3320354 - RNA, 17 nt, Mycobacterium tuberculosis H37Rv
accaguccagcgggcau

SEQ ID NO: 3320355 - RNA, 19 nt, Mycobacterium tuberculosis H37Rv
accaguccucgacguggcc

SEQ ID NO: 3320356 - RNA, 21 nt, Mycobacterium tuberculosis H37Rv
accaguccucgggcaggcggc

SEQ ID NO: 3320357 - RNA, 12 nt, Mycobacterium tuberculosis H37Rv
accagucgaccc

SEQ ID NO: 3320358 - RNA, 15 nt, Mycobacterium tuberculosis H37Rv
accagucgacccagc

SEQ ID NO: 3320359 - RNA, 15 nt, Mycobacterium tuberculosis H37Rv
accagugcagcucga

SEQ ID NO: 3320360 - RNA, 20 nt, Mycobacterium tuberculosis H37Rv
accagugcaucgaucaccgc

SEQ ID NO: 3320361 - RNA, 11 nt, Mycobacterium tuberculosis H37Rv
accagugcccc

SEQ ID NO: 3320362 - RNA, 19 nt, Mycobacterium tuberculosis H37Rv
accaguggauuggcgauga

SEQ ID NO: 3320363 - RNA, 16 nt, Mycobacterium tuberculosis H37Rv
accaguguggcgauga

SEQ ID NO: 3320364 - RNA, 19 nt, Mycobacterium tuberculosis H37Rv
acccaggcacaacaucgcc

SEQ ID NO: 3320365 - RNA, 17 nt, Mycobacterium tuberculosis H37Rv
acccaggccgucgcgcc

SEQ ID NO: 3320366 - RNA, 12 nt, Mycobacterium tuberculosis H37Rv
acccaguccggu

SEQ ID NO: 3320367 - RNA, 20 nt, Mycobacterium tuberculosis H37Rv
acccaguccgguagcagcgc

SEQ ID NO: 3320368 - RNA, 17 nt, Mycobacterium tuberculosis H37Rv
acccagugucagcaaga

SEQ ID NO: 3320369 - RNA, 23 nt, Mycobacterium tuberculosis H37Rv
acccaguuucggcgucgucgaug

SEQ ID NO: 3320370 - RNA, 14 nt, Mycobacterium tuberculosis H37Rv
acccaucaccgcca

SEQ ID NO: 3320371 - RNA, 21 nt, Mycobacterium tuberculosis H37Rv
acccaucccguucagcgacca

SEQ ID NO: 3320372 - RNA, 19 nt, Mycobacterium tuberculosis H37Rv
acccaucgaccgcccgcca

SEQ ID NO: 3320373 - RNA, 15 nt, Mycobacterium tuberculosis H37Rv
acccaucgccacacc

SEQ ID NO: 3320374 - RNA, 14 nt, Mycobacterium tuberculosis H37Rv
acccaucucgaagg

SEQ ID NO: 3320375 - RNA, 18 nt, Mycobacterium tuberculosis H37Rv
acccauggccucccacuc

SEQ ID NO: 3320376 - RNA, 20 nt, Mycobacterium tuberculosis H37Rv
acccauggccucccacucac

SEQ ID NO: 3320377 - RNA, 21 nt, Mycobacterium tuberculosis H37Rv
acccauggcuccgcccaggau

SEQ ID NO: 3320378 - RNA, 17 nt, Mycobacterium tuberculosis H37Rv
accccaaguccagcagc

SEQ ID NO: 3320379 - RNA, 20 nt, Mycobacterium tuberculosis H37Rv
accccaaguccagcagcgac

SEQ ID NO: 3320380 - RNA, 18 nt, Mycobacterium tuberculosis H37Rv
accccaaucgaccgcccg

SEQ ID NO: 3320381 - RNA, 20 nt, Mycobacterium tuberculosis H37Rv
accccaaucgaccgcccgcc

SEQ ID NO: 3320382 - RNA, 14 nt, Mycobacterium tuberculosis H37Rv
accccacacgccga

SEQ ID NO: 3320383 - RNA, 18 nt, Mycobacterium tuberculosis H37Rv
accccacagucgugagcc

SEQ ID NO: 3320384 - RNA, 17 nt, Mycobacterium tuberculosis H37Rv
accccaccacagacgac

SEQ ID NO: 3320385 - RNA, 14 nt, Mycobacterium tuberculosis H37Rv
accccacggccagu

SEQ ID NO: 3320386 - RNA, 19 nt, Mycobacterium tuberculosis H37Rv
accccagccggcagcagcg

SEQ ID NO: 3320387 - RNA, 22 nt, Mycobacterium tuberculosis H37Rv
accccagccggcagcagcgggc

SEQ ID NO: 3320388 - RNA, 17 nt, Mycobacterium tuberculosis H37Rv
accccaggcgcucauca

SEQ ID NO: 3320389 - RNA, 21 nt, Mycobacterium tuberculosis H37Rv
accccaucagaaugccuggcc

SEQ ID NO: 3320390 - RNA, 16 nt, Mycobacterium tuberculosis H37Rv
accccauggccaccga

SEQ ID NO: 3320391 - RNA, 13 nt, Mycobacterium tuberculosis H37Rv
accccauggccag

SEQ ID NO: 3320392 - RNA, 17 nt, Mycobacterium tuberculosis H37Rv
accccauggccagcgcu

SEQ ID NO: 3320393 - RNA, 23 nt, Mycobacterium tuberculosis H37Rv
acccccaacugcgaaacgccacc

SEQ ID NO: 3320394 - RNA, 13 nt, Mycobacterium tuberculosis H37Rv
acccccacgcugc

SEQ ID NO: 3320395 - RNA, 14 nt, Mycobacterium tuberculosis H37Rv
acccccagacaaag

SEQ ID NO: 3320396 - RNA, 13 nt, Mycobacterium tuberculosis H37Rv
accccccagcgac

SEQ ID NO: 3320397 - RNA, 20 nt, Mycobacterium tuberculosis H37Rv
accccccauagcaagaaccg

SEQ ID NO: 3320398 - RNA, 14 nt, Mycobacterium tuberculosis H37Rv
acccccgacaccgc

SEQ ID NO: 3320399 - RNA, 18 nt, Mycobacterium tuberculosis H37Rv
acccccgacaccgccgac

SEQ ID NO: 3320400 - RNA, 12 nt, Mycobacterium tuberculosis H37Rv
acccccgaucag

SEQ ID NO: 3320401 - RNA, 23 nt, Mycobacterium tuberculosis H37Rv
acccccgauggcgucgccggccc

SEQ ID NO: 3320402 - RNA, 14 nt, Mycobacterium tuberculosis H37Rv
acccccggcaggcu

SEQ ID NO: 3320403 - RNA, 22 nt, Mycobacterium tuberculosis H37Rv
acccccggccagcgucaacagc

SEQ ID NO: 3320404 - RNA, 19 nt, Mycobacterium tuberculosis H37Rv
acccccuuuacacccccaa

SEQ ID NO: 3320405 - RNA, 19 nt, Mycobacterium tuberculosis H37Rv
accccgaagaccuggccug

SEQ ID NO: 3320406 - RNA, 16 nt, Mycobacterium tuberculosis H37Rv
accccgagccuugagc

SEQ ID NO: 3320407 - RNA, 19 nt, Mycobacterium tuberculosis H37Rv
accccgagcggagccgccg

SEQ ID NO: 3320408 - RNA, 14 nt, Mycobacterium tuberculosis H37Rv
accccgagcugcca

SEQ ID NO: 3320409 - RNA, 19 nt, Mycobacterium tuberculosis H37Rv
accccgaggcaacaagcac

SEQ ID NO: 3320410 - RNA, 16 nt, Mycobacterium tuberculosis H37Rv
accccgaggccgaccu

SEQ ID NO: 3320411 - RNA, 16 nt, Mycobacterium tuberculosis H37Rv
accccgauggucgaga

SEQ ID NO: 3320412 - RNA, 17 nt, Mycobacterium tuberculosis H37Rv
accccgauggucgagag

SEQ ID NO: 3320413 - RNA, 13 nt, Mycobacterium tuberculosis H37Rv
accccgccagccg

SEQ ID NO: 3320414 - RNA, 16 nt, Mycobacterium tuberculosis H37Rv
accccgccgagcgguu

SEQ ID NO: 3320415 - RNA, 22 nt, Mycobacterium tuberculosis H37Rv
accccgccgagcgguugccuuc

SEQ ID NO: 3320416 - RNA, 23 nt, Mycobacterium tuberculosis H37Rv
accccgccgagcgguugccuucu

SEQ ID NO: 3320417 - RNA, 17 nt, Mycobacterium tuberculosis H37Rv
accccgccgaucaccgc

SEQ ID NO: 3320418 - RNA, 13 nt, Mycobacterium tuberculosis H37Rv
accccgccgccug

SEQ ID NO: 3320419 - RNA, 22 nt, Mycobacterium tuberculosis H37Rv
accccgccggcacauugaucga

SEQ ID NO: 3320420 - RNA, 21 nt, Mycobacterium tuberculosis H37Rv
accccgcgccggcgacaccgc

SEQ ID NO: 3320421 - RNA, 16 nt, Mycobacterium tuberculosis H37Rv
accccgcgcggugccc

SEQ ID NO: 3320422 - RNA, 19 nt, Mycobacterium tuberculosis H37Rv
accccgcgcggugcccugc

SEQ ID NO: 3320423 - RNA, 23 nt, Mycobacterium tuberculosis H37Rv
accccggaauccccaagcccgau

SEQ ID NO: 3320424 - RNA, 14 nt, Mycobacterium tuberculosis H37Rv
accccggaccgcgg

SEQ ID NO: 3320425 - RNA, 20 nt, Mycobacterium tuberculosis H37Rv
accccggcauacaacuggug

SEQ ID NO: 3320426 - RNA, 12 nt, Mycobacterium tuberculosis H37Rv
accccggccacc

SEQ ID NO: 3320427 - RNA, 12 nt, Mycobacterium tuberculosis H37Rv
accccggccacu

SEQ ID NO: 3320428 - RNA, 21 nt, Mycobacterium tuberculosis H37Rv
accccggccuuggcggcggca

SEQ ID NO: 3320429 - RNA, 16 nt, Mycobacterium tuberculosis H37Rv
accccggcgguaccgc

SEQ ID NO: 3320430 - RNA, 18 nt, Mycobacterium tuberculosis H37Rv
accccggcgguaccgccg

SEQ ID NO: 3320431 - RNA, 12 nt, Mycobacterium tuberculosis H37Rv
accccggcucga

SEQ ID NO: 3320432 - RNA, 22 nt, Mycobacterium tuberculosis H37Rv
accccggcugcgcuucgaccga

SEQ ID NO: 3320433 - RNA, 17 nt, Mycobacterium tuberculosis H37Rv
accccggucccgccgac

SEQ ID NO: 3320434 - RNA, 16 nt, Mycobacterium tuberculosis H37Rv
accccggugcccgcgg

SEQ ID NO: 3320435 - RNA, 18 nt, Mycobacterium tuberculosis H37Rv
accccgucagcgggcagc

SEQ ID NO: 3320436 - RNA, 23 nt, Mycobacterium tuberculosis H37Rv
accccgucagcgggcagcaggcg

SEQ ID NO: 3320437 - RNA, 17 nt, Mycobacterium tuberculosis H37Rv
accccguccucgaucgc

SEQ ID NO: 3320438 - RNA, 22 nt, Mycobacterium tuberculosis H37Rv
accccucacccagcuggguccc

SEQ ID NO: 3320439 - RNA, 15 nt, Mycobacterium tuberculosis H37Rv
accccuggccgccgg

SEQ ID NO: 3320440 - RNA, 19 nt, Mycobacterium tuberculosis H37Rv
accccugguagcacccacg

SEQ ID NO: 3320441 - RNA, 22 nt, Mycobacterium tuberculosis H37Rv
accccugguagcacccacggcg

SEQ ID NO: 3320442 - RNA, 21 nt, Mycobacterium tuberculosis H37Rv
accccuucgccagcgccacug

SEQ ID NO: 3320443 - RNA, 23 nt, Mycobacterium tuberculosis H37Rv
accccuugccuuccgacccaacg

SEQ ID NO: 3320444 - RNA, 16 nt, Mycobacterium tuberculosis H37Rv
acccgacaacgcuggg

SEQ ID NO: 3320445 - RNA, 17 nt, Mycobacterium tuberculosis H37Rv
acccgacacggcucgcc

SEQ ID NO: 3320446 - RNA, 18 nt, Mycobacterium tuberculosis H37Rv
acccgacaucggccagcg

SEQ ID NO: 3320447 - RNA, 12 nt, Mycobacterium tuberculosis H37Rv
acccgacccgau

SEQ ID NO: 3320448 - RNA, 13 nt, Mycobacterium tuberculosis H37Rv
acccgagccugga

SEQ ID NO: 3320449 - RNA, 19 nt, Mycobacterium tuberculosis H37Rv
acccgagcgcucgaucacg

SEQ ID NO: 3320450 - RNA, 22 nt, Mycobacterium tuberculosis H37Rv
acccgagcucuuggagcuuggc

SEQ ID NO: 3320451 - RNA, 19 nt, Mycobacterium tuberculosis H37Rv
acccgaguuauagaagccg

SEQ ID NO: 3320452 - RNA, 15 nt, Mycobacterium tuberculosis H37Rv
acccgaucagguacg

SEQ ID NO: 3320453 - RNA, 16 nt, Mycobacterium tuberculosis H37Rv
acccgaugacccacug

SEQ ID NO: 3320454 - RNA, 17 nt, Mycobacterium tuberculosis H37Rv
acccgaugacccacugc

SEQ ID NO: 3320455 - RNA, 14 nt, Mycobacterium tuberculosis H37Rv
acccgaugugcccg

SEQ ID NO: 3320456 - RNA, 17 nt, Mycobacterium tuberculosis H37Rv
acccgauuggccaaccc

SEQ ID NO: 3320457 - RNA, 23 nt, Mycobacterium tuberculosis H37Rv
acccgcaacuacggcguccccga

SEQ ID NO: 3320458 - RNA, 15 nt, Mycobacterium tuberculosis H37Rv
acccgcaaugaccgc

SEQ ID NO: 3320459 - RNA, 16 nt, Mycobacterium tuberculosis H37Rv
acccgcaccucaccgg

SEQ ID NO: 3320460 - RNA, 17 nt, Mycobacterium tuberculosis H37Rv
acccgcacuccaaguca

SEQ ID NO: 3320461 - RNA, 21 nt, Mycobacterium tuberculosis H37Rv
acccgcacuccaagucacagc

SEQ ID NO: 3320462 - RNA, 11 nt, Mycobacterium tuberculosis H37Rv
acccgcagacc

SEQ ID NO: 3320463 - RNA, 14 nt, Mycobacterium tuberculosis H37Rv
acccgcagaccggu

SEQ ID NO: 3320464 - RNA, 14 nt, Mycobacterium tuberculosis H37Rv
acccgcagccgcgc

SEQ ID NO: 3320465 - RNA, 14 nt, Mycobacterium tuberculosis H37Rv
acccgcagcugugg

SEQ ID NO: 3320466 - RNA, 17 nt, Mycobacterium tuberculosis H37Rv
acccgcagcuguggccc

SEQ ID NO: 3320467 - RNA, 20 nt, Mycobacterium tuberculosis H37Rv
acccgcagcuguggcccacu

SEQ ID NO: 3320468 - RNA, 20 nt, Mycobacterium tuberculosis H37Rv
acccgcaggucgaucugcgc

SEQ ID NO: 3320469 - RNA, 21 nt, Mycobacterium tuberculosis H37Rv
acccgcauaccguucacccag

SEQ ID NO: 3320470 - RNA, 18 nt, Mycobacterium tuberculosis H37Rv
acccgcauccacgucgcc

SEQ ID NO: 3320471 - RNA, 17 nt, Mycobacterium tuberculosis H37Rv
acccgcauggacgcgau

SEQ ID NO: 3320472 - RNA, 20 nt, Mycobacterium tuberculosis H37Rv
acccgccacaucguggcguc

SEQ ID NO: 3320473 - RNA, 15 nt, Mycobacterium tuberculosis H37Rv
acccgcccacggcac

SEQ ID NO: 3320474 - RNA, 16 nt, Mycobacterium tuberculosis H37Rv
acccggucgacggguc

SEQ ID NO: 3320475 - RNA, 19 nt, Mycobacterium tuberculosis H37Rv
acccggucgauucggcuca

SEQ ID NO: 3320476 - RNA, 21 nt, Mycobacterium tuberculosis H37Rv
acccggucgccggucaucgcc

SEQ ID NO: 3320477 - RNA, 16 nt, Mycobacterium tuberculosis H37Rv
acccggucggcagcug

SEQ ID NO: 3320478 - RNA, 17 nt, Mycobacterium tuberculosis H37Rv
acccggucggcagcugg

SEQ ID NO: 3320479 - RNA, 14 nt, Mycobacterium tuberculosis H37Rv
acccggucggccau

SEQ ID NO: 3320480 - RNA, 18 nt, Mycobacterium tuberculosis H37Rv
acccggucggccauccac

SEQ ID NO: 3320481 - RNA, 18 nt, Mycobacterium tuberculosis H37Rv
acccggucggguccaacg

SEQ ID NO: 3320482 - RNA, 15 nt, Mycobacterium tuberculosis H37Rv
acccggugaccagca

SEQ ID NO: 3320483 - RNA, 18 nt, Mycobacterium tuberculosis H37Rv
acccggugaccagcaacc

SEQ ID NO: 3320484 - RNA, 14 nt, Mycobacterium tuberculosis H37Rv
acccggugacccgc

SEQ ID NO: 3320485 - RNA, 15 nt, Mycobacterium tuberculosis H37Rv
acccggugacccgcu

SEQ ID NO: 3320486 - RNA, 18 nt, Mycobacterium tuberculosis H37Rv
acccggugagaagaagcc

SEQ ID NO: 3320487 - RNA, 20 nt, Mycobacterium tuberculosis H37Rv
acccggugauggugugcagc

SEQ ID NO: 3320488 - RNA, 16 nt, Mycobacterium tuberculosis H37Rv
acccgguggcaccaua

SEQ ID NO: 3320489 - RNA, 22 nt, Mycobacterium tuberculosis H37Rv
acccgguguugagcgaacccgc

SEQ ID NO: 3320490 - RNA, 14 nt, Mycobacterium tuberculosis H37Rv
acccguaccagccc

SEQ ID NO: 3320491 - RNA, 22 nt, Mycobacterium tuberculosis H37Rv
acccguacccacgacgggccga

SEQ ID NO: 3320492 - RNA, 14 nt, Mycobacterium tuberculosis H37Rv
acccguagcuuggc

SEQ ID NO: 3320493 - RNA, 17 nt, Mycobacterium tuberculosis H37Rv
acccguaggguggccga

SEQ ID NO: 3320494 - RNA, 12 nt, Mycobacterium tuberculosis H37Rv
acccgucaccgc

SEQ ID NO: 3320495 - RNA, 14 nt, Mycobacterium tuberculosis H37Rv
acccgucaccgccg

SEQ ID NO: 3320496 - RNA, 23 nt, Mycobacterium tuberculosis H37Rv
acccguccgccgcagacgccgac

SEQ ID NO: 3320497 - RNA, 16 nt, Mycobacterium tuberculosis H37Rv
acccgucgagcagcau

SEQ ID NO: 3320498 - RNA, 17 nt, Mycobacterium tuberculosis H37Rv
acccgucgagcagcaug

SEQ ID NO: 3320499 - RNA, 17 nt, Mycobacterium tuberculosis H37Rv
acccgucgggugcugau

SEQ ID NO: 3320500 - RNA, 23 nt, Mycobacterium tuberculosis H37Rv
acccgucuuaucggcgucguaga

SEQ ID NO: 3320501 - RNA, 20 nt, Mycobacterium tuberculosis H37Rv
acccgugccgccgaugccgc

SEQ ID NO: 3320502 - RNA, 13 nt, Mycobacterium tuberculosis H37Rv
acccgugccguca

SEQ ID NO: 3320503 - RNA, 23 nt, Mycobacterium tuberculosis H37Rv
acccgugccuuacuuccauccac

SEQ ID NO: 3320504 - RNA, 22 nt, Mycobacterium tuberculosis H37Rv
acccgugcggccacgguucuuc

SEQ ID NO: 3320505 - RNA, 16 nt, Mycobacterium tuberculosis H37Rv
acccguguggcacgug

SEQ ID NO: 3320506 - RNA, 21 nt, Mycobacterium tuberculosis H37Rv
acccguguucgccacacccgu

SEQ ID NO: 3320507 - RNA, 15 nt, Mycobacterium tuberculosis H37Rv
acccguuccacgccg

SEQ ID NO: 3320508 - RNA, 19 nt, Mycobacterium tuberculosis H37Rv
acccguucgugagcggcca

SEQ ID NO: 3320509 - RNA, 13 nt, Mycobacterium tuberculosis H37Rv
acccguucucggu

SEQ ID NO: 3320510 - RNA, 22 nt, Mycobacterium tuberculosis H37Rv
acccuaaaccagccaccaccag

SEQ ID NO: 3320511 - RNA, 16 nt, Mycobacterium tuberculosis H37Rv
acccucaggcaaucgc

SEQ ID NO: 3320512 - RNA, 13 nt, Mycobacterium tuberculosis H37Rv
acccuccacagcg

SEQ ID NO: 3320513 - RNA, 17 nt, Mycobacterium tuberculosis H37Rv
acccuccacagcggcca

SEQ ID NO: 3320514 - RNA, 11 nt, Mycobacterium tuberculosis H37Rv
acccuccagca

SEQ ID NO: 3320515 - RNA, 21 nt, Mycobacterium tuberculosis H37Rv
acccuccggacccacccgcac

SEQ ID NO: 3320516 - RNA, 14 nt, Mycobacterium tuberculosis H37Rv
acccucgccgguca

SEQ ID NO: 3320517 - RNA, 14 nt, Mycobacterium tuberculosis H37Rv
acccugaugaucgu

SEQ ID NO: 3320518 - RNA, 13 nt, Mycobacterium tuberculosis H37Rv
acccugcccggcc

SEQ ID NO: 3320519 - RNA, 19 nt, Mycobacterium tuberculosis H37Rv
acccugcgccgccacagca

SEQ ID NO: 3320520 - RNA, 15 nt, Mycobacterium tuberculosis H37Rv
acccugcggugcagg

SEQ ID NO: 3320521 - RNA, 17 nt, Mycobacterium tuberculosis H37Rv
acccuggcggaacagcu

SEQ ID NO: 3320522 - RNA, 16 nt, Mycobacterium tuberculosis H37Rv
acccuggucgaaacgg

SEQ ID NO: 3320523 - RNA, 20 nt, Mycobacterium tuberculosis H37Rv
acccugguggucagucacca

SEQ ID NO: 3320524 - RNA, 18 nt, Mycobacterium tuberculosis H37Rv
acccuguuccagcgggug

SEQ ID NO: 3320525 - RNA, 22 nt, Mycobacterium tuberculosis H37Rv
acccuguuccagcggguggcca

SEQ ID NO: 3320526 - RNA, 14 nt, Mycobacterium tuberculosis H37Rv
acccuugccgccgg

SEQ ID NO: 3320527 - RNA, 23 nt, Mycobacterium tuberculosis H37Rv
accgaaaagccguucgcgucgcc

SEQ ID NO: 3320528 - RNA, 20 nt, Mycobacterium tuberculosis H37Rv
accgaaaccggucagcacau

SEQ ID NO: 3320529 - RNA, 21 nt, Mycobacterium tuberculosis H37Rv
accgaaacgaugcggccugca

SEQ ID NO: 3320530 - RNA, 15 nt, Mycobacterium tuberculosis H37Rv
accgaaagccgcacc

SEQ ID NO: 3320531 - RNA, 17 nt, Mycobacterium tuberculosis H37Rv
accgaaagccgcaccag

SEQ ID NO: 3320532 - RNA, 18 nt, Mycobacterium tuberculosis H37Rv
accgaaagccgcaccaga

SEQ ID NO: 3320533 - RNA, 16 nt, Mycobacterium tuberculosis H37Rv
accgaaauggucguuc

SEQ ID NO: 3320534 - RNA, 18 nt, Mycobacterium tuberculosis H37Rv
accgaacaacagcggcaa

SEQ ID NO: 3320535 - RNA, 15 nt, Mycobacterium tuberculosis H37Rv
accgaacagcaccga

SEQ ID NO: 3320536 - RNA, 20 nt, Mycobacterium tuberculosis H37Rv
accgaacagucgcagccagg

SEQ ID NO: 3320537 - RNA, 17 nt, Mycobacterium tuberculosis H37Rv
accgaacccgccaccgc

SEQ ID NO: 3320538 - RNA, 23 nt, Mycobacterium tuberculosis H37Rv
accgaacccgccaccgcgacacc

SEQ ID NO: 3320539 - RNA, 22 nt, Mycobacterium tuberculosis H37Rv
accgaacgcaccgaaacgccga

SEQ ID NO: 3320540 - RNA, 15 nt, Mycobacterium tuberculosis H37Rv
accgaacgccagguc

SEQ ID NO: 3320541 - RNA, 17 nt, Mycobacterium tuberculosis H37Rv
accgaacgcgaugcgcc

SEQ ID NO: 3320542 - RNA, 22 nt, Mycobacterium tuberculosis H37Rv
accgaacgcggccaccgaccgc

SEQ ID NO: 3320543 - RNA, 12 nt, Mycobacterium tuberculosis H37Rv
accgaagaagcc

SEQ ID NO: 3320544 - RNA, 14 nt, Mycobacterium tuberculosis H37Rv
accgaagccgccgg

SEQ ID NO: 3320545 - RNA, 18 nt, Mycobacterium tuberculosis H37Rv
accgaagcgaacggcaca

SEQ ID NO: 3320546 - RNA, 15 nt, Mycobacterium tuberculosis H37Rv
accgaagcggugacc

SEQ ID NO: 3320547 - RNA, 13 nt, Mycobacterium tuberculosis H37Rv
accgaauaccgcc

SEQ ID NO: 3320548 - RNA, 17 nt, Mycobacterium tuberculosis H37Rv
accgaauggccgccgca

SEQ ID NO: 3320549 - RNA, 15 nt, Mycobacterium tuberculosis H37Rv
accgaauugaacuga

SEQ ID NO: 3320550 - RNA, 20 nt, Mycobacterium tuberculosis H37Rv
accgaauuguuguaacccgu

SEQ ID NO: 3320551 - RNA, 19 nt, Mycobacterium tuberculosis H37Rv
accgacaccgugucgccgg

SEQ ID NO: 3320552 - RNA, 21 nt, Mycobacterium tuberculosis H37Rv
accgacacugggaucccgacg

SEQ ID NO: 3320553 - RNA, 13 nt, Mycobacterium tuberculosis H37Rv
accgacagcaccc

SEQ ID NO: 3320554 - RNA, 14 nt, Mycobacterium tuberculosis H37Rv
accgacagcaccca

SEQ ID NO: 3320555 - RNA, 22 nt, Mycobacterium tuberculosis H37Rv
accgacagccccaucaccaccg

SEQ ID NO: 3320556 - RNA, 19 nt, Mycobacterium tuberculosis H37Rv
accgacaucgucauccagg

SEQ ID NO: 3320557 - RNA, 12 nt, Mycobacterium tuberculosis H37Rv
accgaccagccg

SEQ ID NO: 3320558 - RNA, 15 nt, Mycobacterium tuberculosis H37Rv
accgaccagccgugg

SEQ ID NO: 3320559 - RNA, 14 nt, Mycobacterium tuberculosis H37Rv
accgaccgcauggu

SEQ ID NO: 3320560 - RNA, 19 nt, Mycobacterium tuberculosis H37Rv
accgaccgggccgcacggu

SEQ ID NO: 3320561 - RNA, 21 nt, Mycobacterium tuberculosis H37Rv
accgaccgggccgcacgguca

SEQ ID NO: 3320562 - RNA, 17 nt, Mycobacterium tuberculosis H37Rv
accgaccuaccgucgac

SEQ ID NO: 3320563 - RNA, 21 nt, Mycobacterium tuberculosis H37Rv
accgaccuaccgucgaccacu

SEQ ID NO: 3320564 - RNA, 22 nt, Mycobacterium tuberculosis H37Rv
accgaccuacugcggucgccca

SEQ ID NO: 3320565 - RNA, 23 nt, Mycobacterium tuberculosis H37Rv
accgaccuacugcggucgcccag

SEQ ID NO: 3320566 - RNA, 20 nt, Mycobacterium tuberculosis H37Rv
accgacgaagaucgcugcga

SEQ ID NO: 3320567 - RNA, 11 nt, Mycobacterium tuberculosis H37Rv
accgacgagga

SEQ ID NO: 3320568 - RNA, 23 nt, Mycobacterium tuberculosis H37Rv
accgacgaggacgucaccgucag

SEQ ID NO: 3320569 - RNA, 14 nt, Mycobacterium tuberculosis H37Rv
accgacgaucaacg

SEQ ID NO: 3320570 - RNA, 12 nt, Mycobacterium tuberculosis H37Rv
accgacgccggu

SEQ ID NO: 3320571 - RNA, 19 nt, Mycobacterium tuberculosis H37Rv
accgacgccgucgagcacg

SEQ ID NO: 3320572 - RNA, 14 nt, Mycobacterium tuberculosis H37Rv
accgacgcgaacgc

SEQ ID NO: 3320573 - RNA, 17 nt, Mycobacterium tuberculosis H37Rv
accgacgcgaacgcggc

SEQ ID NO: 3320574 - RNA, 22 nt, Mycobacterium tuberculosis H37Rv
accgacgcgcccgcgcgcuccg

SEQ ID NO: 3320575 - RNA, 21 nt, Mycobacterium tuberculosis H37Rv
accgacgcguccggugcacca

SEQ ID NO: 3320576 - RNA, 15 nt, Mycobacterium tuberculosis H37Rv
accgacgcugaaguu

SEQ ID NO: 3320577 - RNA, 20 nt, Mycobacterium tuberculosis H37Rv
accgacggccagcaagacga

SEQ ID NO: 3320578 - RNA, 15 nt, Mycobacterium tuberculosis H37Rv
accgacgucgcccau

SEQ ID NO: 3320579 - RNA, 19 nt, Mycobacterium tuberculosis H37Rv
accgacguggccagcccgc

SEQ ID NO: 3320580 - RNA, 16 nt, Mycobacterium tuberculosis H37Rv
accgagaagcccaccg

SEQ ID NO: 3320581 - RNA, 23 nt, Mycobacterium tuberculosis H37Rv
accgagaagcccaccgucugcug

SEQ ID NO: 3320582 - RNA, 15 nt, Mycobacterium tuberculosis H37Rv
accgagacuugcugg

SEQ ID NO: 3320583 - RNA, 17 nt, Mycobacterium tuberculosis H37Rv
accgagacuugcuggcc

SEQ ID NO: 3320584 - RNA, 21 nt, Mycobacterium tuberculosis H37Rv
accgagacuugcuggcccgca

SEQ ID NO: 3320585 - RNA, 13 nt, Mycobacterium tuberculosis H37Rv
accgagaugcgca

SEQ ID NO: 3320586 - RNA, 18 nt, Mycobacterium tuberculosis H37Rv
accgagcaucucgucguc

SEQ ID NO: 3320587 - RNA, 20 nt, Mycobacterium tuberculosis H37Rv
accgagcaucucgucgucga

SEQ ID NO: 3320588 - RNA, 18 nt, Mycobacterium tuberculosis H37Rv
accgagccacgacccagc

SEQ ID NO: 3320589 - RNA, 21 nt, Mycobacterium tuberculosis H37Rv
accgagccacgacccagcaug

SEQ ID NO: 3320590 - RNA, 20 nt, Mycobacterium tuberculosis H37Rv
accgagcccuccagggcccu

SEQ ID NO: 3320591 - RNA, 23 nt, Mycobacterium tuberculosis H37Rv
accgagcccuccagggcccugcu

SEQ ID NO: 3320592 - RNA, 20 nt, Mycobacterium tuberculosis H37Rv
accgagcgcaaucgaccacg

SEQ ID NO: 3320593 - RNA, 21 nt, Mycobacterium tuberculosis H37Rv
accgagcgcccuccucgaugc

SEQ ID NO: 3320594 - RNA, 21 nt, Mycobacterium tuberculosis H37Rv
accgaggaacuugcauccggc

SEQ ID NO: 3320595 - RNA, 14 nt, Mycobacterium tuberculosis H37Rv
accgaggccgccga

SEQ ID NO: 3320596 - RNA, 19 nt, Mycobacterium tuberculosis H37Rv
accgaggccugacugaauu

SEQ ID NO: 3320597 - RNA, 21 nt, Mycobacterium tuberculosis H37Rv
accgagggcaaggacaagccg

SEQ ID NO: 3320598 - RNA, 23 nt, Mycobacterium tuberculosis H37Rv
accgagggccgucacaggccgcc

SEQ ID NO: 3320599 - RNA, 15 nt, Mycobacterium tuberculosis H37Rv
accgagggucgggca

SEQ ID NO: 3320600 - RNA, 17 nt, Mycobacterium tuberculosis H37Rv
accgaggucgagcgacc

SEQ ID NO: 3320601 - RNA, 23 nt, Mycobacterium tuberculosis H37Rv
accgaggucggccagcagcagug

SEQ ID NO: 3320602 - RNA, 20 nt, Mycobacterium tuberculosis H37Rv
accgaggugccgcgcagcug

SEQ ID NO: 3320603 - RNA, 13 nt, Mycobacterium tuberculosis H37Rv
accgaguaccgau

SEQ ID NO: 3320604 - RNA, 17 nt, Mycobacterium tuberculosis H37Rv
accgagucgacggccag

SEQ ID NO: 3320605 - RNA, 23 nt, Mycobacterium tuberculosis H37Rv
accgagucgacggccagugcgca

SEQ ID NO: 3320606 - RNA, 13 nt, Mycobacterium tuberculosis H37Rv
accgauacccccg

SEQ ID NO: 3320607 - RNA, 17 nt, Mycobacterium tuberculosis H37Rv
accgauaccucgccauc

SEQ ID NO: 3320608 - RNA, 14 nt, Mycobacterium tuberculosis H37Rv
accgauaucgcugc

SEQ ID NO: 3320609 - RNA, 13 nt, Mycobacterium tuberculosis H37Rv
accgaucaauccg

SEQ ID NO: 3320610 - RNA, 13 nt, Mycobacterium tuberculosis H37Rv
accgaucaccggu

SEQ ID NO: 3320611 - RNA, 17 nt, Mycobacterium tuberculosis H37Rv
accgauccggccgccga

SEQ ID NO: 3320612 - RNA, 16 nt, Mycobacterium tuberculosis H37Rv
accgaucgaacagugc

SEQ ID NO: 3320613 - RNA, 16 nt, Mycobacterium tuberculosis H37Rv
accgaucgacugcagc

SEQ ID NO: 3320614 - RNA, 12 nt, Mycobacterium tuberculosis H37Rv
accgaucggcag

SEQ ID NO: 3320615 - RNA, 16 nt, Mycobacterium tuberculosis H37Rv
accgaucugcuucagu

SEQ ID NO: 3320616 - RNA, 15 nt, Mycobacterium tuberculosis H37Rv
accgaucuuggccac

SEQ ID NO: 3320617 - RNA, 17 nt, Mycobacterium tuberculosis H37Rv
accgaucuuggccaccg

SEQ ID NO: 3320618 - RNA, 16 nt, Mycobacterium tuberculosis H37Rv
accgaugccuugaccg

SEQ ID NO: 3320619 - RNA, 14 nt, Mycobacterium tuberculosis H37Rv
accgaugcugacga

SEQ ID NO: 3320620 - RNA, 16 nt, Mycobacterium tuberculosis H37Rv
accgauggcgcaccgg

SEQ ID NO: 3320621 - RNA, 19 nt, Mycobacterium tuberculosis H37Rv
accgauggcucacaugccc

SEQ ID NO: 3320622 - RNA, 22 nt, Mycobacterium tuberculosis H37Rv
accgaugguggugccaaccugg

SEQ ID NO: 3320623 - RNA, 20 nt, Mycobacterium tuberculosis H37Rv
accgaugguugagcaucgau

SEQ ID NO: 3320624 - RNA, 14 nt, Mycobacterium tuberculosis H37Rv
accgauuccagcgg

SEQ ID NO: 3320625 - RNA, 19 nt, Mycobacterium tuberculosis H37Rv
accgauucgggcuucucca

SEQ ID NO: 3320626 - RNA, 15 nt, Mycobacterium tuberculosis H37Rv
accgcaaaggagaag

SEQ ID NO: 3320627 - RNA, 22 nt, Mycobacterium tuberculosis H37Rv
accgcaacgcguauucggcauc

SEQ ID NO: 3320628 - RNA, 15 nt, Mycobacterium tuberculosis H37Rv
accgcaacucgccga

SEQ ID NO: 3320629 - RNA, 16 nt, Mycobacterium tuberculosis H37Rv
accgcaacucgccgaa

SEQ ID NO: 3320630 - RNA, 15 nt, Mycobacterium tuberculosis H37Rv
accgcaaggcccaca

SEQ ID NO: 3320631 - RNA, 22 nt, Mycobacterium tuberculosis H37Rv
accgcaaucauccgaucgccgc

SEQ ID NO: 3320632 - RNA, 16 nt, Mycobacterium tuberculosis H37Rv
accgcaaucggauacc

SEQ ID NO: 3320633 - RNA, 15 nt, Mycobacterium tuberculosis H37Rv
accgcaauggcggcc

SEQ ID NO: 3320634 - RNA, 18 nt, Mycobacterium tuberculosis H37Rv
accgcaccaaagcgaaau

SEQ ID NO: 3320635 - RNA, 12 nt, Mycobacterium tuberculosis H37Rv
accgcaccaggu

SEQ ID NO: 3320636 - RNA, 20 nt, Mycobacterium tuberculosis H37Rv
accgcacccgcucgucggua

SEQ ID NO: 3320637 - RNA, 20 nt, Mycobacterium tuberculosis H37Rv
accgcaccgacuccugggcc

SEQ ID NO: 3320638 - RNA, 18 nt, Mycobacterium tuberculosis H37Rv
accgcaccggaauacagc

SEQ ID NO: 3320639 - RNA, 13 nt, Mycobacterium tuberculosis H37Rv
accgcaccguccc

SEQ ID NO: 3320640 - RNA, 17 nt, Mycobacterium tuberculosis H37Rv
accgcacgcuggcgggc

SEQ ID NO: 3320641 - RNA, 20 nt, Mycobacterium tuberculosis H37Rv
accgcacggugaccacgccg

SEQ ID NO: 3320642 - RNA, 14 nt, Mycobacterium tuberculosis H37Rv
accgcagacccucg

SEQ ID NO: 3320643 - RNA, 21 nt, Mycobacterium tuberculosis H37Rv
accgcagacgugguagccggc

SEQ ID NO: 3320644 - RNA, 19 nt, Mycobacterium tuberculosis H37Rv
accgcagauccccgccacc

SEQ ID NO: 3320645 - RNA, 15 nt, Mycobacterium tuberculosis H37Rv
accgcagcacucccu

SEQ ID NO: 3320646 - RNA, 13 nt, Mycobacterium tuberculosis H37Rv
accgcagcggaac

SEQ ID NO: 3320647 - RNA, 18 nt, Mycobacterium tuberculosis H37Rv
accgcagcggaacugggc

SEQ ID NO: 3320648 - RNA, 23 nt, Mycobacterium tuberculosis H37Rv
accgcagcggaacugggccccca

SEQ ID NO: 3320649 - RNA, 13 nt, Mycobacterium tuberculosis H37Rv
accgcagcgggcg

SEQ ID NO: 3320650 - RNA, 13 nt, Mycobacterium tuberculosis H37Rv
accgcagcgggug

SEQ ID NO: 3320651 - RNA, 18 nt, Mycobacterium tuberculosis H37Rv
accgcaggcacaucgcga

SEQ ID NO: 3320652 - RNA, 17 nt, Mycobacterium tuberculosis H37Rv
accgcagucccagcaca

SEQ ID NO: 3320653 - RNA, 19 nt, Mycobacterium tuberculosis H37Rv
accgcaucgggcuugcgca

SEQ ID NO: 3320654 - RNA, 21 nt, Mycobacterium tuberculosis H37Rv
accgcaucucgggcgaagccg

SEQ ID NO: 3320655 - RNA, 20 nt, Mycobacterium tuberculosis H37Rv
accgcaugguggugggugau

SEQ ID NO: 3320656 - RNA, 13 nt, Mycobacterium tuberculosis H37Rv
accgcauguggga

SEQ ID NO: 3320657 - RNA, 17 nt, Mycobacterium tuberculosis H37Rv
accgccaaaaacgccag

SEQ ID NO: 3320658 - RNA, 23 nt, Mycobacterium tuberculosis H37Rv
accgccaacauuggugagguggu

SEQ ID NO: 3320659 - RNA, 16 nt, Mycobacterium tuberculosis H37Rv
accgccaaccuacccu

SEQ ID NO: 3320660 - RNA, 15 nt, Mycobacterium tuberculosis H37Rv
accgccaccacccag

SEQ ID NO: 3320661 - RNA, 19 nt, Mycobacterium tuberculosis H37Rv
accgccaccacccaggcca

SEQ ID NO: 3320662 - RNA, 21 nt, Mycobacterium tuberculosis H37Rv
accgccaccacgccgucgaca

SEQ ID NO: 3320663 - RNA, 16 nt, Mycobacterium tuberculosis H37Rv
accgccaccacgguca

SEQ ID NO: 3320664 - RNA, 15 nt, Mycobacterium tuberculosis H37Rv
accgccaccagacca

SEQ ID NO: 3320665 - RNA, 11 nt, Mycobacterium tuberculosis H37Rv
accgccacccc

SEQ ID NO: 3320666 - RNA, 17 nt, Mycobacterium tuberculosis H37Rv
accgccaccccggucgg

SEQ ID NO: 3320667 - RNA, 15 nt, Mycobacterium tuberculosis H37Rv
accgccaccgccagc

SEQ ID NO: 3320668 - RNA, 16 nt, Mycobacterium tuberculosis H37Rv
accgccaccgccagcg

SEQ ID NO: 3320669 - RNA, 16 nt, Mycobacterium tuberculosis H37Rv
accgccaccgcggccu

SEQ ID NO: 3320670 - RNA, 17 nt, Mycobacterium tuberculosis H37Rv
accgccaccuuggcguu

SEQ ID NO: 3320671 - RNA, 21 nt, Mycobacterium tuberculosis H37Rv
accgccaccuuggcguugacc

SEQ ID NO: 3320672 - RNA, 15 nt, Mycobacterium tuberculosis H37Rv
accgccacggcggcu

SEQ ID NO: 3320673 - RNA, 18 nt, Mycobacterium tuberculosis H37Rv
accgccagcagcaggcca

SEQ ID NO: 3320674 - RNA, 19 nt, Mycobacterium tuberculosis H37Rv
accgccagcaugacaccgg

SEQ ID NO: 3320675 - RNA, 23 nt, Mycobacterium tuberculosis H37Rv
accgccagccaccacaucgcggg

SEQ ID NO: 3320676 - RNA, 16 nt, Mycobacterium tuberculosis H37Rv
accgccagcgccaccg

SEQ ID NO: 3320677 - RNA, 14 nt, Mycobacterium tuberculosis H37Rv
accgccagcggcaa

SEQ ID NO: 3320678 - RNA, 23 nt, Mycobacterium tuberculosis H37Rv
accgccagcggccgcuccaccuc

SEQ ID NO: 3320679 - RNA, 15 nt, Mycobacterium tuberculosis H37Rv
accgccagcgucgac

SEQ ID NO: 3320680 - RNA, 17 nt, Mycobacterium tuberculosis H37Rv
accgccaucgccaacac

SEQ ID NO: 3320681 - RNA, 21 nt, Mycobacterium tuberculosis H37Rv
accgccaucgucgaagaccuc

SEQ ID NO: 3320682 - RNA, 20 nt, Mycobacterium tuberculosis H37Rv
accgcccagugccagaaccc

SEQ ID NO: 3320683 - RNA, 15 nt, Mycobacterium tuberculosis H37Rv
accgcccccagcggu

SEQ ID NO: 3320684 - RNA, 16 nt, Mycobacterium tuberculosis H37Rv
accgcccccagcgguu

SEQ ID NO: 3320685 - RNA, 15 nt, Mycobacterium tuberculosis H37Rv
accgcccgcaccccc

SEQ ID NO: 3320686 - RNA, 20 nt, Mycobacterium tuberculosis H37Rv
accgcccgcacccccgacac

SEQ ID NO: 3320687 - RNA, 15 nt, Mycobacterium tuberculosis H37Rv
accgcccgcaccgug

SEQ ID NO: 3320688 - RNA, 18 nt, Mycobacterium tuberculosis H37Rv
accgcccgcaccguggac

SEQ ID NO: 3320689 - RNA, 19 nt, Mycobacterium tuberculosis H37Rv
accgcccgccaggccguug

SEQ ID NO: 3320690 - RNA, 18 nt, Mycobacterium tuberculosis H37Rv
accgcccgcccuugcggc

SEQ ID NO: 3320691 - RNA, 15 nt, Mycobacterium tuberculosis H37Rv
accgcccgcgccacc

SEQ ID NO: 3320692 - RNA, 12 nt, Mycobacterium tuberculosis H37Rv
accgcccuugcc

SEQ ID NO: 3320693 - RNA, 16 nt, Mycobacterium tuberculosis H37Rv
accgcccuugccgccg

SEQ ID NO: 3320694 - RNA, 20 nt, Mycobacterium tuberculosis H37Rv
accgccgaagcugcggguca

SEQ ID NO: 3320695 - RNA, 17 nt, Mycobacterium tuberculosis H37Rv
accgccgacaggccggc

SEQ ID NO: 3320696 - RNA, 21 nt, Mycobacterium tuberculosis H37Rv
accgccgaccuagucaccuug

SEQ ID NO: 3320697 - RNA, 14 nt, Mycobacterium tuberculosis H37Rv
accgccgacgccgu

SEQ ID NO: 3320698 - RNA, 14 nt, Mycobacterium tuberculosis H37Rv
accgccgagcgggu

SEQ ID NO: 3320699 - RNA, 20 nt, Mycobacterium tuberculosis H37Rv
accgccgauacaacgcggcu

SEQ ID NO: 3320700 - RNA, 19 nt, Mycobacterium tuberculosis H37Rv
accgccgaucggccacagu

SEQ ID NO: 3320701 - RNA, 22 nt, Mycobacterium tuberculosis H37Rv
accgccgaucggccacagugca

SEQ ID NO: 3320702 - RNA, 22 nt, Mycobacterium tuberculosis H37Rv
accgccgauguggucggcuguc

SEQ ID NO: 3320703 - RNA, 20 nt, Mycobacterium tuberculosis H37Rv
accgccgcauucggcgauga

SEQ ID NO: 3320704 - RNA, 21 nt, Mycobacterium tuberculosis H37Rv
accgccgcccaaaacgucacc

SEQ ID NO: 3320705 - RNA, 23 nt, Mycobacterium tuberculosis H37Rv
accgccgcccaaaacgucaccgc

SEQ ID NO: 3320706 - RNA, 11 nt, Mycobacterium tuberculosis H37Rv
accgccgccga

SEQ ID NO: 3320707 - RNA, 13 nt, Mycobacterium tuberculosis H37Rv
accgccgccgccc

SEQ ID NO: 3320708 - RNA, 15 nt, Mycobacterium tuberculosis H37Rv
accgccgccgccgac

SEQ ID NO: 3320709 - RNA, 18 nt, Mycobacterium tuberculosis H37Rv
accgccgccgccgacgcc

SEQ ID NO: 3320710 - RNA, 16 nt, Mycobacterium tuberculosis H37Rv
accgccgccgccgcgu

SEQ ID NO: 3320711 - RNA, 11 nt, Mycobacterium tuberculosis H37Rv
accgccgccgg

SEQ ID NO: 3320712 - RNA, 14 nt, Mycobacterium tuberculosis H37Rv
accgccgccggcac

SEQ ID NO: 3320713 - RNA, 18 nt, Mycobacterium tuberculosis H37Rv
accgccgccggcaccgcc

SEQ ID NO: 3320714 - RNA, 16 nt, Mycobacterium tuberculosis H37Rv
accgccgcgaccgcga

SEQ ID NO: 3320715 - RNA, 15 nt, Mycobacterium tuberculosis H37Rv
accgccgcgcagccg

SEQ ID NO: 3320716 - RNA, 15 nt, Mycobacterium tuberculosis H37Rv
accgccgcgccggca

SEQ ID NO: 3320717 - RNA, 13 nt, Mycobacterium tuberculosis H37Rv
accgccgcgcgac

SEQ ID NO: 3320718 - RNA, 17 nt, Mycobacterium tuberculosis H37Rv
accgccgcuaccgcccg

SEQ ID NO: 3320719 - RNA, 15 nt, Mycobacterium tuberculosis H37Rv
accgccgcugccauc

SEQ ID NO: 3320720 - RNA, 20 nt, Mycobacterium tuberculosis H37Rv
accgccgcugccgccgagcu

SEQ ID NO: 3320721 - RNA, 16 nt, Mycobacterium tuberculosis H37Rv
accgccgcugccggua

SEQ ID NO: 3320722 - RNA, 23 nt, Mycobacterium tuberculosis H37Rv
accgccgcugccgguagcacagc

SEQ ID NO: 3320723 - RNA, 12 nt, Mycobacterium tuberculosis H37Rv
accgccggcacc

SEQ ID NO: 3320724 - RNA, 15 nt, Mycobacterium tuberculosis H37Rv
accgccggcaccgcc

SEQ ID NO: 3320725 - RNA, 16 nt, Mycobacterium tuberculosis H37Rv
accgccggcaccgcca

SEQ ID NO: 3320726 - RNA, 17 nt, Mycobacterium tuberculosis H37Rv
accgccggcaccgccag

SEQ ID NO: 3320727 - RNA, 21 nt, Mycobacterium tuberculosis H37Rv
accgccggcaccgccgccccc

SEQ ID NO: 3320728 - RNA, 16 nt, Mycobacterium tuberculosis H37Rv
accgccggccccaccg

SEQ ID NO: 3320729 - RNA, 20 nt, Mycobacterium tuberculosis H37Rv
accgccggcgcccaggccga

SEQ ID NO: 3320730 - RNA, 23 nt, Mycobacterium tuberculosis H37Rv
accgccggcgcccaggccgauca

SEQ ID NO: 3320731 - RNA, 13 nt, Mycobacterium tuberculosis H37Rv
accgccggcgccg

SEQ ID NO: 3320732 - RNA, 15 nt, Mycobacterium tuberculosis H37Rv
accgccggcgccgcc

SEQ ID NO: 3320733 - RNA, 21 nt, Mycobacterium tuberculosis H37Rv
accgccggcgccgccgucgcc

SEQ ID NO: 3320734 - RNA, 16 nt, Mycobacterium tuberculosis H37Rv
accgccgggaagccgc

SEQ ID NO: 3320735 - RNA, 19 nt, Mycobacterium tuberculosis H37Rv
accgccgggaugccggccc

SEQ ID NO: 3320736 - RNA, 20 nt, Mycobacterium tuberculosis H37Rv
accgccgggcccucgccaug

SEQ ID NO: 3320737 - RNA, 22 nt, Mycobacterium tuberculosis H37Rv
accgccgggcccucgccauggc

SEQ ID NO: 3320738 - RNA, 19 nt, Mycobacterium tuberculosis H37Rv
accgccggggugugcagcg

SEQ ID NO: 3320739 - RNA, 15 nt, Mycobacterium tuberculosis H37Rv
accgccggugcugac

SEQ ID NO: 3320740 - RNA, 16 nt, Mycobacterium tuberculosis H37Rv
accgccgucccggcuc

SEQ ID NO: 3320741 - RNA, 22 nt, Mycobacterium tuberculosis H37Rv
accgccgucccggcucgagcuc

SEQ ID NO: 3320742 - RNA, 12 nt, Mycobacterium tuberculosis H37Rv
accgccgucgcc

SEQ ID NO: 3320743 - RNA, 13 nt, Mycobacterium tuberculosis H37Rv
accgccgucgcca

SEQ ID NO: 3320744 - RNA, 15 nt, Mycobacterium tuberculosis H37Rv
accgccgugugccac

SEQ ID NO: 3320745 - RNA, 19 nt, Mycobacterium tuberculosis H37Rv
accgccguuccacgucgua

SEQ ID NO: 3320746 - RNA, 20 nt, Mycobacterium tuberculosis H37Rv
accgccguugccaagcagcu

SEQ ID NO: 3320747 - RNA, 17 nt, Mycobacterium tuberculosis H37Rv
accgccguugccgauca

SEQ ID NO: 3320748 - RNA, 22 nt, Mycobacterium tuberculosis H37Rv
accgccguugccgaucgcuccg

SEQ ID NO: 3320749 - RNA, 16 nt, Mycobacterium tuberculosis H37Rv
accgccguuugcgccg

SEQ ID NO: 3320750 - RNA, 14 nt, Mycobacterium tuberculosis H37Rv
accgccuccucgau

SEQ ID NO: 3320751 - RNA, 21 nt, Mycobacterium tuberculosis H37Rv
accgccuccucgauagcggcg

SEQ ID NO: 3320752 - RNA, 23 nt, Mycobacterium tuberculosis H37Rv
accgccugcaacacgcgaugcac

SEQ ID NO: 3320753 - RNA, 18 nt, Mycobacterium tuberculosis H37Rv
accgccugcgccgcccgc

SEQ ID NO: 3320754 - RNA, 17 nt, Mycobacterium tuberculosis H37Rv
accgccugugccgccgg

SEQ ID NO: 3320755 - RNA, 11 nt, Mycobacterium tuberculosis H37Rv
accgccuuggu

SEQ ID NO: 3320756 - RNA, 13 nt, Mycobacterium tuberculosis H37Rv
accgccuugguca

SEQ ID NO: 3320757 - RNA, 20 nt, Mycobacterium tuberculosis H37Rv
accgccuuugcccgccgcgu

SEQ ID NO: 3320758 - RNA, 22 nt, Mycobacterium tuberculosis H37Rv
accgccuuugcccgccgcguca

SEQ ID NO: 3320759 - RNA, 21 nt, Mycobacterium tuberculosis H37Rv
accgcgaaagcaccgagcauc

SEQ ID NO: 3320760 - RNA, 16 nt, Mycobacterium tuberculosis H37Rv
accgcgaacagcgggg

SEQ ID NO: 3320761 - RNA, 18 nt, Mycobacterium tuberculosis H37Rv
accgcgaaugugaucacc

SEQ ID NO: 3320762 - RNA, 21 nt, Mycobacterium tuberculosis H37Rv
accgcgaaugugaucacccgc

SEQ ID NO: 3320763 - RNA, 15 nt, Mycobacterium tuberculosis H37Rv
accgcgacaccccgg

SEQ ID NO: 3320764 - RNA, 14 nt, Mycobacterium tuberculosis H37Rv
accgcgaccccugg

SEQ ID NO: 3320765 - RNA, 22 nt, Mycobacterium tuberculosis H37Rv
accgcgaccccugguagcaccc

SEQ ID NO: 3320766 - RNA, 14 nt, Mycobacterium tuberculosis H37Rv
accgcgacccggcc

SEQ ID NO: 3320767 - RNA, 13 nt, Mycobacterium tuberculosis H37Rv
accgcgaccgcgc

SEQ ID NO: 3320768 - RNA, 14 nt, Mycobacterium tuberculosis H37Rv
accgcgagcaugau

SEQ ID NO: 3320769 - RNA, 12 nt, Mycobacterium tuberculosis H37Rv
accgcgaucacc

SEQ ID NO: 3320770 - RNA, 20 nt, Mycobacterium tuberculosis H37Rv
accgcgaucaccaccggauc

SEQ ID NO: 3320771 - RNA, 17 nt, Mycobacterium tuberculosis H37Rv
accgcgauccccacgau

SEQ ID NO: 3320772 - RNA, 14 nt, Mycobacterium tuberculosis H37Rv
accgcgaucgccga

SEQ ID NO: 3320773 - RNA, 19 nt, Mycobacterium tuberculosis H37Rv
accgcgaugacgacgaacc

SEQ ID NO: 3320774 - RNA, 18 nt, Mycobacterium tuberculosis H37Rv
accgcgaugggauaccgc

SEQ ID NO: 3320775 - RNA, 16 nt, Mycobacterium tuberculosis H37Rv
accgcgaugucacgga

SEQ ID NO: 3320776 - RNA, 16 nt, Mycobacterium tuberculosis H37Rv
accgcgcaacccggac

SEQ ID NO: 3320777 - RNA, 17 nt, Mycobacterium tuberculosis H37Rv
accgcgcagaacgaucg

SEQ ID NO: 3320778 - RNA, 15 nt, Mycobacterium tuberculosis H37Rv
accgcgcaucaucgc

SEQ ID NO: 3320779 - RNA, 21 nt, Mycobacterium tuberculosis H37Rv
accgcgcaucaucgcccaccg

SEQ ID NO: 3320780 - RNA, 16 nt, Mycobacterium tuberculosis H37Rv
accgcgcccgcgggca

SEQ ID NO: 3320781 - RNA, 21 nt, Mycobacterium tuberculosis H37Rv
accgcgcccgcgggcaguggc

SEQ ID NO: 3320782 - RNA, 15 nt, Mycobacterium tuberculosis H37Rv
accgcgcccuucagc

SEQ ID NO: 3320783 - RNA, 20 nt, Mycobacterium tuberculosis H37Rv
accgcgcccuucagcacggu

SEQ ID NO: 3320784 - RNA, 15 nt, Mycobacterium tuberculosis H37Rv
accgcgccgaacacg

SEQ ID NO: 3320785 - RNA, 13 nt, Mycobacterium tuberculosis H37Rv
accgcgccgacga

SEQ ID NO: 3320786 - RNA, 17 nt, Mycobacterium tuberculosis H37Rv
accgcgccgaucaccac

SEQ ID NO: 3320787 - RNA, 20 nt, Mycobacterium tuberculosis H37Rv
accgcgccgaucaccaccgg

SEQ ID NO: 3320788 - RNA, 21 nt, Mycobacterium tuberculosis H37Rv
accgcgccgcgccgcgccgcc

SEQ ID NO: 3320789 - RNA, 15 nt, Mycobacterium tuberculosis H37Rv
accgcgccgucgucg

SEQ ID NO: 3320790 - RNA, 20 nt, Mycobacterium tuberculosis H37Rv
accgcgccgucgucgagcac

SEQ ID NO: 3320791 - RNA, 20 nt, Mycobacterium tuberculosis H37Rv
accgcgcggcgcagcaccgu

SEQ ID NO: 3320792 - RNA, 13 nt, Mycobacterium tuberculosis H37Rv
accgcgcgucaua

SEQ ID NO: 3320793 - RNA, 21 nt, Mycobacterium tuberculosis H37Rv
accgcgcuguugccaucgacg

SEQ ID NO: 3320794 - RNA, 17 nt, Mycobacterium tuberculosis H37Rv
accgcggaaggccagcu

SEQ ID NO: 3320795 - RNA, 19 nt, Mycobacterium tuberculosis H37Rv
accgcggaaggccagcucu

SEQ ID NO: 3320796 - RNA, 18 nt, Mycobacterium tuberculosis H37Rv
accgcggacacgaucgcg

SEQ ID NO: 3320797 - RNA, 15 nt, Mycobacterium tuberculosis H37Rv
accgcggacccgcag

SEQ ID NO: 3320798 - RNA, 17 nt, Mycobacterium tuberculosis H37Rv
accgcggacccgcagcu

SEQ ID NO: 3320799 - RNA, 15 nt, Mycobacterium tuberculosis H37Rv
accgcggaccggcgu

SEQ ID NO: 3320800 - RNA, 16 nt, Mycobacterium tuberculosis H37Rv
accgcggaccggcguc

SEQ ID NO: 3320801 - RNA, 16 nt, Mycobacterium tuberculosis H37Rv
accgcggauaggccgc

SEQ ID NO: 3320802 - RNA, 20 nt, Mycobacterium tuberculosis H37Rv
accgcggcaagaguugccgg

SEQ ID NO: 3320803 - RNA, 13 nt, Mycobacterium tuberculosis H37Rv
accgcggccccgc

SEQ ID NO: 3320804 - RNA, 14 nt, Mycobacterium tuberculosis H37Rv
accgcggccccgcc

SEQ ID NO: 3320805 - RNA, 17 nt, Mycobacterium tuberculosis H37Rv
accgcggccccgccguu

SEQ ID NO: 3320806 - RNA, 14 nt, Mycobacterium tuberculosis H37Rv
accgcggcccggac

SEQ ID NO: 3320807 - RNA, 17 nt, Mycobacterium tuberculosis H37Rv
accgcggccgcggucga

SEQ ID NO: 3320808 - RNA, 21 nt, Mycobacterium tuberculosis H37Rv
accgcggccggguggcccggc

SEQ ID NO: 3320809 - RNA, 14 nt, Mycobacterium tuberculosis H37Rv
accgcggccuuggc

SEQ ID NO: 3320810 - RNA, 18 nt, Mycobacterium tuberculosis H37Rv
accgcggcgaucugcgac

SEQ ID NO: 3320811 - RNA, 20 nt, Mycobacterium tuberculosis H37Rv
accgcggcgauuacggccag

SEQ ID NO: 3320812 - RNA, 20 nt, Mycobacterium tuberculosis H37Rv
accgcggcgcguccgggcuc

SEQ ID NO: 3320813 - RNA, 22 nt, Mycobacterium tuberculosis H37Rv
accgcggcgcguccgggcucgc

SEQ ID NO: 3320814 - RNA, 22 nt, Mycobacterium tuberculosis H37Rv
accgcggcugucacgccugcca

SEQ ID NO: 3320815 - RNA, 22 nt, Mycobacterium tuberculosis H37Rv
accgcgggaucgguggcggcac

SEQ ID NO: 3320816 - RNA, 22 nt, Mycobacterium tuberculosis H37Rv
accgcgggcaguagcuguggcc

SEQ ID NO: 3320817 - RNA, 20 nt, Mycobacterium tuberculosis H37Rv
accgcgggccgccaucucgu

SEQ ID NO: 3320818 - RNA, 21 nt, Mycobacterium tuberculosis H37Rv
accgcgggcgccuuccaggcg

SEQ ID NO: 3320819 - RNA, 17 nt, Mycobacterium tuberculosis H37Rv
accgcgggcggcaucgc

SEQ ID NO: 3320820 - RNA, 20 nt, Mycobacterium tuberculosis H37Rv
accgcgggcggcaucgccga

SEQ ID NO: 3320821 - RNA, 21 nt, Mycobacterium tuberculosis H37Rv
accgcgggucgugccagcagc

SEQ ID NO: 3320822 - RNA, 15 nt, Mycobacterium tuberculosis H37Rv
accgcggguggaugu

SEQ ID NO: 3320823 - RNA, 17 nt, Mycobacterium tuberculosis H37Rv
accgcgguacgccgguc

SEQ ID NO: 3320824 - RNA, 19 nt, Mycobacterium tuberculosis H37Rv
accgcgguacgccggucgg

SEQ ID NO: 3320825 - RNA, 22 nt, Mycobacterium tuberculosis H37Rv
accgcggucgccaagaucgggu

SEQ ID NO: 3320826 - RNA, 16 nt, Mycobacterium tuberculosis H37Rv
accgcggugacccgga

SEQ ID NO: 3320827 - RNA, 19 nt, Mycobacterium tuberculosis H37Rv
accgcgguggggucgacgc

SEQ ID NO: 3320828 - RNA, 20 nt, Mycobacterium tuberculosis H37Rv
accgcgguggggucgacgca

SEQ ID NO: 3320829 - RNA, 18 nt, Mycobacterium tuberculosis H37Rv
accgcggugugcguguca

SEQ ID NO: 3320830 - RNA, 17 nt, Mycobacterium tuberculosis H37Rv
accgcgucaacgcuguu

SEQ ID NO: 3320831 - RNA, 17 nt, Mycobacterium tuberculosis H37Rv
accgcgucaucaccggu

SEQ ID NO: 3320832 - RNA, 17 nt, Mycobacterium tuberculosis H37Rv
accgcgucgggccgcaa

SEQ ID NO: 3320833 - RNA, 19 nt, Mycobacterium tuberculosis H37Rv
accgcgucgggccgcaacu

SEQ ID NO: 3320834 - RNA, 13 nt, Mycobacterium tuberculosis H37Rv
accgcgugcaccg

SEQ ID NO: 3320835 - RNA, 14 nt, Mycobacterium tuberculosis H37Rv
accgcgugcaccga

SEQ ID NO: 3320836 - RNA, 13 nt, Mycobacterium tuberculosis H37Rv
accgcgugcgccg

SEQ ID NO: 3320837 - RNA, 20 nt, Mycobacterium tuberculosis H37Rv
accgcgugcucgagcaccuc

SEQ ID NO: 3320838 - RNA, 19 nt, Mycobacterium tuberculosis H37Rv
accgcguggucggcgaacg

SEQ ID NO: 3320839 - RNA, 22 nt, Mycobacterium tuberculosis H37Rv
accgcguucugguuguugccga

SEQ ID NO: 3320840 - RNA, 16 nt, Mycobacterium tuberculosis H37Rv
accgcguuuugcaggc

SEQ ID NO: 3320841 - RNA, 15 nt, Mycobacterium tuberculosis H37Rv
accgcuaacagauug

SEQ ID NO: 3320842 - RNA, 18 nt, Mycobacterium tuberculosis H37Rv
accgcuacccgcgcgacc

SEQ ID NO: 3320843 - RNA, 20 nt, Mycobacterium tuberculosis H37Rv
accgcuacccgcgcgaccug

SEQ ID NO: 3320844 - RNA, 21 nt, Mycobacterium tuberculosis H37Rv
accgcucgccguuauccgacg

SEQ ID NO: 3320845 - RNA, 14 nt, Mycobacterium tuberculosis H37Rv
accgcucggaguug

SEQ ID NO: 3320846 - RNA, 20 nt, Mycobacterium tuberculosis H37Rv
accgcucggaguugagcugu

SEQ ID NO: 3320847 - RNA, 12 nt, Mycobacterium tuberculosis H37Rv
accgcucggcga

SEQ ID NO: 3320848 - RNA, 21 nt, Mycobacterium tuberculosis H37Rv
accgcucgguccagccggucc

SEQ ID NO: 3320849 - RNA, 16 nt, Mycobacterium tuberculosis H37Rv
accgcucgucgccggu

SEQ ID NO: 3320850 - RNA, 24 nt, Mycobacterium tuberculosis H37Rv
accgcucgucguccggccacgguc

SEQ ID NO: 3320851 - RNA, 15 nt, Mycobacterium tuberculosis H37Rv
accgcucugcggcca

SEQ ID NO: 3320852 - RNA, 18 nt, Mycobacterium tuberculosis H37Rv
accgcugaccccggcagc

SEQ ID NO: 3320853 - RNA, 18 nt, Mycobacterium tuberculosis H37Rv
accgcugaccgcaacgcg

SEQ ID NO: 3320854 - RNA, 17 nt, Mycobacterium tuberculosis H37Rv
accgcugagccggugca

SEQ ID NO: 3320855 - RNA, 17 nt, Mycobacterium tuberculosis H37Rv
accgcugauagcggucg

SEQ ID NO: 3320856 - RNA, 21 nt, Mycobacterium tuberculosis H37Rv
accgcugauagcggucgguca

SEQ ID NO: 3320857 - RNA, 14 nt, Mycobacterium tuberculosis H37Rv
accgcugccgcauc

SEQ ID NO: 3320858 - RNA, 23 nt, Mycobacterium tuberculosis H37Rv
accgcugccgcugccgaagcggc

SEQ ID NO: 3320859 - RNA, 14 nt, Mycobacterium tuberculosis H37Rv
accgcugccggcac

SEQ ID NO: 3320860 - RNA, 19 nt, Mycobacterium tuberculosis H37Rv
accgcugccggcacgcaug

SEQ ID NO: 3320861 - RNA, 13 nt, Mycobacterium tuberculosis H37Rv
accgcugccggcg

SEQ ID NO: 3320862 - RNA, 13 nt, Mycobacterium tuberculosis H37Rv
accgcugccugcc

SEQ ID NO: 3320863 - RNA, 14 nt, Mycobacterium tuberculosis H37Rv
accgcugccugccg

SEQ ID NO: 3320864 - RNA, 14 nt, Mycobacterium tuberculosis H37Rv
accgcugcggcacc

SEQ ID NO: 3320865 - RNA, 17 nt, Mycobacterium tuberculosis H37Rv
accgcugcuccucgcgg

SEQ ID NO: 3320866 - RNA, 22 nt, Mycobacterium tuberculosis H37Rv
accgcuggaaaaucgggucaca

SEQ ID NO: 3320867 - RNA, 15 nt, Mycobacterium tuberculosis H37Rv
accgcuggaucgcgu

SEQ ID NO: 3320868 - RNA, 19 nt, Mycobacterium tuberculosis H37Rv
accgcugggacaacgugcc

SEQ ID NO: 3320869 - RNA, 21 nt, Mycobacterium tuberculosis H37Rv
accgcugggggcggucgccuc

SEQ ID NO: 3320870 - RNA, 13 nt, Mycobacterium tuberculosis H37Rv
accgcugucaccg

SEQ ID NO: 3320871 - RNA, 15 nt, Mycobacterium tuberculosis H37Rv
accgcugucagccga

SEQ ID NO: 3320872 - RNA, 16 nt, Mycobacterium tuberculosis H37Rv
accgcugucagccgac

SEQ ID NO: 3320873 - RNA, 14 nt, Mycobacterium tuberculosis H37Rv
accgcuucaggcgc

SEQ ID NO: 3320874 - RNA, 21 nt, Mycobacterium tuberculosis H37Rv
accgcuucaggcgccacugcu

SEQ ID NO: 3320875 - RNA, 21 nt, Mycobacterium tuberculosis H37Rv
accgcuuccagguugaagaau

SEQ ID NO: 3320876 - RNA, 23 nt, Mycobacterium tuberculosis H37Rv
accgcuucccccgguccggucgg

SEQ ID NO: 3320877 - RNA, 16 nt, Mycobacterium tuberculosis H37Rv
accggaaacggucagg

SEQ ID NO: 3320878 - RNA, 17 nt, Mycobacterium tuberculosis H37Rv
accggaaaugucuccuc

SEQ ID NO: 3320879 - RNA, 15 nt, Mycobacterium tuberculosis H37Rv
accggaaucggcggc

SEQ ID NO: 3320880 - RNA, 20 nt, Mycobacterium tuberculosis H37Rv
accggacaaagcugcucguc

SEQ ID NO: 3320881 - RNA, 18 nt, Mycobacterium tuberculosis H37Rv
accggacacuccugcaca

SEQ ID NO: 3320882 - RNA, 22 nt, Mycobacterium tuberculosis H37Rv
accggacauccgaugcgucaca

SEQ ID NO: 3320883 - RNA, 17 nt, Mycobacterium tuberculosis H37Rv
accggaccgaccaccgc

SEQ ID NO: 3320884 - RNA, 20 nt, Mycobacterium tuberculosis H37Rv
accggacgaaacgaucgcgc

SEQ ID NO: 3320885 - RNA, 22 nt, Mycobacterium tuberculosis H37Rv
accggacgaaacgaucgcgcca

SEQ ID NO: 3320886 - RNA, 22 nt, Mycobacterium tuberculosis H37Rv
accggacgaucagggugucgaa

SEQ ID NO: 3320887 - RNA, 20 nt, Mycobacterium tuberculosis H37Rv
accggagaacgggucgacgu

SEQ ID NO: 3320888 - RNA, 16 nt, Mycobacterium tuberculosis H37Rv
accggagaucccgguc

SEQ ID NO: 3320889 - RNA, 19 nt, Mycobacterium tuberculosis H37Rv
accggagucgucggcaacg

SEQ ID NO: 3320890 - RNA, 13 nt, Mycobacterium tuberculosis H37Rv
accggaucaccgc

SEQ ID NO: 3320891 - RNA, 21 nt, Mycobacterium tuberculosis H37Rv
accggauccacggagaccggc

SEQ ID NO: 3320892 - RNA, 23 nt, Mycobacterium tuberculosis H37Rv
accggaucgaccaauucgaccgc

SEQ ID NO: 3320893 - RNA, 19 nt, Mycobacterium tuberculosis H37Rv
accggaucgucgaacagca

SEQ ID NO: 3320894 - RNA, 16 nt, Mycobacterium tuberculosis H37Rv
accggcaacaucagca

SEQ ID NO: 3320895 - RNA, 18 nt, Mycobacterium tuberculosis H37Rv
accggcaagccacgccgg

SEQ ID NO: 3320896 - RNA, 22 nt, Mycobacterium tuberculosis H37Rv
accggcaaucggcggcacccgg

SEQ ID NO: 3320897 - RNA, 15 nt, Mycobacterium tuberculosis H37Rv
accggcaccagcggc

SEQ ID NO: 3320898 - RNA, 11 nt, Mycobacterium tuberculosis H37Rv
accggcacccg

SEQ ID NO: 3320899 - RNA, 16 nt, Mycobacterium tuberculosis H37Rv
accggcacccgcacgg

SEQ ID NO: 3320900 - RNA, 13 nt, Mycobacterium tuberculosis H37Rv
accggcacccgcg

SEQ ID NO: 3320901 - RNA, 19 nt, Mycobacterium tuberculosis H37Rv
accggcacccgcggcgaac

SEQ ID NO: 3320902 - RNA, 23 nt, Mycobacterium tuberculosis H37Rv
accggcacccgcuggcgguaagc

SEQ ID NO: 3320903 - RNA, 12 nt, Mycobacterium tuberculosis H37Rv
accggcaccgcc

SEQ ID NO: 3320904 - RNA, 15 nt, Mycobacterium tuberculosis H37Rv
accggcaccggccgg

SEQ ID NO: 3320905 - RNA, 20 nt, Mycobacterium tuberculosis H37Rv
accggcacgucgucguccca

SEQ ID NO: 3320906 - RNA, 16 nt, Mycobacterium tuberculosis H37Rv
accggcagcgcgaucg

SEQ ID NO: 3320907 - RNA, 13 nt, Mycobacterium tuberculosis H37Rv
accggcagcugcu

SEQ ID NO: 3320908 - RNA, 14 nt, Mycobacterium tuberculosis H37Rv
accggcagcugcuc

SEQ ID NO: 3320909 - RNA, 17 nt, Mycobacterium tuberculosis H37Rv
accggcauacagccggc

SEQ ID NO: 3320910 - RNA, 19 nt, Mycobacterium tuberculosis H37Rv
accggcaucgaagugcggc

SEQ ID NO: 3320911 - RNA, 14 nt, Mycobacterium tuberculosis H37Rv
accggcaucgauca

SEQ ID NO: 3320912 - RNA, 15 nt, Mycobacterium tuberculosis H37Rv
accggcaugccgcca

SEQ ID NO: 3320913 - RNA, 20 nt, Mycobacterium tuberculosis H37Rv
accggcaugccgccaugcgc

SEQ ID NO: 3320914 - RNA, 21 nt, Mycobacterium tuberculosis H37Rv
accggcaugccgccaugcgca

SEQ ID NO: 3320915 - RNA, 21 nt, Mycobacterium tuberculosis H37Rv
accggcaugcgugccggcagc

SEQ ID NO: 3320916 - RNA, 16 nt, Mycobacterium tuberculosis H37Rv
accggccaccagcccg

SEQ ID NO: 3320917 - RNA, 18 nt, Mycobacterium tuberculosis H37Rv
accggccaccagcccgau

SEQ ID NO: 3320918 - RNA, 17 nt, Mycobacterium tuberculosis H37Rv
accggccaccagggcca

SEQ ID NO: 3320919 - RNA, 18 nt, Mycobacterium tuberculosis H37Rv
accggccaccagggccac

SEQ ID NO: 3320920 - RNA, 20 nt, Mycobacterium tuberculosis H37Rv
accggccaccagggccaccg

SEQ ID NO: 3320921 - RNA, 12 nt, Mycobacterium tuberculosis H37Rv
accggccagccg

SEQ ID NO: 3320922 - RNA, 15 nt, Mycobacterium tuberculosis H37Rv
accggccagccgacg

SEQ ID NO: 3320923 - RNA, 18 nt, Mycobacterium tuberculosis H37Rv
accggccagcggcccguc

SEQ ID NO: 3320924 - RNA, 17 nt, Mycobacterium tuberculosis H37Rv
accggccaguccgggga

SEQ ID NO: 3320925 - RNA, 20 nt, Mycobacterium tuberculosis H37Rv
accggccaucgaccguccgg

SEQ ID NO: 3320926 - RNA, 23 nt, Mycobacterium tuberculosis H37Rv
accggccaucgaccguccggguc

SEQ ID NO: 3320927 - RNA, 14 nt, Mycobacterium tuberculosis H37Rv
accggcccagaucg

SEQ ID NO: 3320928 - RNA, 21 nt, Mycobacterium tuberculosis H37Rv
accggcccagaucgguugauc

SEQ ID NO: 3320929 - RNA, 23 nt, Mycobacterium tuberculosis H37Rv
accggcccagaucgguugaucgg

SEQ ID NO: 3320930 - RNA, 15 nt, Mycobacterium tuberculosis H37Rv
accggcccaguggga

SEQ ID NO: 3320931 - RNA, 17 nt, Mycobacterium tuberculosis H37Rv
accggcccagugggacu

SEQ ID NO: 3320932 - RNA, 17 nt, Mycobacterium tuberculosis H37Rv
accggccccaccggcac

SEQ ID NO: 3320933 - RNA, 15 nt, Mycobacterium tuberculosis H37Rv
accggcccgaugccg

SEQ ID NO: 3320934 - RNA, 19 nt, Mycobacterium tuberculosis H37Rv
accggcccgcagcagcauc

SEQ ID NO: 3320935 - RNA, 17 nt, Mycobacterium tuberculosis H37Rv
accggcccgcauccgca

SEQ ID NO: 3320936 - RNA, 16 nt, Mycobacterium tuberculosis H37Rv
accggcccucgccaga

SEQ ID NO: 3320937 - RNA, 18 nt, Mycobacterium tuberculosis H37Rv
accggccgccaucaucgc

SEQ ID NO: 3320938 - RNA, 21 nt, Mycobacterium tuberculosis H37Rv
accggccgcuauggcccgggc

SEQ ID NO: 3320939 - RNA, 19 nt, Mycobacterium tuberculosis H37Rv
accggccgggugaaccaau

SEQ ID NO: 3320940 - RNA, 15 nt, Mycobacterium tuberculosis H37Rv
accggccggugauga

SEQ ID NO: 3320941 - RNA, 15 nt, Mycobacterium tuberculosis H37Rv
accggccgucgacgc

SEQ ID NO: 3320942 - RNA, 16 nt, Mycobacterium tuberculosis H37Rv
accggccgucgacgca

SEQ ID NO: 3320943 - RNA, 23 nt, Mycobacterium tuberculosis H37Rv
accggccgucgacgcauggguca

SEQ ID NO: 3320944 - RNA, 17 nt, Mycobacterium tuberculosis H37Rv
accggccgugccgccga

SEQ ID NO: 3320945 - RNA, 18 nt, Mycobacterium tuberculosis H37Rv
accggccgugccgccgac

SEQ ID NO: 3320946 - RNA, 12 nt, Mycobacterium tuberculosis H37Rv
accggccuucaa

SEQ ID NO: 3320947 - RNA, 22 nt, Mycobacterium tuberculosis H37Rv
accggccuuuccagcaccccga

SEQ ID NO: 3320948 - RNA, 14 nt, Mycobacterium tuberculosis H37Rv
accggcgagcccgc

SEQ ID NO: 3320949 - RNA, 15 nt, Mycobacterium tuberculosis H37Rv
accggcgagcccgca

SEQ ID NO: 3320950 - RNA, 10 nt, Mycobacterium tuberculosis H37Rv
accggcgcca

SEQ ID NO: 3320951 - RNA, 17 nt, Mycobacterium tuberculosis H37Rv
accggcgcccagcgccu

SEQ ID NO: 3320952 - RNA, 23 nt, Mycobacterium tuberculosis H37Rv
accggcgccccugucgaccgcca

SEQ ID NO: 3320953 - RNA, 14 nt, Mycobacterium tuberculosis H37Rv
accggcgccgcaau

SEQ ID NO: 3320954 - RNA, 17 nt, Mycobacterium tuberculosis H37Rv
accggcgccgccggcac

SEQ ID NO: 3320955 - RNA, 14 nt, Mycobacterium tuberculosis H37Rv
accggcgccgccgu

SEQ ID NO: 3320956 - RNA, 16 nt, Mycobacterium tuberculosis H37Rv
accggcgccgccgucg

SEQ ID NO: 3320957 - RNA, 20 nt, Mycobacterium tuberculosis H37Rv
accggcgccgccgucgccgc

SEQ ID NO: 3320958 - RNA, 21 nt, Mycobacterium tuberculosis H37Rv
accggcgccgccgucgccgcc

SEQ ID NO: 3320959 - RNA, 16 nt, Mycobacterium tuberculosis H37Rv
accggcgccgccguug

SEQ ID NO: 3320960 - RNA, 16 nt, Mycobacterium tuberculosis H37Rv
accggcgccggaguug

SEQ ID NO: 3320961 - RNA, 14 nt, Mycobacterium tuberculosis H37Rv
accggcgccucauc

SEQ ID NO: 3320962 - RNA, 15 nt, Mycobacterium tuberculosis H37Rv
accggcgcgccccgc

SEQ ID NO: 3320963 - RNA, 21 nt, Mycobacterium tuberculosis H37Rv
accggcgcgccccgccgcacg

SEQ ID NO: 3320964 - RNA, 22 nt, Mycobacterium tuberculosis H37Rv
accggcgcgccccgccgcacgc

SEQ ID NO: 3320965 - RNA, 12 nt, Mycobacterium tuberculosis H37Rv
accggcggcagc

SEQ ID NO: 3320966 - RNA, 22 nt, Mycobacterium tuberculosis H37Rv
accggcggcaucgaguucggcc

SEQ ID NO: 3320967 - RNA, 17 nt, Mycobacterium tuberculosis H37Rv
accggcggcgagcggcc

SEQ ID NO: 3320968 - RNA, 14 nt, Mycobacterium tuberculosis H37Rv
accggcggcgccga

SEQ ID NO: 3320969 - RNA, 19 nt, Mycobacterium tuberculosis H37Rv
accggcggcuacggcugcc

SEQ ID NO: 3320970 - RNA, 19 nt, Mycobacterium tuberculosis H37Rv
accggcgggacgucgccgc

SEQ ID NO: 3320971 - RNA, 19 nt, Mycobacterium tuberculosis H37Rv
accggcgggaugcgcgccc

SEQ ID NO: 3320972 - RNA, 17 nt, Mycobacterium tuberculosis H37Rv
accggcguaaccggcag

SEQ ID NO: 3320973 - RNA, 18 nt, Mycobacterium tuberculosis H37Rv
accggcguaaccggcagc

SEQ ID NO: 3320974 - RNA, 22 nt, Mycobacterium tuberculosis H37Rv
accggcguccaguccgaucacc

SEQ ID NO: 3320975 - RNA, 14 nt, Mycobacterium tuberculosis H37Rv
accggcgucgacgu

SEQ ID NO: 3320976 - RNA, 15 nt, Mycobacterium tuberculosis H37Rv
accggcgucgacguc

SEQ ID NO: 3320977 - RNA, 15 nt, Mycobacterium tuberculosis H37Rv
accggcgucggcgcg

SEQ ID NO: 3320978 - RNA, 17 nt, Mycobacterium tuberculosis H37Rv
accggcgucugcccgcc

SEQ ID NO: 3320979 - RNA, 20 nt, Mycobacterium tuberculosis H37Rv
accggcgucugcccgcccag

SEQ ID NO: 3320980 - RNA, 16 nt, Mycobacterium tuberculosis H37Rv
accggcgugcugugcu

SEQ ID NO: 3320981 - RNA, 19 nt, Mycobacterium tuberculosis H37Rv
accggcguugcguagacga

SEQ ID NO: 3320982 - RNA, 21 nt, Mycobacterium tuberculosis H37Rv
accggcucaccacgccggucg

SEQ ID NO: 3320983 - RNA, 20 nt, Mycobacterium tuberculosis H37Rv
accggcucacguaaccagug

SEQ ID NO: 3320984 - RNA, 14 nt, Mycobacterium tuberculosis H37Rv
accggcucgaucuc

SEQ ID NO: 3320985 - RNA, 19 nt, Mycobacterium tuberculosis H37Rv
accggcucgccggcgcgca

SEQ ID NO: 3320986 - RNA, 15 nt, Mycobacterium tuberculosis H37Rv
accggcucgucgggc

SEQ ID NO: 3320987 - RNA, 20 nt, Mycobacterium tuberculosis H37Rv
accggcucuuuuucgaucgc

SEQ ID NO: 3320988 - RNA, 18 nt, Mycobacterium tuberculosis H37Rv
accggcugaccgacccgg

SEQ ID NO: 3320989 - RNA, 20 nt, Mycobacterium tuberculosis H37Rv
accggcugaccggggcgccc

SEQ ID NO: 3320990 - RNA, 17 nt, Mycobacterium tuberculosis H37Rv
accggcugauucgagcc

SEQ ID NO: 3320991 - RNA, 18 nt, Mycobacterium tuberculosis H37Rv
accggcugauucgagcca

SEQ ID NO: 3320992 - RNA, 19 nt, Mycobacterium tuberculosis H37Rv
accggcugauucgagccac

SEQ ID NO: 3320993 - RNA, 18 nt, Mycobacterium tuberculosis H37Rv
accggcugcaaccagcgg

SEQ ID NO: 3320994 - RNA, 14 nt, Mycobacterium tuberculosis H37Rv
accggcugcaggug

SEQ ID NO: 3320995 - RNA, 15 nt, Mycobacterium tuberculosis H37Rv
accggcugcugagga

SEQ ID NO: 3320996 - RNA, 18 nt, Mycobacterium tuberculosis H37Rv
accggcuggugccaacug

SEQ ID NO: 3320997 - RNA, 22 nt, Mycobacterium tuberculosis H37Rv
accggcuggugccuuaccaccg

SEQ ID NO: 3320998 - RNA, 21 nt, Mycobacterium tuberculosis H37Rv
accggcugguugaccgaguug

SEQ ID NO: 3320999 - RNA, 21 nt, Mycobacterium tuberculosis H37Rv
accggcuucgucggccagcag

SEQ ID NO: 3321000 - RNA, 16 nt, Mycobacterium tuberculosis H37Rv
accggcuucuccucca

SEQ ID NO: 3321001 - RNA, 22 nt, Mycobacterium tuberculosis H37Rv
accggcuuggugaaccgcgcgg

SEQ ID NO: 3321002 - RNA, 14 nt, Mycobacterium tuberculosis H37Rv
accgggcaccagaa

SEQ ID NO: 3321003 - RNA, 16 nt, Mycobacterium tuberculosis H37Rv
accgggcccgacgcgu

SEQ ID NO: 3321004 - RNA, 16 nt, Mycobacterium tuberculosis H37Rv
accgggcccgccgucc

SEQ ID NO: 3321005 - RNA, 19 nt, Mycobacterium tuberculosis H37Rv
accgggccgcacggucagc

SEQ ID NO: 3321006 - RNA, 23 nt, Mycobacterium tuberculosis H37Rv
accgggccgcacggucagcgcgc

SEQ ID NO: 3321007 - RNA, 23 nt, Mycobacterium tuberculosis H37Rv
accgggccucaugcuaggccacc

SEQ ID NO: 3321008 - RNA, 13 nt, Mycobacterium tuberculosis H37Rv
accgggcggccaa

SEQ ID NO: 3321009 - RNA, 17 nt, Mycobacterium tuberculosis H37Rv
accgggcggcggcgacu

SEQ ID NO: 3321010 - RNA, 23 nt, Mycobacterium tuberculosis H37Rv
accgggcggcguuugagaacaac

SEQ ID NO: 3321011 - RNA, 20 nt, Mycobacterium tuberculosis H37Rv
accgggcgugcggcggccca

SEQ ID NO: 3321012 - RNA, 19 nt, Mycobacterium tuberculosis H37Rv
accgggcuccaauugcggc

SEQ ID NO: 3321013 - RNA, 16 nt, Mycobacterium tuberculosis H37Rv
accggggcgcccggcc

SEQ ID NO: 3321014 - RNA, 17 nt, Mycobacterium tuberculosis H37Rv
accggggcuuggguuga

SEQ ID NO: 3321015 - RNA, 18 nt, Mycobacterium tuberculosis H37Rv
accgggggaagcgguagc

SEQ ID NO: 3321016 - RNA, 22 nt, Mycobacterium tuberculosis H37Rv
accggggucaccuuggccgggu

SEQ ID NO: 3321017 - RNA, 16 nt, Mycobacterium tuberculosis H37Rv
accgggucagcccagc

SEQ ID NO: 3321018 - RNA, 21 nt, Mycobacterium tuberculosis H37Rv
accggguccggugaacccgau

SEQ ID NO: 3321019 - RNA, 15 nt, Mycobacterium tuberculosis H37Rv
accgggucgaugacg

SEQ ID NO: 3321020 - RNA, 13 nt, Mycobacterium tuberculosis H37Rv
accgggucgcaac

SEQ ID NO: 3321021 - RNA, 13 nt, Mycobacterium tuberculosis H37Rv
accgggucgccga

SEQ ID NO: 3321022 - RNA, 19 nt, Mycobacterium tuberculosis H37Rv
accgggucgggcaccgcgc

SEQ ID NO: 3321023 - RNA, 20 nt, Mycobacterium tuberculosis H37Rv
accgggucgggcaccgcgcg

SEQ ID NO: 3321024 - RNA, 16 nt, Mycobacterium tuberculosis H37Rv
accgggucguagccga

SEQ ID NO: 3321025 - RNA, 12 nt, Mycobacterium tuberculosis H37Rv
accgggugcagg

SEQ ID NO: 3321026 - RNA, 20 nt, Mycobacterium tuberculosis H37Rv
accggguuggaagccgcacc

SEQ ID NO: 3321027 - RNA, 21 nt, Mycobacterium tuberculosis H37Rv
accgguaacgguccucgaaac

SEQ ID NO: 3321028 - RNA, 14 nt, Mycobacterium tuberculosis H37Rv
accgguacaacccc

SEQ ID NO: 3321029 - RNA, 20 nt, Mycobacterium tuberculosis H37Rv
accgguaccgaucagcaggg

SEQ ID NO: 3321030 - RNA, 14 nt, Mycobacterium tuberculosis H37Rv
accgguaccgccac

SEQ ID NO: 3321031 - RNA, 13 nt, Mycobacterium tuberculosis H37Rv
accgguagucgcc

SEQ ID NO: 3321032 - RNA, 16 nt, Mycobacterium tuberculosis H37Rv
accgguaucgccaaau

SEQ ID NO: 3321033 - RNA, 14 nt, Mycobacterium tuberculosis H37Rv
accgguauguucgg

SEQ ID NO: 3321034 - RNA, 17 nt, Mycobacterium tuberculosis H37Rv
accggucaaacgcgcgc

SEQ ID NO: 3321035 - RNA, 13 nt, Mycobacterium tuberculosis H37Rv
accggucaccgcg

SEQ ID NO: 3321036 - RNA, 14 nt, Mycobacterium tuberculosis H37Rv
accggucagcaccu

SEQ ID NO: 3321037 - RNA, 15 nt, Mycobacterium tuberculosis H37Rv
accggucagcaccuc

SEQ ID NO: 3321038 - RNA, 23 nt, Mycobacterium tuberculosis H37Rv
accggucagcaccuccaccgcgc

SEQ ID NO: 3321039 - RNA, 19 nt, Mycobacterium tuberculosis H37Rv
accggucagccggaccacc

SEQ ID NO: 3321040 - RNA, 19 nt, Mycobacterium tuberculosis H37Rv
accgguccugggauccggc

SEQ ID NO: 3321041 - RNA, 21 nt, Mycobacterium tuberculosis H37Rv
accggucgaagagguggggca

SEQ ID NO: 3321042 - RNA, 15 nt, Mycobacterium tuberculosis H37Rv
accggucgcagugca

SEQ ID NO: 3321043 - RNA, 18 nt, Mycobacterium tuberculosis H37Rv
accggucgcagugcaccc

SEQ ID NO: 3321044 - RNA, 22 nt, Mycobacterium tuberculosis H37Rv
accggucggccauugcccgggc

SEQ ID NO: 3321045 - RNA, 16 nt, Mycobacterium tuberculosis H37Rv
accggucuggcgauga

SEQ ID NO: 3321046 - RNA, 17 nt, Mycobacterium tuberculosis H37Rv
accggugaccucgguau

SEQ ID NO: 3321047 - RNA, 19 nt, Mycobacterium tuberculosis H37Rv
accggugaucguggguacc

SEQ ID NO: 3321048 - RNA, 17 nt, Mycobacterium tuberculosis H37Rv
accggugauggugacca

SEQ ID NO: 3321049 - RNA, 18 nt, Mycobacterium tuberculosis H37Rv
accggugauggugaccag

SEQ ID NO: 3321050 - RNA, 21 nt, Mycobacterium tuberculosis H37Rv
accggugauggugaccagcag

SEQ ID NO: 3321051 - RNA, 16 nt, Mycobacterium tuberculosis H37Rv
accggugccagcagug

SEQ ID NO: 3321052 - RNA, 15 nt, Mycobacterium tuberculosis H37Rv
accggugcccaccac

SEQ ID NO: 3321053 - RNA, 18 nt, Mycobacterium tuberculosis H37Rv
accggugcccaccaccga

SEQ ID NO: 3321054 - RNA, 14 nt, Mycobacterium tuberculosis H37Rv
accggugccgccgu

SEQ ID NO: 3321055 - RNA, 22 nt, Mycobacterium tuberculosis H37Rv
accggugcucgucgagcaugcg

SEQ ID NO: 3321056 - RNA, 13 nt, Mycobacterium tuberculosis H37Rv
accgguggaaacc

SEQ ID NO: 3321057 - RNA, 17 nt, Mycobacterium tuberculosis H37Rv
accgguggcagccugcu

SEQ ID NO: 3321058 - RNA, 17 nt, Mycobacterium tuberculosis H37Rv
accgguggccaucgcgc

SEQ ID NO: 3321059 - RNA, 20 nt, Mycobacterium tuberculosis H37Rv
accgguggggacccgcucca

SEQ ID NO: 3321060 - RNA, 15 nt, Mycobacterium tuberculosis H37Rv
accgguguagcagcg

SEQ ID NO: 3321061 - RNA, 22 nt, Mycobacterium tuberculosis H37Rv
accgguguugguauguaaguug

SEQ ID NO: 3321062 - RNA, 14 nt, Mycobacterium tuberculosis H37Rv
accgguucggcgua

SEQ ID NO: 3321063 - RNA, 15 nt, Mycobacterium tuberculosis H37Rv
accgguucggugagc

SEQ ID NO: 3321064 - RNA, 16 nt, Mycobacterium tuberculosis H37Rv
accgguugcggucauc

SEQ ID NO: 3321065 - RNA, 15 nt, Mycobacterium tuberculosis H37Rv
accgguuucgucggu

SEQ ID NO: 3321066 - RNA, 19 nt, Mycobacterium tuberculosis H37Rv
accgguuucgucggucugc

SEQ ID NO: 3321067 - RNA, 16 nt, Mycobacterium tuberculosis H37Rv
accgguuucuucggcc

SEQ ID NO: 3321068 - RNA, 17 nt, Mycobacterium tuberculosis H37Rv
accgguuucuucggcca

SEQ ID NO: 3321069 - RNA, 22 nt, Mycobacterium tuberculosis H37Rv
accgguuuucgccggcuccgca

SEQ ID NO: 3321070 - RNA, 15 nt, Mycobacterium tuberculosis H37Rv
accguaauuucuuca

SEQ ID NO: 3321071 - RNA, 14 nt, Mycobacterium tuberculosis H37Rv
accguacggccacg

SEQ ID NO: 3321072 - RNA, 17 nt, Mycobacterium tuberculosis H37Rv
accguagagcaugccgc

SEQ ID NO: 3321073 - RNA, 21 nt, Mycobacterium tuberculosis H37Rv
accguagagcaugccgcccgc

SEQ ID NO: 3321074 - RNA, 15 nt, Mycobacterium tuberculosis H37Rv
accguagccagcagg

SEQ ID NO: 3321075 - RNA, 16 nt, Mycobacterium tuberculosis H37Rv
accguagugaacggcu

SEQ ID NO: 3321076 - RNA, 22 nt, Mycobacterium tuberculosis H37Rv
accguagugaacggcucgggca

SEQ ID NO: 3321077 - RNA, 14 nt, Mycobacterium tuberculosis H37Rv
accguauugaccag

SEQ ID NO: 3321078 - RNA, 20 nt, Mycobacterium tuberculosis H37Rv
accgucacaagucgacacgc

SEQ ID NO: 3321079 - RNA, 14 nt, Mycobacterium tuberculosis H37Rv
accgucacccccga

SEQ ID NO: 3321080 - RNA, 13 nt, Mycobacterium tuberculosis H37Rv
accgucaccgccg

SEQ ID NO: 3321081 - RNA, 21 nt, Mycobacterium tuberculosis H37Rv
accgucagcccgaaccguuug

SEQ ID NO: 3321082 - RNA, 15 nt, Mycobacterium tuberculosis H37Rv
accgucagcgcgacc

SEQ ID NO: 3321083 - RNA, 24 nt, Mycobacterium tuberculosis H37Rv
accgucagcgcgaccgucaggguc

SEQ ID NO: 3321084 - RNA, 19 nt, Mycobacterium tuberculosis H37Rv
accgucaguagccacgccc

SEQ ID NO: 3321085 - RNA, 19 nt, Mycobacterium tuberculosis H37Rv
accgucaugaaaucgauga

SEQ ID NO: 3321086 - RNA, 16 nt, Mycobacterium tuberculosis H37Rv
accgucauggcgggug

SEQ ID NO: 3321087 - RNA, 13 nt, Mycobacterium tuberculosis H37Rv
accguccagcagc

SEQ ID NO: 3321088 - RNA, 14 nt, Mycobacterium tuberculosis H37Rv
accguccagcagcu

SEQ ID NO: 3321089 - RNA, 15 nt, Mycobacterium tuberculosis H37Rv
accguccagcagcuc

SEQ ID NO: 3321090 - RNA, 19 nt, Mycobacterium tuberculosis H37Rv
accgucccugugucgccgu

SEQ ID NO: 3321091 - RNA, 12 nt, Mycobacterium tuberculosis H37Rv
accguccgcgga

SEQ ID NO: 3321092 - RNA, 21 nt, Mycobacterium tuberculosis H37Rv
accguccgggucaccagcgca

SEQ ID NO: 3321093 - RNA, 14 nt, Mycobacterium tuberculosis H37Rv
accgucgagccgga

SEQ ID NO: 3321094 - RNA, 16 nt, Mycobacterium tuberculosis H37Rv
accgucgagccggaca

SEQ ID NO: 3321095 - RNA, 15 nt, Mycobacterium tuberculosis H37Rv
accgucgcgcucgca

SEQ ID NO: 3321096 - RNA, 16 nt, Mycobacterium tuberculosis H37Rv
accgucgcggcggcac

SEQ ID NO: 3321097 - RNA, 16 nt, Mycobacterium tuberculosis H37Rv
accgucgcuaugcgcc

SEQ ID NO: 3321098 - RNA, 22 nt, Mycobacterium tuberculosis H37Rv
accgucggaacugaccacgucg

SEQ ID NO: 3321099 - RNA, 16 nt, Mycobacterium tuberculosis H37Rv
accgucggcagcagcg

SEQ ID NO: 3321100 - RNA, 18 nt, Mycobacterium tuberculosis H37Rv
accgucgggacggccaac

SEQ ID NO: 3321101 - RNA, 19 nt, Mycobacterium tuberculosis H37Rv
accgucgggacggccaaca

SEQ ID NO: 3321102 - RNA, 17 nt, Mycobacterium tuberculosis H37Rv
accgucgggcccagccg

SEQ ID NO: 3321103 - RNA, 20 nt, Mycobacterium tuberculosis H37Rv
accgucguacucggcggcca

SEQ ID NO: 3321104 - RNA, 16 nt, Mycobacterium tuberculosis H37Rv
accgucgucaccgcga

SEQ ID NO: 3321105 - RNA, 14 nt, Mycobacterium tuberculosis H37Rv
accgucguccagac

SEQ ID NO: 3321106 - RNA, 18 nt, Mycobacterium tuberculosis H37Rv
accgucgucgugcaggcg

SEQ ID NO: 3321107 - RNA, 15 nt, Mycobacterium tuberculosis H37Rv
accgucguggcggug

SEQ ID NO: 3321108 - RNA, 16 nt, Mycobacterium tuberculosis H37Rv
accgucucgcaccgcg

SEQ ID NO: 3321109 - RNA, 14 nt, Mycobacterium tuberculosis H37Rv
accgucugcuggcc

SEQ ID NO: 3321110 - RNA, 15 nt, Mycobacterium tuberculosis H37Rv
accgugaaccgcccg

SEQ ID NO: 3321111 - RNA, 16 nt, Mycobacterium tuberculosis H37Rv
accgugacagcggcau

SEQ ID NO: 3321112 - RNA, 21 nt, Mycobacterium tuberculosis H37Rv
accgugacagcggcauugcca

SEQ ID NO: 3321113 - RNA, 13 nt, Mycobacterium tuberculosis H37Rv
accgugaccgccg

SEQ ID NO: 3321114 - RNA, 22 nt, Mycobacterium tuberculosis H37Rv
accgugacguagggcagcgcca

SEQ ID NO: 3321115 - RNA, 15 nt, Mycobacterium tuberculosis H37Rv
accgugcaccagcuc

SEQ ID NO: 3321116 - RNA, 14 nt, Mycobacterium tuberculosis H37Rv
accgugcaccucca

SEQ ID NO: 3321117 - RNA, 18 nt, Mycobacterium tuberculosis H37Rv
accgugcccugggugaug

SEQ ID NO: 3321118 - RNA, 14 nt, Mycobacterium tuberculosis H37Rv
accgugccgcccgg

SEQ ID NO: 3321119 - RNA, 13 nt, Mycobacterium tuberculosis H37Rv
accgugccgggcg

SEQ ID NO: 3321120 - RNA, 17 nt, Mycobacterium tuberculosis H37Rv
accgugccgucggcgug

SEQ ID NO: 3321121 - RNA, 16 nt, Mycobacterium tuberculosis H37Rv
accgugcggaucgcgc

SEQ ID NO: 3321122 - RNA, 19 nt, Mycobacterium tuberculosis H37Rv
accgugcggggggcagcuc

SEQ ID NO: 3321123 - RNA, 13 nt, Mycobacterium tuberculosis H37Rv
accgugcugggca

SEQ ID NO: 3321124 - RNA, 18 nt, Mycobacterium tuberculosis H37Rv
accguggcagcugcucuc

SEQ ID NO: 3321125 - RNA, 17 nt, Mycobacterium tuberculosis H37Rv
accguggccgcagggcc

SEQ ID NO: 3321126 - RNA, 15 nt, Mycobacterium tuberculosis H37Rv
accguggccucgaag

SEQ ID NO: 3321127 - RNA, 15 nt, Mycobacterium tuberculosis H37Rv
accguggcgccgguc

SEQ ID NO: 3321128 - RNA, 19 nt, Mycobacterium tuberculosis H37Rv
accguggcggaucgcgagc

SEQ ID NO: 3321129 - RNA, 23 nt, Mycobacterium tuberculosis H37Rv
accguggcggccuccuccccgac

SEQ ID NO: 3321130 - RNA, 14 nt, Mycobacterium tuberculosis H37Rv
accguggucggagg

SEQ ID NO: 3321131 - RNA, 16 nt, Mycobacterium tuberculosis H37Rv
accguggucggaggug

SEQ ID NO: 3321132 - RNA, 14 nt, Mycobacterium tuberculosis H37Rv
accgugguggacga

SEQ ID NO: 3321133 - RNA, 19 nt, Mycobacterium tuberculosis H37Rv
accgugguggucgggcgca

SEQ ID NO: 3321134 - RNA, 12 nt, Mycobacterium tuberculosis H37Rv
accgugguucgg

SEQ ID NO: 3321135 - RNA, 16 nt, Mycobacterium tuberculosis H37Rv
accguguugcugucga

SEQ ID NO: 3321136 - RNA, 14 nt, Mycobacterium tuberculosis H37Rv
accguuaccgccgu

SEQ ID NO: 3321137 - RNA, 16 nt, Mycobacterium tuberculosis H37Rv
accguucacccagcgg

SEQ ID NO: 3321138 - RNA, 14 nt, Mycobacterium tuberculosis H37Rv
accguugaccucuu

SEQ ID NO: 3321139 - RNA, 15 nt, Mycobacterium tuberculosis H37Rv
accguugaccucuuc

SEQ ID NO: 3321140 - RNA, 20 nt, Mycobacterium tuberculosis H37Rv
accguugaccucuucgggca

SEQ ID NO: 3321141 - RNA, 17 nt, Mycobacterium tuberculosis H37Rv
accguugaggucgauca

SEQ ID NO: 3321142 - RNA, 22 nt, Mycobacterium tuberculosis H37Rv
accguugccgccgucaccgccg

SEQ ID NO: 3321143 - RNA, 20 nt, Mycobacterium tuberculosis H37Rv
accguugcgaagaagaaggc

SEQ ID NO: 3321144 - RNA, 19 nt, Mycobacterium tuberculosis H37Rv
accguuguaccccagcauc

SEQ ID NO: 3321145 - RNA, 21 nt, Mycobacterium tuberculosis H37Rv
accguuguugaggaugccgga

SEQ ID NO: 3321146 - RNA, 16 nt, Mycobacterium tuberculosis H37Rv
accguuucgaucucga

SEQ ID NO: 3321147 - RNA, 20 nt, Mycobacterium tuberculosis H37Rv
accguuucgaucucgagcag

SEQ ID NO: 3321148 - RNA, 17 nt, Mycobacterium tuberculosis H37Rv
accguuugcgcaccggu

SEQ ID NO: 3321149 - RNA, 18 nt, Mycobacterium tuberculosis H37Rv
accguuugcgcaccgguc

SEQ ID NO: 3321150 - RNA, 23 nt, Mycobacterium tuberculosis H37Rv
accuaccgagaucaccgccacca

SEQ ID NO: 3321151 - RNA, 16 nt, Mycobacterium tuberculosis H37Rv
accuaccgucgaccac

SEQ ID NO: 3321152 - RNA, 14 nt, Mycobacterium tuberculosis H37Rv
accuagcaccgcgc

SEQ ID NO: 3321153 - RNA, 17 nt, Mycobacterium tuberculosis H37Rv
accuagcaccgcgccga

SEQ ID NO: 3321154 - RNA, 11 nt, Mycobacterium tuberculosis H37Rv
accuagccgca

SEQ ID NO: 3321155 - RNA, 18 nt, Mycobacterium tuberculosis H37Rv
accuauccguucaauuuc

SEQ ID NO: 3321156 - RNA, 19 nt, Mycobacterium tuberculosis H37Rv
accuauggucaaccgcgcc

SEQ ID NO: 3321157 - RNA, 14 nt, Mycobacterium tuberculosis H37Rv
accuauuugcgacc

SEQ ID NO: 3321158 - RNA, 13 nt, Mycobacterium tuberculosis H37Rv
accucaaacgccu

SEQ ID NO: 3321159 - RNA, 15 nt, Mycobacterium tuberculosis H37Rv
accucaccgaaagau

SEQ ID NO: 3321160 - RNA, 18 nt, Mycobacterium tuberculosis H37Rv
accucaucgcggucgcca

SEQ ID NO: 3321161 - RNA, 21 nt, Mycobacterium tuberculosis H37Rv
accucaucgcggucgccaccg

SEQ ID NO: 3321162 - RNA, 16 nt, Mycobacterium tuberculosis H37Rv
accucaugaucucacc

SEQ ID NO: 3321163 - RNA, 19 nt, Mycobacterium tuberculosis H37Rv
accucaugcacgccguagc

SEQ ID NO: 3321164 - RNA, 15 nt, Mycobacterium tuberculosis H37Rv
accuccagugcggcc

SEQ ID NO: 3321165 - RNA, 18 nt, Mycobacterium tuberculosis H37Rv
accucccacccccgguuc

SEQ ID NO: 3321166 - RNA, 19 nt, Mycobacterium tuberculosis H37Rv
accucccagggcucggcgg

SEQ ID NO: 3321167 - RNA, 18 nt, Mycobacterium tuberculosis H37Rv
accucccgcagccgggca

SEQ ID NO: 3321168 - RNA, 14 nt, Mycobacterium tuberculosis H37Rv
accucccgcggcac

SEQ ID NO: 3321169 - RNA, 14 nt, Mycobacterium tuberculosis H37Rv
accuccgccggcac

SEQ ID NO: 3321170 - RNA, 23 nt, Mycobacterium tuberculosis H37Rv
accuccggauaacccagcggcgc

SEQ ID NO: 3321171 - RNA, 15 nt, Mycobacterium tuberculosis H37Rv
accuccggcaccgcc

SEQ ID NO: 3321172 - RNA, 21 nt, Mycobacterium tuberculosis H37Rv
accuccgggaugucgaagucg

SEQ ID NO: 3321173 - RNA, 11 nt, Mycobacterium tuberculosis H37Rv
accuccucgaa

SEQ ID NO: 3321174 - RNA, 19 nt, Mycobacterium tuberculosis H37Rv
accuccugguugaccucgg

SEQ ID NO: 3321175 - RNA, 18 nt, Mycobacterium tuberculosis H37Rv
accucgaaaccguggcca

SEQ ID NO: 3321176 - RNA, 21 nt, Mycobacterium tuberculosis H37Rv
accucgaaaccguggccaucg

SEQ ID NO: 3321177 - RNA, 18 nt, Mycobacterium tuberculosis H37Rv
accucgaacggggugagc

SEQ ID NO: 3321178 - RNA, 17 nt, Mycobacterium tuberculosis H37Rv
accucgaagcccagcac

SEQ ID NO: 3321179 - RNA, 16 nt, Mycobacterium tuberculosis H37Rv
accucgaagugcaggu

SEQ ID NO: 3321180 - RNA, 19 nt, Mycobacterium tuberculosis H37Rv
accucgaagugcaggugcg

SEQ ID NO: 3321181 - RNA, 21 nt, Mycobacterium tuberculosis H37Rv
accucgccaacaucccaacac

SEQ ID NO: 3321182 - RNA, 22 nt, Mycobacterium tuberculosis H37Rv
accucgccaacaucccaacaca

SEQ ID NO: 3321183 - RNA, 13 nt, Mycobacterium tuberculosis H37Rv
accucgcccauga

SEQ ID NO: 3321184 - RNA, 13 nt, Mycobacterium tuberculosis H37Rv
accucgccgcccu

SEQ ID NO: 3321185 - RNA, 22 nt, Mycobacterium tuberculosis H37Rv
accucgccgcccuguccgggua

SEQ ID NO: 3321186 - RNA, 20 nt, Mycobacterium tuberculosis H37Rv
accucgccggccgucagcac

SEQ ID NO: 3321187 - RNA, 16 nt, Mycobacterium tuberculosis H37Rv
accucgcgggcgaucg

SEQ ID NO: 3321188 - RNA, 15 nt, Mycobacterium tuberculosis H37Rv
accucggacugcagc

SEQ ID NO: 3321189 - RNA, 16 nt, Mycobacterium tuberculosis H37Rv
accucggacugcagcg

SEQ ID NO: 3321190 - RNA, 18 nt, Mycobacterium tuberculosis H37Rv
accucggcaaccaccucg

SEQ ID NO: 3321191 - RNA, 14 nt, Mycobacterium tuberculosis H37Rv
accucggccgccag

SEQ ID NO: 3321192 - RNA, 18 nt, Mycobacterium tuberculosis H37Rv
accucggccgccagcccc

SEQ ID NO: 3321193 - RNA, 20 nt, Mycobacterium tuberculosis H37Rv
accucggccuugaucaccgu

SEQ ID NO: 3321194 - RNA, 18 nt, Mycobacterium tuberculosis H37Rv
accucggcgaagucacgc

SEQ ID NO: 3321195 - RNA, 19 nt, Mycobacterium tuberculosis H37Rv
accucggcgacgaugucga

SEQ ID NO: 3321196 - RNA, 13 nt, Mycobacterium tuberculosis H37Rv
accucgggaucgg

SEQ ID NO: 3321197 - RNA, 17 nt, Mycobacterium tuberculosis H37Rv
accucgguacuugccac

SEQ ID NO: 3321198 - RNA, 12 nt, Mycobacterium tuberculosis H37Rv
accucggugcgg

SEQ ID NO: 3321199 - RNA, 19 nt, Mycobacterium tuberculosis H37Rv
accucgucaaucaccaccg

SEQ ID NO: 3321200 - RNA, 14 nt, Mycobacterium tuberculosis H37Rv
accucgucccacag

SEQ ID NO: 3321201 - RNA, 14 nt, Mycobacterium tuberculosis H37Rv
accucgucgaccgg

SEQ ID NO: 3321202 - RNA, 13 nt, Mycobacterium tuberculosis H37Rv
accucgucgaucg

SEQ ID NO: 3321203 - RNA, 14 nt, Mycobacterium tuberculosis H37Rv
accucgucgaucgc

SEQ ID NO: 3321204 - RNA, 13 nt, Mycobacterium tuberculosis H37Rv
accucgucgaucu

SEQ ID NO: 3321205 - RNA, 16 nt, Mycobacterium tuberculosis H37Rv
accucgucgcgucgcc

SEQ ID NO: 3321206 - RNA, 14 nt, Mycobacterium tuberculosis H37Rv
accucgucggccga

SEQ ID NO: 3321207 - RNA, 16 nt, Mycobacterium tuberculosis H37Rv
accucgucgucaucga

SEQ ID NO: 3321208 - RNA, 17 nt, Mycobacterium tuberculosis H37Rv
accucgugguucugcag

SEQ ID NO: 3321209 - RNA, 19 nt, Mycobacterium tuberculosis H37Rv
accucgugguucugcaggu

SEQ ID NO: 3321210 - RNA, 16 nt, Mycobacterium tuberculosis H37Rv
accucguguccgggga

SEQ ID NO: 3321211 - RNA, 17 nt, Mycobacterium tuberculosis H37Rv
accucguugcugccggc

SEQ ID NO: 3321212 - RNA, 18 nt, Mycobacterium tuberculosis H37Rv
accucucugcgccaggcg

SEQ ID NO: 3321213 - RNA, 16 nt, Mycobacterium tuberculosis H37Rv
accucucugucgcguu

SEQ ID NO: 3321214 - RNA, 16 nt, Mycobacterium tuberculosis H37Rv
accucugcugagcugc

SEQ ID NO: 3321215 - RNA, 20 nt, Mycobacterium tuberculosis H37Rv
accucugcugagcugcucgc

SEQ ID NO: 3321216 - RNA, 19 nt, Mycobacterium tuberculosis H37Rv
accucuucgggugcagcca

SEQ ID NO: 3321217 - RNA, 11 nt, Mycobacterium tuberculosis H37Rv
accucuugccc

SEQ ID NO: 3321218 - RNA, 15 nt, Mycobacterium tuberculosis H37Rv
accugaagccagcgc

SEQ ID NO: 3321219 - RNA, 14 nt, Mycobacterium tuberculosis H37Rv
accugaaugcggcc

SEQ ID NO: 3321220 - RNA, 21 nt, Mycobacterium tuberculosis H37Rv
accugacacgcccgcgagcug

SEQ ID NO: 3321221 - RNA, 19 nt, Mycobacterium tuberculosis H37Rv
accugaccgguggccaucg

SEQ ID NO: 3321222 - RNA, 12 nt, Mycobacterium tuberculosis H37Rv
accugaccguug

SEQ ID NO: 3321223 - RNA, 22 nt, Mycobacterium tuberculosis H37Rv
accugacggaaguacuccaugg

SEQ ID NO: 3321224 - RNA, 13 nt, Mycobacterium tuberculosis H37Rv
accugaggcaccu

SEQ ID NO: 3321225 - RNA, 18 nt, Mycobacterium tuberculosis H37Rv
accugcagcgcauccggu

SEQ ID NO: 3321226 - RNA, 16 nt, Mycobacterium tuberculosis H37Rv
accugcaucgucgcca

SEQ ID NO: 3321227 - RNA, 14 nt, Mycobacterium tuberculosis H37Rv
accugcaugcccag

SEQ ID NO: 3321228 - RNA, 15 nt, Mycobacterium tuberculosis H37Rv
accugcaugcccaga

SEQ ID NO: 3321229 - RNA, 17 nt, Mycobacterium tuberculosis H37Rv
accugcaugggcagcug

SEQ ID NO: 3321230 - RNA, 23 nt, Mycobacterium tuberculosis H37Rv
accugccgacucaucggccgcgg

SEQ ID NO: 3321231 - RNA, 22 nt, Mycobacterium tuberculosis H37Rv
accugccggaccaccgggccga

SEQ ID NO: 3321232 - RNA, 23 nt, Mycobacterium tuberculosis H37Rv
accugccggaccaccgggccgac

SEQ ID NO: 3321233 - RNA, 16 nt, Mycobacterium tuberculosis H37Rv
accugccggaccgcgg

SEQ ID NO: 3321234 - RNA, 16 nt, Mycobacterium tuberculosis H37Rv
accugccgggccacgg

SEQ ID NO: 3321235 - RNA, 18 nt, Mycobacterium tuberculosis H37Rv
accugccgggccacggcu

SEQ ID NO: 3321236 - RNA, 13 nt, Mycobacterium tuberculosis H37Rv
accugccguuccg

SEQ ID NO: 3321237 - RNA, 18 nt, Mycobacterium tuberculosis H37Rv
accugcgaccaggcgcgg

SEQ ID NO: 3321238 - RNA, 19 nt, Mycobacterium tuberculosis H37Rv
accugcgcaaauugcaaca

SEQ ID NO: 3321239 - RNA, 14 nt, Mycobacterium tuberculosis H37Rv
accugcgccgguga

SEQ ID NO: 3321240 - RNA, 19 nt, Mycobacterium tuberculosis H37Rv
accugcgcgcggccgcgcu

SEQ ID NO: 3321241 - RNA, 14 nt, Mycobacterium tuberculosis H37Rv
accugcggcgucaa

SEQ ID NO: 3321242 - RNA, 23 nt, Mycobacterium tuberculosis H37Rv
accugcggcugcuuggucgccca

SEQ ID NO: 3321243 - RNA, 23 nt, Mycobacterium tuberculosis H37Rv
accugcgggaucgccgagaccgc

SEQ ID NO: 3321244 - RNA, 15 nt, Mycobacterium tuberculosis H37Rv
accugcgggcccacg

SEQ ID NO: 3321245 - RNA, 18 nt, Mycobacterium tuberculosis H37Rv
accugcgucggcccgcgg

SEQ ID NO: 3321246 - RNA, 16 nt, Mycobacterium tuberculosis H37Rv
accugcugcaccguca

SEQ ID NO: 3321247 - RNA, 23 nt, Mycobacterium tuberculosis H37Rv
accugcugcacggucaugccgcc

SEQ ID NO: 3321248 - RNA, 17 nt, Mycobacterium tuberculosis H37Rv
accugcuggaagccguc

SEQ ID NO: 3321249 - RNA, 17 nt, Mycobacterium tuberculosis H37Rv
accugcuggaucucggu

SEQ ID NO: 3321250 - RNA, 19 nt, Mycobacterium tuberculosis H37Rv
accugcuggcgcacgaacc

SEQ ID NO: 3321251 - RNA, 23 nt, Mycobacterium tuberculosis H37Rv
accugcugggagggaccacccgg

SEQ ID NO: 3321252 - RNA, 16 nt, Mycobacterium tuberculosis H37Rv
accuggacaaccucgu

SEQ ID NO: 3321253 - RNA, 18 nt, Mycobacterium tuberculosis H37Rv
accuggaucagcgucggu

SEQ ID NO: 3321254 - RNA, 16 nt, Mycobacterium tuberculosis H37Rv
accuggaucagggcuu

SEQ ID NO: 3321255 - RNA, 18 nt, Mycobacterium tuberculosis H37Rv
accuggcccgccacgaug

SEQ ID NO: 3321256 - RNA, 21 nt, Mycobacterium tuberculosis H37Rv
accuggccgcccgcugcggcg

SEQ ID NO: 3321257 - RNA, 16 nt, Mycobacterium tuberculosis H37Rv
accugggacaggacga

SEQ ID NO: 3321258 - RNA, 20 nt, Mycobacterium tuberculosis H37Rv
accugggccagcagccguuc

SEQ ID NO: 3321259 - RNA, 14 nt, Mycobacterium tuberculosis H37Rv
accugggccaucac

SEQ ID NO: 3321260 - RNA, 18 nt, Mycobacterium tuberculosis H37Rv
accugggccaucacgguc

SEQ ID NO: 3321261 - RNA, 19 nt, Mycobacterium tuberculosis H37Rv
accugggcgacuaccggcu

SEQ ID NO: 3321262 - RNA, 20 nt, Mycobacterium tuberculosis H37Rv
accugggcugccggccagac

SEQ ID NO: 3321263 - RNA, 21 nt, Mycobacterium tuberculosis H37Rv
accuggggccaccagaaccac

SEQ ID NO: 3321264 - RNA, 14 nt, Mycobacterium tuberculosis H37Rv
accuggggccgcac

SEQ ID NO: 3321265 - RNA, 22 nt, Mycobacterium tuberculosis H37Rv
accugggguguagccagcggcu

SEQ ID NO: 3321266 - RNA, 23 nt, Mycobacterium tuberculosis H37Rv
accugguaguccccgaaccgagc

SEQ ID NO: 3321267 - RNA, 14 nt, Mycobacterium tuberculosis H37Rv
accugguaugccgc

SEQ ID NO: 3321268 - RNA, 13 nt, Mycobacterium tuberculosis H37Rv
accuggucgcguc

SEQ ID NO: 3321269 - RNA, 14 nt, Mycobacterium tuberculosis H37Rv
accuggugcaaccg

SEQ ID NO: 3321270 - RNA, 19 nt, Mycobacterium tuberculosis H37Rv
accugguuccagaggcccg

SEQ ID NO: 3321271 - RNA, 21 nt, Mycobacterium tuberculosis H37Rv
accugguucgacucaugccga

SEQ ID NO: 3321272 - RNA, 18 nt, Mycobacterium tuberculosis H37Rv
accugguuuacccgcaug

SEQ ID NO: 3321273 - RNA, 19 nt, Mycobacterium tuberculosis H37Rv
accugucaacauuucugag

SEQ ID NO: 3321274 - RNA, 16 nt, Mycobacterium tuberculosis H37Rv
accuguguugagcggc

SEQ ID NO: 3321275 - RNA, 17 nt, Mycobacterium tuberculosis H37Rv
accuguuggcaugccgc

SEQ ID NO: 3321276 - RNA, 22 nt, Mycobacterium tuberculosis H37Rv
accuucaccgcguguaccgcga

SEQ ID NO: 3321277 - RNA, 18 nt, Mycobacterium tuberculosis H37Rv
accuucgcuauggcggcu

SEQ ID NO: 3321278 - RNA, 12 nt, Mycobacterium tuberculosis H37Rv
accuucggcccg

SEQ ID NO: 3321279 - RNA, 19 nt, Mycobacterium tuberculosis H37Rv
accuucggccgaccgggcu

SEQ ID NO: 3321280 - RNA, 18 nt, Mycobacterium tuberculosis H37Rv
accuucugguccagcacc

SEQ ID NO: 3321281 - RNA, 14 nt, Mycobacterium tuberculosis H37Rv
accuugaccgggca

SEQ ID NO: 3321282 - RNA, 17 nt, Mycobacterium tuberculosis H37Rv
accuugaccgucgcgca

SEQ ID NO: 3321283 - RNA, 16 nt, Mycobacterium tuberculosis H37Rv
accuugaucgagcagg

SEQ ID NO: 3321284 - RNA, 15 nt, Mycobacterium tuberculosis H37Rv
accuugaugccauac

SEQ ID NO: 3321285 - RNA, 21 nt, Mycobacterium tuberculosis H37Rv
accuugcccaccaguuccggg

SEQ ID NO: 3321286 - RNA, 18 nt, Mycobacterium tuberculosis H37Rv
accuugcggcagaccaag

SEQ ID NO: 3321287 - RNA, 23 nt, Mycobacterium tuberculosis H37Rv
accuuggccagacccaccaccgc

SEQ ID NO: 3321288 - RNA, 14 nt, Mycobacterium tuberculosis H37Rv
accuuggccgugcc

SEQ ID NO: 3321289 - RNA, 17 nt, Mycobacterium tuberculosis H37Rv
accuuggcgaccaugcu

SEQ ID NO: 3321290 - RNA, 19 nt, Mycobacterium tuberculosis H37Rv
accuuggcguugaccagca

SEQ ID NO: 3321291 - RNA, 23 nt, Mycobacterium tuberculosis H37Rv
accuuggcugggcccgccgucac

SEQ ID NO: 3321292 - RNA, 13 nt, Mycobacterium tuberculosis H37Rv
accuuggucgcca

SEQ ID NO: 3321293 - RNA, 14 nt, Mycobacterium tuberculosis H37Rv
accuuggucgccaa

SEQ ID NO: 3321294 - RNA, 18 nt, Mycobacterium tuberculosis H37Rv
acgaaagucaaucgcguc

SEQ ID NO: 3321295 - RNA, 23 nt, Mycobacterium tuberculosis H37Rv
acgaaaucggcggcguccagcag

SEQ ID NO: 3321296 - RNA, 16 nt, Mycobacterium tuberculosis H37Rv
acgaaaucgucgggua

SEQ ID NO: 3321297 - RNA, 18 nt, Mycobacterium tuberculosis H37Rv
acgaaaugcacgccgggc

SEQ ID NO: 3321298 - RNA, 19 nt, Mycobacterium tuberculosis H37Rv
acgaaaugcacgccgggca

SEQ ID NO: 3321299 - RNA, 22 nt, Mycobacterium tuberculosis H37Rv
acgaaauugggcgauucugcgu

SEQ ID NO: 3321300 - RNA, 16 nt, Mycobacterium tuberculosis H37Rv
acgaacagcgucaacc

SEQ ID NO: 3321301 - RNA, 18 nt, Mycobacterium tuberculosis H37Rv
acgaacaguugcggcugg

SEQ ID NO: 3321302 - RNA, 16 nt, Mycobacterium tuberculosis H37Rv
acgaaccccacgcaga

SEQ ID NO: 3321303 - RNA, 16 nt, Mycobacterium tuberculosis H37Rv
acgaaccccaucagaa

SEQ ID NO: 3321304 - RNA, 14 nt, Mycobacterium tuberculosis H37Rv
acgaacccucagcc

SEQ ID NO: 3321305 - RNA, 12 nt, Mycobacterium tuberculosis H37Rv
acgaaccgccgc

SEQ ID NO: 3321306 - RNA, 15 nt, Mycobacterium tuberculosis H37Rv
acgaaccgcucagcg

SEQ ID NO: 3321307 - RNA, 18 nt, Mycobacterium tuberculosis H37Rv
acgaaccggaucaucgcc

SEQ ID NO: 3321308 - RNA, 20 nt, Mycobacterium tuberculosis H37Rv
acgaaccgggacaaccgcgc

SEQ ID NO: 3321309 - RNA, 21 nt, Mycobacterium tuberculosis H37Rv
acgaaccgggacaaccgcgcc

SEQ ID NO: 3321310 - RNA, 16 nt, Mycobacterium tuberculosis H37Rv
acgaaccgguugccgu

SEQ ID NO: 3321311 - RNA, 22 nt, Mycobacterium tuberculosis H37Rv
acgaacgggugaaggaugcggc

SEQ ID NO: 3321312 - RNA, 13 nt, Mycobacterium tuberculosis H37Rv
acgaacucaccgc

SEQ ID NO: 3321313 - RNA, 22 nt, Mycobacterium tuberculosis H37Rv
acgaacuccgcguugggcaccu

SEQ ID NO: 3321314 - RNA, 19 nt, Mycobacterium tuberculosis H37Rv
acgaacugcagccauucuu

SEQ ID NO: 3321315 - RNA, 12 nt, Mycobacterium tuberculosis H37Rv
acgaacuggucu

SEQ ID NO: 3321316 - RNA, 23 nt, Mycobacterium tuberculosis H37Rv
acgaagaacaccuugggcagcuu

SEQ ID NO: 3321317 - RNA, 13 nt, Mycobacterium tuberculosis H37Rv
acgaagaucgcgu

SEQ ID NO: 3321318 - RNA, 20 nt, Mycobacterium tuberculosis H37Rv
acgaagaucgcgugccacag

SEQ ID NO: 3321319 - RNA, 21 nt, Mycobacterium tuberculosis H37Rv
acgaagaucgcgugccacagc

SEQ ID NO: 3321320 - RNA, 16 nt, Mycobacterium tuberculosis H37Rv
acgaagaucgcugcga

SEQ ID NO: 3321321 - RNA, 18 nt, Mycobacterium tuberculosis H37Rv
acgaagaucgcugcgaag

SEQ ID NO: 3321322 - RNA, 17 nt, Mycobacterium tuberculosis H37Rv
acgaagaucuucaccgg

SEQ ID NO: 3321323 - RNA, 18 nt, Mycobacterium tuberculosis H37Rv
acgaagaucuucaccggc

SEQ ID NO: 3321324 - RNA, 17 nt, Mycobacterium tuberculosis H37Rv
acgaagcagacgaagua

SEQ ID NO: 3321325 - RNA, 19 nt, Mycobacterium tuberculosis H37Rv
acgaagggaaggacgcgca

SEQ ID NO: 3321326 - RNA, 22 nt, Mycobacterium tuberculosis H37Rv
acgaagggaaggacgcgcagca

SEQ ID NO: 3321327 - RNA, 20 nt, Mycobacterium tuberculosis H37Rv
acgaagguggcauucgucga

SEQ ID NO: 3321328 - RNA, 22 nt, Mycobacterium tuberculosis H37Rv
acgaagucgaacggcuuggcgu

SEQ ID NO: 3321329 - RNA, 20 nt, Mycobacterium tuberculosis H37Rv
acgaagucgacgaacucgcc

SEQ ID NO: 3321330 - RNA, 22 nt, Mycobacterium tuberculosis H37Rv
acgaauaacgcggucggcagcg

SEQ ID NO: 3321331 - RNA, 21 nt, Mycobacterium tuberculosis H37Rv
acgaauccacuggucaacggg

SEQ ID NO: 3321332 - RNA, 16 nt, Mycobacterium tuberculosis H37Rv
acgaaucccacggcaa

SEQ ID NO: 3321333 - RNA, 21 nt, Mycobacterium tuberculosis H37Rv
acgaaucugcgguacugagcc

SEQ ID NO: 3321334 - RNA, 15 nt, Mycobacterium tuberculosis H37Rv
acgaaugaucguccc

SEQ ID NO: 3321335 - RNA, 17 nt, Mycobacterium tuberculosis H37Rv
acgaauguccgcagacg

SEQ ID NO: 3321336 - RNA, 20 nt, Mycobacterium tuberculosis H37Rv
acgacaagguguggugacag

SEQ ID NO: 3321337 - RNA, 14 nt, Mycobacterium tuberculosis H37Rv
acgacaccagagcg

SEQ ID NO: 3321338 - RNA, 22 nt, Mycobacterium tuberculosis H37Rv
acgacauacgagcagugaccgc

SEQ ID NO: 3321339 - RNA, 17 nt, Mycobacterium tuberculosis H37Rv
acgaucggcggcgcgcc

SEQ ID NO: 3321340 - RNA, 24 nt, Mycobacterium tuberculosis H37Rv
acgaucgugagacgccgucgacgu

SEQ ID NO: 3321341 - RNA, 15 nt, Mycobacterium tuberculosis H37Rv
acgaucgugccggga

SEQ ID NO: 3321342 - RNA, 13 nt, Mycobacterium tuberculosis H37Rv
acgaucucggcgg

SEQ ID NO: 3321343 - RNA, 21 nt, Mycobacterium tuberculosis H37Rv
acgaucucguggaucugccuc

SEQ ID NO: 3321344 - RNA, 22 nt, Mycobacterium tuberculosis H37Rv
acgaucugcaggcccaggcugu

SEQ ID NO: 3321345 - RNA, 18 nt, Mycobacterium tuberculosis H37Rv
acgaugaccaugaugacc

SEQ ID NO: 3321346 - RNA, 14 nt, Mycobacterium tuberculosis H37Rv
acgaugaccgcgcg

SEQ ID NO: 3321347 - RNA, 23 nt, Mycobacterium tuberculosis H37Rv
acgaugaccggaaaugucuccuc

SEQ ID NO: 3321348 - RNA, 17 nt, Mycobacterium tuberculosis H37Rv
acgaugacggugggguc

SEQ ID NO: 3321349 - RNA, 15 nt, Mycobacterium tuberculosis H37Rv
acgaugaucccaagc

SEQ ID NO: 3321350 - RNA, 17 nt, Mycobacterium tuberculosis H37Rv
acgaugauguuggccgg

SEQ ID NO: 3321351 - RNA, 17 nt, Mycobacterium tuberculosis H37Rv
acgaugcccggcaucgc

SEQ ID NO: 3321352 - RNA, 22 nt, Mycobacterium tuberculosis H37Rv
acgaugcccuucugacuaucuc

SEQ ID NO: 3321353 - RNA, 16 nt, Mycobacterium tuberculosis H37Rv
acgaugccgcgggaca

SEQ ID NO: 3321354 - RNA, 22 nt, Mycobacterium tuberculosis H37Rv
acgaugccggcaagccugcgcu

SEQ ID NO: 3321355 - RNA, 21 nt, Mycobacterium tuberculosis H37Rv
acgaugcgggcgaucucgaug

SEQ ID NO: 3321356 - RNA, 15 nt, Mycobacterium tuberculosis H37Rv
acgauggccgucgau

SEQ ID NO: 3321357 - RNA, 14 nt, Mycobacterium tuberculosis H37Rv
acgauggcgaugag

SEQ ID NO: 3321358 - RNA, 16 nt, Mycobacterium tuberculosis H37Rv
acgauggcgucggcca

SEQ ID NO: 3321359 - RNA, 19 nt, Mycobacterium tuberculosis H37Rv
acgauggcgucggccagga

SEQ ID NO: 3321360 - RNA, 20 nt, Mycobacterium tuberculosis H37Rv
acgaugguguacugcugcuu

SEQ ID NO: 3321361 - RNA, 21 nt, Mycobacterium tuberculosis H37Rv
acgauguaaacaacgcgauag

SEQ ID NO: 3321362 - RNA, 12 nt, Mycobacterium tuberculosis H37Rv
acgaugucaccc

SEQ ID NO: 3321363 - RNA, 15 nt, Mycobacterium tuberculosis H37Rv
acgaugucacccucc

SEQ ID NO: 3321364 - RNA, 15 nt, Mycobacterium tuberculosis H37Rv
acgauguccucgaug

SEQ ID NO: 3321365 - RNA, 16 nt, Mycobacterium tuberculosis H37Rv
acgauguccuggaagc

SEQ ID NO: 3321366 - RNA, 14 nt, Mycobacterium tuberculosis H37Rv
acgaugucggcacc

SEQ ID NO: 3321367 - RNA, 16 nt, Mycobacterium tuberculosis H37Rv
acgaugucgucgauga

SEQ ID NO: 3321368 - RNA, 14 nt, Mycobacterium tuberculosis H37Rv
acgaugugcacggu

SEQ ID NO: 3321369 - RNA, 13 nt, Mycobacterium tuberculosis H37Rv
acgaugugccagg

SEQ ID NO: 3321370 - RNA, 19 nt, Mycobacterium tuberculosis H37Rv
acgaugugguccaucgcgc

SEQ ID NO: 3321371 - RNA, 20 nt, Mycobacterium tuberculosis H37Rv
acgauugcugcggcuuucag

SEQ ID NO: 3321372 - RNA, 14 nt, Mycobacterium tuberculosis H37Rv
acgauugucgauga

SEQ ID NO: 3321373 - RNA, 16 nt, Mycobacterium tuberculosis H37Rv
acgauuuuagcggcug

SEQ ID NO: 3321374 - RNA, 13 nt, Mycobacterium tuberculosis H37Rv
acgcaaaagaacc

SEQ ID NO: 3321375 - RNA, 20 nt, Mycobacterium tuberculosis H37Rv
acgcaaaaucgcccaauuuc

SEQ ID NO: 3321376 - RNA, 11 nt, Mycobacterium tuberculosis H37Rv
acgcaacaucg

SEQ ID NO: 3321377 - RNA, 13 nt, Mycobacterium tuberculosis H37Rv
acgcaaccaaccg

SEQ ID NO: 3321378 - RNA, 20 nt, Mycobacterium tuberculosis H37Rv
acgcaacggcacccaauuuc

SEQ ID NO: 3321379 - RNA, 16 nt, Mycobacterium tuberculosis H37Rv
acgcaacucgacgcgu

SEQ ID NO: 3321380 - RNA, 21 nt, Mycobacterium tuberculosis H37Rv
acgcaagggaauccgaacucg

SEQ ID NO: 3321381 - RNA, 15 nt, Mycobacterium tuberculosis H37Rv
acgcacaagccucga

SEQ ID NO: 3321382 - RNA, 15 nt, Mycobacterium tuberculosis H37Rv
acgcaccacaaucca

SEQ ID NO: 3321383 - RNA, 17 nt, Mycobacterium tuberculosis H37Rv
acgcaccacgagcagcc

SEQ ID NO: 3321384 - RNA, 13 nt, Mycobacterium tuberculosis H37Rv
acgcacccggcaa

SEQ ID NO: 3321385 - RNA, 21 nt, Mycobacterium tuberculosis H37Rv
acgcaccgaugccuugaccgc

SEQ ID NO: 3321386 - RNA, 12 nt, Mycobacterium tuberculosis H37Rv
acgcaccgcccc

SEQ ID NO: 3321387 - RNA, 17 nt, Mycobacterium tuberculosis H37Rv
acgcaccgcgguggggu

SEQ ID NO: 3321388 - RNA, 21 nt, Mycobacterium tuberculosis H37Rv
acgcacgacugugcgccgcag

SEQ ID NO: 3321389 - RNA, 17 nt, Mycobacterium tuberculosis H37Rv
acgcacgcagccccucg

SEQ ID NO: 3321390 - RNA, 14 nt, Mycobacterium tuberculosis H37Rv
acgcacgccgcgug

SEQ ID NO: 3321391 - RNA, 13 nt, Mycobacterium tuberculosis H37Rv
acgcacggccacc

SEQ ID NO: 3321392 - RNA, 17 nt, Mycobacterium tuberculosis H37Rv
acgcacucccgagccac

SEQ ID NO: 3321393 - RNA, 20 nt, Mycobacterium tuberculosis H37Rv
acgcacucccgagccacaaa

SEQ ID NO: 3321394 - RNA, 17 nt, Mycobacterium tuberculosis H37Rv
acgcacugccccgcauc

SEQ ID NO: 3321395 - RNA, 17 nt, Mycobacterium tuberculosis H37Rv
acgcacugccgcggacg

SEQ ID NO: 3321396 - RNA, 18 nt, Mycobacterium tuberculosis H37Rv
acgcagaccguccagcaa

SEQ ID NO: 3321397 - RNA, 19 nt, Mycobacterium tuberculosis H37Rv
acgcagaccguccagcaac

SEQ ID NO: 3321398 - RNA, 13 nt, Mycobacterium tuberculosis H37Rv
acgcagcacggca

SEQ ID NO: 3321399 - RNA, 15 nt, Mycobacterium tuberculosis H37Rv
acgcagcacggcacc

SEQ ID NO: 3321400 - RNA, 15 nt, Mycobacterium tuberculosis H37Rv
acgcagccccucguc

SEQ ID NO: 3321401 - RNA, 18 nt, Mycobacterium tuberculosis H37Rv
acgcagccccucgucguc

SEQ ID NO: 3321402 - RNA, 12 nt, Mycobacterium tuberculosis H37Rv
acgcagcccguc

SEQ ID NO: 3321403 - RNA, 20 nt, Mycobacterium tuberculosis H37Rv
acgcagcccgucggcgccga

SEQ ID NO: 3321404 - RNA, 19 nt, Mycobacterium tuberculosis H37Rv
acgcagccguagcugggca

SEQ ID NO: 3321405 - RNA, 14 nt, Mycobacterium tuberculosis H37Rv
acgcagcggcaagg

SEQ ID NO: 3321406 - RNA, 23 nt, Mycobacterium tuberculosis H37Rv
acgcagcggugaggugaccaacg

SEQ ID NO: 3321407 - RNA, 21 nt, Mycobacterium tuberculosis H37Rv
acgcagcuugcccgacggcgu

SEQ ID NO: 3321408 - RNA, 15 nt, Mycobacterium tuberculosis H37Rv
acgcaggaucacacu

SEQ ID NO: 3321409 - RNA, 22 nt, Mycobacterium tuberculosis H37Rv
acgcaggugaacgccggugcgc

SEQ ID NO: 3321410 - RNA, 22 nt, Mycobacterium tuberculosis H37Rv
acgcagucgcccacuauggccc

SEQ ID NO: 3321411 - RNA, 18 nt, Mycobacterium tuberculosis H37Rv
acgcagucgggcagcgcu

SEQ ID NO: 3321412 - RNA, 20 nt, Mycobacterium tuberculosis H37Rv
acgcauaagcccccgcacgc

SEQ ID NO: 3321413 - RNA, 15 nt, Mycobacterium tuberculosis H37Rv
acgcaucgccgucaa

SEQ ID NO: 3321414 - RNA, 13 nt, Mycobacterium tuberculosis H37Rv
acgcaugagggca

SEQ ID NO: 3321415 - RNA, 20 nt, Mycobacterium tuberculosis H37Rv
acgcaugcgagaacgucgag

SEQ ID NO: 3321416 - RNA, 13 nt, Mycobacterium tuberculosis H37Rv
acgcaugcucgau

SEQ ID NO: 3321417 - RNA, 15 nt, Mycobacterium tuberculosis H37Rv
acgcaugggccaggu

SEQ ID NO: 3321418 - RNA, 19 nt, Mycobacterium tuberculosis H37Rv
acgcaugucgggccaggcg

SEQ ID NO: 3321419 - RNA, 17 nt, Mycobacterium tuberculosis H37Rv
acgcauguuggugauca

SEQ ID NO: 3321420 - RNA, 18 nt, Mycobacterium tuberculosis H37Rv
acgccaaguacgcgaccg

SEQ ID NO: 3321421 - RNA, 21 nt, Mycobacterium tuberculosis H37Rv
acgccaaguacgcgaccgcga

SEQ ID NO: 3321422 - RNA, 18 nt, Mycobacterium tuberculosis H37Rv
acgccaaguccgcucacc

SEQ ID NO: 3321423 - RNA, 12 nt, Mycobacterium tuberculosis H37Rv
acgccaaugccg

SEQ ID NO: 3321424 - RNA, 12 nt, Mycobacterium tuberculosis H37Rv
acgccaccaccu

SEQ ID NO: 3321425 - RNA, 19 nt, Mycobacterium tuberculosis H37Rv
acgccaccaccuccgcguc

SEQ ID NO: 3321426 - RNA, 13 nt, Mycobacterium tuberculosis H37Rv
acgccacccaggg

SEQ ID NO: 3321427 - RNA, 23 nt, Mycobacterium tuberculosis H37Rv
acgccacccccaaccgccggcca

SEQ ID NO: 3321428 - RNA, 21 nt, Mycobacterium tuberculosis H37Rv
acgccaccgccaccacccagg

SEQ ID NO: 3321429 - RNA, 13 nt, Mycobacterium tuberculosis H37Rv
acgccaccgcggu

SEQ ID NO: 3321430 - RNA, 16 nt, Mycobacterium tuberculosis H37Rv
acgccaccgcggucac

SEQ ID NO: 3321431 - RNA, 15 nt, Mycobacterium tuberculosis H37Rv
acgccacgaccgccg

SEQ ID NO: 3321432 - RNA, 20 nt, Mycobacterium tuberculosis H37Rv
acgccacggacgugacgucg

SEQ ID NO: 3321433 - RNA, 13 nt, Mycobacterium tuberculosis H37Rv
acgccacugccag

SEQ ID NO: 3321434 - RNA, 16 nt, Mycobacterium tuberculosis H37Rv
acgccagaacguggcc

SEQ ID NO: 3321435 - RNA, 23 nt, Mycobacterium tuberculosis H37Rv
acgccagaacguggccauccucg

SEQ ID NO: 3321436 - RNA, 16 nt, Mycobacterium tuberculosis H37Rv
acgccucugcucagcc

SEQ ID NO: 3321437 - RNA, 18 nt, Mycobacterium tuberculosis H37Rv
acgccugaaacgauugcu

SEQ ID NO: 3321438 - RNA, 22 nt, Mycobacterium tuberculosis H37Rv
acgccugaaacgauugcugcgg

SEQ ID NO: 3321439 - RNA, 14 nt, Mycobacterium tuberculosis H37Rv
acgccugagccacc

SEQ ID NO: 3321440 - RNA, 15 nt, Mycobacterium tuberculosis H37Rv
acgccugagccacca

SEQ ID NO: 3321441 - RNA, 17 nt, Mycobacterium tuberculosis H37Rv
acgccugcucgucggcc

SEQ ID NO: 3321442 - RNA, 15 nt, Mycobacterium tuberculosis H37Rv
acgccugggcacggc

SEQ ID NO: 3321443 - RNA, 17 nt, Mycobacterium tuberculosis H37Rv
acgccuugacugaacuc

SEQ ID NO: 3321444 - RNA, 23 nt, Mycobacterium tuberculosis H37Rv
acgccuugcacaagcugaacuac

SEQ ID NO: 3321445 - RNA, 19 nt, Mycobacterium tuberculosis H37Rv
acgcgaaaucccccgacac

SEQ ID NO: 3321446 - RNA, 14 nt, Mycobacterium tuberculosis H37Rv
acgcgaacccgcga

SEQ ID NO: 3321447 - RNA, 22 nt, Mycobacterium tuberculosis H37Rv
acgcgaauaccagaccggccga

SEQ ID NO: 3321448 - RNA, 22 nt, Mycobacterium tuberculosis H37Rv
acgcgaaugacgauccagccca

SEQ ID NO: 3321449 - RNA, 12 nt, Mycobacterium tuberculosis H37Rv
acgcgaccgcga

SEQ ID NO: 3321450 - RNA, 14 nt, Mycobacterium tuberculosis H37Rv
acgcgaccgcgauc

SEQ ID NO: 3321451 - RNA, 15 nt, Mycobacterium tuberculosis H37Rv
acgcgaccgcgaugg

SEQ ID NO: 3321452 - RNA, 16 nt, Mycobacterium tuberculosis H37Rv
acgcgacucggcgguc

SEQ ID NO: 3321453 - RNA, 21 nt, Mycobacterium tuberculosis H37Rv
acgcgagcgcuaucaccgccu

SEQ ID NO: 3321454 - RNA, 19 nt, Mycobacterium tuberculosis H37Rv
acgcgaguccgcugcuucu

SEQ ID NO: 3321455 - RNA, 15 nt, Mycobacterium tuberculosis H37Rv
acgcgaucagcgcgc

SEQ ID NO: 3321456 - RNA, 14 nt, Mycobacterium tuberculosis H37Rv
acgcgaucggcguc

SEQ ID NO: 3321457 - RNA, 17 nt, Mycobacterium tuberculosis H37Rv
acgcgaucuguccgcga

SEQ ID NO: 3321458 - RNA, 17 nt, Mycobacterium tuberculosis H37Rv
acgcgaugacacaccgc

SEQ ID NO: 3321459 - RNA, 17 nt, Mycobacterium tuberculosis H37Rv
acgcgaugaccgcaccg

SEQ ID NO: 3321460 - RNA, 20 nt, Mycobacterium tuberculosis H37Rv
acgcgaugaucaugaacgcc

SEQ ID NO: 3321461 - RNA, 12 nt, Mycobacterium tuberculosis H37Rv
acgcgaugcacg

SEQ ID NO: 3321462 - RNA, 19 nt, Mycobacterium tuberculosis H37Rv
acgcgaugguggccgccac

SEQ ID NO: 3321463 - RNA, 16 nt, Mycobacterium tuberculosis H37Rv
acgcgauuucgucguc

SEQ ID NO: 3321464 - RNA, 20 nt, Mycobacterium tuberculosis H37Rv
acgcgcaaacucagacucug

SEQ ID NO: 3321465 - RNA, 15 nt, Mycobacterium tuberculosis H37Rv
acgcgcaaccagccu

SEQ ID NO: 3321466 - RNA, 20 nt, Mycobacterium tuberculosis H37Rv
acgcgcaacgccgccagccu

SEQ ID NO: 3321467 - RNA, 21 nt, Mycobacterium tuberculosis H37Rv
acgcgcaacgccgccagccug

SEQ ID NO: 3321468 - RNA, 17 nt, Mycobacterium tuberculosis H37Rv
acgcgcagagcguuccg

SEQ ID NO: 3321469 - RNA, 15 nt, Mycobacterium tuberculosis H37Rv
acgcgcaggaagccg

SEQ ID NO: 3321470 - RNA, 17 nt, Mycobacterium tuberculosis H37Rv
acgcgcaggaagccggc

SEQ ID NO: 3321471 - RNA, 13 nt, Mycobacterium tuberculosis H37Rv
acgcgcaggccga

SEQ ID NO: 3321472 - RNA, 15 nt, Mycobacterium tuberculosis H37Rv
acgcgcaggccgaca

SEQ ID NO: 3321473 - RNA, 16 nt, Mycobacterium tuberculosis H37Rv
acgcgcaggccgacac

SEQ ID NO: 3321474 - RNA, 11 nt, Mycobacterium tuberculosis H37Rv
acgcgcaugcc

SEQ ID NO: 3321475 - RNA, 18 nt, Mycobacterium tuberculosis H37Rv
acgcgcauucgccgggcg

SEQ ID NO: 3321476 - RNA, 20 nt, Mycobacterium tuberculosis H37Rv
acgcgccccaguucgacggc

SEQ ID NO: 3321477 - RNA, 15 nt, Mycobacterium tuberculosis H37Rv
acgcgcccgcaccac

SEQ ID NO: 3321478 - RNA, 12 nt, Mycobacterium tuberculosis H37Rv
acgcgccgcaca

SEQ ID NO: 3321479 - RNA, 22 nt, Mycobacterium tuberculosis H37Rv
acgcgccgucucgaagcucagc

SEQ ID NO: 3321480 - RNA, 16 nt, Mycobacterium tuberculosis H37Rv
acgcgcgaccgcgaug

SEQ ID NO: 3321481 - RNA, 18 nt, Mycobacterium tuberculosis H37Rv
acgcgcgagaacacccgu

SEQ ID NO: 3321482 - RNA, 18 nt, Mycobacterium tuberculosis H37Rv
acgcgcgcagccgggcac

SEQ ID NO: 3321483 - RNA, 19 nt, Mycobacterium tuberculosis H37Rv
acgcgcgcagccgggcacc

SEQ ID NO: 3321484 - RNA, 17 nt, Mycobacterium tuberculosis H37Rv
acgcgcgcucgcucacc

SEQ ID NO: 3321485 - RNA, 20 nt, Mycobacterium tuberculosis H37Rv
acgcgcgcucgcucaccggc

SEQ ID NO: 3321486 - RNA, 21 nt, Mycobacterium tuberculosis H37Rv
acgcgcggaucgucgaggcac

SEQ ID NO: 3321487 - RNA, 23 nt, Mycobacterium tuberculosis H37Rv
acgcgcguuuagucuccggcguc

SEQ ID NO: 3321488 - RNA, 14 nt, Mycobacterium tuberculosis H37Rv
acgcgcucaccgac

SEQ ID NO: 3321489 - RNA, 20 nt, Mycobacterium tuberculosis H37Rv
acgcgcucgcgcaagcggac

SEQ ID NO: 3321490 - RNA, 15 nt, Mycobacterium tuberculosis H37Rv
acgcgcucggcgauc

SEQ ID NO: 3321491 - RNA, 12 nt, Mycobacterium tuberculosis H37Rv
acgcggacaccg

SEQ ID NO: 3321492 - RNA, 13 nt, Mycobacterium tuberculosis H37Rv
acgcggacaccgc

SEQ ID NO: 3321493 - RNA, 15 nt, Mycobacterium tuberculosis H37Rv
acgcggaucgggcac

SEQ ID NO: 3321494 - RNA, 18 nt, Mycobacterium tuberculosis H37Rv
acgcggaucgggcacccc

SEQ ID NO: 3321495 - RNA, 13 nt, Mycobacterium tuberculosis H37Rv
acgcggcaauggu

SEQ ID NO: 3321496 - RNA, 20 nt, Mycobacterium tuberculosis H37Rv
acgcggccaacgaacgugcc

SEQ ID NO: 3321497 - RNA, 22 nt, Mycobacterium tuberculosis H37Rv
acgcggccggccgcccgcucga

SEQ ID NO: 3321498 - RNA, 18 nt, Mycobacterium tuberculosis H37Rv
acgcggccucgucgaguu

SEQ ID NO: 3321499 - RNA, 23 nt, Mycobacterium tuberculosis H37Rv
acgcggcgaugauggcgcgaucg

SEQ ID NO: 3321500 - RNA, 14 nt, Mycobacterium tuberculosis H37Rv
acgcggcgcgagcc

SEQ ID NO: 3321501 - RNA, 17 nt, Mycobacterium tuberculosis H37Rv
acgcgggaacgaugccg

SEQ ID NO: 3321502 - RNA, 23 nt, Mycobacterium tuberculosis H37Rv
acgcgggcacugguggcgauccg

SEQ ID NO: 3321503 - RNA, 13 nt, Mycobacterium tuberculosis H37Rv
acgcgggccgacc

SEQ ID NO: 3321504 - RNA, 18 nt, Mycobacterium tuberculosis H37Rv
acgcgggcguuggccagc

SEQ ID NO: 3321505 - RNA, 23 nt, Mycobacterium tuberculosis H37Rv
acgcgggcguuggccagcagguu

SEQ ID NO: 3321506 - RNA, 21 nt, Mycobacterium tuberculosis H37Rv
acgcggggaugucgaccgcga

SEQ ID NO: 3321507 - RNA, 15 nt, Mycobacterium tuberculosis H37Rv
acgcgggugccagau

SEQ ID NO: 3321508 - RNA, 16 nt, Mycobacterium tuberculosis H37Rv
acgcgggugccgggca

SEQ ID NO: 3321509 - RNA, 17 nt, Mycobacterium tuberculosis H37Rv
acgcggguugcgcggcu

SEQ ID NO: 3321510 - RNA, 14 nt, Mycobacterium tuberculosis H37Rv
acgcggucgacgac

SEQ ID NO: 3321511 - RNA, 22 nt, Mycobacterium tuberculosis H37Rv
acgcggucgacgacgcccucac

SEQ ID NO: 3321512 - RNA, 20 nt, Mycobacterium tuberculosis H37Rv
acgcggucugcuccaggcgc

SEQ ID NO: 3321513 - RNA, 22 nt, Mycobacterium tuberculosis H37Rv
acgcggucugcuccaggcgcgc

SEQ ID NO: 3321514 - RNA, 19 nt, Mycobacterium tuberculosis H37Rv
acgcggugccgggaucgcc

SEQ ID NO: 3321515 - RNA, 19 nt, Mycobacterium tuberculosis H37Rv
acgcgguggugauugacgg

SEQ ID NO: 3321516 - RNA, 18 nt, Mycobacterium tuberculosis H37Rv
acgcgguuuugugcgggc

SEQ ID NO: 3321517 - RNA, 22 nt, Mycobacterium tuberculosis H37Rv
acgcguacugggugucgguguc

SEQ ID NO: 3321518 - RNA, 13 nt, Mycobacterium tuberculosis H37Rv
acgcguagcuggc

SEQ ID NO: 3321519 - RNA, 14 nt, Mycobacterium tuberculosis H37Rv
acgcguauucggca

SEQ ID NO: 3321520 - RNA, 16 nt, Mycobacterium tuberculosis H37Rv
acgcguauucggcauc

SEQ ID NO: 3321521 - RNA, 18 nt, Mycobacterium tuberculosis H37Rv
acgcguauucggcaucgc

SEQ ID NO: 3321522 - RNA, 14 nt, Mycobacterium tuberculosis H37Rv
acgcgucagcggcg

SEQ ID NO: 3321523 - RNA, 15 nt, Mycobacterium tuberculosis H37Rv
acgcgucgccgacgc

SEQ ID NO: 3321524 - RNA, 15 nt, Mycobacterium tuberculosis H37Rv
acgcgucgcgcgccu

SEQ ID NO: 3321525 - RNA, 19 nt, Mycobacterium tuberculosis H37Rv
acgcgucggucgcggacag

SEQ ID NO: 3321526 - RNA, 21 nt, Mycobacterium tuberculosis H37Rv
acgcgucggucgcggacaggu

SEQ ID NO: 3321527 - RNA, 17 nt, Mycobacterium tuberculosis H37Rv
acgcgucgugccacuuc

SEQ ID NO: 3321528 - RNA, 17 nt, Mycobacterium tuberculosis H37Rv
acgcgugcacgauacuc

SEQ ID NO: 3321529 - RNA, 22 nt, Mycobacterium tuberculosis H37Rv
acgcgugugcgcgugcugcgga

SEQ ID NO: 3321530 - RNA, 21 nt, Mycobacterium tuberculosis H37Rv
acgcguucaacaccgccgacc

SEQ ID NO: 3321531 - RNA, 18 nt, Mycobacterium tuberculosis H37Rv
acgcguuccuccagcagc

SEQ ID NO: 3321532 - RNA, 18 nt, Mycobacterium tuberculosis H37Rv
acggcacccugcggcacc

SEQ ID NO: 3321533 - RNA, 16 nt, Mycobacterium tuberculosis H37Rv
acggcaccucgacguc

SEQ ID NO: 3321534 - RNA, 17 nt, Mycobacterium tuberculosis H37Rv
acggcaccucgacgucg

SEQ ID NO: 3321535 - RNA, 14 nt, Mycobacterium tuberculosis H37Rv
acggcacuagcccg

SEQ ID NO: 3321536 - RNA, 15 nt, Mycobacterium tuberculosis H37Rv
acggcagaccauggu

SEQ ID NO: 3321537 - RNA, 16 nt, Mycobacterium tuberculosis H37Rv
acggcagaucccacgc

SEQ ID NO: 3321538 - RNA, 13 nt, Mycobacterium tuberculosis H37Rv
acggcagcaccgg

SEQ ID NO: 3321539 - RNA, 18 nt, Mycobacterium tuberculosis H37Rv
acggcagcaccggugacc

SEQ ID NO: 3321540 - RNA, 13 nt, Mycobacterium tuberculosis H37Rv
acggcagccaccg

SEQ ID NO: 3321541 - RNA, 13 nt, Mycobacterium tuberculosis H37Rv
acggcagccagcc

SEQ ID NO: 3321542 - RNA, 22 nt, Mycobacterium tuberculosis H37Rv
acggcagcccaaagcgccagca

SEQ ID NO: 3321543 - RNA, 22 nt, Mycobacterium tuberculosis H37Rv
acggcagcgcccagaucgccga

SEQ ID NO: 3321544 - RNA, 23 nt, Mycobacterium tuberculosis H37Rv
acggcagcgccggucggaucggu

SEQ ID NO: 3321545 - RNA, 22 nt, Mycobacterium tuberculosis H37Rv
acggcaggcagggcagcccggc

SEQ ID NO: 3321546 - RNA, 22 nt, Mycobacterium tuberculosis H37Rv
acggcauagcagccagcgucca

SEQ ID NO: 3321547 - RNA, 22 nt, Mycobacterium tuberculosis H37Rv
acggcaucugaaaauugacccc

SEQ ID NO: 3321548 - RNA, 20 nt, Mycobacterium tuberculosis H37Rv
acggcauguaccgaccgcgu

SEQ ID NO: 3321549 - RNA, 17 nt, Mycobacterium tuberculosis H37Rv
acggcauucgaccucaa

SEQ ID NO: 3321550 - RNA, 17 nt, Mycobacterium tuberculosis H37Rv
acggccacaccgucacg

SEQ ID NO: 3321551 - RNA, 15 nt, Mycobacterium tuberculosis H37Rv
acggccaccaggugc

SEQ ID NO: 3321552 - RNA, 17 nt, Mycobacterium tuberculosis H37Rv
acggccaggacaacgca

SEQ ID NO: 3321553 - RNA, 20 nt, Mycobacterium tuberculosis H37Rv
acggccagugucagcacgac

SEQ ID NO: 3321554 - RNA, 22 nt, Mycobacterium tuberculosis H37Rv
acggccaguugguagccgcccu

SEQ ID NO: 3321555 - RNA, 22 nt, Mycobacterium tuberculosis H37Rv
acggccauauugggaguccggc

SEQ ID NO: 3321556 - RNA, 22 nt, Mycobacterium tuberculosis H37Rv
acggccaucgccagccugugcu

SEQ ID NO: 3321557 - RNA, 21 nt, Mycobacterium tuberculosis H37Rv
acggccaugaucacaccgcug

SEQ ID NO: 3321558 - RNA, 17 nt, Mycobacterium tuberculosis H37Rv
acggccccugccacgac

SEQ ID NO: 3321559 - RNA, 21 nt, Mycobacterium tuberculosis H37Rv
acggcccgagccgcgugggcc

SEQ ID NO: 3321560 - RNA, 13 nt, Mycobacterium tuberculosis H37Rv
acggcccgauccc

SEQ ID NO: 3321561 - RNA, 14 nt, Mycobacterium tuberculosis H37Rv
acggcccgaucccg

SEQ ID NO: 3321562 - RNA, 18 nt, Mycobacterium tuberculosis H37Rv
acggcccgaucccgaucg

SEQ ID NO: 3321563 - RNA, 11 nt, Mycobacterium tuberculosis H37Rv
acggcccgcau

SEQ ID NO: 3321564 - RNA, 14 nt, Mycobacterium tuberculosis H37Rv
acggcccgccgucc

SEQ ID NO: 3321565 - RNA, 23 nt, Mycobacterium tuberculosis H37Rv
acggcccgccguccggcgcccac

SEQ ID NO: 3321566 - RNA, 21 nt, Mycobacterium tuberculosis H37Rv
acggcccuuguggaguacggc

SEQ ID NO: 3321567 - RNA, 11 nt, Mycobacterium tuberculosis H37Rv
acggccgcagc

SEQ ID NO: 3321568 - RNA, 11 nt, Mycobacterium tuberculosis H37Rv
acggccgccgc

SEQ ID NO: 3321569 - RNA, 21 nt, Mycobacterium tuberculosis H37Rv
acggccgcucgggccagcgau

SEQ ID NO: 3321570 - RNA, 13 nt, Mycobacterium tuberculosis H37Rv
acggccggcaagc

SEQ ID NO: 3321571 - RNA, 17 nt, Mycobacterium tuberculosis H37Rv
acggccggcaagcaguc

SEQ ID NO: 3321572 - RNA, 19 nt, Mycobacterium tuberculosis H37Rv
acggccggccgcggucucc

SEQ ID NO: 3321573 - RNA, 14 nt, Mycobacterium tuberculosis H37Rv
acggccgggacggc

SEQ ID NO: 3321574 - RNA, 19 nt, Mycobacterium tuberculosis H37Rv
acggccguggaaagccggc

SEQ ID NO: 3321575 - RNA, 13 nt, Mycobacterium tuberculosis H37Rv
acggccugcaacg

SEQ ID NO: 3321576 - RNA, 16 nt, Mycobacterium tuberculosis H37Rv
acggccuggccaccug

SEQ ID NO: 3321577 - RNA, 20 nt, Mycobacterium tuberculosis H37Rv
acggcgaaaaucccgcuccc

SEQ ID NO: 3321578 - RNA, 16 nt, Mycobacterium tuberculosis H37Rv
acggcgaaaguccugc

SEQ ID NO: 3321579 - RNA, 20 nt, Mycobacterium tuberculosis H37Rv
acggcgaaaucgacagcagc

SEQ ID NO: 3321580 - RNA, 16 nt, Mycobacterium tuberculosis H37Rv
acggcgaacuuggccg

SEQ ID NO: 3321581 - RNA, 18 nt, Mycobacterium tuberculosis H37Rv
acggcgaacuuggccgag

SEQ ID NO: 3321582 - RNA, 22 nt, Mycobacterium tuberculosis H37Rv
acggcgaaucgguggucgaugg

SEQ ID NO: 3321583 - RNA, 19 nt, Mycobacterium tuberculosis H37Rv
acggcgaccacgccgccgg

SEQ ID NO: 3321584 - RNA, 12 nt, Mycobacterium tuberculosis H37Rv
acggcgacccag

SEQ ID NO: 3321585 - RNA, 14 nt, Mycobacterium tuberculosis H37Rv
acggcgacgauguc

SEQ ID NO: 3321586 - RNA, 16 nt, Mycobacterium tuberculosis H37Rv
acggcgacggcgccca

SEQ ID NO: 3321587 - RNA, 15 nt, Mycobacterium tuberculosis H37Rv
acggcgacucgagga

SEQ ID NO: 3321588 - RNA, 20 nt, Mycobacterium tuberculosis H37Rv
acggcgaggugcucggaucg

SEQ ID NO: 3321589 - RNA, 17 nt, Mycobacterium tuberculosis H37Rv
acggcgauccccgacgu

SEQ ID NO: 3321590 - RNA, 19 nt, Mycobacterium tuberculosis H37Rv
acggcgauccccgacgucg

SEQ ID NO: 3321591 - RNA, 17 nt, Mycobacterium tuberculosis H37Rv
acggcgaugcagccaca

SEQ ID NO: 3321592 - RNA, 15 nt, Mycobacterium tuberculosis H37Rv
acggcgauggcgcgc

SEQ ID NO: 3321593 - RNA, 16 nt, Mycobacterium tuberculosis H37Rv
acggcgauggcgcgca

SEQ ID NO: 3321594 - RNA, 17 nt, Mycobacterium tuberculosis H37Rv
acggcgcaguuggcacc

SEQ ID NO: 3321595 - RNA, 15 nt, Mycobacterium tuberculosis H37Rv
acggcgcccagcgcu

SEQ ID NO: 3321596 - RNA, 14 nt, Mycobacterium tuberculosis H37Rv
acggcgccgacccg

SEQ ID NO: 3321597 - RNA, 19 nt, Mycobacterium tuberculosis H37Rv
acggcgccgacccgaucac

SEQ ID NO: 3321598 - RNA, 15 nt, Mycobacterium tuberculosis H37Rv
acggcgcgagccgca

SEQ ID NO: 3321599 - RNA, 14 nt, Mycobacterium tuberculosis H37Rv
acggcgcguagugc

SEQ ID NO: 3321600 - RNA, 19 nt, Mycobacterium tuberculosis H37Rv
acggcgcucggcgagcuca

SEQ ID NO: 3321601 - RNA, 15 nt, Mycobacterium tuberculosis H37Rv
acggcgcugacgaac

SEQ ID NO: 3321602 - RNA, 17 nt, Mycobacterium tuberculosis H37Rv
acggcgcugccgggauc

SEQ ID NO: 3321603 - RNA, 16 nt, Mycobacterium tuberculosis H37Rv
acggcggccaaggucg

SEQ ID NO: 3321604 - RNA, 15 nt, Mycobacterium tuberculosis H37Rv
acggcggccgcgaug

SEQ ID NO: 3321605 - RNA, 16 nt, Mycobacterium tuberculosis H37Rv
acggcggccgcgaugg

SEQ ID NO: 3321606 - RNA, 16 nt, Mycobacterium tuberculosis H37Rv
acggcggcgccgccca

SEQ ID NO: 3321607 - RNA, 16 nt, Mycobacterium tuberculosis H37Rv
acggcggcgucgcggu

SEQ ID NO: 3321608 - RNA, 14 nt, Mycobacterium tuberculosis H37Rv
acggcggcuaggca

SEQ ID NO: 3321609 - RNA, 18 nt, Mycobacterium tuberculosis H37Rv
acggcgggaugcagcugc

SEQ ID NO: 3321610 - RNA, 15 nt, Mycobacterium tuberculosis H37Rv
acggcgguaagggcg

SEQ ID NO: 3321611 - RNA, 14 nt, Mycobacterium tuberculosis H37Rv
acggcggugggucg

SEQ ID NO: 3321612 - RNA, 14 nt, Mycobacterium tuberculosis H37Rv
acggcguaaucggg

SEQ ID NO: 3321613 - RNA, 20 nt, Mycobacterium tuberculosis H37Rv
acggcguacgccggacccgg

SEQ ID NO: 3321614 - RNA, 21 nt, Mycobacterium tuberculosis H37Rv
acggcguacgccggacccggu

SEQ ID NO: 3321615 - RNA, 20 nt, Mycobacterium tuberculosis H37Rv
acggcguagacguccgcggu

SEQ ID NO: 3321616 - RNA, 15 nt, Mycobacterium tuberculosis H37Rv
acggcguccaagaac

SEQ ID NO: 3321617 - RNA, 14 nt, Mycobacterium tuberculosis H37Rv
acggcguccccgac

SEQ ID NO: 3321618 - RNA, 15 nt, Mycobacterium tuberculosis H37Rv
acggcgucggccacc

SEQ ID NO: 3321619 - RNA, 19 nt, Mycobacterium tuberculosis H37Rv
acggcgucggccaccgccu

SEQ ID NO: 3321620 - RNA, 14 nt, Mycobacterium tuberculosis H37Rv
acggcgucugcggu

SEQ ID NO: 3321621 - RNA, 21 nt, Mycobacterium tuberculosis H37Rv
acggcgucuuccucggccacc

SEQ ID NO: 3321622 - RNA, 14 nt, Mycobacterium tuberculosis H37Rv
acggcgucuucgga

SEQ ID NO: 3321623 - RNA, 21 nt, Mycobacterium tuberculosis H37Rv
acggcguugcggaaucagcac

SEQ ID NO: 3321624 - RNA, 16 nt, Mycobacterium tuberculosis H37Rv
acggcguugucgacga

SEQ ID NO: 3321625 - RNA, 17 nt, Mycobacterium tuberculosis H37Rv
acggcguugucgacgaa

SEQ ID NO: 3321626 - RNA, 20 nt, Mycobacterium tuberculosis H37Rv
acggcguuuucaauuucacu

SEQ ID NO: 3321627 - RNA, 13 nt, Mycobacterium tuberculosis H37Rv
acggcuaccaccg

SEQ ID NO: 3321628 - RNA, 23 nt, Mycobacterium tuberculosis H37Rv
acggcuccgggcgcucggucucc

SEQ ID NO: 3321629 - RNA, 13 nt, Mycobacterium tuberculosis H37Rv
acgguuaccgcga

SEQ ID NO: 3321630 - RNA, 14 nt, Mycobacterium tuberculosis H37Rv
acgguuccggucgg

SEQ ID NO: 3321631 - RNA, 23 nt, Mycobacterium tuberculosis H37Rv
acgguuccggucggguuggccgg

SEQ ID NO: 3321632 - RNA, 18 nt, Mycobacterium tuberculosis H37Rv
acgguucgcccgucgcga

SEQ ID NO: 3321633 - RNA, 21 nt, Mycobacterium tuberculosis H37Rv
acgguugaugaucuuggugaa

SEQ ID NO: 3321634 - RNA, 15 nt, Mycobacterium tuberculosis H37Rv
acgguugaugcaucc

SEQ ID NO: 3321635 - RNA, 20 nt, Mycobacterium tuberculosis H37Rv
acgguugccgucagggucag

SEQ ID NO: 3321636 - RNA, 19 nt, Mycobacterium tuberculosis H37Rv
acgguugguccgccgucga

SEQ ID NO: 3321637 - RNA, 22 nt, Mycobacterium tuberculosis H37Rv
acgguugguccgccgucgacca

SEQ ID NO: 3321638 - RNA, 13 nt, Mycobacterium tuberculosis H37Rv
acguaacggucgg

SEQ ID NO: 3321639 - RNA, 16 nt, Mycobacterium tuberculosis H37Rv
acguagaagucgaucg

SEQ ID NO: 3321640 - RNA, 17 nt, Mycobacterium tuberculosis H37Rv
acguagaagucgaucgc

SEQ ID NO: 3321641 - RNA, 17 nt, Mycobacterium tuberculosis H37Rv
acguagacgguccgguc

SEQ ID NO: 3321642 - RNA, 18 nt, Mycobacterium tuberculosis H37Rv
acguagcagcgccggcac

SEQ ID NO: 3321643 - RNA, 15 nt, Mycobacterium tuberculosis H37Rv
acguagcgcccaccg

SEQ ID NO: 3321644 - RNA, 17 nt, Mycobacterium tuberculosis H37Rv
acguaggccaggucgcc

SEQ ID NO: 3321645 - RNA, 15 nt, Mycobacterium tuberculosis H37Rv
acguaggcgcugaag

SEQ ID NO: 3321646 - RNA, 19 nt, Mycobacterium tuberculosis H37Rv
acguaggcggcggcccgca

SEQ ID NO: 3321647 - RNA, 15 nt, Mycobacterium tuberculosis H37Rv
acguagugcaccgcc

SEQ ID NO: 3321648 - RNA, 15 nt, Mycobacterium tuberculosis H37Rv
acguaguggaagccg

SEQ ID NO: 3321649 - RNA, 16 nt, Mycobacterium tuberculosis H37Rv
acguaguggaagccga

SEQ ID NO: 3321650 - RNA, 22 nt, Mycobacterium tuberculosis H37Rv
acguauaucgguugcugcgcga

SEQ ID NO: 3321651 - RNA, 15 nt, Mycobacterium tuberculosis H37Rv
acgucaaacccgaca

SEQ ID NO: 3321652 - RNA, 22 nt, Mycobacterium tuberculosis H37Rv
acgucaccggguccggugaacc

SEQ ID NO: 3321653 - RNA, 21 nt, Mycobacterium tuberculosis H37Rv
acgucacgucgacggcggccg

SEQ ID NO: 3321654 - RNA, 18 nt, Mycobacterium tuberculosis H37Rv
acgucacguggucggcca

SEQ ID NO: 3321655 - RNA, 21 nt, Mycobacterium tuberculosis H37Rv
acgucauaucucgagcccucg

SEQ ID NO: 3321656 - RNA, 14 nt, Mycobacterium tuberculosis H37Rv
acgucaucgccgac

SEQ ID NO: 3321657 - RNA, 20 nt, Mycobacterium tuberculosis H37Rv
acgucaucuggcgcugcugg

SEQ ID NO: 3321658 - RNA, 22 nt, Mycobacterium tuberculosis H37Rv
acgucaucuggcgcugcuggca

SEQ ID NO: 3321659 - RNA, 17 nt, Mycobacterium tuberculosis H37Rv
acguccagggccacgau

SEQ ID NO: 3321660 - RNA, 15 nt, Mycobacterium tuberculosis H37Rv
acguccaucccggcg

SEQ ID NO: 3321661 - RNA, 21 nt, Mycobacterium tuberculosis H37Rv
acgucccagagaaucagcgug

SEQ ID NO: 3321662 - RNA, 17 nt, Mycobacterium tuberculosis H37Rv
acguccgcaaccucgcc

SEQ ID NO: 3321663 - RNA, 15 nt, Mycobacterium tuberculosis H37Rv
acguccgcgccgagc

SEQ ID NO: 3321664 - RNA, 22 nt, Mycobacterium tuberculosis H37Rv
acguccgcgggggaccgcccga

SEQ ID NO: 3321665 - RNA, 18 nt, Mycobacterium tuberculosis H37Rv
acgucgacccccugccac

SEQ ID NO: 3321666 - RNA, 16 nt, Mycobacterium tuberculosis H37Rv
acgucgacggcgaugg

SEQ ID NO: 3321667 - RNA, 17 nt, Mycobacterium tuberculosis H37Rv
acgucgacggcgauggc

SEQ ID NO: 3321668 - RNA, 15 nt, Mycobacterium tuberculosis H37Rv
acgucgacuucgccc

SEQ ID NO: 3321669 - RNA, 18 nt, Mycobacterium tuberculosis H37Rv
acgucgagauccucgucg

SEQ ID NO: 3321670 - RNA, 14 nt, Mycobacterium tuberculosis H37Rv
acgucgagcagccg

SEQ ID NO: 3321671 - RNA, 19 nt, Mycobacterium tuberculosis H37Rv
acgucgagcagccgcgaca

SEQ ID NO: 3321672 - RNA, 15 nt, Mycobacterium tuberculosis H37Rv
acgucgagcaggcug

SEQ ID NO: 3321673 - RNA, 14 nt, Mycobacterium tuberculosis H37Rv
acgucgagguugau

SEQ ID NO: 3321674 - RNA, 19 nt, Mycobacterium tuberculosis H37Rv
acgucgaucucggcgcagg

SEQ ID NO: 3321675 - RNA, 18 nt, Mycobacterium tuberculosis H37Rv
acgucgaugugcgcccaa

SEQ ID NO: 3321676 - RNA, 16 nt, Mycobacterium tuberculosis H37Rv
acgucgcauugugcaa

SEQ ID NO: 3321677 - RNA, 13 nt, Mycobacterium tuberculosis H37Rv
acgucgccgggcg

SEQ ID NO: 3321678 - RNA, 16 nt, Mycobacterium tuberculosis H37Rv
acgucgcgcaucgccu

SEQ ID NO: 3321679 - RNA, 17 nt, Mycobacterium tuberculosis H37Rv
acgucgcgcaucgccuc

SEQ ID NO: 3321680 - RNA, 21 nt, Mycobacterium tuberculosis H37Rv
acgucgcgcaucgccuccucg

SEQ ID NO: 3321681 - RNA, 15 nt, Mycobacterium tuberculosis H37Rv
acgucgcuccgaugu

SEQ ID NO: 3321682 - RNA, 20 nt, Mycobacterium tuberculosis H37Rv
acgucgcuguaggccagccc

SEQ ID NO: 3321683 - RNA, 12 nt, Mycobacterium tuberculosis H37Rv
acgucggcgaau

SEQ ID NO: 3321684 - RNA, 14 nt, Mycobacterium tuberculosis H37Rv
acgucggcgagcaa

SEQ ID NO: 3321685 - RNA, 22 nt, Mycobacterium tuberculosis H37Rv
acgucggcgcguccgcaggcga

SEQ ID NO: 3321686 - RNA, 21 nt, Mycobacterium tuberculosis H37Rv
acgucggucaucgguugaccg

SEQ ID NO: 3321687 - RNA, 15 nt, Mycobacterium tuberculosis H37Rv
acgucggugaagucc

SEQ ID NO: 3321688 - RNA, 18 nt, Mycobacterium tuberculosis H37Rv
acgucgucagccaccgca

SEQ ID NO: 3321689 - RNA, 13 nt, Mycobacterium tuberculosis H37Rv
acgucgucgccgc

SEQ ID NO: 3321690 - RNA, 22 nt, Mycobacterium tuberculosis H37Rv
acgucgucggugcgccacgacc

SEQ ID NO: 3321691 - RNA, 21 nt, Mycobacterium tuberculosis H37Rv
acgucucuggugcaggugagu

SEQ ID NO: 3321692 - RNA, 18 nt, Mycobacterium tuberculosis H37Rv
acgucugcagccucgaug

SEQ ID NO: 3321693 - RNA, 23 nt, Mycobacterium tuberculosis H37Rv
acgucuucgggcucguccagcaa

SEQ ID NO: 3321694 - RNA, 21 nt, Mycobacterium tuberculosis H37Rv
acgugaagccaagcgacucgc

SEQ ID NO: 3321695 - RNA, 19 nt, Mycobacterium tuberculosis H37Rv
acgugaaggcgauggcacc

SEQ ID NO: 3321696 - RNA, 16 nt, Mycobacterium tuberculosis H37Rv
acgugaguuucaccac

SEQ ID NO: 3321697 - RNA, 19 nt, Mycobacterium tuberculosis H37Rv
acgugauguagcugcaggu

SEQ ID NO: 3321698 - RNA, 21 nt, Mycobacterium tuberculosis H37Rv
acgugcaaccacggcggcauc

SEQ ID NO: 3321699 - RNA, 19 nt, Mycobacterium tuberculosis H37Rv
acgugcaaccauggcggcu

SEQ ID NO: 3321700 - RNA, 16 nt, Mycobacterium tuberculosis H37Rv
acgugcacggcgaggu

SEQ ID NO: 3321701 - RNA, 17 nt, Mycobacterium tuberculosis H37Rv
acgugcacggucaacga

SEQ ID NO: 3321702 - RNA, 19 nt, Mycobacterium tuberculosis H37Rv
acgugcaggaacacccaua

SEQ ID NO: 3321703 - RNA, 15 nt, Mycobacterium tuberculosis H37Rv
acgugcaucugugag

SEQ ID NO: 3321704 - RNA, 18 nt, Mycobacterium tuberculosis H37Rv
acgugcaugagcguucag

SEQ ID NO: 3321705 - RNA, 14 nt, Mycobacterium tuberculosis H37Rv
acgugccuuccucg

SEQ ID NO: 3321706 - RNA, 16 nt, Mycobacterium tuberculosis H37Rv
acgugcgagcccaccu

SEQ ID NO: 3321707 - RNA, 21 nt, Mycobacterium tuberculosis H37Rv
acgugcgagggcacggcggug

SEQ ID NO: 3321708 - RNA, 20 nt, Mycobacterium tuberculosis H37Rv
acgugcucguagacuugcug

SEQ ID NO: 3321709 - RNA, 21 nt, Mycobacterium tuberculosis H37Rv
acgugcucguagacuugcugc

SEQ ID NO: 3321710 - RNA, 19 nt, Mycobacterium tuberculosis H37Rv
acguggacugaccucguca

SEQ ID NO: 3321711 - RNA, 18 nt, Mycobacterium tuberculosis H37Rv
acguggaucaccaugugg

SEQ ID NO: 3321712 - RNA, 17 nt, Mycobacterium tuberculosis H37Rv
acguggccauccucgag

SEQ ID NO: 3321713 - RNA, 17 nt, Mycobacterium tuberculosis H37Rv
acguggcccuccucggu

SEQ ID NO: 3321714 - RNA, 18 nt, Mycobacterium tuberculosis H37Rv
acguggcgaccggcgacc

SEQ ID NO: 3321715 - RNA, 22 nt, Mycobacterium tuberculosis H37Rv
acguggcuugaguuucggcgca

SEQ ID NO: 3321716 - RNA, 14 nt, Mycobacterium tuberculosis H37Rv
acgugggccaugcu

SEQ ID NO: 3321717 - RNA, 21 nt, Mycobacterium tuberculosis H37Rv
acguggggccggggucggccc

SEQ ID NO: 3321718 - RNA, 19 nt, Mycobacterium tuberculosis H37Rv
acguggguacgcaucucga

SEQ ID NO: 3321719 - RNA, 18 nt, Mycobacterium tuberculosis H37Rv
acguggucggagcgggug

SEQ ID NO: 3321720 - RNA, 14 nt, Mycobacterium tuberculosis H37Rv
acguggucggccac

SEQ ID NO: 3321721 - RNA, 18 nt, Mycobacterium tuberculosis H37Rv
acgugguggaccucacug

SEQ ID NO: 3321722 - RNA, 23 nt, Mycobacterium tuberculosis H37Rv
acgugguugccccgcagcaucgc

SEQ ID NO: 3321723 - RNA, 15 nt, Mycobacterium tuberculosis H37Rv
acgugucaucacggu

SEQ ID NO: 3321724 - RNA, 18 nt, Mycobacterium tuberculosis H37Rv
acgugugcaccaucauca

SEQ ID NO: 3321725 - RNA, 22 nt, Mycobacterium tuberculosis H37Rv
acuccugcagcccgggcagcac

SEQ ID NO: 3321726 - RNA, 17 nt, Mycobacterium tuberculosis H37Rv
acuccugcggcaccgcu

SEQ ID NO: 3321727 - RNA, 17 nt, Mycobacterium tuberculosis H37Rv
acucgaacaaccccggu

SEQ ID NO: 3321728 - RNA, 13 nt, Mycobacterium tuberculosis H37Rv
acucgaagcggug

SEQ ID NO: 3321729 - RNA, 18 nt, Mycobacterium tuberculosis H37Rv
acucgacaauucgcagcc

SEQ ID NO: 3321730 - RNA, 16 nt, Mycobacterium tuberculosis H37Rv
acucgaccaccgccgg

SEQ ID NO: 3321731 - RNA, 19 nt, Mycobacterium tuberculosis H37Rv
acucgaccaccgccggccc

SEQ ID NO: 3321732 - RNA, 13 nt, Mycobacterium tuberculosis H37Rv
acucgaccgacug

SEQ ID NO: 3321733 - RNA, 12 nt, Mycobacterium tuberculosis H37Rv
acucgaccgcga

SEQ ID NO: 3321734 - RNA, 23 nt, Mycobacterium tuberculosis H37Rv
acucgacguaagugugcccugcu

SEQ ID NO: 3321735 - RNA, 18 nt, Mycobacterium tuberculosis H37Rv
acucgaggaccugcucgg

SEQ ID NO: 3321736 - RNA, 20 nt, Mycobacterium tuberculosis H37Rv
acucgaguagucgcuggcca

SEQ ID NO: 3321737 - RNA, 19 nt, Mycobacterium tuberculosis H37Rv
acucgauauaacccggcuc

SEQ ID NO: 3321738 - RNA, 17 nt, Mycobacterium tuberculosis H37Rv
acucgauaugcagcucg

SEQ ID NO: 3321739 - RNA, 14 nt, Mycobacterium tuberculosis H37Rv
acucgaucgccuga

SEQ ID NO: 3321740 - RNA, 16 nt, Mycobacterium tuberculosis H37Rv
acucgccgaaaucggc

SEQ ID NO: 3321741 - RNA, 18 nt, Mycobacterium tuberculosis H37Rv
acucgccgacgucgacgc

SEQ ID NO: 3321742 - RNA, 21 nt, Mycobacterium tuberculosis H37Rv
acucgccgucauagcaggccu

SEQ ID NO: 3321743 - RNA, 22 nt, Mycobacterium tuberculosis H37Rv
acucgccugcacccggcgauug

SEQ ID NO: 3321744 - RNA, 12 nt, Mycobacterium tuberculosis H37Rv
acucgcgcagga

SEQ ID NO: 3321745 - RNA, 22 nt, Mycobacterium tuberculosis H37Rv
acucgcggccggcgucggcguc

SEQ ID NO: 3321746 - RNA, 18 nt, Mycobacterium tuberculosis H37Rv
acucggacccacccuggu

SEQ ID NO: 3321747 - RNA, 18 nt, Mycobacterium tuberculosis H37Rv
acucggccgacgagaucg

SEQ ID NO: 3321748 - RNA, 16 nt, Mycobacterium tuberculosis H37Rv
acucggccgggcucua

SEQ ID NO: 3321749 - RNA, 15 nt, Mycobacterium tuberculosis H37Rv
acucggcgacugcgu

SEQ ID NO: 3321750 - RNA, 14 nt, Mycobacterium tuberculosis H37Rv
acucggcggccacc

SEQ ID NO: 3321751 - RNA, 21 nt, Mycobacterium tuberculosis H37Rv
acucggcggccagcgagauca

SEQ ID NO: 3321752 - RNA, 16 nt, Mycobacterium tuberculosis H37Rv
acucggcggccagcgc

SEQ ID NO: 3321753 - RNA, 15 nt, Mycobacterium tuberculosis H37Rv
acucgggcacgggug

SEQ ID NO: 3321754 - RNA, 15 nt, Mycobacterium tuberculosis H37Rv
acucgggcgacugga

SEQ ID NO: 3321755 - RNA, 19 nt, Mycobacterium tuberculosis H37Rv
acucgggggcugcacgcuc

SEQ ID NO: 3321756 - RNA, 19 nt, Mycobacterium tuberculosis H37Rv
acucggucucauagugcag

SEQ ID NO: 3321757 - RNA, 20 nt, Mycobacterium tuberculosis H37Rv
acucggucucauagugcagg

SEQ ID NO: 3321758 - RNA, 15 nt, Mycobacterium tuberculosis H37Rv
acucggucucgaucc

SEQ ID NO: 3321759 - RNA, 22 nt, Mycobacterium tuberculosis H37Rv
acucggugauguagggcugcuc

SEQ ID NO: 3321760 - RNA, 22 nt, Mycobacterium tuberculosis H37Rv
acucguccaacugaaccgagug

SEQ ID NO: 3321761 - RNA, 20 nt, Mycobacterium tuberculosis H37Rv
acucguggcgccacggcagc

SEQ ID NO: 3321762 - RNA, 19 nt, Mycobacterium tuberculosis H37Rv
acucguucauguagcagcg

SEQ ID NO: 3321763 - RNA, 19 nt, Mycobacterium tuberculosis H37Rv
acucguugccgaccaugca

SEQ ID NO: 3321764 - RNA, 20 nt, Mycobacterium tuberculosis H37Rv
acucuaggguuugcagcgau

SEQ ID NO: 3321765 - RNA, 17 nt, Mycobacterium tuberculosis H37Rv
acucucgcgacaucacc

SEQ ID NO: 3321766 - RNA, 16 nt, Mycobacterium tuberculosis H37Rv
acucugcguccaccac

SEQ ID NO: 3321767 - RNA, 20 nt, Mycobacterium tuberculosis H37Rv
acucuguggugucgauuggc

SEQ ID NO: 3321768 - RNA, 19 nt, Mycobacterium tuberculosis H37Rv
acucuguuuuuggugggca

SEQ ID NO: 3321769 - RNA, 22 nt, Mycobacterium tuberculosis H37Rv
acugaacgguuucuuucggcag

SEQ ID NO: 3321770 - RNA, 15 nt, Mycobacterium tuberculosis H37Rv
acugaauuuggugaa

SEQ ID NO: 3321771 - RNA, 21 nt, Mycobacterium tuberculosis H37Rv
acugaauuuggugaagccgua

SEQ ID NO: 3321772 - RNA, 14 nt, Mycobacterium tuberculosis H37Rv
acugaccaggucug

SEQ ID NO: 3321773 - RNA, 14 nt, Mycobacterium tuberculosis H37Rv
acugacccugaucg

SEQ ID NO: 3321774 - RNA, 17 nt, Mycobacterium tuberculosis H37Rv
acugaccgucugcgacc

SEQ ID NO: 3321775 - RNA, 23 nt, Mycobacterium tuberculosis H37Rv
acugaccucgucaaucaccaccg

SEQ ID NO: 3321776 - RNA, 15 nt, Mycobacterium tuberculosis H37Rv
acugacgucgaacuc

SEQ ID NO: 3321777 - RNA, 18 nt, Mycobacterium tuberculosis H37Rv
acugacguuaccgccgca

SEQ ID NO: 3321778 - RNA, 17 nt, Mycobacterium tuberculosis H37Rv
acugagaucgcuucccg

SEQ ID NO: 3321779 - RNA, 15 nt, Mycobacterium tuberculosis H37Rv
acugagccacaggga

SEQ ID NO: 3321780 - RNA, 20 nt, Mycobacterium tuberculosis H37Rv
acugaggaaagucaccgucc

SEQ ID NO: 3321781 - RNA, 17 nt, Mycobacterium tuberculosis H37Rv
acugaggcucaggugcu

SEQ ID NO: 3321782 - RNA, 20 nt, Mycobacterium tuberculosis H37Rv
acugaucgaccgccuccucg

SEQ ID NO: 3321783 - RNA, 20 nt, Mycobacterium tuberculosis H37Rv
acugaucgccacccgguccc

SEQ ID NO: 3321784 - RNA, 19 nt, Mycobacterium tuberculosis H37Rv
acugaucguuggcaucggc

SEQ ID NO: 3321785 - RNA, 14 nt, Mycobacterium tuberculosis H37Rv
acugaugucgccga

SEQ ID NO: 3321786 - RNA, 17 nt, Mycobacterium tuberculosis H37Rv
acugcaacucuucccau

SEQ ID NO: 3321787 - RNA, 17 nt, Mycobacterium tuberculosis H37Rv
acugcacaccaccgccg

SEQ ID NO: 3321788 - RNA, 22 nt, Mycobacterium tuberculosis H37Rv
acugcagcgccucgauccgcau

SEQ ID NO: 3321789 - RNA, 13 nt, Mycobacterium tuberculosis H37Rv
acugcagcgcggc

SEQ ID NO: 3321790 - RNA, 13 nt, Mycobacterium tuberculosis H37Rv
acugcagcgcggu

SEQ ID NO: 3321791 - RNA, 24 nt, Mycobacterium tuberculosis H37Rv
acugcagugccguguccagcaugc

SEQ ID NO: 3321792 - RNA, 18 nt, Mycobacterium tuberculosis H37Rv
acugcaugguggcgccga

SEQ ID NO: 3321793 - RNA, 12 nt, Mycobacterium tuberculosis H37Rv
acugccacuccu

SEQ ID NO: 3321794 - RNA, 18 nt, Mycobacterium tuberculosis H37Rv
acugccccgcaucgccca

SEQ ID NO: 3321795 - RNA, 22 nt, Mycobacterium tuberculosis H37Rv
acugcccgcguuugcgaagccc

SEQ ID NO: 3321796 - RNA, 23 nt, Mycobacterium tuberculosis H37Rv
acugcccucgcuaauugcggccg

SEQ ID NO: 3321797 - RNA, 19 nt, Mycobacterium tuberculosis H37Rv
acugcccugauugaagccc

SEQ ID NO: 3321798 - RNA, 16 nt, Mycobacterium tuberculosis H37Rv
acugccgcgcucgcgc

SEQ ID NO: 3321799 - RNA, 17 nt, Mycobacterium tuberculosis H37Rv
acugccgcggcaccgcc

SEQ ID NO: 3321800 - RNA, 21 nt, Mycobacterium tuberculosis H37Rv
acugccgcggcaccgccccgc

SEQ ID NO: 3321801 - RNA, 19 nt, Mycobacterium tuberculosis H37Rv
acugccggacagccacgca

SEQ ID NO: 3321802 - RNA, 22 nt, Mycobacterium tuberculosis H37Rv
acugccggcagcgcccccggac

SEQ ID NO: 3321803 - RNA, 17 nt, Mycobacterium tuberculosis H37Rv
acugccguugccgccgg

SEQ ID NO: 3321804 - RNA, 21 nt, Mycobacterium tuberculosis H37Rv
acugcgaagaguccuuaaacg

SEQ ID NO: 3321805 - RNA, 24 nt, Mycobacterium tuberculosis H37Rv
acugcgaaggaccagagcucgaag

SEQ ID NO: 3321806 - RNA, 14 nt, Mycobacterium tuberculosis H37Rv
acugcgaaucucgu

SEQ ID NO: 3321807 - RNA, 15 nt, Mycobacterium tuberculosis H37Rv
acugcgaaugcuggg

SEQ ID NO: 3321808 - RNA, 17 nt, Mycobacterium tuberculosis H37Rv
acugcgaaugcugggcc

SEQ ID NO: 3321809 - RNA, 17 nt, Mycobacterium tuberculosis H37Rv
acugcgcaccugggucg

SEQ ID NO: 3321810 - RNA, 16 nt, Mycobacterium tuberculosis H37Rv
acugcgcccgccacgu

SEQ ID NO: 3321811 - RNA, 13 nt, Mycobacterium tuberculosis H37Rv
acugcgccgccgg

SEQ ID NO: 3321812 - RNA, 13 nt, Mycobacterium tuberculosis H37Rv
acugcgccguucg

SEQ ID NO: 3321813 - RNA, 14 nt, Mycobacterium tuberculosis H37Rv
acugcgccguucgc

SEQ ID NO: 3321814 - RNA, 18 nt, Mycobacterium tuberculosis H37Rv
acugcgccguucgcuccc

SEQ ID NO: 3321815 - RNA, 19 nt, Mycobacterium tuberculosis H37Rv
acugcggcccgacccggcc

SEQ ID NO: 3321816 - RNA, 15 nt, Mycobacterium tuberculosis H37Rv
acugcggccugcucg

SEQ ID NO: 3321817 - RNA, 21 nt, Mycobacterium tuberculosis H37Rv
acugcggcgcugggacggucg

SEQ ID NO: 3321818 - RNA, 18 nt, Mycobacterium tuberculosis H37Rv
acugcguaguugauggcc

SEQ ID NO: 3321819 - RNA, 21 nt, Mycobacterium tuberculosis H37Rv
acugcguuccaucgccgacgc

SEQ ID NO: 3321820 - RNA, 15 nt, Mycobacterium tuberculosis H37Rv
acugcucgccggacg

SEQ ID NO: 3321821 - RNA, 13 nt, Mycobacterium tuberculosis H37Rv
agaacaccaccgc

SEQ ID NO: 3321822 - RNA, 16 nt, Mycobacterium tuberculosis H37Rv
agaacaccaccgccag

SEQ ID NO: 3321823 - RNA, 22 nt, Mycobacterium tuberculosis H37Rv
agaaccgccaccagaccaggaa

SEQ ID NO: 3321824 - RNA, 18 nt, Mycobacterium tuberculosis H37Rv
agaaccggguaaugcgac

SEQ ID NO: 3321825 - RNA, 23 nt, Mycobacterium tuberculosis H37Rv
agaaccggguaaugcgacgccgg

SEQ ID NO: 3321826 - RNA, 19 nt, Mycobacterium tuberculosis H37Rv
agaaccggucgcagugcac

SEQ ID NO: 3321827 - RNA, 15 nt, Mycobacterium tuberculosis H37Rv
agaacgacgccaccg

SEQ ID NO: 3321828 - RNA, 18 nt, Mycobacterium tuberculosis H37Rv
agaacgcccgcugcagac

SEQ ID NO: 3321829 - RNA, 20 nt, Mycobacterium tuberculosis H37Rv
agaacgcggccucgucgagu

SEQ ID NO: 3321830 - RNA, 14 nt, Mycobacterium tuberculosis H37Rv
agaacggcgggcga

SEQ ID NO: 3321831 - RNA, 15 nt, Mycobacterium tuberculosis H37Rv
agaacguagcgccca

SEQ ID NO: 3321832 - RNA, 19 nt, Mycobacterium tuberculosis H37Rv
agaacguaggguggccggu

SEQ ID NO: 3321833 - RNA, 18 nt, Mycobacterium tuberculosis H37Rv
agaacguggccguuaauu

SEQ ID NO: 3321834 - RNA, 20 nt, Mycobacterium tuberculosis H37Rv
agaacguuuucgucacccca

SEQ ID NO: 3321835 - RNA, 15 nt, Mycobacterium tuberculosis H37Rv
agaacuccgccacca

SEQ ID NO: 3321836 - RNA, 16 nt, Mycobacterium tuberculosis H37Rv
agaacuccgccaccau

SEQ ID NO: 3321837 - RNA, 13 nt, Mycobacterium tuberculosis H37Rv
agaacucggcguc

SEQ ID NO: 3321838 - RNA, 22 nt, Mycobacterium tuberculosis H37Rv
agaacucggcgucgugguggcc

SEQ ID NO: 3321839 - RNA, 19 nt, Mycobacterium tuberculosis H37Rv
agaacucguugagcagcug

SEQ ID NO: 3321840 - RNA, 15 nt, Mycobacterium tuberculosis H37Rv
agaagaacucggcgu

SEQ ID NO: 3321841 - RNA, 15 nt, Mycobacterium tuberculosis H37Rv
agaagaagcccagga

SEQ ID NO: 3321842 - RNA, 15 nt, Mycobacterium tuberculosis H37Rv
agaagacaccgcgcu

SEQ ID NO: 3321843 - RNA, 22 nt, Mycobacterium tuberculosis H37Rv
agaagcccaggacggcuaccac

SEQ ID NO: 3321844 - RNA, 15 nt, Mycobacterium tuberculosis H37Rv
agaagcccgaagacg

SEQ ID NO: 3321845 - RNA, 15 nt, Mycobacterium tuberculosis H37Rv
agaagccggccacua

SEQ ID NO: 3321846 - RNA, 14 nt, Mycobacterium tuberculosis H37Rv
agaagcgcuccagc

SEQ ID NO: 3321847 - RNA, 15 nt, Mycobacterium tuberculosis H37Rv
agaaggcgcgggcga

SEQ ID NO: 3321848 - RNA, 21 nt, Mycobacterium tuberculosis H37Rv
agaagucgaucgccgaggcag

SEQ ID NO: 3321849 - RNA, 19 nt, Mycobacterium tuberculosis H37Rv
agaaguuagccaccuugga

SEQ ID NO: 3321850 - RNA, 18 nt, Mycobacterium tuberculosis H37Rv
agaaguucuucgcgaaga

SEQ ID NO: 3321851 - RNA, 14 nt, Mycobacterium tuberculosis H37Rv
agaaucagcagcag

SEQ ID NO: 3321852 - RNA, 22 nt, Mycobacterium tuberculosis H37Rv
agaaucccgggcucugcugcca

SEQ ID NO: 3321853 - RNA, 20 nt, Mycobacterium tuberculosis H37Rv
agaaucgcacgaaaucagcc

SEQ ID NO: 3321854 - RNA, 23 nt, Mycobacterium tuberculosis H37Rv
agaaucgcccaauuucgugccga

SEQ ID NO: 3321855 - RNA, 16 nt, Mycobacterium tuberculosis H37Rv
agaaucggcucagcaa

SEQ ID NO: 3321856 - RNA, 22 nt, Mycobacterium tuberculosis H37Rv
agaaugacaucgucgccagggc

SEQ ID NO: 3321857 - RNA, 18 nt, Mycobacterium tuberculosis H37Rv
agaauuccccagccgcau

SEQ ID NO: 3321858 - RNA, 13 nt, Mycobacterium tuberculosis H37Rv
agacaaaggugcc

SEQ ID NO: 3321859 - RNA, 13 nt, Mycobacterium tuberculosis H37Rv
agacaacaacacg

SEQ ID NO: 3321860 - RNA, 15 nt, Mycobacterium tuberculosis H37Rv
agacaacagucgaca

SEQ ID NO: 3321861 - RNA, 23 nt, Mycobacterium tuberculosis H37Rv
agacaccggcgucgaaggugacc

SEQ ID NO: 3321862 - RNA, 20 nt, Mycobacterium tuberculosis H37Rv
agacaccggcuauaucccgc

SEQ ID NO: 3321863 - RNA, 22 nt, Mycobacterium tuberculosis H37Rv
agacacgcccuaacccugcccu

SEQ ID NO: 3321864 - RNA, 18 nt, Mycobacterium tuberculosis H37Rv
agacacggcagcugcaau

SEQ ID NO: 3321865 - RNA, 17 nt, Mycobacterium tuberculosis H37Rv
agacagcgccaugcccu

SEQ ID NO: 3321866 - RNA, 19 nt, Mycobacterium tuberculosis H37Rv
agacagcgccaugcccucg

SEQ ID NO: 3321867 - RNA, 12 nt, Mycobacterium tuberculosis H37Rv
agacagcgcggg

SEQ ID NO: 3321868 - RNA, 19 nt, Mycobacterium tuberculosis H37Rv
agacaggcggcggccuggc

SEQ ID NO: 3321869 - RNA, 14 nt, Mycobacterium tuberculosis H37Rv
agacaucgcgacga

SEQ ID NO: 3321870 - RNA, 20 nt, Mycobacterium tuberculosis H37Rv
agacaugccggcgagggcgc

SEQ ID NO: 3321871 - RNA, 13 nt, Mycobacterium tuberculosis H37Rv
agacaugggugaa

SEQ ID NO: 3321872 - RNA, 19 nt, Mycobacterium tuberculosis H37Rv
agaccaacauacagcaauc

SEQ ID NO: 3321873 - RNA, 21 nt, Mycobacterium tuberculosis H37Rv
agaccaagagcgcgcagcagu

SEQ ID NO: 3321874 - RNA, 11 nt, Mycobacterium tuberculosis H37Rv
agaccaagucc

SEQ ID NO: 3321875 - RNA, 17 nt, Mycobacterium tuberculosis H37Rv
agaccaagugucgccgc

SEQ ID NO: 3321876 - RNA, 18 nt, Mycobacterium tuberculosis H37Rv
agaccaaugaccgccagc

SEQ ID NO: 3321877 - RNA, 17 nt, Mycobacterium tuberculosis H37Rv
agaccagggcagcggcc

SEQ ID NO: 3321878 - RNA, 18 nt, Mycobacterium tuberculosis H37Rv
agaccagggcagcggcca

SEQ ID NO: 3321879 - RNA, 23 nt, Mycobacterium tuberculosis H37Rv
agaccaugaagaacuggcugcug

SEQ ID NO: 3321880 - RNA, 17 nt, Mycobacterium tuberculosis H37Rv
agaccauggucauguuc

SEQ ID NO: 3321881 - RNA, 13 nt, Mycobacterium tuberculosis H37Rv
agacccaccaccg

SEQ ID NO: 3321882 - RNA, 12 nt, Mycobacterium tuberculosis H37Rv
agacccacgaug

SEQ ID NO: 3321883 - RNA, 16 nt, Mycobacterium tuberculosis H37Rv
agacccgggccaguuc

SEQ ID NO: 3321884 - RNA, 14 nt, Mycobacterium tuberculosis H37Rv
agacccguccggag

SEQ ID NO: 3321885 - RNA, 21 nt, Mycobacterium tuberculosis H37Rv
agacccugggguccagcgucc

SEQ ID NO: 3321886 - RNA, 15 nt, Mycobacterium tuberculosis H37Rv
agaccgaacagcacc

SEQ ID NO: 3321887 - RNA, 20 nt, Mycobacterium tuberculosis H37Rv
agaccgaacagcaccgaacc

SEQ ID NO: 3321888 - RNA, 13 nt, Mycobacterium tuberculosis H37Rv
agaccgaacagcg

SEQ ID NO: 3321889 - RNA, 15 nt, Mycobacterium tuberculosis H37Rv
agaccgaacagcggc

SEQ ID NO: 3321890 - RNA, 17 nt, Mycobacterium tuberculosis H37Rv
agaccgacagcggcacc

SEQ ID NO: 3321891 - RNA, 13 nt, Mycobacterium tuberculosis H37Rv
agaccgcagucgc

SEQ ID NO: 3321892 - RNA, 15 nt, Mycobacterium tuberculosis H37Rv
agaccgcagucgcug

SEQ ID NO: 3321893 - RNA, 12 nt, Mycobacterium tuberculosis H37Rv
agaccgccgcug

SEQ ID NO: 3321894 - RNA, 15 nt, Mycobacterium tuberculosis H37Rv
agaccgccgcugccg

SEQ ID NO: 3321895 - RNA, 14 nt, Mycobacterium tuberculosis H37Rv
agaccgcggccggc

SEQ ID NO: 3321896 - RNA, 21 nt, Mycobacterium tuberculosis H37Rv
agaccgcgugcucgagcaccu

SEQ ID NO: 3321897 - RNA, 23 nt, Mycobacterium tuberculosis H37Rv
agaccgcuacccgcgcgaccuga

SEQ ID NO: 3321898 - RNA, 15 nt, Mycobacterium tuberculosis H37Rv
agaccgggcaacggc

SEQ ID NO: 3321899 - RNA, 21 nt, Mycobacterium tuberculosis H37Rv
agaccgggugggucguucacc

SEQ ID NO: 3321900 - RNA, 14 nt, Mycobacterium tuberculosis H37Rv
agaccguccagcaa

SEQ ID NO: 3321901 - RNA, 21 nt, Mycobacterium tuberculosis H37Rv
agaccucggcgugucugcccg

SEQ ID NO: 3321902 - RNA, 18 nt, Mycobacterium tuberculosis H37Rv
agaccuggccugcggcag

SEQ ID NO: 3321903 - RNA, 16 nt, Mycobacterium tuberculosis H37Rv
agaccuguccggcaua

SEQ ID NO: 3321904 - RNA, 16 nt, Mycobacterium tuberculosis H37Rv
agaccuucucgccgcc

SEQ ID NO: 3321905 - RNA, 16 nt, Mycobacterium tuberculosis H37Rv
agacgacaucgucauc

SEQ ID NO: 3321906 - RNA, 21 nt, Mycobacterium tuberculosis H37Rv
agacgacaucgucaucagcgc

SEQ ID NO: 3321907 - RNA, 15 nt, Mycobacterium tuberculosis H37Rv
agacgacgaucagcc

SEQ ID NO: 3321908 - RNA, 16 nt, Mycobacterium tuberculosis H37Rv
agacgaucgccaggcc

SEQ ID NO: 3321909 - RNA, 20 nt, Mycobacterium tuberculosis H37Rv
agacgcaaaaagcuccaaau

SEQ ID NO: 3321910 - RNA, 20 nt, Mycobacterium tuberculosis H37Rv
agacgcaaaagcuccuaaau

SEQ ID NO: 3321911 - RNA, 20 nt, Mycobacterium tuberculosis H37Rv
agacgcaaaaucgcccaauu

SEQ ID NO: 3321912 - RNA, 20 nt, Mycobacterium tuberculosis H37Rv
agacgcacggccaccgcgca

SEQ ID NO: 3321913 - RNA, 22 nt, Mycobacterium tuberculosis H37Rv
agacgcacggccaccgcgcaac

SEQ ID NO: 3321914 - RNA, 20 nt, Mycobacterium tuberculosis H37Rv
agacgcagaaucgcccaauu

SEQ ID NO: 3321915 - RNA, 14 nt, Mycobacterium tuberculosis H37Rv
agacgcagagucgc

SEQ ID NO: 3321916 - RNA, 20 nt, Mycobacterium tuberculosis H37Rv
agacgcaugucgggccaggc

SEQ ID NO: 3321917 - RNA, 16 nt, Mycobacterium tuberculosis H37Rv
agaucgagaucaccuu

SEQ ID NO: 3321918 - RNA, 12 nt, Mycobacterium tuberculosis H37Rv
agaucgccccag

SEQ ID NO: 3321919 - RNA, 17 nt, Mycobacterium tuberculosis H37Rv
agaucgcccgaguugaa

SEQ ID NO: 3321920 - RNA, 19 nt, Mycobacterium tuberculosis H37Rv
agaucgccucgacgcggca

SEQ ID NO: 3321921 - RNA, 13 nt, Mycobacterium tuberculosis H37Rv
agaucgcgcccug

SEQ ID NO: 3321922 - RNA, 17 nt, Mycobacterium tuberculosis H37Rv
agaucgcgcccugcgga

SEQ ID NO: 3321923 - RNA, 19 nt, Mycobacterium tuberculosis H37Rv
agaucgcgugccacagcau

SEQ ID NO: 3321924 - RNA, 14 nt, Mycobacterium tuberculosis H37Rv
agaucgcugcgaag

SEQ ID NO: 3321925 - RNA, 20 nt, Mycobacterium tuberculosis H37Rv
agaucggcagcguggacauc

SEQ ID NO: 3321926 - RNA, 21 nt, Mycobacterium tuberculosis H37Rv
agaucggccggauacgggcug

SEQ ID NO: 3321927 - RNA, 22 nt, Mycobacterium tuberculosis H37Rv
agaucguuccaggccgcgucga

SEQ ID NO: 3321928 - RNA, 21 nt, Mycobacterium tuberculosis H37Rv
agaucguugccucgucgccgc

SEQ ID NO: 3321929 - RNA, 19 nt, Mycobacterium tuberculosis H37Rv
agaucuccccgaccgcgcc

SEQ ID NO: 3321930 - RNA, 19 nt, Mycobacterium tuberculosis H37Rv
agaucucgcgggcccgcgc

SEQ ID NO: 3321931 - RNA, 22 nt, Mycobacterium tuberculosis H37Rv
agaucucugagcgggcgggccu

SEQ ID NO: 3321932 - RNA, 16 nt, Mycobacterium tuberculosis H37Rv
agaucugggcuggcag

SEQ ID NO: 3321933 - RNA, 14 nt, Mycobacterium tuberculosis H37Rv
agaucuggguuccc

SEQ ID NO: 3321934 - RNA, 23 nt, Mycobacterium tuberculosis H37Rv
agaucuucaccggccggugccag

SEQ ID NO: 3321935 - RNA, 20 nt, Mycobacterium tuberculosis H37Rv
agaucuugcagugcgccagc

SEQ ID NO: 3321936 - RNA, 13 nt, Mycobacterium tuberculosis H37Rv
agaucuugcgcaa

SEQ ID NO: 3321937 - RNA, 18 nt, Mycobacterium tuberculosis H37Rv
agaucuuuucaccaccuc

SEQ ID NO: 3321938 - RNA, 20 nt, Mycobacterium tuberculosis H37Rv
agaugaagcaguugccgcgg

SEQ ID NO: 3321939 - RNA, 13 nt, Mycobacterium tuberculosis H37Rv
agaugaaggugac

SEQ ID NO: 3321940 - RNA, 14 nt, Mycobacterium tuberculosis H37Rv
agaugaaggugacg

SEQ ID NO: 3321941 - RNA, 23 nt, Mycobacterium tuberculosis H37Rv
agaugacgguggugacgucgagg

SEQ ID NO: 3321942 - RNA, 20 nt, Mycobacterium tuberculosis H37Rv
agaugaucgcgaacaucgcc

SEQ ID NO: 3321943 - RNA, 15 nt, Mycobacterium tuberculosis H37Rv
agaugauuucgccga

SEQ ID NO: 3321944 - RNA, 17 nt, Mycobacterium tuberculosis H37Rv
agaugauuucgccgagc

SEQ ID NO: 3321945 - RNA, 16 nt, Mycobacterium tuberculosis H37Rv
agaugcacaggccgac

SEQ ID NO: 3321946 - RNA, 13 nt, Mycobacterium tuberculosis H37Rv
agaugcagcgguc

SEQ ID NO: 3321947 - RNA, 16 nt, Mycobacterium tuberculosis H37Rv
agaugcauccagcugc

SEQ ID NO: 3321948 - RNA, 16 nt, Mycobacterium tuberculosis H37Rv
agaugcggaacgccga

SEQ ID NO: 3321949 - RNA, 16 nt, Mycobacterium tuberculosis H37Rv
agaugcguuccgcgac

SEQ ID NO: 3321950 - RNA, 12 nt, Mycobacterium tuberculosis H37Rv
agauggaauggc

SEQ ID NO: 3321951 - RNA, 19 nt, Mycobacterium tuberculosis H37Rv
agauggcauugcgcccacc

SEQ ID NO: 3321952 - RNA, 14 nt, Mycobacterium tuberculosis H37Rv
agauggcccgucgu

SEQ ID NO: 3321953 - RNA, 13 nt, Mycobacterium tuberculosis H37Rv
agauggcgaucau

SEQ ID NO: 3321954 - RNA, 21 nt, Mycobacterium tuberculosis H37Rv
agauggcgaucaugagcagca

SEQ ID NO: 3321955 - RNA, 22 nt, Mycobacterium tuberculosis H37Rv
agauggcgaucaugagcagcac

SEQ ID NO: 3321956 - RNA, 18 nt, Mycobacterium tuberculosis H37Rv
agauggcgcgcugggcug

SEQ ID NO: 3321957 - RNA, 13 nt, Mycobacterium tuberculosis H37Rv
agaugggccaccc

SEQ ID NO: 3321958 - RNA, 14 nt, Mycobacterium tuberculosis H37Rv
agaugggccacccg

SEQ ID NO: 3321959 - RNA, 19 nt, Mycobacterium tuberculosis H37Rv
agauggugguggcccggcu

SEQ ID NO: 3321960 - RNA, 21 nt, Mycobacterium tuberculosis H37Rv
agauguaccucaucgcagacg

SEQ ID NO: 3321961 - RNA, 16 nt, Mycobacterium tuberculosis H37Rv
agaugugguaccagcc

SEQ ID NO: 3321962 - RNA, 19 nt, Mycobacterium tuberculosis H37Rv
agauguugcgacggccggc

SEQ ID NO: 3321963 - RNA, 20 nt, Mycobacterium tuberculosis H37Rv
agauguuguacggcccgcau

SEQ ID NO: 3321964 - RNA, 14 nt, Mycobacterium tuberculosis H37Rv
agauucauuggccu

SEQ ID NO: 3321965 - RNA, 11 nt, Mycobacterium tuberculosis H37Rv
agauucccggc

SEQ ID NO: 3321966 - RNA, 13 nt, Mycobacterium tuberculosis H37Rv
agauugccgagcc

SEQ ID NO: 3321967 - RNA, 18 nt, Mycobacterium tuberculosis H37Rv
agauugccgguuuugccg

SEQ ID NO: 3321968 - RNA, 13 nt, Mycobacterium tuberculosis H37Rv
agauugcugacga

SEQ ID NO: 3321969 - RNA, 12 nt, Mycobacterium tuberculosis H37Rv
agauuucgucgc

SEQ ID NO: 3321970 - RNA, 15 nt, Mycobacterium tuberculosis H37Rv
agcaaaaacauugcu

SEQ ID NO: 3321971 - RNA, 18 nt, Mycobacterium tuberculosis H37Rv
agcaaaaaccagcgucca

SEQ ID NO: 3321972 - RNA, 16 nt, Mycobacterium tuberculosis H37Rv
agcaaaccagauugcc

SEQ ID NO: 3321973 - RNA, 12 nt, Mycobacterium tuberculosis H37Rv
agcaaaccgcgc

SEQ ID NO: 3321974 - RNA, 22 nt, Mycobacterium tuberculosis H37Rv
agcaaaccgcgcagaacgaucg

SEQ ID NO: 3321975 - RNA, 13 nt, Mycobacterium tuberculosis H37Rv
agcaaagccagcg

SEQ ID NO: 3321976 - RNA, 16 nt, Mycobacterium tuberculosis H37Rv
agcaaagccagcgcag

SEQ ID NO: 3321977 - RNA, 20 nt, Mycobacterium tuberculosis H37Rv
agcaaaggggugugugcugc

SEQ ID NO: 3321978 - RNA, 16 nt, Mycobacterium tuberculosis H37Rv
agcaacaacgucugca

SEQ ID NO: 3321979 - RNA, 18 nt, Mycobacterium tuberculosis H37Rv
agcaacaccagaugcacc

SEQ ID NO: 3321980 - RNA, 15 nt, Mycobacterium tuberculosis H37Rv
agcaacaccagggcc

SEQ ID NO: 3321981 - RNA, 13 nt, Mycobacterium tuberculosis H37Rv
agcaacaggccca

SEQ ID NO: 3321982 - RNA, 22 nt, Mycobacterium tuberculosis H37Rv
agcaacgacccgaagccgaccg

SEQ ID NO: 3321983 - RNA, 13 nt, Mycobacterium tuberculosis H37Rv
agcaacgcccaac

SEQ ID NO: 3321984 - RNA, 14 nt, Mycobacterium tuberculosis H37Rv
agcaacgcugcagc

SEQ ID NO: 3321985 - RNA, 21 nt, Mycobacterium tuberculosis H37Rv
agcaacgcugcagcaggucga

SEQ ID NO: 3321986 - RNA, 22 nt, Mycobacterium tuberculosis H37Rv
agcaacgugugcaccaucauca

SEQ ID NO: 3321987 - RNA, 21 nt, Mycobacterium tuberculosis H37Rv
agcaacucauuacgguagacg

SEQ ID NO: 3321988 - RNA, 16 nt, Mycobacterium tuberculosis H37Rv
agcaacucgaucgccu

SEQ ID NO: 3321989 - RNA, 15 nt, Mycobacterium tuberculosis H37Rv
agcaacucggccacg

SEQ ID NO: 3321990 - RNA, 17 nt, Mycobacterium tuberculosis H37Rv
agcaacucguccagcag

SEQ ID NO: 3321991 - RNA, 21 nt, Mycobacterium tuberculosis H37Rv
agcaacucguccagcagugcg

SEQ ID NO: 3321992 - RNA, 22 nt, Mycobacterium tuberculosis H37Rv
agcaacucguccagcagugcga

SEQ ID NO: 3321993 - RNA, 20 nt, Mycobacterium tuberculosis H37Rv
agcaacugccgcacccgguc

SEQ ID NO: 3321994 - RNA, 22 nt, Mycobacterium tuberculosis H37Rv
agcaacugccgcacccggucga

SEQ ID NO: 3321995 - RNA, 24 nt, Mycobacterium tuberculosis H37Rv
agcaacugggcggccuggucggcc

SEQ ID NO: 3321996 - RNA, 14 nt, Mycobacterium tuberculosis H37Rv
agcaagagccgcag

SEQ ID NO: 3321997 - RNA, 23 nt, Mycobacterium tuberculosis H37Rv
agcaagaucaccuucgucgcggc

SEQ ID NO: 3321998 - RNA, 23 nt, Mycobacterium tuberculosis H37Rv
agcaagccagcaucggcagcagc

SEQ ID NO: 3321999 - RNA, 20 nt, Mycobacterium tuberculosis H37Rv
agcaagucgccgaggcaacc

SEQ ID NO: 3322000 - RNA, 19 nt, Mycobacterium tuberculosis H37Rv
agcaauaccugagcgcgcg

SEQ ID NO: 3322001 - RNA, 14 nt, Mycobacterium tuberculosis H37Rv
agcaaucagccgcc

SEQ ID NO: 3322002 - RNA, 15 nt, Mycobacterium tuberculosis H37Rv
agcaauccgcacagc

SEQ ID NO: 3322003 - RNA, 16 nt, Mycobacterium tuberculosis H37Rv
agcaauccgcacagcg

SEQ ID NO: 3322004 - RNA, 14 nt, Mycobacterium tuberculosis H37Rv
agcaaugacccgcg

SEQ ID NO: 3322005 - RNA, 13 nt, Mycobacterium tuberculosis H37Rv
agcaaugccaacg

SEQ ID NO: 3322006 - RNA, 24 nt, Mycobacterium tuberculosis H37Rv
agcaaugcgguaccaaccugcgcg

SEQ ID NO: 3322007 - RNA, 17 nt, Mycobacterium tuberculosis H37Rv
agcacacaacacccaac

SEQ ID NO: 3322008 - RNA, 12 nt, Mycobacterium tuberculosis H37Rv
agcacacccaga

SEQ ID NO: 3322009 - RNA, 19 nt, Mycobacterium tuberculosis H37Rv
agcacacccagaugcaggc

SEQ ID NO: 3322010 - RNA, 15 nt, Mycobacterium tuberculosis H37Rv
agcacaccgccagcg

SEQ ID NO: 3322011 - RNA, 17 nt, Mycobacterium tuberculosis H37Rv
agcacaccgccagcggc

SEQ ID NO: 3322012 - RNA, 20 nt, Mycobacterium tuberculosis H37Rv
agcacaccgguggacccggc

SEQ ID NO: 3322013 - RNA, 24 nt, Mycobacterium tuberculosis H37Rv
agcacucgcccaagcgcagccugg

SEQ ID NO: 3322014 - RNA, 13 nt, Mycobacterium tuberculosis H37Rv
agcacucggccac

SEQ ID NO: 3322015 - RNA, 20 nt, Mycobacterium tuberculosis H37Rv
agcacuuccaagccgaccug

SEQ ID NO: 3322016 - RNA, 22 nt, Mycobacterium tuberculosis H37Rv
agcacuucgucgaaccugucga

SEQ ID NO: 3322017 - RNA, 16 nt, Mycobacterium tuberculosis H37Rv
agcacuuggacccggc

SEQ ID NO: 3322018 - RNA, 15 nt, Mycobacterium tuberculosis H37Rv
agcagacacagaauc

SEQ ID NO: 3322019 - RNA, 18 nt, Mycobacterium tuberculosis H37Rv
agcagacacagaaucgca

SEQ ID NO: 3322020 - RNA, 19 nt, Mycobacterium tuberculosis H37Rv
agcagacacagaaucgccc

SEQ ID NO: 3322021 - RNA, 20 nt, Mycobacterium tuberculosis H37Rv
agcagacacagaaucgccca

SEQ ID NO: 3322022 - RNA, 21 nt, Mycobacterium tuberculosis H37Rv
agcagacacagaaucgcccau

SEQ ID NO: 3322023 - RNA, 22 nt, Mycobacterium tuberculosis H37Rv
agcagaccaagcccuagcgcau

SEQ ID NO: 3322024 - RNA, 17 nt, Mycobacterium tuberculosis H37Rv
agcagaccaaguccggu

SEQ ID NO: 3322025 - RNA, 17 nt, Mycobacterium tuberculosis H37Rv
agcagaccacaacgccu

SEQ ID NO: 3322026 - RNA, 17 nt, Mycobacterium tuberculosis H37Rv
agcagacgacgaucagc

SEQ ID NO: 3322027 - RNA, 16 nt, Mycobacterium tuberculosis H37Rv
agcagacgcaaaagaa

SEQ ID NO: 3322028 - RNA, 19 nt, Mycobacterium tuberculosis H37Rv
agcagacgcaaaauccccu

SEQ ID NO: 3322029 - RNA, 18 nt, Mycobacterium tuberculosis H37Rv
agcagacgcaaaaucgca

SEQ ID NO: 3322030 - RNA, 19 nt, Mycobacterium tuberculosis H37Rv
agcagacgcaaaaucgcac

SEQ ID NO: 3322031 - RNA, 20 nt, Mycobacterium tuberculosis H37Rv
agcagacgcaaaaucgcccg

SEQ ID NO: 3322032 - RNA, 12 nt, Mycobacterium tuberculosis H37Rv
agcagacgcaac

SEQ ID NO: 3322033 - RNA, 17 nt, Mycobacterium tuberculosis H37Rv
agcagacgcaacggcac

SEQ ID NO: 3322034 - RNA, 20 nt, Mycobacterium tuberculosis H37Rv
agcagacgcagaaucgcauu

SEQ ID NO: 3322035 - RNA, 20 nt, Mycobacterium tuberculosis H37Rv
agcagacgcagaaucgccca

SEQ ID NO: 3322036 - RNA, 19 nt, Mycobacterium tuberculosis H37Rv
agcagacgcagaaucgccu

SEQ ID NO: 3322037 - RNA, 20 nt, Mycobacterium tuberculosis H37Rv
agcagacgcagagucgcacu

SEQ ID NO: 3322038 - RNA, 23 nt, Mycobacterium tuberculosis H37Rv
agcagacgcagagucgcacugcg

SEQ ID NO: 3322039 - RNA, 13 nt, Mycobacterium tuberculosis H37Rv
agcagacgccgua

SEQ ID NO: 3322040 - RNA, 19 nt, Mycobacterium tuberculosis H37Rv
agcagacgcggaaucgcac

SEQ ID NO: 3322041 - RNA, 20 nt, Mycobacterium tuberculosis H37Rv
agcagacgcuaaagcccccg

SEQ ID NO: 3322042 - RNA, 20 nt, Mycobacterium tuberculosis H37Rv
agcagacguaaaagccccca

SEQ ID NO: 3322043 - RNA, 20 nt, Mycobacterium tuberculosis H37Rv
agcagacguaaaagcccccg

SEQ ID NO: 3322044 - RNA, 14 nt, Mycobacterium tuberculosis H37Rv
agcagacugcccuc

SEQ ID NO: 3322045 - RNA, 15 nt, Mycobacterium tuberculosis H37Rv
agcagauccaggcgu

SEQ ID NO: 3322046 - RNA, 15 nt, Mycobacterium tuberculosis H37Rv
agcagaugggcgucg

SEQ ID NO: 3322047 - RNA, 22 nt, Mycobacterium tuberculosis H37Rv
agcagauggguacccgaucacu

SEQ ID NO: 3322048 - RNA, 20 nt, Mycobacterium tuberculosis H37Rv
agcagauucucccuugccga

SEQ ID NO: 3322049 - RNA, 19 nt, Mycobacterium tuberculosis H37Rv
agcagcaaacaucgcaggc

SEQ ID NO: 3322050 - RNA, 19 nt, Mycobacterium tuberculosis H37Rv
agcagcaauccaaggcuca

SEQ ID NO: 3322051 - RNA, 23 nt, Mycobacterium tuberculosis H37Rv
agcagcaauccaaggcucagcag

SEQ ID NO: 3322052 - RNA, 14 nt, Mycobacterium tuberculosis H37Rv
agcagcaccaacug

SEQ ID NO: 3322053 - RNA, 12 nt, Mycobacterium tuberculosis H37Rv
agcagcaccacc

SEQ ID NO: 3322054 - RNA, 15 nt, Mycobacterium tuberculosis H37Rv
agcagcacgucugcg

SEQ ID NO: 3322055 - RNA, 15 nt, Mycobacterium tuberculosis H37Rv
agcagcagagccaac

SEQ ID NO: 3322056 - RNA, 13 nt, Mycobacterium tuberculosis H37Rv
agcagcagcggcg

SEQ ID NO: 3322057 - RNA, 22 nt, Mycobacterium tuberculosis H37Rv
agcagcauccggccgucaucug

SEQ ID NO: 3322058 - RNA, 14 nt, Mycobacterium tuberculosis H37Rv
agcagcaugucgua

SEQ ID NO: 3322059 - RNA, 22 nt, Mycobacterium tuberculosis H37Rv
agcagccacgauccuuggcgua

SEQ ID NO: 3322060 - RNA, 12 nt, Mycobacterium tuberculosis H37Rv
agcagccagcaa

SEQ ID NO: 3322061 - RNA, 14 nt, Mycobacterium tuberculosis H37Rv
agcagccagcaaca

SEQ ID NO: 3322062 - RNA, 17 nt, Mycobacterium tuberculosis H37Rv
agcagccagcaacacca

SEQ ID NO: 3322063 - RNA, 13 nt, Mycobacterium tuberculosis H37Rv
agcagccagccac

SEQ ID NO: 3322064 - RNA, 15 nt, Mycobacterium tuberculosis H37Rv
agcagccagccaccg

SEQ ID NO: 3322065 - RNA, 20 nt, Mycobacterium tuberculosis H37Rv
agcagccagccaccgaucga

SEQ ID NO: 3322066 - RNA, 15 nt, Mycobacterium tuberculosis H37Rv
agcagccagcccagc

SEQ ID NO: 3322067 - RNA, 12 nt, Mycobacterium tuberculosis H37Rv
agcagcccggcg

SEQ ID NO: 3322068 - RNA, 18 nt, Mycobacterium tuberculosis H37Rv
agcagcccggggaugccu

SEQ ID NO: 3322069 - RNA, 12 nt, Mycobacterium tuberculosis H37Rv
agcagccgaacc

SEQ ID NO: 3322070 - RNA, 14 nt, Mycobacterium tuberculosis H37Rv
agcagccgcgacau

SEQ ID NO: 3322071 - RNA, 19 nt, Mycobacterium tuberculosis H37Rv
agcagccggugccggucga

SEQ ID NO: 3322072 - RNA, 14 nt, Mycobacterium tuberculosis H37Rv
agcagcgaccagca

SEQ ID NO: 3322073 - RNA, 20 nt, Mycobacterium tuberculosis H37Rv
agcagcgacgcugccgccag

SEQ ID NO: 3322074 - RNA, 17 nt, Mycobacterium tuberculosis H37Rv
agcagcgcaacggccag

SEQ ID NO: 3322075 - RNA, 14 nt, Mycobacterium tuberculosis H37Rv
agcagcgccacccg

SEQ ID NO: 3322076 - RNA, 14 nt, Mycobacterium tuberculosis H37Rv
agcagcgccagcag

SEQ ID NO: 3322077 - RNA, 15 nt, Mycobacterium tuberculosis H37Rv
agcagcgccagcagc

SEQ ID NO: 3322078 - RNA, 16 nt, Mycobacterium tuberculosis H37Rv
agcagcgccagcagcu

SEQ ID NO: 3322079 - RNA, 16 nt, Mycobacterium tuberculosis H37Rv
agcagcgccaucaucu

SEQ ID NO: 3322080 - RNA, 13 nt, Mycobacterium tuberculosis H37Rv
agcagcgccgcgu

SEQ ID NO: 3322081 - RNA, 18 nt, Mycobacterium tuberculosis H37Rv
agcagcgccggcaccgac

SEQ ID NO: 3322082 - RNA, 18 nt, Mycobacterium tuberculosis H37Rv
agcagcgccucauccucc

SEQ ID NO: 3322083 - RNA, 13 nt, Mycobacterium tuberculosis H37Rv
agcagcgcggcuu

SEQ ID NO: 3322084 - RNA, 17 nt, Mycobacterium tuberculosis H37Rv
agcagcgcgggaucuga

SEQ ID NO: 3322085 - RNA, 15 nt, Mycobacterium tuberculosis H37Rv
agcagcggcacgucg

SEQ ID NO: 3322086 - RNA, 14 nt, Mycobacterium tuberculosis H37Rv
agcagcggugcagc

SEQ ID NO: 3322087 - RNA, 15 nt, Mycobacterium tuberculosis H37Rv
agcagcggugcagcc

SEQ ID NO: 3322088 - RNA, 19 nt, Mycobacterium tuberculosis H37Rv
agcagcgguugaugcggcc

SEQ ID NO: 3322089 - RNA, 14 nt, Mycobacterium tuberculosis H37Rv
agcagcgucaucag

SEQ ID NO: 3322090 - RNA, 17 nt, Mycobacterium tuberculosis H37Rv
agcagcgucaucagguc

SEQ ID NO: 3322091 - RNA, 13 nt, Mycobacterium tuberculosis H37Rv
agcagcguggcga

SEQ ID NO: 3322092 - RNA, 18 nt, Mycobacterium tuberculosis H37Rv
agcagcucgccggcacgc

SEQ ID NO: 3322093 - RNA, 20 nt, Mycobacterium tuberculosis H37Rv
agcagcucgccggcacgcag

SEQ ID NO: 3322094 - RNA, 12 nt, Mycobacterium tuberculosis H37Rv
agcagcucggcc

SEQ ID NO: 3322095 - RNA, 23 nt, Mycobacterium tuberculosis H37Rv
agcagcucggccgaggcggucuu

SEQ ID NO: 3322096 - RNA, 15 nt, Mycobacterium tuberculosis H37Rv
agcagcucggggcga

SEQ ID NO: 3322097 - RNA, 20 nt, Mycobacterium tuberculosis H37Rv
agcagcucggggcgaugagc

SEQ ID NO: 3322098 - RNA, 23 nt, Mycobacterium tuberculosis H37Rv
agcagcugaaaauaggccgggca

SEQ ID NO: 3322099 - RNA, 22 nt, Mycobacterium tuberculosis H37Rv
agcagcugcgauauggucacca

SEQ ID NO: 3322100 - RNA, 19 nt, Mycobacterium tuberculosis H37Rv
agcagcugggcaucaccgc

SEQ ID NO: 3322101 - RNA, 17 nt, Mycobacterium tuberculosis H37Rv
agcagcuugacaucggu

SEQ ID NO: 3322102 - RNA, 23 nt, Mycobacterium tuberculosis H37Rv
agcaggaaaaagggcuuccaggg

SEQ ID NO: 3322103 - RNA, 12 nt, Mycobacterium tuberculosis H37Rv
agcaggacaccu

SEQ ID NO: 3322104 - RNA, 11 nt, Mycobacterium tuberculosis H37Rv
agcaggaugau

SEQ ID NO: 3322105 - RNA, 20 nt, Mycobacterium tuberculosis H37Rv
agcaggaugaugaccgccau

SEQ ID NO: 3322106 - RNA, 23 nt, Mycobacterium tuberculosis H37Rv
agcaggccacugcguuccaucgc

SEQ ID NO: 3322107 - RNA, 13 nt, Mycobacterium tuberculosis H37Rv
agcaggcccagcg

SEQ ID NO: 3322108 - RNA, 13 nt, Mycobacterium tuberculosis H37Rv
agcaggcccauac

SEQ ID NO: 3322109 - RNA, 16 nt, Mycobacterium tuberculosis H37Rv
agccagcgggcgauga

SEQ ID NO: 3322110 - RNA, 17 nt, Mycobacterium tuberculosis H37Rv
agccagcguuggcggcg

SEQ ID NO: 3322111 - RNA, 14 nt, Mycobacterium tuberculosis H37Rv
agccagcugaacac

SEQ ID NO: 3322112 - RNA, 18 nt, Mycobacterium tuberculosis H37Rv
agccaggaagcgguggcc

SEQ ID NO: 3322113 - RNA, 18 nt, Mycobacterium tuberculosis H37Rv
agccaggagccgaucacg

SEQ ID NO: 3322114 - RNA, 20 nt, Mycobacterium tuberculosis H37Rv
agccaggauugccgccguug

SEQ ID NO: 3322115 - RNA, 17 nt, Mycobacterium tuberculosis H37Rv
agccaggcaaccgguca

SEQ ID NO: 3322116 - RNA, 23 nt, Mycobacterium tuberculosis H37Rv
agccaggcacguccgaucggcgc

SEQ ID NO: 3322117 - RNA, 12 nt, Mycobacterium tuberculosis H37Rv
agccaggccagu

SEQ ID NO: 3322118 - RNA, 19 nt, Mycobacterium tuberculosis H37Rv
agccaggccuuggugcggc

SEQ ID NO: 3322119 - RNA, 20 nt, Mycobacterium tuberculosis H37Rv
agccaggccuuggugcggcc

SEQ ID NO: 3322120 - RNA, 21 nt, Mycobacterium tuberculosis H37Rv
agccaggccuuggugcggccg

SEQ ID NO: 3322121 - RNA, 17 nt, Mycobacterium tuberculosis H37Rv
agccaggcgauugcccg

SEQ ID NO: 3322122 - RNA, 15 nt, Mycobacterium tuberculosis H37Rv
agccaggcggcaagg

SEQ ID NO: 3322123 - RNA, 21 nt, Mycobacterium tuberculosis H37Rv
agccaggcgugcacaggucag

SEQ ID NO: 3322124 - RNA, 14 nt, Mycobacterium tuberculosis H37Rv
agccagggucccgc

SEQ ID NO: 3322125 - RNA, 16 nt, Mycobacterium tuberculosis H37Rv
agccaguccagcgcgc

SEQ ID NO: 3322126 - RNA, 22 nt, Mycobacterium tuberculosis H37Rv
agccaguguugcaguggcgacg

SEQ ID NO: 3322127 - RNA, 16 nt, Mycobacterium tuberculosis H37Rv
agccaucacgacuccc

SEQ ID NO: 3322128 - RNA, 18 nt, Mycobacterium tuberculosis H37Rv
agccaucgucgagcgcga

SEQ ID NO: 3322129 - RNA, 22 nt, Mycobacterium tuberculosis H37Rv
agccaucucuugcaaccuggac

SEQ ID NO: 3322130 - RNA, 13 nt, Mycobacterium tuberculosis H37Rv
agccaugcucguc

SEQ ID NO: 3322131 - RNA, 23 nt, Mycobacterium tuberculosis H37Rv
agccauggccgccaggugaauuc

SEQ ID NO: 3322132 - RNA, 18 nt, Mycobacterium tuberculosis H37Rv
agccauguggcgucgcuc

SEQ ID NO: 3322133 - RNA, 19 nt, Mycobacterium tuberculosis H37Rv
agccauucgguguggccgu

SEQ ID NO: 3322134 - RNA, 18 nt, Mycobacterium tuberculosis H37Rv
agcccaaagcgccagcag

SEQ ID NO: 3322135 - RNA, 13 nt, Mycobacterium tuberculosis H37Rv
agcccaaauccca

SEQ ID NO: 3322136 - RNA, 15 nt, Mycobacterium tuberculosis H37Rv
agcccaacagcaacc

SEQ ID NO: 3322137 - RNA, 18 nt, Mycobacterium tuberculosis H37Rv
agcccaacucggccagcu

SEQ ID NO: 3322138 - RNA, 21 nt, Mycobacterium tuberculosis H37Rv
agcccacacgcucacgggcuc

SEQ ID NO: 3322139 - RNA, 15 nt, Mycobacterium tuberculosis H37Rv
agcccacccauggcc

SEQ ID NO: 3322140 - RNA, 12 nt, Mycobacterium tuberculosis H37Rv
agcccacccggg

SEQ ID NO: 3322141 - RNA, 14 nt, Mycobacterium tuberculosis H37Rv
agcccacgaucgcg

SEQ ID NO: 3322142 - RNA, 18 nt, Mycobacterium tuberculosis H37Rv
agcccacgugggcacuca

SEQ ID NO: 3322143 - RNA, 18 nt, Mycobacterium tuberculosis H37Rv
agcccacucgucgaacac

SEQ ID NO: 3322144 - RNA, 17 nt, Mycobacterium tuberculosis H37Rv
agcccagauagagcugg

SEQ ID NO: 3322145 - RNA, 18 nt, Mycobacterium tuberculosis H37Rv
agcccagauccagcaacg

SEQ ID NO: 3322146 - RNA, 14 nt, Mycobacterium tuberculosis H37Rv
agcccagcacgcug

SEQ ID NO: 3322147 - RNA, 17 nt, Mycobacterium tuberculosis H37Rv
agcccagccgggcaccc

SEQ ID NO: 3322148 - RNA, 12 nt, Mycobacterium tuberculosis H37Rv
agcccagcgccu

SEQ ID NO: 3322149 - RNA, 14 nt, Mycobacterium tuberculosis H37Rv
agcccagcgccucc

SEQ ID NO: 3322150 - RNA, 16 nt, Mycobacterium tuberculosis H37Rv
agcccagcgccuccag

SEQ ID NO: 3322151 - RNA, 15 nt, Mycobacterium tuberculosis H37Rv
agcccaggugggccg

SEQ ID NO: 3322152 - RNA, 17 nt, Mycobacterium tuberculosis H37Rv
agcccaucuaccagcuc

SEQ ID NO: 3322153 - RNA, 17 nt, Mycobacterium tuberculosis H37Rv
agcccaugccgaugccc

SEQ ID NO: 3322154 - RNA, 16 nt, Mycobacterium tuberculosis H37Rv
agcccaugucgagcac

SEQ ID NO: 3322155 - RNA, 14 nt, Mycobacterium tuberculosis H37Rv
agccccaaaucgua

SEQ ID NO: 3322156 - RNA, 18 nt, Mycobacterium tuberculosis H37Rv
agccccccgagcccgcca

SEQ ID NO: 3322157 - RNA, 14 nt, Mycobacterium tuberculosis H37Rv
agccccccggcgac

SEQ ID NO: 3322158 - RNA, 20 nt, Mycobacterium tuberculosis H37Rv
agcccccgacacgccgugcg

SEQ ID NO: 3322159 - RNA, 14 nt, Mycobacterium tuberculosis H37Rv
agcccccgacguug

SEQ ID NO: 3322160 - RNA, 13 nt, Mycobacterium tuberculosis H37Rv
agcccccgcacgc

SEQ ID NO: 3322161 - RNA, 15 nt, Mycobacterium tuberculosis H37Rv
agccccgaagccggu

SEQ ID NO: 3322162 - RNA, 14 nt, Mycobacterium tuberculosis H37Rv
agccccgcaggggg

SEQ ID NO: 3322163 - RNA, 20 nt, Mycobacterium tuberculosis H37Rv
agccccgccggggccgccgu

SEQ ID NO: 3322164 - RNA, 13 nt, Mycobacterium tuberculosis H37Rv
agccccgcgccca

SEQ ID NO: 3322165 - RNA, 14 nt, Mycobacterium tuberculosis H37Rv
agccccgcgcccac

SEQ ID NO: 3322166 - RNA, 17 nt, Mycobacterium tuberculosis H37Rv
agccccgcggccagcag

SEQ ID NO: 3322167 - RNA, 19 nt, Mycobacterium tuberculosis H37Rv
agccccuccgcgccgauca

SEQ ID NO: 3322168 - RNA, 19 nt, Mycobacterium tuberculosis H37Rv
agccccugaaggccagcca

SEQ ID NO: 3322169 - RNA, 21 nt, Mycobacterium tuberculosis H37Rv
agccccuggaggggcaacagg

SEQ ID NO: 3322170 - RNA, 22 nt, Mycobacterium tuberculosis H37Rv
agccccuuuugccgcagcaucc

SEQ ID NO: 3322171 - RNA, 17 nt, Mycobacterium tuberculosis H37Rv
agcccgaaccaccgcgu

SEQ ID NO: 3322172 - RNA, 20 nt, Mycobacterium tuberculosis H37Rv
agcccgacaccguccagcag

SEQ ID NO: 3322173 - RNA, 17 nt, Mycobacterium tuberculosis H37Rv
agcccgaccgguccagc

SEQ ID NO: 3322174 - RNA, 18 nt, Mycobacterium tuberculosis H37Rv
agcccgacuggucacugc

SEQ ID NO: 3322175 - RNA, 21 nt, Mycobacterium tuberculosis H37Rv
agcccgacuggucacugcccu

SEQ ID NO: 3322176 - RNA, 13 nt, Mycobacterium tuberculosis H37Rv
agcccgaguugaa

SEQ ID NO: 3322177 - RNA, 19 nt, Mycobacterium tuberculosis H37Rv
agcccgaucggcgggcugg

SEQ ID NO: 3322178 - RNA, 14 nt, Mycobacterium tuberculosis H37Rv
agcccgaugauccc

SEQ ID NO: 3322179 - RNA, 20 nt, Mycobacterium tuberculosis H37Rv
agcccgaugaucccgccacc

SEQ ID NO: 3322180 - RNA, 22 nt, Mycobacterium tuberculosis H37Rv
agcccgaugaucccgccaccga

SEQ ID NO: 3322181 - RNA, 17 nt, Mycobacterium tuberculosis H37Rv
agcccgauucagcgccc

SEQ ID NO: 3322182 - RNA, 16 nt, Mycobacterium tuberculosis H37Rv
agcccgccacagcccc

SEQ ID NO: 3322183 - RNA, 21 nt, Mycobacterium tuberculosis H37Rv
agcccgccacagccccagggu

SEQ ID NO: 3322184 - RNA, 13 nt, Mycobacterium tuberculosis H37Rv
agcccgccacccu

SEQ ID NO: 3322185 - RNA, 19 nt, Mycobacterium tuberculosis H37Rv
agcccgccacccuuggccc

SEQ ID NO: 3322186 - RNA, 14 nt, Mycobacterium tuberculosis H37Rv
agcccgccagcgcc

SEQ ID NO: 3322187 - RNA, 17 nt, Mycobacterium tuberculosis H37Rv
agcccgccagcgccgcu

SEQ ID NO: 3322188 - RNA, 20 nt, Mycobacterium tuberculosis H37Rv
agcccgcccgguguguucgg

SEQ ID NO: 3322189 - RNA, 14 nt, Mycobacterium tuberculosis H37Rv
agcccgccgcgacc

SEQ ID NO: 3322190 - RNA, 19 nt, Mycobacterium tuberculosis H37Rv
agcccgccggacccgcccu

SEQ ID NO: 3322191 - RNA, 17 nt, Mycobacterium tuberculosis H37Rv
agcccgccggccucugg

SEQ ID NO: 3322192 - RNA, 14 nt, Mycobacterium tuberculosis H37Rv
agcccgcgaucucg

SEQ ID NO: 3322193 - RNA, 17 nt, Mycobacterium tuberculosis H37Rv
agcccgcgcagcagugc

SEQ ID NO: 3322194 - RNA, 14 nt, Mycobacterium tuberculosis H37Rv
agcccgcugcgccg

SEQ ID NO: 3322195 - RNA, 17 nt, Mycobacterium tuberculosis H37Rv
agcccgcugcgccgggu

SEQ ID NO: 3322196 - RNA, 23 nt, Mycobacterium tuberculosis H37Rv
agcccggacgcgcggauggccuc

SEQ ID NO: 3322197 - RNA, 21 nt, Mycobacterium tuberculosis H37Rv
agcccggacguaggcaccccg

SEQ ID NO: 3322198 - RNA, 16 nt, Mycobacterium tuberculosis H37Rv
agcccggccgccgagg

SEQ ID NO: 3322199 - RNA, 17 nt, Mycobacterium tuberculosis H37Rv
agcccggccgcggccca

SEQ ID NO: 3322200 - RNA, 20 nt, Mycobacterium tuberculosis H37Rv
agcccggccucggcgagcac

SEQ ID NO: 3322201 - RNA, 18 nt, Mycobacterium tuberculosis H37Rv
agcccggccuugccgccg

SEQ ID NO: 3322202 - RNA, 17 nt, Mycobacterium tuberculosis H37Rv
agcccggcgaucagcag

SEQ ID NO: 3322203 - RNA, 21 nt, Mycobacterium tuberculosis H37Rv
agcccggcggcaugggucgug

SEQ ID NO: 3322204 - RNA, 17 nt, Mycobacterium tuberculosis H37Rv
agcccggcggcggucac

SEQ ID NO: 3322205 - RNA, 23 nt, Mycobacterium tuberculosis H37Rv
agccgccguggaacacgaagucg

SEQ ID NO: 3322206 - RNA, 18 nt, Mycobacterium tuberculosis H37Rv
agccgccguggauacgca

SEQ ID NO: 3322207 - RNA, 17 nt, Mycobacterium tuberculosis H37Rv
agccgccguugccgccg

SEQ ID NO: 3322208 - RNA, 13 nt, Mycobacterium tuberculosis H37Rv
agccgccucaaug

SEQ ID NO: 3322209 - RNA, 20 nt, Mycobacterium tuberculosis H37Rv
agccgccucaaugaccaccg

SEQ ID NO: 3322210 - RNA, 15 nt, Mycobacterium tuberculosis H37Rv
agccgcgaaaucacc

SEQ ID NO: 3322211 - RNA, 15 nt, Mycobacterium tuberculosis H37Rv
agccgcgaccgcagc

SEQ ID NO: 3322212 - RNA, 14 nt, Mycobacterium tuberculosis H37Rv
agccgcgagccggu

SEQ ID NO: 3322213 - RNA, 22 nt, Mycobacterium tuberculosis H37Rv
agccgcgaguccaggcugaucc

SEQ ID NO: 3322214 - RNA, 12 nt, Mycobacterium tuberculosis H37Rv
agccgcgccagc

SEQ ID NO: 3322215 - RNA, 21 nt, Mycobacterium tuberculosis H37Rv
agccgcgcgccaucgccucca

SEQ ID NO: 3322216 - RNA, 16 nt, Mycobacterium tuberculosis H37Rv
agccgcgcgccggcca

SEQ ID NO: 3322217 - RNA, 17 nt, Mycobacterium tuberculosis H37Rv
agccgcgcgccggccau

SEQ ID NO: 3322218 - RNA, 14 nt, Mycobacterium tuberculosis H37Rv
agccgcgcggguca

SEQ ID NO: 3322219 - RNA, 20 nt, Mycobacterium tuberculosis H37Rv
agccgcgcgguacugcgcag

SEQ ID NO: 3322220 - RNA, 22 nt, Mycobacterium tuberculosis H37Rv
agccgcggaucauccuucgccg

SEQ ID NO: 3322221 - RNA, 13 nt, Mycobacterium tuberculosis H37Rv
agccgcggccaca

SEQ ID NO: 3322222 - RNA, 22 nt, Mycobacterium tuberculosis H37Rv
agccgcggccacaaugcggccg

SEQ ID NO: 3322223 - RNA, 17 nt, Mycobacterium tuberculosis H37Rv
agccgcggccacaugau

SEQ ID NO: 3322224 - RNA, 14 nt, Mycobacterium tuberculosis H37Rv
agccgcggccacgg

SEQ ID NO: 3322225 - RNA, 15 nt, Mycobacterium tuberculosis H37Rv
agccgcggcccgcgu

SEQ ID NO: 3322226 - RNA, 21 nt, Mycobacterium tuberculosis H37Rv
agccgcggcgccauagccgcg

SEQ ID NO: 3322227 - RNA, 13 nt, Mycobacterium tuberculosis H37Rv
agccgcggucggc

SEQ ID NO: 3322228 - RNA, 17 nt, Mycobacterium tuberculosis H37Rv
agccgcggucggcgugc

SEQ ID NO: 3322229 - RNA, 20 nt, Mycobacterium tuberculosis H37Rv
agccgcgucgucggccccac

SEQ ID NO: 3322230 - RNA, 21 nt, Mycobacterium tuberculosis H37Rv
agccgcgugggccgcugcaua

SEQ ID NO: 3322231 - RNA, 23 nt, Mycobacterium tuberculosis H37Rv
agccgcuacguuacgccgagaug

SEQ ID NO: 3322232 - RNA, 22 nt, Mycobacterium tuberculosis H37Rv
agccgcuaggacggcgcgagcc

SEQ ID NO: 3322233 - RNA, 18 nt, Mycobacterium tuberculosis H37Rv
agccgcucacccggucgc

SEQ ID NO: 3322234 - RNA, 18 nt, Mycobacterium tuberculosis H37Rv
agccgcucaucgaucccg

SEQ ID NO: 3322235 - RNA, 16 nt, Mycobacterium tuberculosis H37Rv
agccgcuccacguacg

SEQ ID NO: 3322236 - RNA, 17 nt, Mycobacterium tuberculosis H37Rv
agccgcuccacguacgc

SEQ ID NO: 3322237 - RNA, 21 nt, Mycobacterium tuberculosis H37Rv
agccgcuccacguacgcggcu

SEQ ID NO: 3322238 - RNA, 15 nt, Mycobacterium tuberculosis H37Rv
agccgcuccgcccau

SEQ ID NO: 3322239 - RNA, 17 nt, Mycobacterium tuberculosis H37Rv
agccgcucgauggccug

SEQ ID NO: 3322240 - RNA, 23 nt, Mycobacterium tuberculosis H37Rv
agccgcucgcugaaccggaucga

SEQ ID NO: 3322241 - RNA, 18 nt, Mycobacterium tuberculosis H37Rv
agccgcucggcguagcga

SEQ ID NO: 3322242 - RNA, 19 nt, Mycobacterium tuberculosis H37Rv
agccgcugauguacccggc

SEQ ID NO: 3322243 - RNA, 21 nt, Mycobacterium tuberculosis H37Rv
agccgcugauguacccggcga

SEQ ID NO: 3322244 - RNA, 21 nt, Mycobacterium tuberculosis H37Rv
agccgcugccacaggugaccu

SEQ ID NO: 3322245 - RNA, 20 nt, Mycobacterium tuberculosis H37Rv
agccgcugccuggccgggac

SEQ ID NO: 3322246 - RNA, 14 nt, Mycobacterium tuberculosis H37Rv
agccgcugcggcac

SEQ ID NO: 3322247 - RNA, 15 nt, Mycobacterium tuberculosis H37Rv
agccgcugcggcacc

SEQ ID NO: 3322248 - RNA, 15 nt, Mycobacterium tuberculosis H37Rv
agccgcuggaagucg

SEQ ID NO: 3322249 - RNA, 19 nt, Mycobacterium tuberculosis H37Rv
agccggaacagugccaccu

SEQ ID NO: 3322250 - RNA, 13 nt, Mycobacterium tuberculosis H37Rv
agccggaaccgga

SEQ ID NO: 3322251 - RNA, 17 nt, Mycobacterium tuberculosis H37Rv
agccggaaccggacagc

SEQ ID NO: 3322252 - RNA, 19 nt, Mycobacterium tuberculosis H37Rv
agccggacaacugguggcc

SEQ ID NO: 3322253 - RNA, 14 nt, Mycobacterium tuberculosis H37Rv
agccggaugcggcc

SEQ ID NO: 3322254 - RNA, 13 nt, Mycobacterium tuberculosis H37Rv
agccggauucggc

SEQ ID NO: 3322255 - RNA, 21 nt, Mycobacterium tuberculosis H37Rv
agccggauucggcugccaccg

SEQ ID NO: 3322256 - RNA, 14 nt, Mycobacterium tuberculosis H37Rv
agccggcagcagcg

SEQ ID NO: 3322257 - RNA, 21 nt, Mycobacterium tuberculosis H37Rv
agccggcauagcggcccaucg

SEQ ID NO: 3322258 - RNA, 12 nt, Mycobacterium tuberculosis H37Rv
agccggccaccu

SEQ ID NO: 3322259 - RNA, 16 nt, Mycobacterium tuberculosis H37Rv
agccggccacgcauuc

SEQ ID NO: 3322260 - RNA, 22 nt, Mycobacterium tuberculosis H37Rv
agccggccacgcauuccagcag

SEQ ID NO: 3322261 - RNA, 21 nt, Mycobacterium tuberculosis H37Rv
agccggccacuacggccuggc

SEQ ID NO: 3322262 - RNA, 18 nt, Mycobacterium tuberculosis H37Rv
agccggccauacgcgcgc

SEQ ID NO: 3322263 - RNA, 14 nt, Mycobacterium tuberculosis H37Rv
agccggccgcgacc

SEQ ID NO: 3322264 - RNA, 21 nt, Mycobacterium tuberculosis H37Rv
agccggcgaagugcuccaccu

SEQ ID NO: 3322265 - RNA, 22 nt, Mycobacterium tuberculosis H37Rv
agccggcgaagugcuccaccuc

SEQ ID NO: 3322266 - RNA, 15 nt, Mycobacterium tuberculosis H37Rv
agccggcgacaccgc

SEQ ID NO: 3322267 - RNA, 22 nt, Mycobacterium tuberculosis H37Rv
agccggcgagaaacacgacagc

SEQ ID NO: 3322268 - RNA, 14 nt, Mycobacterium tuberculosis H37Rv
agccggcgcccgcc

SEQ ID NO: 3322269 - RNA, 21 nt, Mycobacterium tuberculosis H37Rv
agccggcgcccgccgcgaacu

SEQ ID NO: 3322270 - RNA, 17 nt, Mycobacterium tuberculosis H37Rv
agccggcgccgggucga

SEQ ID NO: 3322271 - RNA, 14 nt, Mycobacterium tuberculosis H37Rv
agccggcgcggcgg

SEQ ID NO: 3322272 - RNA, 13 nt, Mycobacterium tuberculosis H37Rv
agccggcggcugg

SEQ ID NO: 3322273 - RNA, 19 nt, Mycobacterium tuberculosis H37Rv
agccggcucaucgcagccg

SEQ ID NO: 3322274 - RNA, 18 nt, Mycobacterium tuberculosis H37Rv
agccggcuguuaggcgau

SEQ ID NO: 3322275 - RNA, 15 nt, Mycobacterium tuberculosis H37Rv
agccgggauugccgc

SEQ ID NO: 3322276 - RNA, 17 nt, Mycobacterium tuberculosis H37Rv
agccgggauugccgcca

SEQ ID NO: 3322277 - RNA, 13 nt, Mycobacterium tuberculosis H37Rv
agccgggcaaggc

SEQ ID NO: 3322278 - RNA, 20 nt, Mycobacterium tuberculosis H37Rv
agccgggcaccacccuugcc

SEQ ID NO: 3322279 - RNA, 14 nt, Mycobacterium tuberculosis H37Rv
agccgggcacccac

SEQ ID NO: 3322280 - RNA, 19 nt, Mycobacterium tuberculosis H37Rv
agccgggccccacaucgcc

SEQ ID NO: 3322281 - RNA, 22 nt, Mycobacterium tuberculosis H37Rv
agccgggccccacaucgccccc

SEQ ID NO: 3322282 - RNA, 18 nt, Mycobacterium tuberculosis H37Rv
agccgggcgcgccggcca

SEQ ID NO: 3322283 - RNA, 19 nt, Mycobacterium tuberculosis H37Rv
agccgggcggccucguuga

SEQ ID NO: 3322284 - RNA, 14 nt, Mycobacterium tuberculosis H37Rv
agccggggaacgug

SEQ ID NO: 3322285 - RNA, 18 nt, Mycobacterium tuberculosis H37Rv
agccggguaucuuggcga

SEQ ID NO: 3322286 - RNA, 17 nt, Mycobacterium tuberculosis H37Rv
agccgggugccacaacc

SEQ ID NO: 3322287 - RNA, 19 nt, Mycobacterium tuberculosis H37Rv
agccgggugggagcagccg

SEQ ID NO: 3322288 - RNA, 23 nt, Mycobacterium tuberculosis H37Rv
agccggguguuggggaucgcacc

SEQ ID NO: 3322289 - RNA, 19 nt, Mycobacterium tuberculosis H37Rv
agccgguagaucagcgccu

SEQ ID NO: 3322290 - RNA, 21 nt, Mycobacterium tuberculosis H37Rv
agccgguagaucagcgccugg

SEQ ID NO: 3322291 - RNA, 23 nt, Mycobacterium tuberculosis H37Rv
agccgguagaucagcgccugguc

SEQ ID NO: 3322292 - RNA, 21 nt, Mycobacterium tuberculosis H37Rv
agccggucauagucgaauggc

SEQ ID NO: 3322293 - RNA, 16 nt, Mycobacterium tuberculosis H37Rv
agccggucgaugccga

SEQ ID NO: 3322294 - RNA, 18 nt, Mycobacterium tuberculosis H37Rv
agccggucuugcaucgcc

SEQ ID NO: 3322295 - RNA, 15 nt, Mycobacterium tuberculosis H37Rv
agccggugaccgcga

SEQ ID NO: 3322296 - RNA, 16 nt, Mycobacterium tuberculosis H37Rv
agccggugacgguguu

SEQ ID NO: 3322297 - RNA, 17 nt, Mycobacterium tuberculosis H37Rv
agccggugagcgagcgc

SEQ ID NO: 3322298 - RNA, 19 nt, Mycobacterium tuberculosis H37Rv
agccggugagcgagcgcgc

SEQ ID NO: 3322299 - RNA, 19 nt, Mycobacterium tuberculosis H37Rv
agccggugccgacggcgcc

SEQ ID NO: 3322300 - RNA, 21 nt, Mycobacterium tuberculosis H37Rv
agccggugccggcguugccgc

SEQ ID NO: 3322301 - RNA, 23 nt, Mycobacterium tuberculosis H37Rv
agcgacuccguaccggguuccau

SEQ ID NO: 3322302 - RNA, 16 nt, Mycobacterium tuberculosis H37Rv
agcgacucgccggcga

SEQ ID NO: 3322303 - RNA, 18 nt, Mycobacterium tuberculosis H37Rv
agcgacugcagcggcgca

SEQ ID NO: 3322304 - RNA, 15 nt, Mycobacterium tuberculosis H37Rv
agcgagacuucgacg

SEQ ID NO: 3322305 - RNA, 19 nt, Mycobacterium tuberculosis H37Rv
agcgagacuucgacgcggc

SEQ ID NO: 3322306 - RNA, 21 nt, Mycobacterium tuberculosis H37Rv
agcgagacuucgacgcggcga

SEQ ID NO: 3322307 - RNA, 21 nt, Mycobacterium tuberculosis H37Rv
agcgagcgcaaaucgauugcg

SEQ ID NO: 3322308 - RNA, 17 nt, Mycobacterium tuberculosis H37Rv
agcgaggacaagcccgc

SEQ ID NO: 3322309 - RNA, 17 nt, Mycobacterium tuberculosis H37Rv
agcgaggugggcgucau

SEQ ID NO: 3322310 - RNA, 17 nt, Mycobacterium tuberculosis H37Rv
agcgaguuucugcucga

SEQ ID NO: 3322311 - RNA, 22 nt, Mycobacterium tuberculosis H37Rv
agcgauaucggcggcuuggccg

SEQ ID NO: 3322312 - RNA, 23 nt, Mycobacterium tuberculosis H37Rv
agcgaucggggcggugacuccgc

SEQ ID NO: 3322313 - RNA, 15 nt, Mycobacterium tuberculosis H37Rv
agcgaucgugcugcc

SEQ ID NO: 3322314 - RNA, 16 nt, Mycobacterium tuberculosis H37Rv
agcgaugcaccccaug

SEQ ID NO: 3322315 - RNA, 18 nt, Mycobacterium tuberculosis H37Rv
agcgaugggaacggggug

SEQ ID NO: 3322316 - RNA, 21 nt, Mycobacterium tuberculosis H37Rv
agcgauuccacggcagcaccg

SEQ ID NO: 3322317 - RNA, 23 nt, Mycobacterium tuberculosis H37Rv
agcgcaacccguuguggccgccu

SEQ ID NO: 3322318 - RNA, 14 nt, Mycobacterium tuberculosis H37Rv
agcgcaacggccag

SEQ ID NO: 3322319 - RNA, 18 nt, Mycobacterium tuberculosis H37Rv
agcgcaacggccagcgcu

SEQ ID NO: 3322320 - RNA, 17 nt, Mycobacterium tuberculosis H37Rv
agcgcaacucccagcac

SEQ ID NO: 3322321 - RNA, 14 nt, Mycobacterium tuberculosis H37Rv
agcgcaaucgacca

SEQ ID NO: 3322322 - RNA, 14 nt, Mycobacterium tuberculosis H37Rv
agcgcaaugcggcc

SEQ ID NO: 3322323 - RNA, 17 nt, Mycobacterium tuberculosis H37Rv
agcgcacacuaccgccg

SEQ ID NO: 3322324 - RNA, 20 nt, Mycobacterium tuberculosis H37Rv
agcgcaccacggcggucaac

SEQ ID NO: 3322325 - RNA, 19 nt, Mycobacterium tuberculosis H37Rv
agcgcacccggucggcggc

SEQ ID NO: 3322326 - RNA, 21 nt, Mycobacterium tuberculosis H37Rv
agcgcacccggucggcggcau

SEQ ID NO: 3322327 - RNA, 20 nt, Mycobacterium tuberculosis H37Rv
agcgcaccgcugaccgcaac

SEQ ID NO: 3322328 - RNA, 18 nt, Mycobacterium tuberculosis H37Rv
agcgcaccggcguucacc

SEQ ID NO: 3322329 - RNA, 13 nt, Mycobacterium tuberculosis H37Rv
agcgcaccgguga

SEQ ID NO: 3322330 - RNA, 19 nt, Mycobacterium tuberculosis H37Rv
agcgcacgauuucgagcgc

SEQ ID NO: 3322331 - RNA, 20 nt, Mycobacterium tuberculosis H37Rv
agcgcacggaccaucgccag

SEQ ID NO: 3322332 - RNA, 23 nt, Mycobacterium tuberculosis H37Rv
agcgcacggaccaucgccaggcc

SEQ ID NO: 3322333 - RNA, 15 nt, Mycobacterium tuberculosis H37Rv
agcgcacugaaaugg

SEQ ID NO: 3322334 - RNA, 16 nt, Mycobacterium tuberculosis H37Rv
agcgcacugaaauggc

SEQ ID NO: 3322335 - RNA, 15 nt, Mycobacterium tuberculosis H37Rv
agcgcacugcccggg

SEQ ID NO: 3322336 - RNA, 21 nt, Mycobacterium tuberculosis H37Rv
agcgcacuggggaggccaacc

SEQ ID NO: 3322337 - RNA, 22 nt, Mycobacterium tuberculosis H37Rv
agcgcagacacgaccccgucga

SEQ ID NO: 3322338 - RNA, 12 nt, Mycobacterium tuberculosis H37Rv
agcgcagcagcg

SEQ ID NO: 3322339 - RNA, 14 nt, Mycobacterium tuberculosis H37Rv
agcgcagccaggcu

SEQ ID NO: 3322340 - RNA, 16 nt, Mycobacterium tuberculosis H37Rv
agcgcagccugcagcg

SEQ ID NO: 3322341 - RNA, 15 nt, Mycobacterium tuberculosis H37Rv
agcgcagcgccggca

SEQ ID NO: 3322342 - RNA, 17 nt, Mycobacterium tuberculosis H37Rv
agcgcagcgccggcagc

SEQ ID NO: 3322343 - RNA, 21 nt, Mycobacterium tuberculosis H37Rv
agcgcagcgccggcagcagca

SEQ ID NO: 3322344 - RNA, 14 nt, Mycobacterium tuberculosis H37Rv
agcgcaggaccuga

SEQ ID NO: 3322345 - RNA, 17 nt, Mycobacterium tuberculosis H37Rv
agcgcaggagcgcgaug

SEQ ID NO: 3322346 - RNA, 20 nt, Mycobacterium tuberculosis H37Rv
agcgcaggauucugcugacc

SEQ ID NO: 3322347 - RNA, 19 nt, Mycobacterium tuberculosis H37Rv
agcgcaggguucgucggga

SEQ ID NO: 3322348 - RNA, 14 nt, Mycobacterium tuberculosis H37Rv
agcgcaucgccaau

SEQ ID NO: 3322349 - RNA, 23 nt, Mycobacterium tuberculosis H37Rv
agcgcaucgccgcuggccagcac

SEQ ID NO: 3322350 - RNA, 24 nt, Mycobacterium tuberculosis H37Rv
agcgcaucgccgcuggccagcaca

SEQ ID NO: 3322351 - RNA, 17 nt, Mycobacterium tuberculosis H37Rv
agcgcaucggccagcag

SEQ ID NO: 3322352 - RNA, 18 nt, Mycobacterium tuberculosis H37Rv
agcgcauggacgaacgcg

SEQ ID NO: 3322353 - RNA, 22 nt, Mycobacterium tuberculosis H37Rv
agcgcauuuguugcugcugccg

SEQ ID NO: 3322354 - RNA, 14 nt, Mycobacterium tuberculosis H37Rv
agcgccaacccggc

SEQ ID NO: 3322355 - RNA, 15 nt, Mycobacterium tuberculosis H37Rv
agcgccaacccggcg

SEQ ID NO: 3322356 - RNA, 19 nt, Mycobacterium tuberculosis H37Rv
agcgccaacgcccccaucc

SEQ ID NO: 3322357 - RNA, 20 nt, Mycobacterium tuberculosis H37Rv
agcgccaagacgucggcgug

SEQ ID NO: 3322358 - RNA, 21 nt, Mycobacterium tuberculosis H37Rv
agcgccaagccgugccgcaca

SEQ ID NO: 3322359 - RNA, 13 nt, Mycobacterium tuberculosis H37Rv
agcgccaaggcga

SEQ ID NO: 3322360 - RNA, 19 nt, Mycobacterium tuberculosis H37Rv
agcgccacccgcgucaguc

SEQ ID NO: 3322361 - RNA, 15 nt, Mycobacterium tuberculosis H37Rv
agcgccaccgaccga

SEQ ID NO: 3322362 - RNA, 13 nt, Mycobacterium tuberculosis H37Rv
agcgccagcagcc

SEQ ID NO: 3322363 - RNA, 16 nt, Mycobacterium tuberculosis H37Rv
agcgccagcgggauga

SEQ ID NO: 3322364 - RNA, 16 nt, Mycobacterium tuberculosis H37Rv
agcgccaggccgcaca

SEQ ID NO: 3322365 - RNA, 22 nt, Mycobacterium tuberculosis H37Rv
agcgccaucaucuuggcgcggu

SEQ ID NO: 3322366 - RNA, 17 nt, Mycobacterium tuberculosis H37Rv
agcgcccagaucgccga

SEQ ID NO: 3322367 - RNA, 14 nt, Mycobacterium tuberculosis H37Rv
agcgcccccagcag

SEQ ID NO: 3322368 - RNA, 15 nt, Mycobacterium tuberculosis H37Rv
agcgcccccagcagc

SEQ ID NO: 3322369 - RNA, 16 nt, Mycobacterium tuberculosis H37Rv
agcgccccuggcaccu

SEQ ID NO: 3322370 - RNA, 14 nt, Mycobacterium tuberculosis H37Rv
agcgcccgccggca

SEQ ID NO: 3322371 - RNA, 19 nt, Mycobacterium tuberculosis H37Rv
agcgcccgcgcggccacuu

SEQ ID NO: 3322372 - RNA, 12 nt, Mycobacterium tuberculosis H37Rv
agcgcccggaug

SEQ ID NO: 3322373 - RNA, 14 nt, Mycobacterium tuberculosis H37Rv
agcgcccggccacu

SEQ ID NO: 3322374 - RNA, 13 nt, Mycobacterium tuberculosis H37Rv
agcgcccggucac

SEQ ID NO: 3322375 - RNA, 20 nt, Mycobacterium tuberculosis H37Rv
agcgcccgucguagguggcc

SEQ ID NO: 3322376 - RNA, 16 nt, Mycobacterium tuberculosis H37Rv
agcgcccguuggccaa

SEQ ID NO: 3322377 - RNA, 20 nt, Mycobacterium tuberculosis H37Rv
agcgcccguuggccaagaau

SEQ ID NO: 3322378 - RNA, 15 nt, Mycobacterium tuberculosis H37Rv
agcgcccuccucgau

SEQ ID NO: 3322379 - RNA, 20 nt, Mycobacterium tuberculosis H37Rv
agcgccgaaacagcacccag

SEQ ID NO: 3322380 - RNA, 16 nt, Mycobacterium tuberculosis H37Rv
agcgccgagagcaccg

SEQ ID NO: 3322381 - RNA, 14 nt, Mycobacterium tuberculosis H37Rv
agcgccgagcucgg

SEQ ID NO: 3322382 - RNA, 17 nt, Mycobacterium tuberculosis H37Rv
agcgccgagcucggcgc

SEQ ID NO: 3322383 - RNA, 15 nt, Mycobacterium tuberculosis H37Rv
agcgccgauggccgc

SEQ ID NO: 3322384 - RNA, 13 nt, Mycobacterium tuberculosis H37Rv
agcgccgccaccg

SEQ ID NO: 3322385 - RNA, 22 nt, Mycobacterium tuberculosis H37Rv
agcgccgccaccgaagccgccg

SEQ ID NO: 3322386 - RNA, 21 nt, Mycobacterium tuberculosis H37Rv
agcgccgccagguguucgccg

SEQ ID NO: 3322387 - RNA, 13 nt, Mycobacterium tuberculosis H37Rv
agcgccgccgagg

SEQ ID NO: 3322388 - RNA, 15 nt, Mycobacterium tuberculosis H37Rv
agcgccgccgcgagc

SEQ ID NO: 3322389 - RNA, 11 nt, Mycobacterium tuberculosis H37Rv
agcgccgccgg

SEQ ID NO: 3322390 - RNA, 16 nt, Mycobacterium tuberculosis H37Rv
agcgccgcgcuugcga

SEQ ID NO: 3322391 - RNA, 23 nt, Mycobacterium tuberculosis H37Rv
agcgccgcggcuacaucggcggc

SEQ ID NO: 3322392 - RNA, 15 nt, Mycobacterium tuberculosis H37Rv
agcgccgcuuggcga

SEQ ID NO: 3322393 - RNA, 23 nt, Mycobacterium tuberculosis H37Rv
agcgccggauggguggccagcaa

SEQ ID NO: 3322394 - RNA, 17 nt, Mycobacterium tuberculosis H37Rv
agcgccggccaggcuau

SEQ ID NO: 3322395 - RNA, 22 nt, Mycobacterium tuberculosis H37Rv
agcgccggccgaucggccggua

SEQ ID NO: 3322396 - RNA, 18 nt, Mycobacterium tuberculosis H37Rv
agcgccggggugugcggg

SEQ ID NO: 3322397 - RNA, 13 nt, Mycobacterium tuberculosis H37Rv
agcgcucguuccg

SEQ ID NO: 3322398 - RNA, 16 nt, Mycobacterium tuberculosis H37Rv
agcgcugagccgcuca

SEQ ID NO: 3322399 - RNA, 13 nt, Mycobacterium tuberculosis H37Rv
agcgcugccaccg

SEQ ID NO: 3322400 - RNA, 13 nt, Mycobacterium tuberculosis H37Rv
agcgcugcugccg

SEQ ID NO: 3322401 - RNA, 19 nt, Mycobacterium tuberculosis H37Rv
agcgcuggcaggccgggca

SEQ ID NO: 3322402 - RNA, 20 nt, Mycobacterium tuberculosis H37Rv
agcgcuggcaggccgggcac

SEQ ID NO: 3322403 - RNA, 21 nt, Mycobacterium tuberculosis H37Rv
agcgcuggcaggccgggcacc

SEQ ID NO: 3322404 - RNA, 15 nt, Mycobacterium tuberculosis H37Rv
agcgcugggcccagg

SEQ ID NO: 3322405 - RNA, 19 nt, Mycobacterium tuberculosis H37Rv
agcgcuucaaagaucgccu

SEQ ID NO: 3322406 - RNA, 22 nt, Mycobacterium tuberculosis H37Rv
agcgcuucgagguggcugcgcc

SEQ ID NO: 3322407 - RNA, 18 nt, Mycobacterium tuberculosis H37Rv
agcgcuucggcggucgcc

SEQ ID NO: 3322408 - RNA, 19 nt, Mycobacterium tuberculosis H37Rv
agcgcuucgucggccggca

SEQ ID NO: 3322409 - RNA, 19 nt, Mycobacterium tuberculosis H37Rv
agcgcuugaccccgccgaa

SEQ ID NO: 3322410 - RNA, 21 nt, Mycobacterium tuberculosis H37Rv
agcgcuugaccccgccgaacg

SEQ ID NO: 3322411 - RNA, 17 nt, Mycobacterium tuberculosis H37Rv
agcgcuugcgaccccgg

SEQ ID NO: 3322412 - RNA, 20 nt, Mycobacterium tuberculosis H37Rv
agcggaaccgagggccguca

SEQ ID NO: 3322413 - RNA, 20 nt, Mycobacterium tuberculosis H37Rv
agcggaacgucacugcgaaa

SEQ ID NO: 3322414 - RNA, 15 nt, Mycobacterium tuberculosis H37Rv
agcggaagcgguuga

SEQ ID NO: 3322415 - RNA, 17 nt, Mycobacterium tuberculosis H37Rv
agcggaagcgguugacc

SEQ ID NO: 3322416 - RNA, 18 nt, Mycobacterium tuberculosis H37Rv
agcggaauuagucgccgc

SEQ ID NO: 3322417 - RNA, 12 nt, Mycobacterium tuberculosis H37Rv
agcggacccgac

SEQ ID NO: 3322418 - RNA, 23 nt, Mycobacterium tuberculosis H37Rv
agcggaccgaugacgaucggcgg

SEQ ID NO: 3322419 - RNA, 12 nt, Mycobacterium tuberculosis H37Rv
agcggaccgcug

SEQ ID NO: 3322420 - RNA, 19 nt, Mycobacterium tuberculosis H37Rv
agcggaccgcugccugccg

SEQ ID NO: 3322421 - RNA, 20 nt, Mycobacterium tuberculosis H37Rv
agcggagacgaucgccaggc

SEQ ID NO: 3322422 - RNA, 19 nt, Mycobacterium tuberculosis H37Rv
agcggagcaauuccacgau

SEQ ID NO: 3322423 - RNA, 21 nt, Mycobacterium tuberculosis H37Rv
agcggagccacucggcccggc

SEQ ID NO: 3322424 - RNA, 14 nt, Mycobacterium tuberculosis H37Rv
agcggagccgccga

SEQ ID NO: 3322425 - RNA, 13 nt, Mycobacterium tuberculosis H37Rv
agcggagccggcg

SEQ ID NO: 3322426 - RNA, 23 nt, Mycobacterium tuberculosis H37Rv
agcggagccggcgcauaacacaa

SEQ ID NO: 3322427 - RNA, 22 nt, Mycobacterium tuberculosis H37Rv
agcggaucaggucuggcgcgga

SEQ ID NO: 3322428 - RNA, 18 nt, Mycobacterium tuberculosis H37Rv
agcggauccaggccucgc

SEQ ID NO: 3322429 - RNA, 17 nt, Mycobacterium tuberculosis H37Rv
agcggaucgcggucagc

SEQ ID NO: 3322430 - RNA, 23 nt, Mycobacterium tuberculosis H37Rv
agcggaugggcugaggaacgccg

SEQ ID NO: 3322431 - RNA, 16 nt, Mycobacterium tuberculosis H37Rv
agcggauucacgcacc

SEQ ID NO: 3322432 - RNA, 17 nt, Mycobacterium tuberculosis H37Rv
agcggauucagcgucgc

SEQ ID NO: 3322433 - RNA, 19 nt, Mycobacterium tuberculosis H37Rv
agcggauucagcgucgcca

SEQ ID NO: 3322434 - RNA, 15 nt, Mycobacterium tuberculosis H37Rv
agcggcaaagccggg

SEQ ID NO: 3322435 - RNA, 18 nt, Mycobacterium tuberculosis H37Rv
agcggcaacgccuccgga

SEQ ID NO: 3322436 - RNA, 23 nt, Mycobacterium tuberculosis H37Rv
agcggcaaggucaacgggaggug

SEQ ID NO: 3322437 - RNA, 16 nt, Mycobacterium tuberculosis H37Rv
agcggcaauggccagc

SEQ ID NO: 3322438 - RNA, 17 nt, Mycobacterium tuberculosis H37Rv
agcggcaauggccagca

SEQ ID NO: 3322439 - RNA, 21 nt, Mycobacterium tuberculosis H37Rv
agcggcaauggccagcaccac

SEQ ID NO: 3322440 - RNA, 12 nt, Mycobacterium tuberculosis H37Rv
agcggcacaccc

SEQ ID NO: 3322441 - RNA, 17 nt, Mycobacterium tuberculosis H37Rv
agcggcacacccaucac

SEQ ID NO: 3322442 - RNA, 23 nt, Mycobacterium tuberculosis H37Rv
agcggcacacccaucaccgccag

SEQ ID NO: 3322443 - RNA, 19 nt, Mycobacterium tuberculosis H37Rv
agcggcaccgcggccagcg

SEQ ID NO: 3322444 - RNA, 16 nt, Mycobacterium tuberculosis H37Rv
agcggcacgucggcgc

SEQ ID NO: 3322445 - RNA, 22 nt, Mycobacterium tuberculosis H37Rv
agcggcagaugaauugccgggc

SEQ ID NO: 3322446 - RNA, 18 nt, Mycobacterium tuberculosis H37Rv
agcggcagcaccgcacgg

SEQ ID NO: 3322447 - RNA, 23 nt, Mycobacterium tuberculosis H37Rv
agcggcagccuggccucgccauu

SEQ ID NO: 3322448 - RNA, 17 nt, Mycobacterium tuberculosis H37Rv
agcggcauccacaccga

SEQ ID NO: 3322449 - RNA, 21 nt, Mycobacterium tuberculosis H37Rv
agcggcaucgcgggcggcgcu

SEQ ID NO: 3322450 - RNA, 16 nt, Mycobacterium tuberculosis H37Rv
agcggcaucggccagc

SEQ ID NO: 3322451 - RNA, 22 nt, Mycobacterium tuberculosis H37Rv
agcggcaucggccagccguucu

SEQ ID NO: 3322452 - RNA, 17 nt, Mycobacterium tuberculosis H37Rv
agcggcauugccagccg

SEQ ID NO: 3322453 - RNA, 16 nt, Mycobacterium tuberculosis H37Rv
agcggccaccgaggcg

SEQ ID NO: 3322454 - RNA, 18 nt, Mycobacterium tuberculosis H37Rv
agcggccaccgccgccgc

SEQ ID NO: 3322455 - RNA, 21 nt, Mycobacterium tuberculosis H37Rv
agcggccaccgccgccgccac

SEQ ID NO: 3322456 - RNA, 23 nt, Mycobacterium tuberculosis H37Rv
agcggccaccgccgccgccaccg

SEQ ID NO: 3322457 - RNA, 12 nt, Mycobacterium tuberculosis H37Rv
agcggccagcag

SEQ ID NO: 3322458 - RNA, 19 nt, Mycobacterium tuberculosis H37Rv
agcggccagcagugcggua

SEQ ID NO: 3322459 - RNA, 15 nt, Mycobacterium tuberculosis H37Rv
agcggccauaucgcc

SEQ ID NO: 3322460 - RNA, 22 nt, Mycobacterium tuberculosis H37Rv
agcggccauccggcggcggcca

SEQ ID NO: 3322461 - RNA, 15 nt, Mycobacterium tuberculosis H37Rv
agcggcccgaucacc

SEQ ID NO: 3322462 - RNA, 19 nt, Mycobacterium tuberculosis H37Rv
agcggcccgaucaccagcc

SEQ ID NO: 3322463 - RNA, 21 nt, Mycobacterium tuberculosis H37Rv
agcggcccgaucaccagcccc

SEQ ID NO: 3322464 - RNA, 16 nt, Mycobacterium tuberculosis H37Rv
agcggcccgcugcgcg

SEQ ID NO: 3322465 - RNA, 21 nt, Mycobacterium tuberculosis H37Rv
agcggcccgucaccgcgggca

SEQ ID NO: 3322466 - RNA, 17 nt, Mycobacterium tuberculosis H37Rv
agcggccgaccgcgacc

SEQ ID NO: 3322467 - RNA, 12 nt, Mycobacterium tuberculosis H37Rv
agcggccgcagg

SEQ ID NO: 3322468 - RNA, 14 nt, Mycobacterium tuberculosis H37Rv
agcggccgcaggcg

SEQ ID NO: 3322469 - RNA, 16 nt, Mycobacterium tuberculosis H37Rv
agcggccgccgcggcu

SEQ ID NO: 3322470 - RNA, 17 nt, Mycobacterium tuberculosis H37Rv
agcggccgcuccaccuc

SEQ ID NO: 3322471 - RNA, 23 nt, Mycobacterium tuberculosis H37Rv
agcggccgcuccaccucggcguu

SEQ ID NO: 3322472 - RNA, 19 nt, Mycobacterium tuberculosis H37Rv
agcggccgggcggccaggc

SEQ ID NO: 3322473 - RNA, 22 nt, Mycobacterium tuberculosis H37Rv
agcggccgguacacguccagug

SEQ ID NO: 3322474 - RNA, 21 nt, Mycobacterium tuberculosis H37Rv
agcggccuaggacgccgcccu

SEQ ID NO: 3322475 - RNA, 17 nt, Mycobacterium tuberculosis H37Rv
agcggccuccagcaccc

SEQ ID NO: 3322476 - RNA, 23 nt, Mycobacterium tuberculosis H37Rv
agcggccuccgggccaugugggg

SEQ ID NO: 3322477 - RNA, 13 nt, Mycobacterium tuberculosis H37Rv
agcggccucgacc

SEQ ID NO: 3322478 - RNA, 14 nt, Mycobacterium tuberculosis H37Rv
agcggccucgggac

SEQ ID NO: 3322479 - RNA, 22 nt, Mycobacterium tuberculosis H37Rv
agcggcgaaaacaacaccaccg

SEQ ID NO: 3322480 - RNA, 13 nt, Mycobacterium tuberculosis H37Rv
agcggcgaacucg

SEQ ID NO: 3322481 - RNA, 17 nt, Mycobacterium tuberculosis H37Rv
agcggcgaacucgggcg

SEQ ID NO: 3322482 - RNA, 18 nt, Mycobacterium tuberculosis H37Rv
agcggcgaccgcggucgc

SEQ ID NO: 3322483 - RNA, 20 nt, Mycobacterium tuberculosis H37Rv
agcggcgaucggaggcccgc

SEQ ID NO: 3322484 - RNA, 17 nt, Mycobacterium tuberculosis H37Rv
agcggcgcauaggcggc

SEQ ID NO: 3322485 - RNA, 14 nt, Mycobacterium tuberculosis H37Rv
agcggcgccgcccu

SEQ ID NO: 3322486 - RNA, 22 nt, Mycobacterium tuberculosis H37Rv
agcggcgccgccuggacgccgc

SEQ ID NO: 3322487 - RNA, 20 nt, Mycobacterium tuberculosis H37Rv
agcggcgcgaccgucuggag

SEQ ID NO: 3322488 - RNA, 13 nt, Mycobacterium tuberculosis H37Rv
agcggcgcgagca

SEQ ID NO: 3322489 - RNA, 14 nt, Mycobacterium tuberculosis H37Rv
agcggcgcgggggu

SEQ ID NO: 3322490 - RNA, 15 nt, Mycobacterium tuberculosis H37Rv
agcggcgcucggcgc

SEQ ID NO: 3322491 - RNA, 19 nt, Mycobacterium tuberculosis H37Rv
agcggcgcucuugcucacc

SEQ ID NO: 3322492 - RNA, 13 nt, Mycobacterium tuberculosis H37Rv
agcggcggccacg

SEQ ID NO: 3322493 - RNA, 15 nt, Mycobacterium tuberculosis H37Rv
aaaaaccacccccac

SEQ ID NO: 3322494 - RNA, 21 nt, Mycobacterium tuberculosis H37Rv
aaaaacccggugaccagcaac

SEQ ID NO: 3322495 - RNA, 20 nt, Mycobacterium tuberculosis H37Rv
aaaaaccucgacgcccgccc

SEQ ID NO: 3322496 - RNA, 18 nt, Mycobacterium tuberculosis H37Rv
aaaaacgaacccaggcac

SEQ ID NO: 3322497 - RNA, 14 nt, Mycobacterium tuberculosis H37Rv
aaaaagcccagcga

SEQ ID NO: 3322498 - RNA, 21 nt, Mycobacterium tuberculosis H37Rv
aaaaaguuaccgguauagcca

SEQ ID NO: 3322499 - RNA, 15 nt, Mycobacterium tuberculosis H37Rv
aaaacauaucggugc

SEQ ID NO: 3322500 - RNA, 14 nt, Mycobacterium tuberculosis H37Rv
aaaaccacccccac

SEQ ID NO: 3322501 - RNA, 15 nt, Mycobacterium tuberculosis H37Rv
aaaaccacccccacc

SEQ ID NO: 3322502 - RNA, 16 nt, Mycobacterium tuberculosis H37Rv
aaaaccacgcgucgcu

SEQ ID NO: 3322503 - RNA, 14 nt, Mycobacterium tuberculosis H37Rv
aaaacccaacaccc

SEQ ID NO: 3322504 - RNA, 21 nt, Mycobacterium tuberculosis H37Rv
aaaacccggaaucgucgcggc

SEQ ID NO: 3322505 - RNA, 22 nt, Mycobacterium tuberculosis H37Rv
aaaaccucgacgcccgcccugg

SEQ ID NO: 3322506 - RNA, 18 nt, Mycobacterium tuberculosis H37Rv
aaaacgaacccaggcaca

SEQ ID NO: 3322507 - RNA, 13 nt, Mycobacterium tuberculosis H37Rv
aaaacgagcuucc

SEQ ID NO: 3322508 - RNA, 21 nt, Mycobacterium tuberculosis H37Rv
aaaacgccaugccgggaacca

SEQ ID NO: 3322509 - RNA, 17 nt, Mycobacterium tuberculosis H37Rv
aaaacgcccggcacacg

SEQ ID NO: 3322510 - RNA, 21 nt, Mycobacterium tuberculosis H37Rv
aaaacgggguggcacgcauga

SEQ ID NO: 3322511 - RNA, 14 nt, Mycobacterium tuberculosis H37Rv
aaaagcaucaaagc

SEQ ID NO: 3322512 - RNA, 22 nt, Mycobacterium tuberculosis H37Rv
aaaagcccccauuucggcacga

SEQ ID NO: 3322513 - RNA, 23 nt, Mycobacterium tuberculosis H37Rv
aaaagcccccgcacgcucggcgu

SEQ ID NO: 3322514 - RNA, 14 nt, Mycobacterium tuberculosis H37Rv
aaaaggaagaccuc

SEQ ID NO: 3322515 - RNA, 18 nt, Mycobacterium tuberculosis H37Rv
aaaagggcggcagcgagg

SEQ ID NO: 3322516 - RNA, 15 nt, Mycobacterium tuberculosis H37Rv
aaaagucaggacggc

SEQ ID NO: 3322517 - RNA, 19 nt, Mycobacterium tuberculosis H37Rv
aaaaucaucugcacauuca

SEQ ID NO: 3322518 - RNA, 15 nt, Mycobacterium tuberculosis H37Rv
aaaaucgccaucggu

SEQ ID NO: 3322519 - RNA, 20 nt, Mycobacterium tuberculosis H37Rv
aaaaugacccacacaccgag

SEQ ID NO: 3322520 - RNA, 15 nt, Mycobacterium tuberculosis H37Rv
aaaauugcuccacca

SEQ ID NO: 3322521 - RNA, 13 nt, Mycobacterium tuberculosis H37Rv
aaacagaguagac

SEQ ID NO: 3322522 - RNA, 12 nt, Mycobacterium tuberculosis H37Rv
aaacagcaccca

SEQ ID NO: 3322523 - RNA, 22 nt, Mycobacterium tuberculosis H37Rv
aaacagcauggcgaagaacaac

SEQ ID NO: 3322524 - RNA, 23 nt, Mycobacterium tuberculosis H37Rv
aaacagcauggcgaagaacaaca

SEQ ID NO: 3322525 - RNA, 20 nt, Mycobacterium tuberculosis H37Rv
aaacagcuugcugcgcacca

SEQ ID NO: 3322526 - RNA, 13 nt, Mycobacterium tuberculosis H37Rv
aaacagguaagca

SEQ ID NO: 3322527 - RNA, 18 nt, Mycobacterium tuberculosis H37Rv
aaacaucgcacccaccac

SEQ ID NO: 3322528 - RNA, 12 nt, Mycobacterium tuberculosis H37Rv
aaacaugugggu

SEQ ID NO: 3322529 - RNA, 20 nt, Mycobacterium tuberculosis H37Rv
aaacaugugggugaacaccg

SEQ ID NO: 3322530 - RNA, 12 nt, Mycobacterium tuberculosis H37Rv
aaacauugcuag

SEQ ID NO: 3322531 - RNA, 13 nt, Mycobacterium tuberculosis H37Rv
aaaccacagcgcc

SEQ ID NO: 3322532 - RNA, 23 nt, Mycobacterium tuberculosis H37Rv
aaaccacgcugguguuguacugg

SEQ ID NO: 3322533 - RNA, 13 nt, Mycobacterium tuberculosis H37Rv
aaaccagcgucca

SEQ ID NO: 3322534 - RNA, 23 nt, Mycobacterium tuberculosis H37Rv
aaaccagggagcgcccggcugau

SEQ ID NO: 3322535 - RNA, 15 nt, Mycobacterium tuberculosis H37Rv
aaaccccggccacca

SEQ ID NO: 3322536 - RNA, 15 nt, Mycobacterium tuberculosis H37Rv
cgccguugccgccuu

SEQ ID NO: 3322537 - RNA, 15 nt, Mycobacterium tuberculosis H37Rv
cgccguugccggcca

SEQ ID NO: 3322538 - RNA, 15 nt, Mycobacterium tuberculosis H37Rv
cgccguugccggcuu

SEQ ID NO: 3322539 - RNA, 18 nt, Mycobacterium tuberculosis H37Rv
cgccguugccggcuuggc

SEQ ID NO: 3322540 - RNA, 23 nt, Mycobacterium tuberculosis H37Rv
cgccguuggggccguucaaccgg

SEQ ID NO: 3322541 - RNA, 16 nt, Mycobacterium tuberculosis H37Rv
cgccguugucggcggu

SEQ ID NO: 3322542 - RNA, 13 nt, Mycobacterium tuberculosis H37Rv
cgccguugucguc

SEQ ID NO: 3322543 - RNA, 23 nt, Mycobacterium tuberculosis H37Rv
cgccguuguugaggaugacgacg

SEQ ID NO: 3322544 - RNA, 15 nt, Mycobacterium tuberculosis H37Rv
cgccguuguuguaga

SEQ ID NO: 3322545 - RNA, 18 nt, Mycobacterium tuberculosis H37Rv
cgccguuugggccguaca

SEQ ID NO: 3322546 - RNA, 20 nt, Mycobacterium tuberculosis H37Rv
cgccuaccagcaccgggaug

SEQ ID NO: 3322547 - RNA, 18 nt, Mycobacterium tuberculosis H37Rv
cgccuauccaaagacccc

SEQ ID NO: 3322548 - RNA, 14 nt, Mycobacterium tuberculosis H37Rv
cgccucaagcucgc

SEQ ID NO: 3322549 - RNA, 17 nt, Mycobacterium tuberculosis H37Rv
cgccucaaugaccaccg

SEQ ID NO: 3322550 - RNA, 19 nt, Mycobacterium tuberculosis H37Rv
cgccucaaugaccaccggg

SEQ ID NO: 3322551 - RNA, 20 nt, Mycobacterium tuberculosis H37Rv
cgccucaaugaccaccgggc

SEQ ID NO: 3322552 - RNA, 23 nt, Mycobacterium tuberculosis H37Rv
cgccucaaugaccaccgggcgcu

SEQ ID NO: 3322553 - RNA, 18 nt, Mycobacterium tuberculosis H37Rv
cgccucaggggcgccuua

SEQ ID NO: 3322554 - RNA, 14 nt, Mycobacterium tuberculosis H37Rv
cgccuccagcacca

SEQ ID NO: 3322555 - RNA, 22 nt, Mycobacterium tuberculosis H37Rv
cgccuccagcaccacggcgcgc

SEQ ID NO: 3322556 - RNA, 20 nt, Mycobacterium tuberculosis H37Rv
cgccuccagcagguccgcgg

SEQ ID NO: 3322557 - RNA, 15 nt, Mycobacterium tuberculosis H37Rv
cgccuccaggcgcca

SEQ ID NO: 3322558 - RNA, 12 nt, Mycobacterium tuberculosis H37Rv
cgccuccgccga

SEQ ID NO: 3322559 - RNA, 15 nt, Mycobacterium tuberculosis H37Rv
cgccuccgccgaggc

SEQ ID NO: 3322560 - RNA, 14 nt, Mycobacterium tuberculosis H37Rv
cgccuccgcggcau

SEQ ID NO: 3322561 - RNA, 21 nt, Mycobacterium tuberculosis H37Rv
cgccuccggauccucggccgc

SEQ ID NO: 3322562 - RNA, 14 nt, Mycobacterium tuberculosis H37Rv
cgccuccggcaccu

SEQ ID NO: 3322563 - RNA, 13 nt, Mycobacterium tuberculosis H37Rv
cgccuccucgacg

SEQ ID NO: 3322564 - RNA, 13 nt, Mycobacterium tuberculosis H37Rv
cgccuccucgaua

SEQ ID NO: 3322565 - RNA, 15 nt, Mycobacterium tuberculosis H37Rv
cgccuccucgugcag

SEQ ID NO: 3322566 - RNA, 16 nt, Mycobacterium tuberculosis H37Rv
cgccuccugccgccgc

SEQ ID NO: 3322567 - RNA, 21 nt, Mycobacterium tuberculosis H37Rv
cgccuccugccgccgcuccau

SEQ ID NO: 3322568 - RNA, 20 nt, Mycobacterium tuberculosis H37Rv
cgccuccugcggguagaugu

SEQ ID NO: 3322569 - RNA, 15 nt, Mycobacterium tuberculosis H37Rv
cgccucgacacccag

SEQ ID NO: 3322570 - RNA, 17 nt, Mycobacterium tuberculosis H37Rv
cgccucgacacccagcc

SEQ ID NO: 3322571 - RNA, 23 nt, Mycobacterium tuberculosis H37Rv
cgccucgacacccagccgcagcc

SEQ ID NO: 3322572 - RNA, 16 nt, Mycobacterium tuberculosis H37Rv
cgccucgaccgccagc

SEQ ID NO: 3322573 - RNA, 18 nt, Mycobacterium tuberculosis H37Rv
cgccucgaccgccagccc

SEQ ID NO: 3322574 - RNA, 19 nt, Mycobacterium tuberculosis H37Rv
cgccucgagcaacggacga

SEQ ID NO: 3322575 - RNA, 13 nt, Mycobacterium tuberculosis H37Rv
cgccucgauaucg

SEQ ID NO: 3322576 - RNA, 23 nt, Mycobacterium tuberculosis H37Rv
cgccucgauaucgucgggagagu

SEQ ID NO: 3322577 - RNA, 14 nt, Mycobacterium tuberculosis H37Rv
cgccucgccaucca

SEQ ID NO: 3322578 - RNA, 17 nt, Mycobacterium tuberculosis H37Rv
cgccucgcccagcaagg

SEQ ID NO: 3322579 - RNA, 13 nt, Mycobacterium tuberculosis H37Rv
cgccucgccgaag

SEQ ID NO: 3322580 - RNA, 14 nt, Mycobacterium tuberculosis H37Rv
cgccucgccggcca

SEQ ID NO: 3322581 - RNA, 17 nt, Mycobacterium tuberculosis H37Rv
cgccucgccggccaccc

SEQ ID NO: 3322582 - RNA, 23 nt, Mycobacterium tuberculosis H37Rv
cgccucgccggccacccgcgcga

SEQ ID NO: 3322583 - RNA, 15 nt, Mycobacterium tuberculosis H37Rv
cgccucgccggccgc

SEQ ID NO: 3322584 - RNA, 19 nt, Mycobacterium tuberculosis H37Rv
cgccucgccggccgccagc

SEQ ID NO: 3322585 - RNA, 19 nt, Mycobacterium tuberculosis H37Rv
cgccucggacacggcagcc

SEQ ID NO: 3322586 - RNA, 18 nt, Mycobacterium tuberculosis H37Rv
cgccucggaccagaccca

SEQ ID NO: 3322587 - RNA, 17 nt, Mycobacterium tuberculosis H37Rv
cgccucggcaucgccgc

SEQ ID NO: 3322588 - RNA, 12 nt, Mycobacterium tuberculosis H37Rv
cgccucggcgcu

SEQ ID NO: 3322589 - RNA, 19 nt, Mycobacterium tuberculosis H37Rv
cgccucggcggccagcucg

SEQ ID NO: 3322590 - RNA, 15 nt, Mycobacterium tuberculosis H37Rv
cgccucgggcaccug

SEQ ID NO: 3322591 - RNA, 22 nt, Mycobacterium tuberculosis H37Rv
cgccucggugacgucgccgggc

SEQ ID NO: 3322592 - RNA, 22 nt, Mycobacterium tuberculosis H37Rv
cgccucggugagcugcacgccg

SEQ ID NO: 3322593 - RNA, 19 nt, Mycobacterium tuberculosis H37Rv
cgccucguacggaccgucg

SEQ ID NO: 3322594 - RNA, 15 nt, Mycobacterium tuberculosis H37Rv
cgccucgucgucgga

SEQ ID NO: 3322595 - RNA, 21 nt, Mycobacterium tuberculosis H37Rv
cgccugaaacgauugcugcgg

SEQ ID NO: 3322596 - RNA, 16 nt, Mycobacterium tuberculosis H37Rv
cgccugaacgacccgc

SEQ ID NO: 3322597 - RNA, 22 nt, Mycobacterium tuberculosis H37Rv
cgccugaauaggucgguccgca

SEQ ID NO: 3322598 - RNA, 21 nt, Mycobacterium tuberculosis H37Rv
cgccugacgaaguccaccacg

SEQ ID NO: 3322599 - RNA, 23 nt, Mycobacterium tuberculosis H37Rv
cgccugacgaaguccaccacgac

SEQ ID NO: 3322600 - RNA, 23 nt, Mycobacterium tuberculosis H37Rv
cgccugacgguaaaugucgaaca

SEQ ID NO: 3322601 - RNA, 14 nt, Mycobacterium tuberculosis H37Rv
cgccugagccacca

SEQ ID NO: 3322602 - RNA, 13 nt, Mycobacterium tuberculosis H37Rv
cgccugagcgccg

SEQ ID NO: 3322603 - RNA, 15 nt, Mycobacterium tuberculosis H37Rv
cgccugagcgcucga

SEQ ID NO: 3322604 - RNA, 14 nt, Mycobacterium tuberculosis H37Rv
cgccugagcggccu

SEQ ID NO: 3322605 - RNA, 17 nt, Mycobacterium tuberculosis H37Rv
cgccugaggugcugcca

SEQ ID NO: 3322606 - RNA, 16 nt, Mycobacterium tuberculosis H37Rv
cgccugauaggccuga

SEQ ID NO: 3322607 - RNA, 22 nt, Mycobacterium tuberculosis H37Rv
cgccugauaugacuugcgcgcg

SEQ ID NO: 3322608 - RNA, 24 nt, Mycobacterium tuberculosis H37Rv
cgccugaugcugccagaucggucg

SEQ ID NO: 3322609 - RNA, 14 nt, Mycobacterium tuberculosis H37Rv
cgccugcacccggc

SEQ ID NO: 3322610 - RNA, 22 nt, Mycobacterium tuberculosis H37Rv
cgccugcagguuuccggccugc

SEQ ID NO: 3322611 - RNA, 23 nt, Mycobacterium tuberculosis H37Rv
cgccugcagguuuccggccugca

SEQ ID NO: 3322612 - RNA, 16 nt, Mycobacterium tuberculosis H37Rv
cgccugccaccggcgc

SEQ ID NO: 3322613 - RNA, 19 nt, Mycobacterium tuberculosis H37Rv
cgccugccaucacgcgcuc

SEQ ID NO: 3322614 - RNA, 23 nt, Mycobacterium tuberculosis H37Rv
cgccugccaucacgcgcucaccg

SEQ ID NO: 3322615 - RNA, 15 nt, Mycobacterium tuberculosis H37Rv
cgccugccccacccg

SEQ ID NO: 3322616 - RNA, 22 nt, Mycobacterium tuberculosis H37Rv
cgccugcccccgcgcgcacggc

SEQ ID NO: 3322617 - RNA, 16 nt, Mycobacterium tuberculosis H37Rv
cgccugccucaccgcc

SEQ ID NO: 3322618 - RNA, 16 nt, Mycobacterium tuberculosis H37Rv
cgccugcgccgccagc

SEQ ID NO: 3322619 - RNA, 14 nt, Mycobacterium tuberculosis H37Rv
cgccugcgccgccc

SEQ ID NO: 3322620 - RNA, 17 nt, Mycobacterium tuberculosis H37Rv
cgccugcggcagcaccc

SEQ ID NO: 3322621 - RNA, 13 nt, Mycobacterium tuberculosis H37Rv
cgccugcggcggu

SEQ ID NO: 3322622 - RNA, 22 nt, Mycobacterium tuberculosis H37Rv
cgccugcggcgguuacggucaa

SEQ ID NO: 3322623 - RNA, 15 nt, Mycobacterium tuberculosis H37Rv
cgccugcgggaacgc

SEQ ID NO: 3322624 - RNA, 21 nt, Mycobacterium tuberculosis H37Rv
cgccugcucgucggccaccgc

SEQ ID NO: 3322625 - RNA, 16 nt, Mycobacterium tuberculosis H37Rv
cgccugcuggccgcgg

SEQ ID NO: 3322626 - RNA, 22 nt, Mycobacterium tuberculosis H37Rv
cgccuggaagaucacgcgucgu

SEQ ID NO: 3322627 - RNA, 14 nt, Mycobacterium tuberculosis H37Rv
cgccuggacgccgc

SEQ ID NO: 3322628 - RNA, 18 nt, Mycobacterium tuberculosis H37Rv
cgccuggacgccgccgga

SEQ ID NO: 3322629 - RNA, 19 nt, Mycobacterium tuberculosis H37Rv
cgccuggacgccgccggag

SEQ ID NO: 3322630 - RNA, 20 nt, Mycobacterium tuberculosis H37Rv
cgccuggccggaauacccgc

SEQ ID NO: 3322631 - RNA, 17 nt, Mycobacterium tuberculosis H37Rv
cgccuggcggcgccgca

SEQ ID NO: 3322632 - RNA, 15 nt, Mycobacterium tuberculosis H37Rv
cgccuggcuacgcgc

SEQ ID NO: 3322633 - RNA, 22 nt, Mycobacterium tuberculosis H37Rv
cgccuggcuugucauccccgac

SEQ ID NO: 3322634 - RNA, 22 nt, Mycobacterium tuberculosis H37Rv
cgccugggcacggccgucgacg

SEQ ID NO: 3322635 - RNA, 15 nt, Mycobacterium tuberculosis H37Rv
cgccugggcgacgac

SEQ ID NO: 3322636 - RNA, 14 nt, Mycobacterium tuberculosis H37Rv
cgccuguaccggcg

SEQ ID NO: 3322637 - RNA, 13 nt, Mycobacterium tuberculosis H37Rv
cgccugugccacc

SEQ ID NO: 3322638 - RNA, 16 nt, Mycobacterium tuberculosis H37Rv
cgccugugccgccggc

SEQ ID NO: 3322639 - RNA, 19 nt, Mycobacterium tuberculosis H37Rv
cgccugugccgccggcgcc

SEQ ID NO: 3322640 - RNA, 15 nt, Mycobacterium tuberculosis H37Rv
cgccuucacgcuggc

SEQ ID NO: 3322641 - RNA, 22 nt, Mycobacterium tuberculosis H37Rv
cgccuucacgcuggccuccagc

SEQ ID NO: 3322642 - RNA, 13 nt, Mycobacterium tuberculosis H37Rv
cgccuuccaggcg

SEQ ID NO: 3322643 - RNA, 23 nt, Mycobacterium tuberculosis H37Rv
cgccuuccaggcgggcggcaccg

SEQ ID NO: 3322644 - RNA, 17 nt, Mycobacterium tuberculosis H37Rv
cgccuucccagccgacg

SEQ ID NO: 3322645 - RNA, 13 nt, Mycobacterium tuberculosis H37Rv
cgccuucgccagc

SEQ ID NO: 3322646 - RNA, 19 nt, Mycobacterium tuberculosis H37Rv
cgccuucucccgcacggcc

SEQ ID NO: 3322647 - RNA, 18 nt, Mycobacterium tuberculosis H37Rv
cgccuucuucgcggcggu

SEQ ID NO: 3322648 - RNA, 20 nt, Mycobacterium tuberculosis H37Rv
cgccuucuuggcaggugccu

SEQ ID NO: 3322649 - RNA, 17 nt, Mycobacterium tuberculosis H37Rv
cgccuucuuggcggccu

SEQ ID NO: 3322650 - RNA, 20 nt, Mycobacterium tuberculosis H37Rv
cgccuugaagcgguggacga

SEQ ID NO: 3322651 - RNA, 23 nt, Mycobacterium tuberculosis H37Rv
cgccuugacgaucgagcugacga

SEQ ID NO: 3322652 - RNA, 13 nt, Mycobacterium tuberculosis H37Rv
cgccuugacgcca

SEQ ID NO: 3322653 - RNA, 15 nt, Mycobacterium tuberculosis H37Rv
cgccuugcagcgcgu

SEQ ID NO: 3322654 - RNA, 23 nt, Mycobacterium tuberculosis H37Rv
cgccuugcgggccugguggauga

SEQ ID NO: 3322655 - RNA, 13 nt, Mycobacterium tuberculosis H37Rv
cgccuuggcaccc

SEQ ID NO: 3322656 - RNA, 14 nt, Mycobacterium tuberculosis H37Rv
cgccuuggccacca

SEQ ID NO: 3322657 - RNA, 14 nt, Mycobacterium tuberculosis H37Rv
cgccuuggucaccu

SEQ ID NO: 3322658 - RNA, 17 nt, Mycobacterium tuberculosis H37Rv
cgccuuggucaccuucu

SEQ ID NO: 3322659 - RNA, 12 nt, Mycobacterium tuberculosis H37Rv
cgccuuggucgc

SEQ ID NO: 3322660 - RNA, 15 nt, Mycobacterium tuberculosis H37Rv
cgccuuggucgccgc

SEQ ID NO: 3322661 - RNA, 16 nt, Mycobacterium tuberculosis H37Rv
cgccuuggucgccgcc

SEQ ID NO: 3322662 - RNA, 17 nt, Mycobacterium tuberculosis H37Rv
cgccuuggucgccgccu

SEQ ID NO: 3322663 - RNA, 21 nt, Mycobacterium tuberculosis H37Rv
cgccuuggucgccgccuucuu

SEQ ID NO: 3322664 - RNA, 13 nt, Mycobacterium tuberculosis H37Rv
cgccuuggucgcg

SEQ ID NO: 3322665 - RNA, 16 nt, Mycobacterium tuberculosis H37Rv
cgccuuugccgccggc

SEQ ID NO: 3322666 - RNA, 15 nt, Mycobacterium tuberculosis H37Rv
cgccuuuggcguucu

SEQ ID NO: 3322667 - RNA, 17 nt, Mycobacterium tuberculosis H37Rv
cgccuuuuuucgccgcc

SEQ ID NO: 3322668 - RNA, 14 nt, Mycobacterium tuberculosis H37Rv
cgcgaaaccgccgu

SEQ ID NO: 3322669 - RNA, 18 nt, Mycobacterium tuberculosis H37Rv
cgcgaaaucaccgcugag

SEQ ID NO: 3322670 - RNA, 23 nt, Mycobacterium tuberculosis H37Rv
cgcgaaaugccugcgcgaugcga

SEQ ID NO: 3322671 - RNA, 16 nt, Mycobacterium tuberculosis H37Rv
cgcgaacaucgccagc

SEQ ID NO: 3322672 - RNA, 17 nt, Mycobacterium tuberculosis H37Rv
cgcgaacaucgccagcg

SEQ ID NO: 3322673 - RNA, 18 nt, Mycobacterium tuberculosis H37Rv
cgcgaacccgaucgucga

SEQ ID NO: 3322674 - RNA, 17 nt, Mycobacterium tuberculosis H37Rv
cgcgaacccgcgagguu

SEQ ID NO: 3322675 - RNA, 19 nt, Mycobacterium tuberculosis H37Rv
cgcgaaccggccaucgacc

SEQ ID NO: 3322676 - RNA, 15 nt, Mycobacterium tuberculosis H37Rv
cgcgaaccgucucgg

SEQ ID NO: 3322677 - RNA, 21 nt, Mycobacterium tuberculosis H37Rv
cgcgaaccgucucggcgaccg

SEQ ID NO: 3322678 - RNA, 23 nt, Mycobacterium tuberculosis H37Rv
cgcgaacgaagucgacgaacucg

SEQ ID NO: 3322679 - RNA, 15 nt, Mycobacterium tuberculosis H37Rv
cgcgaacgauuucgg

SEQ ID NO: 3322680 - RNA, 18 nt, Mycobacterium tuberculosis H37Rv
cgcgaacgcggccaccac

SEQ ID NO: 3322681 - RNA, 23 nt, Mycobacterium tuberculosis H37Rv
cgcgaacgggucgggacgcugcc

SEQ ID NO: 3322682 - RNA, 14 nt, Mycobacterium tuberculosis H37Rv
cgcgaacuccagca

SEQ ID NO: 3322683 - RNA, 16 nt, Mycobacterium tuberculosis H37Rv
cgcgaacuccagcagc

SEQ ID NO: 3322684 - RNA, 17 nt, Mycobacterium tuberculosis H37Rv
cgcgaacuccagcagcc

SEQ ID NO: 3322685 - RNA, 18 nt, Mycobacterium tuberculosis H37Rv
cgcgaacuccagcagccc

SEQ ID NO: 3322686 - RNA, 15 nt, Mycobacterium tuberculosis H37Rv
cgcgaagaucagcgg

SEQ ID NO: 3322687 - RNA, 14 nt, Mycobacterium tuberculosis H37Rv
cgcgaagccaccag

SEQ ID NO: 3322688 - RNA, 16 nt, Mycobacterium tuberculosis H37Rv
cgcgaagccaccaggu

SEQ ID NO: 3322689 - RNA, 22 nt, Mycobacterium tuberculosis H37Rv
cgcgaagcgcucggcagccggc

SEQ ID NO: 3322690 - RNA, 14 nt, Mycobacterium tuberculosis H37Rv
cgcgaagcugcggg

SEQ ID NO: 3322691 - RNA, 13 nt, Mycobacterium tuberculosis H37Rv
cgcgaagcugugc

SEQ ID NO: 3322692 - RNA, 22 nt, Mycobacterium tuberculosis H37Rv
cgcgaagcugugcccggcgccc

SEQ ID NO: 3322693 - RNA, 23 nt, Mycobacterium tuberculosis H37Rv
cgcgaaggauuugauaggcgcgc

SEQ ID NO: 3322694 - RNA, 21 nt, Mycobacterium tuberculosis H37Rv
cgcgaagucuugaccgcaccg

SEQ ID NO: 3322695 - RNA, 17 nt, Mycobacterium tuberculosis H37Rv
cgcgaauaccagaccgg

SEQ ID NO: 3322696 - RNA, 15 nt, Mycobacterium tuberculosis H37Rv
cgcgaaugucgccgc

SEQ ID NO: 3322697 - RNA, 17 nt, Mycobacterium tuberculosis H37Rv
cgcgaaugucgcgcugu

SEQ ID NO: 3322698 - RNA, 20 nt, Mycobacterium tuberculosis H37Rv
cgcgaauuccucuguacccc

SEQ ID NO: 3322699 - RNA, 13 nt, Mycobacterium tuberculosis H37Rv
cgcgacaacucgc

SEQ ID NO: 3322700 - RNA, 16 nt, Mycobacterium tuberculosis H37Rv
cgcgacacacgccgcc

SEQ ID NO: 3322701 - RNA, 19 nt, Mycobacterium tuberculosis H37Rv
cgcgacacacgccgccggu

SEQ ID NO: 3322702 - RNA, 15 nt, Mycobacterium tuberculosis H37Rv
cgcgacaccccggaa

SEQ ID NO: 3322703 - RNA, 23 nt, Mycobacterium tuberculosis H37Rv
cgcgacacgccggcgggcugucg

SEQ ID NO: 3322704 - RNA, 13 nt, Mycobacterium tuberculosis H37Rv
cgcgacacgcggc

SEQ ID NO: 3322705 - RNA, 17 nt, Mycobacterium tuberculosis H37Rv
cgcgacacgcggcccga

SEQ ID NO: 3322706 - RNA, 17 nt, Mycobacterium tuberculosis H37Rv
cgcgacagacagcaccg

SEQ ID NO: 3322707 - RNA, 15 nt, Mycobacterium tuberculosis H37Rv
cgcgacagcggcguc

SEQ ID NO: 3322708 - RNA, 23 nt, Mycobacterium tuberculosis H37Rv
cgcgacagcggcgucggugccgc

SEQ ID NO: 3322709 - RNA, 14 nt, Mycobacterium tuberculosis H37Rv
cgcgacaggugcua

SEQ ID NO: 3322710 - RNA, 21 nt, Mycobacterium tuberculosis H37Rv
cgcgacauauuguugugccgc

SEQ ID NO: 3322711 - RNA, 17 nt, Mycobacterium tuberculosis H37Rv
cgcgaccaccgccgagc

SEQ ID NO: 3322712 - RNA, 12 nt, Mycobacterium tuberculosis H37Rv
cgcgaccacgca

SEQ ID NO: 3322713 - RNA, 16 nt, Mycobacterium tuberculosis H37Rv
cgcgaccacgcaccgc

SEQ ID NO: 3322714 - RNA, 18 nt, Mycobacterium tuberculosis H37Rv
cgcgaccacgcaccgccc

SEQ ID NO: 3322715 - RNA, 20 nt, Mycobacterium tuberculosis H37Rv
cgcgaccagaaucgggccga

SEQ ID NO: 3322716 - RNA, 20 nt, Mycobacterium tuberculosis H37Rv
cgcgaccagaggcgugucga

SEQ ID NO: 3322717 - RNA, 13 nt, Mycobacterium tuberculosis H37Rv
cgcgaccagccag

SEQ ID NO: 3322718 - RNA, 12 nt, Mycobacterium tuberculosis H37Rv
cgcgaccagcgc

SEQ ID NO: 3322719 - RNA, 21 nt, Mycobacterium tuberculosis H37Rv
cgcgaccagcgccgcacccgc

SEQ ID NO: 3322720 - RNA, 12 nt, Mycobacterium tuberculosis H37Rv
cgcgaccaggaa

SEQ ID NO: 3322721 - RNA, 14 nt, Mycobacterium tuberculosis H37Rv
cgcgaccaucucga

SEQ ID NO: 3322722 - RNA, 17 nt, Mycobacterium tuberculosis H37Rv
cgcgaccaucucgacgu

SEQ ID NO: 3322723 - RNA, 23 nt, Mycobacterium tuberculosis H37Rv
cgcgaccccugguagcacccacg

SEQ ID NO: 3322724 - RNA, 18 nt, Mycobacterium tuberculosis H37Rv
cgcgacccgaucgcgcca

SEQ ID NO: 3322725 - RNA, 14 nt, Mycobacterium tuberculosis H37Rv
cgcgacccggccca

SEQ ID NO: 3322726 - RNA, 14 nt, Mycobacterium tuberculosis H37Rv
cgcgaccgaccagc

SEQ ID NO: 3322727 - RNA, 17 nt, Mycobacterium tuberculosis H37Rv
cgcgaccgaccagccgu

SEQ ID NO: 3322728 - RNA, 18 nt, Mycobacterium tuberculosis H37Rv
cgcgaccgaccagccgug

SEQ ID NO: 3322729 - RNA, 21 nt, Mycobacterium tuberculosis H37Rv
cgcgaccgaugaucgguaccg

SEQ ID NO: 3322730 - RNA, 19 nt, Mycobacterium tuberculosis H37Rv
cgcgaccgcauugagcugg

SEQ ID NO: 3322731 - RNA, 20 nt, Mycobacterium tuberculosis H37Rv
cgcgaccgcauugagcuggc

SEQ ID NO: 3322732 - RNA, 13 nt, Mycobacterium tuberculosis H37Rv
cgcgaccgcgauc

SEQ ID NO: 3322733 - RNA, 21 nt, Mycobacterium tuberculosis H37Rv
cgcgaccgcgauccccacgau

SEQ ID NO: 3322734 - RNA, 22 nt, Mycobacterium tuberculosis H37Rv
cgcgaccggcguaaccggcagc

SEQ ID NO: 3322735 - RNA, 16 nt, Mycobacterium tuberculosis H37Rv
cgcgaccgucaggguc

SEQ ID NO: 3322736 - RNA, 22 nt, Mycobacterium tuberculosis H37Rv
cgcgaccuccgcgaucaccgac

SEQ ID NO: 3322737 - RNA, 17 nt, Mycobacterium tuberculosis H37Rv
cgcgaccucgcggcgcu

SEQ ID NO: 3322738 - RNA, 13 nt, Mycobacterium tuberculosis H37Rv
cgcgaccucggag

SEQ ID NO: 3322739 - RNA, 19 nt, Mycobacterium tuberculosis H37Rv
cgcgaccuggucgaacugu

SEQ ID NO: 3322740 - RNA, 17 nt, Mycobacterium tuberculosis H37Rv
cgcgaccuugcccgcua

SEQ ID NO: 3322741 - RNA, 14 nt, Mycobacterium tuberculosis H37Rv
cgcgacgacgaggu

SEQ ID NO: 3322742 - RNA, 15 nt, Mycobacterium tuberculosis H37Rv
cgcgacgaucgucca

SEQ ID NO: 3322743 - RNA, 22 nt, Mycobacterium tuberculosis H37Rv
cgcgacgaugugguccaucgcg

SEQ ID NO: 3322744 - RNA, 14 nt, Mycobacterium tuberculosis H37Rv
cgcgacgcacugcc

SEQ ID NO: 3322745 - RNA, 13 nt, Mycobacterium tuberculosis H37Rv
cgcgacgcggggc

SEQ ID NO: 3322746 - RNA, 19 nt, Mycobacterium tuberculosis H37Rv
cgcgacggcacgaucaucg

SEQ ID NO: 3322747 - RNA, 22 nt, Mycobacterium tuberculosis H37Rv
cgcgacggucaaggugcgccgc

SEQ ID NO: 3322748 - RNA, 23 nt, Mycobacterium tuberculosis H37Rv
cgcgacggucccuucgucaccgu

SEQ ID NO: 3322749 - RNA, 18 nt, Mycobacterium tuberculosis H37Rv
cgcgacguacgaguagug

SEQ ID NO: 3322750 - RNA, 18 nt, Mycobacterium tuberculosis H37Rv
cgcgacguaguggaagcc

SEQ ID NO: 3322751 - RNA, 21 nt, Mycobacterium tuberculosis H37Rv
cgcgacguaguggaagccgac

SEQ ID NO: 3322752 - RNA, 18 nt, Mycobacterium tuberculosis H37Rv
cgcgacguaguugccggc

SEQ ID NO: 3322753 - RNA, 16 nt, Mycobacterium tuberculosis H37Rv
cgcgacguccaccagc

SEQ ID NO: 3322754 - RNA, 19 nt, Mycobacterium tuberculosis H37Rv
cgcgacguccaccagccgg

SEQ ID NO: 3322755 - RNA, 20 nt, Mycobacterium tuberculosis H37Rv
cgcgacguccaccagccggu

SEQ ID NO: 3322756 - RNA, 14 nt, Mycobacterium tuberculosis H37Rv
cgcgacgucggccg

SEQ ID NO: 3322757 - RNA, 12 nt, Mycobacterium tuberculosis H37Rv
cgcgacgucugc

SEQ ID NO: 3322758 - RNA, 22 nt, Mycobacterium tuberculosis H37Rv
cgcgacgucugccaggcgcagc

SEQ ID NO: 3322759 - RNA, 14 nt, Mycobacterium tuberculosis H37Rv
cgcgacuaccaucg

SEQ ID NO: 3322760 - RNA, 17 nt, Mycobacterium tuberculosis H37Rv
cgcgacuaccaucgccg

SEQ ID NO: 3322761 - RNA, 20 nt, Mycobacterium tuberculosis H37Rv
cgcgacuaccaucgccgccc

SEQ ID NO: 3322762 - RNA, 16 nt, Mycobacterium tuberculosis H37Rv
cgcgacuagacgccgc

SEQ ID NO: 3322763 - RNA, 17 nt, Mycobacterium tuberculosis H37Rv
cgcgacuagacgccgcc

SEQ ID NO: 3322764 - RNA, 16 nt, Mycobacterium tuberculosis H37Rv
cgcgacugauccucga

SEQ ID NO: 3322765 - RNA, 20 nt, Mycobacterium tuberculosis H37Rv
cgcgacugauccucgaugac

SEQ ID NO: 3322766 - RNA, 22 nt, Mycobacterium tuberculosis H37Rv
cgcgacuugcaccccgucucgg

SEQ ID NO: 3322767 - RNA, 17 nt, Mycobacterium tuberculosis H37Rv
cgcgagaaggugcugcg

SEQ ID NO: 3322768 - RNA, 12 nt, Mycobacterium tuberculosis H37Rv
cgcgagaucggg

SEQ ID NO: 3322769 - RNA, 15 nt, Mycobacterium tuberculosis H37Rv
cgcgagcaacaccag

SEQ ID NO: 3322770 - RNA, 16 nt, Mycobacterium tuberculosis H37Rv
cgcgagcaacaccagg

SEQ ID NO: 3322771 - RNA, 18 nt, Mycobacterium tuberculosis H37Rv
cgcgagcaacaccagggc

SEQ ID NO: 3322772 - RNA, 15 nt, Mycobacterium tuberculosis H37Rv
cgcgagcagacgcgg

SEQ ID NO: 3322773 - RNA, 15 nt, Mycobacterium tuberculosis H37Rv
cgcgagcaucgacga

SEQ ID NO: 3322774 - RNA, 23 nt, Mycobacterium tuberculosis H37Rv
cgcgagccagcugcuccacccga

SEQ ID NO: 3322775 - RNA, 16 nt, Mycobacterium tuberculosis H37Rv
cgcgagcccauggacc

SEQ ID NO: 3322776 - RNA, 17 nt, Mycobacterium tuberculosis H37Rv
cgcgagcccgccacagc

SEQ ID NO: 3322777 - RNA, 13 nt, Mycobacterium tuberculosis H37Rv
cgcgagccgguga

SEQ ID NO: 3322778 - RNA, 14 nt, Mycobacterium tuberculosis H37Rv
cgcgagcgagccaa

SEQ ID NO: 3322779 - RNA, 13 nt, Mycobacterium tuberculosis H37Rv
cgcgagcgcgcga

SEQ ID NO: 3322780 - RNA, 19 nt, Mycobacterium tuberculosis H37Rv
cgcgagcgcuaucaccgcc

SEQ ID NO: 3322781 - RNA, 22 nt, Mycobacterium tuberculosis H37Rv
cgcgagcggaauggaggccgcc

SEQ ID NO: 3322782 - RNA, 23 nt, Mycobacterium tuberculosis H37Rv
cgcgagcggaauggaggccgccg

SEQ ID NO: 3322783 - RNA, 21 nt, Mycobacterium tuberculosis H37Rv
cgcgagcggaugaaaucggca

SEQ ID NO: 3322784 - RNA, 22 nt, Mycobacterium tuberculosis H37Rv
cgcgagcggaugaaaucggcaa

SEQ ID NO: 3322785 - RNA, 21 nt, Mycobacterium tuberculosis H37Rv
cgcgagcuuggccagcagcag

SEQ ID NO: 3322786 - RNA, 14 nt, Mycobacterium tuberculosis H37Rv
cgcgaggaugcuga

SEQ ID NO: 3322787 - RNA, 21 nt, Mycobacterium tuberculosis H37Rv
cgcgaggucggcggcgcaggu

SEQ ID NO: 3322788 - RNA, 23 nt, Mycobacterium tuberculosis H37Rv
cgcgagguugaccaccagcgugc

SEQ ID NO: 3322789 - RNA, 22 nt, Mycobacterium tuberculosis H37Rv
cgcgaguaaucgaccgaacgcc

SEQ ID NO: 3322790 - RNA, 17 nt, Mycobacterium tuberculosis H37Rv
cgcgaguagaucaucga

SEQ ID NO: 3322791 - RNA, 15 nt, Mycobacterium tuberculosis H37Rv
cgcgaguagcugacc

SEQ ID NO: 3322792 - RNA, 15 nt, Mycobacterium tuberculosis H37Rv
cgcgaguccaggcug

SEQ ID NO: 3322793 - RNA, 16 nt, Mycobacterium tuberculosis H37Rv
cgcgagucgcccguga

SEQ ID NO: 3322794 - RNA, 12 nt, Mycobacterium tuberculosis H37Rv
cgcgagucggcg

SEQ ID NO: 3322795 - RNA, 22 nt, Mycobacterium tuberculosis H37Rv
cgcgauagauacccgcggcagc

SEQ ID NO: 3322796 - RNA, 20 nt, Mycobacterium tuberculosis H37Rv
cgcgaucaccgagucgacgg

SEQ ID NO: 3322797 - RNA, 20 nt, Mycobacterium tuberculosis H37Rv
cgcgaucaccucgccacacu

SEQ ID NO: 3322798 - RNA, 16 nt, Mycobacterium tuberculosis H37Rv
cgcgaucagcgcgcac

SEQ ID NO: 3322799 - RNA, 18 nt, Mycobacterium tuberculosis H37Rv
cgcgaucaguugcucguu

SEQ ID NO: 3322800 - RNA, 18 nt, Mycobacterium tuberculosis H37Rv
cgcgauccccgcgcugag

SEQ ID NO: 3322801 - RNA, 16 nt, Mycobacterium tuberculosis H37Rv
cgcgauccgcgcgcau

SEQ ID NO: 3322802 - RNA, 16 nt, Mycobacterium tuberculosis H37Rv
cgcgaucgacgcucgg

SEQ ID NO: 3322803 - RNA, 13 nt, Mycobacterium tuberculosis H37Rv
cgcgaucgcagug

SEQ ID NO: 3322804 - RNA, 17 nt, Mycobacterium tuberculosis H37Rv
cgcgaucgcagugagca

SEQ ID NO: 3322805 - RNA, 17 nt, Mycobacterium tuberculosis H37Rv
cgcgaucggcgucacga

SEQ ID NO: 3322806 - RNA, 17 nt, Mycobacterium tuberculosis H37Rv
cgcgaucgggcccagca

SEQ ID NO: 3322807 - RNA, 19 nt, Mycobacterium tuberculosis H37Rv
cgcgaucgggcccagcagc

SEQ ID NO: 3322808 - RNA, 20 nt, Mycobacterium tuberculosis H37Rv
cgcgaucgggcccagcagcg

SEQ ID NO: 3322809 - RNA, 18 nt, Mycobacterium tuberculosis H37Rv
cgcgaucgggccgaucuc

SEQ ID NO: 3322810 - RNA, 20 nt, Mycobacterium tuberculosis H37Rv
cgcgaugaccgcaccgaccu

SEQ ID NO: 3322811 - RNA, 17 nt, Mycobacterium tuberculosis H37Rv
cgcgaugaccucggcga

SEQ ID NO: 3322812 - RNA, 20 nt, Mycobacterium tuberculosis H37Rv
cgcgaugaccucggcgaugu

SEQ ID NO: 3322813 - RNA, 22 nt, Mycobacterium tuberculosis H37Rv
cgcgaugaccucggcgaugucg

SEQ ID NO: 3322814 - RNA, 19 nt, Mycobacterium tuberculosis H37Rv
cgcgaugacgacgaaccgg

SEQ ID NO: 3322815 - RNA, 20 nt, Mycobacterium tuberculosis H37Rv
cgcgaugacgaguucgcgca

SEQ ID NO: 3322816 - RNA, 21 nt, Mycobacterium tuberculosis H37Rv
cgcgaugacggugccgaccgc

SEQ ID NO: 3322817 - RNA, 13 nt, Mycobacterium tuberculosis H37Rv
cgcgaugagcggc

SEQ ID NO: 3322818 - RNA, 19 nt, Mycobacterium tuberculosis H37Rv
cgcgaugaucaugaacgcc

SEQ ID NO: 3322819 - RNA, 23 nt, Mycobacterium tuberculosis H37Rv
cgcgaugaucaugaacgccagca

SEQ ID NO: 3322820 - RNA, 21 nt, Mycobacterium tuberculosis H37Rv
cgcgaugcccacgcacagcaa

SEQ ID NO: 3322821 - RNA, 20 nt, Mycobacterium tuberculosis H37Rv
cgcgaugccccacggugcgg

SEQ ID NO: 3322822 - RNA, 17 nt, Mycobacterium tuberculosis H37Rv
cgcgaugcgcaccagcg

SEQ ID NO: 3322823 - RNA, 14 nt, Mycobacterium tuberculosis H37Rv
cgcgaugcuucccg

SEQ ID NO: 3322824 - RNA, 15 nt, Mycobacterium tuberculosis H37Rv
cgcgaugcuucccgg

SEQ ID NO: 3322825 - RNA, 19 nt, Mycobacterium tuberculosis H37Rv
cgcgaugcuucccggaugc

SEQ ID NO: 3322826 - RNA, 17 nt, Mycobacterium tuberculosis H37Rv
cgcgauggcguagccca

SEQ ID NO: 3322827 - RNA, 18 nt, Mycobacterium tuberculosis H37Rv
cgcgaugggauaccgcgu

SEQ ID NO: 3322828 - RNA, 20 nt, Mycobacterium tuberculosis H37Rv
cgcgaugggcccagcggccg

SEQ ID NO: 3322829 - RNA, 22 nt, Mycobacterium tuberculosis H37Rv
cgcgaugguuauccccuggcca

SEQ ID NO: 3322830 - RNA, 15 nt, Mycobacterium tuberculosis H37Rv
cgcgauguccaggug

SEQ ID NO: 3322831 - RNA, 17 nt, Mycobacterium tuberculosis H37Rv
cgcgauguccagguggc

SEQ ID NO: 3322832 - RNA, 14 nt, Mycobacterium tuberculosis H37Rv
cgcgaugucguucg

SEQ ID NO: 3322833 - RNA, 20 nt, Mycobacterium tuberculosis H37Rv
cgcgauuagcaaaccgaccg

SEQ ID NO: 3322834 - RNA, 13 nt, Mycobacterium tuberculosis H37Rv
cgcgauucagaca

SEQ ID NO: 3322835 - RNA, 18 nt, Mycobacterium tuberculosis H37Rv
cgcgcaaaugccugcugg

SEQ ID NO: 3322836 - RNA, 20 nt, Mycobacterium tuberculosis H37Rv
cgcgcaaaugccugcugguc

SEQ ID NO: 3322837 - RNA, 16 nt, Mycobacterium tuberculosis H37Rv
cgcgcaacacauccag

SEQ ID NO: 3322838 - RNA, 23 nt, Mycobacterium tuberculosis H37Rv
cgcgcaacaccucgucggcuuug

SEQ ID NO: 3322839 - RNA, 23 nt, Mycobacterium tuberculosis H37Rv
cgcgcaaccagauccgguccacc

SEQ ID NO: 3322840 - RNA, 14 nt, Mycobacterium tuberculosis H37Rv
cgcgcaacccggac

SEQ ID NO: 3322841 - RNA, 16 nt, Mycobacterium tuberculosis H37Rv
cgcgcaacccggacga

SEQ ID NO: 3322842 - RNA, 14 nt, Mycobacterium tuberculosis H37Rv
cgcgcaacccugcc

SEQ ID NO: 3322843 - RNA, 21 nt, Mycobacterium tuberculosis H37Rv
cgcgcaacccugccgcgauga

SEQ ID NO: 3322844 - RNA, 15 nt, Mycobacterium tuberculosis H37Rv
cgcgcaaccgggcgg

SEQ ID NO: 3322845 - RNA, 18 nt, Mycobacterium tuberculosis H37Rv
cgcgcaacgccgccagcc

SEQ ID NO: 3322846 - RNA, 19 nt, Mycobacterium tuberculosis H37Rv
cgcgcaacguacgcacgca

SEQ ID NO: 3322847 - RNA, 21 nt, Mycobacterium tuberculosis H37Rv
cgcgcaacguacgcacgcagc

SEQ ID NO: 3322848 - RNA, 17 nt, Mycobacterium tuberculosis H37Rv
cgcgcaacguagccagc

SEQ ID NO: 3322849 - RNA, 19 nt, Mycobacterium tuberculosis H37Rv
cgcgcaacguagccagcag

SEQ ID NO: 3322850 - RNA, 21 nt, Mycobacterium tuberculosis H37Rv
cgcgcaacguagccagcagcg

SEQ ID NO: 3322851 - RNA, 20 nt, Mycobacterium tuberculosis H37Rv
cgcgcaacuuccauuuucgc

SEQ ID NO: 3322852 - RNA, 23 nt, Mycobacterium tuberculosis H37Rv
cgcgcaacuuccauuuucgccaa

SEQ ID NO: 3322853 - RNA, 24 nt, Mycobacterium tuberculosis H37Rv
cgcgcaagcggacccgaccgucgu

SEQ ID NO: 3322854 - RNA, 19 nt, Mycobacterium tuberculosis H37Rv
cgcgcaaggcgccgcaggg

SEQ ID NO: 3322855 - RNA, 12 nt, Mycobacterium tuberculosis H37Rv
cgcgcaagucga

SEQ ID NO: 3322856 - RNA, 17 nt, Mycobacterium tuberculosis H37Rv
cgcgcaccaacaccagc

SEQ ID NO: 3322857 - RNA, 13 nt, Mycobacterium tuberculosis H37Rv
cgcgcaccaccgc

SEQ ID NO: 3322858 - RNA, 16 nt, Mycobacterium tuberculosis H37Rv
cgcgcacccagcccag

SEQ ID NO: 3322859 - RNA, 23 nt, Mycobacterium tuberculosis H37Rv
cgcgcacccagcccagccguucg

SEQ ID NO: 3322860 - RNA, 18 nt, Mycobacterium tuberculosis H37Rv
cgcgcacccguccgccgc

SEQ ID NO: 3322861 - RNA, 19 nt, Mycobacterium tuberculosis H37Rv
cgcgcaccgaccgcaccgu

SEQ ID NO: 3322862 - RNA, 13 nt, Mycobacterium tuberculosis H37Rv
cgcgcaccggauc

SEQ ID NO: 3322863 - RNA, 17 nt, Mycobacterium tuberculosis H37Rv
cgcgcaccggaucgccg

SEQ ID NO: 3322864 - RNA, 18 nt, Mycobacterium tuberculosis H37Rv
cgcgcacgacaacuucgc

SEQ ID NO: 3322865 - RNA, 14 nt, Mycobacterium tuberculosis H37Rv
cgcgcacgcccugg

SEQ ID NO: 3322866 - RNA, 14 nt, Mycobacterium tuberculosis H37Rv
cgcgcacggcgucg

SEQ ID NO: 3322867 - RNA, 20 nt, Mycobacterium tuberculosis H37Rv
cgcgcacucgacggucaucg

SEQ ID NO: 3322868 - RNA, 20 nt, Mycobacterium tuberculosis H37Rv
cgcgcacuugcguggcguug

SEQ ID NO: 3322869 - RNA, 18 nt, Mycobacterium tuberculosis H37Rv
cgcgcagacucgccaccg

SEQ ID NO: 3322870 - RNA, 15 nt, Mycobacterium tuberculosis H37Rv
cgcgcagauacgcgu

SEQ ID NO: 3322871 - RNA, 17 nt, Mycobacterium tuberculosis H37Rv
cgcgcagauacgcgugu

SEQ ID NO: 3322872 - RNA, 20 nt, Mycobacterium tuberculosis H37Rv
cgcgcagaucgaaaucagcc

SEQ ID NO: 3322873 - RNA, 15 nt, Mycobacterium tuberculosis H37Rv
cgcgcagaucgucca

SEQ ID NO: 3322874 - RNA, 19 nt, Mycobacterium tuberculosis H37Rv
cgcgcagaucguccaccgc

SEQ ID NO: 3322875 - RNA, 16 nt, Mycobacterium tuberculosis H37Rv
cgcgcagauggcauug

SEQ ID NO: 3322876 - RNA, 14 nt, Mycobacterium tuberculosis H37Rv
cgcgcagcaccggc

SEQ ID NO: 3322877 - RNA, 20 nt, Mycobacterium tuberculosis H37Rv
cgcgcagcaccggcucgacu

SEQ ID NO: 3322878 - RNA, 20 nt, Mycobacterium tuberculosis H37Rv
cgcgcagcacugcggcagcg

SEQ ID NO: 3322879 - RNA, 12 nt, Mycobacterium tuberculosis H37Rv
cgcgcagcagug

SEQ ID NO: 3322880 - RNA, 12 nt, Mycobacterium tuberculosis H37Rv
cgcgcagcaguu

SEQ ID NO: 3322881 - RNA, 16 nt, Mycobacterium tuberculosis H37Rv
cgcgcagcaucggcga

SEQ ID NO: 3322882 - RNA, 22 nt, Mycobacterium tuberculosis H37Rv
cgcgcagcaucuccgccggucc

SEQ ID NO: 3322883 - RNA, 14 nt, Mycobacterium tuberculosis H37Rv
cgcgcagccgcucg

SEQ ID NO: 3322884 - RNA, 15 nt, Mycobacterium tuberculosis H37Rv
cgcgcagccgcucga

SEQ ID NO: 3322885 - RNA, 17 nt, Mycobacterium tuberculosis H37Rv
cgcgcagccgggcaccg

SEQ ID NO: 3322886 - RNA, 12 nt, Mycobacterium tuberculosis H37Rv
cgcgcagcgcga

SEQ ID NO: 3322887 - RNA, 16 nt, Mycobacterium tuberculosis H37Rv
cgcgcagcgcgaucgc

SEQ ID NO: 3322888 - RNA, 16 nt, Mycobacterium tuberculosis H37Rv
cgcgcagcgguccgcc

SEQ ID NO: 3322889 - RNA, 18 nt, Mycobacterium tuberculosis H37Rv
cgcgcagcgguccgccgc

SEQ ID NO: 3322890 - RNA, 17 nt, Mycobacterium tuberculosis H37Rv
cgcgcagcgucaaaccu

SEQ ID NO: 3322891 - RNA, 14 nt, Mycobacterium tuberculosis H37Rv
cgcgcagcuccacc

SEQ ID NO: 3322892 - RNA, 15 nt, Mycobacterium tuberculosis H37Rv
cgcgcagcuccaccg

SEQ ID NO: 3322893 - RNA, 15 nt, Mycobacterium tuberculosis H37Rv
cgcgcagcugccgca

SEQ ID NO: 3322894 - RNA, 17 nt, Mycobacterium tuberculosis H37Rv
cgcgcagcugccgcacc

SEQ ID NO: 3322895 - RNA, 19 nt, Mycobacterium tuberculosis H37Rv
cgcgcagcugccgcacccc

SEQ ID NO: 3322896 - RNA, 13 nt, Mycobacterium tuberculosis H37Rv
cgcgcaggaagcc

SEQ ID NO: 3322897 - RNA, 19 nt, Mycobacterium tuberculosis H37Rv
cgcgcaggaagccggcgug

SEQ ID NO: 3322898 - RNA, 16 nt, Mycobacterium tuberculosis H37Rv
cgcgcaggccgacacg

SEQ ID NO: 3322899 - RNA, 15 nt, Mycobacterium tuberculosis H37Rv
cgcgcagggaucgca

SEQ ID NO: 3322900 - RNA, 18 nt, Mycobacterium tuberculosis H37Rv
cgcgcagggaucgcaggg

SEQ ID NO: 3322901 - RNA, 17 nt, Mycobacterium tuberculosis H37Rv
cgcgcaggggcggcgug

SEQ ID NO: 3322902 - RNA, 21 nt, Mycobacterium tuberculosis H37Rv
cgcgcagguagccaucggugc

SEQ ID NO: 3322903 - RNA, 17 nt, Mycobacterium tuberculosis H37Rv
cgcgcagguagcgcucg

SEQ ID NO: 3322904 - RNA, 18 nt, Mycobacterium tuberculosis H37Rv
cgcgcagguagcgcucga

SEQ ID NO: 3322905 - RNA, 14 nt, Mycobacterium tuberculosis H37Rv
cgcgcauauccgca

SEQ ID NO: 3322906 - RNA, 15 nt, Mycobacterium tuberculosis H37Rv
cgcgcauauccgcag

SEQ ID NO: 3322907 - RNA, 16 nt, Mycobacterium tuberculosis H37Rv
cgcgcaucaucgccca

SEQ ID NO: 3322908 - RNA, 19 nt, Mycobacterium tuberculosis H37Rv
cgcgcaucaucgcccaccg

SEQ ID NO: 3322909 - RNA, 20 nt, Mycobacterium tuberculosis H37Rv
cgcgcaucaucgcccaccgc

SEQ ID NO: 3322910 - RNA, 17 nt, Mycobacterium tuberculosis H37Rv
cgcgcaucugucgcgcg

SEQ ID NO: 3322911 - RNA, 22 nt, Mycobacterium tuberculosis H37Rv
cgcgcauguuaugagcgcucgg

SEQ ID NO: 3322912 - RNA, 14 nt, Mycobacterium tuberculosis H37Rv
cgcgcauucgccgg

SEQ ID NO: 3322913 - RNA, 16 nt, Mycobacterium tuberculosis H37Rv
cgcgcauucgccgggc

SEQ ID NO: 3322914 - RNA, 21 nt, Mycobacterium tuberculosis H37Rv
cgcgcauucgggaucggccgg

SEQ ID NO: 3322915 - RNA, 17 nt, Mycobacterium tuberculosis H37Rv
cgcgcauugccgacgcg

SEQ ID NO: 3322916 - RNA, 21 nt, Mycobacterium tuberculosis H37Rv
cgcgcauugccgacgcgcggc

SEQ ID NO: 3322917 - RNA, 17 nt, Mycobacterium tuberculosis H37Rv
cgcgcauuucguggcgc

SEQ ID NO: 3322918 - RNA, 20 nt, Mycobacterium tuberculosis H37Rv
cgcgcauuuuucgccagcug

SEQ ID NO: 3322919 - RNA, 20 nt, Mycobacterium tuberculosis H37Rv
cgcgccaaacaccccggccu

SEQ ID NO: 3322920 - RNA, 22 nt, Mycobacterium tuberculosis H37Rv
cgcgccaacagaugccacccag

SEQ ID NO: 3322921 - RNA, 15 nt, Mycobacterium tuberculosis H37Rv
cgcgccaagacgaac

SEQ ID NO: 3322922 - RNA, 20 nt, Mycobacterium tuberculosis H37Rv
cgcgccaaguggcgcucgca

SEQ ID NO: 3322923 - RNA, 15 nt, Mycobacterium tuberculosis H37Rv
cgcgccaccagcacc

SEQ ID NO: 3322924 - RNA, 18 nt, Mycobacterium tuberculosis H37Rv
cgcgccaccagcaccgcc

SEQ ID NO: 3322925 - RNA, 12 nt, Mycobacterium tuberculosis H37Rv
cgcgccacccag

SEQ ID NO: 3322926 - RNA, 16 nt, Mycobacterium tuberculosis H37Rv
cgcgccacccagcacc

SEQ ID NO: 3322927 - RNA, 11 nt, Mycobacterium tuberculosis H37Rv
cgcgccaccga

SEQ ID NO: 3322928 - RNA, 23 nt, Mycobacterium tuberculosis H37Rv
cgcgccaccgagcccuccagggc

SEQ ID NO: 3322929 - RNA, 12 nt, Mycobacterium tuberculosis H37Rv
cgcgccaccgau

SEQ ID NO: 3322930 - RNA, 13 nt, Mycobacterium tuberculosis H37Rv
cgcgccaccgaua

SEQ ID NO: 3322931 - RNA, 22 nt, Mycobacterium tuberculosis H37Rv
cgcgccaccgauaccgucagcg

SEQ ID NO: 3322932 - RNA, 16 nt, Mycobacterium tuberculosis H37Rv
cgcgccaccggcaccg

SEQ ID NO: 3322933 - RNA, 20 nt, Mycobacterium tuberculosis H37Rv
cgcgccaccggcaccgccug

SEQ ID NO: 3322934 - RNA, 22 nt, Mycobacterium tuberculosis H37Rv
cgcgccaccgugguucggcggc

SEQ ID NO: 3322935 - RNA, 14 nt, Mycobacterium tuberculosis H37Rv
cgcgccagccucca

SEQ ID NO: 3322936 - RNA, 21 nt, Mycobacterium tuberculosis H37Rv
cgcgccagccuccaccagguc

SEQ ID NO: 3322937 - RNA, 13 nt, Mycobacterium tuberculosis H37Rv
cgcgccagcuccg

SEQ ID NO: 3322938 - RNA, 15 nt, Mycobacterium tuberculosis H37Rv
cgcgccaggccacgu

SEQ ID NO: 3322939 - RNA, 22 nt, Mycobacterium tuberculosis H37Rv
cgcgccaggcgcgaucgcgccc

SEQ ID NO: 3322940 - RNA, 19 nt, Mycobacterium tuberculosis H37Rv
cgcgccaggcuugcggcac

SEQ ID NO: 3322941 - RNA, 20 nt, Mycobacterium tuberculosis H37Rv
cgcgccaggcuugcggcacc

SEQ ID NO: 3322942 - RNA, 17 nt, Mycobacterium tuberculosis H37Rv
cgcgccaggucggugac

SEQ ID NO: 3322943 - RNA, 19 nt, Mycobacterium tuberculosis H37Rv
cgcgccaggucggugacga

SEQ ID NO: 3322944 - RNA, 21 nt, Mycobacterium tuberculosis H37Rv
cgcgccaguguggugcggcgc

SEQ ID NO: 3322945 - RNA, 13 nt, Mycobacterium tuberculosis H37Rv
cgcgcccaccccg

SEQ ID NO: 3322946 - RNA, 20 nt, Mycobacterium tuberculosis H37Rv
cgcgcccaccccggccgcau

SEQ ID NO: 3322947 - RNA, 21 nt, Mycobacterium tuberculosis H37Rv
cgcgccccaccgcgccgagca

SEQ ID NO: 3322948 - RNA, 19 nt, Mycobacterium tuberculosis H37Rv
cgcgccccagacgcgcagg

SEQ ID NO: 3322949 - RNA, 19 nt, Mycobacterium tuberculosis H37Rv
cgcgcccccggugccguug

SEQ ID NO: 3322950 - RNA, 14 nt, Mycobacterium tuberculosis H37Rv
cgcgccccgccgca

SEQ ID NO: 3322951 - RNA, 16 nt, Mycobacterium tuberculosis H37Rv
cgcgcccgacacccgu

SEQ ID NO: 3322952 - RNA, 16 nt, Mycobacterium tuberculosis H37Rv
cgcgcccgagaccggc

SEQ ID NO: 3322953 - RNA, 16 nt, Mycobacterium tuberculosis H37Rv
cgcgcccgagccggua

SEQ ID NO: 3322954 - RNA, 13 nt, Mycobacterium tuberculosis H37Rv
cgcgcccgcacca

SEQ ID NO: 3322955 - RNA, 15 nt, Mycobacterium tuberculosis H37Rv
cgcgcccgcaccacc

SEQ ID NO: 3322956 - RNA, 21 nt, Mycobacterium tuberculosis H37Rv
cgcgcccgccaucagcccggc

SEQ ID NO: 3322957 - RNA, 19 nt, Mycobacterium tuberculosis H37Rv
cgcgcccgccucaucggca

SEQ ID NO: 3322958 - RNA, 15 nt, Mycobacterium tuberculosis H37Rv
cgcgcccgccucgac

SEQ ID NO: 3322959 - RNA, 18 nt, Mycobacterium tuberculosis H37Rv
cgcgcccgccucgaccgc

SEQ ID NO: 3322960 - RNA, 22 nt, Mycobacterium tuberculosis H37Rv
cgcgcccgccucgaccgccagc

SEQ ID NO: 3322961 - RNA, 14 nt, Mycobacterium tuberculosis H37Rv
cgcgcccgcgcgcu

SEQ ID NO: 3322962 - RNA, 13 nt, Mycobacterium tuberculosis H37Rv
cgcgcccgcgggc

SEQ ID NO: 3322963 - RNA, 21 nt, Mycobacterium tuberculosis H37Rv
cgcgcccggaucucggcguag

SEQ ID NO: 3322964 - RNA, 14 nt, Mycobacterium tuberculosis H37Rv
cgcgcccggcgcua

SEQ ID NO: 3322965 - RNA, 17 nt, Mycobacterium tuberculosis H37Rv
cgcgcccggcgcuagcg

SEQ ID NO: 3322966 - RNA, 21 nt, Mycobacterium tuberculosis H37Rv
cgcgcccggcgcuagcgccgc

SEQ ID NO: 3322967 - RNA, 19 nt, Mycobacterium tuberculosis H37Rv
cgcgcccgggcggaacgcc

SEQ ID NO: 3322968 - RNA, 14 nt, Mycobacterium tuberculosis H37Rv
cgcgcccucagccg

SEQ ID NO: 3322969 - RNA, 23 nt, Mycobacterium tuberculosis H37Rv
cgcgcccuucagcacggugauca

SEQ ID NO: 3322970 - RNA, 21 nt, Mycobacterium tuberculosis H37Rv
cgcgccgaacacgcacacgau

SEQ ID NO: 3322971 - RNA, 17 nt, Mycobacterium tuberculosis H37Rv
cgcgccgaccaccgcug

SEQ ID NO: 3322972 - RNA, 17 nt, Mycobacterium tuberculosis H37Rv
cgcgccgaccucaucgg

SEQ ID NO: 3322973 - RNA, 19 nt, Mycobacterium tuberculosis H37Rv
cgcgccgaccucaucggca

SEQ ID NO: 3322974 - RNA, 19 nt, Mycobacterium tuberculosis H37Rv
cgcgccgacggccagcagg

SEQ ID NO: 3322975 - RNA, 15 nt, Mycobacterium tuberculosis H37Rv
cgcgccgagcccggg

SEQ ID NO: 3322976 - RNA, 17 nt, Mycobacterium tuberculosis H37Rv
cgcgccgagcccgggcc

SEQ ID NO: 3322977 - RNA, 18 nt, Mycobacterium tuberculosis H37Rv
cgcgccgagcccgggccu

SEQ ID NO: 3322978 - RNA, 18 nt, Mycobacterium tuberculosis H37Rv
cgcgccgaguugcccggg

SEQ ID NO: 3322979 - RNA, 14 nt, Mycobacterium tuberculosis H37Rv
cgcgccgaucacca

SEQ ID NO: 3322980 - RNA, 13 nt, Mycobacterium tuberculosis H37Rv
cgcgccgaucacg

SEQ ID NO: 3322981 - RNA, 17 nt, Mycobacterium tuberculosis H37Rv
cgcgccgauuccaccgc

SEQ ID NO: 3322982 - RNA, 18 nt, Mycobacterium tuberculosis H37Rv
cgcgccgauuccaccgcc

SEQ ID NO: 3322983 - RNA, 23 nt, Mycobacterium tuberculosis H37Rv
cgcgccgauuccaccgccgacgc

SEQ ID NO: 3322984 - RNA, 15 nt, Mycobacterium tuberculosis H37Rv
cgcgccgcaucggcg

SEQ ID NO: 3322985 - RNA, 17 nt, Mycobacterium tuberculosis H37Rv
cgcgccgccagcgccgc

SEQ ID NO: 3322986 - RNA, 23 nt, Mycobacterium tuberculosis H37Rv
cgcgccgccagcgccgccggcac

SEQ ID NO: 3322987 - RNA, 23 nt, Mycobacterium tuberculosis H37Rv
cgcgccgccgcuacccccgaugg

SEQ ID NO: 3322988 - RNA, 16 nt, Mycobacterium tuberculosis H37Rv
cgcgccgccucgggca

SEQ ID NO: 3322989 - RNA, 17 nt, Mycobacterium tuberculosis H37Rv
cgcgccgcgaggcaccg

SEQ ID NO: 3322990 - RNA, 13 nt, Mycobacterium tuberculosis H37Rv
cgcgccgcgcauc

SEQ ID NO: 3322991 - RNA, 16 nt, Mycobacterium tuberculosis H37Rv
cgcgccgcgcaucgcg

SEQ ID NO: 3322992 - RNA, 19 nt, Mycobacterium tuberculosis H37Rv
cgcgccgcgcaucgcggcc

SEQ ID NO: 3322993 - RNA, 13 nt, Mycobacterium tuberculosis H37Rv
cgcgccgcgccgc

SEQ ID NO: 3322994 - RNA, 19 nt, Mycobacterium tuberculosis H37Rv
cgcgccgcgcucgccgaua

SEQ ID NO: 3322995 - RNA, 13 nt, Mycobacterium tuberculosis H37Rv
cgcgccgcggccc

SEQ ID NO: 3322996 - RNA, 21 nt, Mycobacterium tuberculosis H37Rv
cgcgccgcggcccgcuccacg

SEQ ID NO: 3322997 - RNA, 17 nt, Mycobacterium tuberculosis H37Rv
cgcgccgcuaaccggac

SEQ ID NO: 3322998 - RNA, 20 nt, Mycobacterium tuberculosis H37Rv
cgcgccgcugggugaccagg

SEQ ID NO: 3322999 - RNA, 16 nt, Mycobacterium tuberculosis H37Rv
cgcgccggacagcgca

SEQ ID NO: 3323000 - RNA, 16 nt, Mycobacterium tuberculosis H37Rv
cgcgccggauacaccg

SEQ ID NO: 3323001 - RNA, 18 nt, Mycobacterium tuberculosis H37Rv
cgcgccggauguauucca

SEQ ID NO: 3323002 - RNA, 14 nt, Mycobacterium tuberculosis H37Rv
cgcgccggcagacc

SEQ ID NO: 3323003 - RNA, 20 nt, Mycobacterium tuberculosis H37Rv
cgcgccggcagacccgggcc

SEQ ID NO: 3323004 - RNA, 21 nt, Mycobacterium tuberculosis H37Rv
cgcgccggcagacccgggcca

SEQ ID NO: 3323005 - RNA, 12 nt, Mycobacterium tuberculosis H37Rv
cgcgccggcccc

SEQ ID NO: 3323006 - RNA, 13 nt, Mycobacterium tuberculosis H37Rv
cgcgccggccgcu

SEQ ID NO: 3323007 - RNA, 12 nt, Mycobacterium tuberculosis H37Rv
cgcgccggcggc

SEQ ID NO: 3323008 - RNA, 13 nt, Mycobacterium tuberculosis H37Rv
cgcgccggcggca

SEQ ID NO: 3323009 - RNA, 17 nt, Mycobacterium tuberculosis H37Rv
cgcgccggcggccaccu

SEQ ID NO: 3323010 - RNA, 12 nt, Mycobacterium tuberculosis H37Rv
cgcgccggcggu

SEQ ID NO: 3323011 - RNA, 13 nt, Mycobacterium tuberculosis H37Rv
cgcgccggcggua

SEQ ID NO: 3323012 - RNA, 15 nt, Mycobacterium tuberculosis H37Rv
cgcgccggcgguagu

SEQ ID NO: 3323013 - RNA, 14 nt, Mycobacterium tuberculosis H37Rv
cgcgccggcuaggg

SEQ ID NO: 3323014 - RNA, 16 nt, Mycobacterium tuberculosis H37Rv
cgcgccggcugccaca

SEQ ID NO: 3323015 - RNA, 19 nt, Mycobacterium tuberculosis H37Rv
cgcgccggcugccacacag

SEQ ID NO: 3323016 - RNA, 16 nt, Mycobacterium tuberculosis H37Rv
cgcgccggguccgcgg

SEQ ID NO: 3323017 - RNA, 20 nt, Mycobacterium tuberculosis H37Rv
cgcgccggugaggcgaccgg

SEQ ID NO: 3323018 - RNA, 14 nt, Mycobacterium tuberculosis H37Rv
cgcgccgguucaga

SEQ ID NO: 3323019 - RNA, 17 nt, Mycobacterium tuberculosis H37Rv
cgcgccgguucagacgg

SEQ ID NO: 3323020 - RNA, 19 nt, Mycobacterium tuberculosis H37Rv
cgcgccguagaccagcagg

SEQ ID NO: 3323021 - RNA, 22 nt, Mycobacterium tuberculosis H37Rv
cgcgccguagaccagcaggccc

SEQ ID NO: 3323022 - RNA, 19 nt, Mycobacterium tuberculosis H37Rv
cgcgccgucccgaaacgcc

SEQ ID NO: 3323023 - RNA, 24 nt, Mycobacterium tuberculosis H37Rv
cgcgccgucggguuccuccucggc

SEQ ID NO: 3323024 - RNA, 14 nt, Mycobacterium tuberculosis H37Rv
cgcgccgucgucga

SEQ ID NO: 3323025 - RNA, 17 nt, Mycobacterium tuberculosis H37Rv
cgcgccgucgucgacca

SEQ ID NO: 3323026 - RNA, 19 nt, Mycobacterium tuberculosis H37Rv
cgcgccgucgucgaccacg

SEQ ID NO: 3323027 - RNA, 19 nt, Mycobacterium tuberculosis H37Rv
cgcgccgucgucgcgcagu

SEQ ID NO: 3323028 - RNA, 13 nt, Mycobacterium tuberculosis H37Rv
cgcgccguucacc

SEQ ID NO: 3323029 - RNA, 23 nt, Mycobacterium tuberculosis H37Rv
cgcgccguucacccuggugguca

SEQ ID NO: 3323030 - RNA, 17 nt, Mycobacterium tuberculosis H37Rv
cgcgccuaugggccugc

SEQ ID NO: 3323031 - RNA, 21 nt, Mycobacterium tuberculosis H37Rv
cgcgccuccguugcccccauu

SEQ ID NO: 3323032 - RNA, 14 nt, Mycobacterium tuberculosis H37Rv
cgcgccugcccggg

SEQ ID NO: 3323033 - RNA, 12 nt, Mycobacterium tuberculosis H37Rv
cgcgccugccuc

SEQ ID NO: 3323034 - RNA, 13 nt, Mycobacterium tuberculosis H37Rv
cgcgccugccuca

SEQ ID NO: 3323035 - RNA, 18 nt, Mycobacterium tuberculosis H37Rv
cgcgccugccucaccgcc

SEQ ID NO: 3323036 - RNA, 19 nt, Mycobacterium tuberculosis H37Rv
cgcgccugccucaccgccg

SEQ ID NO: 3323037 - RNA, 19 nt, Mycobacterium tuberculosis H37Rv
cgcgccugugccaccgcug

SEQ ID NO: 3323038 - RNA, 19 nt, Mycobacterium tuberculosis H37Rv
cgcgccugugcgcaaggcc

SEQ ID NO: 3323039 - RNA, 14 nt, Mycobacterium tuberculosis H37Rv
cgcgccuucacgcu

SEQ ID NO: 3323040 - RNA, 19 nt, Mycobacterium tuberculosis H37Rv
cgcgccuucacgcuggccu

SEQ ID NO: 3323041 - RNA, 21 nt, Mycobacterium tuberculosis H37Rv
cgcgccuuggcacccuccgcc

SEQ ID NO: 3323042 - RNA, 15 nt, Mycobacterium tuberculosis H37Rv
cgcgccuuugagccc

SEQ ID NO: 3323043 - RNA, 17 nt, Mycobacterium tuberculosis H37Rv
cgcgccuuugagcccgc

SEQ ID NO: 3323044 - RNA, 22 nt, Mycobacterium tuberculosis H37Rv
cgcgcgaaacggugaaugugca

SEQ ID NO: 3323045 - RNA, 18 nt, Mycobacterium tuberculosis H37Rv
cgcgcgaaccccagccga

SEQ ID NO: 3323046 - RNA, 18 nt, Mycobacterium tuberculosis H37Rv
cgcgcgaagaucggcgcu

SEQ ID NO: 3323047 - RNA, 16 nt, Mycobacterium tuberculosis H37Rv
cgcgcgacaacccggc

SEQ ID NO: 3323048 - RNA, 23 nt, Mycobacterium tuberculosis H37Rv
cgcgcgacaacccggcgucgacg

SEQ ID NO: 3323049 - RNA, 16 nt, Mycobacterium tuberculosis H37Rv
cgcgcgaccaugagcu

SEQ ID NO: 3323050 - RNA, 21 nt, Mycobacterium tuberculosis H37Rv
cgcgcgaccucgcuggccgca

SEQ ID NO: 3323051 - RNA, 13 nt, Mycobacterium tuberculosis H37Rv
cgcgcgaccuggu

SEQ ID NO: 3323052 - RNA, 16 nt, Mycobacterium tuberculosis H37Rv
cgcgcgaccuggucga

SEQ ID NO: 3323053 - RNA, 14 nt, Mycobacterium tuberculosis H37Rv
cgcgcgacgagcau

SEQ ID NO: 3323054 - RNA, 12 nt, Mycobacterium tuberculosis H37Rv
cgcgcgacggac

SEQ ID NO: 3323055 - RNA, 21 nt, Mycobacterium tuberculosis H37Rv
cgcgcgacuguacaccgacac

SEQ ID NO: 3323056 - RNA, 22 nt, Mycobacterium tuberculosis H37Rv
cgcgcgacuguacaccgacacg

SEQ ID NO: 3323057 - RNA, 14 nt, Mycobacterium tuberculosis H37Rv
cgcgcgagaacacc

SEQ ID NO: 3323058 - RNA, 21 nt, Mycobacterium tuberculosis H37Rv
cgcgcgagaacacccgugccu

SEQ ID NO: 3323059 - RNA, 21 nt, Mycobacterium tuberculosis H37Rv
cgcgcgagagccuccauggcc

SEQ ID NO: 3323060 - RNA, 23 nt, Mycobacterium tuberculosis H37Rv
cgcgcgcaacccugccgcgauga

SEQ ID NO: 3323061 - RNA, 22 nt, Mycobacterium tuberculosis H37Rv
cgcgcgcaagucgauguacacc

SEQ ID NO: 3323062 - RNA, 13 nt, Mycobacterium tuberculosis H37Rv
cgcgcgcaccaga

SEQ ID NO: 3323063 - RNA, 22 nt, Mycobacterium tuberculosis H37Rv
cgcgcgcacggcgucggccacc

SEQ ID NO: 3323064 - RNA, 14 nt, Mycobacterium tuberculosis H37Rv
cgcgcgcagccggg

SEQ ID NO: 3323065 - RNA, 21 nt, Mycobacterium tuberculosis H37Rv
cgcgcgcaguuguacggcacu

SEQ ID NO: 3323066 - RNA, 13 nt, Mycobacterium tuberculosis H37Rv
cgcgcgccacggu

SEQ ID NO: 3323067 - RNA, 21 nt, Mycobacterium tuberculosis H37Rv
cgcgcgccaucgccuccagcc

SEQ ID NO: 3323068 - RNA, 19 nt, Mycobacterium tuberculosis H37Rv
cgcgcgccauuggcggugg

SEQ ID NO: 3323069 - RNA, 23 nt, Mycobacterium tuberculosis H37Rv
cgcgcgcccgaaugcgacgucgu

SEQ ID NO: 3323070 - RNA, 17 nt, Mycobacterium tuberculosis H37Rv
cgcgcgcccgauccggu

SEQ ID NO: 3323071 - RNA, 16 nt, Mycobacterium tuberculosis H37Rv
cgcgcgcccgccucau

SEQ ID NO: 3323072 - RNA, 20 nt, Mycobacterium tuberculosis H37Rv
cgcgcgccgaccgacgucgc

SEQ ID NO: 3323073 - RNA, 14 nt, Mycobacterium tuberculosis H37Rv
cgcgcgccgcagcg

SEQ ID NO: 3323074 - RNA, 13 nt, Mycobacterium tuberculosis H37Rv
cgcgcgccgcgac

SEQ ID NO: 3323075 - RNA, 17 nt, Mycobacterium tuberculosis H37Rv
cgcgcgccggcugccac

SEQ ID NO: 3323076 - RNA, 21 nt, Mycobacterium tuberculosis H37Rv
cgcgcgccuuggccagcgcgu

SEQ ID NO: 3323077 - RNA, 11 nt, Mycobacterium tuberculosis H37Rv
cgcgcgcgcca

SEQ ID NO: 3323078 - RNA, 12 nt, Mycobacterium tuberculosis H37Rv
cgcgcgcggugc

SEQ ID NO: 3323079 - RNA, 12 nt, Mycobacterium tuberculosis H37Rv
cgcgcgcucgcg

SEQ ID NO: 3323080 - RNA, 14 nt, Mycobacterium tuberculosis H37Rv
cgcgcgcucgcggc

SEQ ID NO: 3323081 - RNA, 16 nt, Mycobacterium tuberculosis H37Rv
cgcgcgcugagccgua

SEQ ID NO: 3323082 - RNA, 14 nt, Mycobacterium tuberculosis H37Rv
cgcgcgcugggcgc

SEQ ID NO: 3323083 - RNA, 13 nt, Mycobacterium tuberculosis H37Rv
cgcgcggaacacc

SEQ ID NO: 3323084 - RNA, 14 nt, Mycobacterium tuberculosis H37Rv
cgcgcggaccagag

SEQ ID NO: 3323085 - RNA, 18 nt, Mycobacterium tuberculosis H37Rv
cgcgcggacccagcaccc

SEQ ID NO: 3323086 - RNA, 21 nt, Mycobacterium tuberculosis H37Rv
cgcgcggagucaagcagcagc

SEQ ID NO: 3323087 - RNA, 20 nt, Mycobacterium tuberculosis H37Rv
cgcgcggaucggcggccgcg

SEQ ID NO: 3323088 - RNA, 22 nt, Mycobacterium tuberculosis H37Rv
cgcgcggauggguacgacaccg

SEQ ID NO: 3323089 - RNA, 20 nt, Mycobacterium tuberculosis H37Rv
cgcgcggcaccgauggcgca

SEQ ID NO: 3323090 - RNA, 14 nt, Mycobacterium tuberculosis H37Rv
cgcgcggccagccc

SEQ ID NO: 3323091 - RNA, 16 nt, Mycobacterium tuberculosis H37Rv
cgcgcggccagcccac

SEQ ID NO: 3323092 - RNA, 22 nt, Mycobacterium tuberculosis H37Rv
cgcgcggcgagagccucggcca

SEQ ID NO: 3323093 - RNA, 13 nt, Mycobacterium tuberculosis H37Rv
cgcgcggcgcagc

SEQ ID NO: 3323094 - RNA, 16 nt, Mycobacterium tuberculosis H37Rv
cgcgcggcgcagcacc

SEQ ID NO: 3323095 - RNA, 21 nt, Mycobacterium tuberculosis H37Rv
cgcgcggcgcagcaccgucgg

SEQ ID NO: 3323096 - RNA, 14 nt, Mycobacterium tuberculosis H37Rv
cgcgcggcgccgca

SEQ ID NO: 3323097 - RNA, 21 nt, Mycobacterium tuberculosis H37Rv
cgcgcggcucacgggcgaucg

SEQ ID NO: 3323098 - RNA, 18 nt, Mycobacterium tuberculosis H37Rv
cgcgcggcucggguaccg

SEQ ID NO: 3323099 - RNA, 16 nt, Mycobacterium tuberculosis H37Rv
cgcgcggggccucgcg

SEQ ID NO: 3323100 - RNA, 16 nt, Mycobacterium tuberculosis H37Rv
cgcgcggggcggcugc

SEQ ID NO: 3323101 - RNA, 19 nt, Mycobacterium tuberculosis H37Rv
cgcgcggggcggcugcggg

SEQ ID NO: 3323102 - RNA, 22 nt, Mycobacterium tuberculosis H37Rv
cgcgcggggcggcugcgggccc

SEQ ID NO: 3323103 - RNA, 20 nt, Mycobacterium tuberculosis H37Rv
cgcgcggggugcgcgcgacc

SEQ ID NO: 3323104 - RNA, 20 nt, Mycobacterium tuberculosis H37Rv
cgcgcgggguggcggcgcug

SEQ ID NO: 3323105 - RNA, 17 nt, Mycobacterium tuberculosis H37Rv
cgcgcgggucacgaccu

SEQ ID NO: 3323106 - RNA, 19 nt, Mycobacterium tuberculosis H37Rv
cgcgcggguugucggcgac

SEQ ID NO: 3323107 - RNA, 23 nt, Mycobacterium tuberculosis H37Rv
cgcgcggguugucggcgaccccg

SEQ ID NO: 3323108 - RNA, 15 nt, Mycobacterium tuberculosis H37Rv
cgcgcgguacugcgc

SEQ ID NO: 3323109 - RNA, 19 nt, Mycobacterium tuberculosis H37Rv
cgcgcggucguacgcaugg

SEQ ID NO: 3323110 - RNA, 23 nt, Mycobacterium tuberculosis H37Rv
cgcgcggugcccugccggcagcg

SEQ ID NO: 3323111 - RNA, 16 nt, Mycobacterium tuberculosis H37Rv
cgcgcgguuuucggcu

SEQ ID NO: 3323112 - RNA, 18 nt, Mycobacterium tuberculosis H37Rv
cgcgcgguuuuucgcagu

SEQ ID NO: 3323113 - RNA, 20 nt, Mycobacterium tuberculosis H37Rv
cgcgcgguuuuucgcagugg

SEQ ID NO: 3323114 - RNA, 16 nt, Mycobacterium tuberculosis H37Rv
cgcgcguaauccgagc

SEQ ID NO: 3323115 - RNA, 17 nt, Mycobacterium tuberculosis H37Rv
cgcgcguacccgaucag

SEQ ID NO: 3323116 - RNA, 15 nt, Mycobacterium tuberculosis H37Rv
cgcgcguagcggggg

SEQ ID NO: 3323117 - RNA, 21 nt, Mycobacterium tuberculosis H37Rv
cgcgcgucacauccgacagca

SEQ ID NO: 3323118 - RNA, 12 nt, Mycobacterium tuberculosis H37Rv
cgcgcguccgcc

SEQ ID NO: 3323119 - RNA, 22 nt, Mycobacterium tuberculosis H37Rv
cgcgcguccgggcagccgcgcc

SEQ ID NO: 3323120 - RNA, 17 nt, Mycobacterium tuberculosis H37Rv
cgcgcguccgucggcga

SEQ ID NO: 3323121 - RNA, 13 nt, Mycobacterium tuberculosis H37Rv
cgcgcgucgaguu

SEQ ID NO: 3323122 - RNA, 20 nt, Mycobacterium tuberculosis H37Rv
cgcgcgucgaguuuugcggc

SEQ ID NO: 3323123 - RNA, 16 nt, Mycobacterium tuberculosis H37Rv
cgcgcguggucgcccc

SEQ ID NO: 3323124 - RNA, 14 nt, Mycobacterium tuberculosis H37Rv
cgcgcguucggcga

SEQ ID NO: 3323125 - RNA, 17 nt, Mycobacterium tuberculosis H37Rv
cgcgcguucggcgagca

SEQ ID NO: 3323126 - RNA, 21 nt, Mycobacterium tuberculosis H37Rv
cgcgcguucggcgagcagcgc

SEQ ID NO: 3323127 - RNA, 16 nt, Mycobacterium tuberculosis H37Rv
cgcgcguucggcgcug

SEQ ID NO: 3323128 - RNA, 22 nt, Mycobacterium tuberculosis H37Rv
cgcgcguucggcgcugaucgcg

SEQ ID NO: 3323129 - RNA, 19 nt, Mycobacterium tuberculosis H37Rv
cgcgcguugaagucgccgg

SEQ ID NO: 3323130 - RNA, 14 nt, Mycobacterium tuberculosis H37Rv
cgcgcguugcgguc

SEQ ID NO: 3323131 - RNA, 19 nt, Mycobacterium tuberculosis H37Rv
cgcgcguuuagucuccggc

SEQ ID NO: 3323132 - RNA, 14 nt, Mycobacterium tuberculosis H37Rv
cgcgcuaaugucga

SEQ ID NO: 3323133 - RNA, 14 nt, Mycobacterium tuberculosis H37Rv
cgcgcuacgcggcc

SEQ ID NO: 3323134 - RNA, 16 nt, Mycobacterium tuberculosis H37Rv
cgcgcuaucaugacca

SEQ ID NO: 3323135 - RNA, 18 nt, Mycobacterium tuberculosis H37Rv
cgcgcuaucaugaccacc

SEQ ID NO: 3323136 - RNA, 13 nt, Mycobacterium tuberculosis H37Rv
cgcgcucaacggc

SEQ ID NO: 3323137 - RNA, 19 nt, Mycobacterium tuberculosis H37Rv
cgcgcucaccgacgcugac

SEQ ID NO: 3323138 - RNA, 15 nt, Mycobacterium tuberculosis H37Rv
cgcgcucaccggggc

SEQ ID NO: 3323139 - RNA, 13 nt, Mycobacterium tuberculosis H37Rv
cgcgcucagguca

SEQ ID NO: 3323140 - RNA, 15 nt, Mycobacterium tuberculosis H37Rv
cgcgcucaucgaccg

SEQ ID NO: 3323141 - RNA, 16 nt, Mycobacterium tuberculosis H37Rv
cgcgcucaucgaccgg

SEQ ID NO: 3323142 - RNA, 17 nt, Mycobacterium tuberculosis H37Rv
cgcgcucaucgaccggg

SEQ ID NO: 3323143 - RNA, 22 nt, Mycobacterium tuberculosis H37Rv
cgcgcucauguucucgaccgcg

SEQ ID NO: 3323144 - RNA, 18 nt, Mycobacterium tuberculosis H37Rv
cgcgcucauugcaucugc

SEQ ID NO: 3323145 - RNA, 16 nt, Mycobacterium tuberculosis H37Rv
cgcgcucccggcgucu

SEQ ID NO: 3323146 - RNA, 20 nt, Mycobacterium tuberculosis H37Rv
cgcgcucgauggcggccacc

SEQ ID NO: 3323147 - RNA, 18 nt, Mycobacterium tuberculosis H37Rv
cgcgcucgcacccgcucg

SEQ ID NO: 3323148 - RNA, 12 nt, Mycobacterium tuberculosis H37Rv
cgcgcucgcgca

SEQ ID NO: 3323149 - RNA, 13 nt, Mycobacterium tuberculosis H37Rv
cgcgcucgcgcaa

SEQ ID NO: 3323150 - RNA, 14 nt, Mycobacterium tuberculosis H37Rv
cgcgcucgcucacc

SEQ ID NO: 3323151 - RNA, 16 nt, Mycobacterium tuberculosis H37Rv
cgcgcucgcucaccgg

SEQ ID NO: 3323152 - RNA, 18 nt, Mycobacterium tuberculosis H37Rv
cgcgcucgcucaccggcu

SEQ ID NO: 3323153 - RNA, 13 nt, Mycobacterium tuberculosis H37Rv
cgcgcucggccag

SEQ ID NO: 3323154 - RNA, 17 nt, Mycobacterium tuberculosis H37Rv
cgcgcucgggcccagcg

SEQ ID NO: 3323155 - RNA, 21 nt, Mycobacterium tuberculosis H37Rv
cgcgcucgggcccagcgcgcg

SEQ ID NO: 3323156 - RNA, 12 nt, Mycobacterium tuberculosis H37Rv
cgcgcucggugc

SEQ ID NO: 3323157 - RNA, 16 nt, Mycobacterium tuberculosis H37Rv
cgcgcucggugccgcc

SEQ ID NO: 3323158 - RNA, 17 nt, Mycobacterium tuberculosis H37Rv
cgcgcucggugccgccc

SEQ ID NO: 3323159 - RNA, 16 nt, Mycobacterium tuberculosis H37Rv
cgcgcugaaccagaug

SEQ ID NO: 3323160 - RNA, 22 nt, Mycobacterium tuberculosis H37Rv
cgcgcugacccgccgacgaccg

SEQ ID NO: 3323161 - RNA, 15 nt, Mycobacterium tuberculosis H37Rv
cgcgcugagcacgcg

SEQ ID NO: 3323162 - RNA, 19 nt, Mycobacterium tuberculosis H37Rv
cgcgcugagcacgcggauc

SEQ ID NO: 3323163 - RNA, 16 nt, Mycobacterium tuberculosis H37Rv
cgcgcugagcucgaug

SEQ ID NO: 3323164 - RNA, 21 nt, Mycobacterium tuberculosis H37Rv
cgcgcugccaguucuuggcga

SEQ ID NO: 3323165 - RNA, 13 nt, Mycobacterium tuberculosis H37Rv
cgcgcugccggcc

SEQ ID NO: 3323166 - RNA, 15 nt, Mycobacterium tuberculosis H37Rv
cgcgcugccggccgc

SEQ ID NO: 3323167 - RNA, 20 nt, Mycobacterium tuberculosis H37Rv
cgcgcugcgcgacugauccu

SEQ ID NO: 3323168 - RNA, 19 nt, Mycobacterium tuberculosis H37Rv
cgcgcugcggcccacacca

SEQ ID NO: 3323169 - RNA, 21 nt, Mycobacterium tuberculosis H37Rv
cgcgcugcggcccacaccagc

SEQ ID NO: 3323170 - RNA, 23 nt, Mycobacterium tuberculosis H37Rv
cgcgcugcggcccacaccagcgc

SEQ ID NO: 3323171 - RNA, 16 nt, Mycobacterium tuberculosis H37Rv
cgcgcugcgucgucga

SEQ ID NO: 3323172 - RNA, 13 nt, Mycobacterium tuberculosis H37Rv
cgcgcugcuggcg

SEQ ID NO: 3323173 - RNA, 22 nt, Mycobacterium tuberculosis H37Rv
cgcgcugcuucuucggacagca

SEQ ID NO: 3323174 - RNA, 20 nt, Mycobacterium tuberculosis H37Rv
cgcgcuggaucgugcuggug

SEQ ID NO: 3323175 - RNA, 13 nt, Mycobacterium tuberculosis H37Rv
cgcgcuggcgccc

SEQ ID NO: 3323176 - RNA, 15 nt, Mycobacterium tuberculosis H37Rv
cgcgcuggcgcccuu

SEQ ID NO: 3323177 - RNA, 15 nt, Mycobacterium tuberculosis H37Rv
cgcgcugggcgcgcu

SEQ ID NO: 3323178 - RNA, 17 nt, Mycobacterium tuberculosis H37Rv
cgcgcuggugauucgca

SEQ ID NO: 3323179 - RNA, 24 nt, Mycobacterium tuberculosis H37Rv
cgcgcuggugauucgcagccgauc

SEQ ID NO: 3323180 - RNA, 14 nt, Mycobacterium tuberculosis H37Rv
cgcgcuguacugcc

SEQ ID NO: 3323181 - RNA, 20 nt, Mycobacterium tuberculosis H37Rv
cgcgcuguacugccccagca

SEQ ID NO: 3323182 - RNA, 17 nt, Mycobacterium tuberculosis H37Rv
cgcgcuguagggcacug

SEQ ID NO: 3323183 - RNA, 20 nt, Mycobacterium tuberculosis H37Rv
cgcgcuguccacgaugacgu

SEQ ID NO: 3323184 - RNA, 23 nt, Mycobacterium tuberculosis H37Rv
cgcgcuguugccaucgacgccgc

SEQ ID NO: 3323185 - RNA, 17 nt, Mycobacterium tuberculosis H37Rv
cgcgcuguuguacggcc

SEQ ID NO: 3323186 - RNA, 13 nt, Mycobacterium tuberculosis H37Rv
cgcgcuucacagc

SEQ ID NO: 3323187 - RNA, 20 nt, Mycobacterium tuberculosis H37Rv
cgcgcuucacagccaccagc

SEQ ID NO: 3323188 - RNA, 14 nt, Mycobacterium tuberculosis H37Rv
cgcgcuugcgaucg

SEQ ID NO: 3323189 - RNA, 17 nt, Mycobacterium tuberculosis H37Rv
cgcgcuugcgaucggca

SEQ ID NO: 3323190 - RNA, 18 nt, Mycobacterium tuberculosis H37Rv
cgcgcuugcgccgcccau

SEQ ID NO: 3323191 - RNA, 22 nt, Mycobacterium tuberculosis H37Rv
cgcgcuuggcuccacaauccug

SEQ ID NO: 3323192 - RNA, 21 nt, Mycobacterium tuberculosis H37Rv
cgcgcuuuucuccgccgagca

SEQ ID NO: 3323193 - RNA, 18 nt, Mycobacterium tuberculosis H37Rv
cgcggaaaccaucgccag

SEQ ID NO: 3323194 - RNA, 15 nt, Mycobacterium tuberculosis H37Rv
cgcggaaaggcuucc

SEQ ID NO: 3323195 - RNA, 13 nt, Mycobacterium tuberculosis H37Rv
cgcggaacccagc

SEQ ID NO: 3323196 - RNA, 15 nt, Mycobacterium tuberculosis H37Rv
cgcggaauccgcggc

SEQ ID NO: 3323197 - RNA, 16 nt, Mycobacterium tuberculosis H37Rv
cgcggaauccgcggcg

SEQ ID NO: 3323198 - RNA, 18 nt, Mycobacterium tuberculosis H37Rv
cgcggaaucgcaucggcg

SEQ ID NO: 3323199 - RNA, 20 nt, Mycobacterium tuberculosis H37Rv
cgcggaaucgcaucggcggg

SEQ ID NO: 3323200 - RNA, 16 nt, Mycobacterium tuberculosis H37Rv
cgcggacacgaucgcg

SEQ ID NO: 3323201 - RNA, 14 nt, Mycobacterium tuberculosis H37Rv
cgcggacacugcga

SEQ ID NO: 3323202 - RNA, 14 nt, Mycobacterium tuberculosis H37Rv
cgcggacagcauca

SEQ ID NO: 3323203 - RNA, 12 nt, Mycobacterium tuberculosis H37Rv
cgcggacagccc

SEQ ID NO: 3323204 - RNA, 14 nt, Mycobacterium tuberculosis H37Rv
cgcggacagcccgg

SEQ ID NO: 3323205 - RNA, 23 nt, Mycobacterium tuberculosis H37Rv
cgcggacagguagucgccgguca

SEQ ID NO: 3323206 - RNA, 21 nt, Mycobacterium tuberculosis H37Rv
cgcggacccgcagcugcggau

SEQ ID NO: 3323207 - RNA, 22 nt, Mycobacterium tuberculosis H37Rv
cgcggacccgcagcugcggauc

SEQ ID NO: 3323208 - RNA, 14 nt, Mycobacterium tuberculosis H37Rv
cgcggacccgccgu

SEQ ID NO: 3323209 - RNA, 22 nt, Mycobacterium tuberculosis H37Rv
cgcggacccgccgugaguaggu

SEQ ID NO: 3323210 - RNA, 13 nt, Mycobacterium tuberculosis H37Rv
cgcggacccgcgc

SEQ ID NO: 3323211 - RNA, 20 nt, Mycobacterium tuberculosis H37Rv
cgcggacccgcgcgucgccc

SEQ ID NO: 3323212 - RNA, 14 nt, Mycobacterium tuberculosis H37Rv
cgcggaccgcgaau

SEQ ID NO: 3323213 - RNA, 15 nt, Mycobacterium tuberculosis H37Rv
cgcggaccggcgucg

SEQ ID NO: 3323214 - RNA, 23 nt, Mycobacterium tuberculosis H37Rv
cgcccgcaccagcugucgggcag

SEQ ID NO: 3323215 - RNA, 14 nt, Mycobacterium tuberculosis H37Rv
cgcccgcacccaug

SEQ ID NO: 3323216 - RNA, 19 nt, Mycobacterium tuberculosis H37Rv
cgcccgcaccguggacacc

SEQ ID NO: 3323217 - RNA, 23 nt, Mycobacterium tuberculosis H37Rv
cgcccgcaccguggacaccuggc

SEQ ID NO: 3323218 - RNA, 22 nt, Mycobacterium tuberculosis H37Rv
cgcccgcaucgcggcaucgacg

SEQ ID NO: 3323219 - RNA, 18 nt, Mycobacterium tuberculosis H37Rv
cgcccgcccaccucgauc

SEQ ID NO: 3323220 - RNA, 12 nt, Mycobacterium tuberculosis H37Rv
cgcccgccccgc

SEQ ID NO: 3323221 - RNA, 14 nt, Mycobacterium tuberculosis H37Rv
cgcccgccccgcgc

SEQ ID NO: 3323222 - RNA, 14 nt, Mycobacterium tuberculosis H37Rv
cgcccgccgcgaac

SEQ ID NO: 3323223 - RNA, 21 nt, Mycobacterium tuberculosis H37Rv
cgcccgccuucauuacccguu

SEQ ID NO: 3323224 - RNA, 17 nt, Mycobacterium tuberculosis H37Rv
cgcccgccuucgaucau

SEQ ID NO: 3323225 - RNA, 24 nt, Mycobacterium tuberculosis H37Rv
cgcccgcgagagaguucgcaugcu

SEQ ID NO: 3323226 - RNA, 17 nt, Mycobacterium tuberculosis H37Rv
cgcccgcgagcuguagg

SEQ ID NO: 3323227 - RNA, 13 nt, Mycobacterium tuberculosis H37Rv
cgcccgcgccacc

SEQ ID NO: 3323228 - RNA, 22 nt, Mycobacterium tuberculosis H37Rv
cgcccgcgccaccagcaccgcc

SEQ ID NO: 3323229 - RNA, 15 nt, Mycobacterium tuberculosis H37Rv
cgcccgcgccaccga

SEQ ID NO: 3323230 - RNA, 15 nt, Mycobacterium tuberculosis H37Rv
cgcccgcgccaccgg

SEQ ID NO: 3323231 - RNA, 16 nt, Mycobacterium tuberculosis H37Rv
cgcccgcgcccccggu

SEQ ID NO: 3323232 - RNA, 16 nt, Mycobacterium tuberculosis H37Rv
cgcccgcgccgccgcu

SEQ ID NO: 3323233 - RNA, 17 nt, Mycobacterium tuberculosis H37Rv
cgcccgcgccgccggac

SEQ ID NO: 3323234 - RNA, 23 nt, Mycobacterium tuberculosis H37Rv
cgcccgcgugacgcuuggccaau

SEQ ID NO: 3323235 - RNA, 13 nt, Mycobacterium tuberculosis H37Rv
cgcccgcuaccaa

SEQ ID NO: 3323236 - RNA, 20 nt, Mycobacterium tuberculosis H37Rv
cgcccgcuacggcagcccgu

SEQ ID NO: 3323237 - RNA, 21 nt, Mycobacterium tuberculosis H37Rv
cgcccgcuaggcgaagcgucu

SEQ ID NO: 3323238 - RNA, 15 nt, Mycobacterium tuberculosis H37Rv
cgcccgcuccgccgu

SEQ ID NO: 3323239 - RNA, 18 nt, Mycobacterium tuberculosis H37Rv
cgcccgcuccgccgucgc

SEQ ID NO: 3323240 - RNA, 14 nt, Mycobacterium tuberculosis H37Rv
cgcccgcuccgcgg

SEQ ID NO: 3323241 - RNA, 21 nt, Mycobacterium tuberculosis H37Rv
cgcccgcucgcgagcggcuga

SEQ ID NO: 3323242 - RNA, 16 nt, Mycobacterium tuberculosis H37Rv
cgcccgcucggccgca

SEQ ID NO: 3323243 - RNA, 21 nt, Mycobacterium tuberculosis H37Rv
cgcccgcugagcacucaugau

SEQ ID NO: 3323244 - RNA, 13 nt, Mycobacterium tuberculosis H37Rv
cgcccgcugcaga

SEQ ID NO: 3323245 - RNA, 15 nt, Mycobacterium tuberculosis H37Rv
cgcccgcugcagacg

SEQ ID NO: 3323246 - RNA, 14 nt, Mycobacterium tuberculosis H37Rv
cgcccgcugcggcg

SEQ ID NO: 3323247 - RNA, 19 nt, Mycobacterium tuberculosis H37Rv
cgcccgcuucagcacggug

SEQ ID NO: 3323248 - RNA, 18 nt, Mycobacterium tuberculosis H37Rv
cgcccggaaaggccgcgg

SEQ ID NO: 3323249 - RNA, 22 nt, Mycobacterium tuberculosis H37Rv
cgcccggaaccggcgugcagca

SEQ ID NO: 3323250 - RNA, 19 nt, Mycobacterium tuberculosis H37Rv
cgcccggacccaaagcacu

SEQ ID NO: 3323251 - RNA, 18 nt, Mycobacterium tuberculosis H37Rv
cgcccggauguccgccga

SEQ ID NO: 3323252 - RNA, 20 nt, Mycobacterium tuberculosis H37Rv
cgcccggauguccgccgacg

SEQ ID NO: 3323253 - RNA, 17 nt, Mycobacterium tuberculosis H37Rv
cgcccggcacacggccu

SEQ ID NO: 3323254 - RNA, 13 nt, Mycobacterium tuberculosis H37Rv
cgcccggccagcu

SEQ ID NO: 3323255 - RNA, 16 nt, Mycobacterium tuberculosis H37Rv
cgcccggccagcucgg

SEQ ID NO: 3323256 - RNA, 13 nt, Mycobacterium tuberculosis H37Rv
cgcccggccccgc

SEQ ID NO: 3323257 - RNA, 17 nt, Mycobacterium tuberculosis H37Rv
cgcccggccccgcaagc

SEQ ID NO: 3323258 - RNA, 21 nt, Mycobacterium tuberculosis H37Rv
cgcccggccccgcaagcggau

SEQ ID NO: 3323259 - RNA, 13 nt, Mycobacterium tuberculosis H37Rv
cgcccggcccggc

SEQ ID NO: 3323260 - RNA, 22 nt, Mycobacterium tuberculosis H37Rv
cgcccggcccugagcugccgag

SEQ ID NO: 3323261 - RNA, 12 nt, Mycobacterium tuberculosis H37Rv
cgcccggccgca

SEQ ID NO: 3323262 - RNA, 15 nt, Mycobacterium tuberculosis H37Rv
cgcccggcgagcagg

SEQ ID NO: 3323263 - RNA, 18 nt, Mycobacterium tuberculosis H37Rv
cgcccggcgcuagcgccg

SEQ ID NO: 3323264 - RNA, 20 nt, Mycobacterium tuberculosis H37Rv
cgcccggcgcuagcgccgcg

SEQ ID NO: 3323265 - RNA, 22 nt, Mycobacterium tuberculosis H37Rv
cgcccggcguggcuucacccaa

SEQ ID NO: 3323266 - RNA, 17 nt, Mycobacterium tuberculosis H37Rv
cgcccggcguggugagc

SEQ ID NO: 3323267 - RNA, 12 nt, Mycobacterium tuberculosis H37Rv
cgcccggcugcg

SEQ ID NO: 3323268 - RNA, 11 nt, Mycobacterium tuberculosis H37Rv
cgcccgggcac

SEQ ID NO: 3323269 - RNA, 13 nt, Mycobacterium tuberculosis H37Rv
cgcccgggcccac

SEQ ID NO: 3323270 - RNA, 17 nt, Mycobacterium tuberculosis H37Rv
cgcccgggcggaacgcc

SEQ ID NO: 3323271 - RNA, 12 nt, Mycobacterium tuberculosis H37Rv
cgcccgggcggc

SEQ ID NO: 3323272 - RNA, 19 nt, Mycobacterium tuberculosis H37Rv
cgcccgggucccggcagcu

SEQ ID NO: 3323273 - RNA, 21 nt, Mycobacterium tuberculosis H37Rv
cgcccgggucccggcagcugg

SEQ ID NO: 3323274 - RNA, 13 nt, Mycobacterium tuberculosis H37Rv
cgcccggucacgc

SEQ ID NO: 3323275 - RNA, 15 nt, Mycobacterium tuberculosis H37Rv
cgcccggucacgcug

SEQ ID NO: 3323276 - RNA, 13 nt, Mycobacterium tuberculosis H37Rv
cgcccggucgagc

SEQ ID NO: 3323277 - RNA, 17 nt, Mycobacterium tuberculosis H37Rv
cgcccggucgagccagc

SEQ ID NO: 3323278 - RNA, 20 nt, Mycobacterium tuberculosis H37Rv
cgcccggucucgacggcggc

SEQ ID NO: 3323279 - RNA, 20 nt, Mycobacterium tuberculosis H37Rv
cgcccgguucagcgcuggca

SEQ ID NO: 3323280 - RNA, 19 nt, Mycobacterium tuberculosis H37Rv
cgcccgucccgccggcccc

SEQ ID NO: 3323281 - RNA, 16 nt, Mycobacterium tuberculosis H37Rv
cgcccgucgcugggag

SEQ ID NO: 3323282 - RNA, 17 nt, Mycobacterium tuberculosis H37Rv
cgcccgucguagguggc

SEQ ID NO: 3323283 - RNA, 14 nt, Mycobacterium tuberculosis H37Rv
cgcccgugagaucc

SEQ ID NO: 3323284 - RNA, 14 nt, Mycobacterium tuberculosis H37Rv
cgcccgugccgccc

SEQ ID NO: 3323285 - RNA, 15 nt, Mycobacterium tuberculosis H37Rv
cgcccgugccgcccg

SEQ ID NO: 3323286 - RNA, 13 nt, Mycobacterium tuberculosis H37Rv
cgcccguguugaa

SEQ ID NO: 3323287 - RNA, 23 nt, Mycobacterium tuberculosis H37Rv
cgcccguguugaagaagcccgag

SEQ ID NO: 3323288 - RNA, 17 nt, Mycobacterium tuberculosis H37Rv
cgcccuaacccugcccu

SEQ ID NO: 3323289 - RNA, 15 nt, Mycobacterium tuberculosis H37Rv
cgcccucagccgcgg

SEQ ID NO: 3323290 - RNA, 19 nt, Mycobacterium tuberculosis H37Rv
cgcccucaguucacgcucg

SEQ ID NO: 3323291 - RNA, 19 nt, Mycobacterium tuberculosis H37Rv
cgcccucaguucacguucg

SEQ ID NO: 3323292 - RNA, 15 nt, Mycobacterium tuberculosis H37Rv
cgcccucccgggccc

SEQ ID NO: 3323293 - RNA, 15 nt, Mycobacterium tuberculosis H37Rv
cgcccucccuggggc

SEQ ID NO: 3323294 - RNA, 16 nt, Mycobacterium tuberculosis H37Rv
cgcccucgaucgccac

SEQ ID NO: 3323295 - RNA, 20 nt, Mycobacterium tuberculosis H37Rv
cgcccucggcgaccuggcuc

SEQ ID NO: 3323296 - RNA, 22 nt, Mycobacterium tuberculosis H37Rv
cgcccucgucgaucgccgcgau

SEQ ID NO: 3323297 - RNA, 12 nt, Mycobacterium tuberculosis H37Rv
cgcccucgucgc

SEQ ID NO: 3323298 - RNA, 21 nt, Mycobacterium tuberculosis H37Rv
cgcccucgucgcgggccaccg

SEQ ID NO: 3323299 - RNA, 16 nt, Mycobacterium tuberculosis H37Rv
cgcccugaagggccgc

SEQ ID NO: 3323300 - RNA, 18 nt, Mycobacterium tuberculosis H37Rv
cgcccugaagggccgccu

SEQ ID NO: 3323301 - RNA, 19 nt, Mycobacterium tuberculosis H37Rv
cgcccugaagggccgccuc

SEQ ID NO: 3323302 - RNA, 23 nt, Mycobacterium tuberculosis H37Rv
cgcccugacacaacaccggcgug

SEQ ID NO: 3323303 - RNA, 20 nt, Mycobacterium tuberculosis H37Rv
cgcccugacccggagccgcc

SEQ ID NO: 3323304 - RNA, 13 nt, Mycobacterium tuberculosis H37Rv
cgcccugaccgcc

SEQ ID NO: 3323305 - RNA, 16 nt, Mycobacterium tuberculosis H37Rv
cgcccugaccgcccgc

SEQ ID NO: 3323306 - RNA, 20 nt, Mycobacterium tuberculosis H37Rv
cgcccugacgucacguucgg

SEQ ID NO: 3323307 - RNA, 19 nt, Mycobacterium tuberculosis H37Rv
cgcccugagaacacguucg

SEQ ID NO: 3323308 - RNA, 20 nt, Mycobacterium tuberculosis H37Rv
cgcccugagaacacguucgg

SEQ ID NO: 3323309 - RNA, 12 nt, Mycobacterium tuberculosis H37Rv
cgcccugcggau

SEQ ID NO: 3323310 - RNA, 18 nt, Mycobacterium tuberculosis H37Rv
cgcccuggacgucggcga

SEQ ID NO: 3323311 - RNA, 23 nt, Mycobacterium tuberculosis H37Rv
cgcccuggacgucggcgauaucg

SEQ ID NO: 3323312 - RNA, 14 nt, Mycobacterium tuberculosis H37Rv
cgcccuggccgccc

SEQ ID NO: 3323313 - RNA, 22 nt, Mycobacterium tuberculosis H37Rv
cgcccuggccgcccagaccgcc

SEQ ID NO: 3323314 - RNA, 11 nt, Mycobacterium tuberculosis H37Rv
cgcccugggcg

SEQ ID NO: 3323315 - RNA, 16 nt, Mycobacterium tuberculosis H37Rv
cgcccugggcgccggc

SEQ ID NO: 3323316 - RNA, 23 nt, Mycobacterium tuberculosis H37Rv
cgcccugggcgccggcguccgga

SEQ ID NO: 3323317 - RNA, 21 nt, Mycobacterium tuberculosis H37Rv
cgcccugguccaggcccuggc

SEQ ID NO: 3323318 - RNA, 23 nt, Mycobacterium tuberculosis H37Rv
cgcccuuaagccggcgcggcggc

SEQ ID NO: 3323319 - RNA, 18 nt, Mycobacterium tuberculosis H37Rv
cgcccuuagggucgccgc

SEQ ID NO: 3323320 - RNA, 14 nt, Mycobacterium tuberculosis H37Rv
cgcccuugccgcag

SEQ ID NO: 3323321 - RNA, 13 nt, Mycobacterium tuberculosis H37Rv
cgcccuugccgcc

SEQ ID NO: 3323322 - RNA, 16 nt, Mycobacterium tuberculosis H37Rv
cgcccuugccgccagc

SEQ ID NO: 3323323 - RNA, 18 nt, Mycobacterium tuberculosis H37Rv
cgcccuugccgccagccc

SEQ ID NO: 3323324 - RNA, 19 nt, Mycobacterium tuberculosis H37Rv
cgcccuugccgccagcccc

SEQ ID NO: 3323325 - RNA, 22 nt, Mycobacterium tuberculosis H37Rv
cgcccuugccgccagccccagc

SEQ ID NO: 3323326 - RNA, 16 nt, Mycobacterium tuberculosis H37Rv
cgcccuugccgcccgc

SEQ ID NO: 3323327 - RNA, 17 nt, Mycobacterium tuberculosis H37Rv
cgcccuugccgcccgcu

SEQ ID NO: 3323328 - RNA, 14 nt, Mycobacterium tuberculosis H37Rv
cgcccuugccgccg

SEQ ID NO: 3323329 - RNA, 22 nt, Mycobacterium tuberculosis H37Rv
cgcccuugccuccggcgccgcc

SEQ ID NO: 3323330 - RNA, 23 nt, Mycobacterium tuberculosis H37Rv
cgcccuugccuccggcgccgccc

SEQ ID NO: 3323331 - RNA, 17 nt, Mycobacterium tuberculosis H37Rv
cgccgaaaaugccgccc

SEQ ID NO: 3323332 - RNA, 18 nt, Mycobacterium tuberculosis H37Rv
cgccgaaaaugccgccca

SEQ ID NO: 3323333 - RNA, 22 nt, Mycobacterium tuberculosis H37Rv
cgccgaaaaugccgcccagcga

SEQ ID NO: 3323334 - RNA, 16 nt, Mycobacterium tuberculosis H37Rv
cgccgaaacagcaccc

SEQ ID NO: 3323335 - RNA, 14 nt, Mycobacterium tuberculosis H37Rv
cgccgaaaccgccg

SEQ ID NO: 3323336 - RNA, 15 nt, Mycobacterium tuberculosis H37Rv
cgccgaaaccgccgg

SEQ ID NO: 3323337 - RNA, 19 nt, Mycobacterium tuberculosis H37Rv
cgccgaaacucaccagcac

SEQ ID NO: 3323338 - RNA, 15 nt, Mycobacterium tuberculosis H37Rv
cgccgaaaucggcca

SEQ ID NO: 3323339 - RNA, 17 nt, Mycobacterium tuberculosis H37Rv
cgccgaaaucggccagc

SEQ ID NO: 3323340 - RNA, 19 nt, Mycobacterium tuberculosis H37Rv
cgccgaacaccgagugcgg

SEQ ID NO: 3323341 - RNA, 23 nt, Mycobacterium tuberculosis H37Rv
cgccgaacaccggcuccagcaug

SEQ ID NO: 3323342 - RNA, 17 nt, Mycobacterium tuberculosis H37Rv
cgccgaacaccgguaac

SEQ ID NO: 3323343 - RNA, 23 nt, Mycobacterium tuberculosis H37Rv
cgccgaacacgcacacgaucgcg

SEQ ID NO: 3323344 - RNA, 15 nt, Mycobacterium tuberculosis H37Rv
cgccgaacagcagcc

SEQ ID NO: 3323345 - RNA, 19 nt, Mycobacterium tuberculosis H37Rv
cgccgaacagcagcccgcc

SEQ ID NO: 3323346 - RNA, 16 nt, Mycobacterium tuberculosis H37Rv
cgccgaaccagcgaug

SEQ ID NO: 3323347 - RNA, 17 nt, Mycobacterium tuberculosis H37Rv
cgccgaaccaguaauac

SEQ ID NO: 3323348 - RNA, 13 nt, Mycobacterium tuberculosis H37Rv
cgccgaacgcucc

SEQ ID NO: 3323349 - RNA, 20 nt, Mycobacterium tuberculosis H37Rv
cgccgaacgugcaaccacgg

SEQ ID NO: 3323350 - RNA, 16 nt, Mycobacterium tuberculosis H37Rv
cgccgaagccgcgcau

SEQ ID NO: 3323351 - RNA, 15 nt, Mycobacterium tuberculosis H37Rv
cgccgaagccggacc

SEQ ID NO: 3323352 - RNA, 18 nt, Mycobacterium tuberculosis H37Rv
cgccgaagcucaucgccg

SEQ ID NO: 3323353 - RNA, 22 nt, Mycobacterium tuberculosis H37Rv
cgccgaagcucaucgccgcuac

SEQ ID NO: 3323354 - RNA, 21 nt, Mycobacterium tuberculosis H37Rv
cgccgaaguagacggugguga

SEQ ID NO: 3323355 - RNA, 24 nt, Mycobacterium tuberculosis H37Rv
cgccgaauacggcugccuccauga

SEQ ID NO: 3323356 - RNA, 15 nt, Mycobacterium tuberculosis H37Rv
cgccgaauccgacgu

SEQ ID NO: 3323357 - RNA, 22 nt, Mycobacterium tuberculosis H37Rv
cgccgaaucgcgggcugaccaa

SEQ ID NO: 3323358 - RNA, 15 nt, Mycobacterium tuberculosis H37Rv
cgccgaaucgcugac

SEQ ID NO: 3323359 - RNA, 16 nt, Mycobacterium tuberculosis H37Rv
cgccgaaucgcugacc

SEQ ID NO: 3323360 - RNA, 13 nt, Mycobacterium tuberculosis H37Rv
cgccgaaucggca

SEQ ID NO: 3323361 - RNA, 14 nt, Mycobacterium tuberculosis H37Rv
cgccgaaucggcag

SEQ ID NO: 3323362 - RNA, 16 nt, Mycobacterium tuberculosis H37Rv
cgccgaaucggcaguu

SEQ ID NO: 3323363 - RNA, 20 nt, Mycobacterium tuberculosis H37Rv
cgccgaaucuggggugacug

SEQ ID NO: 3323364 - RNA, 20 nt, Mycobacterium tuberculosis H37Rv
cgccgaaugccaccucgacg

SEQ ID NO: 3323365 - RNA, 23 nt, Mycobacterium tuberculosis H37Rv
cgccgacaaccccgccaggaucu

SEQ ID NO: 3323366 - RNA, 17 nt, Mycobacterium tuberculosis H37Rv
cgccgacaauggcagcg

SEQ ID NO: 3323367 - RNA, 14 nt, Mycobacterium tuberculosis H37Rv
cgccgacaccaccg

SEQ ID NO: 3323368 - RNA, 16 nt, Mycobacterium tuberculosis H37Rv
cgccgacaccaccggc

SEQ ID NO: 3323369 - RNA, 21 nt, Mycobacterium tuberculosis H37Rv
cgccgacaccaccggcgccgc

SEQ ID NO: 3323370 - RNA, 17 nt, Mycobacterium tuberculosis H37Rv
cgccgacaccacggcgc

SEQ ID NO: 3323371 - RNA, 21 nt, Mycobacterium tuberculosis H37Rv
cgccgacaccacggcgcgcag

SEQ ID NO: 3323372 - RNA, 20 nt, Mycobacterium tuberculosis H37Rv
cgccgacacccccggugccg

SEQ ID NO: 3323373 - RNA, 12 nt, Mycobacterium tuberculosis H37Rv
cgccgacaccgg

SEQ ID NO: 3323374 - RNA, 15 nt, Mycobacterium tuberculosis H37Rv
cgccgacaccggcug

SEQ ID NO: 3323375 - RNA, 13 nt, Mycobacterium tuberculosis H37Rv
cgccgacaccggg

SEQ ID NO: 3323376 - RNA, 23 nt, Mycobacterium tuberculosis H37Rv
cgccgacagaugugguaccagcc

SEQ ID NO: 3323377 - RNA, 15 nt, Mycobacterium tuberculosis H37Rv
cgccgacagcgccuu

SEQ ID NO: 3323378 - RNA, 22 nt, Mycobacterium tuberculosis H37Rv
cgccgacaggccggccaccagu

SEQ ID NO: 3323379 - RNA, 21 nt, Mycobacterium tuberculosis H37Rv
cgccgacauggcggugcgcag

SEQ ID NO: 3323380 - RNA, 13 nt, Mycobacterium tuberculosis H37Rv
cgccgaccaccgc

SEQ ID NO: 3323381 - RNA, 21 nt, Mycobacterium tuberculosis H37Rv
cgccgaccagaacgacgccgc

SEQ ID NO: 3323382 - RNA, 22 nt, Mycobacterium tuberculosis H37Rv
cgccgaccagcuugaccgacca

SEQ ID NO: 3323383 - RNA, 19 nt, Mycobacterium tuberculosis H37Rv
cgccgacccaacccgaucu

SEQ ID NO: 3323384 - RNA, 17 nt, Mycobacterium tuberculosis H37Rv
cgccgacccgaucaccu

SEQ ID NO: 3323385 - RNA, 17 nt, Mycobacterium tuberculosis H37Rv
cgccgacccgcgcgccg

SEQ ID NO: 3323386 - RNA, 20 nt, Mycobacterium tuberculosis H37Rv
cgccgaccgacaccaccagg

SEQ ID NO: 3323387 - RNA, 21 nt, Mycobacterium tuberculosis H37Rv
cgccgaccgacaccaccaggu

SEQ ID NO: 3323388 - RNA, 16 nt, Mycobacterium tuberculosis H37Rv
cgccgaccgacgucgc

SEQ ID NO: 3323389 - RNA, 15 nt, Mycobacterium tuberculosis H37Rv
cgccgaccgcgccgc

SEQ ID NO: 3323390 - RNA, 16 nt, Mycobacterium tuberculosis H37Rv
cgccgaccgcgccgca

SEQ ID NO: 3323391 - RNA, 20 nt, Mycobacterium tuberculosis H37Rv
cgccgaccgcgccgcaucau

SEQ ID NO: 3323392 - RNA, 14 nt, Mycobacterium tuberculosis H37Rv
cgccgaccggaccg

SEQ ID NO: 3323393 - RNA, 18 nt, Mycobacterium tuberculosis H37Rv
cgccgaccggagccgccg

SEQ ID NO: 3323394 - RNA, 20 nt, Mycobacterium tuberculosis H37Rv
cgccgaccggagccgccgga

SEQ ID NO: 3323395 - RNA, 23 nt, Mycobacterium tuberculosis H37Rv
cgccgaccggcccgcauccgcac

SEQ ID NO: 3323396 - RNA, 16 nt, Mycobacterium tuberculosis H37Rv
cgccgaccgucacuga

SEQ ID NO: 3323397 - RNA, 21 nt, Mycobacterium tuberculosis H37Rv
cgccgaccgucacugaugggc

SEQ ID NO: 3323398 - RNA, 20 nt, Mycobacterium tuberculosis H37Rv
cgccgaccuagucaccuuga

SEQ ID NO: 3323399 - RNA, 12 nt, Mycobacterium tuberculosis H37Rv
cgccgaccugga

SEQ ID NO: 3323400 - RNA, 23 nt, Mycobacterium tuberculosis H37Rv
cgccgaccugguaugccgcccgc

SEQ ID NO: 3323401 - RNA, 13 nt, Mycobacterium tuberculosis H37Rv
cgccgaccuucgg

SEQ ID NO: 3323402 - RNA, 17 nt, Mycobacterium tuberculosis H37Rv
cgccgaccuucggcccg

SEQ ID NO: 3323403 - RNA, 19 nt, Mycobacterium tuberculosis H37Rv
cgccgaccuucggcccgcu

SEQ ID NO: 3323404 - RNA, 17 nt, Mycobacterium tuberculosis H37Rv
cgccgacgaacugcagc

SEQ ID NO: 3323405 - RNA, 17 nt, Mycobacterium tuberculosis H37Rv
cgccgacgaccgccugc

SEQ ID NO: 3323406 - RNA, 19 nt, Mycobacterium tuberculosis H37Rv
cgccgacgacuccggcaag

SEQ ID NO: 3323407 - RNA, 20 nt, Mycobacterium tuberculosis H37Rv
cgccgacgauccagucuggg

SEQ ID NO: 3323408 - RNA, 18 nt, Mycobacterium tuberculosis H37Rv
cgccgacgauuaccagcg

SEQ ID NO: 3323409 - RNA, 14 nt, Mycobacterium tuberculosis H37Rv
cgccgacgccagaa

SEQ ID NO: 3323410 - RNA, 16 nt, Mycobacterium tuberculosis H37Rv
cgccgacgccgccggc

SEQ ID NO: 3323411 - RNA, 22 nt, Mycobacterium tuberculosis H37Rv
cgccgacgccgccggccccgcc

SEQ ID NO: 3323412 - RNA, 16 nt, Mycobacterium tuberculosis H37Rv
cgccgacgccgguggg

SEQ ID NO: 3323413 - RNA, 12 nt, Mycobacterium tuberculosis H37Rv
cgccgacgccgu

SEQ ID NO: 3323414 - RNA, 15 nt, Mycobacterium tuberculosis H37Rv
cgccgacggccagca

SEQ ID NO: 3323415 - RNA, 21 nt, Mycobacterium tuberculosis H37Rv
cgccgacggccagcaggauga

SEQ ID NO: 3323416 - RNA, 19 nt, Mycobacterium tuberculosis H37Rv
cgccgacgguuacccagcc

SEQ ID NO: 3323417 - RNA, 20 nt, Mycobacterium tuberculosis H37Rv
cgccgacguauagaccaggu

SEQ ID NO: 3323418 - RNA, 14 nt, Mycobacterium tuberculosis H37Rv
cgccgacuacgaag

SEQ ID NO: 3323419 - RNA, 17 nt, Mycobacterium tuberculosis H37Rv
cgccgacuccccgccgg

SEQ ID NO: 3323420 - RNA, 16 nt, Mycobacterium tuberculosis H37Rv
cgccgacuccgcguag

SEQ ID NO: 3323421 - RNA, 16 nt, Mycobacterium tuberculosis H37Rv
cgccgacucggcaccg

SEQ ID NO: 3323422 - RNA, 23 nt, Mycobacterium tuberculosis H37Rv
cgccgacucggcaccgcggccgc

SEQ ID NO: 3323423 - RNA, 14 nt, Mycobacterium tuberculosis H37Rv
cgccgagaccgccg

SEQ ID NO: 3323424 - RNA, 17 nt, Mycobacterium tuberculosis H37Rv
cgccgagauccgcgcuu

SEQ ID NO: 3323425 - RNA, 15 nt, Mycobacterium tuberculosis H37Rv
cgccgagaucgacau

SEQ ID NO: 3323426 - RNA, 18 nt, Mycobacterium tuberculosis H37Rv
cgccgagaugcugcaccc

SEQ ID NO: 3323427 - RNA, 22 nt, Mycobacterium tuberculosis H37Rv
cgccgagaugcugcacccggag

SEQ ID NO: 3323428 - RNA, 16 nt, Mycobacterium tuberculosis H37Rv
cgccgagaugcugguc

SEQ ID NO: 3323429 - RNA, 20 nt, Mycobacterium tuberculosis H37Rv
cgccgagaugcuggucggcg

SEQ ID NO: 3323430 - RNA, 21 nt, Mycobacterium tuberculosis H37Rv
cgccgagaugcuggucggcga

SEQ ID NO: 3323431 - RNA, 21 nt, Mycobacterium tuberculosis H37Rv
cgccgagcaaggggaucugag

SEQ ID NO: 3323432 - RNA, 14 nt, Mycobacterium tuberculosis H37Rv
cgccgagcaccggg

SEQ ID NO: 3323433 - RNA, 22 nt, Mycobacterium tuberculosis H37Rv
cgccgagccagcacccgcagcc

SEQ ID NO: 3323434 - RNA, 16 nt, Mycobacterium tuberculosis H37Rv
cgccgagcgcaacucc

SEQ ID NO: 3323435 - RNA, 20 nt, Mycobacterium tuberculosis H37Rv
cgccgagcgccaguucgcgg

SEQ ID NO: 3323436 - RNA, 17 nt, Mycobacterium tuberculosis H37Rv
cgccgagcggaccaccg

SEQ ID NO: 3323437 - RNA, 18 nt, Mycobacterium tuberculosis H37Rv
cgccgagcggaccaccgc

SEQ ID NO: 3323438 - RNA, 22 nt, Mycobacterium tuberculosis H37Rv
cgccgagcggaccaccgcucgc

SEQ ID NO: 3323439 - RNA, 17 nt, Mycobacterium tuberculosis H37Rv
cgccgagcggguuagcg

SEQ ID NO: 3323440 - RNA, 16 nt, Mycobacterium tuberculosis H37Rv
cgccgagcgguugccu

SEQ ID NO: 3323441 - RNA, 20 nt, Mycobacterium tuberculosis H37Rv
cgccgagcgugaagucacgg

SEQ ID NO: 3323442 - RNA, 17 nt, Mycobacterium tuberculosis H37Rv
cgccgagcuagaucacg

SEQ ID NO: 3323443 - RNA, 16 nt, Mycobacterium tuberculosis H37Rv
cgccgagcucggcgcc

SEQ ID NO: 3323444 - RNA, 20 nt, Mycobacterium tuberculosis H37Rv
cgccgagcuggcaacgccgc

SEQ ID NO: 3323445 - RNA, 14 nt, Mycobacterium tuberculosis H37Rv
cgccgagcuggcgc

SEQ ID NO: 3323446 - RNA, 19 nt, Mycobacterium tuberculosis H37Rv
cgccgagcugguugacggc

SEQ ID NO: 3323447 - RNA, 19 nt, Mycobacterium tuberculosis H37Rv
cgccgaggaaaccaccagu

SEQ ID NO: 3323448 - RNA, 17 nt, Mycobacterium tuberculosis H37Rv
cgccgaggccucggcca

SEQ ID NO: 3323449 - RNA, 14 nt, Mycobacterium tuberculosis H37Rv
cgccgaggcguucg

SEQ ID NO: 3323450 - RNA, 15 nt, Mycobacterium tuberculosis H37Rv
cgccgaggcguucga

SEQ ID NO: 3323451 - RNA, 18 nt, Mycobacterium tuberculosis H37Rv
cgccgaggucgaaccgcc

SEQ ID NO: 3323452 - RNA, 23 nt, Mycobacterium tuberculosis H37Rv
cgccgaggucgaaccgccggcug

SEQ ID NO: 3323453 - RNA, 12 nt, Mycobacterium tuberculosis H37Rv
cgccgaguccgg

SEQ ID NO: 3323454 - RNA, 16 nt, Mycobacterium tuberculosis H37Rv
cgccgaguccggcgag

SEQ ID NO: 3323455 - RNA, 16 nt, Mycobacterium tuberculosis H37Rv
cgccgaguucugcugg

SEQ ID NO: 3323456 - RNA, 18 nt, Mycobacterium tuberculosis H37Rv
cgccgauacaacgcggcu

SEQ ID NO: 3323457 - RNA, 15 nt, Mycobacterium tuberculosis H37Rv
cgccgauacccagcg

SEQ ID NO: 3323458 - RNA, 13 nt, Mycobacterium tuberculosis H37Rv
cgccgauaccgcc

SEQ ID NO: 3323459 - RNA, 14 nt, Mycobacterium tuberculosis H37Rv
cgccgauaccgccg

SEQ ID NO: 3323460 - RNA, 16 nt, Mycobacterium tuberculosis H37Rv
cgccgauaccgccggc

SEQ ID NO: 3323461 - RNA, 19 nt, Mycobacterium tuberculosis H37Rv
cgccgauaccgccggcccc

SEQ ID NO: 3323462 - RNA, 17 nt, Mycobacterium tuberculosis H37Rv
cgccgauaccggcggcg

SEQ ID NO: 3323463 - RNA, 21 nt, Mycobacterium tuberculosis H37Rv
cgccgauaccgugcaccucca

SEQ ID NO: 3323464 - RNA, 13 nt, Mycobacterium tuberculosis H37Rv
cgccgauaucgca

SEQ ID NO: 3323465 - RNA, 14 nt, Mycobacterium tuberculosis H37Rv
cgccgauaucgcag

SEQ ID NO: 3323466 - RNA, 20 nt, Mycobacterium tuberculosis H37Rv
cgccgauaucgcagauggcg

SEQ ID NO: 3323467 - RNA, 15 nt, Mycobacterium tuberculosis H37Rv
cgccgauaucgguga

SEQ ID NO: 3323468 - RNA, 22 nt, Mycobacterium tuberculosis H37Rv
cgccgauaucggugaccguggc

SEQ ID NO: 3323469 - RNA, 19 nt, Mycobacterium tuberculosis H37Rv
cgccgauaucugccacguu

SEQ ID NO: 3323470 - RNA, 17 nt, Mycobacterium tuberculosis H37Rv
cgccgaucaacaugccg

SEQ ID NO: 3323471 - RNA, 15 nt, Mycobacterium tuberculosis H37Rv
cgccgaucaccaccg

SEQ ID NO: 3323472 - RNA, 16 nt, Mycobacterium tuberculosis H37Rv
cgccgaucaccaccgg

SEQ ID NO: 3323473 - RNA, 21 nt, Mycobacterium tuberculosis H37Rv
cgccgaucagcgaaccaccgg

SEQ ID NO: 3323474 - RNA, 22 nt, Mycobacterium tuberculosis H37Rv
cgccgaucagcgaaccaccggc

SEQ ID NO: 3323475 - RNA, 15 nt, Mycobacterium tuberculosis H37Rv
cgccgaucccgccca

SEQ ID NO: 3323476 - RNA, 16 nt, Mycobacterium tuberculosis H37Rv
cgccgaucccgucggg

SEQ ID NO: 3323477 - RNA, 13 nt, Mycobacterium tuberculosis H37Rv
cgccgaucgaacc

SEQ ID NO: 3323478 - RNA, 15 nt, Mycobacterium tuberculosis H37Rv
cgccgaucgacaccc

SEQ ID NO: 3323479 - RNA, 22 nt, Mycobacterium tuberculosis H37Rv
cgccgaucgacacccgcucggc

SEQ ID NO: 3323480 - RNA, 13 nt, Mycobacterium tuberculosis H37Rv
cgccgaucgagac

SEQ ID NO: 3323481 - RNA, 19 nt, Mycobacterium tuberculosis H37Rv
cgccgaucggcaccguguc

SEQ ID NO: 3323482 - RNA, 21 nt, Mycobacterium tuberculosis H37Rv
cgccgaucggcaccgugucga

SEQ ID NO: 3323483 - RNA, 16 nt, Mycobacterium tuberculosis H37Rv
cgccgaugacggugua

SEQ ID NO: 3323484 - RNA, 16 nt, Mycobacterium tuberculosis H37Rv
cgccgaugaugcggcg

SEQ ID NO: 3323485 - RNA, 18 nt, Mycobacterium tuberculosis H37Rv
cgccgaugaugcggcgca

SEQ ID NO: 3323486 - RNA, 17 nt, Mycobacterium tuberculosis H37Rv
cgccgaugauggacacc

SEQ ID NO: 3323487 - RNA, 20 nt, Mycobacterium tuberculosis H37Rv
cgccgaugauggacaccagc

SEQ ID NO: 3323488 - RNA, 21 nt, Mycobacterium tuberculosis H37Rv
cgccgaugauggacaccagcc

SEQ ID NO: 3323489 - RNA, 22 nt, Mycobacterium tuberculosis H37Rv
cgccgaugaugugcggugaccg

SEQ ID NO: 3323490 - RNA, 17 nt, Mycobacterium tuberculosis H37Rv
cgccgaugccgccggca

SEQ ID NO: 3323491 - RNA, 18 nt, Mycobacterium tuberculosis H37Rv
cgccgaugccgccggcac

SEQ ID NO: 3323492 - RNA, 20 nt, Mycobacterium tuberculosis H37Rv
cgccgaugccgccggcaccg

SEQ ID NO: 3323493 - RNA, 15 nt, Mycobacterium tuberculosis H37Rv
cgccgaugccggcca

SEQ ID NO: 3323494 - RNA, 14 nt, Mycobacterium tuberculosis H37Rv
cgccgauggccgca

SEQ ID NO: 3323495 - RNA, 23 nt, Mycobacterium tuberculosis H37Rv
cgccgaugggaaccgaaucggca

SEQ ID NO: 3323496 - RNA, 18 nt, Mycobacterium tuberculosis H37Rv
cgccgauguagacggugg

SEQ ID NO: 3323497 - RNA, 19 nt, Mycobacterium tuberculosis H37Rv
cgccgauguagacgguggc

SEQ ID NO: 3323498 - RNA, 13 nt, Mycobacterium tuberculosis H37Rv
cgccgauguggcc

SEQ ID NO: 3323499 - RNA, 18 nt, Mycobacterium tuberculosis H37Rv
cgccgauguggccggcga

SEQ ID NO: 3323500 - RNA, 19 nt, Mycobacterium tuberculosis H37Rv
cgccgauguggccggcgau

SEQ ID NO: 3323501 - RNA, 21 nt, Mycobacterium tuberculosis H37Rv
cgccgauguggucggcuguca

SEQ ID NO: 3323502 - RNA, 17 nt, Mycobacterium tuberculosis H37Rv
cgccgauuccaccgccg

SEQ ID NO: 3323503 - RNA, 18 nt, Mycobacterium tuberculosis H37Rv
cgccgauuccaccgccga

SEQ ID NO: 3323504 - RNA, 17 nt, Mycobacterium tuberculosis H37Rv
cgccgauucgccgucgu

SEQ ID NO: 3323505 - RNA, 22 nt, Mycobacterium tuberculosis H37Rv
cgccgauuggcaggcaaugccc

SEQ ID NO: 3323506 - RNA, 17 nt, Mycobacterium tuberculosis H37Rv
cgccgauuuggccguca

SEQ ID NO: 3323507 - RNA, 23 nt, Mycobacterium tuberculosis H37Rv
cgccgauuuggccgucaucuccg

SEQ ID NO: 3323508 - RNA, 18 nt, Mycobacterium tuberculosis H37Rv
cgccgauuuugggaucgu

SEQ ID NO: 3323509 - RNA, 17 nt, Mycobacterium tuberculosis H37Rv
cgccgcaaucagacggc

SEQ ID NO: 3323510 - RNA, 16 nt, Mycobacterium tuberculosis H37Rv
cgccgcaaugacgucg

SEQ ID NO: 3323511 - RNA, 23 nt, Mycobacterium tuberculosis H37Rv
cgccgcaaugacgucgucggcca

SEQ ID NO: 3323512 - RNA, 16 nt, Mycobacterium tuberculosis H37Rv
cgccgcaauggaccga

SEQ ID NO: 3323513 - RNA, 21 nt, Mycobacterium tuberculosis H37Rv
cgccgcaauggaccgaacgac

SEQ ID NO: 3323514 - RNA, 23 nt, Mycobacterium tuberculosis H37Rv
cgccgcacccacauaccggcgca

SEQ ID NO: 3323515 - RNA, 13 nt, Mycobacterium tuberculosis H37Rv
cgccgcacccggg

SEQ ID NO: 3323516 - RNA, 13 nt, Mycobacterium tuberculosis H37Rv
cgccgcaccgccg

SEQ ID NO: 3323517 - RNA, 16 nt, Mycobacterium tuberculosis H37Rv
cgccgcaccgccgcau

SEQ ID NO: 3323518 - RNA, 19 nt, Mycobacterium tuberculosis H37Rv
cgccgcaccggaucaccgc

SEQ ID NO: 3323519 - RNA, 14 nt, Mycobacterium tuberculosis H37Rv
cgccgcacgccggc

SEQ ID NO: 3323520 - RNA, 21 nt, Mycobacterium tuberculosis H37Rv
cgccgcacgccggcaugccag

SEQ ID NO: 3323521 - RNA, 23 nt, Mycobacterium tuberculosis H37Rv
cgccgcacgcuagccgacagcuc

SEQ ID NO: 3323522 - RNA, 20 nt, Mycobacterium tuberculosis H37Rv
cgccgcagaucaccgccagc

SEQ ID NO: 3323523 - RNA, 13 nt, Mycobacterium tuberculosis H37Rv
cgccgcagauggg

SEQ ID NO: 3323524 - RNA, 21 nt, Mycobacterium tuberculosis H37Rv
cgccgcagaugggccuccacc

SEQ ID NO: 3323525 - RNA, 13 nt, Mycobacterium tuberculosis H37Rv
cgccgcagcaggu

SEQ ID NO: 3323526 - RNA, 21 nt, Mycobacterium tuberculosis H37Rv
cgccgcagcaggugcaucgcc

SEQ ID NO: 3323527 - RNA, 15 nt, Mycobacterium tuberculosis H37Rv
cgccgcagcgcguac

SEQ ID NO: 3323528 - RNA, 20 nt, Mycobacterium tuberculosis H37Rv
cgccgcagcuccccgaccga

SEQ ID NO: 3323529 - RNA, 22 nt, Mycobacterium tuberculosis H37Rv
cgccgcagcuccccgaccgaac

SEQ ID NO: 3323530 - RNA, 22 nt, Mycobacterium tuberculosis H37Rv
cgccgcagugacgggacccggg

SEQ ID NO: 3323531 - RNA, 12 nt, Mycobacterium tuberculosis H37Rv
cgccgcaucggc

SEQ ID NO: 3323532 - RNA, 16 nt, Mycobacterium tuberculosis H37Rv
cgccgcaucggcggug

SEQ ID NO: 3323533 - RNA, 17 nt, Mycobacterium tuberculosis H37Rv
cgccgcaugccaccgag

SEQ ID NO: 3323534 - RNA, 17 nt, Mycobacterium tuberculosis H37Rv
cgccgcauucggcgaug

SEQ ID NO: 3323535 - RNA, 16 nt, Mycobacterium tuberculosis H37Rv
cgccgccaaagccggg

SEQ ID NO: 3323536 - RNA, 18 nt, Mycobacterium tuberculosis H37Rv
cgccgccaagcucggcca

SEQ ID NO: 3323537 - RNA, 23 nt, Mycobacterium tuberculosis H37Rv
cgccgccaagcucggccaccagc

SEQ ID NO: 3323538 - RNA, 14 nt, Mycobacterium tuberculosis H37Rv
cgccgccaaugcca

SEQ ID NO: 3323539 - RNA, 16 nt, Mycobacterium tuberculosis H37Rv
cgccgccaaugccacc

SEQ ID NO: 3323540 - RNA, 19 nt, Mycobacterium tuberculosis H37Rv
cgccgccacagcacccacg

SEQ ID NO: 3323541 - RNA, 14 nt, Mycobacterium tuberculosis H37Rv
cgccgccaccaccg

SEQ ID NO: 3323542 - RNA, 18 nt, Mycobacterium tuberculosis H37Rv
cgccgccaccaccgcugc

SEQ ID NO: 3323543 - RNA, 13 nt, Mycobacterium tuberculosis H37Rv
cgccgccaccagc

SEQ ID NO: 3323544 - RNA, 15 nt, Mycobacterium tuberculosis H37Rv
cgccgccaccagcgc

SEQ ID NO: 3323545 - RNA, 19 nt, Mycobacterium tuberculosis H37Rv
cgccgccaccagcgcacgc

SEQ ID NO: 3323546 - RNA, 14 nt, Mycobacterium tuberculosis H37Rv
cgccgccacccggc

SEQ ID NO: 3323547 - RNA, 15 nt, Mycobacterium tuberculosis H37Rv
cgccgccacccggcg

SEQ ID NO: 3323548 - RNA, 12 nt, Mycobacterium tuberculosis H37Rv
cgccgccaccga

SEQ ID NO: 3323549 - RNA, 20 nt, Mycobacterium tuberculosis H37Rv
cgccgccaccgaagccgccg

SEQ ID NO: 3323550 - RNA, 21 nt, Mycobacterium tuberculosis H37Rv
cgccgccaccgaagccgccgg

SEQ ID NO: 3323551 - RNA, 18 nt, Mycobacterium tuberculosis H37Rv
cgccgccaccggcgccgc

SEQ ID NO: 3323552 - RNA, 20 nt, Mycobacterium tuberculosis H37Rv
cgccgccacugccggcagcg

SEQ ID NO: 3323553 - RNA, 13 nt, Mycobacterium tuberculosis H37Rv
cgccgccagauga

SEQ ID NO: 3323554 - RNA, 16 nt, Mycobacterium tuberculosis H37Rv
cgccgccagaugagga

SEQ ID NO: 3323555 - RNA, 12 nt, Mycobacterium tuberculosis H37Rv
cgccgccagcac

SEQ ID NO: 3323556 - RNA, 15 nt, Mycobacterium tuberculosis H37Rv
cgccgccagcaccac

SEQ ID NO: 3323557 - RNA, 19 nt, Mycobacterium tuberculosis H37Rv
cgccgccagcaccucggcc

SEQ ID NO: 3323558 - RNA, 13 nt, Mycobacterium tuberculosis H37Rv
cgccgccagcaga

SEQ ID NO: 3323559 - RNA, 14 nt, Mycobacterium tuberculosis H37Rv
cgccgccagccugg

SEQ ID NO: 3323560 - RNA, 20 nt, Mycobacterium tuberculosis H37Rv
cgccgccagguguucgccgg

SEQ ID NO: 3323561 - RNA, 18 nt, Mycobacterium tuberculosis H37Rv
cgccgccagguugcccgg

SEQ ID NO: 3323562 - RNA, 17 nt, Mycobacterium tuberculosis H37Rv
cgccgccagucguccuc

SEQ ID NO: 3323563 - RNA, 15 nt, Mycobacterium tuberculosis H37Rv
cgccgccaucacgca

SEQ ID NO: 3323564 - RNA, 14 nt, Mycobacterium tuberculosis H37Rv
cgccgccaucagcc

SEQ ID NO: 3323565 - RNA, 14 nt, Mycobacterium tuberculosis H37Rv
cgccgccaucgccg

SEQ ID NO: 3323566 - RNA, 16 nt, Mycobacterium tuberculosis H37Rv
cgccgccaucgccgau

SEQ ID NO: 3323567 - RNA, 17 nt, Mycobacterium tuberculosis H37Rv
cgccgccaucgccgaug

SEQ ID NO: 3323568 - RNA, 13 nt, Mycobacterium tuberculosis H37Rv
cgccgccauugcc

SEQ ID NO: 3323569 - RNA, 17 nt, Mycobacterium tuberculosis H37Rv
cgccgccauugccgccg

SEQ ID NO: 3323570 - RNA, 18 nt, Mycobacterium tuberculosis H37Rv
cgccgccauugccgccgg

SEQ ID NO: 3323571 - RNA, 21 nt, Mycobacterium tuberculosis H37Rv
cgccgccauuggacagcgcga

SEQ ID NO: 3323572 - RNA, 20 nt, Mycobacterium tuberculosis H37Rv
cgccgccauugucgccaaau

SEQ ID NO: 3323573 - RNA, 20 nt, Mycobacterium tuberculosis H37Rv
cgccgcccaaaacgucaccg

SEQ ID NO: 3323574 - RNA, 21 nt, Mycobacterium tuberculosis H37Rv
cgccgcccaaaacgucaccgc

SEQ ID NO: 3323575 - RNA, 15 nt, Mycobacterium tuberculosis H37Rv
cgccgcccaacgcga

SEQ ID NO: 3323576 - RNA, 19 nt, Mycobacterium tuberculosis H37Rv
cgccgcccacaugaacgac

SEQ ID NO: 3323577 - RNA, 12 nt, Mycobacterium tuberculosis H37Rv
cgccgcccagcg

SEQ ID NO: 3323578 - RNA, 16 nt, Mycobacterium tuberculosis H37Rv
cgccgcccccgcccgu

SEQ ID NO: 3323579 - RNA, 15 nt, Mycobacterium tuberculosis H37Rv
cgccgcccccgccgg

SEQ ID NO: 3323580 - RNA, 18 nt, Mycobacterium tuberculosis H37Rv
cgccgcccccgccggccg

SEQ ID NO: 3323581 - RNA, 17 nt, Mycobacterium tuberculosis H37Rv
cgccgccccgcucgguu

SEQ ID NO: 3323582 - RNA, 22 nt, Mycobacterium tuberculosis H37Rv
cgccgcccgaggcacccgugcc

SEQ ID NO: 3323583 - RNA, 17 nt, Mycobacterium tuberculosis H37Rv
cgccgcccgcgccaccg

SEQ ID NO: 3323584 - RNA, 18 nt, Mycobacterium tuberculosis H37Rv
cgccgcccgcuccuccgg

SEQ ID NO: 3323585 - RNA, 22 nt, Mycobacterium tuberculosis H37Rv
cgccgcccgcuccuccggcacc

SEQ ID NO: 3323586 - RNA, 15 nt, Mycobacterium tuberculosis H37Rv
cgccgcccggcguau

SEQ ID NO: 3323587 - RNA, 23 nt, Mycobacterium tuberculosis H37Rv
cgccgcccuugccgccggccccg

SEQ ID NO: 3323588 - RNA, 19 nt, Mycobacterium tuberculosis H37Rv
cgccgccgaaaaccucgcc

SEQ ID NO: 3323589 - RNA, 18 nt, Mycobacterium tuberculosis H37Rv
cgccgccgacaaucacca

SEQ ID NO: 3323590 - RNA, 21 nt, Mycobacterium tuberculosis H37Rv
cgccgccgaucuugagccgga

SEQ ID NO: 3323591 - RNA, 13 nt, Mycobacterium tuberculosis H37Rv
cgccgccgccacc

SEQ ID NO: 3323592 - RNA, 16 nt, Mycobacterium tuberculosis H37Rv
cgccgccgccaucgcc

SEQ ID NO: 3323593 - RNA, 12 nt, Mycobacterium tuberculosis H37Rv
cgccgccgccga

SEQ ID NO: 3323594 - RNA, 13 nt, Mycobacterium tuberculosis H37Rv
cgccgccgccgac

SEQ ID NO: 3323595 - RNA, 15 nt, Mycobacterium tuberculosis H37Rv
cgccgccgccgacga

SEQ ID NO: 3323596 - RNA, 13 nt, Mycobacterium tuberculosis H37Rv
cgccgccgccggc

SEQ ID NO: 3323597 - RNA, 14 nt, Mycobacterium tuberculosis H37Rv
cgccgccgccgggu

SEQ ID NO: 3323598 - RNA, 23 nt, Mycobacterium tuberculosis H37Rv
cgccgccgcgacgcacugccccg

SEQ ID NO: 3323599 - RNA, 16 nt, Mycobacterium tuberculosis H37Rv
cgccgccgcgagcgcc

SEQ ID NO: 3323600 - RNA, 13 nt, Mycobacterium tuberculosis H37Rv
cgccgccgcgcgu

SEQ ID NO: 3323601 - RNA, 12 nt, Mycobacterium tuberculosis H37Rv
cgccgccgcggg

SEQ ID NO: 3323602 - RNA, 17 nt, Mycobacterium tuberculosis H37Rv
cgccgccgcugccgccc

SEQ ID NO: 3323603 - RNA, 21 nt, Mycobacterium tuberculosis H37Rv
cgccgccgcuguugaucgaca

SEQ ID NO: 3323604 - RNA, 22 nt, Mycobacterium tuberculosis H37Rv
cgccgccggaagcgccggccga

SEQ ID NO: 3323605 - RNA, 22 nt, Mycobacterium tuberculosis H37Rv
cgccgccggacccaccgucacc

SEQ ID NO: 3323606 - RNA, 17 nt, Mycobacterium tuberculosis H37Rv
cgccgccggaucgccgg

SEQ ID NO: 3323607 - RNA, 13 nt, Mycobacterium tuberculosis H37Rv
cgccgccggcacc

SEQ ID NO: 3323608 - RNA, 20 nt, Mycobacterium tuberculosis H37Rv
cgccgccggcaccaccguug

SEQ ID NO: 3323609 - RNA, 15 nt, Mycobacterium tuberculosis H37Rv
cgccgccggcaccgc

SEQ ID NO: 3323610 - RNA, 19 nt, Mycobacterium tuberculosis H37Rv
cgccgccggcaccgccggc

SEQ ID NO: 3323611 - RNA, 21 nt, Mycobacterium tuberculosis H37Rv
cgccgccggcaccgccggcgc

SEQ ID NO: 3323612 - RNA, 15 nt, Mycobacterium tuberculosis H37Rv
cgccgccggcaccuc

SEQ ID NO: 3323613 - RNA, 16 nt, Mycobacterium tuberculosis H37Rv
cgccgccggcaccucc

SEQ ID NO: 3323614 - RNA, 13 nt, Mycobacterium tuberculosis H37Rv
cgccgccggcccc

SEQ ID NO: 3323615 - RNA, 15 nt, Mycobacterium tuberculosis H37Rv
cgccgccggccccgc

SEQ ID NO: 3323616 - RNA, 14 nt, Mycobacterium tuberculosis H37Rv
cgccgccggccgcc

SEQ ID NO: 3323617 - RNA, 15 nt, Mycobacterium tuberculosis H37Rv
cgccgccggccgcca

SEQ ID NO: 3323618 - RNA, 14 nt, Mycobacterium tuberculosis H37Rv
cgccgccggcgcca

SEQ ID NO: 3323619 - RNA, 14 nt, Mycobacterium tuberculosis H37Rv
cgccgccggcgccc

SEQ ID NO: 3323620 - RNA, 18 nt, Mycobacterium tuberculosis H37Rv
cgccgccggcgccgccgg

SEQ ID NO: 3323621 - RNA, 16 nt, Mycobacterium tuberculosis H37Rv
cgccgccggcgccgga

SEQ ID NO: 3323622 - RNA, 19 nt, Mycobacterium tuberculosis H37Rv
cgccgccggcgccggcgcu

SEQ ID NO: 3323623 - RNA, 13 nt, Mycobacterium tuberculosis H37Rv
cgccgccggcgcg

SEQ ID NO: 3323624 - RNA, 13 nt, Mycobacterium tuberculosis H37Rv
cgccgccggcggc

SEQ ID NO: 3323625 - RNA, 19 nt, Mycobacterium tuberculosis H37Rv
cgccgccggcggcgguacc

SEQ ID NO: 3323626 - RNA, 14 nt, Mycobacterium tuberculosis H37Rv
cgccgccggucccc

SEQ ID NO: 3323627 - RNA, 20 nt, Mycobacterium tuberculosis H37Rv
cgccgccgguguaacccucg

SEQ ID NO: 3323628 - RNA, 22 nt, Mycobacterium tuberculosis H37Rv
cgccgccggugucgggcuguca

SEQ ID NO: 3323629 - RNA, 18 nt, Mycobacterium tuberculosis H37Rv
cgccgccguccagcgccg

SEQ ID NO: 3323630 - RNA, 22 nt, Mycobacterium tuberculosis H37Rv
cgccgccguccagcgccgcggc

SEQ ID NO: 3323631 - RNA, 13 nt, Mycobacterium tuberculosis H37Rv
cgccgccgucgcc

SEQ ID NO: 3323632 - RNA, 14 nt, Mycobacterium tuberculosis H37Rv
cgccgccgucggcg

SEQ ID NO: 3323633 - RNA, 14 nt, Mycobacterium tuberculosis H37Rv
cgccgccgucgggu

SEQ ID NO: 3323634 - RNA, 22 nt, Mycobacterium tuberculosis H37Rv
cgccgccguucccgccggcccc

SEQ ID NO: 3323635 - RNA, 15 nt, Mycobacterium tuberculosis H37Rv
cgccgccguugccgc

SEQ ID NO: 3323636 - RNA, 19 nt, Mycobacterium tuberculosis H37Rv
cgccgccguugccgccagc

SEQ ID NO: 3323637 - RNA, 20 nt, Mycobacterium tuberculosis H37Rv
cgccgccguugccgccagcg

SEQ ID NO: 3323638 - RNA, 19 nt, Mycobacterium tuberculosis H37Rv
cgccgccguugccgccauc

SEQ ID NO: 3323639 - RNA, 17 nt, Mycobacterium tuberculosis H37Rv
cgccgccguugccgccg

SEQ ID NO: 3323640 - RNA, 18 nt, Mycobacterium tuberculosis H37Rv
cgccgccguugccgccgg

SEQ ID NO: 3323641 - RNA, 19 nt, Mycobacterium tuberculosis H37Rv
cgccgccguugccgccggu

SEQ ID NO: 3323642 - RNA, 14 nt, Mycobacterium tuberculosis H37Rv
cgccgccucgggca

SEQ ID NO: 3323643 - RNA, 16 nt, Mycobacterium tuberculosis H37Rv
cgccgccucgggcacc

SEQ ID NO: 3323644 - RNA, 12 nt, Mycobacterium tuberculosis H37Rv
cgccgccucguc

SEQ ID NO: 3323645 - RNA, 14 nt, Mycobacterium tuberculosis H37Rv
cgccgccucgucgu

SEQ ID NO: 3323646 - RNA, 15 nt, Mycobacterium tuberculosis H37Rv
cgccgccugcccggc

SEQ ID NO: 3323647 - RNA, 20 nt, Mycobacterium tuberculosis H37Rv
cgccgccugcccggcccgcu

SEQ ID NO: 3323648 - RNA, 13 nt, Mycobacterium tuberculosis H37Rv
cgccgccugcgca

SEQ ID NO: 3323649 - RNA, 12 nt, Mycobacterium tuberculosis H37Rv
cgccgccugcuc

SEQ ID NO: 3323650 - RNA, 15 nt, Mycobacterium tuberculosis H37Rv
cgccgccuggacgcc

SEQ ID NO: 3323651 - RNA, 21 nt, Mycobacterium tuberculosis H37Rv
cgccgccuggacgccgccgga

SEQ ID NO: 3323652 - RNA, 16 nt, Mycobacterium tuberculosis H37Rv
cgccgcgaacuccagc

SEQ ID NO: 3323653 - RNA, 20 nt, Mycobacterium tuberculosis H37Rv
cgccgcgaagcgcucggcag

SEQ ID NO: 3323654 - RNA, 20 nt, Mycobacterium tuberculosis H37Rv
cgccgcgaaggggugcccgg

SEQ ID NO: 3323655 - RNA, 14 nt, Mycobacterium tuberculosis H37Rv
cgccgcgaaugucg

SEQ ID NO: 3323656 - RNA, 22 nt, Mycobacterium tuberculosis H37Rv
cgccgcgaaugucgccgccugg

SEQ ID NO: 3323657 - RNA, 19 nt, Mycobacterium tuberculosis H37Rv
cgccgcgacaaaucggucg

SEQ ID NO: 3323658 - RNA, 22 nt, Mycobacterium tuberculosis H37Rv
cgccgcgaccacgcaccgcccc

SEQ ID NO: 3323659 - RNA, 16 nt, Mycobacterium tuberculosis H37Rv
cgccgcgagcgccggc

SEQ ID NO: 3323660 - RNA, 19 nt, Mycobacterium tuberculosis H37Rv
cgccgcgagcgccggccgc

SEQ ID NO: 3323661 - RNA, 15 nt, Mycobacterium tuberculosis H37Rv
cgccgcgaggcaccg

SEQ ID NO: 3323662 - RNA, 17 nt, Mycobacterium tuberculosis H37Rv
cgccgcgaggcaccgac

SEQ ID NO: 3323663 - RNA, 16 nt, Mycobacterium tuberculosis H37Rv
cgccgcgauggccccu

SEQ ID NO: 3323664 - RNA, 13 nt, Mycobacterium tuberculosis H37Rv
cgccgcgauggcg

SEQ ID NO: 3323665 - RNA, 22 nt, Mycobacterium tuberculosis H37Rv
cgccgcgauggcgguccaccgg

SEQ ID NO: 3323666 - RNA, 12 nt, Mycobacterium tuberculosis H37Rv
cgccgcgcagcc

SEQ ID NO: 3323667 - RNA, 14 nt, Mycobacterium tuberculosis H37Rv
cgccgcgcagccgg

SEQ ID NO: 3323668 - RNA, 16 nt, Mycobacterium tuberculosis H37Rv
cgccgcgcauccgcag

SEQ ID NO: 3323669 - RNA, 19 nt, Mycobacterium tuberculosis H37Rv
cgccgcgcaucgcggccga

SEQ ID NO: 3323670 - RNA, 17 nt, Mycobacterium tuberculosis H37Rv
cgccgcgcccaccauga

SEQ ID NO: 3323671 - RNA, 22 nt, Mycobacterium tuberculosis H37Rv
cgccgcgcccaccaugaucaca

SEQ ID NO: 3323672 - RNA, 19 nt, Mycobacterium tuberculosis H37Rv
cgccgcgccccagacgcgc

SEQ ID NO: 3323673 - RNA, 21 nt, Mycobacterium tuberculosis H37Rv
cgccgcgccccagacgcgcag

SEQ ID NO: 3323674 - RNA, 20 nt, Mycobacterium tuberculosis H37Rv
cgccgcgcccggcgcuagcg

SEQ ID NO: 3323675 - RNA, 21 nt, Mycobacterium tuberculosis H37Rv
cgccgcgccgaaucgcgggcu

SEQ ID NO: 3323676 - RNA, 16 nt, Mycobacterium tuberculosis H37Rv
cgccgcgccgcgccgc

SEQ ID NO: 3323677 - RNA, 12 nt, Mycobacterium tuberculosis H37Rv
cgccgcgccggc

SEQ ID NO: 3323678 - RNA, 14 nt, Mycobacterium tuberculosis H37Rv
cgccgcgccggcac

SEQ ID NO: 3323679 - RNA, 20 nt, Mycobacterium tuberculosis H37Rv
cgccgcgccggcggccaccu

SEQ ID NO: 3323680 - RNA, 15 nt, Mycobacterium tuberculosis H37Rv
cgccgcgccgucccg

SEQ ID NO: 3323681 - RNA, 18 nt, Mycobacterium tuberculosis H37Rv
cgccgcgcgacaggcccu

SEQ ID NO: 3323682 - RNA, 15 nt, Mycobacterium tuberculosis H37Rv
cgccgcgcgcggcgu

SEQ ID NO: 3323683 - RNA, 14 nt, Mycobacterium tuberculosis H37Rv
cgccgcgcggcuug

SEQ ID NO: 3323684 - RNA, 12 nt, Mycobacterium tuberculosis H37Rv
cgccgcgcguca

SEQ ID NO: 3323685 - RNA, 13 nt, Mycobacterium tuberculosis H37Rv
cgccgcgcgucgc

SEQ ID NO: 3323686 - RNA, 16 nt, Mycobacterium tuberculosis H37Rv
cgccgcgcgucgcgag

SEQ ID NO: 3323687 - RNA, 17 nt, Mycobacterium tuberculosis H37Rv
cgccgcgcguucggcgc

SEQ ID NO: 3323688 - RNA, 21 nt, Mycobacterium tuberculosis H37Rv
cgccgcgcguucggcgcugau

SEQ ID NO: 3323689 - RNA, 12 nt, Mycobacterium tuberculosis H37Rv
cgccgcgcucga

SEQ ID NO: 3323690 - RNA, 16 nt, Mycobacterium tuberculosis H37Rv
cgccgcgcucgccgau

SEQ ID NO: 3323691 - RNA, 18 nt, Mycobacterium tuberculosis H37Rv
cgccgcgcuggucggaga

SEQ ID NO: 3323692 - RNA, 22 nt, Mycobacterium tuberculosis H37Rv
cgccgcgcuugcgaucgccgcu

SEQ ID NO: 3323693 - RNA, 21 nt, Mycobacterium tuberculosis H37Rv
cgccgcggaguaggccgcgcc

SEQ ID NO: 3323694 - RNA, 22 nt, Mycobacterium tuberculosis H37Rv
cgccgcggcagcguugacgguc

SEQ ID NO: 3323695 - RNA, 14 nt, Mycobacterium tuberculosis H37Rv
cgccgcggccacca

SEQ ID NO: 3323696 - RNA, 17 nt, Mycobacterium tuberculosis H37Rv
cgccgcggccaccaccg

SEQ ID NO: 3323697 - RNA, 13 nt, Mycobacterium tuberculosis H37Rv
cgccgcggccgcc

SEQ ID NO: 3323698 - RNA, 18 nt, Mycobacterium tuberculosis H37Rv
cgccgcggccgccguccc

SEQ ID NO: 3323699 - RNA, 15 nt, Mycobacterium tuberculosis H37Rv
cgccgcggccggcgc

SEQ ID NO: 3323700 - RNA, 16 nt, Mycobacterium tuberculosis H37Rv
cgccgcggccggcgcu

SEQ ID NO: 3323701 - RNA, 12 nt, Mycobacterium tuberculosis H37Rv
cgccgcggcgcc

SEQ ID NO: 3323702 - RNA, 16 nt, Mycobacterium tuberculosis H37Rv
cgccgcggcgcccggc

SEQ ID NO: 3323703 - RNA, 15 nt, Mycobacterium tuberculosis H37Rv
cgccgcggcggcagc

SEQ ID NO: 3323704 - RNA, 19 nt, Mycobacterium tuberculosis H37Rv
cgccgcgggacaccaccgc

SEQ ID NO: 3323705 - RNA, 23 nt, Mycobacterium tuberculosis H37Rv
cgccgcgggacaccaccgcccgc

SEQ ID NO: 3323706 - RNA, 16 nt, Mycobacterium tuberculosis H37Rv
cgccgcgggcgccggu

SEQ ID NO: 3323707 - RNA, 21 nt, Mycobacterium tuberculosis H37Rv
cgccgcggucgugaucagcag

SEQ ID NO: 3323708 - RNA, 22 nt, Mycobacterium tuberculosis H37Rv
cgccgcguaccaauucccgcgc

SEQ ID NO: 3323709 - RNA, 18 nt, Mycobacterium tuberculosis H37Rv
cgccgcgucauucaccgc

SEQ ID NO: 3323710 - RNA, 19 nt, Mycobacterium tuberculosis H37Rv
cgccgcgucuaccaaccgg

SEQ ID NO: 3323711 - RNA, 19 nt, Mycobacterium tuberculosis H37Rv
cgccgcgugcugcggcugg

SEQ ID NO: 3323712 - RNA, 20 nt, Mycobacterium tuberculosis H37Rv
cgccgcgugguuccggcgug

SEQ ID NO: 3323713 - RNA, 18 nt, Mycobacterium tuberculosis H37Rv
cgccgcguugucggcgcu

SEQ ID NO: 3323714 - RNA, 21 nt, Mycobacterium tuberculosis H37Rv
cgccgcguugucggcgcuccc

SEQ ID NO: 3323715 - RNA, 20 nt, Mycobacterium tuberculosis H37Rv
cgccgcguuuauaccucgcc

SEQ ID NO: 3323716 - RNA, 19 nt, Mycobacterium tuberculosis H37Rv
cgccgcguuucggucguug

SEQ ID NO: 3323717 - RNA, 15 nt, Mycobacterium tuberculosis H37Rv
cgccgcuaacgcacc

SEQ ID NO: 3323718 - RNA, 16 nt, Mycobacterium tuberculosis H37Rv
cgccgcuaacgcaccu

SEQ ID NO: 3323719 - RNA, 18 nt, Mycobacterium tuberculosis H37Rv
cgccgcuaacgcaccugc

SEQ ID NO: 3323720 - RNA, 19 nt, Mycobacterium tuberculosis H37Rv
cgccgcuaacgcaccugcg

SEQ ID NO: 3323721 - RNA, 15 nt, Mycobacterium tuberculosis H37Rv
cgccgcuacgccggc

SEQ ID NO: 3323722 - RNA, 19 nt, Mycobacterium tuberculosis H37Rv
cgccgcuacgccggcccga

SEQ ID NO: 3323723 - RNA, 21 nt, Mycobacterium tuberculosis H37Rv
cgccgcuaggugacgccgcca

SEQ ID NO: 3323724 - RNA, 24 nt, Mycobacterium tuberculosis H37Rv
cgccgcuaugaggcagucguugau

SEQ ID NO: 3323725 - RNA, 13 nt, Mycobacterium tuberculosis H37Rv
cgccgcucccgca

SEQ ID NO: 3323726 - RNA, 22 nt, Mycobacterium tuberculosis H37Rv
cgccgcucccucuacacccgga

SEQ ID NO: 3323727 - RNA, 14 nt, Mycobacterium tuberculosis H37Rv
cgccgcucgguccc

SEQ ID NO: 3323728 - RNA, 16 nt, Mycobacterium tuberculosis H37Rv
cgccgcucgguccccg

SEQ ID NO: 3323729 - RNA, 20 nt, Mycobacterium tuberculosis H37Rv
cgccgcucgguccccgcagc

SEQ ID NO: 3323730 - RNA, 16 nt, Mycobacterium tuberculosis H37Rv
cgccgcugacuccugc

SEQ ID NO: 3323731 - RNA, 17 nt, Mycobacterium tuberculosis H37Rv
cgccgcugacuccugcg

SEQ ID NO: 3323732 - RNA, 16 nt, Mycobacterium tuberculosis H37Rv
cgccgcugccgccggu

SEQ ID NO: 3323733 - RNA, 14 nt, Mycobacterium tuberculosis H37Rv
cgccgcugccgccu

SEQ ID NO: 3323734 - RNA, 16 nt, Mycobacterium tuberculosis H37Rv
cgccgcugccgccugc

SEQ ID NO: 3323735 - RNA, 13 nt, Mycobacterium tuberculosis H37Rv
cgccgcugccgcg

SEQ ID NO: 3323736 - RNA, 20 nt, Mycobacterium tuberculosis H37Rv
cgccgcuggagaucacgccg

SEQ ID NO: 3323737 - RNA, 16 nt, Mycobacterium tuberculosis H37Rv
cgccgcuggccagcac

SEQ ID NO: 3323738 - RNA, 19 nt, Mycobacterium tuberculosis H37Rv
cgccgcugggugaccagga

SEQ ID NO: 3323739 - RNA, 12 nt, Mycobacterium tuberculosis H37Rv
cgccgcuggucg

SEQ ID NO: 3323740 - RNA, 15 nt, Mycobacterium tuberculosis H37Rv
cgccgcuuucuuggc

SEQ ID NO: 3323741 - RNA, 22 nt, Mycobacterium tuberculosis H37Rv
cgccgcuuucuuggcgggcgcc

SEQ ID NO: 3323742 - RNA, 17 nt, Mycobacterium tuberculosis H37Rv
cgccggaaagcccgucg

SEQ ID NO: 3323743 - RNA, 20 nt, Mycobacterium tuberculosis H37Rv
cgccggacaaaccgggcggc

SEQ ID NO: 3323744 - RNA, 14 nt, Mycobacterium tuberculosis H37Rv
cgccggaccagagc

SEQ ID NO: 3323745 - RNA, 16 nt, Mycobacterium tuberculosis H37Rv
cgccggaccagcuccu

SEQ ID NO: 3323746 - RNA, 13 nt, Mycobacterium tuberculosis H37Rv
cgccggacccgcc

SEQ ID NO: 3323747 - RNA, 21 nt, Mycobacterium tuberculosis H37Rv
cgccggacccgccggguccgc

SEQ ID NO: 3323748 - RNA, 23 nt, Mycobacterium tuberculosis H37Rv
cgccggacccggucgccgggacg

SEQ ID NO: 3323749 - RNA, 21 nt, Mycobacterium tuberculosis H37Rv
cgccggacgacaacaggccgu

SEQ ID NO: 3323750 - RNA, 16 nt, Mycobacterium tuberculosis H37Rv
cgccggacugcggccc

SEQ ID NO: 3323751 - RNA, 20 nt, Mycobacterium tuberculosis H37Rv
cgccggagaucgucgcguag

SEQ ID NO: 3323752 - RNA, 13 nt, Mycobacterium tuberculosis H37Rv
cgccggagccgcc

SEQ ID NO: 3323753 - RNA, 15 nt, Mycobacterium tuberculosis H37Rv
cgccggagccgccca

SEQ ID NO: 3323754 - RNA, 19 nt, Mycobacterium tuberculosis H37Rv
cgccggagccgcccaagcc

SEQ ID NO: 3323755 - RNA, 20 nt, Mycobacterium tuberculosis H37Rv
cgccggagccgcccaagccg

SEQ ID NO: 3323756 - RNA, 14 nt, Mycobacterium tuberculosis H37Rv
cgccggaggcaagc

SEQ ID NO: 3323757 - RNA, 13 nt, Mycobacterium tuberculosis H37Rv
cgccggaggucgg

SEQ ID NO: 3323758 - RNA, 22 nt, Mycobacterium tuberculosis H37Rv
cgccggaguugaagaagcccga

SEQ ID NO: 3323759 - RNA, 20 nt, Mycobacterium tuberculosis H37Rv
cgccggauacgucagcccga

SEQ ID NO: 3323760 - RNA, 23 nt, Mycobacterium tuberculosis H37Rv
cgccggauagcaccggcacccgc

SEQ ID NO: 3323761 - RNA, 15 nt, Mycobacterium tuberculosis H37Rv
cgccggauccgccag

SEQ ID NO: 3323762 - RNA, 16 nt, Mycobacterium tuberculosis H37Rv
cgccggauccgccaga

SEQ ID NO: 3323763 - RNA, 19 nt, Mycobacterium tuberculosis H37Rv
cgccggaucgccacggugg

SEQ ID NO: 3323764 - RNA, 13 nt, Mycobacterium tuberculosis H37Rv
cgccggaucgccg

SEQ ID NO: 3323765 - RNA, 18 nt, Mycobacterium tuberculosis H37Rv
cgccggaugacaccgacc

SEQ ID NO: 3323766 - RNA, 18 nt, Mycobacterium tuberculosis H37Rv
cgccggaugcugucagca

SEQ ID NO: 3323767 - RNA, 20 nt, Mycobacterium tuberculosis H37Rv
cgccggaugcugucagcagc

SEQ ID NO: 3323768 - RNA, 21 nt, Mycobacterium tuberculosis H37Rv
cgccggaugcugucagcagcc

SEQ ID NO: 3323769 - RNA, 16 nt, Mycobacterium tuberculosis H37Rv
cgccggauucgaugac

SEQ ID NO: 3323770 - RNA, 19 nt, Mycobacterium tuberculosis H37Rv
cgccggcaaaggacgucga

SEQ ID NO: 3323771 - RNA, 20 nt, Mycobacterium tuberculosis H37Rv
cgccggcaacaucgagcgcc

SEQ ID NO: 3323772 - RNA, 19 nt, Mycobacterium tuberculosis H37Rv
cgccggcaauaccgccagc

SEQ ID NO: 3323773 - RNA, 20 nt, Mycobacterium tuberculosis H37Rv
cgccggcaauaccgccagcg

SEQ ID NO: 3323774 - RNA, 11 nt, Mycobacterium tuberculosis H37Rv
cgccggcaccg

SEQ ID NO: 3323775 - RNA, 15 nt, Mycobacterium tuberculosis H37Rv
cgccggcaccgccgc

SEQ ID NO: 3323776 - RNA, 17 nt, Mycobacterium tuberculosis H37Rv
cgccggcaccgccgccc

SEQ ID NO: 3323777 - RNA, 21 nt, Mycobacterium tuberculosis H37Rv
cgccggcaccgccggcgccgc

SEQ ID NO: 3323778 - RNA, 16 nt, Mycobacterium tuberculosis H37Rv
cgccggcaccgccggu

SEQ ID NO: 3323779 - RNA, 18 nt, Mycobacterium tuberculosis H37Rv
cgccggcaccggggcugc

SEQ ID NO: 3323780 - RNA, 18 nt, Mycobacterium tuberculosis H37Rv
cgccggcaccucccuggc

SEQ ID NO: 3323781 - RNA, 14 nt, Mycobacterium tuberculosis H37Rv
cgccggcagcgcgg

SEQ ID NO: 3323782 - RNA, 15 nt, Mycobacterium tuberculosis H37Rv
cgccggcaucgcgca

SEQ ID NO: 3323783 - RNA, 17 nt, Mycobacterium tuberculosis H37Rv
cgccggcaucgcgcaac

SEQ ID NO: 3323784 - RNA, 15 nt, Mycobacterium tuberculosis H37Rv
cgccggcaucgguca

SEQ ID NO: 3323785 - RNA, 14 nt, Mycobacterium tuberculosis H37Rv
cgccggcaucgucg

SEQ ID NO: 3323786 - RNA, 15 nt, Mycobacterium tuberculosis H37Rv
cgccggcaucgucga

SEQ ID NO: 3323787 - RNA, 21 nt, Mycobacterium tuberculosis H37Rv
cgccggcaucuccaccgucgc

SEQ ID NO: 3323788 - RNA, 16 nt, Mycobacterium tuberculosis H37Rv
cgccggcaugccagcc

SEQ ID NO: 3323789 - RNA, 17 nt, Mycobacterium tuberculosis H37Rv
cgccggccaagaccgcg

SEQ ID NO: 3323790 - RNA, 15 nt, Mycobacterium tuberculosis H37Rv
cgccggccacccgcg

SEQ ID NO: 3323791 - RNA, 16 nt, Mycobacterium tuberculosis H37Rv
cgccggccacccgcgc

SEQ ID NO: 3323792 - RNA, 13 nt, Mycobacterium tuberculosis H37Rv
cgccggccacgac

SEQ ID NO: 3323793 - RNA, 14 nt, Mycobacterium tuberculosis H37Rv
cgccggccacgacc

SEQ ID NO: 3323794 - RNA, 20 nt, Mycobacterium tuberculosis H37Rv
cgccggccagcacuccgcgg

SEQ ID NO: 3323795 - RNA, 14 nt, Mycobacterium tuberculosis H37Rv
cgccggccagcggc

SEQ ID NO: 3323796 - RNA, 22 nt, Mycobacterium tuberculosis H37Rv
cgccggccagcggccauccggc

SEQ ID NO: 3323797 - RNA, 14 nt, Mycobacterium tuberculosis H37Rv
cgccggccaguccg

SEQ ID NO: 3323798 - RNA, 15 nt, Mycobacterium tuberculosis H37Rv
cgccggccaguccgc

SEQ ID NO: 3323799 - RNA, 15 nt, Mycobacterium tuberculosis H37Rv
cgccggccaguucgg

SEQ ID NO: 3323800 - RNA, 20 nt, Mycobacterium tuberculosis H37Rv
cgccggccccaccgguaccg

SEQ ID NO: 3323801 - RNA, 21 nt, Mycobacterium tuberculosis H37Rv
cgccggccccaccggugccgc

SEQ ID NO: 3323802 - RNA, 14 nt, Mycobacterium tuberculosis H37Rv
cgccggccccgcca

SEQ ID NO: 3323803 - RNA, 15 nt, Mycobacterium tuberculosis H37Rv
cgccggccccgccag

SEQ ID NO: 3323804 - RNA, 21 nt, Mycobacterium tuberculosis H37Rv
cgccggccccgccgaugccgc

SEQ ID NO: 3323805 - RNA, 15 nt, Mycobacterium tuberculosis H37Rv
cgccggccccgccgc

SEQ ID NO: 3323806 - RNA, 16 nt, Mycobacterium tuberculosis H37Rv
cgccggccccgccggc

SEQ ID NO: 3323807 - RNA, 15 nt, Mycobacterium tuberculosis H37Rv
cgccggccccgccgu

SEQ ID NO: 3323808 - RNA, 17 nt, Mycobacterium tuberculosis H37Rv
cgccggccccgccguca

SEQ ID NO: 3323809 - RNA, 20 nt, Mycobacterium tuberculosis H37Rv
cgccggccccgccgucaccg

SEQ ID NO: 3323810 - RNA, 21 nt, Mycobacterium tuberculosis H37Rv
cgccggccccgccgucaccgc

SEQ ID NO: 3323811 - RNA, 20 nt, Mycobacterium tuberculosis H37Rv
cgccggccccgccguuaccg

SEQ ID NO: 3323812 - RNA, 17 nt, Mycobacterium tuberculosis H37Rv
cgccggcccggugauga

SEQ ID NO: 3323813 - RNA, 22 nt, Mycobacterium tuberculosis H37Rv
cgccggccgcacgccggccagc

SEQ ID NO: 3323814 - RNA, 13 nt, Mycobacterium tuberculosis H37Rv
cgccggccgcagu

SEQ ID NO: 3323815 - RNA, 14 nt, Mycobacterium tuberculosis H37Rv
cgccggccgccagc

SEQ ID NO: 3323816 - RNA, 14 nt, Mycobacterium tuberculosis H37Rv
cgccggccgcgcag

SEQ ID NO: 3323817 - RNA, 15 nt, Mycobacterium tuberculosis H37Rv
cgccggccgcgcaga

SEQ ID NO: 3323818 - RNA, 13 nt, Mycobacterium tuberculosis H37Rv
cgccggccgcgcu

SEQ ID NO: 3323819 - RNA, 21 nt, Mycobacterium tuberculosis H37Rv
cgccggccgcggcggccccgc

SEQ ID NO: 3323820 - RNA, 15 nt, Mycobacterium tuberculosis H37Rv
cgccggccgcugccu

SEQ ID NO: 3323821 - RNA, 12 nt, Mycobacterium tuberculosis H37Rv
cgccggccggcc

SEQ ID NO: 3323822 - RNA, 15 nt, Mycobacterium tuberculosis H37Rv
cgccggccgucagca

SEQ ID NO: 3323823 - RNA, 18 nt, Mycobacterium tuberculosis H37Rv
cgccggccgucgaucuuc

SEQ ID NO: 3323824 - RNA, 17 nt, Mycobacterium tuberculosis H37Rv
cgccggccgucggccgg

SEQ ID NO: 3323825 - RNA, 12 nt, Mycobacterium tuberculosis H37Rv
cgccggccuggc

SEQ ID NO: 3323826 - RNA, 15 nt, Mycobacterium tuberculosis H37Rv
cgccggccuggccgc

SEQ ID NO: 3323827 - RNA, 19 nt, Mycobacterium tuberculosis H37Rv
cgccggccuggccgccaga

SEQ ID NO: 3323828 - RNA, 15 nt, Mycobacterium tuberculosis H37Rv
cgccggcgaacugau

SEQ ID NO: 3323829 - RNA, 21 nt, Mycobacterium tuberculosis H37Rv
cgccggcgaagaccgccggga

SEQ ID NO: 3323830 - RNA, 21 nt, Mycobacterium tuberculosis H37Rv
cgccggcgacaccgcaccgac

SEQ ID NO: 3323831 - RNA, 13 nt, Mycobacterium tuberculosis H37Rv
cgccggcgacggc

SEQ ID NO: 3323832 - RNA, 19 nt, Mycobacterium tuberculosis H37Rv
cgccggcgccaagucucgg

SEQ ID NO: 3323833 - RNA, 15 nt, Mycobacterium tuberculosis H37Rv
cgccggcgccacccg

SEQ ID NO: 3323834 - RNA, 17 nt, Mycobacterium tuberculosis H37Rv
cgccggcgccacccgcg

SEQ ID NO: 3323835 - RNA, 21 nt, Mycobacterium tuberculosis H37Rv
cgccggcgccacccgcgccgc

SEQ ID NO: 3323836 - RNA, 22 nt, Mycobacterium tuberculosis H37Rv
cgccggcgccacccgcgccgcc

SEQ ID NO: 3323837 - RNA, 14 nt, Mycobacterium tuberculosis H37Rv
cgccggcgccaccg

SEQ ID NO: 3323838 - RNA, 14 nt, Mycobacterium tuberculosis H37Rv
cgccggcgccagca

SEQ ID NO: 3323839 - RNA, 18 nt, Mycobacterium tuberculosis H37Rv
cgccggcgccagcgccgc

SEQ ID NO: 3323840 - RNA, 22 nt, Mycobacterium tuberculosis H37Rv
cgccggcgccaucgggucaccc

SEQ ID NO: 3323841 - RNA, 17 nt, Mycobacterium tuberculosis H37Rv
cgccggcgcccaggccg

SEQ ID NO: 3323842 - RNA, 18 nt, Mycobacterium tuberculosis H37Rv
cgccggcgcccaggccga

SEQ ID NO: 3323843 - RNA, 19 nt, Mycobacterium tuberculosis H37Rv
cgccggcgcccaggccgau

SEQ ID NO: 3323844 - RNA, 13 nt, Mycobacterium tuberculosis H37Rv
cgccggcgccgcc

SEQ ID NO: 3323845 - RNA, 15 nt, Mycobacterium tuberculosis H37Rv
cgccggcgccgccau

SEQ ID NO: 3323846 - RNA, 18 nt, Mycobacterium tuberculosis H37Rv
cgccggcgccgccggcac

SEQ ID NO: 3323847 - RNA, 22 nt, Mycobacterium tuberculosis H37Rv
cgccggcgccgccggugccacc

SEQ ID NO: 3323848 - RNA, 17 nt, Mycobacterium tuberculosis H37Rv
cgccggcgccggugccg

SEQ ID NO: 3323849 - RNA, 15 nt, Mycobacterium tuberculosis H37Rv
cgccggcgccucgug

SEQ ID NO: 3323850 - RNA, 13 nt, Mycobacterium tuberculosis H37Rv
cgccggcgcgccg

SEQ ID NO: 3323851 - RNA, 15 nt, Mycobacterium tuberculosis H37Rv
cgccggcgcgccgau

SEQ ID NO: 3323852 - RNA, 17 nt, Mycobacterium tuberculosis H37Rv
cgccggcgcgccgauga

SEQ ID NO: 3323853 - RNA, 20 nt, Mycobacterium tuberculosis H37Rv
cgccggcgcugaucgcgaag

SEQ ID NO: 3323854 - RNA, 13 nt, Mycobacterium tuberculosis H37Rv
cgccggcgcugcu

SEQ ID NO: 3323855 - RNA, 23 nt, Mycobacterium tuberculosis H37Rv
cgccggcgcugcugccauugccg

SEQ ID NO: 3323856 - RNA, 21 nt, Mycobacterium tuberculosis H37Rv
cgccggcggccaccagugcgg

SEQ ID NO: 3323857 - RNA, 15 nt, Mycobacterium tuberculosis H37Rv
cgccggcggccaccu

SEQ ID NO: 3323858 - RNA, 13 nt, Mycobacterium tuberculosis H37Rv
cgccggcggccgc

SEQ ID NO: 3323859 - RNA, 13 nt, Mycobacterium tuberculosis H37Rv
cgccggcggcgga

SEQ ID NO: 3323860 - RNA, 15 nt, Mycobacterium tuberculosis H37Rv
cgccggcggcggugc

SEQ ID NO: 3323861 - RNA, 22 nt, Mycobacterium tuberculosis H37Rv
cgccggcggcggugcgccccgc

SEQ ID NO: 3323862 - RNA, 16 nt, Mycobacterium tuberculosis H37Rv
cgccggcgggacgggg

SEQ ID NO: 3323863 - RNA, 20 nt, Mycobacterium tuberculosis H37Rv
cgccggcgggacgggggcug

SEQ ID NO: 3323864 - RNA, 21 nt, Mycobacterium tuberculosis H37Rv
cgccggcgguagucggccagc

SEQ ID NO: 3323865 - RNA, 18 nt, Mycobacterium tuberculosis H37Rv
cgccggcguccggagccc

SEQ ID NO: 3323866 - RNA, 20 nt, Mycobacterium tuberculosis H37Rv
cgccggcguuugggcaucau

SEQ ID NO: 3323867 - RNA, 14 nt, Mycobacterium tuberculosis H37Rv
cgccggcuccgcag

SEQ ID NO: 3323868 - RNA, 14 nt, Mycobacterium tuberculosis H37Rv
cgccggcuccgcca

SEQ ID NO: 3323869 - RNA, 16 nt, Mycobacterium tuberculosis H37Rv
cgccggcuccgccacu

SEQ ID NO: 3323870 - RNA, 15 nt, Mycobacterium tuberculosis H37Rv
cgccggcuccgccag

SEQ ID NO: 3323871 - RNA, 21 nt, Mycobacterium tuberculosis H37Rv
cgccggcuccgccagcgccgc

SEQ ID NO: 3323872 - RNA, 14 nt, Mycobacterium tuberculosis H37Rv
cgccggcuccgccg

SEQ ID NO: 3323873 - RNA, 16 nt, Mycobacterium tuberculosis H37Rv
cgccggcugcgccagu

SEQ ID NO: 3323874 - RNA, 16 nt, Mycobacterium tuberculosis H37Rv
cgccggcuggcggccu

SEQ ID NO: 3323875 - RNA, 23 nt, Mycobacterium tuberculosis H37Rv
cgccggcuucgcccagagccgcu

SEQ ID NO: 3323876 - RNA, 16 nt, Mycobacterium tuberculosis H37Rv
cgccgggaacauccca

SEQ ID NO: 3323877 - RNA, 19 nt, Mycobacterium tuberculosis H37Rv
cgccgggaacaucccagcg

SEQ ID NO: 3323878 - RNA, 19 nt, Mycobacterium tuberculosis H37Rv
cgccgggauaacccagcac

SEQ ID NO: 3323879 - RNA, 19 nt, Mycobacterium tuberculosis H37Rv
cgccgggauaucgucgacg

SEQ ID NO: 3323880 - RNA, 20 nt, Mycobacterium tuberculosis H37Rv
cgccgggauaucgucgacgc

SEQ ID NO: 3323881 - RNA, 14 nt, Mycobacterium tuberculosis H37Rv
cgccgggaucaccg

SEQ ID NO: 3323882 - RNA, 15 nt, Mycobacterium tuberculosis H37Rv
cgccgggcaacgcga

SEQ ID NO: 3323883 - RNA, 23 nt, Mycobacterium tuberculosis H37Rv
cgccgggcaauacguagucgccg

SEQ ID NO: 3323884 - RNA, 15 nt, Mycobacterium tuberculosis H37Rv
cgccgggcaucggcg

SEQ ID NO: 3323885 - RNA, 21 nt, Mycobacterium tuberculosis H37Rv
cgccgggccaggccgaugccg

SEQ ID NO: 3323886 - RNA, 19 nt, Mycobacterium tuberculosis H37Rv
cgccgggccccggggugcc

SEQ ID NO: 3323887 - RNA, 12 nt, Mycobacterium tuberculosis H37Rv
cgccgggcccuc

SEQ ID NO: 3323888 - RNA, 17 nt, Mycobacterium tuberculosis H37Rv
cgccgggcccucgccau

SEQ ID NO: 3323889 - RNA, 12 nt, Mycobacterium tuberculosis H37Rv
cgccgggcggca

SEQ ID NO: 3323890 - RNA, 15 nt, Mycobacterium tuberculosis H37Rv
cgccgggcggccgcg

SEQ ID NO: 3323891 - RNA, 15 nt, Mycobacterium tuberculosis H37Rv
cgccgggcggcgcga

SEQ ID NO: 3323892 - RNA, 14 nt, Mycobacterium tuberculosis H37Rv
cgccgggcggcggu

SEQ ID NO: 3323893 - RNA, 16 nt, Mycobacterium tuberculosis H37Rv
cgccgggcggcggugc

SEQ ID NO: 3323894 - RNA, 17 nt, Mycobacterium tuberculosis H37Rv
cgccgggcucagcuggg

SEQ ID NO: 3323895 - RNA, 21 nt, Mycobacterium tuberculosis H37Rv
cgccgggcucagcugggccgc

SEQ ID NO: 3323896 - RNA, 22 nt, Mycobacterium tuberculosis H37Rv
cgccgggcucagcugggccgcu

SEQ ID NO: 3323897 - RNA, 18 nt, Mycobacterium tuberculosis H37Rv
cgccgggcuuaggccgcg

SEQ ID NO: 3323898 - RNA, 13 nt, Mycobacterium tuberculosis H37Rv
cgccggggaccac

SEQ ID NO: 3323899 - RNA, 18 nt, Mycobacterium tuberculosis H37Rv
cgccggggaccacgguga

SEQ ID NO: 3323900 - RNA, 20 nt, Mycobacterium tuberculosis H37Rv
cgccggggacgccgcggcgc

SEQ ID NO: 3323901 - RNA, 21 nt, Mycobacterium tuberculosis H37Rv
cgccggggauaccggucagca

SEQ ID NO: 3323902 - RNA, 15 nt, Mycobacterium tuberculosis H37Rv
cgccggggccgccgu

SEQ ID NO: 3323903 - RNA, 20 nt, Mycobacterium tuberculosis H37Rv
cgccgggggcaccguuaccg

SEQ ID NO: 3323904 - RNA, 15 nt, Mycobacterium tuberculosis H37Rv
cgccgggggcgccgc

SEQ ID NO: 3323905 - RNA, 16 nt, Mycobacterium tuberculosis H37Rv
cgccgggggcgccgcc

SEQ ID NO: 3323906 - RNA, 16 nt, Mycobacterium tuberculosis H37Rv
cgccgggguagacgcc

SEQ ID NO: 3323907 - RNA, 17 nt, Mycobacterium tuberculosis H37Rv
cgccgggguagacgccc

SEQ ID NO: 3323908 - RNA, 17 nt, Mycobacterium tuberculosis H37Rv
cgccggguagcuguaca

SEQ ID NO: 3323909 - RNA, 20 nt, Mycobacterium tuberculosis H37Rv
cgccgggucagcccggcgcg

SEQ ID NO: 3323910 - RNA, 21 nt, Mycobacterium tuberculosis H37Rv
cgccgggucagcccggcgcga

SEQ ID NO: 3323911 - RNA, 21 nt, Mycobacterium tuberculosis H37Rv
cgccggguccaucaaccccag

SEQ ID NO: 3323912 - RNA, 21 nt, Mycobacterium tuberculosis H37Rv
cgccgggugaggcggugacga

SEQ ID NO: 3323913 - RNA, 18 nt, Mycobacterium tuberculosis H37Rv
cgccgggugcaacggcgu

SEQ ID NO: 3323914 - RNA, 16 nt, Mycobacterium tuberculosis H37Rv
cgccgggugucggugg

SEQ ID NO: 3323915 - RNA, 15 nt, Mycobacterium tuberculosis H37Rv
cgccggguucgccgg

SEQ ID NO: 3323916 - RNA, 20 nt, Mycobacterium tuberculosis H37Rv
cgccggguuggcgccggcca

SEQ ID NO: 3323917 - RNA, 18 nt, Mycobacterium tuberculosis H37Rv
cgccggguuuauccaguc

SEQ ID NO: 3323918 - RNA, 22 nt, Mycobacterium tuberculosis H37Rv
cgccgguaacuguccgcccgga

SEQ ID NO: 3323919 - RNA, 13 nt, Mycobacterium tuberculosis H37Rv
cgccggucacgac

SEQ ID NO: 3323920 - RNA, 17 nt, Mycobacterium tuberculosis H37Rv
cgccggucacgacgucc

SEQ ID NO: 3323921 - RNA, 22 nt, Mycobacterium tuberculosis H37Rv
cgccggucagcaauacggcggc

SEQ ID NO: 3323922 - RNA, 23 nt, Mycobacterium tuberculosis H37Rv
cgccggucagcaauacggcggcg

SEQ ID NO: 3323923 - RNA, 14 nt, Mycobacterium tuberculosis H37Rv
cgccggucagcgug

SEQ ID NO: 3323924 - RNA, 18 nt, Mycobacterium tuberculosis H37Rv
cgccggucaggccgccgc

SEQ ID NO: 3323925 - RNA, 14 nt, Mycobacterium tuberculosis H37Rv
cgccggucauccca

SEQ ID NO: 3323926 - RNA, 18 nt, Mycobacterium tuberculosis H37Rv
cgccggucaucccaagcg

SEQ ID NO: 3323927 - RNA, 19 nt, Mycobacterium tuberculosis H37Rv
cgccgguccccgccggcgg

SEQ ID NO: 3323928 - RNA, 17 nt, Mycobacterium tuberculosis H37Rv
cgccgguccccucggug

SEQ ID NO: 3323929 - RNA, 23 nt, Mycobacterium tuberculosis H37Rv
cgccggucccgcgugccacucga

SEQ ID NO: 3323930 - RNA, 15 nt, Mycobacterium tuberculosis H37Rv
cgccggucgccggcu

SEQ ID NO: 3323931 - RNA, 16 nt, Mycobacterium tuberculosis H37Rv
cgccggucgccggcug

SEQ ID NO: 3323932 - RNA, 17 nt, Mycobacterium tuberculosis H37Rv
cgccggugacgacgucg

SEQ ID NO: 3323933 - RNA, 21 nt, Mycobacterium tuberculosis H37Rv
cgccggugacgaugaccgcgc

SEQ ID NO: 3323934 - RNA, 18 nt, Mycobacterium tuberculosis H37Rv
cgccggugaggaucagcg

SEQ ID NO: 3323935 - RNA, 14 nt, Mycobacterium tuberculosis H37Rv
cgccggugaggcga

SEQ ID NO: 3323936 - RNA, 17 nt, Mycobacterium tuberculosis H37Rv
cgccggugccaccgacg

SEQ ID NO: 3323937 - RNA, 19 nt, Mycobacterium tuberculosis H37Rv
cgccggugccaccgacgcc

SEQ ID NO: 3323938 - RNA, 18 nt, Mycobacterium tuberculosis H37Rv
cgccggugccaccggcug

SEQ ID NO: 3323939 - RNA, 21 nt, Mycobacterium tuberculosis H37Rv
cgccggugccaccggcuggug

SEQ ID NO: 3323940 - RNA, 23 nt, Mycobacterium tuberculosis H37Rv
cgccggugccaguacucggccag

SEQ ID NO: 3323941 - RNA, 15 nt, Mycobacterium tuberculosis H37Rv
cgccggugccgauca

SEQ ID NO: 3323942 - RNA, 19 nt, Mycobacterium tuberculosis H37Rv
cgccggugccgaugaccga

SEQ ID NO: 3323943 - RNA, 13 nt, Mycobacterium tuberculosis H37Rv
cgccggugccgcc

SEQ ID NO: 3323944 - RNA, 15 nt, Mycobacterium tuberculosis H37Rv
cgccggugccgccau

SEQ ID NO: 3323945 - RNA, 17 nt, Mycobacterium tuberculosis H37Rv
cgccggugccgccggug

SEQ ID NO: 3323946 - RNA, 21 nt, Mycobacterium tuberculosis H37Rv
cgccggugccgccggugccgc

SEQ ID NO: 3323947 - RNA, 15 nt, Mycobacterium tuberculosis H37Rv
cgccggugccgccgu

SEQ ID NO: 3323948 - RNA, 19 nt, Mycobacterium tuberculosis H37Rv
cgccggugccgccgucgcc

SEQ ID NO: 3323949 - RNA, 16 nt, Mycobacterium tuberculosis H37Rv
cgccggugccgccugc

SEQ ID NO: 3323950 - RNA, 21 nt, Mycobacterium tuberculosis H37Rv
cgccggugcgcaacuucgacu

SEQ ID NO: 3323951 - RNA, 21 nt, Mycobacterium tuberculosis H37Rv
cgccggugcgcgcugacccgc

SEQ ID NO: 3323952 - RNA, 20 nt, Mycobacterium tuberculosis H37Rv
cgccggugcgcuggaucuuc

SEQ ID NO: 3323953 - RNA, 15 nt, Mycobacterium tuberculosis H37Rv
cgccggugcggcggg

SEQ ID NO: 3323954 - RNA, 13 nt, Mycobacterium tuberculosis H37Rv
cgccgguggcacg

SEQ ID NO: 3323955 - RNA, 15 nt, Mycobacterium tuberculosis H37Rv
cgccgguggcacggc

SEQ ID NO: 3323956 - RNA, 19 nt, Mycobacterium tuberculosis H37Rv
cgccgguggcacggccccu

SEQ ID NO: 3323957 - RNA, 14 nt, Mycobacterium tuberculosis H37Rv
cgccgguggccgcg

SEQ ID NO: 3323958 - RNA, 21 nt, Mycobacterium tuberculosis H37Rv
cgccgguggccgcgcugguca

SEQ ID NO: 3323959 - RNA, 22 nt, Mycobacterium tuberculosis H37Rv
cgccgguggcgccggggccgcc

SEQ ID NO: 3323960 - RNA, 21 nt, Mycobacterium tuberculosis H37Rv
cgccggugggcgguccgcguc

SEQ ID NO: 3323961 - RNA, 18 nt, Mycobacterium tuberculosis H37Rv
cgccgguggggucggucu

SEQ ID NO: 3323962 - RNA, 14 nt, Mycobacterium tuberculosis H37Rv
cgccgguggucacg

SEQ ID NO: 3323963 - RNA, 15 nt, Mycobacterium tuberculosis H37Rv
cgccgguggugagga

SEQ ID NO: 3323964 - RNA, 21 nt, Mycobacterium tuberculosis H37Rv
cgccgguggugccggcgccgc

SEQ ID NO: 3323965 - RNA, 22 nt, Mycobacterium tuberculosis H37Rv
cgccgguggugccggcgccgcc

SEQ ID NO: 3323966 - RNA, 18 nt, Mycobacterium tuberculosis H37Rv
cgccgguguaacccucga

SEQ ID NO: 3323967 - RNA, 20 nt, Mycobacterium tuberculosis H37Rv
cgccgguguaacccucgaac

SEQ ID NO: 3323968 - RNA, 16 nt, Mycobacterium tuberculosis H37Rv
cgccggugugcgcacc

SEQ ID NO: 3323969 - RNA, 16 nt, Mycobacterium tuberculosis H37Rv
cgccgguguugccguu

SEQ ID NO: 3323970 - RNA, 19 nt, Mycobacterium tuberculosis H37Rv
cgccgguuacccggaccgu

SEQ ID NO: 3323971 - RNA, 20 nt, Mycobacterium tuberculosis H37Rv
cgccgguuacccggaccguc

SEQ ID NO: 3323972 - RNA, 13 nt, Mycobacterium tuberculosis H37Rv
cgccgguucccga

SEQ ID NO: 3323973 - RNA, 17 nt, Mycobacterium tuberculosis H37Rv
cgccgguuccgccggcc

SEQ ID NO: 3323974 - RNA, 18 nt, Mycobacterium tuberculosis H37Rv
cgccgguuccgccggccc

SEQ ID NO: 3323975 - RNA, 17 nt, Mycobacterium tuberculosis H37Rv
cgccgguuucgaggcga

SEQ ID NO: 3323976 - RNA, 15 nt, Mycobacterium tuberculosis H37Rv
cgccguaacagccgg

SEQ ID NO: 3323977 - RNA, 17 nt, Mycobacterium tuberculosis H37Rv
cgccguaagcaccagcc

SEQ ID NO: 3323978 - RNA, 19 nt, Mycobacterium tuberculosis H37Rv
cgccguaagcaccagccag

SEQ ID NO: 3323979 - RNA, 20 nt, Mycobacterium tuberculosis H37Rv
cgccguaagcaccagccagc

SEQ ID NO: 3323980 - RNA, 21 nt, Mycobacterium tuberculosis H37Rv
cgccguacagcggcggcgucg

SEQ ID NO: 3323981 - RNA, 13 nt, Mycobacterium tuberculosis H37Rv
cgccguacaucag

SEQ ID NO: 3323982 - RNA, 15 nt, Mycobacterium tuberculosis H37Rv
cgccguacaucagcg

SEQ ID NO: 3323983 - RNA, 18 nt, Mycobacterium tuberculosis H37Rv
cgccguacaucagcgcga

SEQ ID NO: 3323984 - RNA, 18 nt, Mycobacterium tuberculosis H37Rv
cgccguagaccagcaggc

SEQ ID NO: 3323985 - RNA, 19 nt, Mycobacterium tuberculosis H37Rv
cgccguagaccagcaggcc

SEQ ID NO: 3323986 - RNA, 16 nt, Mycobacterium tuberculosis H37Rv
cgccguagagcuggug

SEQ ID NO: 3323987 - RNA, 18 nt, Mycobacterium tuberculosis H37Rv
cgccguagcaucgggcga

SEQ ID NO: 3323988 - RNA, 15 nt, Mycobacterium tuberculosis H37Rv
cgccguagccggccg

SEQ ID NO: 3323989 - RNA, 15 nt, Mycobacterium tuberculosis H37Rv
caaccagcaaugccg

SEQ ID NO: 3323990 - RNA, 11 nt, Mycobacterium tuberculosis H37Rv
caaccagcagc

SEQ ID NO: 3323991 - RNA, 13 nt, Mycobacterium tuberculosis H37Rv
caaccagcccggc

SEQ ID NO: 3323992 - RNA, 18 nt, Mycobacterium tuberculosis H37Rv
caaccagcccggccgccg

SEQ ID NO: 3323993 - RNA, 22 nt, Mycobacterium tuberculosis H37Rv
caaccagcccggccgccgagga

SEQ ID NO: 3323994 - RNA, 18 nt, Mycobacterium tuberculosis H37Rv
caaccagcgagcccagcu

SEQ ID NO: 3323995 - RNA, 21 nt, Mycobacterium tuberculosis H37Rv
caaccagcgagcccagcugcg

SEQ ID NO: 3323996 - RNA, 21 nt, Mycobacterium tuberculosis H37Rv
caacccacacgcccucgacgc

SEQ ID NO: 3323997 - RNA, 11 nt, Mycobacterium tuberculosis H37Rv
caacccacccc

SEQ ID NO: 3323998 - RNA, 16 nt, Mycobacterium tuberculosis H37Rv
caaccccaacaucccg

SEQ ID NO: 3323999 - RNA, 17 nt, Mycobacterium tuberculosis H37Rv
caacccgcaccccggcc

SEQ ID NO: 3324000 - RNA, 22 nt, Mycobacterium tuberculosis H37Rv
caacccgcgauucgcggcagcc

SEQ ID NO: 3324001 - RNA, 14 nt, Mycobacterium tuberculosis H37Rv
caacccgcuuggca

SEQ ID NO: 3324002 - RNA, 21 nt, Mycobacterium tuberculosis H37Rv
caacccggcgggcccgccggc

SEQ ID NO: 3324003 - RNA, 17 nt, Mycobacterium tuberculosis H37Rv
caacccggcgucgacga

SEQ ID NO: 3324004 - RNA, 23 nt, Mycobacterium tuberculosis H37Rv
caacccggugauggugugcagca

SEQ ID NO: 3324005 - RNA, 11 nt, Mycobacterium tuberculosis H37Rv
caacccuaggg

SEQ ID NO: 3324006 - RNA, 17 nt, Mycobacterium tuberculosis H37Rv
caacccucgccggucag

SEQ ID NO: 3324007 - RNA, 14 nt, Mycobacterium tuberculosis H37Rv
caacccugcccggc

SEQ ID NO: 3324008 - RNA, 15 nt, Mycobacterium tuberculosis H37Rv
caacccugccgcgau

SEQ ID NO: 3324009 - RNA, 18 nt, Mycobacterium tuberculosis H37Rv
caacccugcggugcagga

SEQ ID NO: 3324010 - RNA, 14 nt, Mycobacterium tuberculosis H37Rv
caaccgaaccgcgu

SEQ ID NO: 3324011 - RNA, 17 nt, Mycobacterium tuberculosis H37Rv
caaccgaccgggccgca

SEQ ID NO: 3324012 - RNA, 24 nt, Mycobacterium tuberculosis H37Rv
caaccgagcgcccuccucgaugcc

SEQ ID NO: 3324013 - RNA, 19 nt, Mycobacterium tuberculosis H37Rv
caaccgaugacgcguucaa

SEQ ID NO: 3324014 - RNA, 19 nt, Mycobacterium tuberculosis H37Rv
caaccgccaucgucgaaga

SEQ ID NO: 3324015 - RNA, 11 nt, Mycobacterium tuberculosis H37Rv
caaccgcccgu

SEQ ID NO: 3324016 - RNA, 14 nt, Mycobacterium tuberculosis H37Rv
caaccgcgccaccu

SEQ ID NO: 3324017 - RNA, 19 nt, Mycobacterium tuberculosis H37Rv
caaccgcgggaacccccca

SEQ ID NO: 3324018 - RNA, 19 nt, Mycobacterium tuberculosis H37Rv
caaccgcgucgaagccggg

SEQ ID NO: 3324019 - RNA, 14 nt, Mycobacterium tuberculosis H37Rv
caaccgcucggcga

SEQ ID NO: 3324020 - RNA, 14 nt, Mycobacterium tuberculosis H37Rv
caaccgcugcugcu

SEQ ID NO: 3324021 - RNA, 15 nt, Mycobacterium tuberculosis H37Rv
caaccgcugcugcug

SEQ ID NO: 3324022 - RNA, 19 nt, Mycobacterium tuberculosis H37Rv
caaccggacauccgaugcg

SEQ ID NO: 3324023 - RNA, 23 nt, Mycobacterium tuberculosis H37Rv
caaccggacauccgaugcgucac

SEQ ID NO: 3324024 - RNA, 15 nt, Mycobacterium tuberculosis H37Rv
caaccggacgcccuc

SEQ ID NO: 3324025 - RNA, 22 nt, Mycobacterium tuberculosis H37Rv
caaccggcgcaguagccgacca

SEQ ID NO: 3324026 - RNA, 14 nt, Mycobacterium tuberculosis H37Rv
caaccgggacaacc

SEQ ID NO: 3324027 - RNA, 18 nt, Mycobacterium tuberculosis H37Rv
caaccgggaggccaccgc

SEQ ID NO: 3324028 - RNA, 15 nt, Mycobacterium tuberculosis H37Rv
caaccgggcgggacu

SEQ ID NO: 3324029 - RNA, 19 nt, Mycobacterium tuberculosis H37Rv
caaccgggucagcccagcc

SEQ ID NO: 3324030 - RNA, 17 nt, Mycobacterium tuberculosis H37Rv
caaccgggucguucggg

SEQ ID NO: 3324031 - RNA, 17 nt, Mycobacterium tuberculosis H37Rv
caaccgggugugcgucg

SEQ ID NO: 3324032 - RNA, 19 nt, Mycobacterium tuberculosis H37Rv
caaccgguaucgccgcuac

SEQ ID NO: 3324033 - RNA, 15 nt, Mycobacterium tuberculosis H37Rv
caaccggucagccug

SEQ ID NO: 3324034 - RNA, 13 nt, Mycobacterium tuberculosis H37Rv
caaccgguccagg

SEQ ID NO: 3324035 - RNA, 14 nt, Mycobacterium tuberculosis H37Rv
caaccggugcgcau

SEQ ID NO: 3324036 - RNA, 19 nt, Mycobacterium tuberculosis H37Rv
caaccgguggaugaacacc

SEQ ID NO: 3324037 - RNA, 23 nt, Mycobacterium tuberculosis H37Rv
caaccgguggaugaacaccucau

SEQ ID NO: 3324038 - RNA, 21 nt, Mycobacterium tuberculosis H37Rv
caaccgguguaauugccgacg

SEQ ID NO: 3324039 - RNA, 15 nt, Mycobacterium tuberculosis H37Rv
caaccgucgaaaaau

SEQ ID NO: 3324040 - RNA, 14 nt, Mycobacterium tuberculosis H37Rv
caaccgucggugaa

SEQ ID NO: 3324041 - RNA, 15 nt, Mycobacterium tuberculosis H37Rv
caaccgugagcacca

SEQ ID NO: 3324042 - RNA, 18 nt, Mycobacterium tuberculosis H37Rv
caaccgugagcaccagca

SEQ ID NO: 3324043 - RNA, 19 nt, Mycobacterium tuberculosis H37Rv
caaccguuguaccccagca

SEQ ID NO: 3324044 - RNA, 18 nt, Mycobacterium tuberculosis H37Rv
caaccuaaauugccgggc

SEQ ID NO: 3324045 - RNA, 13 nt, Mycobacterium tuberculosis H37Rv
caaccucaucgcg

SEQ ID NO: 3324046 - RNA, 21 nt, Mycobacterium tuberculosis H37Rv
caaccucccucuagcgcccga

SEQ ID NO: 3324047 - RNA, 15 nt, Mycobacterium tuberculosis H37Rv
caaccucgccgucgu

SEQ ID NO: 3324048 - RNA, 23 nt, Mycobacterium tuberculosis H37Rv
cacggcagacacgcugcaggcgg

SEQ ID NO: 3324049 - RNA, 13 nt, Mycobacterium tuberculosis H37Rv
cacggcagccaac

SEQ ID NO: 3324050 - RNA, 23 nt, Mycobacterium tuberculosis H37Rv
cacggcagccuugaucucguccc

SEQ ID NO: 3324051 - RNA, 14 nt, Mycobacterium tuberculosis H37Rv
cacggcagcgccca

SEQ ID NO: 3324052 - RNA, 13 nt, Mycobacterium tuberculosis H37Rv
cacggcagcugca

SEQ ID NO: 3324053 - RNA, 18 nt, Mycobacterium tuberculosis H37Rv
cacggccagaaacccggc

SEQ ID NO: 3324054 - RNA, 17 nt, Mycobacterium tuberculosis H37Rv
cacggccaggucgacgg

SEQ ID NO: 3324055 - RNA, 14 nt, Mycobacterium tuberculosis H37Rv
cacggccgagcagg

SEQ ID NO: 3324056 - RNA, 15 nt, Mycobacterium tuberculosis H37Rv
cacggccgagcaggu

SEQ ID NO: 3324057 - RNA, 14 nt, Mycobacterium tuberculosis H37Rv
cacggccgcagccg

SEQ ID NO: 3324058 - RNA, 16 nt, Mycobacterium tuberculosis H37Rv
cacggccgcagccgau

SEQ ID NO: 3324059 - RNA, 18 nt, Mycobacterium tuberculosis H37Rv
cacggccggccgcugcca

SEQ ID NO: 3324060 - RNA, 21 nt, Mycobacterium tuberculosis H37Rv
cacggccgucauuuccacauc

SEQ ID NO: 3324061 - RNA, 14 nt, Mycobacterium tuberculosis H37Rv
cacggccuccggac

SEQ ID NO: 3324062 - RNA, 17 nt, Mycobacterium tuberculosis H37Rv
cacggccuccggaccga

SEQ ID NO: 3324063 - RNA, 22 nt, Mycobacterium tuberculosis H37Rv
cacggccuugccgaucagcugg

SEQ ID NO: 3324064 - RNA, 21 nt, Mycobacterium tuberculosis H37Rv
cacggcgacauacccgaucaa

SEQ ID NO: 3324065 - RNA, 18 nt, Mycobacterium tuberculosis H37Rv
cacggcgacgaucucggc

SEQ ID NO: 3324066 - RNA, 14 nt, Mycobacterium tuberculosis H37Rv
cacggcgacgccag

SEQ ID NO: 3324067 - RNA, 16 nt, Mycobacterium tuberculosis H37Rv
cacggcgaggugcucg

SEQ ID NO: 3324068 - RNA, 16 nt, Mycobacterium tuberculosis H37Rv
cacggcgauccccgac

SEQ ID NO: 3324069 - RNA, 15 nt, Mycobacterium tuberculosis H37Rv
cacggcgaucgguga

SEQ ID NO: 3324070 - RNA, 13 nt, Mycobacterium tuberculosis H37Rv
cacggcgccgcca

SEQ ID NO: 3324071 - RNA, 16 nt, Mycobacterium tuberculosis H37Rv
cacggcgcgcgcgccg

SEQ ID NO: 3324072 - RNA, 15 nt, Mycobacterium tuberculosis H37Rv
cacggcgcguuggga

SEQ ID NO: 3324073 - RNA, 22 nt, Mycobacterium tuberculosis H37Rv
cacggcgcguugggaccagugc

SEQ ID NO: 3324074 - RNA, 12 nt, Mycobacterium tuberculosis H37Rv
cacggcggccac

SEQ ID NO: 3324075 - RNA, 15 nt, Mycobacterium tuberculosis H37Rv
cacggcggccaccug

SEQ ID NO: 3324076 - RNA, 16 nt, Mycobacterium tuberculosis H37Rv
cacggcggccaccugc

SEQ ID NO: 3324077 - RNA, 22 nt, Mycobacterium tuberculosis H37Rv
cacggcggccaccugcuggccg

SEQ ID NO: 3324078 - RNA, 14 nt, Mycobacterium tuberculosis H37Rv
cacggcggccacgu

SEQ ID NO: 3324079 - RNA, 14 nt, Mycobacterium tuberculosis H37Rv
cacggcggccaggg

SEQ ID NO: 3324080 - RNA, 15 nt, Mycobacterium tuberculosis H37Rv
cacggcggccccggc

SEQ ID NO: 3324081 - RNA, 14 nt, Mycobacterium tuberculosis H37Rv
cacggcggcggcgu

SEQ ID NO: 3324082 - RNA, 22 nt, Mycobacterium tuberculosis H37Rv
cacggcggcggcguagcagaag

SEQ ID NO: 3324083 - RNA, 16 nt, Mycobacterium tuberculosis H37Rv
cacggcgggcgagcca

SEQ ID NO: 3324084 - RNA, 18 nt, Mycobacterium tuberculosis H37Rv
cacggcgguugccccgac

SEQ ID NO: 3324085 - RNA, 11 nt, Mycobacterium tuberculosis H37Rv
cacggcgucgg

SEQ ID NO: 3324086 - RNA, 14 nt, Mycobacterium tuberculosis H37Rv
cacggcgucggcca

SEQ ID NO: 3324087 - RNA, 15 nt, Mycobacterium tuberculosis H37Rv
cacggcgucggccac

SEQ ID NO: 3324088 - RNA, 17 nt, Mycobacterium tuberculosis H37Rv
cacggcgucggccaccg

SEQ ID NO: 3324089 - RNA, 18 nt, Mycobacterium tuberculosis H37Rv
cacggcgucggccaccgc

SEQ ID NO: 3324090 - RNA, 15 nt, Mycobacterium tuberculosis H37Rv
cacggcgugaccacu

SEQ ID NO: 3324091 - RNA, 19 nt, Mycobacterium tuberculosis H37Rv
cacggcuaccccgcagaau

SEQ ID NO: 3324092 - RNA, 14 nt, Mycobacterium tuberculosis H37Rv
cacggcuagcgccg

SEQ ID NO: 3324093 - RNA, 19 nt, Mycobacterium tuberculosis H37Rv
cacggcuucgccgcgggac

SEQ ID NO: 3324094 - RNA, 13 nt, Mycobacterium tuberculosis H37Rv
cacggcuucggcg

SEQ ID NO: 3324095 - RNA, 21 nt, Mycobacterium tuberculosis H37Rv
cacggcuuugcggcgcgacca

SEQ ID NO: 3324096 - RNA, 17 nt, Mycobacterium tuberculosis H37Rv
cacggcuuuucgacgcu

SEQ ID NO: 3324097 - RNA, 18 nt, Mycobacterium tuberculosis H37Rv
cacgggaaucgcucgcgc

SEQ ID NO: 3324098 - RNA, 15 nt, Mycobacterium tuberculosis H37Rv
cacgggacgacggca

SEQ ID NO: 3324099 - RNA, 20 nt, Mycobacterium tuberculosis H37Rv
cacgggaguacgggagccgg

SEQ ID NO: 3324100 - RNA, 15 nt, Mycobacterium tuberculosis H37Rv
cacgggcacgaucgu

SEQ ID NO: 3324101 - RNA, 16 nt, Mycobacterium tuberculosis H37Rv
cacgggccguccagga

SEQ ID NO: 3324102 - RNA, 15 nt, Mycobacterium tuberculosis H37Rv
cacgggcgaccugcg

SEQ ID NO: 3324103 - RNA, 23 nt, Mycobacterium tuberculosis H37Rv
cacgggcgucgucgguaaugccg

SEQ ID NO: 3324104 - RNA, 20 nt, Mycobacterium tuberculosis H37Rv
cacgggcucgcugcaccagc

SEQ ID NO: 3324105 - RNA, 13 nt, Mycobacterium tuberculosis H37Rv
cacggggcugccg

SEQ ID NO: 3324106 - RNA, 21 nt, Mycobacterium tuberculosis H37Rv
cacggggcuuggcgacgucgc

SEQ ID NO: 3324107 - RNA, 17 nt, Mycobacterium tuberculosis H37Rv
cacgggguccgaugcgu

SEQ ID NO: 3324108 - RNA, 18 nt, Mycobacterium tuberculosis H37Rv
cacggucaagccggcgcc

SEQ ID NO: 3324109 - RNA, 23 nt, Mycobacterium tuberculosis H37Rv
cacggucaagccggcgcccgccg

SEQ ID NO: 3324110 - RNA, 15 nt, Mycobacterium tuberculosis H37Rv
cacggucacacgcca

SEQ ID NO: 3324111 - RNA, 19 nt, Mycobacterium tuberculosis H37Rv
cacggucacacgccagccg

SEQ ID NO: 3324112 - RNA, 21 nt, Mycobacterium tuberculosis H37Rv
cacggucagcucgcugacggc

SEQ ID NO: 3324113 - RNA, 13 nt, Mycobacterium tuberculosis H37Rv
cacggucaugccg

SEQ ID NO: 3324114 - RNA, 16 nt, Mycobacterium tuberculosis H37Rv
cacggucaugccgccg

SEQ ID NO: 3324115 - RNA, 17 nt, Mycobacterium tuberculosis H37Rv
cacggucaugccgccgc

SEQ ID NO: 3324116 - RNA, 22 nt, Mycobacterium tuberculosis H37Rv
cacggucauugggugucaaugu

SEQ ID NO: 3324117 - RNA, 23 nt, Mycobacterium tuberculosis H37Rv
cacgguccggcccaccagcgcag

SEQ ID NO: 3324118 - RNA, 14 nt, Mycobacterium tuberculosis H37Rv
cacgguccggcggg

SEQ ID NO: 3324119 - RNA, 12 nt, Mycobacterium tuberculosis H37Rv
cacggucgacga

SEQ ID NO: 3324120 - RNA, 20 nt, Mycobacterium tuberculosis H37Rv
cacggucgcccgaucggcgg

SEQ ID NO: 3324121 - RNA, 22 nt, Mycobacterium tuberculosis H37Rv
cacggucgccgaccacucgagc

SEQ ID NO: 3324122 - RNA, 15 nt, Mycobacterium tuberculosis H37Rv
cacggugaucagcag

SEQ ID NO: 3324123 - RNA, 19 nt, Mycobacterium tuberculosis H37Rv
cacggugaucuucuucagg

SEQ ID NO: 3324124 - RNA, 12 nt, Mycobacterium tuberculosis H37Rv
cacggugcccag

SEQ ID NO: 3324125 - RNA, 14 nt, Mycobacterium tuberculosis H37Rv
cacggugcccaggg

SEQ ID NO: 3324126 - RNA, 16 nt, Mycobacterium tuberculosis H37Rv
cacggugccgccgucg

SEQ ID NO: 3324127 - RNA, 14 nt, Mycobacterium tuberculosis H37Rv
cacggugccggcac

SEQ ID NO: 3324128 - RNA, 17 nt, Mycobacterium tuberculosis H37Rv
cacgguggccgcaucga

SEQ ID NO: 3324129 - RNA, 17 nt, Mycobacterium tuberculosis H37Rv
cacgguggcucuguagc

SEQ ID NO: 3324130 - RNA, 22 nt, Mycobacterium tuberculosis H37Rv
cacgguggcucuguagcgucgc

SEQ ID NO: 3324131 - RNA, 13 nt, Mycobacterium tuberculosis H37Rv
cacgguggcuucg

SEQ ID NO: 3324132 - RNA, 17 nt, Mycobacterium tuberculosis H37Rv
cacgguggugucagcca

SEQ ID NO: 3324133 - RNA, 18 nt, Mycobacterium tuberculosis H37Rv
cacgguggugucagccac

SEQ ID NO: 3324134 - RNA, 23 nt, Mycobacterium tuberculosis H37Rv
cacgguguaccagguggaccggc

SEQ ID NO: 3324135 - RNA, 17 nt, Mycobacterium tuberculosis H37Rv
cacgguguauuggggug

SEQ ID NO: 3324136 - RNA, 13 nt, Mycobacterium tuberculosis H37Rv
cacggugucccgc

SEQ ID NO: 3324137 - RNA, 19 nt, Mycobacterium tuberculosis H37Rv
cacgguguugcgcacccgc

SEQ ID NO: 3324138 - RNA, 21 nt, Mycobacterium tuberculosis H37Rv
cacgguucgggcagcacccgc

SEQ ID NO: 3324139 - RNA, 22 nt, Mycobacterium tuberculosis H37Rv
cacgguucgggcagcacccgcg

SEQ ID NO: 3324140 - RNA, 19 nt, Mycobacterium tuberculosis H37Rv
cacgguugccgcgaucggg

SEQ ID NO: 3324141 - RNA, 14 nt, Mycobacterium tuberculosis H37Rv
cacgguugccggcg

SEQ ID NO: 3324142 - RNA, 17 nt, Mycobacterium tuberculosis H37Rv
cacgguugccggcggcg

SEQ ID NO: 3324143 - RNA, 22 nt, Mycobacterium tuberculosis H37Rv
cacgguugccgucagggucagc

SEQ ID NO: 3324144 - RNA, 13 nt, Mycobacterium tuberculosis H37Rv
cacgguuggccac

SEQ ID NO: 3324145 - RNA, 21 nt, Mycobacterium tuberculosis H37Rv
cacuccagcagcucgccggca

SEQ ID NO: 3324146 - RNA, 14 nt, Mycobacterium tuberculosis H37Rv
cacuccagcggcgg

SEQ ID NO: 3324147 - RNA, 16 nt, Mycobacterium tuberculosis H37Rv
cacucccccacacacc

SEQ ID NO: 3324148 - RNA, 14 nt, Mycobacterium tuberculosis H37Rv
cacucccgccccgc

SEQ ID NO: 3324149 - RNA, 15 nt, Mycobacterium tuberculosis H37Rv
cacucccgccccgcu

SEQ ID NO: 3324150 - RNA, 12 nt, Mycobacterium tuberculosis H37Rv
cacuccgccaac

SEQ ID NO: 3324151 - RNA, 12 nt, Mycobacterium tuberculosis H37Rv
cacuccgccgau

SEQ ID NO: 3324152 - RNA, 19 nt, Mycobacterium tuberculosis H37Rv
cacuccgguggccaacacc

SEQ ID NO: 3324153 - RNA, 13 nt, Mycobacterium tuberculosis H37Rv
cacuccucggugu

SEQ ID NO: 3324154 - RNA, 17 nt, Mycobacterium tuberculosis H37Rv
cacuccugagaugcggc

SEQ ID NO: 3324155 - RNA, 13 nt, Mycobacterium tuberculosis H37Rv
cacuccugcacac

SEQ ID NO: 3324156 - RNA, 21 nt, Mycobacterium tuberculosis H37Rv
cacuccugcaccaucgguauc

SEQ ID NO: 3324157 - RNA, 19 nt, Mycobacterium tuberculosis H37Rv
cacucgaccaggaccggcu

SEQ ID NO: 3324158 - RNA, 22 nt, Mycobacterium tuberculosis H37Rv
cacucgaccaggaccggcugca

SEQ ID NO: 3324159 - RNA, 13 nt, Mycobacterium tuberculosis H37Rv
cacucgacgucgu

SEQ ID NO: 3324160 - RNA, 20 nt, Mycobacterium tuberculosis H37Rv
cacucgaugcggugcggcac

SEQ ID NO: 3324161 - RNA, 23 nt, Mycobacterium tuberculosis H37Rv
cacucgaugcuuucguauucggc

SEQ ID NO: 3324162 - RNA, 23 nt, Mycobacterium tuberculosis H37Rv
cacucgccagggccaucuggcug

SEQ ID NO: 3324163 - RNA, 20 nt, Mycobacterium tuberculosis H37Rv
cacucgcccgauccggaucc

SEQ ID NO: 3324164 - RNA, 21 nt, Mycobacterium tuberculosis H37Rv
cacucgccgaaucgcugaccg

SEQ ID NO: 3324165 - RNA, 19 nt, Mycobacterium tuberculosis H37Rv
cacucgccggcggacgccc

SEQ ID NO: 3324166 - RNA, 19 nt, Mycobacterium tuberculosis H37Rv
cacucgcggauccgggcgu

SEQ ID NO: 3324167 - RNA, 18 nt, Mycobacterium tuberculosis H37Rv
cacucgcggguugccucg

SEQ ID NO: 3324168 - RNA, 19 nt, Mycobacterium tuberculosis H37Rv
cacucgcggguugccucgg

SEQ ID NO: 3324169 - RNA, 15 nt, Mycobacterium tuberculosis H37Rv
cacucggcccggccc

SEQ ID NO: 3324170 - RNA, 15 nt, Mycobacterium tuberculosis H37Rv
cacucgggacuuccc

SEQ ID NO: 3324171 - RNA, 18 nt, Mycobacterium tuberculosis H37Rv
cacucgggauucggcagc

SEQ ID NO: 3324172 - RNA, 20 nt, Mycobacterium tuberculosis H37Rv
cacucggucucgauccagcg

SEQ ID NO: 3324173 - RNA, 15 nt, Mycobacterium tuberculosis H37Rv
cacucguugaccggc

SEQ ID NO: 3324174 - RNA, 16 nt, Mycobacterium tuberculosis H37Rv
cacucguugaccggcc

SEQ ID NO: 3324175 - RNA, 17 nt, Mycobacterium tuberculosis H37Rv
cacucguugaccggccg

SEQ ID NO: 3324176 - RNA, 18 nt, Mycobacterium tuberculosis H37Rv
cacucguugaccggccgg

SEQ ID NO: 3324177 - RNA, 15 nt, Mycobacterium tuberculosis H37Rv
cacucguugccgacc

SEQ ID NO: 3324178 - RNA, 21 nt, Mycobacterium tuberculosis H37Rv
cacucuggucacugguccaac

SEQ ID NO: 3324179 - RNA, 22 nt, Mycobacterium tuberculosis H37Rv
cacugaaccguucgacccagcg

SEQ ID NO: 3324180 - RNA, 16 nt, Mycobacterium tuberculosis H37Rv
cacugaagaucgcgcc

SEQ ID NO: 3324181 - RNA, 20 nt, Mycobacterium tuberculosis H37Rv
cacugaaucguuggcgaucg

SEQ ID NO: 3324182 - RNA, 21 nt, Mycobacterium tuberculosis H37Rv
cacugaaucguuggcgaucgc

SEQ ID NO: 3324183 - RNA, 19 nt, Mycobacterium tuberculosis H37Rv
cacugaccaggucugcggu

SEQ ID NO: 3324184 - RNA, 21 nt, Mycobacterium tuberculosis H37Rv
cacugacgcgcccgacgaaca

SEQ ID NO: 3324185 - RNA, 14 nt, Mycobacterium tuberculosis H37Rv
cacugagccacagg

SEQ ID NO: 3324186 - RNA, 20 nt, Mycobacterium tuberculosis H37Rv
cacugaggagaugagcacca

SEQ ID NO: 3324187 - RNA, 15 nt, Mycobacterium tuberculosis H37Rv
cacugaucaggccga

SEQ ID NO: 3324188 - RNA, 18 nt, Mycobacterium tuberculosis H37Rv
cacugaugucacccgccc

SEQ ID NO: 3324189 - RNA, 15 nt, Mycobacterium tuberculosis H37Rv
cacugcaucacgccg

SEQ ID NO: 3324190 - RNA, 12 nt, Mycobacterium tuberculosis H37Rv
cacugccaccgc

SEQ ID NO: 3324191 - RNA, 19 nt, Mycobacterium tuberculosis H37Rv
cacugccaguagucgccgg

SEQ ID NO: 3324192 - RNA, 15 nt, Mycobacterium tuberculosis H37Rv
cacugcccggggucc

SEQ ID NO: 3324193 - RNA, 21 nt, Mycobacterium tuberculosis H37Rv
cacugcccucaacgaucgcgc

SEQ ID NO: 3324194 - RNA, 18 nt, Mycobacterium tuberculosis H37Rv
cacugccgcgcgcccgcc

SEQ ID NO: 3324195 - RNA, 22 nt, Mycobacterium tuberculosis H37Rv
cacugccgcgcucgcgcaccgu

SEQ ID NO: 3324196 - RNA, 17 nt, Mycobacterium tuberculosis H37Rv
cacugccggccaacuuc

SEQ ID NO: 3324197 - RNA, 17 nt, Mycobacterium tuberculosis H37Rv
cacugccguugccgccg

SEQ ID NO: 3324198 - RNA, 20 nt, Mycobacterium tuberculosis H37Rv
cacugccguugccgccggug

SEQ ID NO: 3324199 - RNA, 12 nt, Mycobacterium tuberculosis H37Rv
cacugcgagcgc

SEQ ID NO: 3324200 - RNA, 16 nt, Mycobacterium tuberculosis H37Rv
cacugcgagcgccggc

SEQ ID NO: 3324201 - RNA, 22 nt, Mycobacterium tuberculosis H37Rv
cacugcgaucgcgacccgaucg

SEQ ID NO: 3324202 - RNA, 15 nt, Mycobacterium tuberculosis H37Rv
cacugcgccgugacc

SEQ ID NO: 3324203 - RNA, 12 nt, Mycobacterium tuberculosis H37Rv
cacugcggccag

SEQ ID NO: 3324204 - RNA, 15 nt, Mycobacterium tuberculosis H37Rv
cacugcggccgcgcc

SEQ ID NO: 3324205 - RNA, 18 nt, Mycobacterium tuberculosis H37Rv
cacugcggccugcucgac

SEQ ID NO: 3324206 - RNA, 20 nt, Mycobacterium tuberculosis H37Rv
cacugcggccugcucgacca

SEQ ID NO: 3324207 - RNA, 21 nt, Mycobacterium tuberculosis H37Rv
cacugcuagucgugccgcguc

SEQ ID NO: 3324208 - RNA, 11 nt, Mycobacterium tuberculosis H37Rv
cacugcugcgg

SEQ ID NO: 3324209 - RNA, 17 nt, Mycobacterium tuberculosis H37Rv
cacuggaauggaucucg

SEQ ID NO: 3324210 - RNA, 18 nt, Mycobacterium tuberculosis H37Rv
cacuggaccacucggcgg

SEQ ID NO: 3324211 - RNA, 18 nt, Mycobacterium tuberculosis H37Rv
cacuggacgcuccgggaa

SEQ ID NO: 3324212 - RNA, 19 nt, Mycobacterium tuberculosis H37Rv
cacuggauccgggagucga

SEQ ID NO: 3324213 - RNA, 22 nt, Mycobacterium tuberculosis H37Rv
cacuggcgaaccagaguucggc

SEQ ID NO: 3324214 - RNA, 13 nt, Mycobacterium tuberculosis H37Rv
cacuggcgccggu

SEQ ID NO: 3324215 - RNA, 22 nt, Mycobacterium tuberculosis H37Rv
cacugggccggucgaggcccuc

SEQ ID NO: 3324216 - RNA, 22 nt, Mycobacterium tuberculosis H37Rv
cacuggggccccgggaagugaa

SEQ ID NO: 3324217 - RNA, 23 nt, Mycobacterium tuberculosis H37Rv
cacuggggugcugcgcgcggcgg

SEQ ID NO: 3324218 - RNA, 16 nt, Mycobacterium tuberculosis H37Rv
cacuggguccacgcgc

SEQ ID NO: 3324219 - RNA, 22 nt, Mycobacterium tuberculosis H37Rv
cacugggugcgucgacccagcu

SEQ ID NO: 3324220 - RNA, 13 nt, Mycobacterium tuberculosis H37Rv
cacuggugcagcg

SEQ ID NO: 3324221 - RNA, 20 nt, Mycobacterium tuberculosis H37Rv
cacuggugcagcgccgacag

SEQ ID NO: 3324222 - RNA, 23 nt, Mycobacterium tuberculosis H37Rv
cacuggugcagcgccgacagccg

SEQ ID NO: 3324223 - RNA, 21 nt, Mycobacterium tuberculosis H37Rv
cacugguugggcgagaccgcg

SEQ ID NO: 3324224 - RNA, 18 nt, Mycobacterium tuberculosis H37Rv
cacuguaccgggcgacac

SEQ ID NO: 3324225 - RNA, 18 nt, Mycobacterium tuberculosis H37Rv
cacugucggguaacccca

SEQ ID NO: 3324226 - RNA, 14 nt, Mycobacterium tuberculosis H37Rv
cacugugaggucau

SEQ ID NO: 3324227 - RNA, 18 nt, Mycobacterium tuberculosis H37Rv
cacugugccgcugcaucc

SEQ ID NO: 3324228 - RNA, 16 nt, Mycobacterium tuberculosis H37Rv
cacuguuacggccaca

SEQ ID NO: 3324229 - RNA, 18 nt, Mycobacterium tuberculosis H37Rv
cacuguuacggccacacc

SEQ ID NO: 3324230 - RNA, 15 nt, Mycobacterium tuberculosis H37Rv
cacuguugaagaagc

SEQ ID NO: 3324231 - RNA, 19 nt, Mycobacterium tuberculosis H37Rv
cacuguugaagaagcccga

SEQ ID NO: 3324232 - RNA, 16 nt, Mycobacterium tuberculosis H37Rv
cacuguuggugccgcc

SEQ ID NO: 3324233 - RNA, 17 nt, Mycobacterium tuberculosis H37Rv
cacuuaccgagccguca

SEQ ID NO: 3324234 - RNA, 19 nt, Mycobacterium tuberculosis H37Rv
cacuucacgaguagcgguu

SEQ ID NO: 3324235 - RNA, 16 nt, Mycobacterium tuberculosis H37Rv
cacuucccccgggucc

SEQ ID NO: 3324236 - RNA, 18 nt, Mycobacterium tuberculosis H37Rv
cacuuccggauucggacu

SEQ ID NO: 3324237 - RNA, 12 nt, Mycobacterium tuberculosis H37Rv
cacuucggcgcc

SEQ ID NO: 3324238 - RNA, 15 nt, Mycobacterium tuberculosis H37Rv
cacuucggcgccgcg

SEQ ID NO: 3324239 - RNA, 17 nt, Mycobacterium tuberculosis H37Rv
cacuucggcgccgcgcc

SEQ ID NO: 3324240 - RNA, 14 nt, Mycobacterium tuberculosis H37Rv
cacuucggcgucca

SEQ ID NO: 3324241 - RNA, 23 nt, Mycobacterium tuberculosis H37Rv
cagacgccacugccagccgugca

SEQ ID NO: 3324242 - RNA, 16 nt, Mycobacterium tuberculosis H37Rv
cagacgccccuucccu

SEQ ID NO: 3324243 - RNA, 15 nt, Mycobacterium tuberculosis H37Rv
cagacgcggaaucgc

SEQ ID NO: 3324244 - RNA, 20 nt, Mycobacterium tuberculosis H37Rv
cagacgcucuugaauaggaa

SEQ ID NO: 3324245 - RNA, 14 nt, Mycobacterium tuberculosis H37Rv
cagacgcugcccaa

SEQ ID NO: 3324246 - RNA, 15 nt, Mycobacterium tuberculosis H37Rv
cagacggcugccacg

SEQ ID NO: 3324247 - RNA, 14 nt, Mycobacterium tuberculosis H37Rv
cagacggggaucgg

SEQ ID NO: 3324248 - RNA, 20 nt, Mycobacterium tuberculosis H37Rv
cagacggggucgcccggggc

SEQ ID NO: 3324249 - RNA, 22 nt, Mycobacterium tuberculosis H37Rv
cagacggugaagccgagcgccc

SEQ ID NO: 3324250 - RNA, 23 nt, Mycobacterium tuberculosis H37Rv
cagacggugaagccgagcgcccg

SEQ ID NO: 3324251 - RNA, 14 nt, Mycobacterium tuberculosis H37Rv
cagacggugcagcu

SEQ ID NO: 3324252 - RNA, 13 nt, Mycobacterium tuberculosis H37Rv
cagacgucaugcg

SEQ ID NO: 3324253 - RNA, 14 nt, Mycobacterium tuberculosis H37Rv
cagacugucgagcg

SEQ ID NO: 3324254 - RNA, 18 nt, Mycobacterium tuberculosis H37Rv
cagagaacuccgccacca

SEQ ID NO: 3324255 - RNA, 20 nt, Mycobacterium tuberculosis H37Rv
cagagaacuccgccaccauc

SEQ ID NO: 3324256 - RNA, 19 nt, Mycobacterium tuberculosis H37Rv
cagagcaccgcgaacagca

SEQ ID NO: 3324257 - RNA, 23 nt, Mycobacterium tuberculosis H37Rv
cagagcacgggcucgcugcacca

SEQ ID NO: 3324258 - RNA, 16 nt, Mycobacterium tuberculosis H37Rv
cagagccgcccuugcc

SEQ ID NO: 3324259 - RNA, 20 nt, Mycobacterium tuberculosis H37Rv
cagagccgcccuugccuccg

SEQ ID NO: 3324260 - RNA, 15 nt, Mycobacterium tuberculosis H37Rv
cagagccgcgcgccg

SEQ ID NO: 3324261 - RNA, 18 nt, Mycobacterium tuberculosis H37Rv
cagagccgcgcgccgguu

SEQ ID NO: 3324262 - RNA, 17 nt, Mycobacterium tuberculosis H37Rv
cagagccgcugcggcac

SEQ ID NO: 3324263 - RNA, 17 nt, Mycobacterium tuberculosis H37Rv
cagagccgggcuggccg

SEQ ID NO: 3324264 - RNA, 22 nt, Mycobacterium tuberculosis H37Rv
cagagcgaacccccgccgcgca

SEQ ID NO: 3324265 - RNA, 20 nt, Mycobacterium tuberculosis H37Rv
cagagcgucgaacacgucgg

SEQ ID NO: 3324266 - RNA, 20 nt, Mycobacterium tuberculosis H37Rv
cagagcguuccgcucgaauc

SEQ ID NO: 3324267 - RNA, 21 nt, Mycobacterium tuberculosis H37Rv
cagagcguuccgcucgaaucg

SEQ ID NO: 3324268 - RNA, 17 nt, Mycobacterium tuberculosis H37Rv
cagagcuucgccgcgca

SEQ ID NO: 3324269 - RNA, 17 nt, Mycobacterium tuberculosis H37Rv
cagaggucacgcagcac

SEQ ID NO: 3324270 - RNA, 19 nt, Mycobacterium tuberculosis H37Rv
cagaggucacgcagcaccc

SEQ ID NO: 3324271 - RNA, 17 nt, Mycobacterium tuberculosis H37Rv
cagaggucgagcgccuu

SEQ ID NO: 3324272 - RNA, 17 nt, Mycobacterium tuberculosis H37Rv
cagaggucgccggcaca

SEQ ID NO: 3324273 - RNA, 15 nt, Mycobacterium tuberculosis H37Rv
cagaggucggucagc

SEQ ID NO: 3324274 - RNA, 23 nt, Mycobacterium tuberculosis H37Rv
cagaguagacaacagucgacaau

SEQ ID NO: 3324275 - RNA, 12 nt, Mycobacterium tuberculosis H37Rv
cagagucaacag

SEQ ID NO: 3324276 - RNA, 16 nt, Mycobacterium tuberculosis H37Rv
cagagucgcacugcgc

SEQ ID NO: 3324277 - RNA, 18 nt, Mycobacterium tuberculosis H37Rv
cagaguucccgaaacccg

SEQ ID NO: 3324278 - RNA, 17 nt, Mycobacterium tuberculosis H37Rv
cagaguugccgggucga

SEQ ID NO: 3324279 - RNA, 19 nt, Mycobacterium tuberculosis H37Rv
cagaguuugcgaugcccac

SEQ ID NO: 3324280 - RNA, 20 nt, Mycobacterium tuberculosis H37Rv
cagaguuugcgaugcccacg

SEQ ID NO: 3324281 - RNA, 16 nt, Mycobacterium tuberculosis H37Rv
cagauaaggaucagaa

SEQ ID NO: 3324282 - RNA, 18 nt, Mycobacterium tuberculosis H37Rv
cagauacaggaacaacgc

SEQ ID NO: 3324283 - RNA, 23 nt, Mycobacterium tuberculosis H37Rv
cagauacaucgggaucugggcuc

SEQ ID NO: 3324284 - RNA, 12 nt, Mycobacterium tuberculosis H37Rv
cagauagacuag

SEQ ID NO: 3324285 - RNA, 23 nt, Mycobacterium tuberculosis H37Rv
cagauagcgcucgaacucggcgg

SEQ ID NO: 3324286 - RNA, 19 nt, Mycobacterium tuberculosis H37Rv
cagauagucgccgccgucg

SEQ ID NO: 3324287 - RNA, 17 nt, Mycobacterium tuberculosis H37Rv
cagauauuugucggcgc

SEQ ID NO: 3324288 - RNA, 20 nt, Mycobacterium tuberculosis H37Rv
cagaucaacgcgaaccgucu

SEQ ID NO: 3324289 - RNA, 14 nt, Mycobacterium tuberculosis H37Rv
cagaucaacgcguc

SEQ ID NO: 3324290 - RNA, 16 nt, Mycobacterium tuberculosis H37Rv
cagaucaacgcgucgc

SEQ ID NO: 3324291 - RNA, 22 nt, Mycobacterium tuberculosis H37Rv
cagaucacgcacucgcgucccg

SEQ ID NO: 3324292 - RNA, 18 nt, Mycobacterium tuberculosis H37Rv
cagaucacgggugugccu

SEQ ID NO: 3324293 - RNA, 15 nt, Mycobacterium tuberculosis H37Rv
cagaucaggacgcga

SEQ ID NO: 3324294 - RNA, 17 nt, Mycobacterium tuberculosis H37Rv
cagaucaggacgcgauc

SEQ ID NO: 3324295 - RNA, 19 nt, Mycobacterium tuberculosis H37Rv
cagaucaggguggcgcggu

SEQ ID NO: 3324296 - RNA, 17 nt, Mycobacterium tuberculosis H37Rv
cagauccacgccgacca

SEQ ID NO: 3324297 - RNA, 14 nt, Mycobacterium tuberculosis H37Rv
cagauccccgccac

SEQ ID NO: 3324298 - RNA, 19 nt, Mycobacterium tuberculosis H37Rv
cagauccgacgaccgcauu

SEQ ID NO: 3324299 - RNA, 18 nt, Mycobacterium tuberculosis H37Rv
cagauccgggcaugcgcc

SEQ ID NO: 3324300 - RNA, 16 nt, Mycobacterium tuberculosis H37Rv
cagaucgaaaucagcc

SEQ ID NO: 3324301 - RNA, 20 nt, Mycobacterium tuberculosis H37Rv
cagaucgaagcgcagcaccu

SEQ ID NO: 3324302 - RNA, 14 nt, Mycobacterium tuberculosis H37Rv
cagaucgaggggga

SEQ ID NO: 3324303 - RNA, 17 nt, Mycobacterium tuberculosis H37Rv
cagaucgagggggacgc

SEQ ID NO: 3324304 - RNA, 17 nt, Mycobacterium tuberculosis H37Rv
cagaucgcacaccaaca

SEQ ID NO: 3324305 - RNA, 18 nt, Mycobacterium tuberculosis H37Rv
cagaucgcgguccgagcg

SEQ ID NO: 3324306 - RNA, 17 nt, Mycobacterium tuberculosis H37Rv
cagaucggcgacgccgu

SEQ ID NO: 3324307 - RNA, 19 nt, Mycobacterium tuberculosis H37Rv
cagaucguagugcgcgcca

SEQ ID NO: 3324308 - RNA, 15 nt, Mycobacterium tuberculosis H37Rv
cagaucguccaccgc

SEQ ID NO: 3324309 - RNA, 20 nt, Mycobacterium tuberculosis H37Rv
cagaucuccaagcucgacaa

SEQ ID NO: 3324310 - RNA, 21 nt, Mycobacterium tuberculosis H37Rv
cagaucuccagguuccagguc

SEQ ID NO: 3324311 - RNA, 17 nt, Mycobacterium tuberculosis H37Rv
cagaucuccccgaccgc

SEQ ID NO: 3324312 - RNA, 21 nt, Mycobacterium tuberculosis H37Rv
cagaucuggguucccgaugug

SEQ ID NO: 3324313 - RNA, 13 nt, Mycobacterium tuberculosis H37Rv
cagaucuugcagu

SEQ ID NO: 3324314 - RNA, 13 nt, Mycobacterium tuberculosis H37Rv
cagaugagucaaa

SEQ ID NO: 3324315 - RNA, 14 nt, Mycobacterium tuberculosis H37Rv
cagaugagucaaaa

SEQ ID NO: 3324316 - RNA, 17 nt, Mycobacterium tuberculosis H37Rv
cagaugagucaaaaucc

SEQ ID NO: 3324317 - RNA, 21 nt, Mycobacterium tuberculosis H37Rv
cagaugaugccguucggaccc

SEQ ID NO: 3324318 - RNA, 15 nt, Mycobacterium tuberculosis H37Rv
cagaugcauccagcu

SEQ ID NO: 3324319 - RNA, 15 nt, Mycobacterium tuberculosis H37Rv
cagaugcccagcagg

SEQ ID NO: 3324320 - RNA, 18 nt, Mycobacterium tuberculosis H37Rv
cagaugccgggcugaggc

SEQ ID NO: 3324321 - RNA, 22 nt, Mycobacterium tuberculosis H37Rv
cagaugccgguaacgaacagcg

SEQ ID NO: 3324322 - RNA, 19 nt, Mycobacterium tuberculosis H37Rv
cagaugcgaaagugguggc

SEQ ID NO: 3324323 - RNA, 18 nt, Mycobacterium tuberculosis H37Rv
cagauggcauugcgccca

SEQ ID NO: 3324324 - RNA, 19 nt, Mycobacterium tuberculosis H37Rv
cagauggcauugcgcccac

SEQ ID NO: 3324325 - RNA, 13 nt, Mycobacterium tuberculosis H37Rv
cagauggccaccc

SEQ ID NO: 3324326 - RNA, 14 nt, Mycobacterium tuberculosis H37Rv
cagauggccacccg

SEQ ID NO: 3324327 - RNA, 15 nt, Mycobacterium tuberculosis H37Rv
cagauggccacccgc

SEQ ID NO: 3324328 - RNA, 20 nt, Mycobacterium tuberculosis H37Rv
cagaugggccuccaccgcgu

SEQ ID NO: 3324329 - RNA, 14 nt, Mycobacterium tuberculosis H37Rv
cagaugggcgucgg

SEQ ID NO: 3324330 - RNA, 20 nt, Mycobacterium tuberculosis H37Rv
cagauggguacccgaucacu

SEQ ID NO: 3324331 - RNA, 22 nt, Mycobacterium tuberculosis H37Rv
cagauggucggucgcuucagcg

SEQ ID NO: 3324332 - RNA, 22 nt, Mycobacterium tuberculosis H37Rv
cagauggucucgaacuccaugc

SEQ ID NO: 3324333 - RNA, 12 nt, Mycobacterium tuberculosis H37Rv
cagauggugaac

SEQ ID NO: 3324334 - RNA, 21 nt, Mycobacterium tuberculosis H37Rv
cagaugguuggaucgccaccg

SEQ ID NO: 3324335 - RNA, 20 nt, Mycobacterium tuberculosis H37Rv
cagauguaccucaucgcaga

SEQ ID NO: 3324336 - RNA, 12 nt, Mycobacterium tuberculosis H37Rv
cagauucgccgc

SEQ ID NO: 3324337 - RNA, 15 nt, Mycobacterium tuberculosis H37Rv
cagcacggcgccgcc

SEQ ID NO: 3324338 - RNA, 14 nt, Mycobacterium tuberculosis H37Rv
cagcacggcggcca

SEQ ID NO: 3324339 - RNA, 16 nt, Mycobacterium tuberculosis H37Rv
cagcacggcggccacg

SEQ ID NO: 3324340 - RNA, 13 nt, Mycobacterium tuberculosis H37Rv
cagcacggcuucg

SEQ ID NO: 3324341 - RNA, 20 nt, Mycobacterium tuberculosis H37Rv
cagcacgggugagcaccacg

SEQ ID NO: 3324342 - RNA, 15 nt, Mycobacterium tuberculosis H37Rv
cagcacggucaacgu

SEQ ID NO: 3324343 - RNA, 17 nt, Mycobacterium tuberculosis H37Rv
cagcacggugaucagca

SEQ ID NO: 3324344 - RNA, 23 nt, Mycobacterium tuberculosis H37Rv
cagcacgguguugcgcacccgcg

SEQ ID NO: 3324345 - RNA, 16 nt, Mycobacterium tuberculosis H37Rv
cagcacguaacccagu

SEQ ID NO: 3324346 - RNA, 18 nt, Mycobacterium tuberculosis H37Rv
cagcacguaacgccgcuc

SEQ ID NO: 3324347 - RNA, 13 nt, Mycobacterium tuberculosis H37Rv
cagcacguacugc

SEQ ID NO: 3324348 - RNA, 15 nt, Mycobacterium tuberculosis H37Rv
cagcacgucacgcaa

SEQ ID NO: 3324349 - RNA, 17 nt, Mycobacterium tuberculosis H37Rv
cagcacguccgcggagc

SEQ ID NO: 3324350 - RNA, 14 nt, Mycobacterium tuberculosis H37Rv
cagcacgugugcgg

SEQ ID NO: 3324351 - RNA, 16 nt, Mycobacterium tuberculosis H37Rv
cagcacuccaccgcug

SEQ ID NO: 3324352 - RNA, 19 nt, Mycobacterium tuberculosis H37Rv
cagcacuccaccgcuggcc

SEQ ID NO: 3324353 - RNA, 14 nt, Mycobacterium tuberculosis H37Rv
cagcacucgguguc

SEQ ID NO: 3324354 - RNA, 20 nt, Mycobacterium tuberculosis H37Rv
cagcacugccaucgcggcgu

SEQ ID NO: 3324355 - RNA, 14 nt, Mycobacterium tuberculosis H37Rv
cagcacugcggcag

SEQ ID NO: 3324356 - RNA, 18 nt, Mycobacterium tuberculosis H37Rv
cagcacuuccaagccgac

SEQ ID NO: 3324357 - RNA, 18 nt, Mycobacterium tuberculosis H37Rv
cagcacuuggacccggcc

SEQ ID NO: 3324358 - RNA, 22 nt, Mycobacterium tuberculosis H37Rv
cagcacuuggacccggccggcc

SEQ ID NO: 3324359 - RNA, 15 nt, Mycobacterium tuberculosis H37Rv
cagcagaaacaucga

SEQ ID NO: 3324360 - RNA, 15 nt, Mycobacterium tuberculosis H37Rv
cagcagaccaagucc

SEQ ID NO: 3324361 - RNA, 13 nt, Mycobacterium tuberculosis H37Rv
cagcagagccaac

SEQ ID NO: 3324362 - RNA, 19 nt, Mycobacterium tuberculosis H37Rv
cagcagagcggcacgcacg

SEQ ID NO: 3324363 - RNA, 20 nt, Mycobacterium tuberculosis H37Rv
cagcagaguggugaucuugg

SEQ ID NO: 3324364 - RNA, 22 nt, Mycobacterium tuberculosis H37Rv
cagcagauccaggcgucgguga

SEQ ID NO: 3324365 - RNA, 18 nt, Mycobacterium tuberculosis H37Rv
cagcagauccuggccggu

SEQ ID NO: 3324366 - RNA, 20 nt, Mycobacterium tuberculosis H37Rv
cagcagaugcgaaaguggug

SEQ ID NO: 3324367 - RNA, 18 nt, Mycobacterium tuberculosis H37Rv
cagcagcaacgacccgaa

SEQ ID NO: 3324368 - RNA, 17 nt, Mycobacterium tuberculosis H37Rv
cagcagcaccugcaccg

SEQ ID NO: 3324369 - RNA, 15 nt, Mycobacterium tuberculosis H37Rv
cagcagcauccggcc

SEQ ID NO: 3324370 - RNA, 21 nt, Mycobacterium tuberculosis H37Rv
cagcagcaugucgacggucag

SEQ ID NO: 3324371 - RNA, 14 nt, Mycobacterium tuberculosis H37Rv
cagcagccaggagc

SEQ ID NO: 3324372 - RNA, 20 nt, Mycobacterium tuberculosis H37Rv
cagcagcccgacaguggucc

SEQ ID NO: 3324373 - RNA, 13 nt, Mycobacterium tuberculosis H37Rv
cagcagcccgccc

SEQ ID NO: 3324374 - RNA, 14 nt, Mycobacterium tuberculosis H37Rv
cagcagcccgggca

SEQ ID NO: 3324375 - RNA, 21 nt, Mycobacterium tuberculosis H37Rv
cagcagcccgggcagccccuc

SEQ ID NO: 3324376 - RNA, 17 nt, Mycobacterium tuberculosis H37Rv
cagcagccgccgaugau

SEQ ID NO: 3324377 - RNA, 17 nt, Mycobacterium tuberculosis H37Rv
cagcagccgcgacgcgg

SEQ ID NO: 3324378 - RNA, 20 nt, Mycobacterium tuberculosis H37Rv
cagcagcgacgcugccgcca

SEQ ID NO: 3324379 - RNA, 17 nt, Mycobacterium tuberculosis H37Rv
cagcagcgacuccagcg

SEQ ID NO: 3324380 - RNA, 20 nt, Mycobacterium tuberculosis H37Rv
cagcagcgacuccagcgccc

SEQ ID NO: 3324381 - RNA, 15 nt, Mycobacterium tuberculosis H37Rv
cagcagcgcacugcc

SEQ ID NO: 3324382 - RNA, 15 nt, Mycobacterium tuberculosis H37Rv
cagcagcgccacccg

SEQ ID NO: 3324383 - RNA, 14 nt, Mycobacterium tuberculosis H37Rv
cagcagcgcgacgg

SEQ ID NO: 3324384 - RNA, 20 nt, Mycobacterium tuberculosis H37Rv
cagcagcgcgaucugcucgc

SEQ ID NO: 3324385 - RNA, 13 nt, Mycobacterium tuberculosis H37Rv
cagcagcggcgac

SEQ ID NO: 3324386 - RNA, 16 nt, Mycobacterium tuberculosis H37Rv
cagcagcggcgagcca

SEQ ID NO: 3324387 - RNA, 21 nt, Mycobacterium tuberculosis H37Rv
cagcagcggcggcgacgagcg

SEQ ID NO: 3324388 - RNA, 14 nt, Mycobacterium tuberculosis H37Rv
cagcagcgguugau

SEQ ID NO: 3324389 - RNA, 18 nt, Mycobacterium tuberculosis H37Rv
cagcagcgguugaugcgg

SEQ ID NO: 3324390 - RNA, 15 nt, Mycobacterium tuberculosis H37Rv
cagcagcgucggugc

SEQ ID NO: 3324391 - RNA, 22 nt, Mycobacterium tuberculosis H37Rv
cagcagcgucggugccaccacg

SEQ ID NO: 3324392 - RNA, 23 nt, Mycobacterium tuberculosis H37Rv
cagcagcgucggugccaccacgc

SEQ ID NO: 3324393 - RNA, 16 nt, Mycobacterium tuberculosis H37Rv
cagcagcgugaccacc

SEQ ID NO: 3324394 - RNA, 20 nt, Mycobacterium tuberculosis H37Rv
cagcagcguugacggcuucg

SEQ ID NO: 3324395 - RNA, 14 nt, Mycobacterium tuberculosis H37Rv
cagcagcuccacug

SEQ ID NO: 3324396 - RNA, 20 nt, Mycobacterium tuberculosis H37Rv
cagcagcuccacuggcgucu

SEQ ID NO: 3324397 - RNA, 20 nt, Mycobacterium tuberculosis H37Rv
cagcagcucgccggcacgca

SEQ ID NO: 3324398 - RNA, 19 nt, Mycobacterium tuberculosis H37Rv
cagcagcucggggcgauga

SEQ ID NO: 3324399 - RNA, 13 nt, Mycobacterium tuberculosis H37Rv
cagcagcugcgau

SEQ ID NO: 3324400 - RNA, 14 nt, Mycobacterium tuberculosis H37Rv
cagcagcugcucca

SEQ ID NO: 3324401 - RNA, 15 nt, Mycobacterium tuberculosis H37Rv
cagcagcuucggacu

SEQ ID NO: 3324402 - RNA, 18 nt, Mycobacterium tuberculosis H37Rv
cagcagcuucggacuggg

SEQ ID NO: 3324403 - RNA, 22 nt, Mycobacterium tuberculosis H37Rv
cagcagcuugacccacauuccg

SEQ ID NO: 3324404 - RNA, 18 nt, Mycobacterium tuberculosis H37Rv
cagcaggaaguagccgag

SEQ ID NO: 3324405 - RNA, 22 nt, Mycobacterium tuberculosis H37Rv
cagcaggacacucuuuugcugg

SEQ ID NO: 3324406 - RNA, 17 nt, Mycobacterium tuberculosis H37Rv
cagcaggaucggcagca

SEQ ID NO: 3324407 - RNA, 19 nt, Mycobacterium tuberculosis H37Rv
cagcaggaucggcagcaga

SEQ ID NO: 3324408 - RNA, 19 nt, Mycobacterium tuberculosis H37Rv
cagcaggaugaugaccgcc

SEQ ID NO: 3324409 - RNA, 17 nt, Mycobacterium tuberculosis H37Rv
cagcaggccacugcguu

SEQ ID NO: 3324410 - RNA, 19 nt, Mycobacterium tuberculosis H37Rv
cagcaggcccacccgggcg

SEQ ID NO: 3324411 - RNA, 16 nt, Mycobacterium tuberculosis H37Rv
cagcaggcccagcgga

SEQ ID NO: 3324412 - RNA, 14 nt, Mycobacterium tuberculosis H37Rv
cagcaggcccuggc

SEQ ID NO: 3324413 - RNA, 18 nt, Mycobacterium tuberculosis H37Rv
cagcaggcccuggccacc

SEQ ID NO: 3324414 - RNA, 19 nt, Mycobacterium tuberculosis H37Rv
cagcaggcccuggccaccc

SEQ ID NO: 3324415 - RNA, 18 nt, Mycobacterium tuberculosis H37Rv
cagcaggcccuucaguuc

SEQ ID NO: 3324416 - RNA, 15 nt, Mycobacterium tuberculosis H37Rv
cagcaggccgggcgc

SEQ ID NO: 3324417 - RNA, 21 nt, Mycobacterium tuberculosis H37Rv
cagcaggccgggcgcaagcag

SEQ ID NO: 3324418 - RNA, 22 nt, Mycobacterium tuberculosis H37Rv
cagcaggccgggcgcaagcagc

SEQ ID NO: 3324419 - RNA, 14 nt, Mycobacterium tuberculosis H37Rv
cagcaggccuccaa

SEQ ID NO: 3324420 - RNA, 12 nt, Mycobacterium tuberculosis H37Rv
cagcaggcggcu

SEQ ID NO: 3324421 - RNA, 22 nt, Mycobacterium tuberculosis H37Rv
cagcaggcggcugaacggcagc

SEQ ID NO: 3324422 - RNA, 15 nt, Mycobacterium tuberculosis H37Rv
cagcaggcucgaacc

SEQ ID NO: 3324423 - RNA, 19 nt, Mycobacterium tuberculosis H37Rv
cagcagggccaccaccacg

SEQ ID NO: 3324424 - RNA, 18 nt, Mycobacterium tuberculosis H37Rv
cagcagggccagaccgaa

SEQ ID NO: 3324425 - RNA, 20 nt, Mycobacterium tuberculosis H37Rv
cagcagggcgcgcaucugcu

SEQ ID NO: 3324426 - RNA, 23 nt, Mycobacterium tuberculosis H37Rv
cagcagggcgcgcaucugcucgg

SEQ ID NO: 3324427 - RNA, 20 nt, Mycobacterium tuberculosis H37Rv
cagcagggcuucgugcacca

SEQ ID NO: 3324428 - RNA, 22 nt, Mycobacterium tuberculosis H37Rv
cagcagggcuucgugcaccaca

SEQ ID NO: 3324429 - RNA, 23 nt, Mycobacterium tuberculosis H37Rv
cagcaggggacgggcggccagga

SEQ ID NO: 3324430 - RNA, 18 nt, Mycobacterium tuberculosis H37Rv
cagcagguauuugccgug

SEQ ID NO: 3324431 - RNA, 23 nt, Mycobacterium tuberculosis H37Rv
cagcagguccgcggccgcgguga

SEQ ID NO: 3324432 - RNA, 22 nt, Mycobacterium tuberculosis H37Rv
cagcaggucgucggcgucgcgg

SEQ ID NO: 3324433 - RNA, 16 nt, Mycobacterium tuberculosis H37Rv
cagcaggugagccagu

SEQ ID NO: 3324434 - RNA, 20 nt, Mycobacterium tuberculosis H37Rv
cagcaggugagccaguuggc

SEQ ID NO: 3324435 - RNA, 18 nt, Mycobacterium tuberculosis H37Rv
cagcagguuccacggcca

SEQ ID NO: 3324436 - RNA, 16 nt, Mycobacterium tuberculosis H37Rv
cagcagguuggcgagc

SEQ ID NO: 3324437 - RNA, 17 nt, Mycobacterium tuberculosis H37Rv
cagcagguuggcgagcu

SEQ ID NO: 3324438 - RNA, 15 nt, Mycobacterium tuberculosis H37Rv
cagcagguuguaguc

SEQ ID NO: 3324439 - RNA, 12 nt, Mycobacterium tuberculosis H37Rv
cagcaguacuaa

SEQ ID NO: 3324440 - RNA, 15 nt, Mycobacterium tuberculosis H37Rv
cagcagugccgugcu

SEQ ID NO: 3324441 - RNA, 19 nt, Mycobacterium tuberculosis H37Rv
cagcagugccgugcugaac

SEQ ID NO: 3324442 - RNA, 15 nt, Mycobacterium tuberculosis H37Rv
cagcaguucggcgau

SEQ ID NO: 3324443 - RNA, 23 nt, Mycobacterium tuberculosis H37Rv
cagcaguucggcgaugcgcgggu

SEQ ID NO: 3324444 - RNA, 20 nt, Mycobacterium tuberculosis H37Rv
cagcaucacguccgcggugu

SEQ ID NO: 3324445 - RNA, 17 nt, Mycobacterium tuberculosis H37Rv
cagcaucagcgccagcg

SEQ ID NO: 3324446 - RNA, 13 nt, Mycobacterium tuberculosis H37Rv
cagcauccggccg

SEQ ID NO: 3324447 - RNA, 23 nt, Mycobacterium tuberculosis H37Rv
cagcauccggccgucaucuggaa

SEQ ID NO: 3324448 - RNA, 14 nt, Mycobacterium tuberculosis H37Rv
cagcauccuucgcg

SEQ ID NO: 3324449 - RNA, 15 nt, Mycobacterium tuberculosis H37Rv
cagcaucggcacccc

SEQ ID NO: 3324450 - RNA, 17 nt, Mycobacterium tuberculosis H37Rv
cagcaucggcaccccgg

SEQ ID NO: 3324451 - RNA, 18 nt, Mycobacterium tuberculosis H37Rv
cagcaucggcaccccggc

SEQ ID NO: 3324452 - RNA, 16 nt, Mycobacterium tuberculosis H37Rv
cagcaucggcagcagc

SEQ ID NO: 3324453 - RNA, 18 nt, Mycobacterium tuberculosis H37Rv
cagcaucguggccgcacc

SEQ ID NO: 3324454 - RNA, 15 nt, Mycobacterium tuberculosis H37Rv
cagcaucuccgucgg

SEQ ID NO: 3324455 - RNA, 20 nt, Mycobacterium tuberculosis H37Rv
cagcaucuccgucggccagg

SEQ ID NO: 3324456 - RNA, 13 nt, Mycobacterium tuberculosis H37Rv
cagcaugacaccg

SEQ ID NO: 3324457 - RNA, 15 nt, Mycobacterium tuberculosis H37Rv
cagcaugacaccggc

SEQ ID NO: 3324458 - RNA, 23 nt, Mycobacterium tuberculosis H37Rv
cagcaugacaccggccaccagcc

SEQ ID NO: 3324459 - RNA, 16 nt, Mycobacterium tuberculosis H37Rv
cagcaugcccgccauc

SEQ ID NO: 3324460 - RNA, 16 nt, Mycobacterium tuberculosis H37Rv
cagcaugccuucggcc

SEQ ID NO: 3324461 - RNA, 13 nt, Mycobacterium tuberculosis H37Rv
cagcauggcccug

SEQ ID NO: 3324462 - RNA, 17 nt, Mycobacterium tuberculosis H37Rv
cagcauggcccuggcga

SEQ ID NO: 3324463 - RNA, 20 nt, Mycobacterium tuberculosis H37Rv
cagcauggcuuuugcgccga

SEQ ID NO: 3324464 - RNA, 17 nt, Mycobacterium tuberculosis H37Rv
cagcaugggcgagaagu

SEQ ID NO: 3324465 - RNA, 17 nt, Mycobacterium tuberculosis H37Rv
cagcaugguccacagcc

SEQ ID NO: 3324466 - RNA, 13 nt, Mycobacterium tuberculosis H37Rv
cagcaugguggac

SEQ ID NO: 3324467 - RNA, 20 nt, Mycobacterium tuberculosis H37Rv
cagcaugguuagcggugaug

SEQ ID NO: 3324468 - RNA, 19 nt, Mycobacterium tuberculosis H37Rv
cagcauguccgcagcggug

SEQ ID NO: 3324469 - RNA, 23 nt, Mycobacterium tuberculosis H37Rv
cagcaugucgggccgcucgaaau

SEQ ID NO: 3324470 - RNA, 14 nt, Mycobacterium tuberculosis H37Rv
cagcauugaagaag

SEQ ID NO: 3324471 - RNA, 17 nt, Mycobacterium tuberculosis H37Rv
cagcauugacccgacga

SEQ ID NO: 3324472 - RNA, 21 nt, Mycobacterium tuberculosis H37Rv
cagccaaaacgagcagauggu

SEQ ID NO: 3324473 - RNA, 15 nt, Mycobacterium tuberculosis H37Rv
cagccaaaucagcca

SEQ ID NO: 3324474 - RNA, 14 nt, Mycobacterium tuberculosis H37Rv
cagccaaccggcgc

SEQ ID NO: 3324475 - RNA, 17 nt, Mycobacterium tuberculosis H37Rv
cagccaacgggaacaac

SEQ ID NO: 3324476 - RNA, 18 nt, Mycobacterium tuberculosis H37Rv
cagccaacucaggccggu

SEQ ID NO: 3324477 - RNA, 19 nt, Mycobacterium tuberculosis H37Rv
cagccaaugccggaucggg

SEQ ID NO: 3324478 - RNA, 15 nt, Mycobacterium tuberculosis H37Rv
cagccacagcccggc

SEQ ID NO: 3324479 - RNA, 19 nt, Mycobacterium tuberculosis H37Rv
cagccacagccgaccucga

SEQ ID NO: 3324480 - RNA, 23 nt, Mycobacterium tuberculosis H37Rv
cagccacauacaggcccgccagc

SEQ ID NO: 3324481 - RNA, 12 nt, Mycobacterium tuberculosis H37Rv
cagccaccacca

SEQ ID NO: 3324482 - RNA, 16 nt, Mycobacterium tuberculosis H37Rv
cagccaccaccagguc

SEQ ID NO: 3324483 - RNA, 12 nt, Mycobacterium tuberculosis H37Rv
cagccaccagcc

SEQ ID NO: 3324484 - RNA, 16 nt, Mycobacterium tuberculosis H37Rv
cagccaccagccgggc

SEQ ID NO: 3324485 - RNA, 19 nt, Mycobacterium tuberculosis H37Rv
cagccaccagcgacgacca

SEQ ID NO: 3324486 - RNA, 18 nt, Mycobacterium tuberculosis H37Rv
cagccaccaucuggaugg

SEQ ID NO: 3324487 - RNA, 17 nt, Mycobacterium tuberculosis H37Rv
cagccacccgacaacgc

SEQ ID NO: 3324488 - RNA, 15 nt, Mycobacterium tuberculosis H37Rv
cagccaccgcaugug

SEQ ID NO: 3324489 - RNA, 13 nt, Mycobacterium tuberculosis H37Rv
cagccaccgcgcg

SEQ ID NO: 3324490 - RNA, 14 nt, Mycobacterium tuberculosis H37Rv
cagccaccgcgcgu

SEQ ID NO: 3324491 - RNA, 16 nt, Mycobacterium tuberculosis H37Rv
cagccaccgcgcguca

SEQ ID NO: 3324492 - RNA, 13 nt, Mycobacterium tuberculosis H37Rv
cagccaccgcggu

SEQ ID NO: 3324493 - RNA, 12 nt, Mycobacterium tuberculosis H37Rv
cagccaccgggc

SEQ ID NO: 3324494 - RNA, 14 nt, Mycobacterium tuberculosis H37Rv
cagccaccgggcgu

SEQ ID NO: 3324495 - RNA, 17 nt, Mycobacterium tuberculosis H37Rv
cagccaccgucaugccg

SEQ ID NO: 3324496 - RNA, 22 nt, Mycobacterium tuberculosis H37Rv
cagccaccugccgacucaucgg

SEQ ID NO: 3324497 - RNA, 16 nt, Mycobacterium tuberculosis H37Rv
cagccacgcugucccg

SEQ ID NO: 3324498 - RNA, 17 nt, Mycobacterium tuberculosis H37Rv
cagccagaucuccccga

SEQ ID NO: 3324499 - RNA, 14 nt, Mycobacterium tuberculosis H37Rv
cagccagaugccgg

SEQ ID NO: 3324500 - RNA, 16 nt, Mycobacterium tuberculosis H37Rv
cagccagaugccggua

SEQ ID NO: 3324501 - RNA, 12 nt, Mycobacterium tuberculosis H37Rv
cagccagcaaca

SEQ ID NO: 3324502 - RNA, 12 nt, Mycobacterium tuberculosis H37Rv
cagccagcaagu

SEQ ID NO: 3324503 - RNA, 12 nt, Mycobacterium tuberculosis H37Rv
cagccagccacc

SEQ ID NO: 3324504 - RNA, 13 nt, Mycobacterium tuberculosis H37Rv
cagccagccaccg

SEQ ID NO: 3324505 - RNA, 14 nt, Mycobacterium tuberculosis H37Rv
cagccagccaccga

SEQ ID NO: 3324506 - RNA, 16 nt, Mycobacterium tuberculosis H37Rv
cagccagcccagccgc

SEQ ID NO: 3324507 - RNA, 14 nt, Mycobacterium tuberculosis H37Rv
cagccagccgcccu

SEQ ID NO: 3324508 - RNA, 22 nt, Mycobacterium tuberculosis H37Rv
cagccagccugcuggccgcggc

SEQ ID NO: 3324509 - RNA, 20 nt, Mycobacterium tuberculosis H37Rv
cagccagcgccaugcugucg

SEQ ID NO: 3324510 - RNA, 14 nt, Mycobacterium tuberculosis H37Rv
cagccagcgggcga

SEQ ID NO: 3324511 - RNA, 14 nt, Mycobacterium tuberculosis H37Rv
cagccagcuggacu

SEQ ID NO: 3324512 - RNA, 22 nt, Mycobacterium tuberculosis H37Rv
cagccagcuggacuccggucag

SEQ ID NO: 3324513 - RNA, 12 nt, Mycobacterium tuberculosis H37Rv
cagccaggaagc

SEQ ID NO: 3324514 - RNA, 15 nt, Mycobacterium tuberculosis H37Rv
cagccaggaagcggu

SEQ ID NO: 3324515 - RNA, 12 nt, Mycobacterium tuberculosis H37Rv
cagccaggagcc

SEQ ID NO: 3324516 - RNA, 14 nt, Mycobacterium tuberculosis H37Rv
cagccaggagccga

SEQ ID NO: 3324517 - RNA, 16 nt, Mycobacterium tuberculosis H37Rv
cagccaggagccgauc

SEQ ID NO: 3324518 - RNA, 23 nt, Mycobacterium tuberculosis H37Rv
cagccaggagccgaucacgcugc

SEQ ID NO: 3324519 - RNA, 17 nt, Mycobacterium tuberculosis H37Rv
cagccaggcacguccga

SEQ ID NO: 3324520 - RNA, 17 nt, Mycobacterium tuberculosis H37Rv
cagccaggccagugcca

SEQ ID NO: 3324521 - RNA, 12 nt, Mycobacterium tuberculosis H37Rv
cagccaggccgc

SEQ ID NO: 3324522 - RNA, 17 nt, Mycobacterium tuberculosis H37Rv
cagccaggcgugcacag

SEQ ID NO: 3324523 - RNA, 20 nt, Mycobacterium tuberculosis H37Rv
cagccaggcgugcacagguc

SEQ ID NO: 3324524 - RNA, 16 nt, Mycobacterium tuberculosis H37Rv
cagccagggcaacacu

SEQ ID NO: 3324525 - RNA, 15 nt, Mycobacterium tuberculosis H37Rv
cagccagggcgccga

SEQ ID NO: 3324526 - RNA, 16 nt, Mycobacterium tuberculosis H37Rv
cagccagggcgccgaa

SEQ ID NO: 3324527 - RNA, 20 nt, Mycobacterium tuberculosis H37Rv
cagccagggucccgccgccu

SEQ ID NO: 3324528 - RNA, 24 nt, Mycobacterium tuberculosis H37Rv
cagccagggucccgccgccuggaa

SEQ ID NO: 3324529 - RNA, 22 nt, Mycobacterium tuberculosis H37Rv
cagccaggugcccaagcagucc

SEQ ID NO: 3324530 - RNA, 16 nt, Mycobacterium tuberculosis H37Rv
cagccgagacaccacg

SEQ ID NO: 3324531 - RNA, 19 nt, Mycobacterium tuberculosis H37Rv
cagccgauccgaucgcaga

SEQ ID NO: 3324532 - RNA, 20 nt, Mycobacterium tuberculosis H37Rv
cagccgaucgucucggccac

SEQ ID NO: 3324533 - RNA, 13 nt, Mycobacterium tuberculosis H37Rv
cagccgaugcucg

SEQ ID NO: 3324534 - RNA, 22 nt, Mycobacterium tuberculosis H37Rv
cagccgcaccaguggcgcccau

SEQ ID NO: 3324535 - RNA, 14 nt, Mycobacterium tuberculosis H37Rv
cagccgcaccccgc

SEQ ID NO: 3324536 - RNA, 17 nt, Mycobacterium tuberculosis H37Rv
cagccgcagcaccucgg

SEQ ID NO: 3324537 - RNA, 23 nt, Mycobacterium tuberculosis H37Rv
cagccgcagccaggucuccuugg

SEQ ID NO: 3324538 - RNA, 14 nt, Mycobacterium tuberculosis H37Rv
cagccgcagcggcc

SEQ ID NO: 3324539 - RNA, 18 nt, Mycobacterium tuberculosis H37Rv
cagccgcauaggccccgc

SEQ ID NO: 3324540 - RNA, 23 nt, Mycobacterium tuberculosis H37Rv
cagccgcauaggccccgccagcg

SEQ ID NO: 3324541 - RNA, 20 nt, Mycobacterium tuberculosis H37Rv
cagccgccaugcgacuucgc

SEQ ID NO: 3324542 - RNA, 17 nt, Mycobacterium tuberculosis H37Rv
cagccgcccgcccaccu

SEQ ID NO: 3324543 - RNA, 13 nt, Mycobacterium tuberculosis H37Rv
cagccgcccucgg

SEQ ID NO: 3324544 - RNA, 21 nt, Mycobacterium tuberculosis H37Rv
cagccgcccugaauccucucg

SEQ ID NO: 3324545 - RNA, 22 nt, Mycobacterium tuberculosis H37Rv
cagccgcccugaauccucucga

SEQ ID NO: 3324546 - RNA, 13 nt, Mycobacterium tuberculosis H37Rv
cagccgccgacuu

SEQ ID NO: 3324547 - RNA, 22 nt, Mycobacterium tuberculosis H37Rv
cagccgccgacuuccgcgucgc

SEQ ID NO: 3324548 - RNA, 19 nt, Mycobacterium tuberculosis H37Rv
cagccgcgaccgcagcugg

SEQ ID NO: 3324549 - RNA, 19 nt, Mycobacterium tuberculosis H37Rv
cagccgcgagccggugauc

SEQ ID NO: 3324550 - RNA, 13 nt, Mycobacterium tuberculosis H37Rv
cagccgcgccagc

SEQ ID NO: 3324551 - RNA, 15 nt, Mycobacterium tuberculosis H37Rv
cagccgcgccgcggc

SEQ ID NO: 3324552 - RNA, 22 nt, Mycobacterium tuberculosis H37Rv
cagccgcgccgcggcccgcucc

SEQ ID NO: 3324553 - RNA, 13 nt, Mycobacterium tuberculosis H37Rv
cagccgcgccggg

SEQ ID NO: 3324554 - RNA, 14 nt, Mycobacterium tuberculosis H37Rv
cagccgcgccgggu

SEQ ID NO: 3324555 - RNA, 20 nt, Mycobacterium tuberculosis H37Rv
cagccgcgcgguacugcgca

SEQ ID NO: 3324556 - RNA, 17 nt, Mycobacterium tuberculosis H37Rv
cagccgcgcguccgggc

SEQ ID NO: 3324557 - RNA, 13 nt, Mycobacterium tuberculosis H37Rv
cagccgcgcugcg

SEQ ID NO: 3324558 - RNA, 18 nt, Mycobacterium tuberculosis H37Rv
cagccgcggggcccacac

SEQ ID NO: 3324559 - RNA, 16 nt, Mycobacterium tuberculosis H37Rv
cagccgcucacccggu

SEQ ID NO: 3324560 - RNA, 22 nt, Mycobacterium tuberculosis H37Rv
cagccgcuccacguacgcggcu

SEQ ID NO: 3324561 - RNA, 21 nt, Mycobacterium tuberculosis H37Rv
cagccgcugaucugccgccgc

SEQ ID NO: 3324562 - RNA, 19 nt, Mycobacterium tuberculosis H37Rv
cagccggaaccggacagcg

SEQ ID NO: 3324563 - RNA, 20 nt, Mycobacterium tuberculosis H37Rv
cagccggaaccggacagcgu

SEQ ID NO: 3324564 - RNA, 15 nt, Mycobacterium tuberculosis H37Rv
cagccggaccaccag

SEQ ID NO: 3324565 - RNA, 16 nt, Mycobacterium tuberculosis H37Rv
cagccggaccguguac

SEQ ID NO: 3324566 - RNA, 16 nt, Mycobacterium tuberculosis H37Rv
cagccggagucaccga

SEQ ID NO: 3324567 - RNA, 13 nt, Mycobacterium tuberculosis H37Rv
cagccggcccugc

SEQ ID NO: 3324568 - RNA, 17 nt, Mycobacterium tuberculosis H37Rv
cagccggcccugcggcc

SEQ ID NO: 3324569 - RNA, 18 nt, Mycobacterium tuberculosis H37Rv
cagccggcccugcggcca

SEQ ID NO: 3324570 - RNA, 23 nt, Mycobacterium tuberculosis H37Rv
cagccggcgaaugcgguccucga

SEQ ID NO: 3324571 - RNA, 20 nt, Mycobacterium tuberculosis H37Rv
cagccggcggcuggucucug

SEQ ID NO: 3324572 - RNA, 14 nt, Mycobacterium tuberculosis H37Rv
cagccggcuugggc

SEQ ID NO: 3324573 - RNA, 20 nt, Mycobacterium tuberculosis H37Rv
cagccgggcgucgcuggugg

SEQ ID NO: 3324574 - RNA, 21 nt, Mycobacterium tuberculosis H37Rv
cagccgggugccacaacccgc

SEQ ID NO: 3324575 - RNA, 15 nt, Mycobacterium tuberculosis H37Rv
cagccggguggacac

SEQ ID NO: 3324576 - RNA, 22 nt, Mycobacterium tuberculosis H37Rv
cagccggguuuggugcagccgc

SEQ ID NO: 3324577 - RNA, 14 nt, Mycobacterium tuberculosis H37Rv
cagccgguccagac

SEQ ID NO: 3324578 - RNA, 15 nt, Mycobacterium tuberculosis H37Rv
cagccgguccagacc

SEQ ID NO: 3324579 - RNA, 18 nt, Mycobacterium tuberculosis H37Rv
cagccgguccagacccag

SEQ ID NO: 3324580 - RNA, 14 nt, Mycobacterium tuberculosis H37Rv
cagccgguccagcg

SEQ ID NO: 3324581 - RNA, 11 nt, Mycobacterium tuberculosis H37Rv
cagccggucga

SEQ ID NO: 3324582 - RNA, 15 nt, Mycobacterium tuberculosis H37Rv
cagccggucgaugcc

SEQ ID NO: 3324583 - RNA, 21 nt, Mycobacterium tuberculosis H37Rv
cagccggucgaugccgaugcg

SEQ ID NO: 3324584 - RNA, 16 nt, Mycobacterium tuberculosis H37Rv
cagccggugccgccgu

SEQ ID NO: 3324585 - RNA, 17 nt, Mycobacterium tuberculosis H37Rv
cagccggugcgcugguu

SEQ ID NO: 3324586 - RNA, 20 nt, Mycobacterium tuberculosis H37Rv
cagccgguggucugcgcggu

SEQ ID NO: 3324587 - RNA, 23 nt, Mycobacterium tuberculosis H37Rv
cagccgguggugggcgggaucga

SEQ ID NO: 3324588 - RNA, 23 nt, Mycobacterium tuberculosis H37Rv
cagccguagcugggcaccccguu

SEQ ID NO: 3324589 - RNA, 17 nt, Mycobacterium tuberculosis H37Rv
cagccgucaccgcgacc

SEQ ID NO: 3324590 - RNA, 14 nt, Mycobacterium tuberculosis H37Rv
cagccgucgccacc

SEQ ID NO: 3324591 - RNA, 19 nt, Mycobacterium tuberculosis H37Rv
cagccgugcccaggccacc

SEQ ID NO: 3324592 - RNA, 24 nt, Mycobacterium tuberculosis H37Rv
cagccgugcccaggccaccggcug

SEQ ID NO: 3324593 - RNA, 15 nt, Mycobacterium tuberculosis H37Rv
cagccgugccguggu

SEQ ID NO: 3324594 - RNA, 17 nt, Mycobacterium tuberculosis H37Rv
cagccgugcgggccggu

SEQ ID NO: 3324595 - RNA, 16 nt, Mycobacterium tuberculosis H37Rv
cagccguggcagucgc

SEQ ID NO: 3324596 - RNA, 17 nt, Mycobacterium tuberculosis H37Rv
cagccguggcgcgacgu

SEQ ID NO: 3324597 - RNA, 16 nt, Mycobacterium tuberculosis H37Rv
cagccguggcggcggg

SEQ ID NO: 3324598 - RNA, 21 nt, Mycobacterium tuberculosis H37Rv
cagccguggugguugaucagc

SEQ ID NO: 3324599 - RNA, 19 nt, Mycobacterium tuberculosis H37Rv
cagccguucccggugacca

SEQ ID NO: 3324600 - RNA, 22 nt, Mycobacterium tuberculosis H37Rv
cagccguucucgcccacccgcu

SEQ ID NO: 3324601 - RNA, 17 nt, Mycobacterium tuberculosis H37Rv
cagccguuugaggucua

SEQ ID NO: 3324602 - RNA, 18 nt, Mycobacterium tuberculosis H37Rv
cagccuaccggcuacggc

SEQ ID NO: 3324603 - RNA, 12 nt, Mycobacterium tuberculosis H37Rv
cagccuccacca

SEQ ID NO: 3324604 - RNA, 15 nt, Mycobacterium tuberculosis H37Rv
cagccuccaccaggu

SEQ ID NO: 3324605 - RNA, 20 nt, Mycobacterium tuberculosis H37Rv
cagccugcaacgucuugcug

SEQ ID NO: 3324606 - RNA, 23 nt, Mycobacterium tuberculosis H37Rv
cagccugcaacgucuugcugguc

SEQ ID NO: 3324607 - RNA, 13 nt, Mycobacterium tuberculosis H37Rv
cagccugcagcga

SEQ ID NO: 3324608 - RNA, 15 nt, Mycobacterium tuberculosis H37Rv
cagccugccagguac

SEQ ID NO: 3324609 - RNA, 12 nt, Mycobacterium tuberculosis H37Rv
cagccugcugca

SEQ ID NO: 3324610 - RNA, 17 nt, Mycobacterium tuberculosis H37Rv
cagccugcuggccgcgg

SEQ ID NO: 3324611 - RNA, 20 nt, Mycobacterium tuberculosis H37Rv
cagccugcuggccgcggccu

SEQ ID NO: 3324612 - RNA, 16 nt, Mycobacterium tuberculosis H37Rv
cagccuggcaaccacg

SEQ ID NO: 3324613 - RNA, 14 nt, Mycobacterium tuberculosis H37Rv
cagccuggccaucg

SEQ ID NO: 3324614 - RNA, 18 nt, Mycobacterium tuberculosis H37Rv
cagccuuaugcagugaca

SEQ ID NO: 3324615 - RNA, 16 nt, Mycobacterium tuberculosis H37Rv
cagccuuuccggccgc

SEQ ID NO: 3324616 - RNA, 18 nt, Mycobacterium tuberculosis H37Rv
cagccuuuccggccgccu

SEQ ID NO: 3324617 - RNA, 15 nt, Mycobacterium tuberculosis H37Rv
cagcgaaaaccgucg

SEQ ID NO: 3324618 - RNA, 19 nt, Mycobacterium tuberculosis H37Rv
cagcgaaacaccggccagc

SEQ ID NO: 3324619 - RNA, 21 nt, Mycobacterium tuberculosis H37Rv
cagcgaaaugcccaucaccag

SEQ ID NO: 3324620 - RNA, 16 nt, Mycobacterium tuberculosis H37Rv
cagcgaaccaccggcg

SEQ ID NO: 3324621 - RNA, 24 nt, Mycobacterium tuberculosis H37Rv
cagcgaaccggcugggcgccacca

SEQ ID NO: 3324622 - RNA, 13 nt, Mycobacterium tuberculosis H37Rv
cagcgaacgcugc

SEQ ID NO: 3324623 - RNA, 16 nt, Mycobacterium tuberculosis H37Rv
cagcgaacggccagga

SEQ ID NO: 3324624 - RNA, 18 nt, Mycobacterium tuberculosis H37Rv
cagcgaagacuagcugcu

SEQ ID NO: 3324625 - RNA, 13 nt, Mycobacterium tuberculosis H37Rv
cagcgaauccagc

SEQ ID NO: 3324626 - RNA, 13 nt, Mycobacterium tuberculosis H37Rv
cagcgccacccgg

SEQ ID NO: 3324627 - RNA, 15 nt, Mycobacterium tuberculosis H37Rv
cagcgccaccgaccg

SEQ ID NO: 3324628 - RNA, 15 nt, Mycobacterium tuberculosis H37Rv
cagcgccaccguuac

SEQ ID NO: 3324629 - RNA, 23 nt, Mycobacterium tuberculosis H37Rv
cagcgccaccguuaccgccguuu

SEQ ID NO: 3324630 - RNA, 20 nt, Mycobacterium tuberculosis H37Rv
cagcgccacuggaagccaag

SEQ ID NO: 3324631 - RNA, 15 nt, Mycobacterium tuberculosis H37Rv
cagcgccagcgagca

SEQ ID NO: 3324632 - RNA, 16 nt, Mycobacterium tuberculosis H37Rv
cagcgccagcgccugc

SEQ ID NO: 3324633 - RNA, 17 nt, Mycobacterium tuberculosis H37Rv
cagcgccagcgccugcg

SEQ ID NO: 3324634 - RNA, 13 nt, Mycobacterium tuberculosis H37Rv
cagcgccaggccg

SEQ ID NO: 3324635 - RNA, 14 nt, Mycobacterium tuberculosis H37Rv
cagcgccaggccgu

SEQ ID NO: 3324636 - RNA, 20 nt, Mycobacterium tuberculosis H37Rv
cagcgccaggggugugccgu

SEQ ID NO: 3324637 - RNA, 19 nt, Mycobacterium tuberculosis H37Rv
cagcgccagugccucgcgg

SEQ ID NO: 3324638 - RNA, 18 nt, Mycobacterium tuberculosis H37Rv
cagcgccaucaucuuggc

SEQ ID NO: 3324639 - RNA, 19 nt, Mycobacterium tuberculosis H37Rv
cagcgccaucgaugcggug

SEQ ID NO: 3324640 - RNA, 15 nt, Mycobacterium tuberculosis H37Rv
cagcgccaugcuguc

SEQ ID NO: 3324641 - RNA, 22 nt, Mycobacterium tuberculosis H37Rv
cagcgccauuccaagacguugc

SEQ ID NO: 3324642 - RNA, 17 nt, Mycobacterium tuberculosis H37Rv
cagcgcccccagcagcu

SEQ ID NO: 3324643 - RNA, 20 nt, Mycobacterium tuberculosis H37Rv
cagcgcccccagcagcugcg

SEQ ID NO: 3324644 - RNA, 21 nt, Mycobacterium tuberculosis H37Rv
cagcgcccccagcagcugcga

SEQ ID NO: 3324645 - RNA, 22 nt, Mycobacterium tuberculosis H37Rv
cagcgcccccggacugcggaac

SEQ ID NO: 3324646 - RNA, 15 nt, Mycobacterium tuberculosis H37Rv
cagcgcccgccggca

SEQ ID NO: 3324647 - RNA, 19 nt, Mycobacterium tuberculosis H37Rv
cagcgcccggccacuccag

SEQ ID NO: 3324648 - RNA, 19 nt, Mycobacterium tuberculosis H37Rv
cagcgcccuuggacgcgau

SEQ ID NO: 3324649 - RNA, 14 nt, Mycobacterium tuberculosis H37Rv
cagcgccgacccgu

SEQ ID NO: 3324650 - RNA, 21 nt, Mycobacterium tuberculosis H37Rv
cagcgccgacccguaccagcc

SEQ ID NO: 3324651 - RNA, 18 nt, Mycobacterium tuberculosis H37Rv
cagcgccgagagcaccgc

SEQ ID NO: 3324652 - RNA, 20 nt, Mycobacterium tuberculosis H37Rv
cagcgccgagagcaccgcuc

SEQ ID NO: 3324653 - RNA, 15 nt, Mycobacterium tuberculosis H37Rv
cagcgccgccgaggu

SEQ ID NO: 3324654 - RNA, 14 nt, Mycobacterium tuberculosis H37Rv
cagcgccgccggca

SEQ ID NO: 3324655 - RNA, 15 nt, Mycobacterium tuberculosis H37Rv
cagcgccgccggcac

SEQ ID NO: 3324656 - RNA, 16 nt, Mycobacterium tuberculosis H37Rv
cagcgccgccggcacc

SEQ ID NO: 3324657 - RNA, 24 nt, Mycobacterium tuberculosis H37Rv
cagcgccgccggcaccucccuggc

SEQ ID NO: 3324658 - RNA, 16 nt, Mycobacterium tuberculosis H37Rv
cagcgccgccggcgcc

SEQ ID NO: 3324659 - RNA, 19 nt, Mycobacterium tuberculosis H37Rv
cagcgccgccggcgccggc

SEQ ID NO: 3324660 - RNA, 22 nt, Mycobacterium tuberculosis H37Rv
cagcgccgcgccccagacgcgc

SEQ ID NO: 3324661 - RNA, 19 nt, Mycobacterium tuberculosis H37Rv
cagcgccgcgcgcgccgca

SEQ ID NO: 3324662 - RNA, 13 nt, Mycobacterium tuberculosis H37Rv
cagcgccgcggug

SEQ ID NO: 3324663 - RNA, 13 nt, Mycobacterium tuberculosis H37Rv
cagcgccgcguug

SEQ ID NO: 3324664 - RNA, 13 nt, Mycobacterium tuberculosis H37Rv
cagcgccgcugac

SEQ ID NO: 3324665 - RNA, 20 nt, Mycobacterium tuberculosis H37Rv
cagcgccgcugacuccugcg

SEQ ID NO: 3324666 - RNA, 18 nt, Mycobacterium tuberculosis H37Rv
cagcgccggauccacacc

SEQ ID NO: 3324667 - RNA, 21 nt, Mycobacterium tuberculosis H37Rv
cagcgccggccaagaccgcgg

SEQ ID NO: 3324668 - RNA, 18 nt, Mycobacterium tuberculosis H37Rv
cagcgccggccauaccgc

SEQ ID NO: 3324669 - RNA, 21 nt, Mycobacterium tuberculosis H37Rv
cagcgccucauccuccaguuc

SEQ ID NO: 3324670 - RNA, 11 nt, Mycobacterium tuberculosis H37Rv
cagcgccucca

SEQ ID NO: 3324671 - RNA, 12 nt, Mycobacterium tuberculosis H37Rv
cagcgccuccag

SEQ ID NO: 3324672 - RNA, 14 nt, Mycobacterium tuberculosis H37Rv
cagcgccuccagca

SEQ ID NO: 3324673 - RNA, 17 nt, Mycobacterium tuberculosis H37Rv
cagcgccuccagcacca

SEQ ID NO: 3324674 - RNA, 12 nt, Mycobacterium tuberculosis H37Rv
cagcgccuccuc

SEQ ID NO: 3324675 - RNA, 14 nt, Mycobacterium tuberculosis H37Rv
cagcgccuccucga

SEQ ID NO: 3324676 - RNA, 21 nt, Mycobacterium tuberculosis H37Rv
cagcgccucgauccgcaucau

SEQ ID NO: 3324677 - RNA, 15 nt, Mycobacterium tuberculosis H37Rv
cagcgccugcgccca

SEQ ID NO: 3324678 - RNA, 13 nt, Mycobacterium tuberculosis H37Rv
cagcgccuggccg

SEQ ID NO: 3324679 - RNA, 15 nt, Mycobacterium tuberculosis H37Rv
cagcgccuggccgga

SEQ ID NO: 3324680 - RNA, 17 nt, Mycobacterium tuberculosis H37Rv
cagcgccuugaccagca

SEQ ID NO: 3324681 - RNA, 20 nt, Mycobacterium tuberculosis H37Rv
cagcgccuugaccagcagcu

SEQ ID NO: 3324682 - RNA, 21 nt, Mycobacterium tuberculosis H37Rv
cagcgccuugaccagcagcug

SEQ ID NO: 3324683 - RNA, 19 nt, Mycobacterium tuberculosis H37Rv
cagcgccuuguggcacacc

SEQ ID NO: 3324684 - RNA, 20 nt, Mycobacterium tuberculosis H37Rv
cagcgccuuguggcacaccc

SEQ ID NO: 3324685 - RNA, 15 nt, Mycobacterium tuberculosis H37Rv
cagcgcgaacaccau

SEQ ID NO: 3324686 - RNA, 11 nt, Mycobacterium tuberculosis H37Rv
cagcgcgacgu

SEQ ID NO: 3324687 - RNA, 18 nt, Mycobacterium tuberculosis H37Rv
cagcgcgacguccaccag

SEQ ID NO: 3324688 - RNA, 21 nt, Mycobacterium tuberculosis H37Rv
cagcgcgacguccaccagccg

SEQ ID NO: 3324689 - RNA, 17 nt, Mycobacterium tuberculosis H37Rv
cagcgcgagaucagccg

SEQ ID NO: 3324690 - RNA, 22 nt, Mycobacterium tuberculosis H37Rv
cagcgcgagaucagccggcagc

SEQ ID NO: 3324691 - RNA, 21 nt, Mycobacterium tuberculosis H37Rv
cagcgcgagcccgaaccaccg

SEQ ID NO: 3324692 - RNA, 19 nt, Mycobacterium tuberculosis H37Rv
cagcgcgcaaagacaccga

SEQ ID NO: 3324693 - RNA, 16 nt, Mycobacterium tuberculosis H37Rv
cagcgcgcacgacagg

SEQ ID NO: 3324694 - RNA, 15 nt, Mycobacterium tuberculosis H37Rv
cagcgcgccacccag

SEQ ID NO: 3324695 - RNA, 16 nt, Mycobacterium tuberculosis H37Rv
cagcgcgccacccagc

SEQ ID NO: 3324696 - RNA, 12 nt, Mycobacterium tuberculosis H37Rv
cagcgcgcccga

SEQ ID NO: 3324697 - RNA, 15 nt, Mycobacterium tuberculosis H37Rv
cagcgcgcccgacac

SEQ ID NO: 3324698 - RNA, 17 nt, Mycobacterium tuberculosis H37Rv
cagcgcgcccgacaccc

SEQ ID NO: 3324699 - RNA, 12 nt, Mycobacterium tuberculosis H37Rv
cagcgcgccgcg

SEQ ID NO: 3324700 - RNA, 13 nt, Mycobacterium tuberculosis H37Rv
cagcgcgccggcg

SEQ ID NO: 3324701 - RNA, 17 nt, Mycobacterium tuberculosis H37Rv
cagcgcgccggcgucgg

SEQ ID NO: 3324702 - RNA, 14 nt, Mycobacterium tuberculosis H37Rv
cagcgcgcgccgca

SEQ ID NO: 3324703 - RNA, 14 nt, Mycobacterium tuberculosis H37Rv
cagcgcgcgcgggu

SEQ ID NO: 3324704 - RNA, 23 nt, Mycobacterium tuberculosis H37Rv
cagcgcgcgcgggugcaaccgga

SEQ ID NO: 3324705 - RNA, 12 nt, Mycobacterium tuberculosis H37Rv
cagcgcgcggcu

SEQ ID NO: 3324706 - RNA, 18 nt, Mycobacterium tuberculosis H37Rv
cagcgcgcugggaagcuc

SEQ ID NO: 3324707 - RNA, 13 nt, Mycobacterium tuberculosis H37Rv
cagcgcggcaagc

SEQ ID NO: 3324708 - RNA, 14 nt, Mycobacterium tuberculosis H37Rv
cagcgcggcaccca

SEQ ID NO: 3324709 - RNA, 19 nt, Mycobacterium tuberculosis H37Rv
cagcgcggcacccaaccag

SEQ ID NO: 3324710 - RNA, 23 nt, Mycobacterium tuberculosis H37Rv
cagcgcggcacggugugcggcau

SEQ ID NO: 3324711 - RNA, 22 nt, Mycobacterium tuberculosis H37Rv
cagcgcggccaauugcgccgcc

SEQ ID NO: 3324712 - RNA, 14 nt, Mycobacterium tuberculosis H37Rv
cagcgcggccacca

SEQ ID NO: 3324713 - RNA, 18 nt, Mycobacterium tuberculosis H37Rv
cagcgcggccacccgcga

SEQ ID NO: 3324714 - RNA, 16 nt, Mycobacterium tuberculosis H37Rv
cagcgcggccagugcu

SEQ ID NO: 3324715 - RNA, 23 nt, Mycobacterium tuberculosis H37Rv
cagcgcggccauuagcagcaccc

SEQ ID NO: 3324716 - RNA, 19 nt, Mycobacterium tuberculosis H37Rv
cagcgcggccgggcgcccu

SEQ ID NO: 3324717 - RNA, 22 nt, Mycobacterium tuberculosis H37Rv
cagcgcggccuuggugggcaga

SEQ ID NO: 3324718 - RNA, 22 nt, Mycobacterium tuberculosis H37Rv
cagcgcggcgagggcggucagc

SEQ ID NO: 3324719 - RNA, 15 nt, Mycobacterium tuberculosis H37Rv
cagcgcggcgcacaa

SEQ ID NO: 3324720 - RNA, 12 nt, Mycobacterium tuberculosis H37Rv
cagcgcggcgcg

SEQ ID NO: 3324721 - RNA, 14 nt, Mycobacterium tuberculosis H37Rv
cagcgcggcgcgcg

SEQ ID NO: 3324722 - RNA, 18 nt, Mycobacterium tuberculosis H37Rv
cagcgcggcgucgccuug

SEQ ID NO: 3324723 - RNA, 19 nt, Mycobacterium tuberculosis H37Rv
cagcggccugaccggcucg

SEQ ID NO: 3324724 - RNA, 16 nt, Mycobacterium tuberculosis H37Rv
cagcggcgaucaggcg

SEQ ID NO: 3324725 - RNA, 23 nt, Mycobacterium tuberculosis H37Rv
cagcggcgaucggaggcccgcca

SEQ ID NO: 3324726 - RNA, 18 nt, Mycobacterium tuberculosis H37Rv
cagcggcgauugauccgg

SEQ ID NO: 3324727 - RNA, 14 nt, Mycobacterium tuberculosis H37Rv
cagcggcgccacgu

SEQ ID NO: 3324728 - RNA, 14 nt, Mycobacterium tuberculosis H37Rv
cagcggcgccagua

SEQ ID NO: 3324729 - RNA, 17 nt, Mycobacterium tuberculosis H37Rv
cagcggcgccgccugga

SEQ ID NO: 3324730 - RNA, 22 nt, Mycobacterium tuberculosis H37Rv
cagcggcgcgaggaacgccggg

SEQ ID NO: 3324731 - RNA, 12 nt, Mycobacterium tuberculosis H37Rv
cagcggcgcgcu

SEQ ID NO: 3324732 - RNA, 21 nt, Mycobacterium tuberculosis H37Rv
cagcggcggaaggacggcagc

SEQ ID NO: 3324733 - RNA, 23 nt, Mycobacterium tuberculosis H37Rv
cagcggcggcaacccugcccggc

SEQ ID NO: 3324734 - RNA, 18 nt, Mycobacterium tuberculosis H37Rv
cagcggcggccacggcca

SEQ ID NO: 3324735 - RNA, 20 nt, Mycobacterium tuberculosis H37Rv
cagcggcggcgacgagcgca

SEQ ID NO: 3324736 - RNA, 19 nt, Mycobacterium tuberculosis H37Rv
cagcggcggcgucgacggc

SEQ ID NO: 3324737 - RNA, 18 nt, Mycobacterium tuberculosis H37Rv
cagcggcgggccguacac

SEQ ID NO: 3324738 - RNA, 16 nt, Mycobacterium tuberculosis H37Rv
cagcggcgggcgauga

SEQ ID NO: 3324739 - RNA, 12 nt, Mycobacterium tuberculosis H37Rv
cagcggcgucgu

SEQ ID NO: 3324740 - RNA, 18 nt, Mycobacterium tuberculosis H37Rv
cagcggcgucgucgucga

SEQ ID NO: 3324741 - RNA, 19 nt, Mycobacterium tuberculosis H37Rv
cagcggcucuauccggcgc

SEQ ID NO: 3324742 - RNA, 15 nt, Mycobacterium tuberculosis H37Rv
cagcggcugaccggg

SEQ ID NO: 3324743 - RNA, 12 nt, Mycobacterium tuberculosis H37Rv
cagcggcuggga

SEQ ID NO: 3324744 - RNA, 21 nt, Mycobacterium tuberculosis H37Rv
cagcgggacugcggaagccac

SEQ ID NO: 3324745 - RNA, 19 nt, Mycobacterium tuberculosis H37Rv
cagcgggcagcaggcgaug

SEQ ID NO: 3324746 - RNA, 18 nt, Mycobacterium tuberculosis H37Rv
cagcgggccacugagcca

SEQ ID NO: 3324747 - RNA, 19 nt, Mycobacterium tuberculosis H37Rv
cagcgggcgaugagcgcga

SEQ ID NO: 3324748 - RNA, 13 nt, Mycobacterium tuberculosis H37Rv
cagcgggcgcgcu

SEQ ID NO: 3324749 - RNA, 14 nt, Mycobacterium tuberculosis H37Rv
cagcgggcuggcga

SEQ ID NO: 3324750 - RNA, 20 nt, Mycobacterium tuberculosis H37Rv
cagcggguccuucugccggg

SEQ ID NO: 3324751 - RNA, 17 nt, Mycobacterium tuberculosis H37Rv
cagcgggucgaccccgg

SEQ ID NO: 3324752 - RNA, 23 nt, Mycobacterium tuberculosis H37Rv
cagcgggucgaccccggccagga

SEQ ID NO: 3324753 - RNA, 20 nt, Mycobacterium tuberculosis H37Rv
cagcgggucgcgggugccga

SEQ ID NO: 3324754 - RNA, 22 nt, Mycobacterium tuberculosis H37Rv
cagcggguggccaucaccgcgc

SEQ ID NO: 3324755 - RNA, 23 nt, Mycobacterium tuberculosis H37Rv
cagcggguggccaucaccgcgcu

SEQ ID NO: 3324756 - RNA, 20 nt, Mycobacterium tuberculosis H37Rv
cagcggguucaacgcgcgca

SEQ ID NO: 3324757 - RNA, 20 nt, Mycobacterium tuberculosis H37Rv
cagcggguugcggucaccgg

SEQ ID NO: 3324758 - RNA, 21 nt, Mycobacterium tuberculosis H37Rv
cagcggguugcggucaccgga

SEQ ID NO: 3324759 - RNA, 13 nt, Mycobacterium tuberculosis H37Rv
cagcgguagccga

SEQ ID NO: 3324760 - RNA, 21 nt, Mycobacterium tuberculosis H37Rv
cagcgguagcugcccagcguc

SEQ ID NO: 3324761 - RNA, 24 nt, Mycobacterium tuberculosis H37Rv
cagcgguaucccccagccgcggcg

SEQ ID NO: 3324762 - RNA, 18 nt, Mycobacterium tuberculosis H37Rv
cagcgguccagacaucag

SEQ ID NO: 3324763 - RNA, 14 nt, Mycobacterium tuberculosis H37Rv
cagcgguccgccgc

SEQ ID NO: 3324764 - RNA, 17 nt, Mycobacterium tuberculosis H37Rv
cagcggucgcagcucgu

SEQ ID NO: 3324765 - RNA, 13 nt, Mycobacterium tuberculosis H37Rv
cagcggugcuggu

SEQ ID NO: 3324766 - RNA, 19 nt, Mycobacterium tuberculosis H37Rv
cagcgguugaugcggccgc

SEQ ID NO: 3324767 - RNA, 20 nt, Mycobacterium tuberculosis H37Rv
cagcgguuuuaggcagccca

SEQ ID NO: 3324768 - RNA, 17 nt, Mycobacterium tuberculosis H37Rv
cagcguaagaccugagu

SEQ ID NO: 3324769 - RNA, 23 nt, Mycobacterium tuberculosis H37Rv
cagcguaucucccaacggcagcg

SEQ ID NO: 3324770 - RNA, 22 nt, Mycobacterium tuberculosis H37Rv
cagcguauuggacgcugccgca

SEQ ID NO: 3324771 - RNA, 23 nt, Mycobacterium tuberculosis H37Rv
cagcgucacccugucgcgcaccg

SEQ ID NO: 3324772 - RNA, 15 nt, Mycobacterium tuberculosis H37Rv
cagcgucaccucacc

SEQ ID NO: 3324773 - RNA, 17 nt, Mycobacterium tuberculosis H37Rv
cagcgucagcgcggcgu

SEQ ID NO: 3324774 - RNA, 13 nt, Mycobacterium tuberculosis H37Rv
cagcgucagcugu

SEQ ID NO: 3324775 - RNA, 21 nt, Mycobacterium tuberculosis H37Rv
cagcgucagcuguuugccggc

SEQ ID NO: 3324776 - RNA, 20 nt, Mycobacterium tuberculosis H37Rv
cagcgucaggugcgcgacca

SEQ ID NO: 3324777 - RNA, 17 nt, Mycobacterium tuberculosis H37Rv
cagcgucaucccgaugu

SEQ ID NO: 3324778 - RNA, 16 nt, Mycobacterium tuberculosis H37Rv
cagcgucauccucguc

SEQ ID NO: 3324779 - RNA, 16 nt, Mycobacterium tuberculosis H37Rv
cagcguccagccgccc

SEQ ID NO: 3324780 - RNA, 17 nt, Mycobacterium tuberculosis H37Rv
cagcguccagccgcccu

SEQ ID NO: 3324781 - RNA, 18 nt, Mycobacterium tuberculosis H37Rv
cagcguccagccgcccuc

SEQ ID NO: 3324782 - RNA, 19 nt, Mycobacterium tuberculosis H37Rv
cagcguccagccgcccucg

SEQ ID NO: 3324783 - RNA, 23 nt, Mycobacterium tuberculosis H37Rv
cagcguccccaugcagcgcgucg

SEQ ID NO: 3324784 - RNA, 17 nt, Mycobacterium tuberculosis H37Rv
cagcguccgaaccaccu

SEQ ID NO: 3324785 - RNA, 18 nt, Mycobacterium tuberculosis H37Rv
cagcguccgaaccaccug

SEQ ID NO: 3324786 - RNA, 16 nt, Mycobacterium tuberculosis H37Rv
cagcguccgcggaugc

SEQ ID NO: 3324787 - RNA, 19 nt, Mycobacterium tuberculosis H37Rv
cagcguccgucgucggcgu

SEQ ID NO: 3324788 - RNA, 16 nt, Mycobacterium tuberculosis H37Rv
cagcgucgguggcagc

SEQ ID NO: 3324789 - RNA, 15 nt, Mycobacterium tuberculosis H37Rv
cagcgucgucgacga

SEQ ID NO: 3324790 - RNA, 18 nt, Mycobacterium tuberculosis H37Rv
cagcgucgucgacgacaa

SEQ ID NO: 3324791 - RNA, 21 nt, Mycobacterium tuberculosis H37Rv
cagcgucucgugaacaacucc

SEQ ID NO: 3324792 - RNA, 19 nt, Mycobacterium tuberculosis H37Rv
cagcgucugagcgccggca

SEQ ID NO: 3324793 - RNA, 17 nt, Mycobacterium tuberculosis H37Rv
cagcgucuggccgucgc

SEQ ID NO: 3324794 - RNA, 20 nt, Mycobacterium tuberculosis H37Rv
cagcgucuucagguccaccg

SEQ ID NO: 3324795 - RNA, 12 nt, Mycobacterium tuberculosis H37Rv
cagcgugaacug

SEQ ID NO: 3324796 - RNA, 21 nt, Mycobacterium tuberculosis H37Rv
cagcgugaccaccgccgacag

SEQ ID NO: 3324797 - RNA, 22 nt, Mycobacterium tuberculosis H37Rv
cagcgugaccaccgccgacagg

SEQ ID NO: 3324798 - RNA, 15 nt, Mycobacterium tuberculosis H37Rv
cagcgugagugcagc

SEQ ID NO: 3324799 - RNA, 15 nt, Mycobacterium tuberculosis H37Rv
cagcgugaucuggcc

SEQ ID NO: 3324800 - RNA, 16 nt, Mycobacterium tuberculosis H37Rv
cagcgugaucuggcca

SEQ ID NO: 3324801 - RNA, 13 nt, Mycobacterium tuberculosis H37Rv
cagcgugcccgcc

SEQ ID NO: 3324802 - RNA, 14 nt, Mycobacterium tuberculosis H37Rv
cagcgugcccgcca

SEQ ID NO: 3324803 - RNA, 18 nt, Mycobacterium tuberculosis H37Rv
cagcgugcccgccaccgg

SEQ ID NO: 3324804 - RNA, 23 nt, Mycobacterium tuberculosis H37Rv
cagcgugccgguggcgccgccgc

SEQ ID NO: 3324805 - RNA, 16 nt, Mycobacterium tuberculosis H37Rv
cagcgugccugguucu

SEQ ID NO: 3324806 - RNA, 18 nt, Mycobacterium tuberculosis H37Rv
cagcguggacgcccgccc

SEQ ID NO: 3324807 - RNA, 22 nt, Mycobacterium tuberculosis H37Rv
cagcguggcgcccgugccgccc

SEQ ID NO: 3324808 - RNA, 17 nt, Mycobacterium tuberculosis H37Rv
cagcguggggccgccac

SEQ ID NO: 3324809 - RNA, 18 nt, Mycobacterium tuberculosis H37Rv
cagcguggggccgccacc

SEQ ID NO: 3324810 - RNA, 22 nt, Mycobacterium tuberculosis H37Rv
cagcguguaguggcccgcgggc

SEQ ID NO: 3324811 - RNA, 23 nt, Mycobacterium tuberculosis H37Rv
cagcguguggagcucgcggcgca

SEQ ID NO: 3324812 - RNA, 18 nt, Mycobacterium tuberculosis H37Rv
cagcguguugagggcugu

SEQ ID NO: 3324813 - RNA, 13 nt, Mycobacterium tuberculosis H37Rv
cagcguucccgcc

SEQ ID NO: 3324814 - RNA, 19 nt, Mycobacterium tuberculosis H37Rv
cagcguucccgccggcucc

SEQ ID NO: 3324815 - RNA, 20 nt, Mycobacterium tuberculosis H37Rv
cagcguugacggcuucggca

SEQ ID NO: 3324816 - RNA, 17 nt, Mycobacterium tuberculosis H37Rv
cagcguuggcggcgauc

SEQ ID NO: 3324817 - RNA, 17 nt, Mycobacterium tuberculosis H37Rv
cagcuaacccgccacgu

SEQ ID NO: 3324818 - RNA, 14 nt, Mycobacterium tuberculosis H37Rv
cagcuaauaccugc

SEQ ID NO: 3324819 - RNA, 17 nt, Mycobacterium tuberculosis H37Rv
cagcuagcccggcagca

SEQ ID NO: 3324820 - RNA, 19 nt, Mycobacterium tuberculosis H37Rv
cagcuagcccggcagcacg

SEQ ID NO: 3324821 - RNA, 20 nt, Mycobacterium tuberculosis H37Rv
cagcuaucccaggggcaccg

SEQ ID NO: 3324822 - RNA, 24 nt, Mycobacterium tuberculosis H37Rv
cagcuaucccaggggcaccgagcu

SEQ ID NO: 3324823 - RNA, 16 nt, Mycobacterium tuberculosis H37Rv
cagcuaugucaccugg

SEQ ID NO: 3324824 - RNA, 15 nt, Mycobacterium tuberculosis H37Rv
cagcucaccacccag

SEQ ID NO: 3324825 - RNA, 16 nt, Mycobacterium tuberculosis H37Rv
cagcucacgcugaagc

SEQ ID NO: 3324826 - RNA, 17 nt, Mycobacterium tuberculosis H37Rv
cagcucacggacgcugg

SEQ ID NO: 3324827 - RNA, 21 nt, Mycobacterium tuberculosis H37Rv
cagcucacggacgcugggcgg

SEQ ID NO: 3324828 - RNA, 13 nt, Mycobacterium tuberculosis H37Rv
cagcucagcugcg

SEQ ID NO: 3324829 - RNA, 13 nt, Mycobacterium tuberculosis H37Rv
cagcucaucgcgc

SEQ ID NO: 3324830 - RNA, 17 nt, Mycobacterium tuberculosis H37Rv
cagcucaucgcgcacgc

SEQ ID NO: 3324831 - RNA, 12 nt, Mycobacterium tuberculosis H37Rv
cagcuccaccag

SEQ ID NO: 3324832 - RNA, 23 nt, Mycobacterium tuberculosis H37Rv
cagcuccaccaggacguggucgg

SEQ ID NO: 3324833 - RNA, 17 nt, Mycobacterium tuberculosis H37Rv
cagcuccagcgccgcgg

SEQ ID NO: 3324834 - RNA, 16 nt, Mycobacterium tuberculosis H37Rv
cagcuccccgaccgaa

SEQ ID NO: 3324835 - RNA, 16 nt, Mycobacterium tuberculosis H37Rv
cagcuccccgccggaa

SEQ ID NO: 3324836 - RNA, 24 nt, Mycobacterium tuberculosis H37Rv
cagcucccgccacgucgccggcua

SEQ ID NO: 3324837 - RNA, 16 nt, Mycobacterium tuberculosis H37Rv
cagcucccgcgagcgg

SEQ ID NO: 3324838 - RNA, 21 nt, Mycobacterium tuberculosis H37Rv
cagcucccgcggcgccacccg

SEQ ID NO: 3324839 - RNA, 22 nt, Mycobacterium tuberculosis H37Rv
cagcucccgcggcgccacccgc

SEQ ID NO: 3324840 - RNA, 22 nt, Mycobacterium tuberculosis H37Rv
cagcucccggcuucuugaccac

SEQ ID NO: 3324841 - RNA, 19 nt, Mycobacterium tuberculosis H37Rv
cagcucccgggcggcggcc

SEQ ID NO: 3324842 - RNA, 14 nt, Mycobacterium tuberculosis H37Rv
cagcuccgccgccg

SEQ ID NO: 3324843 - RNA, 20 nt, Mycobacterium tuberculosis H37Rv
cagcuccgggugcagaucgc

SEQ ID NO: 3324844 - RNA, 21 nt, Mycobacterium tuberculosis H37Rv
cagcuccguaaacgaggucgc

SEQ ID NO: 3324845 - RNA, 18 nt, Mycobacterium tuberculosis H37Rv
cagcuccgugacaccggg

SEQ ID NO: 3324846 - RNA, 19 nt, Mycobacterium tuberculosis H37Rv
cagcuccgugacaccgggg

SEQ ID NO: 3324847 - RNA, 18 nt, Mycobacterium tuberculosis H37Rv
cagcuccucagccaccgc

SEQ ID NO: 3324848 - RNA, 21 nt, Mycobacterium tuberculosis H37Rv
cagcuccuuggcuaacaccgc

SEQ ID NO: 3324849 - RNA, 16 nt, Mycobacterium tuberculosis H37Rv
cagcucgaacagcucg

SEQ ID NO: 3324850 - RNA, 17 nt, Mycobacterium tuberculosis H37Rv
cagcucgaacagcucga

SEQ ID NO: 3324851 - RNA, 19 nt, Mycobacterium tuberculosis H37Rv
cagcucgaacagcucgauc

SEQ ID NO: 3324852 - RNA, 17 nt, Mycobacterium tuberculosis H37Rv
cagcucgaggaccaccu

SEQ ID NO: 3324853 - RNA, 23 nt, Mycobacterium tuberculosis H37Rv
cagcucgaggaccaccuggucgc

SEQ ID NO: 3324854 - RNA, 15 nt, Mycobacterium tuberculosis H37Rv
cagcucgauacccag

SEQ ID NO: 3324855 - RNA, 13 nt, Mycobacterium tuberculosis H37Rv
cagcucgccagcc

SEQ ID NO: 3324856 - RNA, 15 nt, Mycobacterium tuberculosis H37Rv
cagcucgccagccug

SEQ ID NO: 3324857 - RNA, 15 nt, Mycobacterium tuberculosis H37Rv
cagcucgccaggguc

SEQ ID NO: 3324858 - RNA, 12 nt, Mycobacterium tuberculosis H37Rv
cagcucgccggc

SEQ ID NO: 3324859 - RNA, 16 nt, Mycobacterium tuberculosis H37Rv
cagcucgccgugacca

SEQ ID NO: 3324860 - RNA, 20 nt, Mycobacterium tuberculosis H37Rv
cagcucgccgugaccaggug

SEQ ID NO: 3324861 - RNA, 23 nt, Mycobacterium tuberculosis H37Rv
cagcucgccuaguugcaacgggu

SEQ ID NO: 3324862 - RNA, 15 nt, Mycobacterium tuberculosis H37Rv
cagcucgcgcucgcu

SEQ ID NO: 3324863 - RNA, 21 nt, Mycobacterium tuberculosis H37Rv
cagcucggaucgguuccggcc

SEQ ID NO: 3324864 - RNA, 20 nt, Mycobacterium tuberculosis H37Rv
cagcucggccgaggcggucu

SEQ ID NO: 3324865 - RNA, 15 nt, Mycobacterium tuberculosis H37Rv
cagcucggccugguc

SEQ ID NO: 3324866 - RNA, 13 nt, Mycobacterium tuberculosis H37Rv
cagcucgggcagg

SEQ ID NO: 3324867 - RNA, 23 nt, Mycobacterium tuberculosis H37Rv
cagcucgggcagggaccgcaucg

SEQ ID NO: 3324868 - RNA, 15 nt, Mycobacterium tuberculosis H37Rv
cagcucgggcaugaa

SEQ ID NO: 3324869 - RNA, 17 nt, Mycobacterium tuberculosis H37Rv
cagcucggggcgaugag

SEQ ID NO: 3324870 - RNA, 14 nt, Mycobacterium tuberculosis H37Rv
cagcucggugacaa

SEQ ID NO: 3324871 - RNA, 14 nt, Mycobacterium tuberculosis H37Rv
cagcucggugaugu

SEQ ID NO: 3324872 - RNA, 14 nt, Mycobacterium tuberculosis H37Rv
cagcucggugcacg

SEQ ID NO: 3324873 - RNA, 16 nt, Mycobacterium tuberculosis H37Rv
cagcucgguggcaucg

SEQ ID NO: 3324874 - RNA, 22 nt, Mycobacterium tuberculosis H37Rv
cagcucgguggcaucggcggcc

SEQ ID NO: 3324875 - RNA, 12 nt, Mycobacterium tuberculosis H37Rv
cagcucgucggc

SEQ ID NO: 3324876 - RNA, 18 nt, Mycobacterium tuberculosis H37Rv
cagcucgucggcgauggc

SEQ ID NO: 3324877 - RNA, 20 nt, Mycobacterium tuberculosis H37Rv
cagcucgucggcgauggcca

SEQ ID NO: 3324878 - RNA, 18 nt, Mycobacterium tuberculosis H37Rv
cagcucgucgucggcgua

SEQ ID NO: 3324879 - RNA, 20 nt, Mycobacterium tuberculosis H37Rv
cagcucgugaucuucggcga

SEQ ID NO: 3324880 - RNA, 22 nt, Mycobacterium tuberculosis H37Rv
cagcucgugaucuucggcgauc

SEQ ID NO: 3324881 - RNA, 24 nt, Mycobacterium tuberculosis H37Rv
cagcucgugaucuucggcgaucgu

SEQ ID NO: 3324882 - RNA, 21 nt, Mycobacterium tuberculosis H37Rv
cagcugaacacgaauccggcc

SEQ ID NO: 3324883 - RNA, 23 nt, Mycobacterium tuberculosis H37Rv
cagcugaacacgaauccggccac

SEQ ID NO: 3324884 - RNA, 22 nt, Mycobacterium tuberculosis H37Rv
cagcugacacccgcagcugugg

SEQ ID NO: 3324885 - RNA, 13 nt, Mycobacterium tuberculosis H37Rv
cagcugaccagcg

SEQ ID NO: 3324886 - RNA, 22 nt, Mycobacterium tuberculosis H37Rv
cagcugaccagcguccagccgc

SEQ ID NO: 3324887 - RNA, 15 nt, Mycobacterium tuberculosis H37Rv
cagcugacggcgcaa

SEQ ID NO: 3324888 - RNA, 17 nt, Mycobacterium tuberculosis H37Rv
cagcugacgucaccacg

SEQ ID NO: 3324889 - RNA, 21 nt, Mycobacterium tuberculosis H37Rv
cagcugagaugaggauggcug

SEQ ID NO: 3324890 - RNA, 13 nt, Mycobacterium tuberculosis H37Rv
cagcugaucccag

SEQ ID NO: 3324891 - RNA, 18 nt, Mycobacterium tuberculosis H37Rv
cagcugcaauagccuuac

SEQ ID NO: 3324892 - RNA, 17 nt, Mycobacterium tuberculosis H37Rv
cagcugcaaugacugga

SEQ ID NO: 3324893 - RNA, 23 nt, Mycobacterium tuberculosis H37Rv
cagcugcaaugacuggaccgcgg

SEQ ID NO: 3324894 - RNA, 18 nt, Mycobacterium tuberculosis H37Rv
cagcugcacacagagguc

SEQ ID NO: 3324895 - RNA, 22 nt, Mycobacterium tuberculosis H37Rv
cagcugcaccuccgacggccgc

SEQ ID NO: 3324896 - RNA, 15 nt, Mycobacterium tuberculosis H37Rv
cagcugcccgacguu

SEQ ID NO: 3324897 - RNA, 12 nt, Mycobacterium tuberculosis H37Rv
cagcugcccgcc

SEQ ID NO: 3324898 - RNA, 15 nt, Mycobacterium tuberculosis H37Rv
cagcugcccgccagc

SEQ ID NO: 3324899 - RNA, 17 nt, Mycobacterium tuberculosis H37Rv
cagcugcccgccagcgc

SEQ ID NO: 3324900 - RNA, 21 nt, Mycobacterium tuberculosis H37Rv
cagcugcccgccagcgccgcc

SEQ ID NO: 3324901 - RNA, 22 nt, Mycobacterium tuberculosis H37Rv
cagcugccgaucaauggcaacg

SEQ ID NO: 3324902 - RNA, 14 nt, Mycobacterium tuberculosis H37Rv
cagcugcgccgaac

SEQ ID NO: 3324903 - RNA, 13 nt, Mycobacterium tuberculosis H37Rv
cagcugcgucccg

SEQ ID NO: 3324904 - RNA, 21 nt, Mycobacterium tuberculosis H37Rv
cagcugcguggcgaaccaggg

SEQ ID NO: 3324905 - RNA, 15 nt, Mycobacterium tuberculosis H37Rv
cagcugcuccaguuc

SEQ ID NO: 3324906 - RNA, 23 nt, Mycobacterium tuberculosis H37Rv
cagcugcucgucgucgauccagc

SEQ ID NO: 3324907 - RNA, 20 nt, Mycobacterium tuberculosis H37Rv
cagcugcucgucuuggcggc

SEQ ID NO: 3324908 - RNA, 16 nt, Mycobacterium tuberculosis H37Rv
cagcugcugccaccgg

SEQ ID NO: 3324909 - RNA, 14 nt, Mycobacterium tuberculosis H37Rv
cagcugcugccgau

SEQ ID NO: 3324910 - RNA, 16 nt, Mycobacterium tuberculosis H37Rv
cagcuggacuccgguc

SEQ ID NO: 3324911 - RNA, 12 nt, Mycobacterium tuberculosis H37Rv
cagcuggccacu

SEQ ID NO: 3324912 - RNA, 18 nt, Mycobacterium tuberculosis H37Rv
cagcuggcgaaugcgggc

SEQ ID NO: 3324913 - RNA, 21 nt, Mycobacterium tuberculosis H37Rv
cagcuggcgaaugcgggccuc

SEQ ID NO: 3324914 - RNA, 21 nt, Mycobacterium tuberculosis H37Rv
cagcuggcgauacagcgacag

SEQ ID NO: 3324915 - RNA, 15 nt, Mycobacterium tuberculosis H37Rv
cagcuggcgcagccu

SEQ ID NO: 3324916 - RNA, 17 nt, Mycobacterium tuberculosis H37Rv
cagcuggcgcagccugc

SEQ ID NO: 3324917 - RNA, 20 nt, Mycobacterium tuberculosis H37Rv
cagcuggcgcagccugccga

SEQ ID NO: 3324918 - RNA, 23 nt, Mycobacterium tuberculosis H37Rv
cagcuggcucaccgacaugacgc

SEQ ID NO: 3324919 - RNA, 22 nt, Mycobacterium tuberculosis H37Rv
cagcugggcagccagaucucca

SEQ ID NO: 3324920 - RNA, 20 nt, Mycobacterium tuberculosis H37Rv
cagcugggcaucaccgccgc

SEQ ID NO: 3324921 - RNA, 14 nt, Mycobacterium tuberculosis H37Rv
cagcugggcgacca

SEQ ID NO: 3324922 - RNA, 17 nt, Mycobacterium tuberculosis H37Rv
cagcugggcgaccacuu

SEQ ID NO: 3324923 - RNA, 17 nt, Mycobacterium tuberculosis H37Rv
cagcuggggcggauaug

SEQ ID NO: 3324924 - RNA, 23 nt, Mycobacterium tuberculosis H37Rv
cagcugggugaccucgucgaccg

SEQ ID NO: 3324925 - RNA, 16 nt, Mycobacterium tuberculosis H37Rv
cagcugguaaccggcg

SEQ ID NO: 3324926 - RNA, 21 nt, Mycobacterium tuberculosis H37Rv
cagcugguaaccggcggcagc

SEQ ID NO: 3324927 - RNA, 15 nt, Mycobacterium tuberculosis H37Rv
cagcugguugugcug

SEQ ID NO: 3324928 - RNA, 20 nt, Mycobacterium tuberculosis H37Rv
cagcuguaauuccucggaua

SEQ ID NO: 3324929 - RNA, 22 nt, Mycobacterium tuberculosis H37Rv
cagcugugaacaggccgaggcg

SEQ ID NO: 3324930 - RNA, 16 nt, Mycobacterium tuberculosis H37Rv
cagcugugcgacccgc

SEQ ID NO: 3324931 - RNA, 16 nt, Mycobacterium tuberculosis H37Rv
cagcuguucgagccgc

SEQ ID NO: 3324932 - RNA, 18 nt, Mycobacterium tuberculosis H37Rv
cagcuguugucgcggaag

SEQ ID NO: 3324933 - RNA, 21 nt, Mycobacterium tuberculosis H37Rv
cagcuuccgcugaacaccgug

SEQ ID NO: 3324934 - RNA, 17 nt, Mycobacterium tuberculosis H37Rv
cagcuucgccagguggc

SEQ ID NO: 3324935 - RNA, 21 nt, Mycobacterium tuberculosis H37Rv
cagcuucgccagguggccgcu

SEQ ID NO: 3324936 - RNA, 21 nt, Mycobacterium tuberculosis H37Rv
cagcuucucagcaccaugcuc

SEQ ID NO: 3324937 - RNA, 13 nt, Mycobacterium tuberculosis H37Rv
cagcuugacccac

SEQ ID NO: 3324938 - RNA, 21 nt, Mycobacterium tuberculosis H37Rv
cagcuugcagugccgccggcc

SEQ ID NO: 3324939 - RNA, 22 nt, Mycobacterium tuberculosis H37Rv
cagcuugcccgagcccagccgg

SEQ ID NO: 3324940 - RNA, 16 nt, Mycobacterium tuberculosis H37Rv
cagcuugcggagccgc

SEQ ID NO: 3324941 - RNA, 20 nt, Mycobacterium tuberculosis H37Rv
cagcuugcggagccgccgcu

SEQ ID NO: 3324942 - RNA, 13 nt, Mycobacterium tuberculosis H37Rv
cagcuugcugcgc

SEQ ID NO: 3324943 - RNA, 17 nt, Mycobacterium tuberculosis H37Rv
cagcuugcugcgcacca

SEQ ID NO: 3324944 - RNA, 22 nt, Mycobacterium tuberculosis H37Rv
cagcuuggacucaucggcgugc

SEQ ID NO: 3324945 - RNA, 17 nt, Mycobacterium tuberculosis H37Rv
cagcuuggagaucgccg

SEQ ID NO: 3324946 - RNA, 16 nt, Mycobacterium tuberculosis H37Rv
cagcuuggccagccac

SEQ ID NO: 3324947 - RNA, 21 nt, Mycobacterium tuberculosis H37Rv
cagcuuggccucagccaccgg

SEQ ID NO: 3324948 - RNA, 22 nt, Mycobacterium tuberculosis H37Rv
cagcuuggccucagccaccggg

SEQ ID NO: 3324949 - RNA, 14 nt, Mycobacterium tuberculosis H37Rv
cagcuuggcgucga

SEQ ID NO: 3324950 - RNA, 18 nt, Mycobacterium tuberculosis H37Rv
cagcuuggcgucgaugcg

SEQ ID NO: 3324951 - RNA, 23 nt, Mycobacterium tuberculosis H37Rv
cagcuuggcgucgaugcgggcca

SEQ ID NO: 3324952 - RNA, 21 nt, Mycobacterium tuberculosis H37Rv
cagcuugucguagcgacgcca

SEQ ID NO: 3324953 - RNA, 18 nt, Mycobacterium tuberculosis H37Rv
cagcuugugggcgacggc

SEQ ID NO: 3324954 - RNA, 20 nt, Mycobacterium tuberculosis H37Rv
cagcuugugggcgacggcga

SEQ ID NO: 3324955 - RNA, 21 nt, Mycobacterium tuberculosis H37Rv
cagcuuguuuuccaccagcga

SEQ ID NO: 3324956 - RNA, 23 nt, Mycobacterium tuberculosis H37Rv
cagcuuguuuuccaccagcgagc

SEQ ID NO: 3324957 - RNA, 21 nt, Mycobacterium tuberculosis H37Rv
cagcuuuaaucguggcacuga

SEQ ID NO: 3324958 - RNA, 17 nt, Mycobacterium tuberculosis H37Rv
cagcuuucuuggcgggc

SEQ ID NO: 3324959 - RNA, 16 nt, Mycobacterium tuberculosis H37Rv
cagcuuugacgcccuc

SEQ ID NO: 3324960 - RNA, 17 nt, Mycobacterium tuberculosis H37Rv
cagcuuuguucccuuca

SEQ ID NO: 3324961 - RNA, 18 nt, Mycobacterium tuberculosis H37Rv
caggaaaaagggcuucca

SEQ ID NO: 3324962 - RNA, 15 nt, Mycobacterium tuberculosis H37Rv
caggaaaaccccggc

SEQ ID NO: 3324963 - RNA, 14 nt, Mycobacterium tuberculosis H37Rv
caggaaaccggcgc

SEQ ID NO: 3324964 - RNA, 20 nt, Mycobacterium tuberculosis H37Rv
caggaacaaguagccgucgu

SEQ ID NO: 3324965 - RNA, 22 nt, Mycobacterium tuberculosis H37Rv
caggaacacucgcgaauaaccu

SEQ ID NO: 3324966 - RNA, 21 nt, Mycobacterium tuberculosis H37Rv
caggaacgccgugccguacgc

SEQ ID NO: 3324967 - RNA, 15 nt, Mycobacterium tuberculosis H37Rv
caggaacucggccca

SEQ ID NO: 3324968 - RNA, 22 nt, Mycobacterium tuberculosis H37Rv
caggaagccggcgugcucggga

SEQ ID NO: 3324969 - RNA, 17 nt, Mycobacterium tuberculosis H37Rv
caggaagucgcggacgu

SEQ ID NO: 3324970 - RNA, 20 nt, Mycobacterium tuberculosis H37Rv
caggaauuccccaccgucgu

SEQ ID NO: 3324971 - RNA, 21 nt, Mycobacterium tuberculosis H37Rv
caggacaauggacaccaaccc

SEQ ID NO: 3324972 - RNA, 19 nt, Mycobacterium tuberculosis H37Rv
caggaccaacuguggugga

SEQ ID NO: 3324973 - RNA, 15 nt, Mycobacterium tuberculosis H37Rv
caggaccagcaccgc

SEQ ID NO: 3324974 - RNA, 12 nt, Mycobacterium tuberculosis H37Rv
caggaccgcgcc

SEQ ID NO: 3324975 - RNA, 17 nt, Mycobacterium tuberculosis H37Rv
caggaccgggaucguca

SEQ ID NO: 3324976 - RNA, 18 nt, Mycobacterium tuberculosis H37Rv
caggaccgggauucccaa

SEQ ID NO: 3324977 - RNA, 20 nt, Mycobacterium tuberculosis H37Rv
caggaccggugggucugcuc

SEQ ID NO: 3324978 - RNA, 22 nt, Mycobacterium tuberculosis H37Rv
caggacgacgccgacgaugacg

SEQ ID NO: 3324979 - RNA, 13 nt, Mycobacterium tuberculosis H37Rv
caggacgacugga

SEQ ID NO: 3324980 - RNA, 21 nt, Mycobacterium tuberculosis H37Rv
caggacgcccacaugcucagg

SEQ ID NO: 3324981 - RNA, 22 nt, Mycobacterium tuberculosis H37Rv
caggacgcgaucggcgucacga

SEQ ID NO: 3324982 - RNA, 13 nt, Mycobacterium tuberculosis H37Rv
caggacggcaccc

SEQ ID NO: 3324983 - RNA, 16 nt, Mycobacterium tuberculosis H37Rv
caggacguggucggga

SEQ ID NO: 3324984 - RNA, 14 nt, Mycobacterium tuberculosis H37Rv
caggacgugucggu

SEQ ID NO: 3324985 - RNA, 19 nt, Mycobacterium tuberculosis H37Rv
caggacuccggccgcacgc

SEQ ID NO: 3324986 - RNA, 19 nt, Mycobacterium tuberculosis H37Rv
caggacucgcguccucggg

SEQ ID NO: 3324987 - RNA, 16 nt, Mycobacterium tuberculosis H37Rv
caggacuggcaccgcc

SEQ ID NO: 3324988 - RNA, 22 nt, Mycobacterium tuberculosis H37Rv
caggacuggcaccgccagccac

SEQ ID NO: 3324989 - RNA, 19 nt, Mycobacterium tuberculosis H37Rv
caggagacgguacgccagu

SEQ ID NO: 3324990 - RNA, 22 nt, Mycobacterium tuberculosis H37Rv
caggagaucaacauccugggca

SEQ ID NO: 3324991 - RNA, 21 nt, Mycobacterium tuberculosis H37Rv
caggagauccaccgguccagg

SEQ ID NO: 3324992 - RNA, 22 nt, Mycobacterium tuberculosis H37Rv
caggagcaccucgaagugcagg

SEQ ID NO: 3324993 - RNA, 18 nt, Mycobacterium tuberculosis H37Rv
caggagccuccagcgcac

SEQ ID NO: 3324994 - RNA, 22 nt, Mycobacterium tuberculosis H37Rv
caggagccuccagcgcaccggu

SEQ ID NO: 3324995 - RNA, 16 nt, Mycobacterium tuberculosis H37Rv
caggagcggauagcgg

SEQ ID NO: 3324996 - RNA, 22 nt, Mycobacterium tuberculosis H37Rv
caggaggcgaaugucuucgccg

SEQ ID NO: 3324997 - RNA, 23 nt, Mycobacterium tuberculosis H37Rv
caggaggcgaaugucuucgccgu

SEQ ID NO: 3324998 - RNA, 18 nt, Mycobacterium tuberculosis H37Rv
caggagguugggaacagc

SEQ ID NO: 3324999 - RNA, 18 nt, Mycobacterium tuberculosis H37Rv
caggaguuugaccaccug

SEQ ID NO: 3325000 - RNA, 21 nt, Mycobacterium tuberculosis H37Rv
caggauaccgaaaucaccuca

SEQ ID NO: 3325001 - RNA, 16 nt, Mycobacterium tuberculosis H37Rv
caggauauuucuaaau

SEQ ID NO: 3325002 - RNA, 16 nt, Mycobacterium tuberculosis H37Rv
caggaucacacuggcc

SEQ ID NO: 3325003 - RNA, 23 nt, Mycobacterium tuberculosis H37Rv
caggaucacccacucgacgucgu

SEQ ID NO: 3325004 - RNA, 13 nt, Mycobacterium tuberculosis H37Rv
caggaucagcgac

SEQ ID NO: 3325005 - RNA, 16 nt, Mycobacterium tuberculosis H37Rv
caggaucagcgacuug

SEQ ID NO: 3325006 - RNA, 20 nt, Mycobacterium tuberculosis H37Rv
caggaucagcgacuugcugg

SEQ ID NO: 3325007 - RNA, 13 nt, Mycobacterium tuberculosis H37Rv
caggauccgaccc

SEQ ID NO: 3325008 - RNA, 16 nt, Mycobacterium tuberculosis H37Rv
caggauccgaccccgc

SEQ ID NO: 3325009 - RNA, 14 nt, Mycobacterium tuberculosis H37Rv
caggaucgccugag

SEQ ID NO: 3325010 - RNA, 16 nt, Mycobacterium tuberculosis H37Rv
caggaucgccugagcg

SEQ ID NO: 3325011 - RNA, 20 nt, Mycobacterium tuberculosis H37Rv
caggaucgccugagcgccgc

SEQ ID NO: 3325012 - RNA, 17 nt, Mycobacterium tuberculosis H37Rv
caggaucgcuacgucga

SEQ ID NO: 3325013 - RNA, 20 nt, Mycobacterium tuberculosis H37Rv
caggaucgcuacgucgaccg

SEQ ID NO: 3325014 - RNA, 20 nt, Mycobacterium tuberculosis H37Rv
caggaucggcuugggaaacc

SEQ ID NO: 3325015 - RNA, 13 nt, Mycobacterium tuberculosis H37Rv
caggaugaugacc

SEQ ID NO: 3325016 - RNA, 18 nt, Mycobacterium tuberculosis H37Rv
caggaugccugccacccg

SEQ ID NO: 3325017 - RNA, 21 nt, Mycobacterium tuberculosis H37Rv
caggauggccaucagcucgcc

SEQ ID NO: 3325018 - RNA, 18 nt, Mycobacterium tuberculosis H37Rv
caggaugguugcgacggc

SEQ ID NO: 3325019 - RNA, 16 nt, Mycobacterium tuberculosis H37Rv
caggauguucaauccc

SEQ ID NO: 3325020 - RNA, 16 nt, Mycobacterium tuberculosis H37Rv
caggauucccagucca

SEQ ID NO: 3325021 - RNA, 19 nt, Mycobacterium tuberculosis H37Rv
caggauucugcugaccaug

SEQ ID NO: 3325022 - RNA, 21 nt, Mycobacterium tuberculosis H37Rv
caggauucugcugaccaugac

SEQ ID NO: 3325023 - RNA, 19 nt, Mycobacterium tuberculosis H37Rv
caggauugccgccguugcc

SEQ ID NO: 3325024 - RNA, 15 nt, Mycobacterium tuberculosis H37Rv
caggcaaaccgauca

SEQ ID NO: 3325025 - RNA, 15 nt, Mycobacterium tuberculosis H37Rv
caggcaaccggucag

SEQ ID NO: 3325026 - RNA, 14 nt, Mycobacterium tuberculosis H37Rv
caggcacaacaucg

SEQ ID NO: 3325027 - RNA, 14 nt, Mycobacterium tuberculosis H37Rv
caggcacaacgcga

SEQ ID NO: 3325028 - RNA, 15 nt, Mycobacterium tuberculosis H37Rv
caggcaccacgaccg

SEQ ID NO: 3325029 - RNA, 17 nt, Mycobacterium tuberculosis H37Rv
caggcaccccgaucacc

SEQ ID NO: 3325030 - RNA, 19 nt, Mycobacterium tuberculosis H37Rv
caggcaccggaugaugugg

SEQ ID NO: 3325031 - RNA, 19 nt, Mycobacterium tuberculosis H37Rv
caggcacuccagcggcggg

SEQ ID NO: 3325032 - RNA, 20 nt, Mycobacterium tuberculosis H37Rv
caggcagcggcgacacaucg

SEQ ID NO: 3325033 - RNA, 13 nt, Mycobacterium tuberculosis H37Rv
caggcagcuccgc

SEQ ID NO: 3325034 - RNA, 18 nt, Mycobacterium tuberculosis H37Rv
caggcaguccaccgcgcg

SEQ ID NO: 3325035 - RNA, 13 nt, Mycobacterium tuberculosis H37Rv
caggcaucaccgg

SEQ ID NO: 3325036 - RNA, 14 nt, Mycobacterium tuberculosis H37Rv
caggcaucaccgga

SEQ ID NO: 3325037 - RNA, 13 nt, Mycobacterium tuberculosis H37Rv
caggcauggcgcc

SEQ ID NO: 3325038 - RNA, 19 nt, Mycobacterium tuberculosis H37Rv
caggcauucccgcggcaac

SEQ ID NO: 3325039 - RNA, 17 nt, Mycobacterium tuberculosis H37Rv
caggccaacggcgcugc

SEQ ID NO: 3325040 - RNA, 20 nt, Mycobacterium tuberculosis H37Rv
caggccaacuuggcggccag

SEQ ID NO: 3325041 - RNA, 21 nt, Mycobacterium tuberculosis H37Rv
caggccaacuuggcggccagc

SEQ ID NO: 3325042 - RNA, 23 nt, Mycobacterium tuberculosis H37Rv
caggccaccccgaccucccggca

SEQ ID NO: 3325043 - RNA, 20 nt, Mycobacterium tuberculosis H37Rv
caggccaccgcagacgccgu

SEQ ID NO: 3325044 - RNA, 17 nt, Mycobacterium tuberculosis H37Rv
caggccacgcaccgggu

SEQ ID NO: 3325045 - RNA, 22 nt, Mycobacterium tuberculosis H37Rv
caggccacucacguaauccucg

SEQ ID NO: 3325046 - RNA, 23 nt, Mycobacterium tuberculosis H37Rv
caggccacugccgaccagcgcgc

SEQ ID NO: 3325047 - RNA, 16 nt, Mycobacterium tuberculosis H37Rv
caggccagagccgccc

SEQ ID NO: 3325048 - RNA, 19 nt, Mycobacterium tuberculosis H37Rv
caggccagagccgcccuug

SEQ ID NO: 3325049 - RNA, 14 nt, Mycobacterium tuberculosis H37Rv
caggccagagucgc

SEQ ID NO: 3325050 - RNA, 23 nt, Mycobacterium tuberculosis H37Rv
caggccagaguuugcgaugccca

SEQ ID NO: 3325051 - RNA, 15 nt, Mycobacterium tuberculosis H37Rv
caggccagcaugucg

SEQ ID NO: 3325052 - RNA, 16 nt, Mycobacterium tuberculosis H37Rv
caggccagggugacca

SEQ ID NO: 3325053 - RNA, 18 nt, Mycobacterium tuberculosis H37Rv
caggccagggugaccagg

SEQ ID NO: 3325054 - RNA, 19 nt, Mycobacterium tuberculosis H37Rv
caggccagggugaccaggc

SEQ ID NO: 3325055 - RNA, 21 nt, Mycobacterium tuberculosis H37Rv
caggccagggugaccaggccg

SEQ ID NO: 3325056 - RNA, 16 nt, Mycobacterium tuberculosis H37Rv
caggccagugccaccu

SEQ ID NO: 3325057 - RNA, 13 nt, Mycobacterium tuberculosis H37Rv
caggcccacccgg

SEQ ID NO: 3325058 - RNA, 14 nt, Mycobacterium tuberculosis H37Rv
caggcccacccggg

SEQ ID NO: 3325059 - RNA, 17 nt, Mycobacterium tuberculosis H37Rv
caggcccacggcgacca

SEQ ID NO: 3325060 - RNA, 13 nt, Mycobacterium tuberculosis H37Rv
caggcccagcgga

SEQ ID NO: 3325061 - RNA, 17 nt, Mycobacterium tuberculosis H37Rv
caggcccauaccgaugg

SEQ ID NO: 3325062 - RNA, 18 nt, Mycobacterium tuberculosis H37Rv
caggcccauaccgauggu

SEQ ID NO: 3325063 - RNA, 19 nt, Mycobacterium tuberculosis H37Rv
caggcccauacgugccgcc

SEQ ID NO: 3325064 - RNA, 19 nt, Mycobacterium tuberculosis H37Rv
caggccccacaccuuggcg

SEQ ID NO: 3325065 - RNA, 22 nt, Mycobacterium tuberculosis H37Rv
caggccccacuggugcagcgcc

SEQ ID NO: 3325066 - RNA, 17 nt, Mycobacterium tuberculosis H37Rv
caggcccgacggcgccc

SEQ ID NO: 3325067 - RNA, 20 nt, Mycobacterium tuberculosis H37Rv
caggcccgccagcagggcca

SEQ ID NO: 3325068 - RNA, 17 nt, Mycobacterium tuberculosis H37Rv
caggcccggcaccgcgu

SEQ ID NO: 3325069 - RNA, 20 nt, Mycobacterium tuberculosis H37Rv
caggcccggcggugugcgca

SEQ ID NO: 3325070 - RNA, 20 nt, Mycobacterium tuberculosis H37Rv
caggcccgguucgaggaucc

SEQ ID NO: 3325071 - RNA, 18 nt, Mycobacterium tuberculosis H37Rv
caggcccgugccuggccg

SEQ ID NO: 3325072 - RNA, 20 nt, Mycobacterium tuberculosis H37Rv
caggcccgugccuggccggu

SEQ ID NO: 3325073 - RNA, 14 nt, Mycobacterium tuberculosis H37Rv
caggcccucgggac

SEQ ID NO: 3325074 - RNA, 16 nt, Mycobacterium tuberculosis H37Rv
caggcccugccgacgc

SEQ ID NO: 3325075 - RNA, 16 nt, Mycobacterium tuberculosis H37Rv
caggcccuggccaccc

SEQ ID NO: 3325076 - RNA, 17 nt, Mycobacterium tuberculosis H37Rv
caggcccuggccaccca

SEQ ID NO: 3325077 - RNA, 17 nt, Mycobacterium tuberculosis H37Rv
caggcccuuuucccugc

SEQ ID NO: 3325078 - RNA, 23 nt, Mycobacterium tuberculosis H37Rv
caggccgacaaugucggcgaugc

SEQ ID NO: 3325079 - RNA, 14 nt, Mycobacterium tuberculosis H37Rv
caggccgaccauaa

SEQ ID NO: 3325080 - RNA, 14 nt, Mycobacterium tuberculosis H37Rv
caggccgacgucga

SEQ ID NO: 3325081 - RNA, 14 nt, Mycobacterium tuberculosis H37Rv
caggccgagcagau

SEQ ID NO: 3325082 - RNA, 18 nt, Mycobacterium tuberculosis H37Rv
caggccgagcccggugcu

SEQ ID NO: 3325083 - RNA, 13 nt, Mycobacterium tuberculosis H37Rv
caggccgaggcga

SEQ ID NO: 3325084 - RNA, 19 nt, Mycobacterium tuberculosis H37Rv
caggccgaugacgaugccg

SEQ ID NO: 3325085 - RNA, 16 nt, Mycobacterium tuberculosis H37Rv
caggccgaugccgacc

SEQ ID NO: 3325086 - RNA, 18 nt, Mycobacterium tuberculosis H37Rv
caggccgaugcgggucuc

SEQ ID NO: 3325087 - RNA, 19 nt, Mycobacterium tuberculosis H37Rv
caggccgcaaugcguugac

SEQ ID NO: 3325088 - RNA, 13 nt, Mycobacterium tuberculosis H37Rv
caggccgcacagc

SEQ ID NO: 3325089 - RNA, 15 nt, Mycobacterium tuberculosis H37Rv
caggccgccuggggg

SEQ ID NO: 3325090 - RNA, 15 nt, Mycobacterium tuberculosis H37Rv
caggccgcgcgacaa

SEQ ID NO: 3325091 - RNA, 22 nt, Mycobacterium tuberculosis H37Rv
caggccgcgcgacaacccggcg

SEQ ID NO: 3325092 - RNA, 18 nt, Mycobacterium tuberculosis H37Rv
caggccgcgcgcaccggu

SEQ ID NO: 3325093 - RNA, 19 nt, Mycobacterium tuberculosis H37Rv
caggccgcgcgcaccggua

SEQ ID NO: 3325094 - RNA, 14 nt, Mycobacterium tuberculosis H37Rv
caggccgcgcggac

SEQ ID NO: 3325095 - RNA, 16 nt, Mycobacterium tuberculosis H37Rv
caggccgcgcucgucg

SEQ ID NO: 3325096 - RNA, 19 nt, Mycobacterium tuberculosis H37Rv
caggccgcuugccccgccu

SEQ ID NO: 3325097 - RNA, 17 nt, Mycobacterium tuberculosis H37Rv
caggccggcagcuugca

SEQ ID NO: 3325098 - RNA, 14 nt, Mycobacterium tuberculosis H37Rv
caggccggccacca

SEQ ID NO: 3325099 - RNA, 15 nt, Mycobacterium tuberculosis H37Rv
caggccggccaccag

SEQ ID NO: 3325100 - RNA, 17 nt, Mycobacterium tuberculosis H37Rv
caggccggcgucgauca

SEQ ID NO: 3325101 - RNA, 16 nt, Mycobacterium tuberculosis H37Rv
caggccgguaccggga

SEQ ID NO: 3325102 - RNA, 14 nt, Mycobacterium tuberculosis H37Rv
caggccggugacgg

SEQ ID NO: 3325103 - RNA, 15 nt, Mycobacterium tuberculosis H37Rv
caggccgguucccuu

SEQ ID NO: 3325104 - RNA, 23 nt, Mycobacterium tuberculosis H37Rv
caggccgguuugcacgcaccaca

SEQ ID NO: 3325105 - RNA, 18 nt, Mycobacterium tuberculosis H37Rv
caggccguagcccacgac

SEQ ID NO: 3325106 - RNA, 19 nt, Mycobacterium tuberculosis H37Rv
caggccguagcccacgacg

SEQ ID NO: 3325107 - RNA, 14 nt, Mycobacterium tuberculosis H37Rv
caggccguccucgg

SEQ ID NO: 3325108 - RNA, 23 nt, Mycobacterium tuberculosis H37Rv
caggccguccucggucagcucgu

SEQ ID NO: 3325109 - RNA, 19 nt, Mycobacterium tuberculosis H37Rv
caggccgucgaugaucugc

SEQ ID NO: 3325110 - RNA, 19 nt, Mycobacterium tuberculosis H37Rv
caggccguguacgugcucg

SEQ ID NO: 3325111 - RNA, 17 nt, Mycobacterium tuberculosis H37Rv
caggccguugccccguc

SEQ ID NO: 3325112 - RNA, 22 nt, Mycobacterium tuberculosis H37Rv
caggccguugcuauucgccagc

SEQ ID NO: 3325113 - RNA, 17 nt, Mycobacterium tuberculosis H37Rv
caggccuaggucgacgc

SEQ ID NO: 3325114 - RNA, 19 nt, Mycobacterium tuberculosis H37Rv
caggccuaguccggcacug

SEQ ID NO: 3325115 - RNA, 23 nt, Mycobacterium tuberculosis H37Rv
caggccuaguccggcacugcggc

SEQ ID NO: 3325116 - RNA, 15 nt, Mycobacterium tuberculosis H37Rv
caggccuccaagccc

SEQ ID NO: 3325117 - RNA, 21 nt, Mycobacterium tuberculosis H37Rv
caggccuccaagcccgccgga

SEQ ID NO: 3325118 - RNA, 20 nt, Mycobacterium tuberculosis H37Rv
caggccuccucuugggucca

SEQ ID NO: 3325119 - RNA, 17 nt, Mycobacterium tuberculosis H37Rv
caggccucgcaccggau

SEQ ID NO: 3325120 - RNA, 22 nt, Mycobacterium tuberculosis H37Rv
caggccucgcaccggauccacg

SEQ ID NO: 3325121 - RNA, 15 nt, Mycobacterium tuberculosis H37Rv
caggccucggcgccg

SEQ ID NO: 3325122 - RNA, 18 nt, Mycobacterium tuberculosis H37Rv
caggccucggcgccgccc

SEQ ID NO: 3325123 - RNA, 18 nt, Mycobacterium tuberculosis H37Rv
caggccuuuuggcgaacc

SEQ ID NO: 3325124 - RNA, 19 nt, Mycobacterium tuberculosis H37Rv
caggccuuuuggcgaaccg

SEQ ID NO: 3325125 - RNA, 20 nt, Mycobacterium tuberculosis H37Rv
caggccuuuuggcgaaccgc

SEQ ID NO: 3325126 - RNA, 15 nt, Mycobacterium tuberculosis H37Rv
caggcgaacaccaga

SEQ ID NO: 3325127 - RNA, 20 nt, Mycobacterium tuberculosis H37Rv
caggcgaacaccagauggcu

SEQ ID NO: 3325128 - RNA, 15 nt, Mycobacterium tuberculosis H37Rv
caggcgagccggcgc

SEQ ID NO: 3325129 - RNA, 16 nt, Mycobacterium tuberculosis H37Rv
caggcgagugaacucg

SEQ ID NO: 3325130 - RNA, 22 nt, Mycobacterium tuberculosis H37Rv
caggcgagugaacucguccuga

SEQ ID NO: 3325131 - RNA, 19 nt, Mycobacterium tuberculosis H37Rv
caggcgaguuaggccgcca

SEQ ID NO: 3325132 - RNA, 20 nt, Mycobacterium tuberculosis H37Rv
caggcgaguuaggccgccag

SEQ ID NO: 3325133 - RNA, 21 nt, Mycobacterium tuberculosis H37Rv
caggcgaucuggccgaacgac

SEQ ID NO: 3325134 - RNA, 23 nt, Mycobacterium tuberculosis H37Rv
caggcgauugcagcuucggccag

SEQ ID NO: 3325135 - RNA, 20 nt, Mycobacterium tuberculosis H37Rv
caggcgcaagguggcaugcg

SEQ ID NO: 3325136 - RNA, 14 nt, Mycobacterium tuberculosis H37Rv
caggcgcaccaggc

SEQ ID NO: 3325137 - RNA, 19 nt, Mycobacterium tuberculosis H37Rv
caggcgcagauuccucuuc

SEQ ID NO: 3325138 - RNA, 14 nt, Mycobacterium tuberculosis H37Rv
caggcgcauagggc

SEQ ID NO: 3325139 - RNA, 20 nt, Mycobacterium tuberculosis H37Rv
caggcgcauagggccaccgc

SEQ ID NO: 3325140 - RNA, 22 nt, Mycobacterium tuberculosis H37Rv
caggcgcauagggccaccgccg

SEQ ID NO: 3325141 - RNA, 23 nt, Mycobacterium tuberculosis H37Rv
caggcgcauagggccaccgccgc

SEQ ID NO: 3325142 - RNA, 15 nt, Mycobacterium tuberculosis H37Rv
caggcgcccacaaau

SEQ ID NO: 3325143 - RNA, 12 nt, Mycobacterium tuberculosis H37Rv
caggcgccgcua

SEQ ID NO: 3325144 - RNA, 15 nt, Mycobacterium tuberculosis H37Rv
caggcgccgucucgc

SEQ ID NO: 3325145 - RNA, 18 nt, Mycobacterium tuberculosis H37Rv
caggcgcgaucgcucauu

SEQ ID NO: 3325146 - RNA, 13 nt, Mycobacterium tuberculosis H37Rv
caggcgcgcacca

SEQ ID NO: 3325147 - RNA, 14 nt, Mycobacterium tuberculosis H37Rv
caggcgcgcaccac

SEQ ID NO: 3325148 - RNA, 15 nt, Mycobacterium tuberculosis H37Rv
caggcgcgcaccacc

SEQ ID NO: 3325149 - RNA, 14 nt, Mycobacterium tuberculosis H37Rv
caggcgcgccgcac

SEQ ID NO: 3325150 - RNA, 19 nt, Mycobacterium tuberculosis H37Rv
caggcgcucagcgcggcca

SEQ ID NO: 3325151 - RNA, 17 nt, Mycobacterium tuberculosis H37Rv
caggcgcucgaaggccg

SEQ ID NO: 3325152 - RNA, 22 nt, Mycobacterium tuberculosis H37Rv
caggcgcucgaaggccgcacuc

SEQ ID NO: 3325153 - RNA, 14 nt, Mycobacterium tuberculosis H37Rv
caggcgcugcagca

SEQ ID NO: 3325154 - RNA, 18 nt, Mycobacterium tuberculosis H37Rv
caggcgcugcagcauggc

SEQ ID NO: 3325155 - RNA, 20 nt, Mycobacterium tuberculosis H37Rv
caggcgcugcagcauggcuc

SEQ ID NO: 3325156 - RNA, 14 nt, Mycobacterium tuberculosis H37Rv
caggcggccgagcu

SEQ ID NO: 3325157 - RNA, 13 nt, Mycobacterium tuberculosis H37Rv
caggcggccgcca

SEQ ID NO: 3325158 - RNA, 21 nt, Mycobacterium tuberculosis H37Rv
caggcggccgccgggaaauau

SEQ ID NO: 3325159 - RNA, 14 nt, Mycobacterium tuberculosis H37Rv
caggcggccgucgu

SEQ ID NO: 3325160 - RNA, 15 nt, Mycobacterium tuberculosis H37Rv
caggcggccgucguc

SEQ ID NO: 3325161 - RNA, 15 nt, Mycobacterium tuberculosis H37Rv
caggcggcgaacugc

SEQ ID NO: 3325162 - RNA, 20 nt, Mycobacterium tuberculosis H37Rv
caggcggcucaaccucuggc

SEQ ID NO: 3325163 - RNA, 13 nt, Mycobacterium tuberculosis H37Rv
caggcggcuggcc

SEQ ID NO: 3325164 - RNA, 17 nt, Mycobacterium tuberculosis H37Rv
caggcggcuggcccgca

SEQ ID NO: 3325165 - RNA, 15 nt, Mycobacterium tuberculosis H37Rv
caggcgggaacgauc

SEQ ID NO: 3325166 - RNA, 16 nt, Mycobacterium tuberculosis H37Rv
caggcgggcaacgcag

SEQ ID NO: 3325167 - RNA, 16 nt, Mycobacterium tuberculosis H37Rv
caggcgggggaucggu

SEQ ID NO: 3325168 - RNA, 22 nt, Mycobacterium tuberculosis H37Rv
caggcgggggaucggugguacg

SEQ ID NO: 3325169 - RNA, 16 nt, Mycobacterium tuberculosis H37Rv
caggcggugacguggu

SEQ ID NO: 3325170 - RNA, 14 nt, Mycobacterium tuberculosis H37Rv
caggcguccaucag

SEQ ID NO: 3325171 - RNA, 23 nt, Mycobacterium tuberculosis H37Rv
caggcgucccagccgaucacggg

SEQ ID NO: 3325172 - RNA, 17 nt, Mycobacterium tuberculosis H37Rv
caggcgucccgcccgga

SEQ ID NO: 3325173 - RNA, 16 nt, Mycobacterium tuberculosis H37Rv
caggcgucggugaccu

SEQ ID NO: 3325174 - RNA, 19 nt, Mycobacterium tuberculosis H37Rv
caggcgucggugaccuucg

SEQ ID NO: 3325175 - RNA, 21 nt, Mycobacterium tuberculosis H37Rv
caggcgugcacaggucagcgc

SEQ ID NO: 3325176 - RNA, 23 nt, Mycobacterium tuberculosis H37Rv
caggcguuggaucccagcccgaa

SEQ ID NO: 3325177 - RNA, 21 nt, Mycobacterium tuberculosis H37Rv
caggcguuuggcgugccgucg

SEQ ID NO: 3325178 - RNA, 17 nt, Mycobacterium tuberculosis H37Rv
caggcuaaucagccagg

SEQ ID NO: 3325179 - RNA, 22 nt, Mycobacterium tuberculosis H37Rv
caggcucacacucggccgggcu

SEQ ID NO: 3325180 - RNA, 14 nt, Mycobacterium tuberculosis H37Rv
caggcucauccgcc

SEQ ID NO: 3325181 - RNA, 18 nt, Mycobacterium tuberculosis H37Rv
caggcucauccgccgggc

SEQ ID NO: 3325182 - RNA, 19 nt, Mycobacterium tuberculosis H37Rv
caggcucauccgccgggcc

SEQ ID NO: 3325183 - RNA, 15 nt, Mycobacterium tuberculosis H37Rv
caggcucgcaccgug

SEQ ID NO: 3325184 - RNA, 11 nt, Mycobacterium tuberculosis H37Rv
caggcucgccg

SEQ ID NO: 3325185 - RNA, 16 nt, Mycobacterium tuberculosis H37Rv
caggcucgccgaugcu

SEQ ID NO: 3325186 - RNA, 17 nt, Mycobacterium tuberculosis H37Rv
caggcugcagucgagca

SEQ ID NO: 3325187 - RNA, 22 nt, Mycobacterium tuberculosis H37Rv
caggcugcggcuuggccaucac

SEQ ID NO: 3325188 - RNA, 17 nt, Mycobacterium tuberculosis H37Rv
caggcuggcgauggccg

SEQ ID NO: 3325189 - RNA, 20 nt, Mycobacterium tuberculosis H37Rv
caggcugggcagaccgaucg

SEQ ID NO: 3325190 - RNA, 17 nt, Mycobacterium tuberculosis H37Rv
caggcugucaauccgcc

SEQ ID NO: 3325191 - RNA, 17 nt, Mycobacterium tuberculosis H37Rv
caggcuguccagcagcg

SEQ ID NO: 3325192 - RNA, 22 nt, Mycobacterium tuberculosis H37Rv
caggcugucgcgggccaccacc

SEQ ID NO: 3325193 - RNA, 18 nt, Mycobacterium tuberculosis H37Rv
caggcuguggccagcauc

SEQ ID NO: 3325194 - RNA, 13 nt, Mycobacterium tuberculosis H37Rv
caggcuuccagcc

SEQ ID NO: 3325195 - RNA, 14 nt, Mycobacterium tuberculosis H37Rv
caggcuucccugau

SEQ ID NO: 3325196 - RNA, 15 nt, Mycobacterium tuberculosis H37Rv
caggcuucccugauc

SEQ ID NO: 3325197 - RNA, 21 nt, Mycobacterium tuberculosis H37Rv
caggcuugacugcacaccacc

SEQ ID NO: 3325198 - RNA, 22 nt, Mycobacterium tuberculosis H37Rv
caggcuugacugcacaccaccg

SEQ ID NO: 3325199 - RNA, 18 nt, Mycobacterium tuberculosis H37Rv
cagggaaccauugcccga

SEQ ID NO: 3325200 - RNA, 14 nt, Mycobacterium tuberculosis H37Rv
cagggaagccugcg

SEQ ID NO: 3325201 - RNA, 19 nt, Mycobacterium tuberculosis H37Rv
cagggaagccugcgggccg

SEQ ID NO: 3325202 - RNA, 13 nt, Mycobacterium tuberculosis H37Rv
cagggacgaugcc

SEQ ID NO: 3325203 - RNA, 21 nt, Mycobacterium tuberculosis H37Rv
cagggagccguucaacgugga

SEQ ID NO: 3325204 - RNA, 15 nt, Mycobacterium tuberculosis H37Rv
cagggagcggcugca

SEQ ID NO: 3325205 - RNA, 15 nt, Mycobacterium tuberculosis H37Rv
cagggagugccgcac

SEQ ID NO: 3325206 - RNA, 22 nt, Mycobacterium tuberculosis H37Rv
cagggaucagccgugcgggccg

SEQ ID NO: 3325207 - RNA, 21 nt, Mycobacterium tuberculosis H37Rv
cagggaucgauuuggaucggc

SEQ ID NO: 3325208 - RNA, 16 nt, Mycobacterium tuberculosis H37Rv
cagggauucuggaugc

SEQ ID NO: 3325209 - RNA, 16 nt, Mycobacterium tuberculosis H37Rv
cagggcaacggccgcu

SEQ ID NO: 3325210 - RNA, 12 nt, Mycobacterium tuberculosis H37Rv
cagggcagcccg

SEQ ID NO: 3325211 - RNA, 20 nt, Mycobacterium tuberculosis H37Rv
cagggcagcccggcgaugag

SEQ ID NO: 3325212 - RNA, 14 nt, Mycobacterium tuberculosis H37Rv
cagggcagcggcca

SEQ ID NO: 3325213 - RNA, 17 nt, Mycobacterium tuberculosis H37Rv
cagggcagcggccaggg

SEQ ID NO: 3325214 - RNA, 17 nt, Mycobacterium tuberculosis H37Rv
cagggcaucagcagagc

SEQ ID NO: 3325215 - RNA, 14 nt, Mycobacterium tuberculosis H37Rv
cagggccaccacca

SEQ ID NO: 3325216 - RNA, 18 nt, Mycobacterium tuberculosis H37Rv
cagggccaccaccacggc

SEQ ID NO: 3325217 - RNA, 20 nt, Mycobacterium tuberculosis H37Rv
cagggccaccaccacggcca

SEQ ID NO: 3325218 - RNA, 21 nt, Mycobacterium tuberculosis H37Rv
cagggccaccaccacggccag

SEQ ID NO: 3325219 - RNA, 18 nt, Mycobacterium tuberculosis H37Rv
cagggccaccgcgccgua

SEQ ID NO: 3325220 - RNA, 17 nt, Mycobacterium tuberculosis H37Rv
cagggccacuggccggu

SEQ ID NO: 3325221 - RNA, 15 nt, Mycobacterium tuberculosis H37Rv
cagggccagaccgaa

SEQ ID NO: 3325222 - RNA, 15 nt, Mycobacterium tuberculosis H37Rv
cagggccagcggcag

SEQ ID NO: 3325223 - RNA, 16 nt, Mycobacterium tuberculosis H37Rv
cagggccgacgcgaac

SEQ ID NO: 3325224 - RNA, 12 nt, Mycobacterium tuberculosis H37Rv
cagggccgagca

SEQ ID NO: 3325225 - RNA, 22 nt, Mycobacterium tuberculosis H37Rv
cagggccgcaguggcaagcugu

SEQ ID NO: 3325226 - RNA, 19 nt, Mycobacterium tuberculosis H37Rv
cagggccgcucgccucgau

SEQ ID NO: 3325227 - RNA, 14 nt, Mycobacterium tuberculosis H37Rv
cagggccggcaccg

SEQ ID NO: 3325228 - RNA, 17 nt, Mycobacterium tuberculosis H37Rv
cagggccggcaccgcag

SEQ ID NO: 3325229 - RNA, 19 nt, Mycobacterium tuberculosis H37Rv
cagggccggcaccgcagcg

SEQ ID NO: 3325230 - RNA, 13 nt, Mycobacterium tuberculosis H37Rv
cagggccucaagg

SEQ ID NO: 3325231 - RNA, 15 nt, Mycobacterium tuberculosis H37Rv
cagggccuccacccg

SEQ ID NO: 3325232 - RNA, 16 nt, Mycobacterium tuberculosis H37Rv
cagggccuccacccgc

SEQ ID NO: 3325233 - RNA, 20 nt, Mycobacterium tuberculosis H37Rv
cagggccuccacccgccacg

SEQ ID NO: 3325234 - RNA, 18 nt, Mycobacterium tuberculosis H37Rv
cagggccucgaccgccag

SEQ ID NO: 3325235 - RNA, 22 nt, Mycobacterium tuberculosis H37Rv
cagggccuguucgagaucgccg

SEQ ID NO: 3325236 - RNA, 14 nt, Mycobacterium tuberculosis H37Rv
cagggcgacggcca

SEQ ID NO: 3325237 - RNA, 16 nt, Mycobacterium tuberculosis H37Rv
cagggcgaucugcgcg

SEQ ID NO: 3325238 - RNA, 18 nt, Mycobacterium tuberculosis H37Rv
cagggcgcaaaccacccg

SEQ ID NO: 3325239 - RNA, 15 nt, Mycobacterium tuberculosis H37Rv
cagggcgccgacgac

SEQ ID NO: 3325240 - RNA, 20 nt, Mycobacterium tuberculosis H37Rv
cagggcgcgcaucugcucgg

SEQ ID NO: 3325241 - RNA, 18 nt, Mycobacterium tuberculosis H37Rv
cagggcgcgucgacgcgg

SEQ ID NO: 3325242 - RNA, 18 nt, Mycobacterium tuberculosis H37Rv
cagggcggugcucuucgg

SEQ ID NO: 3325243 - RNA, 21 nt, Mycobacterium tuberculosis H37Rv
cagggcgguggccacccggcc

SEQ ID NO: 3325244 - RNA, 22 nt, Mycobacterium tuberculosis H37Rv
cagggcgucgaccgcggcccgg

SEQ ID NO: 3325245 - RNA, 14 nt, Mycobacterium tuberculosis H37Rv
cagggcgucgaccu

SEQ ID NO: 3325246 - RNA, 19 nt, Mycobacterium tuberculosis H37Rv
cagggcgucggcgacgucc

SEQ ID NO: 3325247 - RNA, 20 nt, Mycobacterium tuberculosis H37Rv
cagggcgucggcgacgucca

SEQ ID NO: 3325248 - RNA, 15 nt, Mycobacterium tuberculosis H37Rv
cagggcucgcucgcc

SEQ ID NO: 3325249 - RNA, 17 nt, Mycobacterium tuberculosis H37Rv
cagggcuucgugcacca

SEQ ID NO: 3325250 - RNA, 13 nt, Mycobacterium tuberculosis H37Rv
caggggacgacca

SEQ ID NO: 3325251 - RNA, 16 nt, Mycobacterium tuberculosis H37Rv
caggggaucaccggcu

SEQ ID NO: 3325252 - RNA, 13 nt, Mycobacterium tuberculosis H37Rv
caggggcagcgcg

SEQ ID NO: 3325253 - RNA, 17 nt, Mycobacterium tuberculosis H37Rv
caggggcagcgcggcca

SEQ ID NO: 3325254 - RNA, 20 nt, Mycobacterium tuberculosis H37Rv
caggggccagcgcgccacga

SEQ ID NO: 3325255 - RNA, 20 nt, Mycobacterium tuberculosis H37Rv
cagggggacccggaccuucg

SEQ ID NO: 3325256 - RNA, 19 nt, Mycobacterium tuberculosis H37Rv
cagggucaccugcgggccc

SEQ ID NO: 3325257 - RNA, 13 nt, Mycobacterium tuberculosis H37Rv
cagggucagcugg

SEQ ID NO: 3325258 - RNA, 20 nt, Mycobacterium tuberculosis H37Rv
cagggucagcugggacccga

SEQ ID NO: 3325259 - RNA, 20 nt, Mycobacterium tuberculosis H37Rv
cagggucccgccgccuggaa

SEQ ID NO: 3325260 - RNA, 17 nt, Mycobacterium tuberculosis H37Rv
cagggucgaguucgcag

SEQ ID NO: 3325261 - RNA, 21 nt, Mycobacterium tuberculosis H37Rv
cagggucgaguucgcagucga

SEQ ID NO: 3325262 - RNA, 23 nt, Mycobacterium tuberculosis H37Rv
cagggucgcgagcccgccacagc

SEQ ID NO: 3325263 - RNA, 17 nt, Mycobacterium tuberculosis H37Rv
cagggucugcgccgccg

SEQ ID NO: 3325264 - RNA, 14 nt, Mycobacterium tuberculosis H37Rv
cagggugacuucgc

SEQ ID NO: 3325265 - RNA, 21 nt, Mycobacterium tuberculosis H37Rv
cagggugacuucgcugcggug

SEQ ID NO: 3325266 - RNA, 17 nt, Mycobacterium tuberculosis H37Rv
cagggugcccucggccg

SEQ ID NO: 3325267 - RNA, 15 nt, Mycobacterium tuberculosis H37Rv
cagggugccggcgcc

SEQ ID NO: 3325268 - RNA, 20 nt, Mycobacterium tuberculosis H37Rv
cagggugccggcgccgcccu

SEQ ID NO: 3325269 - RNA, 14 nt, Mycobacterium tuberculosis H37Rv
cagggugccgucgg

SEQ ID NO: 3325270 - RNA, 17 nt, Mycobacterium tuberculosis H37Rv
cagggugcgccgcagca

SEQ ID NO: 3325271 - RNA, 20 nt, Mycobacterium tuberculosis H37Rv
cagggugcgccgcagcaggu

SEQ ID NO: 3325272 - RNA, 14 nt, Mycobacterium tuberculosis H37Rv
cagggugcgccggu

SEQ ID NO: 3325273 - RNA, 16 nt, Mycobacterium tuberculosis H37Rv
cagggugcgcuggccg

SEQ ID NO: 3325274 - RNA, 13 nt, Mycobacterium tuberculosis H37Rv
caggguggccagc

SEQ ID NO: 3325275 - RNA, 14 nt, Mycobacterium tuberculosis H37Rv
caggguggcgacgu

SEQ ID NO: 3325276 - RNA, 12 nt, Mycobacterium tuberculosis H37Rv
cagggugggcuu

SEQ ID NO: 3325277 - RNA, 19 nt, Mycobacterium tuberculosis H37Rv
caggguggggcgguggccg

SEQ ID NO: 3325278 - RNA, 20 nt, Mycobacterium tuberculosis H37Rv
caggguguauggccaccacg

SEQ ID NO: 3325279 - RNA, 18 nt, Mycobacterium tuberculosis H37Rv
cagggugugcgaacaagu

SEQ ID NO: 3325280 - RNA, 18 nt, Mycobacterium tuberculosis H37Rv
cagguaaccccgcacgag

SEQ ID NO: 3325281 - RNA, 17 nt, Mycobacterium tuberculosis H37Rv
cagguaagcagccagca

SEQ ID NO: 3325282 - RNA, 13 nt, Mycobacterium tuberculosis H37Rv
cagguaagccaca

SEQ ID NO: 3325283 - RNA, 15 nt, Mycobacterium tuberculosis H37Rv
cagguaagccacaua

SEQ ID NO: 3325284 - RNA, 17 nt, Mycobacterium tuberculosis H37Rv
cagguaauucguccacu

SEQ ID NO: 3325285 - RNA, 21 nt, Mycobacterium tuberculosis H37Rv
cagguaauugccgaccgccug

SEQ ID NO: 3325286 - RNA, 17 nt, Mycobacterium tuberculosis H37Rv
cagguaccaccgcggug

SEQ ID NO: 3325287 - RNA, 14 nt, Mycobacterium tuberculosis H37Rv
cagguacgccaggu

SEQ ID NO: 3325288 - RNA, 18 nt, Mycobacterium tuberculosis H37Rv
cagguacgcgaucagcgc

SEQ ID NO: 3325289 - RNA, 18 nt, Mycobacterium tuberculosis H37Rv
cagguacuuugcgcccgg

SEQ ID NO: 3325290 - RNA, 14 nt, Mycobacterium tuberculosis H37Rv
cagguaggucuggg

SEQ ID NO: 3325291 - RNA, 19 nt, Mycobacterium tuberculosis H37Rv
cagguagucgacgacgugg

SEQ ID NO: 3325292 - RNA, 16 nt, Mycobacterium tuberculosis H37Rv
cagguagucgccgguc

SEQ ID NO: 3325293 - RNA, 23 nt, Mycobacterium tuberculosis H37Rv
cagguagucgccggucaggcuca

SEQ ID NO: 3325294 - RNA, 23 nt, Mycobacterium tuberculosis H37Rv
cagguaucggggggucuugccga

SEQ ID NO: 3325295 - RNA, 20 nt, Mycobacterium tuberculosis H37Rv
cagguauuugccgugcucac

SEQ ID NO: 3325296 - RNA, 18 nt, Mycobacterium tuberculosis H37Rv
caggucagccgcgcgggu

SEQ ID NO: 3325297 - RNA, 17 nt, Mycobacterium tuberculosis H37Rv
caggucagcgcugccac

SEQ ID NO: 3325298 - RNA, 16 nt, Mycobacterium tuberculosis H37Rv
caggucauagccccgc

SEQ ID NO: 3325299 - RNA, 21 nt, Mycobacterium tuberculosis H37Rv
caggucaucggcuaucgcuag

SEQ ID NO: 3325300 - RNA, 13 nt, Mycobacterium tuberculosis H37Rv
cagguccaccccg

SEQ ID NO: 3325301 - RNA, 14 nt, Mycobacterium tuberculosis H37Rv
cagguccaccgcug

SEQ ID NO: 3325302 - RNA, 16 nt, Mycobacterium tuberculosis H37Rv
cagguccaccgcugcc

SEQ ID NO: 3325303 - RNA, 17 nt, Mycobacterium tuberculosis H37Rv
cagguccaccgcugccg

SEQ ID NO: 3325304 - RNA, 20 nt, Mycobacterium tuberculosis H37Rv
cagguccaccgcugccggca

SEQ ID NO: 3325305 - RNA, 23 nt, Mycobacterium tuberculosis H37Rv
cagguccaguaccuuggcgucga

SEQ ID NO: 3325306 - RNA, 15 nt, Mycobacterium tuberculosis H37Rv
cagguccgccaccgc

SEQ ID NO: 3325307 - RNA, 22 nt, Mycobacterium tuberculosis H37Rv
cagguccgccaccgcgagcaga

SEQ ID NO: 3325308 - RNA, 14 nt, Mycobacterium tuberculosis H37Rv
cagguccgccggug

SEQ ID NO: 3325309 - RNA, 22 nt, Mycobacterium tuberculosis H37Rv
cagguccugcgccgcacgccga

SEQ ID NO: 3325310 - RNA, 18 nt, Mycobacterium tuberculosis H37Rv
caggucgacaccgcggug

SEQ ID NO: 3325311 - RNA, 23 nt, Mycobacterium tuberculosis H37Rv
caggucgacaccgcggugccccg

SEQ ID NO: 3325312 - RNA, 21 nt, Mycobacterium tuberculosis H37Rv
caggucgacauaggccaccuc

SEQ ID NO: 3325313 - RNA, 16 nt, Mycobacterium tuberculosis H37Rv
caggucgacggccacg

SEQ ID NO: 3325314 - RNA, 16 nt, Mycobacterium tuberculosis H37Rv
caggucgacgggcacg

SEQ ID NO: 3325315 - RNA, 17 nt, Mycobacterium tuberculosis H37Rv
caggucgagcaccggcu

SEQ ID NO: 3325316 - RNA, 17 nt, Mycobacterium tuberculosis H37Rv
caggucgaugcgggcga

SEQ ID NO: 3325317 - RNA, 15 nt, Mycobacterium tuberculosis H37Rv
caggucgaugcugcc

SEQ ID NO: 3325318 - RNA, 22 nt, Mycobacterium tuberculosis H37Rv
caggucgaugcugccagccaug

SEQ ID NO: 3325319 - RNA, 23 nt, Mycobacterium tuberculosis H37Rv
caggucgaugcugccagccaugg

SEQ ID NO: 3325320 - RNA, 23 nt, Mycobacterium tuberculosis H37Rv
caggucgcagaccagacugcagu

SEQ ID NO: 3325321 - RNA, 19 nt, Mycobacterium tuberculosis H37Rv
caggucgcauucugcugcc

SEQ ID NO: 3325322 - RNA, 20 nt, Mycobacterium tuberculosis H37Rv
caggucgccuucccagccga

SEQ ID NO: 3325323 - RNA, 16 nt, Mycobacterium tuberculosis H37Rv
caggucggcauccucu

SEQ ID NO: 3325324 - RNA, 14 nt, Mycobacterium tuberculosis H37Rv
caggucggccaccg

SEQ ID NO: 3325325 - RNA, 23 nt, Mycobacterium tuberculosis H37Rv
caggucggccaccugcucgucgg

SEQ ID NO: 3325326 - RNA, 22 nt, Mycobacterium tuberculosis H37Rv
caggucggcccacggugucccg

SEQ ID NO: 3325327 - RNA, 16 nt, Mycobacterium tuberculosis H37Rv
caggucggccgccucg

SEQ ID NO: 3325328 - RNA, 23 nt, Mycobacterium tuberculosis H37Rv
caggucggcgaacaaccgccgcu

SEQ ID NO: 3325329 - RNA, 20 nt, Mycobacterium tuberculosis H37Rv
caggucggcggacgcgggug

SEQ ID NO: 3325330 - RNA, 19 nt, Mycobacterium tuberculosis H37Rv
caggucggcgggcgcgggu

SEQ ID NO: 3325331 - RNA, 14 nt, Mycobacterium tuberculosis H37Rv
caggucgggcagca

SEQ ID NO: 3325332 - RNA, 13 nt, Mycobacterium tuberculosis H37Rv
caggucggugacg

SEQ ID NO: 3325333 - RNA, 15 nt, Mycobacterium tuberculosis H37Rv
caggucggugacgaa

SEQ ID NO: 3325334 - RNA, 23 nt, Mycobacterium tuberculosis H37Rv
caggucggugacgaagagcaccg

SEQ ID NO: 3325335 - RNA, 17 nt, Mycobacterium tuberculosis H37Rv
caggucggugggcggcg

SEQ ID NO: 3325336 - RNA, 18 nt, Mycobacterium tuberculosis H37Rv
caggucggugggcggcga

SEQ ID NO: 3325337 - RNA, 21 nt, Mycobacterium tuberculosis H37Rv
caggucgguggucucgacggc

SEQ ID NO: 3325338 - RNA, 17 nt, Mycobacterium tuberculosis H37Rv
caggucgucacgccccu

SEQ ID NO: 3325339 - RNA, 20 nt, Mycobacterium tuberculosis H37Rv
caggucguccaucgcgucgu

SEQ ID NO: 3325340 - RNA, 17 nt, Mycobacterium tuberculosis H37Rv
caggucgucggcgucgc

SEQ ID NO: 3325341 - RNA, 15 nt, Mycobacterium tuberculosis H37Rv
caggucgugcccggg

SEQ ID NO: 3325342 - RNA, 15 nt, Mycobacterium tuberculosis H37Rv
caggucgugcuccca

SEQ ID NO: 3325343 - RNA, 19 nt, Mycobacterium tuberculosis H37Rv
caggucguuuacggcaagu

SEQ ID NO: 3325344 - RNA, 21 nt, Mycobacterium tuberculosis H37Rv
caggucuccaucaaccgcgcu

SEQ ID NO: 3325345 - RNA, 15 nt, Mycobacterium tuberculosis H37Rv
caggucuccuugggc

SEQ ID NO: 3325346 - RNA, 21 nt, Mycobacterium tuberculosis H37Rv
caggucucguaucgcacccgc

SEQ ID NO: 3325347 - RNA, 15 nt, Mycobacterium tuberculosis H37Rv
caggucuucaagcuc

SEQ ID NO: 3325348 - RNA, 19 nt, Mycobacterium tuberculosis H37Rv
caggucuucgauggccaug

SEQ ID NO: 3325349 - RNA, 15 nt, Mycobacterium tuberculosis H37Rv
caggugaacgccggu

SEQ ID NO: 3325350 - RNA, 23 nt, Mycobacterium tuberculosis H37Rv
caggugaacgccggugcgcugga

SEQ ID NO: 3325351 - RNA, 21 nt, Mycobacterium tuberculosis H37Rv
caggugaccaguaggcaagca

SEQ ID NO: 3325352 - RNA, 19 nt, Mycobacterium tuberculosis H37Rv
caggugaccuugaugccau

SEQ ID NO: 3325353 - RNA, 15 nt, Mycobacterium tuberculosis H37Rv
caggugacgcccgcu

SEQ ID NO: 3325354 - RNA, 22 nt, Mycobacterium tuberculosis H37Rv
caggugacguucgaugcccugg

SEQ ID NO: 3325355 - RNA, 17 nt, Mycobacterium tuberculosis H37Rv
caggugagaccagguuc

SEQ ID NO: 3325356 - RNA, 17 nt, Mycobacterium tuberculosis H37Rv
caggugagcgacgcuga

SEQ ID NO: 3325357 - RNA, 16 nt, Mycobacterium tuberculosis H37Rv
caggugagugcggcgu

SEQ ID NO: 3325358 - RNA, 16 nt, Mycobacterium tuberculosis H37Rv
caggugauucgcgcag

SEQ ID NO: 3325359 - RNA, 13 nt, Mycobacterium tuberculosis H37Rv
caggugcagcacc

SEQ ID NO: 3325360 - RNA, 19 nt, Mycobacterium tuberculosis H37Rv
caggugcagguugcccuca

SEQ ID NO: 3325361 - RNA, 17 nt, Mycobacterium tuberculosis H37Rv
caggugccagaccaggg

SEQ ID NO: 3325362 - RNA, 18 nt, Mycobacterium tuberculosis H37Rv
caggugccagaccagggc

SEQ ID NO: 3325363 - RNA, 19 nt, Mycobacterium tuberculosis H37Rv
caggugccagaccagggca

SEQ ID NO: 3325364 - RNA, 20 nt, Mycobacterium tuberculosis H37Rv
caggugccagaccagggcag

SEQ ID NO: 3325365 - RNA, 15 nt, Mycobacterium tuberculosis H37Rv
caggugccaggaugu

SEQ ID NO: 3325366 - RNA, 15 nt, Mycobacterium tuberculosis H37Rv
caggugcccaagcag

SEQ ID NO: 3325367 - RNA, 12 nt, Mycobacterium tuberculosis H37Rv
caggugcccggc

SEQ ID NO: 3325368 - RNA, 18 nt, Mycobacterium tuberculosis H37Rv
caggugcccggccaaaau

SEQ ID NO: 3325369 - RNA, 15 nt, Mycobacterium tuberculosis H37Rv
caggugccuucuucg

SEQ ID NO: 3325370 - RNA, 23 nt, Mycobacterium tuberculosis H37Rv
caggugcgccuggcuggccagcu

SEQ ID NO: 3325371 - RNA, 17 nt, Mycobacterium tuberculosis H37Rv
caggugcgcgaccagga

SEQ ID NO: 3325372 - RNA, 15 nt, Mycobacterium tuberculosis H37Rv
caggugcgggccggu

SEQ ID NO: 3325373 - RNA, 18 nt, Mycobacterium tuberculosis H37Rv
caggugcucagcuucgcg

SEQ ID NO: 3325374 - RNA, 14 nt, Mycobacterium tuberculosis H37Rv
caggugcugggcga

SEQ ID NO: 3325375 - RNA, 21 nt, Mycobacterium tuberculosis H37Rv
caggugcugggcgaggugagg

SEQ ID NO: 3325376 - RNA, 22 nt, Mycobacterium tuberculosis H37Rv
caggugcuguuugguugcgcca

SEQ ID NO: 3325377 - RNA, 16 nt, Mycobacterium tuberculosis H37Rv
cagguggccgcaucgc

SEQ ID NO: 3325378 - RNA, 18 nt, Mycobacterium tuberculosis H37Rv
cagguggccgcaucgccu

SEQ ID NO: 3325379 - RNA, 16 nt, Mycobacterium tuberculosis H37Rv
cagguggccgucgccg

SEQ ID NO: 3325380 - RNA, 17 nt, Mycobacterium tuberculosis H37Rv
caggugggccgagagca

SEQ ID NO: 3325381 - RNA, 18 nt, Mycobacterium tuberculosis H37Rv
caggugggccgagagcag

SEQ ID NO: 3325382 - RNA, 20 nt, Mycobacterium tuberculosis H37Rv
caggugggcguuggcgacga

SEQ ID NO: 3325383 - RNA, 22 nt, Mycobacterium tuberculosis H37Rv
caggugggcguuggcgacgaag

SEQ ID NO: 3325384 - RNA, 18 nt, Mycobacterium tuberculosis H37Rv
cagguggugacacgacgu

SEQ ID NO: 3325385 - RNA, 20 nt, Mycobacterium tuberculosis H37Rv
cagguguaggugccccacuc

SEQ ID NO: 3325386 - RNA, 22 nt, Mycobacterium tuberculosis H37Rv
cagguguccccgcccggccagc

SEQ ID NO: 3325387 - RNA, 20 nt, Mycobacterium tuberculosis H37Rv
cagguguuggacgccuugca

SEQ ID NO: 3325388 - RNA, 17 nt, Mycobacterium tuberculosis H37Rv
cagguuaggguccaggu

SEQ ID NO: 3325389 - RNA, 19 nt, Mycobacterium tuberculosis H37Rv
cagguucaaccccguugcg

SEQ ID NO: 3325390 - RNA, 17 nt, Mycobacterium tuberculosis H37Rv
cagguuccacgcguuga

SEQ ID NO: 3325391 - RNA, 20 nt, Mycobacterium tuberculosis H37Rv
cagguuccacgcguugacga

SEQ ID NO: 3325392 - RNA, 16 nt, Mycobacterium tuberculosis H37Rv
cagguuccacggccag

SEQ ID NO: 3325393 - RNA, 23 nt, Mycobacterium tuberculosis H37Rv
cagguuccgcacgaucagggaag

SEQ ID NO: 3325394 - RNA, 19 nt, Mycobacterium tuberculosis H37Rv
cagguucgagggugacccc

SEQ ID NO: 3325395 - RNA, 15 nt, Mycobacterium tuberculosis H37Rv
cagguucuucuccac

SEQ ID NO: 3325396 - RNA, 17 nt, Mycobacterium tuberculosis H37Rv
cagguucuucuccacca

SEQ ID NO: 3325397 - RNA, 21 nt, Mycobacterium tuberculosis H37Rv
cagguucuucuccaccaccgu

SEQ ID NO: 3325398 - RNA, 19 nt, Mycobacterium tuberculosis H37Rv
cagguucuugaccagcagc

SEQ ID NO: 3325399 - RNA, 22 nt, Mycobacterium tuberculosis H37Rv
cagguugaagaaugccgucuga

SEQ ID NO: 3325400 - RNA, 22 nt, Mycobacterium tuberculosis H37Rv
cagguugcccgguggaaugcca

SEQ ID NO: 3325401 - RNA, 20 nt, Mycobacterium tuberculosis H37Rv
cagguugccgagguugcgga

SEQ ID NO: 3325402 - RNA, 14 nt, Mycobacterium tuberculosis H37Rv
cagguugccgucgg

SEQ ID NO: 3325403 - RNA, 19 nt, Mycobacterium tuberculosis H37Rv
cagguugcguugcaggaaa

SEQ ID NO: 3325404 - RNA, 20 nt, Mycobacterium tuberculosis H37Rv
cagguugcguugcaggaaag

SEQ ID NO: 3325405 - RNA, 14 nt, Mycobacterium tuberculosis H37Rv
cagguuggcaagca

SEQ ID NO: 3325406 - RNA, 16 nt, Mycobacterium tuberculosis H37Rv
cagguuggcacgcugu

SEQ ID NO: 3325407 - RNA, 15 nt, Mycobacterium tuberculosis H37Rv
cagguuggccaccgc

SEQ ID NO: 3325408 - RNA, 15 nt, Mycobacterium tuberculosis H37Rv
cagguuggccccggc

SEQ ID NO: 3325409 - RNA, 17 nt, Mycobacterium tuberculosis H37Rv
cagguuggccccggccc

SEQ ID NO: 3325410 - RNA, 18 nt, Mycobacterium tuberculosis H37Rv
cagguuggcggcugcacg

SEQ ID NO: 3325411 - RNA, 17 nt, Mycobacterium tuberculosis H37Rv
cagguuggucaccaccu

SEQ ID NO: 3325412 - RNA, 19 nt, Mycobacterium tuberculosis H37Rv
cagguuggugcucagcggc

SEQ ID NO: 3325413 - RNA, 17 nt, Mycobacterium tuberculosis H37Rv
cagguuguagacggcac

SEQ ID NO: 3325414 - RNA, 18 nt, Mycobacterium tuberculosis H37Rv
cagguugucggcgaucaa

SEQ ID NO: 3325415 - RNA, 19 nt, Mycobacterium tuberculosis H37Rv
cagguugucggcgaucaac

SEQ ID NO: 3325416 - RNA, 17 nt, Mycobacterium tuberculosis H37Rv
cagguuuccggccugca

SEQ ID NO: 3325417 - RNA, 21 nt, Mycobacterium tuberculosis H37Rv
cagguuugcgccgcgcagcga

SEQ ID NO: 3325418 - RNA, 19 nt, Mycobacterium tuberculosis H37Rv
cagguuuugccgcguacga

SEQ ID NO: 3325419 - RNA, 23 nt, Mycobacterium tuberculosis H37Rv
caguacgaucucauccuccugcg

SEQ ID NO: 3325420 - RNA, 13 nt, Mycobacterium tuberculosis H37Rv
caguacgcgcuga

SEQ ID NO: 3325421 - RNA, 21 nt, Mycobacterium tuberculosis H37Rv
caguacgcgcugagcgacugc

SEQ ID NO: 3325422 - RNA, 16 nt, Mycobacterium tuberculosis H37Rv
caguacggugguaaga

SEQ ID NO: 3325423 - RNA, 23 nt, Mycobacterium tuberculosis H37Rv
caguacuaacaacaccaccagca

SEQ ID NO: 3325424 - RNA, 21 nt, Mycobacterium tuberculosis H37Rv
caguagaucgccucgacgcgg

SEQ ID NO: 3325425 - RNA, 20 nt, Mycobacterium tuberculosis H37Rv
caguagcacguugacgucca

SEQ ID NO: 3325426 - RNA, 14 nt, Mycobacterium tuberculosis H37Rv
caguagccacgccc

SEQ ID NO: 3325427 - RNA, 22 nt, Mycobacterium tuberculosis H37Rv
caguagcuguggcccgcgguga

SEQ ID NO: 3325428 - RNA, 16 nt, Mycobacterium tuberculosis H37Rv
caguaggccuccgcug

SEQ ID NO: 3325429 - RNA, 19 nt, Mycobacterium tuberculosis H37Rv
caguaggccuccgcugccg

SEQ ID NO: 3325430 - RNA, 21 nt, Mycobacterium tuberculosis H37Rv
caguaguagcgcaaccgcgcu

SEQ ID NO: 3325431 - RNA, 18 nt, Mycobacterium tuberculosis H37Rv
caguauggccgccaccgc

SEQ ID NO: 3325432 - RNA, 15 nt, Mycobacterium tuberculosis H37Rv
cagucaacagggcca

SEQ ID NO: 3325433 - RNA, 19 nt, Mycobacterium tuberculosis H37Rv
cagucaacucccgaacacu

SEQ ID NO: 3325434 - RNA, 18 nt, Mycobacterium tuberculosis H37Rv
cagucacgcccaccacug

SEQ ID NO: 3325435 - RNA, 16 nt, Mycobacterium tuberculosis H37Rv
cagucacggaccgcuu

SEQ ID NO: 3325436 - RNA, 13 nt, Mycobacterium tuberculosis H37Rv
cagucaggaaacc

SEQ ID NO: 3325437 - RNA, 21 nt, Mycobacterium tuberculosis H37Rv
cagucaggccuagcgcggcga

SEQ ID NO: 3325438 - RNA, 23 nt, Mycobacterium tuberculosis H37Rv
cagucaggccuagcgcggcgacg

SEQ ID NO: 3325439 - RNA, 15 nt, Mycobacterium tuberculosis H37Rv
caguccaagcuguca

SEQ ID NO: 3325440 - RNA, 19 nt, Mycobacterium tuberculosis H37Rv
caguccaaucuucucgagc

SEQ ID NO: 3325441 - RNA, 22 nt, Mycobacterium tuberculosis H37Rv
caguccaaucuucucgagccgc

SEQ ID NO: 3325442 - RNA, 18 nt, Mycobacterium tuberculosis H37Rv
caguccaccgcgcggcgc

SEQ ID NO: 3325443 - RNA, 15 nt, Mycobacterium tuberculosis H37Rv
caguccagcgggcau

SEQ ID NO: 3325444 - RNA, 15 nt, Mycobacterium tuberculosis H37Rv
caguccaucgacagg

SEQ ID NO: 3325445 - RNA, 22 nt, Mycobacterium tuberculosis H37Rv
cagucccaagggcaacagugaa

SEQ ID NO: 3325446 - RNA, 15 nt, Mycobacterium tuberculosis H37Rv
cagucccaguucguu

SEQ ID NO: 3325447 - RNA, 14 nt, Mycobacterium tuberculosis H37Rv
cagucccggcgcac

SEQ ID NO: 3325448 - RNA, 17 nt, Mycobacterium tuberculosis H37Rv
caguccgaaagccgccg

SEQ ID NO: 3325449 - RNA, 18 nt, Mycobacterium tuberculosis H37Rv
caguccgaagcugcugcu

SEQ ID NO: 3325450 - RNA, 16 nt, Mycobacterium tuberculosis H37Rv
caguccgacaccggcg

SEQ ID NO: 3325451 - RNA, 14 nt, Mycobacterium tuberculosis H37Rv
caguccgaucgccg

SEQ ID NO: 3325452 - RNA, 15 nt, Mycobacterium tuberculosis H37Rv
caguccgaucgccga

SEQ ID NO: 3325453 - RNA, 22 nt, Mycobacterium tuberculosis H37Rv
caguccgaugggaaucagugaa

SEQ ID NO: 3325454 - RNA, 15 nt, Mycobacterium tuberculosis H37Rv
caguccgcagcgucc

SEQ ID NO: 3325455 - RNA, 13 nt, Mycobacterium tuberculosis H37Rv
caguccgcuggcc

SEQ ID NO: 3325456 - RNA, 21 nt, Mycobacterium tuberculosis H37Rv
caguccggcguucccgccauu

SEQ ID NO: 3325457 - RNA, 21 nt, Mycobacterium tuberculosis H37Rv
caguccggggcgcaggucguc

SEQ ID NO: 3325458 - RNA, 15 nt, Mycobacterium tuberculosis H37Rv
caguccguccagguc

SEQ ID NO: 3325459 - RNA, 16 nt, Mycobacterium tuberculosis H37Rv
caguccucaucgagcg

SEQ ID NO: 3325460 - RNA, 14 nt, Mycobacterium tuberculosis H37Rv
caguccucgggcag

SEQ ID NO: 3325461 - RNA, 15 nt, Mycobacterium tuberculosis H37Rv
cagucgaagaagacc

SEQ ID NO: 3325462 - RNA, 15 nt, Mycobacterium tuberculosis H37Rv
cagucgacaauuccc

SEQ ID NO: 3325463 - RNA, 22 nt, Mycobacterium tuberculosis H37Rv
cagucgaccggacacuccugca

SEQ ID NO: 3325464 - RNA, 19 nt, Mycobacterium tuberculosis H37Rv
cagucgagcaucucgucgg

SEQ ID NO: 3325465 - RNA, 20 nt, Mycobacterium tuberculosis H37Rv
cagucgagugaagccgacau

SEQ ID NO: 3325466 - RNA, 15 nt, Mycobacterium tuberculosis H37Rv
cagucgaugagugac

SEQ ID NO: 3325467 - RNA, 12 nt, Mycobacterium tuberculosis H37Rv
cagucgcgcgcu

SEQ ID NO: 3325468 - RNA, 18 nt, Mycobacterium tuberculosis H37Rv
cagucgcgcgcucgcggc

SEQ ID NO: 3325469 - RNA, 12 nt, Mycobacterium tuberculosis H37Rv
cagucgcggcgc

SEQ ID NO: 3325470 - RNA, 17 nt, Mycobacterium tuberculosis H37Rv
cagucgcggcguucggc

SEQ ID NO: 3325471 - RNA, 19 nt, Mycobacterium tuberculosis H37Rv
cagucgcuaaagcccccga

SEQ ID NO: 3325472 - RNA, 13 nt, Mycobacterium tuberculosis H37Rv
cagucgcucucgg

SEQ ID NO: 3325473 - RNA, 14 nt, Mycobacterium tuberculosis H37Rv
cagucgcugggugg

SEQ ID NO: 3325474 - RNA, 14 nt, Mycobacterium tuberculosis H37Rv
cagucggcgccgcc

SEQ ID NO: 3325475 - RNA, 14 nt, Mycobacterium tuberculosis H37Rv
cagucgggcagcgc

SEQ ID NO: 3325476 - RNA, 20 nt, Mycobacterium tuberculosis H37Rv
cagucguacucccaggccgc

SEQ ID NO: 3325477 - RNA, 14 nt, Mycobacterium tuberculosis H37Rv
cagucgugggcugu

SEQ ID NO: 3325478 - RNA, 17 nt, Mycobacterium tuberculosis H37Rv
cagucgugggcugugcg

SEQ ID NO: 3325479 - RNA, 14 nt, Mycobacterium tuberculosis H37Rv
cagucugcgacugg

SEQ ID NO: 3325480 - RNA, 15 nt, Mycobacterium tuberculosis H37Rv
cagucugggcgaucg

SEQ ID NO: 3325481 - RNA, 22 nt, Mycobacterium tuberculosis H37Rv
cagucugggcgaucgcuucgca

SEQ ID NO: 3325482 - RNA, 22 nt, Mycobacterium tuberculosis H37Rv
cagucuuguugcuuugcuggcg

SEQ ID NO: 3325483 - RNA, 17 nt, Mycobacterium tuberculosis H37Rv
cagugaaaccaccggcc

SEQ ID NO: 3325484 - RNA, 23 nt, Mycobacterium tuberculosis H37Rv
cagugaaauugccgccgccggga

SEQ ID NO: 3325485 - RNA, 14 nt, Mycobacterium tuberculosis H37Rv
cagugaacauuggg

SEQ ID NO: 3325486 - RNA, 17 nt, Mycobacterium tuberculosis H37Rv
cagugaagacaccaggc

SEQ ID NO: 3325487 - RNA, 22 nt, Mycobacterium tuberculosis H37Rv
cagugaagacaccaggcccggu

SEQ ID NO: 3325488 - RNA, 17 nt, Mycobacterium tuberculosis H37Rv
cagugacagugcgucga

SEQ ID NO: 3325489 - RNA, 15 nt, Mycobacterium tuberculosis H37Rv
cagugaccgcagucc

SEQ ID NO: 3325490 - RNA, 19 nt, Mycobacterium tuberculosis H37Rv
cagugaccgcagucccagc

SEQ ID NO: 3325491 - RNA, 16 nt, Mycobacterium tuberculosis H37Rv
cagugaccgcuggugu

SEQ ID NO: 3325492 - RNA, 15 nt, Mycobacterium tuberculosis H37Rv
cagugaccugggcgc

SEQ ID NO: 3325493 - RNA, 14 nt, Mycobacterium tuberculosis H37Rv
cagugacgccacga

SEQ ID NO: 3325494 - RNA, 16 nt, Mycobacterium tuberculosis H37Rv
cagugacucgaucacc

SEQ ID NO: 3325495 - RNA, 15 nt, Mycobacterium tuberculosis H37Rv
cagugagcaugcgac

SEQ ID NO: 3325496 - RNA, 16 nt, Mycobacterium tuberculosis H37Rv
cagugaucaccaaccc

SEQ ID NO: 3325497 - RNA, 16 nt, Mycobacterium tuberculosis H37Rv
cagugcaccgcgucgu

SEQ ID NO: 3325498 - RNA, 17 nt, Mycobacterium tuberculosis H37Rv
cagugcagcgaucccgg

SEQ ID NO: 3325499 - RNA, 18 nt, Mycobacterium tuberculosis H37Rv
cagugcaucgaucaccgc

SEQ ID NO: 3325500 - RNA, 17 nt, Mycobacterium tuberculosis H37Rv
cagugccaauuccagcc

SEQ ID NO: 3325501 - RNA, 19 nt, Mycobacterium tuberculosis H37Rv
cagugccaauuccagcccc

SEQ ID NO: 3325502 - RNA, 20 nt, Mycobacterium tuberculosis H37Rv
cagugccagaacccggacag

SEQ ID NO: 3325503 - RNA, 20 nt, Mycobacterium tuberculosis H37Rv
cagugccagugccagcgucc

SEQ ID NO: 3325504 - RNA, 17 nt, Mycobacterium tuberculosis H37Rv
cagugccccgcagcacu

SEQ ID NO: 3325505 - RNA, 19 nt, Mycobacterium tuberculosis H37Rv
cagugccccgccgagcggu

SEQ ID NO: 3325506 - RNA, 22 nt, Mycobacterium tuberculosis H37Rv
cagugccgcacccagaccgccg

SEQ ID NO: 3325507 - RNA, 20 nt, Mycobacterium tuberculosis H37Rv
cagugccguguccagcaugc

SEQ ID NO: 3325508 - RNA, 14 nt, Mycobacterium tuberculosis H37Rv
cagugccucggcga

SEQ ID NO: 3325509 - RNA, 17 nt, Mycobacterium tuberculosis H37Rv
cagugccucggcgaugg

SEQ ID NO: 3325510 - RNA, 23 nt, Mycobacterium tuberculosis H37Rv
cagugcgaacucaucgugguaac

SEQ ID NO: 3325511 - RNA, 15 nt, Mycobacterium tuberculosis H37Rv
cagugcgcaacccag

SEQ ID NO: 3325512 - RNA, 21 nt, Mycobacterium tuberculosis H37Rv
cagugcgcaacccagccgcgc

SEQ ID NO: 3325513 - RNA, 23 nt, Mycobacterium tuberculosis H37Rv
cagugcgcaacccagccgcgcca

SEQ ID NO: 3325514 - RNA, 15 nt, Mycobacterium tuberculosis H37Rv
cagugcgcagaacac

SEQ ID NO: 3325515 - RNA, 18 nt, Mycobacterium tuberculosis H37Rv
cagugcgcggaucaacag

SEQ ID NO: 3325516 - RNA, 23 nt, Mycobacterium tuberculosis H37Rv
cagugcgcggaucaacaggccgg

SEQ ID NO: 3325517 - RNA, 16 nt, Mycobacterium tuberculosis H37Rv
cagugcgcgugcccgu

SEQ ID NO: 3325518 - RNA, 14 nt, Mycobacterium tuberculosis H37Rv
cagugcggccuugg

SEQ ID NO: 3325519 - RNA, 17 nt, Mycobacterium tuberculosis H37Rv
cagugcggccuuggcga

SEQ ID NO: 3325520 - RNA, 15 nt, Mycobacterium tuberculosis H37Rv
cagugcucgcccagu

SEQ ID NO: 3325521 - RNA, 14 nt, Mycobacterium tuberculosis H37Rv
caguggauccggca

SEQ ID NO: 3325522 - RNA, 21 nt, Mycobacterium tuberculosis H37Rv
caguggcaacagcaacggcag

SEQ ID NO: 3325523 - RNA, 23 nt, Mycobacterium tuberculosis H37Rv
caguggcaacagcaacggcagcg

SEQ ID NO: 3325524 - RNA, 13 nt, Mycobacterium tuberculosis H37Rv
caguggcagcccg

SEQ ID NO: 3325525 - RNA, 19 nt, Mycobacterium tuberculosis H37Rv
caguggcgcccauggccac

SEQ ID NO: 3325526 - RNA, 18 nt, Mycobacterium tuberculosis H37Rv
cagugggacaggucggca

SEQ ID NO: 3325527 - RNA, 15 nt, Mycobacterium tuberculosis H37Rv
cagugggacgggcgc

SEQ ID NO: 3325528 - RNA, 17 nt, Mycobacterium tuberculosis H37Rv
cagugggacuggcguga

SEQ ID NO: 3325529 - RNA, 21 nt, Mycobacterium tuberculosis H37Rv
caguggucccggugaugaccg

SEQ ID NO: 3325530 - RNA, 20 nt, Mycobacterium tuberculosis H37Rv
caguggucgauuucggcgcg

SEQ ID NO: 3325531 - RNA, 23 nt, Mycobacterium tuberculosis H37Rv
caguggugucggaaugggcgcca

SEQ ID NO: 3325532 - RNA, 20 nt, Mycobacterium tuberculosis H37Rv
cagugucagcacgacgacaa

SEQ ID NO: 3325533 - RNA, 18 nt, Mycobacterium tuberculosis H37Rv
cagugucgauagcccgcc

SEQ ID NO: 3325534 - RNA, 22 nt, Mycobacterium tuberculosis H37Rv
cagugugcgguuggaucggcgg

SEQ ID NO: 3325535 - RNA, 23 nt, Mycobacterium tuberculosis H37Rv
cagugugcgguuggaucggcggc

SEQ ID NO: 3325536 - RNA, 14 nt, Mycobacterium tuberculosis H37Rv
caguguggcgauga

SEQ ID NO: 3325537 - RNA, 16 nt, Mycobacterium tuberculosis H37Rv
cagugugggggucagg

SEQ ID NO: 3325538 - RNA, 21 nt, Mycobacterium tuberculosis H37Rv
caguguugcgcugcggccagc

SEQ ID NO: 3325539 - RNA, 22 nt, Mycobacterium tuberculosis H37Rv
caguguugcgcugcggccagcg

SEQ ID NO: 3325540 - RNA, 14 nt, Mycobacterium tuberculosis H37Rv
caguuaaagguggu

SEQ ID NO: 3325541 - RNA, 18 nt, Mycobacterium tuberculosis H37Rv
caguucacgcucgacgac

SEQ ID NO: 3325542 - RNA, 15 nt, Mycobacterium tuberculosis H37Rv
caguucacguucggc

SEQ ID NO: 3325543 - RNA, 17 nt, Mycobacterium tuberculosis H37Rv
caguucaucgggcacca

SEQ ID NO: 3325544 - RNA, 20 nt, Mycobacterium tuberculosis H37Rv
caguuccacccggugccgca

SEQ ID NO: 3325545 - RNA, 13 nt, Mycobacterium tuberculosis H37Rv
caguuccaccgcg

SEQ ID NO: 3325546 - RNA, 15 nt, Mycobacterium tuberculosis H37Rv
caguuccaccgcgca

SEQ ID NO: 3325547 - RNA, 14 nt, Mycobacterium tuberculosis H37Rv
caguuccagcucgc

SEQ ID NO: 3325548 - RNA, 16 nt, Mycobacterium tuberculosis H37Rv
caguuccagcucgcgg

SEQ ID NO: 3325549 - RNA, 17 nt, Mycobacterium tuberculosis H37Rv
caguucccagaccaccg

SEQ ID NO: 3325550 - RNA, 15 nt, Mycobacterium tuberculosis H37Rv
caguuccccgggcuc

SEQ ID NO: 3325551 - RNA, 16 nt, Mycobacterium tuberculosis H37Rv
caguucccuacaccca

SEQ ID NO: 3325552 - RNA, 21 nt, Mycobacterium tuberculosis H37Rv
caguuccgcggcgaguggcuc

SEQ ID NO: 3325553 - RNA, 22 nt, Mycobacterium tuberculosis H37Rv
caguuccgcugcggugccggcc

SEQ ID NO: 3325554 - RNA, 17 nt, Mycobacterium tuberculosis H37Rv
caguuccggugacggca

SEQ ID NO: 3325555 - RNA, 21 nt, Mycobacterium tuberculosis H37Rv
caguucgacauaaccggccga

SEQ ID NO: 3325556 - RNA, 17 nt, Mycobacterium tuberculosis H37Rv
caguucgacggcgucaa

SEQ ID NO: 3325557 - RNA, 15 nt, Mycobacterium tuberculosis H37Rv
caguucgccggaucg

SEQ ID NO: 3325558 - RNA, 15 nt, Mycobacterium tuberculosis H37Rv
caguucgcgccacgc

SEQ ID NO: 3325559 - RNA, 21 nt, Mycobacterium tuberculosis H37Rv
caguucggccuugaucgugcu

SEQ ID NO: 3325560 - RNA, 15 nt, Mycobacterium tuberculosis H37Rv
caguucggcgaugcg

SEQ ID NO: 3325561 - RNA, 20 nt, Mycobacterium tuberculosis H37Rv
caguucggcgaugcgcgggu

SEQ ID NO: 3325562 - RNA, 18 nt, Mycobacterium tuberculosis H37Rv
caguucggcggccgccgc

SEQ ID NO: 3325563 - RNA, 16 nt, Mycobacterium tuberculosis H37Rv
caguucguggcuggca

SEQ ID NO: 3325564 - RNA, 12 nt, Mycobacterium tuberculosis H37Rv
caguugacccau

SEQ ID NO: 3325565 - RNA, 16 nt, Mycobacterium tuberculosis H37Rv
caguugauccugcagu

SEQ ID NO: 3325566 - RNA, 20 nt, Mycobacterium tuberculosis H37Rv
caguugcacaccgaucggca

SEQ ID NO: 3325567 - RNA, 16 nt, Mycobacterium tuberculosis H37Rv
caguugcacaccggca

SEQ ID NO: 3325568 - RNA, 21 nt, Mycobacterium tuberculosis H37Rv
caguugcguuguccaccauca

SEQ ID NO: 3325569 - RNA, 17 nt, Mycobacterium tuberculosis H37Rv
caguuggaacugaugaa

SEQ ID NO: 3325570 - RNA, 17 nt, Mycobacterium tuberculosis H37Rv
caguuggaacugcccga

SEQ ID NO: 3325571 - RNA, 16 nt, Mycobacterium tuberculosis H37Rv
caguuggcaccagccg

SEQ ID NO: 3325572 - RNA, 17 nt, Mycobacterium tuberculosis H37Rv
caguuggcaccagccgg

SEQ ID NO: 3325573 - RNA, 20 nt, Mycobacterium tuberculosis H37Rv
caguuggcaccagccgguga

SEQ ID NO: 3325574 - RNA, 20 nt, Mycobacterium tuberculosis H37Rv
caguugucuggucauggccg

SEQ ID NO: 3325575 - RNA, 15 nt, Mycobacterium tuberculosis H37Rv
caguugugcggccag

SEQ ID NO: 3325576 - RNA, 16 nt, Mycobacterium tuberculosis H37Rv
caguuugugccgccgc

SEQ ID NO: 3325577 - RNA, 19 nt, Mycobacterium tuberculosis H37Rv
cauaaaccucgccggugac

SEQ ID NO: 3325578 - RNA, 19 nt, Mycobacterium tuberculosis H37Rv
cauaaagaucagcaugguc

SEQ ID NO: 3325579 - RNA, 12 nt, Mycobacterium tuberculosis H37Rv
cauaacagcugg

SEQ ID NO: 3325580 - RNA, 16 nt, Mycobacterium tuberculosis H37Rv
cauaaccggcgcgccc

SEQ ID NO: 3325581 - RNA, 13 nt, Mycobacterium tuberculosis H37Rv
cauaaccgguggg

SEQ ID NO: 3325582 - RNA, 18 nt, Mycobacterium tuberculosis H37Rv
cauaacgcgaacccgcga

SEQ ID NO: 3325583 - RNA, 15 nt, Mycobacterium tuberculosis H37Rv
cauaacugcggccca

SEQ ID NO: 3325584 - RNA, 20 nt, Mycobacterium tuberculosis H37Rv
cauaagcccccgacacgccg

SEQ ID NO: 3325585 - RNA, 18 nt, Mycobacterium tuberculosis H37Rv
cauaagcucguagagcac

SEQ ID NO: 3325586 - RNA, 21 nt, Mycobacterium tuberculosis H37Rv
cauaaggaaugauggccagca

SEQ ID NO: 3325587 - RNA, 16 nt, Mycobacterium tuberculosis H37Rv
cauaagugaacagcag

SEQ ID NO: 3325588 - RNA, 23 nt, Mycobacterium tuberculosis H37Rv
cauacaacuggugggccaucguc

SEQ ID NO: 3325589 - RNA, 16 nt, Mycobacterium tuberculosis H37Rv
cauacagcaugucgcg

SEQ ID NO: 3325590 - RNA, 21 nt, Mycobacterium tuberculosis H37Rv
cauacagcgggcgcuguaguc

SEQ ID NO: 3325591 - RNA, 20 nt, Mycobacterium tuberculosis H37Rv
cauacaucgccuugcccagc

SEQ ID NO: 3325592 - RNA, 17 nt, Mycobacterium tuberculosis H37Rv
cauacccgcgcgcacca

SEQ ID NO: 3325593 - RNA, 13 nt, Mycobacterium tuberculosis H37Rv
cauaccgccgcug

SEQ ID NO: 3325594 - RNA, 16 nt, Mycobacterium tuberculosis H37Rv
cauaccgccgcugcca

SEQ ID NO: 3325595 - RNA, 18 nt, Mycobacterium tuberculosis H37Rv
cauaccggccgccaucau

SEQ ID NO: 3325596 - RNA, 18 nt, Mycobacterium tuberculosis H37Rv
cauaccggcuggccaggu

SEQ ID NO: 3325597 - RNA, 17 nt, Mycobacterium tuberculosis H37Rv
cauaccguucacccagc

SEQ ID NO: 3325598 - RNA, 11 nt, Mycobacterium tuberculosis H37Rv
cauaccugaau

SEQ ID NO: 3325599 - RNA, 17 nt, Mycobacterium tuberculosis H37Rv
cauaccuuccagaucgc

SEQ ID NO: 3325600 - RNA, 20 nt, Mycobacterium tuberculosis H37Rv
cauacgagcagugaccgcug

SEQ ID NO: 3325601 - RNA, 18 nt, Mycobacterium tuberculosis H37Rv
cauacgcccacuccagca

SEQ ID NO: 3325602 - RNA, 19 nt, Mycobacterium tuberculosis H37Rv
cauacgcccacuccagcag

SEQ ID NO: 3325603 - RNA, 20 nt, Mycobacterium tuberculosis H37Rv
cauacgcccacuccagcagc

SEQ ID NO: 3325604 - RNA, 20 nt, Mycobacterium tuberculosis H37Rv
cauacgcgcugacccgccac

SEQ ID NO: 3325605 - RNA, 19 nt, Mycobacterium tuberculosis H37Rv
cauacgcgugugcgcgugc

SEQ ID NO: 3325606 - RNA, 21 nt, Mycobacterium tuberculosis H37Rv
cauacgucggggccgcacugu

SEQ ID NO: 3325607 - RNA, 12 nt, Mycobacterium tuberculosis H37Rv
cauacucggcgg

SEQ ID NO: 3325608 - RNA, 19 nt, Mycobacterium tuberculosis H37Rv
cauacucugcgacaccacg

SEQ ID NO: 3325609 - RNA, 17 nt, Mycobacterium tuberculosis H37Rv
cauagaacucgccgcug

SEQ ID NO: 3325610 - RNA, 16 nt, Mycobacterium tuberculosis H37Rv
cauagacagggccgcu

SEQ ID NO: 3325611 - RNA, 17 nt, Mycobacterium tuberculosis H37Rv
cauagauacagucgacc

SEQ ID NO: 3325612 - RNA, 15 nt, Mycobacterium tuberculosis H37Rv
cauagccgaacagcg

SEQ ID NO: 3325613 - RNA, 17 nt, Mycobacterium tuberculosis H37Rv
cauagccgaacagcgga

SEQ ID NO: 3325614 - RNA, 15 nt, Mycobacterium tuberculosis H37Rv
cauagccgcgacccg

SEQ ID NO: 3325615 - RNA, 16 nt, Mycobacterium tuberculosis H37Rv
cauagccgcgcucgaa

SEQ ID NO: 3325616 - RNA, 17 nt, Mycobacterium tuberculosis H37Rv
cauagcgccgcgcccac

SEQ ID NO: 3325617 - RNA, 22 nt, Mycobacterium tuberculosis H37Rv
cauagcucaacggaaccgauac

SEQ ID NO: 3325618 - RNA, 18 nt, Mycobacterium tuberculosis H37Rv
cauagcugccggcccacc

SEQ ID NO: 3325619 - RNA, 18 nt, Mycobacterium tuberculosis H37Rv
cauaggacaggaacggcc

SEQ ID NO: 3325620 - RNA, 18 nt, Mycobacterium tuberculosis H37Rv
cauaggccgacggguugg

SEQ ID NO: 3325621 - RNA, 16 nt, Mycobacterium tuberculosis H37Rv
cauaggccugcagccg

SEQ ID NO: 3325622 - RNA, 17 nt, Mycobacterium tuberculosis H37Rv
cauaggcgcugaacgcg

SEQ ID NO: 3325623 - RNA, 16 nt, Mycobacterium tuberculosis H37Rv
cauaggcuuccggcgc

SEQ ID NO: 3325624 - RNA, 16 nt, Mycobacterium tuberculosis H37Rv
cauaggugcggggccg

SEQ ID NO: 3325625 - RNA, 22 nt, Mycobacterium tuberculosis H37Rv
cauagguuugggcacggaacgc

SEQ ID NO: 3325626 - RNA, 20 nt, Mycobacterium tuberculosis H37Rv
cauagugaggccgaccagca

SEQ ID NO: 3325627 - RNA, 21 nt, Mycobacterium tuberculosis H37Rv
cauagugcggcaccgccgccc

SEQ ID NO: 3325628 - RNA, 16 nt, Mycobacterium tuberculosis H37Rv
cauagugcggcugcaa

SEQ ID NO: 3325629 - RNA, 16 nt, Mycobacterium tuberculosis H37Rv
cauaguuggcgcccga

SEQ ID NO: 3325630 - RNA, 23 nt, Mycobacterium tuberculosis H37Rv
cauaguuggcgcccgaagccggg

SEQ ID NO: 3325631 - RNA, 13 nt, Mycobacterium tuberculosis H37Rv
cauauagaucacu

SEQ ID NO: 3325632 - RNA, 21 nt, Mycobacterium tuberculosis H37Rv
cauauagaucacugcucgucg

SEQ ID NO: 3325633 - RNA, 13 nt, Mycobacterium tuberculosis H37Rv
cauaucaaccccg

SEQ ID NO: 3325634 - RNA, 17 nt, Mycobacterium tuberculosis H37Rv
cauauccgccccagcug

SEQ ID NO: 3325635 - RNA, 18 nt, Mycobacterium tuberculosis H37Rv
cauauccgccccagcugc

SEQ ID NO: 3325636 - RNA, 16 nt, Mycobacterium tuberculosis H37Rv
cauaucgcagcguugg

SEQ ID NO: 3325637 - RNA, 23 nt, Mycobacterium tuberculosis H37Rv
cauaucgugaugugcccauucau

SEQ ID NO: 3325638 - RNA, 22 nt, Mycobacterium tuberculosis H37Rv
caucaaaaacgaacccaggcac

SEQ ID NO: 3325639 - RNA, 14 nt, Mycobacterium tuberculosis H37Rv
caucaacgacacca

SEQ ID NO: 3325640 - RNA, 16 nt, Mycobacterium tuberculosis H37Rv
caucaacgacaccaga

SEQ ID NO: 3325641 - RNA, 19 nt, Mycobacterium tuberculosis H37Rv
caucaacgccacgaugacc

SEQ ID NO: 3325642 - RNA, 19 nt, Mycobacterium tuberculosis H37Rv
caucaacgccggcgacggc

SEQ ID NO: 3325643 - RNA, 16 nt, Mycobacterium tuberculosis H37Rv
caucaacgcgggcgcu

SEQ ID NO: 3325644 - RNA, 18 nt, Mycobacterium tuberculosis H37Rv
caucaaggacucggacgc

SEQ ID NO: 3325645 - RNA, 14 nt, Mycobacterium tuberculosis H37Rv
caucaaggccaccu

SEQ ID NO: 3325646 - RNA, 14 nt, Mycobacterium tuberculosis H37Rv
caucacauccacgc

SEQ ID NO: 3325647 - RNA, 15 nt, Mycobacterium tuberculosis H37Rv
caucacauccacgca

SEQ ID NO: 3325648 - RNA, 21 nt, Mycobacterium tuberculosis H37Rv
caucaccaccgaccuggacgc

SEQ ID NO: 3325649 - RNA, 15 nt, Mycobacterium tuberculosis H37Rv
caucaccaccggcac

SEQ ID NO: 3325650 - RNA, 17 nt, Mycobacterium tuberculosis H37Rv
caucaccaccggcaccg

SEQ ID NO: 3325651 - RNA, 15 nt, Mycobacterium tuberculosis H37Rv
caucaccacuggacc

SEQ ID NO: 3325652 - RNA, 20 nt, Mycobacterium tuberculosis H37Rv
caucaccacuggacccgccc

SEQ ID NO: 3325653 - RNA, 22 nt, Mycobacterium tuberculosis H37Rv
caucaccacuggacccgcccag

SEQ ID NO: 3325654 - RNA, 11 nt, Mycobacterium tuberculosis H37Rv
caucaccagcg

SEQ ID NO: 3325655 - RNA, 18 nt, Mycobacterium tuberculosis H37Rv
caucaccgacgcgucggc

SEQ ID NO: 3325656 - RNA, 15 nt, Mycobacterium tuberculosis H37Rv
caucaccgcagcacc

SEQ ID NO: 3325657 - RNA, 22 nt, Mycobacterium tuberculosis H37Rv
caucaccgcagcaccggagaac

SEQ ID NO: 3325658 - RNA, 20 nt, Mycobacterium tuberculosis H37Rv
caucaccgccagccccgcgc

SEQ ID NO: 3325659 - RNA, 21 nt, Mycobacterium tuberculosis H37Rv
caucaccggcaugcgugccgg

SEQ ID NO: 3325660 - RNA, 14 nt, Mycobacterium tuberculosis H37Rv
caucaccgucgccc

SEQ ID NO: 3325661 - RNA, 14 nt, Mycobacterium tuberculosis H37Rv
caucacgcccacga

SEQ ID NO: 3325662 - RNA, 11 nt, Mycobacterium tuberculosis H37Rv
caucacgcccu

SEQ ID NO: 3325663 - RNA, 22 nt, Mycobacterium tuberculosis H37Rv
caucacgccgccggaggugaca

SEQ ID NO: 3325664 - RNA, 16 nt, Mycobacterium tuberculosis H37Rv
caucacggcggggauc

SEQ ID NO: 3325665 - RNA, 22 nt, Mycobacterium tuberculosis H37Rv
caucacggcggggaucgcuggc

SEQ ID NO: 3325666 - RNA, 23 nt, Mycobacterium tuberculosis H37Rv
caucacggcggggaucgcuggcc

SEQ ID NO: 3325667 - RNA, 15 nt, Mycobacterium tuberculosis H37Rv
caucacgggacgacg

SEQ ID NO: 3325668 - RNA, 12 nt, Mycobacterium tuberculosis H37Rv
caucacggucag

SEQ ID NO: 3325669 - RNA, 20 nt, Mycobacterium tuberculosis H37Rv
caucacggucagcucgcuga

SEQ ID NO: 3325670 - RNA, 19 nt, Mycobacterium tuberculosis H37Rv
caucacgguggccgcacga

SEQ ID NO: 3325671 - RNA, 16 nt, Mycobacterium tuberculosis H37Rv
caucagaaucaggcuc

SEQ ID NO: 3325672 - RNA, 18 nt, Mycobacterium tuberculosis H37Rv
caucagaaugccuggccc

SEQ ID NO: 3325673 - RNA, 23 nt, Mycobacterium tuberculosis H37Rv
caucagaccaaugaccgccagca

SEQ ID NO: 3325674 - RNA, 14 nt, Mycobacterium tuberculosis H37Rv
caucagcagagccc

SEQ ID NO: 3325675 - RNA, 16 nt, Mycobacterium tuberculosis H37Rv
caucagcagagccccg

SEQ ID NO: 3325676 - RNA, 14 nt, Mycobacterium tuberculosis H37Rv
caucagcccucggc

SEQ ID NO: 3325677 - RNA, 12 nt, Mycobacterium tuberculosis H37Rv
caucagccgcac

SEQ ID NO: 3325678 - RNA, 15 nt, Mycobacterium tuberculosis H37Rv
caucagccgcugcgu

SEQ ID NO: 3325679 - RNA, 19 nt, Mycobacterium tuberculosis H37Rv
caucagcggcgccaguaug

SEQ ID NO: 3325680 - RNA, 18 nt, Mycobacterium tuberculosis H37Rv
caucagcucgaugccgug

SEQ ID NO: 3325681 - RNA, 19 nt, Mycobacterium tuberculosis H37Rv
caucagcucgccagggucg

SEQ ID NO: 3325682 - RNA, 18 nt, Mycobacterium tuberculosis H37Rv
caucagggccuuggcggg

SEQ ID NO: 3325683 - RNA, 23 nt, Mycobacterium tuberculosis H37Rv
caucaggucgguggucucgacgg

SEQ ID NO: 3325684 - RNA, 18 nt, Mycobacterium tuberculosis H37Rv
caucaggucgucguccug

SEQ ID NO: 3325685 - RNA, 16 nt, Mycobacterium tuberculosis H37Rv
caucagguuguacagg

SEQ ID NO: 3325686 - RNA, 22 nt, Mycobacterium tuberculosis H37Rv
caucaguugcacaccgaucggc

SEQ ID NO: 3325687 - RNA, 17 nt, Mycobacterium tuberculosis H37Rv
caucaucgcccugggcg

SEQ ID NO: 3325688 - RNA, 18 nt, Mycobacterium tuberculosis H37Rv
caucaucggaaccguuug

SEQ ID NO: 3325689 - RNA, 21 nt, Mycobacterium tuberculosis H37Rv
caucaucuuugcguacaacgc

SEQ ID NO: 3325690 - RNA, 20 nt, Mycobacterium tuberculosis H37Rv
caucauggccggaucccagu

SEQ ID NO: 3325691 - RNA, 14 nt, Mycobacterium tuberculosis H37Rv
caucaugucggcgc

SEQ ID NO: 3325692 - RNA, 15 nt, Mycobacterium tuberculosis H37Rv
caucaugucggcgca

SEQ ID NO: 3325693 - RNA, 20 nt, Mycobacterium tuberculosis H37Rv
caucaugucggcgcaggcgu

SEQ ID NO: 3325694 - RNA, 17 nt, Mycobacterium tuberculosis H37Rv
caucauguggucaacgg

SEQ ID NO: 3325695 - RNA, 21 nt, Mycobacterium tuberculosis H37Rv
cauccaacgaccuccacgccc

SEQ ID NO: 3325696 - RNA, 23 nt, Mycobacterium tuberculosis H37Rv
cauccaacgcggcgcgagccugc

SEQ ID NO: 3325697 - RNA, 13 nt, Mycobacterium tuberculosis H37Rv
cauccacaccgac

SEQ ID NO: 3325698 - RNA, 18 nt, Mycobacterium tuberculosis H37Rv
cauccacaccgcggcggc

SEQ ID NO: 3325699 - RNA, 13 nt, Mycobacterium tuberculosis H37Rv
cauccaccgaugg

SEQ ID NO: 3325700 - RNA, 18 nt, Mycobacterium tuberculosis H37Rv
cauccacgcacucacuac

SEQ ID NO: 3325701 - RNA, 16 nt, Mycobacterium tuberculosis H37Rv
cauccacuccgccaac

SEQ ID NO: 3325702 - RNA, 22 nt, Mycobacterium tuberculosis H37Rv
cauccagaucggauugccuccg

SEQ ID NO: 3325703 - RNA, 15 nt, Mycobacterium tuberculosis H37Rv
cauccagcagcgccu

SEQ ID NO: 3325704 - RNA, 13 nt, Mycobacterium tuberculosis H37Rv
cauccagccagca

SEQ ID NO: 3325705 - RNA, 14 nt, Mycobacterium tuberculosis H37Rv
cauccagccgugcg

SEQ ID NO: 3325706 - RNA, 20 nt, Mycobacterium tuberculosis H37Rv
cauccagcgcgcgcugagcc

SEQ ID NO: 3325707 - RNA, 21 nt, Mycobacterium tuberculosis H37Rv
cauccaggcugucgcgggcca

SEQ ID NO: 3325708 - RNA, 23 nt, Mycobacterium tuberculosis H37Rv
cauccaggggcgcaacucaucgu

SEQ ID NO: 3325709 - RNA, 17 nt, Mycobacterium tuberculosis H37Rv
cauccaguaaccguccg

SEQ ID NO: 3325710 - RNA, 18 nt, Mycobacterium tuberculosis H37Rv
cauccauucggcggcggc

SEQ ID NO: 3325711 - RNA, 22 nt, Mycobacterium tuberculosis H37Rv
caucccaacgagaugugagcac

SEQ ID NO: 3325712 - RNA, 22 nt, Mycobacterium tuberculosis H37Rv
caucccagcgaaugcugacaug

SEQ ID NO: 3325713 - RNA, 14 nt, Mycobacterium tuberculosis H37Rv
caucgccagcgccg

SEQ ID NO: 3325714 - RNA, 19 nt, Mycobacterium tuberculosis H37Rv
caucgccagcgccggccag

SEQ ID NO: 3325715 - RNA, 16 nt, Mycobacterium tuberculosis H37Rv
caucgcccaccgcaac

SEQ ID NO: 3325716 - RNA, 14 nt, Mycobacterium tuberculosis H37Rv
caucgcccgaugcg

SEQ ID NO: 3325717 - RNA, 20 nt, Mycobacterium tuberculosis H37Rv
caucgcccggaaccggcgug

SEQ ID NO: 3325718 - RNA, 17 nt, Mycobacterium tuberculosis H37Rv
caucgccgacagcgccu

SEQ ID NO: 3325719 - RNA, 15 nt, Mycobacterium tuberculosis H37Rv
caucgccgacccgcc

SEQ ID NO: 3325720 - RNA, 17 nt, Mycobacterium tuberculosis H37Rv
caucgccgccaaccacu

SEQ ID NO: 3325721 - RNA, 21 nt, Mycobacterium tuberculosis H37Rv
caucgccgcccgagcacccca

SEQ ID NO: 3325722 - RNA, 14 nt, Mycobacterium tuberculosis H37Rv
caucgccgccguug

SEQ ID NO: 3325723 - RNA, 17 nt, Mycobacterium tuberculosis H37Rv
caucgccgcuaccguca

SEQ ID NO: 3325724 - RNA, 15 nt, Mycobacterium tuberculosis H37Rv
caucgccgcuggcca

SEQ ID NO: 3325725 - RNA, 15 nt, Mycobacterium tuberculosis H37Rv
caucgccggcgucga

SEQ ID NO: 3325726 - RNA, 23 nt, Mycobacterium tuberculosis H37Rv
caucgccggcgucgacccugccc

SEQ ID NO: 3325727 - RNA, 20 nt, Mycobacterium tuberculosis H37Rv
caucgccggguagcuguaca

SEQ ID NO: 3325728 - RNA, 14 nt, Mycobacterium tuberculosis H37Rv
caucgccuccucga

SEQ ID NO: 3325729 - RNA, 12 nt, Mycobacterium tuberculosis H37Rv
caucgccucgag

SEQ ID NO: 3325730 - RNA, 20 nt, Mycobacterium tuberculosis H37Rv
caucgccucgaggaccacca

SEQ ID NO: 3325731 - RNA, 20 nt, Mycobacterium tuberculosis H37Rv
caucgccucggcgcugcgca

SEQ ID NO: 3325732 - RNA, 15 nt, Mycobacterium tuberculosis H37Rv
caucgccuugcccag

SEQ ID NO: 3325733 - RNA, 17 nt, Mycobacterium tuberculosis H37Rv
caucgccuugcccagcg

SEQ ID NO: 3325734 - RNA, 22 nt, Mycobacterium tuberculosis H37Rv
caucgcgaaaccggaccugacc

SEQ ID NO: 3325735 - RNA, 23 nt, Mycobacterium tuberculosis H37Rv
caucgcgacuagacgccgccgcu

SEQ ID NO: 3325736 - RNA, 19 nt, Mycobacterium tuberculosis H37Rv
caucgcgagccagcugcuc

SEQ ID NO: 3325737 - RNA, 19 nt, Mycobacterium tuberculosis H37Rv
caucgcgauuccggcggcc

SEQ ID NO: 3325738 - RNA, 20 nt, Mycobacterium tuberculosis H37Rv
caucgcgauuccggcggcca

SEQ ID NO: 3325739 - RNA, 22 nt, Mycobacterium tuberculosis H37Rv
caucgcgcaaccgggcggacag

SEQ ID NO: 3325740 - RNA, 14 nt, Mycobacterium tuberculosis H37Rv
caucgcgcggacca

SEQ ID NO: 3325741 - RNA, 17 nt, Mycobacterium tuberculosis H37Rv
caucgcgcggaccagag

SEQ ID NO: 3325742 - RNA, 12 nt, Mycobacterium tuberculosis H37Rv
caucgcgcggcu

SEQ ID NO: 3325743 - RNA, 13 nt, Mycobacterium tuberculosis H37Rv
caucgcggcgacg

SEQ ID NO: 3325744 - RNA, 17 nt, Mycobacterium tuberculosis H37Rv
caucgcggcgacgucgu

SEQ ID NO: 3325745 - RNA, 13 nt, Mycobacterium tuberculosis H37Rv
caucgcggcggcg

SEQ ID NO: 3325746 - RNA, 17 nt, Mycobacterium tuberculosis H37Rv
caucgcgggcggcgcug

SEQ ID NO: 3325747 - RNA, 19 nt, Mycobacterium tuberculosis H37Rv
caucgcgggcggcgcuggc

SEQ ID NO: 3325748 - RNA, 21 nt, Mycobacterium tuberculosis H37Rv
caucgcgggcgugccgaccag

SEQ ID NO: 3325749 - RNA, 22 nt, Mycobacterium tuberculosis H37Rv
caucgcgggcgugccgaccagc

SEQ ID NO: 3325750 - RNA, 16 nt, Mycobacterium tuberculosis H37Rv
caucgcgucggcgaug

SEQ ID NO: 3325751 - RNA, 19 nt, Mycobacterium tuberculosis H37Rv
caucgcgucgucuucuucg

SEQ ID NO: 3325752 - RNA, 16 nt, Mycobacterium tuberculosis H37Rv
caucgcuggucgaugg

SEQ ID NO: 3325753 - RNA, 21 nt, Mycobacterium tuberculosis H37Rv
caucgcuguaggcagccucuc

SEQ ID NO: 3325754 - RNA, 16 nt, Mycobacterium tuberculosis H37Rv
caucggaacgugaccg

SEQ ID NO: 3325755 - RNA, 20 nt, Mycobacterium tuberculosis H37Rv
caucggagauacgggccacc

SEQ ID NO: 3325756 - RNA, 22 nt, Mycobacterium tuberculosis H37Rv
caucggaugaccagugaucagc

SEQ ID NO: 3325757 - RNA, 14 nt, Mycobacterium tuberculosis H37Rv
caucggauggcccc

SEQ ID NO: 3325758 - RNA, 16 nt, Mycobacterium tuberculosis H37Rv
caucggcaccgucucg

SEQ ID NO: 3325759 - RNA, 14 nt, Mycobacterium tuberculosis H37Rv
caucggcagcagga

SEQ ID NO: 3325760 - RNA, 23 nt, Mycobacterium tuberculosis H37Rv
caucggcauccgcggggagucga

SEQ ID NO: 3325761 - RNA, 18 nt, Mycobacterium tuberculosis H37Rv
caucggcaucgacugcca

SEQ ID NO: 3325762 - RNA, 19 nt, Mycobacterium tuberculosis H37Rv
caucggcaucgacugccag

SEQ ID NO: 3325763 - RNA, 20 nt, Mycobacterium tuberculosis H37Rv
caucggccaccuguuggcau

SEQ ID NO: 3325764 - RNA, 12 nt, Mycobacterium tuberculosis H37Rv
caucggccagca

SEQ ID NO: 3325765 - RNA, 22 nt, Mycobacterium tuberculosis H37Rv
caucggccgcggucggccacca

SEQ ID NO: 3325766 - RNA, 16 nt, Mycobacterium tuberculosis H37Rv
caucggccggcgucag

SEQ ID NO: 3325767 - RNA, 23 nt, Mycobacterium tuberculosis H37Rv
caucggccggcgucagccccgac

SEQ ID NO: 3325768 - RNA, 19 nt, Mycobacterium tuberculosis H37Rv
caucggccucugaccagcc

SEQ ID NO: 3325769 - RNA, 15 nt, Mycobacterium tuberculosis H37Rv
caucggcgaacaacc

SEQ ID NO: 3325770 - RNA, 18 nt, Mycobacterium tuberculosis H37Rv
caucggcgacaggagacg

SEQ ID NO: 3325771 - RNA, 16 nt, Mycobacterium tuberculosis H37Rv
caucggcgaccgccug

SEQ ID NO: 3325772 - RNA, 17 nt, Mycobacterium tuberculosis H37Rv
caucggcgaccgccugc

SEQ ID NO: 3325773 - RNA, 13 nt, Mycobacterium tuberculosis H37Rv
caucggcgccaau

SEQ ID NO: 3325774 - RNA, 16 nt, Mycobacterium tuberculosis H37Rv
caucggcggccugcuc

SEQ ID NO: 3325775 - RNA, 14 nt, Mycobacterium tuberculosis H37Rv
caucggcggcgucg

SEQ ID NO: 3325776 - RNA, 21 nt, Mycobacterium tuberculosis H37Rv
caucggcggcgucgacgucca

SEQ ID NO: 3325777 - RNA, 21 nt, Mycobacterium tuberculosis H37Rv
caucggcuggccgcgccucgg

SEQ ID NO: 3325778 - RNA, 23 nt, Mycobacterium tuberculosis H37Rv
caucggcuggccgcgccucgguc

SEQ ID NO: 3325779 - RNA, 15 nt, Mycobacterium tuberculosis H37Rv
caucgggaccgggga

SEQ ID NO: 3325780 - RNA, 17 nt, Mycobacterium tuberculosis H37Rv
caucgggaccggggacg

SEQ ID NO: 3325781 - RNA, 20 nt, Mycobacterium tuberculosis H37Rv
caucgggaccggggacgcgc

SEQ ID NO: 3325782 - RNA, 14 nt, Mycobacterium tuberculosis H37Rv
caucgggagccgca

SEQ ID NO: 3325783 - RNA, 19 nt, Mycobacterium tuberculosis H37Rv
caucgggaugcggacucag

SEQ ID NO: 3325784 - RNA, 19 nt, Mycobacterium tuberculosis H37Rv
caucgggcgagcucgucga

SEQ ID NO: 3325785 - RNA, 13 nt, Mycobacterium tuberculosis H37Rv
caucgggcgccca

SEQ ID NO: 3325786 - RNA, 14 nt, Mycobacterium tuberculosis H37Rv
caucgggcggcacc

SEQ ID NO: 3325787 - RNA, 19 nt, Mycobacterium tuberculosis H37Rv
caucggguggcgaggcagc

SEQ ID NO: 3325788 - RNA, 16 nt, Mycobacterium tuberculosis H37Rv
caucggucagcgccga

SEQ ID NO: 3325789 - RNA, 18 nt, Mycobacterium tuberculosis H37Rv
caucggucagcgccgacu

SEQ ID NO: 3325790 - RNA, 22 nt, Mycobacterium tuberculosis H37Rv
caucggucagcgggcacgccgc

SEQ ID NO: 3325791 - RNA, 14 nt, Mycobacterium tuberculosis H37Rv
caucggucccacug

SEQ ID NO: 3325792 - RNA, 20 nt, Mycobacterium tuberculosis H37Rv
caucggugagcccguugacc

SEQ ID NO: 3325793 - RNA, 15 nt, Mycobacterium tuberculosis H37Rv
caucggugaugaguc

SEQ ID NO: 3325794 - RNA, 17 nt, Mycobacterium tuberculosis H37Rv
caucggugcagcccgcc

SEQ ID NO: 3325795 - RNA, 13 nt, Mycobacterium tuberculosis H37Rv
caucggugcgcac

SEQ ID NO: 3325796 - RNA, 20 nt, Mycobacterium tuberculosis H37Rv
caucggugcgcacggcggcc

SEQ ID NO: 3325797 - RNA, 20 nt, Mycobacterium tuberculosis H37Rv
caucggugcgguucgcugcg

SEQ ID NO: 3325798 - RNA, 16 nt, Mycobacterium tuberculosis H37Rv
caucgguggcccggug

SEQ ID NO: 3325799 - RNA, 17 nt, Mycobacterium tuberculosis H37Rv
caucgguggcgccgaac

SEQ ID NO: 3325800 - RNA, 14 nt, Mycobacterium tuberculosis H37Rv
caucggugucuucc

SEQ ID NO: 3325801 - RNA, 19 nt, Mycobacterium tuberculosis H37Rv
caucgguguggcccaacac

SEQ ID NO: 3325802 - RNA, 20 nt, Mycobacterium tuberculosis H37Rv
caucgguguggcccaacacc

SEQ ID NO: 3325803 - RNA, 12 nt, Mycobacterium tuberculosis H37Rv
caucgguugacc

SEQ ID NO: 3325804 - RNA, 16 nt, Mycobacterium tuberculosis H37Rv
caucgguugacccggc

SEQ ID NO: 3325805 - RNA, 21 nt, Mycobacterium tuberculosis H37Rv
caucgguugaccggucgacca

SEQ ID NO: 3325806 - RNA, 15 nt, Mycobacterium tuberculosis H37Rv
caucguaggccggca

SEQ ID NO: 3325807 - RNA, 15 nt, Mycobacterium tuberculosis H37Rv
caucgucagcgacca

SEQ ID NO: 3325808 - RNA, 18 nt, Mycobacterium tuberculosis H37Rv
caucgucaucgacgagcg

SEQ ID NO: 3325809 - RNA, 21 nt, Mycobacterium tuberculosis H37Rv
caugccgcccaucaccccgaa

SEQ ID NO: 3325810 - RNA, 19 nt, Mycobacterium tuberculosis H37Rv
caugccgccgaagccgcgc

SEQ ID NO: 3325811 - RNA, 19 nt, Mycobacterium tuberculosis H37Rv
caugccgcggaccccgacc

SEQ ID NO: 3325812 - RNA, 19 nt, Mycobacterium tuberculosis H37Rv
caugccgggauugccgucg

SEQ ID NO: 3325813 - RNA, 14 nt, Mycobacterium tuberculosis H37Rv
caugccggucaucc

SEQ ID NO: 3325814 - RNA, 19 nt, Mycobacterium tuberculosis H37Rv
caugccgugugugcgaucc

SEQ ID NO: 3325815 - RNA, 20 nt, Mycobacterium tuberculosis H37Rv
caugccgugugugcgaucca

SEQ ID NO: 3325816 - RNA, 13 nt, Mycobacterium tuberculosis H37Rv
caugccuccagaa

SEQ ID NO: 3325817 - RNA, 17 nt, Mycobacterium tuberculosis H37Rv
caugccuucggccaacc

SEQ ID NO: 3325818 - RNA, 22 nt, Mycobacterium tuberculosis H37Rv
caugccuucggccaaccaugcu

SEQ ID NO: 3325819 - RNA, 19 nt, Mycobacterium tuberculosis H37Rv
caugcgacuucaucuucga

SEQ ID NO: 3325820 - RNA, 17 nt, Mycobacterium tuberculosis H37Rv
caugcgcaccaguccag

SEQ ID NO: 3325821 - RNA, 17 nt, Mycobacterium tuberculosis H37Rv
caugcgccaacccggcc

SEQ ID NO: 3325822 - RNA, 22 nt, Mycobacterium tuberculosis H37Rv
caugcgccgagauccacgccag

SEQ ID NO: 3325823 - RNA, 16 nt, Mycobacterium tuberculosis H37Rv
caugcgccguagccga

SEQ ID NO: 3325824 - RNA, 18 nt, Mycobacterium tuberculosis H37Rv
caugcgcgcgccggugcu

SEQ ID NO: 3325825 - RNA, 20 nt, Mycobacterium tuberculosis H37Rv
caugcgcuccggcgcgacgc

SEQ ID NO: 3325826 - RNA, 21 nt, Mycobacterium tuberculosis H37Rv
caugcggaucacaucggccau

SEQ ID NO: 3325827 - RNA, 16 nt, Mycobacterium tuberculosis H37Rv
caugcgggcagcacuc

SEQ ID NO: 3325828 - RNA, 20 nt, Mycobacterium tuberculosis H37Rv
caugcgguuagcagccgcug

SEQ ID NO: 3325829 - RNA, 16 nt, Mycobacterium tuberculosis H37Rv
caugcguaugcccacg

SEQ ID NO: 3325830 - RNA, 19 nt, Mycobacterium tuberculosis H37Rv
caugcguuggggcacgacg

SEQ ID NO: 3325831 - RNA, 20 nt, Mycobacterium tuberculosis H37Rv
caugcguuggggcacgacgc

SEQ ID NO: 3325832 - RNA, 17 nt, Mycobacterium tuberculosis H37Rv
caugcuaggaccaccag

SEQ ID NO: 3325833 - RNA, 15 nt, Mycobacterium tuberculosis H37Rv
caugcuaggccaccg

SEQ ID NO: 3325834 - RNA, 21 nt, Mycobacterium tuberculosis H37Rv
caugcucaccgaaacgaugcg

SEQ ID NO: 3325835 - RNA, 14 nt, Mycobacterium tuberculosis H37Rv
caugcucagggcag

SEQ ID NO: 3325836 - RNA, 20 nt, Mycobacterium tuberculosis H37Rv
caugcucgacgcccgccacc

SEQ ID NO: 3325837 - RNA, 23 nt, Mycobacterium tuberculosis H37Rv
caugcucgagugggugaggccaa

SEQ ID NO: 3325838 - RNA, 21 nt, Mycobacterium tuberculosis H37Rv
caugcucgucuugggccggga

SEQ ID NO: 3325839 - RNA, 21 nt, Mycobacterium tuberculosis H37Rv
caugcuggaaguugugcgcac

SEQ ID NO: 3325840 - RNA, 23 nt, Mycobacterium tuberculosis H37Rv
caugcuggaaguugugcgcacuc

SEQ ID NO: 3325841 - RNA, 15 nt, Mycobacterium tuberculosis H37Rv
caugcuggaccucgc

SEQ ID NO: 3325842 - RNA, 22 nt, Mycobacterium tuberculosis H37Rv
caugcuggagaaaccacuggau

SEQ ID NO: 3325843 - RNA, 23 nt, Mycobacterium tuberculosis H37Rv
caugcuguguaucaacagauuuc

SEQ ID NO: 3325844 - RNA, 15 nt, Mycobacterium tuberculosis H37Rv
cauggaacucacccu

SEQ ID NO: 3325845 - RNA, 20 nt, Mycobacterium tuberculosis H37Rv
cauggacgccauggugaacg

SEQ ID NO: 3325846 - RNA, 12 nt, Mycobacterium tuberculosis H37Rv
cauggcauuccg

SEQ ID NO: 3325847 - RNA, 15 nt, Mycobacterium tuberculosis H37Rv
cauggccagcgcuuc

SEQ ID NO: 3325848 - RNA, 16 nt, Mycobacterium tuberculosis H37Rv
cauggccagugucccg

SEQ ID NO: 3325849 - RNA, 20 nt, Mycobacterium tuberculosis H37Rv
cauggcccgaucgaccgcug

SEQ ID NO: 3325850 - RNA, 22 nt, Mycobacterium tuberculosis H37Rv
cauggcccgcucguaggaccuc

SEQ ID NO: 3325851 - RNA, 14 nt, Mycobacterium tuberculosis H37Rv
cauggccgccaggu

SEQ ID NO: 3325852 - RNA, 23 nt, Mycobacterium tuberculosis H37Rv
cauggccgccguuggcaccgggu

SEQ ID NO: 3325853 - RNA, 18 nt, Mycobacterium tuberculosis H37Rv
cauggcgaaccgucagcg

SEQ ID NO: 3325854 - RNA, 14 nt, Mycobacterium tuberculosis H37Rv
cauggcgccgcgcc

SEQ ID NO: 3325855 - RNA, 18 nt, Mycobacterium tuberculosis H37Rv
cauggcgcgagcagacgc

SEQ ID NO: 3325856 - RNA, 16 nt, Mycobacterium tuberculosis H37Rv
cauggcgcggguccag

SEQ ID NO: 3325857 - RNA, 16 nt, Mycobacterium tuberculosis H37Rv
cauggcgcugggaugu

SEQ ID NO: 3325858 - RNA, 14 nt, Mycobacterium tuberculosis H37Rv
cauggcggcccggu

SEQ ID NO: 3325859 - RNA, 19 nt, Mycobacterium tuberculosis H37Rv
cauggcggcuccgcccggc

SEQ ID NO: 3325860 - RNA, 22 nt, Mycobacterium tuberculosis H37Rv
cauggcggcuccgcccggcgug

SEQ ID NO: 3325861 - RNA, 17 nt, Mycobacterium tuberculosis H37Rv
cauggcgucgaaccagu

SEQ ID NO: 3325862 - RNA, 14 nt, Mycobacterium tuberculosis H37Rv
cauggcgugcccca

SEQ ID NO: 3325863 - RNA, 19 nt, Mycobacterium tuberculosis H37Rv
cauggcuagggcgaugagg

SEQ ID NO: 3325864 - RNA, 13 nt, Mycobacterium tuberculosis H37Rv
cauggcuugcucu

SEQ ID NO: 3325865 - RNA, 19 nt, Mycobacterium tuberculosis H37Rv
caugggagcgggauucugg

SEQ ID NO: 3325866 - RNA, 21 nt, Mycobacterium tuberculosis H37Rv
caugggaucaggcugggcaga

SEQ ID NO: 3325867 - RNA, 19 nt, Mycobacterium tuberculosis H37Rv
caugggaugcucaccggga

SEQ ID NO: 3325868 - RNA, 19 nt, Mycobacterium tuberculosis H37Rv
caugggcccugcacagcag

SEQ ID NO: 3325869 - RNA, 16 nt, Mycobacterium tuberculosis H37Rv
caugggcgcugccaau

SEQ ID NO: 3325870 - RNA, 19 nt, Mycobacterium tuberculosis H37Rv
caugggggcguuggcgggc

SEQ ID NO: 3325871 - RNA, 12 nt, Mycobacterium tuberculosis H37Rv
caugggguagau

SEQ ID NO: 3325872 - RNA, 14 nt, Mycobacterium tuberculosis H37Rv
cauggguagccgcc

SEQ ID NO: 3325873 - RNA, 16 nt, Mycobacterium tuberculosis H37Rv
caugggucauggcgcu

SEQ ID NO: 3325874 - RNA, 21 nt, Mycobacterium tuberculosis H37Rv
caugggucuggcaggccagca

SEQ ID NO: 3325875 - RNA, 19 nt, Mycobacterium tuberculosis H37Rv
caugggugaaucgacaggu

SEQ ID NO: 3325876 - RNA, 22 nt, Mycobacterium tuberculosis H37Rv
caugggugaugcaacgcggcga

SEQ ID NO: 3325877 - RNA, 17 nt, Mycobacterium tuberculosis H37Rv
caugguccaaccagcac

SEQ ID NO: 3325878 - RNA, 14 nt, Mycobacterium tuberculosis H37Rv
caugguccacagcc

SEQ ID NO: 3325879 - RNA, 13 nt, Mycobacterium tuberculosis H37Rv
caugguccgacca

SEQ ID NO: 3325880 - RNA, 17 nt, Mycobacterium tuberculosis H37Rv
cauggucgacgaacacc

SEQ ID NO: 3325881 - RNA, 18 nt, Mycobacterium tuberculosis H37Rv
cauggugacgugcucucg

SEQ ID NO: 3325882 - RNA, 20 nt, Mycobacterium tuberculosis H37Rv
caugguggcgccgaccugga

SEQ ID NO: 3325883 - RNA, 21 nt, Mycobacterium tuberculosis H37Rv
caugguggcgccgaccuggac

SEQ ID NO: 3325884 - RNA, 23 nt, Mycobacterium tuberculosis H37Rv
caugguggcuuugcucgccagca

SEQ ID NO: 3325885 - RNA, 19 nt, Mycobacterium tuberculosis H37Rv
cauggugggaaaugaagug

SEQ ID NO: 3325886 - RNA, 17 nt, Mycobacterium tuberculosis H37Rv
cauggugggccuuccuc

SEQ ID NO: 3325887 - RNA, 16 nt, Mycobacterium tuberculosis H37Rv
cauggugggucgacga

SEQ ID NO: 3325888 - RNA, 20 nt, Mycobacterium tuberculosis H37Rv
caugguugaugacggcgucg

SEQ ID NO: 3325889 - RNA, 15 nt, Mycobacterium tuberculosis H37Rv
caugguuggugucgu

SEQ ID NO: 3325890 - RNA, 15 nt, Mycobacterium tuberculosis H37Rv
cauguaauucaacaa

SEQ ID NO: 3325891 - RNA, 15 nt, Mycobacterium tuberculosis H37Rv
cauguaccgaccgcg

SEQ ID NO: 3325892 - RNA, 17 nt, Mycobacterium tuberculosis H37Rv
cauguauuuguuguaaa

SEQ ID NO: 3325893 - RNA, 18 nt, Mycobacterium tuberculosis H37Rv
caugucaagcgauguccc

SEQ ID NO: 3325894 - RNA, 20 nt, Mycobacterium tuberculosis H37Rv
caugucaaguucgccagcaa

SEQ ID NO: 3325895 - RNA, 13 nt, Mycobacterium tuberculosis H37Rv
caugucacaccca

SEQ ID NO: 3325896 - RNA, 14 nt, Mycobacterium tuberculosis H37Rv
caugucacacccac

SEQ ID NO: 3325897 - RNA, 21 nt, Mycobacterium tuberculosis H37Rv
caugucacacccacacccagc

SEQ ID NO: 3325898 - RNA, 14 nt, Mycobacterium tuberculosis H37Rv
cauguccagugccg

SEQ ID NO: 3325899 - RNA, 15 nt, Mycobacterium tuberculosis H37Rv
cauguccagugccgu

SEQ ID NO: 3325900 - RNA, 18 nt, Mycobacterium tuberculosis H37Rv
cauguccaucgcgcggcu

SEQ ID NO: 3325901 - RNA, 17 nt, Mycobacterium tuberculosis H37Rv
cauguccauguuuugcu

SEQ ID NO: 3325902 - RNA, 14 nt, Mycobacterium tuberculosis H37Rv
cauguccgcacgcu

SEQ ID NO: 3325903 - RNA, 15 nt, Mycobacterium tuberculosis H37Rv
cauguccgcagcggu

SEQ ID NO: 3325904 - RNA, 16 nt, Mycobacterium tuberculosis H37Rv
cauguccguccgcgac

SEQ ID NO: 3325905 - RNA, 23 nt, Mycobacterium tuberculosis H37Rv
cauuucggcaaaauaaccguuga

SEQ ID NO: 3325906 - RNA, 17 nt, Mycobacterium tuberculosis H37Rv
ccaaaaacccggugacc

SEQ ID NO: 3325907 - RNA, 17 nt, Mycobacterium tuberculosis H37Rv
ccaaaaaguagcugcgg

SEQ ID NO: 3325908 - RNA, 15 nt, Mycobacterium tuberculosis H37Rv
ccaaaacgucaccgc

SEQ ID NO: 3325909 - RNA, 13 nt, Mycobacterium tuberculosis H37Rv
ccaaaagcccggu

SEQ ID NO: 3325910 - RNA, 12 nt, Mycobacterium tuberculosis H37Rv
ccaaaagcgcgg

SEQ ID NO: 3325911 - RNA, 17 nt, Mycobacterium tuberculosis H37Rv
ccaaaccggcccgcagc

SEQ ID NO: 3325912 - RNA, 22 nt, Mycobacterium tuberculosis H37Rv
ccaaaccggcccgcagcagcau

SEQ ID NO: 3325913 - RNA, 17 nt, Mycobacterium tuberculosis H37Rv
ccaaacuaacggcagcc

SEQ ID NO: 3325914 - RNA, 15 nt, Mycobacterium tuberculosis H37Rv
ccaaacuacccgccc

SEQ ID NO: 3325915 - RNA, 19 nt, Mycobacterium tuberculosis H37Rv
ccaaagccgggauugccgc

SEQ ID NO: 3325916 - RNA, 22 nt, Mycobacterium tuberculosis H37Rv
ccaaagccgggauugccgccac

SEQ ID NO: 3325917 - RNA, 18 nt, Mycobacterium tuberculosis H37Rv
ccaaagcgacgagcagca

SEQ ID NO: 3325918 - RNA, 14 nt, Mycobacterium tuberculosis H37Rv
ccaaaggacgacac

SEQ ID NO: 3325919 - RNA, 20 nt, Mycobacterium tuberculosis H37Rv
ccaacaacaucagcgacagc

SEQ ID NO: 3325920 - RNA, 23 nt, Mycobacterium tuberculosis H37Rv
ccaacacagcguaugcacaugau

SEQ ID NO: 3325921 - RNA, 16 nt, Mycobacterium tuberculosis H37Rv
ccaacaccagcgcguu

SEQ ID NO: 3325922 - RNA, 14 nt, Mycobacterium tuberculosis H37Rv
ccaacaccagguca

SEQ ID NO: 3325923 - RNA, 15 nt, Mycobacterium tuberculosis H37Rv
ccaacaccaggucau

SEQ ID NO: 3325924 - RNA, 13 nt, Mycobacterium tuberculosis H37Rv
ccaacaccgccag

SEQ ID NO: 3325925 - RNA, 15 nt, Mycobacterium tuberculosis H37Rv
ccaacaccgccagca

SEQ ID NO: 3325926 - RNA, 20 nt, Mycobacterium tuberculosis H37Rv
ccaacaccgcgccgacgaaa

SEQ ID NO: 3325927 - RNA, 17 nt, Mycobacterium tuberculosis H37Rv
ccaacacgucgagcagc

SEQ ID NO: 3325928 - RNA, 17 nt, Mycobacterium tuberculosis H37Rv
ccaacagcacccgggcc

SEQ ID NO: 3325929 - RNA, 17 nt, Mycobacterium tuberculosis H37Rv
ccaacagcccaccggug

SEQ ID NO: 3325930 - RNA, 17 nt, Mycobacterium tuberculosis H37Rv
ccaacaucccggaccga

SEQ ID NO: 3325931 - RNA, 15 nt, Mycobacterium tuberculosis H37Rv
ccaaccagugcagcu

SEQ ID NO: 3325932 - RNA, 18 nt, Mycobacterium tuberculosis H37Rv
ccaaccagugcagcucga

SEQ ID NO: 3325933 - RNA, 20 nt, Mycobacterium tuberculosis H37Rv
ccaaccaugcgguuagcagc

SEQ ID NO: 3325934 - RNA, 21 nt, Mycobacterium tuberculosis H37Rv
ccaaccaugcugucggugccg

SEQ ID NO: 3325935 - RNA, 20 nt, Mycobacterium tuberculosis H37Rv
ccaacccaggguggcgacgu

SEQ ID NO: 3325936 - RNA, 20 nt, Mycobacterium tuberculosis H37Rv
ccaaccccgccggccggaac

SEQ ID NO: 3325937 - RNA, 19 nt, Mycobacterium tuberculosis H37Rv
ccaacccgauuuauccgga

SEQ ID NO: 3325938 - RNA, 13 nt, Mycobacterium tuberculosis H37Rv
ccaacccggcggc

SEQ ID NO: 3325939 - RNA, 14 nt, Mycobacterium tuberculosis H37Rv
ccaacccgggccgc

SEQ ID NO: 3325940 - RNA, 15 nt, Mycobacterium tuberculosis H37Rv
ccaacccgggccgcc

SEQ ID NO: 3325941 - RNA, 22 nt, Mycobacterium tuberculosis H37Rv
ccaacccgucuuaucggcgucg

SEQ ID NO: 3325942 - RNA, 15 nt, Mycobacterium tuberculosis H37Rv
ccaacccguguggca

SEQ ID NO: 3325943 - RNA, 21 nt, Mycobacterium tuberculosis H37Rv
ccaacccuaaaccagccacca

SEQ ID NO: 3325944 - RNA, 12 nt, Mycobacterium tuberculosis H37Rv
ccaacccucgcc

SEQ ID NO: 3325945 - RNA, 22 nt, Mycobacterium tuberculosis H37Rv
ccaacccucgccggucagcgug

SEQ ID NO: 3325946 - RNA, 13 nt, Mycobacterium tuberculosis H37Rv
ccaaccgaaccgc

SEQ ID NO: 3325947 - RNA, 15 nt, Mycobacterium tuberculosis H37Rv
ccaaccgaaccgcgu

SEQ ID NO: 3325948 - RNA, 20 nt, Mycobacterium tuberculosis H37Rv
ccaaccgagcgcccuccucg

SEQ ID NO: 3325949 - RNA, 21 nt, Mycobacterium tuberculosis H37Rv
ccaaccgcauauucaccccgc

SEQ ID NO: 3325950 - RNA, 14 nt, Mycobacterium tuberculosis H37Rv
ccaaccgcuuccaa

SEQ ID NO: 3325951 - RNA, 14 nt, Mycobacterium tuberculosis H37Rv
ccaaccgggccggc

SEQ ID NO: 3325952 - RNA, 15 nt, Mycobacterium tuberculosis H37Rv
ccaaccgggccggcu

SEQ ID NO: 3325953 - RNA, 19 nt, Mycobacterium tuberculosis H37Rv
ccaaccgguacuccugggu

SEQ ID NO: 3325954 - RNA, 16 nt, Mycobacterium tuberculosis H37Rv
ccaaccgguucgucga

SEQ ID NO: 3325955 - RNA, 22 nt, Mycobacterium tuberculosis H37Rv
ccaaccucggaucgccaggccg

SEQ ID NO: 3325956 - RNA, 23 nt, Mycobacterium tuberculosis H37Rv
ccaaccucggaucgccaggccgu

SEQ ID NO: 3325957 - RNA, 13 nt, Mycobacterium tuberculosis H37Rv
ccaaccugggcca

SEQ ID NO: 3325958 - RNA, 16 nt, Mycobacterium tuberculosis H37Rv
ccaacgaccaccacca

SEQ ID NO: 3325959 - RNA, 17 nt, Mycobacterium tuberculosis H37Rv
ccaacgacuguggcgcc

SEQ ID NO: 3325960 - RNA, 20 nt, Mycobacterium tuberculosis H37Rv
ccaacgaucagucgucuuga

SEQ ID NO: 3325961 - RNA, 18 nt, Mycobacterium tuberculosis H37Rv
ccaacgcagaucagggug

SEQ ID NO: 3325962 - RNA, 16 nt, Mycobacterium tuberculosis H37Rv
ccaacgccaccgucgc

SEQ ID NO: 3325963 - RNA, 13 nt, Mycobacterium tuberculosis H37Rv
ccaacgcccgggc

SEQ ID NO: 3325964 - RNA, 14 nt, Mycobacterium tuberculosis H37Rv
ccaacgcccgggcg

SEQ ID NO: 3325965 - RNA, 13 nt, Mycobacterium tuberculosis H37Rv
ccaacgccuugac

SEQ ID NO: 3325966 - RNA, 22 nt, Mycobacterium tuberculosis H37Rv
ccaacgccuugacugaacucaa

SEQ ID NO: 3325967 - RNA, 16 nt, Mycobacterium tuberculosis H37Rv
ccaacgcgcagagcgu

SEQ ID NO: 3325968 - RNA, 22 nt, Mycobacterium tuberculosis H37Rv
ccaacgcgggaacgaugccgcc

SEQ ID NO: 3325969 - RNA, 19 nt, Mycobacterium tuberculosis H37Rv
ccaacgcgguaaagccccg

SEQ ID NO: 3325970 - RNA, 16 nt, Mycobacterium tuberculosis H37Rv
ccaacgcggugacgau

SEQ ID NO: 3325971 - RNA, 19 nt, Mycobacterium tuberculosis H37Rv
ccaacgcggugggcacagc

SEQ ID NO: 3325972 - RNA, 22 nt, Mycobacterium tuberculosis H37Rv
ccaacgcggugggcacagccag

SEQ ID NO: 3325973 - RNA, 22 nt, Mycobacterium tuberculosis H37Rv
ccaacgcucccuacgagcccac

SEQ ID NO: 3325974 - RNA, 15 nt, Mycobacterium tuberculosis H37Rv
ccaacgcuucugccu

SEQ ID NO: 3325975 - RNA, 23 nt, Mycobacterium tuberculosis H37Rv
ccaacgcuucugccugcgcacga

SEQ ID NO: 3325976 - RNA, 12 nt, Mycobacterium tuberculosis H37Rv
ccaacggcagcg

SEQ ID NO: 3325977 - RNA, 20 nt, Mycobacterium tuberculosis H37Rv
ccaacgucgacuucagcggc

SEQ ID NO: 3325978 - RNA, 23 nt, Mycobacterium tuberculosis H37Rv
ccaacgucgccaggucaucggug

SEQ ID NO: 3325979 - RNA, 18 nt, Mycobacterium tuberculosis H37Rv
ccaacguugcgccagcgg

SEQ ID NO: 3325980 - RNA, 16 nt, Mycobacterium tuberculosis H37Rv
ccaacguugugccgcu

SEQ ID NO: 3325981 - RNA, 21 nt, Mycobacterium tuberculosis H37Rv
ccaacguuuugggcgccggag

SEQ ID NO: 3325982 - RNA, 19 nt, Mycobacterium tuberculosis H37Rv
ccaacucaagcaauggugc

SEQ ID NO: 3325983 - RNA, 18 nt, Mycobacterium tuberculosis H37Rv
ccaacuccaagaugccgc

SEQ ID NO: 3325984 - RNA, 13 nt, Mycobacterium tuberculosis H37Rv
ccaacuccaccca

SEQ ID NO: 3325985 - RNA, 14 nt, Mycobacterium tuberculosis H37Rv
ccaacuccucagcc

SEQ ID NO: 3325986 - RNA, 18 nt, Mycobacterium tuberculosis H37Rv
ccaacuccucagccgccu

SEQ ID NO: 3325987 - RNA, 12 nt, Mycobacterium tuberculosis H37Rv
ccaacucggcca

SEQ ID NO: 3325988 - RNA, 13 nt, Mycobacterium tuberculosis H37Rv
ccaacucggccaa

SEQ ID NO: 3325989 - RNA, 12 nt, Mycobacterium tuberculosis H37Rv
ccaacucggccc

SEQ ID NO: 3325990 - RNA, 18 nt, Mycobacterium tuberculosis H37Rv
ccaacucggcggccagcg

SEQ ID NO: 3325991 - RNA, 17 nt, Mycobacterium tuberculosis H37Rv
ccaacucgguucgcccc

SEQ ID NO: 3325992 - RNA, 16 nt, Mycobacterium tuberculosis H37Rv
ccaacugaaccgagug

SEQ ID NO: 3325993 - RNA, 20 nt, Mycobacterium tuberculosis H37Rv
ccaacugcgaaacgccaccg

SEQ ID NO: 3325994 - RNA, 19 nt, Mycobacterium tuberculosis H37Rv
ccaacugcgccguucgcuc

SEQ ID NO: 3325995 - RNA, 18 nt, Mycobacterium tuberculosis H37Rv
ccaacugggccgagcgcg

SEQ ID NO: 3325996 - RNA, 14 nt, Mycobacterium tuberculosis H37Rv
ccaacuggucgcca

SEQ ID NO: 3325997 - RNA, 16 nt, Mycobacterium tuberculosis H37Rv
ccaacuggucgccaac

SEQ ID NO: 3325998 - RNA, 23 nt, Mycobacterium tuberculosis H37Rv
ccaacuucugcacgaacgccugc

SEQ ID NO: 3325999 - RNA, 21 nt, Mycobacterium tuberculosis H37Rv
ccaagaaagacgcuguccagg

SEQ ID NO: 3326000 - RNA, 18 nt, Mycobacterium tuberculosis H37Rv
ccaagagcgcgcagcagu

SEQ ID NO: 3326001 - RNA, 11 nt, Mycobacterium tuberculosis H37Rv
ccacagcccca

SEQ ID NO: 3326002 - RNA, 22 nt, Mycobacterium tuberculosis H37Rv
ccacagcggcgauuggcuguga

SEQ ID NO: 3326003 - RNA, 13 nt, Mycobacterium tuberculosis H37Rv
ccacagcgugcgg

SEQ ID NO: 3326004 - RNA, 11 nt, Mycobacterium tuberculosis H37Rv
ccacagcuugc

SEQ ID NO: 3326005 - RNA, 13 nt, Mycobacterium tuberculosis H37Rv
ccacaggaagcga

SEQ ID NO: 3326006 - RNA, 21 nt, Mycobacterium tuberculosis H37Rv
ccacaggacaauggacaccaa

SEQ ID NO: 3326007 - RNA, 19 nt, Mycobacterium tuberculosis H37Rv
ccacaggcugaagacgaau

SEQ ID NO: 3326008 - RNA, 12 nt, Mycobacterium tuberculosis H37Rv
ccacaggugacc

SEQ ID NO: 3326009 - RNA, 14 nt, Mycobacterium tuberculosis H37Rv
ccacaggugaccuu

SEQ ID NO: 3326010 - RNA, 15 nt, Mycobacterium tuberculosis H37Rv
ccacagguuugcgcc

SEQ ID NO: 3326011 - RNA, 23 nt, Mycobacterium tuberculosis H37Rv
ccacagguuugcgccgcgcagcg

SEQ ID NO: 3326012 - RNA, 17 nt, Mycobacterium tuberculosis H37Rv
ccacagucgucgagcgc

SEQ ID NO: 3326013 - RNA, 20 nt, Mycobacterium tuberculosis H37Rv
ccacagugcauacgguugau

SEQ ID NO: 3326014 - RNA, 23 nt, Mycobacterium tuberculosis H37Rv
ccacagugccaauuccagccccc

SEQ ID NO: 3326015 - RNA, 17 nt, Mycobacterium tuberculosis H37Rv
ccacauacgcggcggcc

SEQ ID NO: 3326016 - RNA, 19 nt, Mycobacterium tuberculosis H37Rv
ccacauacgcggcggccug

SEQ ID NO: 3326017 - RNA, 15 nt, Mycobacterium tuberculosis H37Rv
ccacaucaccaaaaa

SEQ ID NO: 3326018 - RNA, 14 nt, Mycobacterium tuberculosis H37Rv
ccacaucaggucgg

SEQ ID NO: 3326019 - RNA, 18 nt, Mycobacterium tuberculosis H37Rv
ccacaucaggucggcgaa

SEQ ID NO: 3326020 - RNA, 15 nt, Mycobacterium tuberculosis H37Rv
ccacaucaugccagc

SEQ ID NO: 3326021 - RNA, 16 nt, Mycobacterium tuberculosis H37Rv
ccacaucccacggugg

SEQ ID NO: 3326022 - RNA, 22 nt, Mycobacterium tuberculosis H37Rv
ccacauccuggcggcugcagcc

SEQ ID NO: 3326023 - RNA, 24 nt, Mycobacterium tuberculosis H37Rv
ccacauccuggcggcugcagccga

SEQ ID NO: 3326024 - RNA, 23 nt, Mycobacterium tuberculosis H37Rv
ccacaucgaacgacgcauccgga

SEQ ID NO: 3326025 - RNA, 19 nt, Mycobacterium tuberculosis H37Rv
ccacaucgccagcagcaaa

SEQ ID NO: 3326026 - RNA, 22 nt, Mycobacterium tuberculosis H37Rv
ccacaugaacgaccaccgcuga

SEQ ID NO: 3326027 - RNA, 17 nt, Mycobacterium tuberculosis H37Rv
ccacaugacgaucgcgg

SEQ ID NO: 3326028 - RNA, 19 nt, Mycobacterium tuberculosis H37Rv
ccacaugacgaucgcggcg

SEQ ID NO: 3326029 - RNA, 22 nt, Mycobacterium tuberculosis H37Rv
ccacaugaucgagcaguuccag

SEQ ID NO: 3326030 - RNA, 19 nt, Mycobacterium tuberculosis H37Rv
ccacaugggagccguucgg

SEQ ID NO: 3326031 - RNA, 22 nt, Mycobacterium tuberculosis H37Rv
ccacauuggcgaucagcagccg

SEQ ID NO: 3326032 - RNA, 15 nt, Mycobacterium tuberculosis H37Rv
ccaccaaacgcugcu

SEQ ID NO: 3326033 - RNA, 13 nt, Mycobacterium tuberculosis H37Rv
ccaccaacacccg

SEQ ID NO: 3326034 - RNA, 20 nt, Mycobacterium tuberculosis H37Rv
ccaccaacgagucagugcca

SEQ ID NO: 3326035 - RNA, 13 nt, Mycobacterium tuberculosis H37Rv
ccaccaagcucgc

SEQ ID NO: 3326036 - RNA, 22 nt, Mycobacterium tuberculosis H37Rv
ccaccaagcucggccagcacgc

SEQ ID NO: 3326037 - RNA, 20 nt, Mycobacterium tuberculosis H37Rv
ccaccaagguguggccuugc

SEQ ID NO: 3326038 - RNA, 23 nt, Mycobacterium tuberculosis H37Rv
ccaccacaacgccaggaacccgu

SEQ ID NO: 3326039 - RNA, 12 nt, Mycobacterium tuberculosis H37Rv
ccaccacacagc

SEQ ID NO: 3326040 - RNA, 15 nt, Mycobacterium tuberculosis H37Rv
ccaccacacagccgc

SEQ ID NO: 3326041 - RNA, 18 nt, Mycobacterium tuberculosis H37Rv
ccaccacaccggagccga

SEQ ID NO: 3326042 - RNA, 15 nt, Mycobacterium tuberculosis H37Rv
ccaccacagacgacg

SEQ ID NO: 3326043 - RNA, 23 nt, Mycobacterium tuberculosis H37Rv
ccaccacaggacaauggacacca

SEQ ID NO: 3326044 - RNA, 13 nt, Mycobacterium tuberculosis H37Rv
ccaccacccggaa

SEQ ID NO: 3326045 - RNA, 13 nt, Mycobacterium tuberculosis H37Rv
ccaccacccggcg

SEQ ID NO: 3326046 - RNA, 15 nt, Mycobacterium tuberculosis H37Rv
ccaccaccgacgagg

SEQ ID NO: 3326047 - RNA, 13 nt, Mycobacterium tuberculosis H37Rv
ccaccaccgccgc

SEQ ID NO: 3326048 - RNA, 17 nt, Mycobacterium tuberculosis H37Rv
ccaccaccgccgccgaa

SEQ ID NO: 3326049 - RNA, 18 nt, Mycobacterium tuberculosis H37Rv
ccaccaccgccggugccg

SEQ ID NO: 3326050 - RNA, 23 nt, Mycobacterium tuberculosis H37Rv
ccaccaccggcacccgcuggcgg

SEQ ID NO: 3326051 - RNA, 13 nt, Mycobacterium tuberculosis H37Rv
ccaccaccggcgc

SEQ ID NO: 3326052 - RNA, 13 nt, Mycobacterium tuberculosis H37Rv
ccaccaccgguga

SEQ ID NO: 3326053 - RNA, 14 nt, Mycobacterium tuberculosis H37Rv
ccaccaccgucgag

SEQ ID NO: 3326054 - RNA, 23 nt, Mycobacterium tuberculosis H37Rv
ccaccaccgucgagccggacagg

SEQ ID NO: 3326055 - RNA, 13 nt, Mycobacterium tuberculosis H37Rv
ccaccacgcuccc

SEQ ID NO: 3326056 - RNA, 17 nt, Mycobacterium tuberculosis H37Rv
ccaccacgcuggccucg

SEQ ID NO: 3326057 - RNA, 19 nt, Mycobacterium tuberculosis H37Rv
ccaccacguggcccuccuc

SEQ ID NO: 3326058 - RNA, 16 nt, Mycobacterium tuberculosis H37Rv
ccaccacugcgcccgc

SEQ ID NO: 3326059 - RNA, 17 nt, Mycobacterium tuberculosis H37Rv
ccaccagaaacaccgac

SEQ ID NO: 3326060 - RNA, 21 nt, Mycobacterium tuberculosis H37Rv
ccaccagacaacgccgucgau

SEQ ID NO: 3326061 - RNA, 18 nt, Mycobacterium tuberculosis H37Rv
ccaccagaccaggaagca

SEQ ID NO: 3326062 - RNA, 22 nt, Mycobacterium tuberculosis H37Rv
ccaccagcgacgaccacaccac

SEQ ID NO: 3326063 - RNA, 14 nt, Mycobacterium tuberculosis H37Rv
ccaccagcgcccgu

SEQ ID NO: 3326064 - RNA, 15 nt, Mycobacterium tuberculosis H37Rv
ccaccagcgcccguc

SEQ ID NO: 3326065 - RNA, 12 nt, Mycobacterium tuberculosis H37Rv
ccaccagcgccu

SEQ ID NO: 3326066 - RNA, 15 nt, Mycobacterium tuberculosis H37Rv
ccaccagcgcuccag

SEQ ID NO: 3326067 - RNA, 13 nt, Mycobacterium tuberculosis H37Rv
ccaccagcggcau

SEQ ID NO: 3326068 - RNA, 14 nt, Mycobacterium tuberculosis H37Rv
ccaccagcggcaua

SEQ ID NO: 3326069 - RNA, 16 nt, Mycobacterium tuberculosis H37Rv
ccaccagcggcggccc

SEQ ID NO: 3326070 - RNA, 23 nt, Mycobacterium tuberculosis H37Rv
ccaccagggcaacggccgcuagc

SEQ ID NO: 3326071 - RNA, 15 nt, Mycobacterium tuberculosis H37Rv
ccaccaggugccgug

SEQ ID NO: 3326072 - RNA, 15 nt, Mycobacterium tuberculosis H37Rv
ccaccagucacgccc

SEQ ID NO: 3326073 - RNA, 22 nt, Mycobacterium tuberculosis H37Rv
ccaccaguccgaugggaaucag

SEQ ID NO: 3326074 - RNA, 23 nt, Mycobacterium tuberculosis H37Rv
ccaccaguccgaugggaaucagu

SEQ ID NO: 3326075 - RNA, 15 nt, Mycobacterium tuberculosis H37Rv
ccaccagugcaucga

SEQ ID NO: 3326076 - RNA, 20 nt, Mycobacterium tuberculosis H37Rv
ccaccagugcaucgaucacc

SEQ ID NO: 3326077 - RNA, 21 nt, Mycobacterium tuberculosis H37Rv
ccaccagugccccgccgagcg

SEQ ID NO: 3326078 - RNA, 21 nt, Mycobacterium tuberculosis H37Rv
ccaccaguggcgcgugcagcg

SEQ ID NO: 3326079 - RNA, 15 nt, Mycobacterium tuberculosis H37Rv
ccaccaucaccgccu

SEQ ID NO: 3326080 - RNA, 13 nt, Mycobacterium tuberculosis H37Rv
ccaccaucgccgc

SEQ ID NO: 3326081 - RNA, 23 nt, Mycobacterium tuberculosis H37Rv
ccaccaucgccgccguugccgcc

SEQ ID NO: 3326082 - RNA, 13 nt, Mycobacterium tuberculosis H37Rv
ccaccaucgccuc

SEQ ID NO: 3326083 - RNA, 14 nt, Mycobacterium tuberculosis H37Rv
ccaccaugaucaca

SEQ ID NO: 3326084 - RNA, 23 nt, Mycobacterium tuberculosis H37Rv
ccaccauguauuucucccagccc

SEQ ID NO: 3326085 - RNA, 17 nt, Mycobacterium tuberculosis H37Rv
ccacccaacagcccacc

SEQ ID NO: 3326086 - RNA, 23 nt, Mycobacterium tuberculosis H37Rv
ccacccacauggcggcccggugg

SEQ ID NO: 3326087 - RNA, 12 nt, Mycobacterium tuberculosis H37Rv
ccacccacccgc

SEQ ID NO: 3326088 - RNA, 13 nt, Mycobacterium tuberculosis H37Rv
ccacccacccgca

SEQ ID NO: 3326089 - RNA, 16 nt, Mycobacterium tuberculosis H37Rv
ccacccacccgcacca

SEQ ID NO: 3326090 - RNA, 16 nt, Mycobacterium tuberculosis H37Rv
ccacccacgaucagca

SEQ ID NO: 3326091 - RNA, 18 nt, Mycobacterium tuberculosis H37Rv
ccacccagacaccggcua

SEQ ID NO: 3326092 - RNA, 19 nt, Mycobacterium tuberculosis H37Rv
ccacccagaugcagcgguc

SEQ ID NO: 3326093 - RNA, 13 nt, Mycobacterium tuberculosis H37Rv
ccacccagugcca

SEQ ID NO: 3326094 - RNA, 23 nt, Mycobacterium tuberculosis H37Rv
ccacccagugccacgccugagcc

SEQ ID NO: 3326095 - RNA, 22 nt, Mycobacterium tuberculosis H37Rv
ccacccauggccucccacucac

SEQ ID NO: 3326096 - RNA, 22 nt, Mycobacterium tuberculosis H37Rv
ccaccccagcggccaccgaggc

SEQ ID NO: 3326097 - RNA, 17 nt, Mycobacterium tuberculosis H37Rv
ccaccgggccgacagca

SEQ ID NO: 3326098 - RNA, 23 nt, Mycobacterium tuberculosis H37Rv
ccaccgggcgcugcuugaggucc

SEQ ID NO: 3326099 - RNA, 20 nt, Mycobacterium tuberculosis H37Rv
ccaccgggcgucgucgguga

SEQ ID NO: 3326100 - RNA, 17 nt, Mycobacterium tuberculosis H37Rv
ccaccgguaccgaucag

SEQ ID NO: 3326101 - RNA, 14 nt, Mycobacterium tuberculosis H37Rv
ccaccggucgccgc

SEQ ID NO: 3326102 - RNA, 21 nt, Mycobacterium tuberculosis H37Rv
ccaccggugagcgcagcuuga

SEQ ID NO: 3326103 - RNA, 16 nt, Mycobacterium tuberculosis H37Rv
ccaccggugccgccgu

SEQ ID NO: 3326104 - RNA, 21 nt, Mycobacterium tuberculosis H37Rv
ccaccggugccgccguugcca

SEQ ID NO: 3326105 - RNA, 17 nt, Mycobacterium tuberculosis H37Rv
ccaccgguuauggcauu

SEQ ID NO: 3326106 - RNA, 15 nt, Mycobacterium tuberculosis H37Rv
ccaccgucacccccg

SEQ ID NO: 3326107 - RNA, 16 nt, Mycobacterium tuberculosis H37Rv
ccaccgucaccgccgg

SEQ ID NO: 3326108 - RNA, 16 nt, Mycobacterium tuberculosis H37Rv
ccaccgucaccgccgu

SEQ ID NO: 3326109 - RNA, 20 nt, Mycobacterium tuberculosis H37Rv
ccaccgucaugccgacgaca

SEQ ID NO: 3326110 - RNA, 13 nt, Mycobacterium tuberculosis H37Rv
ccaccgucccugu

SEQ ID NO: 3326111 - RNA, 17 nt, Mycobacterium tuberculosis H37Rv
ccaccgucccugugucg

SEQ ID NO: 3326112 - RNA, 22 nt, Mycobacterium tuberculosis H37Rv
ccaccgucgaaccaugguugau

SEQ ID NO: 3326113 - RNA, 18 nt, Mycobacterium tuberculosis H37Rv
ccaccgucgcaccagcga

SEQ ID NO: 3326114 - RNA, 16 nt, Mycobacterium tuberculosis H37Rv
ccaccgucgccgccgg

SEQ ID NO: 3326115 - RNA, 19 nt, Mycobacterium tuberculosis H37Rv
ccaccgucuccggcgccac

SEQ ID NO: 3326116 - RNA, 18 nt, Mycobacterium tuberculosis H37Rv
ccaccgucucgccgcgca

SEQ ID NO: 3326117 - RNA, 15 nt, Mycobacterium tuberculosis H37Rv
ccaccgucugcuggc

SEQ ID NO: 3326118 - RNA, 14 nt, Mycobacterium tuberculosis H37Rv
ccaccgugaccgag

SEQ ID NO: 3326119 - RNA, 20 nt, Mycobacterium tuberculosis H37Rv
ccaccgugaccgagaagccc

SEQ ID NO: 3326120 - RNA, 22 nt, Mycobacterium tuberculosis H37Rv
ccaccgugcgguauuugaacgc

SEQ ID NO: 3326121 - RNA, 18 nt, Mycobacterium tuberculosis H37Rv
ccaccguuagccaggucg

SEQ ID NO: 3326122 - RNA, 24 nt, Mycobacterium tuberculosis H37Rv
ccaccguugccgaaccacgcgccc

SEQ ID NO: 3326123 - RNA, 14 nt, Mycobacterium tuberculosis H37Rv
ccaccguugccgcc

SEQ ID NO: 3326124 - RNA, 20 nt, Mycobacterium tuberculosis H37Rv
ccaccguugggccgacuggg

SEQ ID NO: 3326125 - RNA, 19 nt, Mycobacterium tuberculosis H37Rv
ccaccguuugcgcaccggu

SEQ ID NO: 3326126 - RNA, 13 nt, Mycobacterium tuberculosis H37Rv
ccaccucagcugc

SEQ ID NO: 3326127 - RNA, 12 nt, Mycobacterium tuberculosis H37Rv
ccaccucccagg

SEQ ID NO: 3326128 - RNA, 15 nt, Mycobacterium tuberculosis H37Rv
ccaccuccugguuga

SEQ ID NO: 3326129 - RNA, 22 nt, Mycobacterium tuberculosis H37Rv
ccaccucgaucgcgccgucggc

SEQ ID NO: 3326130 - RNA, 18 nt, Mycobacterium tuberculosis H37Rv
ccaccucgaugccgcccc

SEQ ID NO: 3326131 - RNA, 13 nt, Mycobacterium tuberculosis H37Rv
ccaccucgauggc

SEQ ID NO: 3326132 - RNA, 19 nt, Mycobacterium tuberculosis H37Rv
ccaccucggugaccaggcc

SEQ ID NO: 3326133 - RNA, 15 nt, Mycobacterium tuberculosis H37Rv
ccaccucgucacagu

SEQ ID NO: 3326134 - RNA, 18 nt, Mycobacterium tuberculosis H37Rv
ccaccucuucucggacac

SEQ ID NO: 3326135 - RNA, 14 nt, Mycobacterium tuberculosis H37Rv
ccaccugcuccgcu

SEQ ID NO: 3326136 - RNA, 20 nt, Mycobacterium tuberculosis H37Rv
ccaccuggaguccagcucgg

SEQ ID NO: 3326137 - RNA, 12 nt, Mycobacterium tuberculosis H37Rv
ccaccugggcgg

SEQ ID NO: 3326138 - RNA, 20 nt, Mycobacterium tuberculosis H37Rv
ccaccuggugcaaccgugcc

SEQ ID NO: 3326139 - RNA, 17 nt, Mycobacterium tuberculosis H37Rv
ccaccuguucacccacu

SEQ ID NO: 3326140 - RNA, 20 nt, Mycobacterium tuberculosis H37Rv
ccaccuguugcccuugcgca

SEQ ID NO: 3326141 - RNA, 19 nt, Mycobacterium tuberculosis H37Rv
ccaccuucggguagccccg

SEQ ID NO: 3326142 - RNA, 18 nt, Mycobacterium tuberculosis H37Rv
ccaccuucugguccagca

SEQ ID NO: 3326143 - RNA, 20 nt, Mycobacterium tuberculosis H37Rv
ccaccuuggaugcccugccc

SEQ ID NO: 3326144 - RNA, 21 nt, Mycobacterium tuberculosis H37Rv
ccaccuuggcguugaccagca

SEQ ID NO: 3326145 - RNA, 23 nt, Mycobacterium tuberculosis H37Rv
ccaccuuggcguugaccagcacg

SEQ ID NO: 3326146 - RNA, 21 nt, Mycobacterium tuberculosis H37Rv
ccaccuuggcugggcccgccg

SEQ ID NO: 3326147 - RNA, 17 nt, Mycobacterium tuberculosis H37Rv
ccacgaacacguucggg

SEQ ID NO: 3326148 - RNA, 17 nt, Mycobacterium tuberculosis H37Rv
ccacgaacccucagccg

SEQ ID NO: 3326149 - RNA, 19 nt, Mycobacterium tuberculosis H37Rv
ccacgaaccgugcugggca

SEQ ID NO: 3326150 - RNA, 22 nt, Mycobacterium tuberculosis H37Rv
ccacgaacugaucgaccgccuc

SEQ ID NO: 3326151 - RNA, 14 nt, Mycobacterium tuberculosis H37Rv
ccacgacagcagag

SEQ ID NO: 3326152 - RNA, 15 nt, Mycobacterium tuberculosis H37Rv
ccacgacaggucgcc

SEQ ID NO: 3326153 - RNA, 16 nt, Mycobacterium tuberculosis H37Rv
ccacgaccgcggcggc

SEQ ID NO: 3326154 - RNA, 14 nt, Mycobacterium tuberculosis H37Rv
ccacgacgcgaugg

SEQ ID NO: 3326155 - RNA, 20 nt, Mycobacterium tuberculosis H37Rv
ccacgacgucggugaacgcg

SEQ ID NO: 3326156 - RNA, 20 nt, Mycobacterium tuberculosis H37Rv
ccacgacgucgucguccucg

SEQ ID NO: 3326157 - RNA, 20 nt, Mycobacterium tuberculosis H37Rv
ccacgagcguagcgaccucg

SEQ ID NO: 3326158 - RNA, 15 nt, Mycobacterium tuberculosis H37Rv
ccacgaggcuugcgg

SEQ ID NO: 3326159 - RNA, 14 nt, Mycobacterium tuberculosis H37Rv
ccacgaguccgcgg

SEQ ID NO: 3326160 - RNA, 15 nt, Mycobacterium tuberculosis H37Rv
ccacgagucgcacgu

SEQ ID NO: 3326161 - RNA, 14 nt, Mycobacterium tuberculosis H37Rv
ccacgagugcaaga

SEQ ID NO: 3326162 - RNA, 15 nt, Mycobacterium tuberculosis H37Rv
ccacgaguuggccaa

SEQ ID NO: 3326163 - RNA, 16 nt, Mycobacterium tuberculosis H37Rv
ccacgaguuggccaag

SEQ ID NO: 3326164 - RNA, 16 nt, Mycobacterium tuberculosis H37Rv
ccacgauaaggucaca

SEQ ID NO: 3326165 - RNA, 16 nt, Mycobacterium tuberculosis H37Rv
ccacgaucacccggau

SEQ ID NO: 3326166 - RNA, 22 nt, Mycobacterium tuberculosis H37Rv
ccacgaucagcagcgucggugc

SEQ ID NO: 3326167 - RNA, 19 nt, Mycobacterium tuberculosis H37Rv
ccacgaucggcccagcccu

SEQ ID NO: 3326168 - RNA, 15 nt, Mycobacterium tuberculosis H37Rv
ccacgaucggcucac

SEQ ID NO: 3326169 - RNA, 18 nt, Mycobacterium tuberculosis H37Rv
ccacgaugaucccaagcg

SEQ ID NO: 3326170 - RNA, 19 nt, Mycobacterium tuberculosis H37Rv
ccacgaugaucuugccgcg

SEQ ID NO: 3326171 - RNA, 17 nt, Mycobacterium tuberculosis H37Rv
ccacgauggcggccacc

SEQ ID NO: 3326172 - RNA, 20 nt, Mycobacterium tuberculosis H37Rv
ccacgcaaaguucgucacca

SEQ ID NO: 3326173 - RNA, 23 nt, Mycobacterium tuberculosis H37Rv
ccacgcaagggaauccgaacucg

SEQ ID NO: 3326174 - RNA, 14 nt, Mycobacterium tuberculosis H37Rv
ccacgcacccggca

SEQ ID NO: 3326175 - RNA, 18 nt, Mycobacterium tuberculosis H37Rv
ccacgcaccgggugcagg

SEQ ID NO: 3326176 - RNA, 21 nt, Mycobacterium tuberculosis H37Rv
ccacgcaccgggugcagguga

SEQ ID NO: 3326177 - RNA, 15 nt, Mycobacterium tuberculosis H37Rv
ccacgcacucacuac

SEQ ID NO: 3326178 - RNA, 17 nt, Mycobacterium tuberculosis H37Rv
ccacgcacucgucgggg

SEQ ID NO: 3326179 - RNA, 14 nt, Mycobacterium tuberculosis H37Rv
ccacgcacugccgc

SEQ ID NO: 3326180 - RNA, 16 nt, Mycobacterium tuberculosis H37Rv
ccacgcagaaguugau

SEQ ID NO: 3326181 - RNA, 15 nt, Mycobacterium tuberculosis H37Rv
ccacgcagcacggca

SEQ ID NO: 3326182 - RNA, 17 nt, Mycobacterium tuberculosis H37Rv
ccacgcauaucgcuuga

SEQ ID NO: 3326183 - RNA, 14 nt, Mycobacterium tuberculosis H37Rv
ccacgcaugggcca

SEQ ID NO: 3326184 - RNA, 11 nt, Mycobacterium tuberculosis H37Rv
ccacgccaccg

SEQ ID NO: 3326185 - RNA, 15 nt, Mycobacterium tuberculosis H37Rv
ccacgccaccgcggu

SEQ ID NO: 3326186 - RNA, 15 nt, Mycobacterium tuberculosis H37Rv
ccacgccacguccaa

SEQ ID NO: 3326187 - RNA, 22 nt, Mycobacterium tuberculosis H37Rv
ccacgccacguccaacucggcc

SEQ ID NO: 3326188 - RNA, 17 nt, Mycobacterium tuberculosis H37Rv
ccacgccagcucgccgg

SEQ ID NO: 3326189 - RNA, 13 nt, Mycobacterium tuberculosis H37Rv
ccacgcccgacga

SEQ ID NO: 3326190 - RNA, 17 nt, Mycobacterium tuberculosis H37Rv
ccacgcccgacgccagc

SEQ ID NO: 3326191 - RNA, 15 nt, Mycobacterium tuberculosis H37Rv
ccacgccgaccaucu

SEQ ID NO: 3326192 - RNA, 21 nt, Mycobacterium tuberculosis H37Rv
ccacgccgaccaucucaccgg

SEQ ID NO: 3326193 - RNA, 18 nt, Mycobacterium tuberculosis H37Rv
ccacuccgguggccaaca

SEQ ID NO: 3326194 - RNA, 22 nt, Mycobacterium tuberculosis H37Rv
ccacuccgguggccaacaccgc

SEQ ID NO: 3326195 - RNA, 23 nt, Mycobacterium tuberculosis H37Rv
ccacuccugaguuccggucgacu

SEQ ID NO: 3326196 - RNA, 12 nt, Mycobacterium tuberculosis H37Rv
ccacucgaccug

SEQ ID NO: 3326197 - RNA, 16 nt, Mycobacterium tuberculosis H37Rv
ccacucgagcgcucac

SEQ ID NO: 3326198 - RNA, 14 nt, Mycobacterium tuberculosis H37Rv
ccacucggcccggc

SEQ ID NO: 3326199 - RNA, 17 nt, Mycobacterium tuberculosis H37Rv
ccacucggcccggcagg

SEQ ID NO: 3326200 - RNA, 17 nt, Mycobacterium tuberculosis H37Rv
ccacugaacaggccggu

SEQ ID NO: 3326201 - RNA, 15 nt, Mycobacterium tuberculosis H37Rv
ccacugagccacagg

SEQ ID NO: 3326202 - RNA, 15 nt, Mycobacterium tuberculosis H37Rv
ccacugccacuccug

SEQ ID NO: 3326203 - RNA, 12 nt, Mycobacterium tuberculosis H37Rv
ccacugcccgcc

SEQ ID NO: 3326204 - RNA, 19 nt, Mycobacterium tuberculosis H37Rv
ccacugccgcgcgcccgcc

SEQ ID NO: 3326205 - RNA, 14 nt, Mycobacterium tuberculosis H37Rv
ccacugccggcagc

SEQ ID NO: 3326206 - RNA, 20 nt, Mycobacterium tuberculosis H37Rv
ccacugccggcagcgccccc

SEQ ID NO: 3326207 - RNA, 21 nt, Mycobacterium tuberculosis H37Rv
ccacugccgugccgguguguc

SEQ ID NO: 3326208 - RNA, 16 nt, Mycobacterium tuberculosis H37Rv
ccacugccguugccgc

SEQ ID NO: 3326209 - RNA, 18 nt, Mycobacterium tuberculosis H37Rv
ccacugccguugccgccg

SEQ ID NO: 3326210 - RNA, 18 nt, Mycobacterium tuberculosis H37Rv
ccacugcgagcgccggcu

SEQ ID NO: 3326211 - RNA, 18 nt, Mycobacterium tuberculosis H37Rv
ccacugcgccgugaccca

SEQ ID NO: 3326212 - RNA, 18 nt, Mycobacterium tuberculosis H37Rv
ccacugcuuccggaacaa

SEQ ID NO: 3326213 - RNA, 15 nt, Mycobacterium tuberculosis H37Rv
ccacuggaccaccgc

SEQ ID NO: 3326214 - RNA, 21 nt, Mycobacterium tuberculosis H37Rv
ccacuggacccgcccaggcgu

SEQ ID NO: 3326215 - RNA, 12 nt, Mycobacterium tuberculosis H37Rv
ccacuggccggu

SEQ ID NO: 3326216 - RNA, 21 nt, Mycobacterium tuberculosis H37Rv
ccacuggcgccggugccgccg

SEQ ID NO: 3326217 - RNA, 24 nt, Mycobacterium tuberculosis H37Rv
ccacuggucaacgggaugccggcg

SEQ ID NO: 3326218 - RNA, 17 nt, Mycobacterium tuberculosis H37Rv
ccacuggugaucugguc

SEQ ID NO: 3326219 - RNA, 15 nt, Mycobacterium tuberculosis H37Rv
ccacuguuacggcca

SEQ ID NO: 3326220 - RNA, 18 nt, Mycobacterium tuberculosis H37Rv
ccacuguuggugccgcca

SEQ ID NO: 3326221 - RNA, 21 nt, Mycobacterium tuberculosis H37Rv
ccacuguuggugccgccacca

SEQ ID NO: 3326222 - RNA, 17 nt, Mycobacterium tuberculosis H37Rv
ccacuuagcuggcgggg

SEQ ID NO: 3326223 - RNA, 17 nt, Mycobacterium tuberculosis H37Rv
ccacuucagaucggcga

SEQ ID NO: 3326224 - RNA, 16 nt, Mycobacterium tuberculosis H37Rv
ccacuuccacggcgug

SEQ ID NO: 3326225 - RNA, 17 nt, Mycobacterium tuberculosis H37Rv
ccacuucccgcuugagc

SEQ ID NO: 3326226 - RNA, 17 nt, Mycobacterium tuberculosis H37Rv
ccacuucggcgccgcgc

SEQ ID NO: 3326227 - RNA, 13 nt, Mycobacterium tuberculosis H37Rv
ccacuucggcguc

SEQ ID NO: 3326228 - RNA, 14 nt, Mycobacterium tuberculosis H37Rv
ccacuugaugcucg

SEQ ID NO: 3326229 - RNA, 19 nt, Mycobacterium tuberculosis H37Rv
ccacuuguuguccgucgau

SEQ ID NO: 3326230 - RNA, 16 nt, Mycobacterium tuberculosis H37Rv
ccacuuugcguuccca

SEQ ID NO: 3326231 - RNA, 15 nt, Mycobacterium tuberculosis H37Rv
ccagaaaacauugcg

SEQ ID NO: 3326232 - RNA, 22 nt, Mycobacterium tuberculosis H37Rv
ccagaaaacauugcggcccucg

SEQ ID NO: 3326233 - RNA, 18 nt, Mycobacterium tuberculosis H37Rv
ccagaaaugguucgcaca

SEQ ID NO: 3326234 - RNA, 21 nt, Mycobacterium tuberculosis H37Rv
ccagaaaugguucgcacaccu

SEQ ID NO: 3326235 - RNA, 16 nt, Mycobacterium tuberculosis H37Rv
ccagaacccggacagg

SEQ ID NO: 3326236 - RNA, 20 nt, Mycobacterium tuberculosis H37Rv
ccagaaccuggagccgugcg

SEQ ID NO: 3326237 - RNA, 15 nt, Mycobacterium tuberculosis H37Rv
ccagaacggcgucga

SEQ ID NO: 3326238 - RNA, 22 nt, Mycobacterium tuberculosis H37Rv
ccagaacgguggcgcggugccg

SEQ ID NO: 3326239 - RNA, 23 nt, Mycobacterium tuberculosis H37Rv
ccagaagaagaugaucgcgaaca

SEQ ID NO: 3326240 - RNA, 15 nt, Mycobacterium tuberculosis H37Rv
ccagaagccggccac

SEQ ID NO: 3326241 - RNA, 20 nt, Mycobacterium tuberculosis H37Rv
ccagaaggccgcaccgccac

SEQ ID NO: 3326242 - RNA, 20 nt, Mycobacterium tuberculosis H37Rv
ccagaaggccggggcggaac

SEQ ID NO: 3326243 - RNA, 20 nt, Mycobacterium tuberculosis H37Rv
ccagaaguaggcgaccgcca

SEQ ID NO: 3326244 - RNA, 18 nt, Mycobacterium tuberculosis H37Rv
ccagaagucgucauauuc

SEQ ID NO: 3326245 - RNA, 15 nt, Mycobacterium tuberculosis H37Rv
ccagaauccaggugg

SEQ ID NO: 3326246 - RNA, 23 nt, Mycobacterium tuberculosis H37Rv
ccagaaugacaucgucgccaggg

SEQ ID NO: 3326247 - RNA, 18 nt, Mycobacterium tuberculosis H37Rv
ccagaauuccggcggagc

SEQ ID NO: 3326248 - RNA, 14 nt, Mycobacterium tuberculosis H37Rv
ccagacaauccgcc

SEQ ID NO: 3326249 - RNA, 17 nt, Mycobacterium tuberculosis H37Rv
ccagacaauccgccgcc

SEQ ID NO: 3326250 - RNA, 16 nt, Mycobacterium tuberculosis H37Rv
ccagacacaaccgcuu

SEQ ID NO: 3326251 - RNA, 18 nt, Mycobacterium tuberculosis H37Rv
ccagacagacccccagac

SEQ ID NO: 3326252 - RNA, 15 nt, Mycobacterium tuberculosis H37Rv
ccagaccagggcagc

SEQ ID NO: 3326253 - RNA, 14 nt, Mycobacterium tuberculosis H37Rv
ccagacccaccacc

SEQ ID NO: 3326254 - RNA, 14 nt, Mycobacterium tuberculosis H37Rv
ccagacccagcucg

SEQ ID NO: 3326255 - RNA, 19 nt, Mycobacterium tuberculosis H37Rv
ccagaccgccgacgccguu

SEQ ID NO: 3326256 - RNA, 17 nt, Mycobacterium tuberculosis H37Rv
ccagaccgcgcgcauac

SEQ ID NO: 3326257 - RNA, 13 nt, Mycobacterium tuberculosis H37Rv
ccagaccggcggc

SEQ ID NO: 3326258 - RNA, 14 nt, Mycobacterium tuberculosis H37Rv
ccagaccggcggcu

SEQ ID NO: 3326259 - RNA, 19 nt, Mycobacterium tuberculosis H37Rv
ccagacgaacgaccaggcg

SEQ ID NO: 3326260 - RNA, 19 nt, Mycobacterium tuberculosis H37Rv
ccagacgauggccagguug

SEQ ID NO: 3326261 - RNA, 19 nt, Mycobacterium tuberculosis H37Rv
ccagacgccacugccagcc

SEQ ID NO: 3326262 - RNA, 16 nt, Mycobacterium tuberculosis H37Rv
ccagacgcucuugaau

SEQ ID NO: 3326263 - RNA, 17 nt, Mycobacterium tuberculosis H37Rv
ccagacggugcagcucc

SEQ ID NO: 3326264 - RNA, 19 nt, Mycobacterium tuberculosis H37Rv
ccagacguuccaucacgga

SEQ ID NO: 3326265 - RNA, 22 nt, Mycobacterium tuberculosis H37Rv
ccagagcagcucacuggugacc

SEQ ID NO: 3326266 - RNA, 18 nt, Mycobacterium tuberculosis H37Rv
ccagaggcgcuucgccac

SEQ ID NO: 3326267 - RNA, 16 nt, Mycobacterium tuberculosis H37Rv
ccagaggcgugucgac

SEQ ID NO: 3326268 - RNA, 13 nt, Mycobacterium tuberculosis H37Rv
ccagagucgcccg

SEQ ID NO: 3326269 - RNA, 14 nt, Mycobacterium tuberculosis H37Rv
ccagagucgcccgc

SEQ ID NO: 3326270 - RNA, 17 nt, Mycobacterium tuberculosis H37Rv
ccagagucgcccgcaca

SEQ ID NO: 3326271 - RNA, 18 nt, Mycobacterium tuberculosis H37Rv
ccagagucgcccgcacac

SEQ ID NO: 3326272 - RNA, 13 nt, Mycobacterium tuberculosis H37Rv
ccagagucggaga

SEQ ID NO: 3326273 - RNA, 12 nt, Mycobacterium tuberculosis H37Rv
ccagaguggugg

SEQ ID NO: 3326274 - RNA, 19 nt, Mycobacterium tuberculosis H37Rv
ccagaguucccgaaacccg

SEQ ID NO: 3326275 - RNA, 16 nt, Mycobacterium tuberculosis H37Rv
ccagaguucggccagc

SEQ ID NO: 3326276 - RNA, 22 nt, Mycobacterium tuberculosis H37Rv
ccagaguucggccagcgugucg

SEQ ID NO: 3326277 - RNA, 19 nt, Mycobacterium tuberculosis H37Rv
ccagauagagcuggugcag

SEQ ID NO: 3326278 - RNA, 18 nt, Mycobacterium tuberculosis H37Rv
ccagauaucguacuggcu

SEQ ID NO: 3326279 - RNA, 19 nt, Mycobacterium tuberculosis H37Rv
ccagauaucguacuggcua

SEQ ID NO: 3326280 - RNA, 13 nt, Mycobacterium tuberculosis H37Rv
ccagaucagcacc

SEQ ID NO: 3326281 - RNA, 22 nt, Mycobacterium tuberculosis H37Rv
ccagauccgucagcuuggaccc

SEQ ID NO: 3326282 - RNA, 18 nt, Mycobacterium tuberculosis H37Rv
ccagaucgaacgcagcca

SEQ ID NO: 3326283 - RNA, 22 nt, Mycobacterium tuberculosis H37Rv
ccagaucgaagcgcagcaccuc

SEQ ID NO: 3326284 - RNA, 16 nt, Mycobacterium tuberculosis H37Rv
ccagaucgcacaccaa

SEQ ID NO: 3326285 - RNA, 12 nt, Mycobacterium tuberculosis H37Rv
ccagaucgcggu

SEQ ID NO: 3326286 - RNA, 13 nt, Mycobacterium tuberculosis H37Rv
ccagaucggcggg

SEQ ID NO: 3326287 - RNA, 19 nt, Mycobacterium tuberculosis H37Rv
ccagaucggcguuggcaug

SEQ ID NO: 3326288 - RNA, 17 nt, Mycobacterium tuberculosis H37Rv
ccagaucggucggccaa

SEQ ID NO: 3326289 - RNA, 17 nt, Mycobacterium tuberculosis H37Rv
ccagcaguacaccgccc

SEQ ID NO: 3326290 - RNA, 19 nt, Mycobacterium tuberculosis H37Rv
ccagcaguacaccgcccgg

SEQ ID NO: 3326291 - RNA, 16 nt, Mycobacterium tuberculosis H37Rv
ccagcagugcgaugaa

SEQ ID NO: 3326292 - RNA, 19 nt, Mycobacterium tuberculosis H37Rv
ccagcaucaguuugacgcc

SEQ ID NO: 3326293 - RNA, 22 nt, Mycobacterium tuberculosis H37Rv
ccagcaucggcagcagcgcaac

SEQ ID NO: 3326294 - RNA, 14 nt, Mycobacterium tuberculosis H37Rv
ccagcaucucggcg

SEQ ID NO: 3326295 - RNA, 21 nt, Mycobacterium tuberculosis H37Rv
ccagcaucucggcggccaaca

SEQ ID NO: 3326296 - RNA, 16 nt, Mycobacterium tuberculosis H37Rv
ccagcaugaagucccg

SEQ ID NO: 3326297 - RNA, 15 nt, Mycobacterium tuberculosis H37Rv
ccagcaugacaccgg

SEQ ID NO: 3326298 - RNA, 20 nt, Mycobacterium tuberculosis H37Rv
ccagcaugacaccggccacc

SEQ ID NO: 3326299 - RNA, 21 nt, Mycobacterium tuberculosis H37Rv
ccagcaugacaccggccacca

SEQ ID NO: 3326300 - RNA, 23 nt, Mycobacterium tuberculosis H37Rv
ccagcaugacaccggccaccagc

SEQ ID NO: 3326301 - RNA, 21 nt, Mycobacterium tuberculosis H37Rv
ccagcaugcccgccauccgau

SEQ ID NO: 3326302 - RNA, 19 nt, Mycobacterium tuberculosis H37Rv
ccagcauggggucagcucg

SEQ ID NO: 3326303 - RNA, 22 nt, Mycobacterium tuberculosis H37Rv
ccagcauggggucagcucgcca

SEQ ID NO: 3326304 - RNA, 20 nt, Mycobacterium tuberculosis H37Rv
ccagcauucucgccgacggc

SEQ ID NO: 3326305 - RNA, 14 nt, Mycobacterium tuberculosis H37Rv
ccagcauugacccg

SEQ ID NO: 3326306 - RNA, 18 nt, Mycobacterium tuberculosis H37Rv
ccagccaaaacgagcaga

SEQ ID NO: 3326307 - RNA, 16 nt, Mycobacterium tuberculosis H37Rv
ccagccaacucaggcc

SEQ ID NO: 3326308 - RNA, 17 nt, Mycobacterium tuberculosis H37Rv
ccagccaacucaggccg

SEQ ID NO: 3326309 - RNA, 16 nt, Mycobacterium tuberculosis H37Rv
ccagccacagcccggc

SEQ ID NO: 3326310 - RNA, 15 nt, Mycobacterium tuberculosis H37Rv
ccagccacagccgac

SEQ ID NO: 3326311 - RNA, 19 nt, Mycobacterium tuberculosis H37Rv
ccagccacagccgaccucg

SEQ ID NO: 3326312 - RNA, 15 nt, Mycobacterium tuberculosis H37Rv
ccagccaccaccagg

SEQ ID NO: 3326313 - RNA, 14 nt, Mycobacterium tuberculosis H37Rv
ccagccaccgccgc

SEQ ID NO: 3326314 - RNA, 19 nt, Mycobacterium tuberculosis H37Rv
ccagccagcagcggcgagc

SEQ ID NO: 3326315 - RNA, 14 nt, Mycobacterium tuberculosis H37Rv
ccagccagccgccc

SEQ ID NO: 3326316 - RNA, 16 nt, Mycobacterium tuberculosis H37Rv
ccagccagccugcugg

SEQ ID NO: 3326317 - RNA, 15 nt, Mycobacterium tuberculosis H37Rv
ccagccagcgggcga

SEQ ID NO: 3326318 - RNA, 18 nt, Mycobacterium tuberculosis H37Rv
ccagccagcgggcgauga

SEQ ID NO: 3326319 - RNA, 21 nt, Mycobacterium tuberculosis H37Rv
ccagccaggugauuaccuggu

SEQ ID NO: 3326320 - RNA, 23 nt, Mycobacterium tuberculosis H37Rv
ccagccauagugcggcagcggug

SEQ ID NO: 3326321 - RNA, 13 nt, Mycobacterium tuberculosis H37Rv
ccagccaugcucg

SEQ ID NO: 3326322 - RNA, 18 nt, Mycobacterium tuberculosis H37Rv
ccagccauggcagcgccg

SEQ ID NO: 3326323 - RNA, 19 nt, Mycobacterium tuberculosis H37Rv
ccagcccaacucggccagc

SEQ ID NO: 3326324 - RNA, 17 nt, Mycobacterium tuberculosis H37Rv
ccagcccagauccagca

SEQ ID NO: 3326325 - RNA, 16 nt, Mycobacterium tuberculosis H37Rv
ccagcccagccgccag

SEQ ID NO: 3326326 - RNA, 19 nt, Mycobacterium tuberculosis H37Rv
ccagcccagccgccagccc

SEQ ID NO: 3326327 - RNA, 13 nt, Mycobacterium tuberculosis H37Rv
ccagcccagccgg

SEQ ID NO: 3326328 - RNA, 13 nt, Mycobacterium tuberculosis H37Rv
ccagcccagcggc

SEQ ID NO: 3326329 - RNA, 17 nt, Mycobacterium tuberculosis H37Rv
ccagcccagcggcuggu

SEQ ID NO: 3326330 - RNA, 14 nt, Mycobacterium tuberculosis H37Rv
ccagcccaggccuu

SEQ ID NO: 3326331 - RNA, 14 nt, Mycobacterium tuberculosis H37Rv
ccagccccacccgc

SEQ ID NO: 3326332 - RNA, 16 nt, Mycobacterium tuberculosis H37Rv
ccagccccaucgcugg

SEQ ID NO: 3326333 - RNA, 13 nt, Mycobacterium tuberculosis H37Rv
ccagccccccggc

SEQ ID NO: 3326334 - RNA, 17 nt, Mycobacterium tuberculosis H37Rv
ccagccccccggcgacg

SEQ ID NO: 3326335 - RNA, 17 nt, Mycobacterium tuberculosis H37Rv
ccagccccgacugacag

SEQ ID NO: 3326336 - RNA, 16 nt, Mycobacterium tuberculosis H37Rv
ccagccccgcgcccac

SEQ ID NO: 3326337 - RNA, 20 nt, Mycobacterium tuberculosis H37Rv
ccagccccgcgcccaccccg

SEQ ID NO: 3326338 - RNA, 17 nt, Mycobacterium tuberculosis H37Rv
ccagccccgcuggucga

SEQ ID NO: 3326339 - RNA, 19 nt, Mycobacterium tuberculosis H37Rv
ccagccccgcuggucgacc

SEQ ID NO: 3326340 - RNA, 19 nt, Mycobacterium tuberculosis H37Rv
ccagcccgacagcagguug

SEQ ID NO: 3326341 - RNA, 14 nt, Mycobacterium tuberculosis H37Rv
ccagcccgagcaga

SEQ ID NO: 3326342 - RNA, 13 nt, Mycobacterium tuberculosis H37Rv
ccagcccgcccag

SEQ ID NO: 3326343 - RNA, 20 nt, Mycobacterium tuberculosis H37Rv
ccagcccgcccgguguguuc

SEQ ID NO: 3326344 - RNA, 12 nt, Mycobacterium tuberculosis H37Rv
ccagcccgccga

SEQ ID NO: 3326345 - RNA, 15 nt, Mycobacterium tuberculosis H37Rv
ccagcccgccgucgg

SEQ ID NO: 3326346 - RNA, 15 nt, Mycobacterium tuberculosis H37Rv
ccagcccggcccagu

SEQ ID NO: 3326347 - RNA, 13 nt, Mycobacterium tuberculosis H37Rv
ccagcccggccgc

SEQ ID NO: 3326348 - RNA, 23 nt, Mycobacterium tuberculosis H37Rv
ccagcccggccggucgagacgcu

SEQ ID NO: 3326349 - RNA, 21 nt, Mycobacterium tuberculosis H37Rv
ccagcccggcggcggucacca

SEQ ID NO: 3326350 - RNA, 23 nt, Mycobacterium tuberculosis H37Rv
ccagcccggucauggucagcaga

SEQ ID NO: 3326351 - RNA, 16 nt, Mycobacterium tuberculosis H37Rv
ccagcccgucaucgcg

SEQ ID NO: 3326352 - RNA, 16 nt, Mycobacterium tuberculosis H37Rv
ccagcccguccggccc

SEQ ID NO: 3326353 - RNA, 24 nt, Mycobacterium tuberculosis H37Rv
ccagcccguccggcccccgaggcu

SEQ ID NO: 3326354 - RNA, 18 nt, Mycobacterium tuberculosis H37Rv
ccagcccuguuugacugc

SEQ ID NO: 3326355 - RNA, 24 nt, Mycobacterium tuberculosis H37Rv
ccagccgaagaaccggucgcagug

SEQ ID NO: 3326356 - RNA, 20 nt, Mycobacterium tuberculosis H37Rv
ccagccgacaacuguccugc

SEQ ID NO: 3326357 - RNA, 16 nt, Mycobacterium tuberculosis H37Rv
ccagccgacgccuucc

SEQ ID NO: 3326358 - RNA, 20 nt, Mycobacterium tuberculosis H37Rv
ccagccgacguaccagggug

SEQ ID NO: 3326359 - RNA, 17 nt, Mycobacterium tuberculosis H37Rv
ccagccgaucaucaccg

SEQ ID NO: 3326360 - RNA, 16 nt, Mycobacterium tuberculosis H37Rv
ccagccgcagcaccuc

SEQ ID NO: 3326361 - RNA, 14 nt, Mycobacterium tuberculosis H37Rv
ccagccgccccggc

SEQ ID NO: 3326362 - RNA, 15 nt, Mycobacterium tuberculosis H37Rv
ccagccgccccggcu

SEQ ID NO: 3326363 - RNA, 21 nt, Mycobacterium tuberculosis H37Rv
ccagccgcgccagcuccgugu

SEQ ID NO: 3326364 - RNA, 17 nt, Mycobacterium tuberculosis H37Rv
ccagccgcgcgccggcc

SEQ ID NO: 3326365 - RNA, 14 nt, Mycobacterium tuberculosis H37Rv
ccagccgcgcgucc

SEQ ID NO: 3326366 - RNA, 16 nt, Mycobacterium tuberculosis H37Rv
ccagccgcggcccucg

SEQ ID NO: 3326367 - RNA, 13 nt, Mycobacterium tuberculosis H37Rv
ccagccggaccgc

SEQ ID NO: 3326368 - RNA, 15 nt, Mycobacterium tuberculosis H37Rv
ccagccggcagcagc

SEQ ID NO: 3326369 - RNA, 15 nt, Mycobacterium tuberculosis H37Rv
ccagccggcgcacuc

SEQ ID NO: 3326370 - RNA, 16 nt, Mycobacterium tuberculosis H37Rv
ccagccggcgcacucc

SEQ ID NO: 3326371 - RNA, 14 nt, Mycobacterium tuberculosis H37Rv
ccagccggcgcgcc

SEQ ID NO: 3326372 - RNA, 13 nt, Mycobacterium tuberculosis H37Rv
ccagccgguccag

SEQ ID NO: 3326373 - RNA, 17 nt, Mycobacterium tuberculosis H37Rv
ccagccgguccagaccc

SEQ ID NO: 3326374 - RNA, 15 nt, Mycobacterium tuberculosis H37Rv
ccagccggucgucgc

SEQ ID NO: 3326375 - RNA, 14 nt, Mycobacterium tuberculosis H37Rv
ccagccggucuugg

SEQ ID NO: 3326376 - RNA, 14 nt, Mycobacterium tuberculosis H37Rv
ccagccgucggcgc

SEQ ID NO: 3326377 - RNA, 23 nt, Mycobacterium tuberculosis H37Rv
ccagccgucggcgcugcgcgcga

SEQ ID NO: 3326378 - RNA, 20 nt, Mycobacterium tuberculosis H37Rv
ccagccgucgucagguggcc

SEQ ID NO: 3326379 - RNA, 16 nt, Mycobacterium tuberculosis H37Rv
ccagccgugcggcggc

SEQ ID NO: 3326380 - RNA, 17 nt, Mycobacterium tuberculosis H37Rv
ccagccguggugguuga

SEQ ID NO: 3326381 - RNA, 17 nt, Mycobacterium tuberculosis H37Rv
ccagccguucucgccca

SEQ ID NO: 3326382 - RNA, 14 nt, Mycobacterium tuberculosis H37Rv
ccagccuaccggcu

SEQ ID NO: 3326383 - RNA, 13 nt, Mycobacterium tuberculosis H37Rv
ccagccugcuggc

SEQ ID NO: 3326384 - RNA, 23 nt, Mycobacterium tuberculosis H37Rv
ccagccugcuggccgcggccucg

SEQ ID NO: 3326385 - RNA, 13 nt, Mycobacterium tuberculosis H37Rv
ccagccuggcaac

SEQ ID NO: 3326386 - RNA, 24 nt, Mycobacterium tuberculosis H37Rv
ccagcgguaaugccagcggcacac

SEQ ID NO: 3326387 - RNA, 17 nt, Mycobacterium tuberculosis H37Rv
ccagcgguagccgagcu

SEQ ID NO: 3326388 - RNA, 18 nt, Mycobacterium tuberculosis H37Rv
ccagcggucagccggcca

SEQ ID NO: 3326389 - RNA, 14 nt, Mycobacterium tuberculosis H37Rv
ccagcggucggcgg

SEQ ID NO: 3326390 - RNA, 14 nt, Mycobacterium tuberculosis H37Rv
ccagcgguggacca

SEQ ID NO: 3326391 - RNA, 18 nt, Mycobacterium tuberculosis H37Rv
ccagcguaaauagcgccc

SEQ ID NO: 3326392 - RNA, 22 nt, Mycobacterium tuberculosis H37Rv
ccagcguaaauagcgcccugcc

SEQ ID NO: 3326393 - RNA, 16 nt, Mycobacterium tuberculosis H37Rv
ccagcgucaccucacc

SEQ ID NO: 3326394 - RNA, 18 nt, Mycobacterium tuberculosis H37Rv
ccagcguccagccgcccu

SEQ ID NO: 3326395 - RNA, 22 nt, Mycobacterium tuberculosis H37Rv
ccagcguccauggucgcgccac

SEQ ID NO: 3326396 - RNA, 14 nt, Mycobacterium tuberculosis H37Rv
ccagcguccuggcg

SEQ ID NO: 3326397 - RNA, 16 nt, Mycobacterium tuberculosis H37Rv
ccagcgucgacacacc

SEQ ID NO: 3326398 - RNA, 18 nt, Mycobacterium tuberculosis H37Rv
ccagcgucgacacaccca

SEQ ID NO: 3326399 - RNA, 15 nt, Mycobacterium tuberculosis H37Rv
ccagcgucgcaaggc

SEQ ID NO: 3326400 - RNA, 13 nt, Mycobacterium tuberculosis H37Rv
ccagcgucgccgc

SEQ ID NO: 3326401 - RNA, 15 nt, Mycobacterium tuberculosis H37Rv
ccagcgucgccgcca

SEQ ID NO: 3326402 - RNA, 20 nt, Mycobacterium tuberculosis H37Rv
ccagcgucgcgauugccgcg

SEQ ID NO: 3326403 - RNA, 22 nt, Mycobacterium tuberculosis H37Rv
ccagcgucgcgauugccgcggu

SEQ ID NO: 3326404 - RNA, 15 nt, Mycobacterium tuberculosis H37Rv
ccagcgucgcggcca

SEQ ID NO: 3326405 - RNA, 14 nt, Mycobacterium tuberculosis H37Rv
ccagcgucucgauc

SEQ ID NO: 3326406 - RNA, 17 nt, Mycobacterium tuberculosis H37Rv
ccagcgucucgaucacc

SEQ ID NO: 3326407 - RNA, 14 nt, Mycobacterium tuberculosis H37Rv
ccagcgugcccgcc

SEQ ID NO: 3326408 - RNA, 15 nt, Mycobacterium tuberculosis H37Rv
ccagcgugcccgcca

SEQ ID NO: 3326409 - RNA, 22 nt, Mycobacterium tuberculosis H37Rv
ccagcgugcccgccaccggcgc

SEQ ID NO: 3326410 - RNA, 16 nt, Mycobacterium tuberculosis H37Rv
ccagcgugcugccgga

SEQ ID NO: 3326411 - RNA, 17 nt, Mycobacterium tuberculosis H37Rv
ccagcguggggccgcca

SEQ ID NO: 3326412 - RNA, 23 nt, Mycobacterium tuberculosis H37Rv
ccagcguggugaagucggugccg

SEQ ID NO: 3326413 - RNA, 17 nt, Mycobacterium tuberculosis H37Rv
ccagcguguggagcucg

SEQ ID NO: 3326414 - RNA, 20 nt, Mycobacterium tuberculosis H37Rv
ccagcguuaggucgccggcu

SEQ ID NO: 3326415 - RNA, 18 nt, Mycobacterium tuberculosis H37Rv
ccagcguucccgccggcu

SEQ ID NO: 3326416 - RNA, 14 nt, Mycobacterium tuberculosis H37Rv
ccagcucacccugc

SEQ ID NO: 3326417 - RNA, 16 nt, Mycobacterium tuberculosis H37Rv
ccagcucacgaugucg

SEQ ID NO: 3326418 - RNA, 20 nt, Mycobacterium tuberculosis H37Rv
ccagcucacggacgcugggc

SEQ ID NO: 3326419 - RNA, 19 nt, Mycobacterium tuberculosis H37Rv
ccagcuccacaaguagccg

SEQ ID NO: 3326420 - RNA, 13 nt, Mycobacterium tuberculosis H37Rv
ccagcuccagcgc

SEQ ID NO: 3326421 - RNA, 14 nt, Mycobacterium tuberculosis H37Rv
ccagcucccgcggc

SEQ ID NO: 3326422 - RNA, 14 nt, Mycobacterium tuberculosis H37Rv
ccagcuccgccugc

SEQ ID NO: 3326423 - RNA, 16 nt, Mycobacterium tuberculosis H37Rv
ccagcuccgccugccg

SEQ ID NO: 3326424 - RNA, 12 nt, Mycobacterium tuberculosis H37Rv
ccagcuccugac

SEQ ID NO: 3326425 - RNA, 13 nt, Mycobacterium tuberculosis H37Rv
ccagcuccugcau

SEQ ID NO: 3326426 - RNA, 17 nt, Mycobacterium tuberculosis H37Rv
ccagcuccugcaugccg

SEQ ID NO: 3326427 - RNA, 21 nt, Mycobacterium tuberculosis H37Rv
ccagcucgagguccucagcga

SEQ ID NO: 3326428 - RNA, 14 nt, Mycobacterium tuberculosis H37Rv
ccagcucgcgcacc

SEQ ID NO: 3326429 - RNA, 19 nt, Mycobacterium tuberculosis H37Rv
ccagcucgcgcacccagcc

SEQ ID NO: 3326430 - RNA, 17 nt, Mycobacterium tuberculosis H37Rv
ccagcucgcgggccgcg

SEQ ID NO: 3326431 - RNA, 14 nt, Mycobacterium tuberculosis H37Rv
ccagcucgcugcgc

SEQ ID NO: 3326432 - RNA, 18 nt, Mycobacterium tuberculosis H37Rv
ccagcucgcugcgcgccc

SEQ ID NO: 3326433 - RNA, 20 nt, Mycobacterium tuberculosis H37Rv
ccagcucgcugcgcgcccac

SEQ ID NO: 3326434 - RNA, 12 nt, Mycobacterium tuberculosis H37Rv
ccagcucggcac

SEQ ID NO: 3326435 - RNA, 13 nt, Mycobacterium tuberculosis H37Rv
ccagcucggccag

SEQ ID NO: 3326436 - RNA, 16 nt, Mycobacterium tuberculosis H37Rv
ccagcucggccagcug

SEQ ID NO: 3326437 - RNA, 13 nt, Mycobacterium tuberculosis H37Rv
ccagcucggcggg

SEQ ID NO: 3326438 - RNA, 17 nt, Mycobacterium tuberculosis H37Rv
ccagcucggcgggcucg

SEQ ID NO: 3326439 - RNA, 16 nt, Mycobacterium tuberculosis H37Rv
ccagcucgggcgcgcg

SEQ ID NO: 3326440 - RNA, 21 nt, Mycobacterium tuberculosis H37Rv
ccagcucggugaucaccauga

SEQ ID NO: 3326441 - RNA, 16 nt, Mycobacterium tuberculosis H37Rv
ccagcucgucgacguc

SEQ ID NO: 3326442 - RNA, 20 nt, Mycobacterium tuberculosis H37Rv
ccagcucgucgagcugaucc

SEQ ID NO: 3326443 - RNA, 18 nt, Mycobacterium tuberculosis H37Rv
ccagcucgucgucggcgu

SEQ ID NO: 3326444 - RNA, 19 nt, Mycobacterium tuberculosis H37Rv
ccagcucuucggggaugac

SEQ ID NO: 3326445 - RNA, 18 nt, Mycobacterium tuberculosis H37Rv
ccagcugagcggccggca

SEQ ID NO: 3326446 - RNA, 16 nt, Mycobacterium tuberculosis H37Rv
ccagcugcagcagacc

SEQ ID NO: 3326447 - RNA, 18 nt, Mycobacterium tuberculosis H37Rv
ccagcugcagcagacccg

SEQ ID NO: 3326448 - RNA, 20 nt, Mycobacterium tuberculosis H37Rv
ccagcugcagcagacccggu

SEQ ID NO: 3326449 - RNA, 22 nt, Mycobacterium tuberculosis H37Rv
ccagcugcagcagacccggugg

SEQ ID NO: 3326450 - RNA, 17 nt, Mycobacterium tuberculosis H37Rv
ccagcugcgcgggcgag

SEQ ID NO: 3326451 - RNA, 13 nt, Mycobacterium tuberculosis H37Rv
ccagcugcucguc

SEQ ID NO: 3326452 - RNA, 18 nt, Mycobacterium tuberculosis H37Rv
ccagcuggaacggcagca

SEQ ID NO: 3326453 - RNA, 15 nt, Mycobacterium tuberculosis H37Rv
ccagcugggcgacca

SEQ ID NO: 3326454 - RNA, 15 nt, Mycobacterium tuberculosis H37Rv
ccagcuguugucgcg

SEQ ID NO: 3326455 - RNA, 21 nt, Mycobacterium tuberculosis H37Rv
ccagcuucucagcaccaugcu

SEQ ID NO: 3326456 - RNA, 21 nt, Mycobacterium tuberculosis H37Rv
ccagcuugaccgaccacgcga

SEQ ID NO: 3326457 - RNA, 16 nt, Mycobacterium tuberculosis H37Rv
ccagcuugcgccgcag

SEQ ID NO: 3326458 - RNA, 19 nt, Mycobacterium tuberculosis H37Rv
ccagcuugcggagccgccg

SEQ ID NO: 3326459 - RNA, 16 nt, Mycobacterium tuberculosis H37Rv
ccagcuuggcaaccug

SEQ ID NO: 3326460 - RNA, 17 nt, Mycobacterium tuberculosis H37Rv
ccagcuuggcgagcagg

SEQ ID NO: 3326461 - RNA, 12 nt, Mycobacterium tuberculosis H37Rv
ccaggaacccgu

SEQ ID NO: 3326462 - RNA, 16 nt, Mycobacterium tuberculosis H37Rv
ccaggaacgggacgcc

SEQ ID NO: 3326463 - RNA, 22 nt, Mycobacterium tuberculosis H37Rv
ccaggaagcacaugcucggccu

SEQ ID NO: 3326464 - RNA, 19 nt, Mycobacterium tuberculosis H37Rv
ccaggaagcaggugaaaca

SEQ ID NO: 3326465 - RNA, 20 nt, Mycobacterium tuberculosis H37Rv
ccaggaaguagaugagcaga

SEQ ID NO: 3326466 - RNA, 12 nt, Mycobacterium tuberculosis H37Rv
ccaggaaguccc

SEQ ID NO: 3326467 - RNA, 13 nt, Mycobacterium tuberculosis H37Rv
ccaggaagucccg

SEQ ID NO: 3326468 - RNA, 14 nt, Mycobacterium tuberculosis H37Rv
ccaggaagucccgg

SEQ ID NO: 3326469 - RNA, 17 nt, Mycobacterium tuberculosis H37Rv
ccaggaaugucuccagu

SEQ ID NO: 3326470 - RNA, 22 nt, Mycobacterium tuberculosis H37Rv
ccaggaaugucuccaguagccg

SEQ ID NO: 3326471 - RNA, 12 nt, Mycobacterium tuberculosis H37Rv
ccaggacaccuu

SEQ ID NO: 3326472 - RNA, 19 nt, Mycobacterium tuberculosis H37Rv
ccaggacgacgccgacgau

SEQ ID NO: 3326473 - RNA, 21 nt, Mycobacterium tuberculosis H37Rv
ccaggacgauggcaagggccg

SEQ ID NO: 3326474 - RNA, 19 nt, Mycobacterium tuberculosis H37Rv
ccaggacggcuaccaccgc

SEQ ID NO: 3326475 - RNA, 14 nt, Mycobacterium tuberculosis H37Rv
ccaggacggucgcc

SEQ ID NO: 3326476 - RNA, 19 nt, Mycobacterium tuberculosis H37Rv
ccaggacgguugguccgcc

SEQ ID NO: 3326477 - RNA, 16 nt, Mycobacterium tuberculosis H37Rv
ccaggacuggcaccgc

SEQ ID NO: 3326478 - RNA, 19 nt, Mycobacterium tuberculosis H37Rv
ccaggacuggcaccgccag

SEQ ID NO: 3326479 - RNA, 21 nt, Mycobacterium tuberculosis H37Rv
ccaggacuggcaccgccagcc

SEQ ID NO: 3326480 - RNA, 22 nt, Mycobacterium tuberculosis H37Rv
ccaggacuggcaccgccagcca

SEQ ID NO: 3326481 - RNA, 16 nt, Mycobacterium tuberculosis H37Rv
ccaggagcacggguug

SEQ ID NO: 3326482 - RNA, 17 nt, Mycobacterium tuberculosis H37Rv
ccaggagcacggguuga

SEQ ID NO: 3326483 - RNA, 16 nt, Mycobacterium tuberculosis H37Rv
ccagggccgccgcugc

SEQ ID NO: 3326484 - RNA, 21 nt, Mycobacterium tuberculosis H37Rv
ccagggccgccgcugccgccu

SEQ ID NO: 3326485 - RNA, 17 nt, Mycobacterium tuberculosis H37Rv
ccagggccucgaccgcc

SEQ ID NO: 3326486 - RNA, 20 nt, Mycobacterium tuberculosis H37Rv
ccagggccucgaccgccagc

SEQ ID NO: 3326487 - RNA, 21 nt, Mycobacterium tuberculosis H37Rv
ccagggccucgaccgccagcc

SEQ ID NO: 3326488 - RNA, 18 nt, Mycobacterium tuberculosis H37Rv
ccagggcgacgagaucug

SEQ ID NO: 3326489 - RNA, 12 nt, Mycobacterium tuberculosis H37Rv
ccagggcgccac

SEQ ID NO: 3326490 - RNA, 18 nt, Mycobacterium tuberculosis H37Rv
ccagggcgccacggguga

SEQ ID NO: 3326491 - RNA, 14 nt, Mycobacterium tuberculosis H37Rv
ccagggcggcaucc

SEQ ID NO: 3326492 - RNA, 18 nt, Mycobacterium tuberculosis H37Rv
ccagggcggcauccccag

SEQ ID NO: 3326493 - RNA, 18 nt, Mycobacterium tuberculosis H37Rv
ccagggcgguggccaccc

SEQ ID NO: 3326494 - RNA, 20 nt, Mycobacterium tuberculosis H37Rv
ccagggcgguggccacccgg

SEQ ID NO: 3326495 - RNA, 19 nt, Mycobacterium tuberculosis H37Rv
ccagggcucggcggcccgg

SEQ ID NO: 3326496 - RNA, 13 nt, Mycobacterium tuberculosis H37Rv
ccaggggcgcaac

SEQ ID NO: 3326497 - RNA, 19 nt, Mycobacterium tuberculosis H37Rv
ccagggggcgugccgccgc

SEQ ID NO: 3326498 - RNA, 15 nt, Mycobacterium tuberculosis H37Rv
ccagggucccgccgc

SEQ ID NO: 3326499 - RNA, 15 nt, Mycobacterium tuberculosis H37Rv
ccagggucgaugucg

SEQ ID NO: 3326500 - RNA, 18 nt, Mycobacterium tuberculosis H37Rv
ccagggucgaugucgucg

SEQ ID NO: 3326501 - RNA, 19 nt, Mycobacterium tuberculosis H37Rv
ccagggucgcgagcccgcc

SEQ ID NO: 3326502 - RNA, 15 nt, Mycobacterium tuberculosis H37Rv
ccagggucugcucau

SEQ ID NO: 3326503 - RNA, 16 nt, Mycobacterium tuberculosis H37Rv
ccagggucugcucauc

SEQ ID NO: 3326504 - RNA, 12 nt, Mycobacterium tuberculosis H37Rv
ccagggugacca

SEQ ID NO: 3326505 - RNA, 21 nt, Mycobacterium tuberculosis H37Rv
ccagggugcccucggccgccu

SEQ ID NO: 3326506 - RNA, 22 nt, Mycobacterium tuberculosis H37Rv
ccaggguggucaguccgucggc

SEQ ID NO: 3326507 - RNA, 18 nt, Mycobacterium tuberculosis H37Rv
ccaggguguauggccacc

SEQ ID NO: 3326508 - RNA, 23 nt, Mycobacterium tuberculosis H37Rv
ccaggguguccauguucuccggc

SEQ ID NO: 3326509 - RNA, 22 nt, Mycobacterium tuberculosis H37Rv
ccaggguguccgucgaaccuac

SEQ ID NO: 3326510 - RNA, 21 nt, Mycobacterium tuberculosis H37Rv
ccagguacgcgaucagcgcgc

SEQ ID NO: 3326511 - RNA, 23 nt, Mycobacterium tuberculosis H37Rv
ccagguacucaguguuccgccac

SEQ ID NO: 3326512 - RNA, 22 nt, Mycobacterium tuberculosis H37Rv
ccagguagaacuccucgcuguc

SEQ ID NO: 3326513 - RNA, 15 nt, Mycobacterium tuberculosis H37Rv
ccagguagaccaggu

SEQ ID NO: 3326514 - RNA, 19 nt, Mycobacterium tuberculosis H37Rv
ccagguagaccaggugcag

SEQ ID NO: 3326515 - RNA, 15 nt, Mycobacterium tuberculosis H37Rv
ccagguagucgacca

SEQ ID NO: 3326516 - RNA, 19 nt, Mycobacterium tuberculosis H37Rv
ccaggucaacgacguugau

SEQ ID NO: 3326517 - RNA, 14 nt, Mycobacterium tuberculosis H37Rv
ccaggucaugccgu

SEQ ID NO: 3326518 - RNA, 18 nt, Mycobacterium tuberculosis H37Rv
ccaggucauugccggcga

SEQ ID NO: 3326519 - RNA, 21 nt, Mycobacterium tuberculosis H37Rv
ccagguccgccggugccgccg

SEQ ID NO: 3326520 - RNA, 15 nt, Mycobacterium tuberculosis H37Rv
ccaggucgacaccgc

SEQ ID NO: 3326521 - RNA, 21 nt, Mycobacterium tuberculosis H37Rv
ccaggucgacauaggccaccu

SEQ ID NO: 3326522 - RNA, 19 nt, Mycobacterium tuberculosis H37Rv
ccaggucgaggcaggccuc

SEQ ID NO: 3326523 - RNA, 14 nt, Mycobacterium tuberculosis H37Rv
ccaggucgaugcgg

SEQ ID NO: 3326524 - RNA, 20 nt, Mycobacterium tuberculosis H37Rv
ccaggucgcauucugcugcc

SEQ ID NO: 3326525 - RNA, 13 nt, Mycobacterium tuberculosis H37Rv
ccaggucggccac

SEQ ID NO: 3326526 - RNA, 14 nt, Mycobacterium tuberculosis H37Rv
ccaggucggccacc

SEQ ID NO: 3326527 - RNA, 16 nt, Mycobacterium tuberculosis H37Rv
ccaggucggccaccgu

SEQ ID NO: 3326528 - RNA, 12 nt, Mycobacterium tuberculosis H37Rv
ccaggucggcga

SEQ ID NO: 3326529 - RNA, 12 nt, Mycobacterium tuberculosis H37Rv
ccaggucggcgg

SEQ ID NO: 3326530 - RNA, 15 nt, Mycobacterium tuberculosis H37Rv
ccaggucggcggacg

SEQ ID NO: 3326531 - RNA, 16 nt, Mycobacterium tuberculosis H37Rv
ccaggucggcguugau

SEQ ID NO: 3326532 - RNA, 20 nt, Mycobacterium tuberculosis H37Rv
ccaggucggcuucgacaacc

SEQ ID NO: 3326533 - RNA, 22 nt, Mycobacterium tuberculosis H37Rv
ccaggucuccaucaaccgcgcu

SEQ ID NO: 3326534 - RNA, 15 nt, Mycobacterium tuberculosis H37Rv
ccaggucuccuuggg

SEQ ID NO: 3326535 - RNA, 22 nt, Mycobacterium tuberculosis H37Rv
ccaggucugggcuuugcagcgu

SEQ ID NO: 3326536 - RNA, 18 nt, Mycobacterium tuberculosis H37Rv
ccaggucuuucgaauccc

SEQ ID NO: 3326537 - RNA, 14 nt, Mycobacterium tuberculosis H37Rv
ccaggugaugccgc

SEQ ID NO: 3326538 - RNA, 11 nt, Mycobacterium tuberculosis H37Rv
ccaggugcagg

SEQ ID NO: 3326539 - RNA, 13 nt, Mycobacterium tuberculosis H37Rv
ccaggugcaggcu

SEQ ID NO: 3326540 - RNA, 17 nt, Mycobacterium tuberculosis H37Rv
ccaggugcccaagcagu

SEQ ID NO: 3326541 - RNA, 14 nt, Mycobacterium tuberculosis H37Rv
ccagguggccaggc

SEQ ID NO: 3326542 - RNA, 15 nt, Mycobacterium tuberculosis H37Rv
ccagguggccaggcc

SEQ ID NO: 3326543 - RNA, 14 nt, Mycobacterium tuberculosis H37Rv
ccaggugggcagca

SEQ ID NO: 3326544 - RNA, 18 nt, Mycobacterium tuberculosis H37Rv
ccaggugggcagcaggcc

SEQ ID NO: 3326545 - RNA, 22 nt, Mycobacterium tuberculosis H37Rv
ccaggugggcagcaggcccacc

SEQ ID NO: 3326546 - RNA, 21 nt, Mycobacterium tuberculosis H37Rv
ccaggugggccgagagcagcc

SEQ ID NO: 3326547 - RNA, 19 nt, Mycobacterium tuberculosis H37Rv
ccaggugggugaacgccug

SEQ ID NO: 3326548 - RNA, 17 nt, Mycobacterium tuberculosis H37Rv
ccaggugguucaaccgg

SEQ ID NO: 3326549 - RNA, 20 nt, Mycobacterium tuberculosis H37Rv
ccagguguccccgcccggcc

SEQ ID NO: 3326550 - RNA, 23 nt, Mycobacterium tuberculosis H37Rv
ccagguguucgccggagacccgg

SEQ ID NO: 3326551 - RNA, 20 nt, Mycobacterium tuberculosis H37Rv
ccagguugaagaaugccguc

SEQ ID NO: 3326552 - RNA, 16 nt, Mycobacterium tuberculosis H37Rv
ccagguugauccagug

SEQ ID NO: 3326553 - RNA, 19 nt, Mycobacterium tuberculosis H37Rv
ccagguugugugacagccc

SEQ ID NO: 3326554 - RNA, 22 nt, Mycobacterium tuberculosis H37Rv
ccagguugugugacagcccgcu

SEQ ID NO: 3326555 - RNA, 16 nt, Mycobacterium tuberculosis H37Rv
ccagguuuugccgcgu

SEQ ID NO: 3326556 - RNA, 14 nt, Mycobacterium tuberculosis H37Rv
ccaguaagccgcgg

SEQ ID NO: 3326557 - RNA, 14 nt, Mycobacterium tuberculosis H37Rv
ccaguaauuccgau

SEQ ID NO: 3326558 - RNA, 16 nt, Mycobacterium tuberculosis H37Rv
ccaguaccaccggcac

SEQ ID NO: 3326559 - RNA, 22 nt, Mycobacterium tuberculosis H37Rv
ccaguaccacuguuacggccac

SEQ ID NO: 3326560 - RNA, 13 nt, Mycobacterium tuberculosis H37Rv
ccaguacucggcc

SEQ ID NO: 3326561 - RNA, 14 nt, Mycobacterium tuberculosis H37Rv
ccaguacucggcca

SEQ ID NO: 3326562 - RNA, 16 nt, Mycobacterium tuberculosis H37Rv
ccaguacucggccagc

SEQ ID NO: 3326563 - RNA, 16 nt, Mycobacterium tuberculosis H37Rv
ccaguagaucgccucg

SEQ ID NO: 3326564 - RNA, 21 nt, Mycobacterium tuberculosis H37Rv
ccaguaggcuucgaccguggu

SEQ ID NO: 3326565 - RNA, 18 nt, Mycobacterium tuberculosis H37Rv
ccaguauggccgccaccg

SEQ ID NO: 3326566 - RNA, 21 nt, Mycobacterium tuberculosis H37Rv
ccaguauggccgccaccgcga

SEQ ID NO: 3326567 - RNA, 16 nt, Mycobacterium tuberculosis H37Rv
ccagucacgcccacca

SEQ ID NO: 3326568 - RNA, 14 nt, Mycobacterium tuberculosis H37Rv
ccaguccaagcugu

SEQ ID NO: 3326569 - RNA, 20 nt, Mycobacterium tuberculosis H37Rv
ccaguccaggacggucgcca

SEQ ID NO: 3326570 - RNA, 19 nt, Mycobacterium tuberculosis H37Rv
ccaguccaugugcccaggu

SEQ ID NO: 3326571 - RNA, 14 nt, Mycobacterium tuberculosis H37Rv
ccagucccggcgca

SEQ ID NO: 3326572 - RNA, 17 nt, Mycobacterium tuberculosis H37Rv
ccaguccgaugggaauc

SEQ ID NO: 3326573 - RNA, 23 nt, Mycobacterium tuberculosis H37Rv
ccaguccgaugguaugcccgccg

SEQ ID NO: 3326574 - RNA, 23 nt, Mycobacterium tuberculosis H37Rv
ccaguccgcgcgcaagucgaugu

SEQ ID NO: 3326575 - RNA, 19 nt, Mycobacterium tuberculosis H37Rv
ccaguccggcggacgugac

SEQ ID NO: 3326576 - RNA, 16 nt, Mycobacterium tuberculosis H37Rv
ccaguccguccagguc

SEQ ID NO: 3326577 - RNA, 15 nt, Mycobacterium tuberculosis H37Rv
ccagucgaagaagac

SEQ ID NO: 3326578 - RNA, 18 nt, Mycobacterium tuberculosis H37Rv
ccagucgaagaagacccg

SEQ ID NO: 3326579 - RNA, 15 nt, Mycobacterium tuberculosis H37Rv
ccaucaugugcgcga

SEQ ID NO: 3326580 - RNA, 19 nt, Mycobacterium tuberculosis H37Rv
ccauccaugauggccguca

SEQ ID NO: 3326581 - RNA, 17 nt, Mycobacterium tuberculosis H37Rv
ccauccccuggccagca

SEQ ID NO: 3326582 - RNA, 16 nt, Mycobacterium tuberculosis H37Rv
ccaucccgaucccggc

SEQ ID NO: 3326583 - RNA, 18 nt, Mycobacterium tuberculosis H37Rv
ccaucccgaucccggcca

SEQ ID NO: 3326584 - RNA, 21 nt, Mycobacterium tuberculosis H37Rv
ccaucccucgaaaaccguggu

SEQ ID NO: 3326585 - RNA, 22 nt, Mycobacterium tuberculosis H37Rv
ccaucccugaaauaccaguccg

SEQ ID NO: 3326586 - RNA, 16 nt, Mycobacterium tuberculosis H37Rv
ccauccgauggcccgg

SEQ ID NO: 3326587 - RNA, 16 nt, Mycobacterium tuberculosis H37Rv
ccauccgcagcaggug

SEQ ID NO: 3326588 - RNA, 18 nt, Mycobacterium tuberculosis H37Rv
ccauccgggccgcggcca

SEQ ID NO: 3326589 - RNA, 20 nt, Mycobacterium tuberculosis H37Rv
ccauccucgaguuuggccag

SEQ ID NO: 3326590 - RNA, 14 nt, Mycobacterium tuberculosis H37Rv
ccauccucgcggug

SEQ ID NO: 3326591 - RNA, 17 nt, Mycobacterium tuberculosis H37Rv
ccaucgaccgcccgcca

SEQ ID NO: 3326592 - RNA, 20 nt, Mycobacterium tuberculosis H37Rv
ccaucgaccgcccgccagcg

SEQ ID NO: 3326593 - RNA, 17 nt, Mycobacterium tuberculosis H37Rv
ccaucgaggcgaucacc

SEQ ID NO: 3326594 - RNA, 19 nt, Mycobacterium tuberculosis H37Rv
ccaucgaggcgaucaccgc

SEQ ID NO: 3326595 - RNA, 18 nt, Mycobacterium tuberculosis H37Rv
ccaucgaguccaccaccu

SEQ ID NO: 3326596 - RNA, 19 nt, Mycobacterium tuberculosis H37Rv
ccaucgccaacaccaacca

SEQ ID NO: 3326597 - RNA, 13 nt, Mycobacterium tuberculosis H37Rv
ccaucgccaccgc

SEQ ID NO: 3326598 - RNA, 16 nt, Mycobacterium tuberculosis H37Rv
ccaucgccaccgcguc

SEQ ID NO: 3326599 - RNA, 17 nt, Mycobacterium tuberculosis H37Rv
ccaucgccaccgcguca

SEQ ID NO: 3326600 - RNA, 19 nt, Mycobacterium tuberculosis H37Rv
ccaucgccaccgcgucacu

SEQ ID NO: 3326601 - RNA, 23 nt, Mycobacterium tuberculosis H37Rv
ccaucgccacuguugaagaagcc

SEQ ID NO: 3326602 - RNA, 23 nt, Mycobacterium tuberculosis H37Rv
ccaucgcccgaugcgccagcgua

SEQ ID NO: 3326603 - RNA, 16 nt, Mycobacterium tuberculosis H37Rv
ccaucgccuccagccg

SEQ ID NO: 3326604 - RNA, 23 nt, Mycobacterium tuberculosis H37Rv
ccaucgcgacuagacgccgccgc

SEQ ID NO: 3326605 - RNA, 14 nt, Mycobacterium tuberculosis H37Rv
ccaucgcgcaccgc

SEQ ID NO: 3326606 - RNA, 15 nt, Mycobacterium tuberculosis H37Rv
ccaucgcggaaccgu

SEQ ID NO: 3326607 - RNA, 19 nt, Mycobacterium tuberculosis H37Rv
ccaucgcgucggcgaugaa

SEQ ID NO: 3326608 - RNA, 13 nt, Mycobacterium tuberculosis H37Rv
ccaucgggaccgg

SEQ ID NO: 3326609 - RNA, 18 nt, Mycobacterium tuberculosis H37Rv
ccaucgggauggacacca

SEQ ID NO: 3326610 - RNA, 21 nt, Mycobacterium tuberculosis H37Rv
ccaucggggaaggggcucagc

SEQ ID NO: 3326611 - RNA, 15 nt, Mycobacterium tuberculosis H37Rv
ccaucgggucacccc

SEQ ID NO: 3326612 - RNA, 20 nt, Mycobacterium tuberculosis H37Rv
ccaucggguccgaaguacug

SEQ ID NO: 3326613 - RNA, 17 nt, Mycobacterium tuberculosis H37Rv
ccaucggugcgcacggc

SEQ ID NO: 3326614 - RNA, 11 nt, Mycobacterium tuberculosis H37Rv
ccaucgguuga

SEQ ID NO: 3326615 - RNA, 13 nt, Mycobacterium tuberculosis H37Rv
ccaucgguugacc

SEQ ID NO: 3326616 - RNA, 16 nt, Mycobacterium tuberculosis H37Rv
ccaucgucgagccgcc

SEQ ID NO: 3326617 - RNA, 14 nt, Mycobacterium tuberculosis H37Rv
ccaucgucgagcgc

SEQ ID NO: 3326618 - RNA, 20 nt, Mycobacterium tuberculosis H37Rv
ccaucguucguugacucugc

SEQ ID NO: 3326619 - RNA, 16 nt, Mycobacterium tuberculosis H37Rv
ccaucuaccagcucac

SEQ ID NO: 3326620 - RNA, 14 nt, Mycobacterium tuberculosis H37Rv
ccaucuccaacagg

SEQ ID NO: 3326621 - RNA, 22 nt, Mycobacterium tuberculosis H37Rv
ccaucuccggugugaucggcgg

SEQ ID NO: 3326622 - RNA, 23 nt, Mycobacterium tuberculosis H37Rv
ccaucuccgguguguuuggcaug

SEQ ID NO: 3326623 - RNA, 19 nt, Mycobacterium tuberculosis H37Rv
ccaucucgacgucggugaa

SEQ ID NO: 3326624 - RNA, 17 nt, Mycobacterium tuberculosis H37Rv
ccaucucuugcaaccug

SEQ ID NO: 3326625 - RNA, 21 nt, Mycobacterium tuberculosis H37Rv
ccaucugauccggugucgcga

SEQ ID NO: 3326626 - RNA, 20 nt, Mycobacterium tuberculosis H37Rv
ccaucugaucgggcccgucc

SEQ ID NO: 3326627 - RNA, 16 nt, Mycobacterium tuberculosis H37Rv
ccaucuuaacgucggc

SEQ ID NO: 3326628 - RNA, 18 nt, Mycobacterium tuberculosis H37Rv
ccaucuucggacgccagc

SEQ ID NO: 3326629 - RNA, 13 nt, Mycobacterium tuberculosis H37Rv
ccaucuugaccaa

SEQ ID NO: 3326630 - RNA, 16 nt, Mycobacterium tuberculosis H37Rv
ccaucuugaccaaugu

SEQ ID NO: 3326631 - RNA, 13 nt, Mycobacterium tuberculosis H37Rv
ccaugaaaucacc

SEQ ID NO: 3326632 - RNA, 18 nt, Mycobacterium tuberculosis H37Rv
ccaugaacucgaacuggg

SEQ ID NO: 3326633 - RNA, 21 nt, Mycobacterium tuberculosis H37Rv
ccaugaagaacuggcugcugu

SEQ ID NO: 3326634 - RNA, 16 nt, Mycobacterium tuberculosis H37Rv
ccaugaccgggcuggc

SEQ ID NO: 3326635 - RNA, 19 nt, Mycobacterium tuberculosis H37Rv
ccaugagcuugguggccac

SEQ ID NO: 3326636 - RNA, 21 nt, Mycobacterium tuberculosis H37Rv
ccaugagcuugguggccacca

SEQ ID NO: 3326637 - RNA, 18 nt, Mycobacterium tuberculosis H37Rv
ccaugaucacaccgagcg

SEQ ID NO: 3326638 - RNA, 19 nt, Mycobacterium tuberculosis H37Rv
ccaugaucuggugcgcgga

SEQ ID NO: 3326639 - RNA, 14 nt, Mycobacterium tuberculosis H37Rv
ccaugaugaugaca

SEQ ID NO: 3326640 - RNA, 20 nt, Mycobacterium tuberculosis H37Rv
ccaugaugccuaccgggccc

SEQ ID NO: 3326641 - RNA, 12 nt, Mycobacterium tuberculosis H37Rv
ccaugauggccg

SEQ ID NO: 3326642 - RNA, 16 nt, Mycobacterium tuberculosis H37Rv
ccaugauggccgucag

SEQ ID NO: 3326643 - RNA, 20 nt, Mycobacterium tuberculosis H37Rv
ccaugauggccgucagccag

SEQ ID NO: 3326644 - RNA, 16 nt, Mycobacterium tuberculosis H37Rv
ccaugcaacacaccgc

SEQ ID NO: 3326645 - RNA, 19 nt, Mycobacterium tuberculosis H37Rv
ccaugcacggccgagcagg

SEQ ID NO: 3326646 - RNA, 14 nt, Mycobacterium tuberculosis H37Rv
ccaugcacguugcc

SEQ ID NO: 3326647 - RNA, 17 nt, Mycobacterium tuberculosis H37Rv
ccaugccacaacgccuc

SEQ ID NO: 3326648 - RNA, 18 nt, Mycobacterium tuberculosis H37Rv
ccaugccacaacgccucg

SEQ ID NO: 3326649 - RNA, 15 nt, Mycobacterium tuberculosis H37Rv
ccaugcccgcacgcu

SEQ ID NO: 3326650 - RNA, 14 nt, Mycobacterium tuberculosis H37Rv
ccaugcccuguucg

SEQ ID NO: 3326651 - RNA, 19 nt, Mycobacterium tuberculosis H37Rv
ccaugccgaauaccggugg

SEQ ID NO: 3326652 - RNA, 19 nt, Mycobacterium tuberculosis H37Rv
ccaugccgaccggcacccg

SEQ ID NO: 3326653 - RNA, 18 nt, Mycobacterium tuberculosis H37Rv
ccaugccgaucggccugc

SEQ ID NO: 3326654 - RNA, 23 nt, Mycobacterium tuberculosis H37Rv
ccaugccgaucggccugcagcga

SEQ ID NO: 3326655 - RNA, 17 nt, Mycobacterium tuberculosis H37Rv
ccaugccgcucggcaac

SEQ ID NO: 3326656 - RNA, 20 nt, Mycobacterium tuberculosis H37Rv
ccaugccgcucggcaaccug

SEQ ID NO: 3326657 - RNA, 17 nt, Mycobacterium tuberculosis H37Rv
ccaugcgccacgccacu

SEQ ID NO: 3326658 - RNA, 18 nt, Mycobacterium tuberculosis H37Rv
ccaugcggcaggugccca

SEQ ID NO: 3326659 - RNA, 21 nt, Mycobacterium tuberculosis H37Rv
ccaugcgggugucgggcagca

SEQ ID NO: 3326660 - RNA, 17 nt, Mycobacterium tuberculosis H37Rv
ccaugcgguuagcagcc

SEQ ID NO: 3326661 - RNA, 20 nt, Mycobacterium tuberculosis H37Rv
ccaugcgguuagcagccgcu

SEQ ID NO: 3326662 - RNA, 14 nt, Mycobacterium tuberculosis H37Rv
ccaugcuaggacca

SEQ ID NO: 3326663 - RNA, 18 nt, Mycobacterium tuberculosis H37Rv
ccaugcuaggaccaccag

SEQ ID NO: 3326664 - RNA, 19 nt, Mycobacterium tuberculosis H37Rv
ccaugcuccuaucacugga

SEQ ID NO: 3326665 - RNA, 12 nt, Mycobacterium tuberculosis H37Rv
ccauggccaccg

SEQ ID NO: 3326666 - RNA, 15 nt, Mycobacterium tuberculosis H37Rv
ccauggcccguuggc

SEQ ID NO: 3326667 - RNA, 16 nt, Mycobacterium tuberculosis H37Rv
ccauggcgccgcgccg

SEQ ID NO: 3326668 - RNA, 16 nt, Mycobacterium tuberculosis H37Rv
ccauggcgcgagcaga

SEQ ID NO: 3326669 - RNA, 19 nt, Mycobacterium tuberculosis H37Rv
ccauggcggguuggguggc

SEQ ID NO: 3326670 - RNA, 17 nt, Mycobacterium tuberculosis H37Rv
ccauggcgugccccagu

SEQ ID NO: 3326671 - RNA, 15 nt, Mycobacterium tuberculosis H37Rv
ccauggcuccgccca

SEQ ID NO: 3326672 - RNA, 18 nt, Mycobacterium tuberculosis H37Rv
ccauggcuccgcccagga

SEQ ID NO: 3326673 - RNA, 21 nt, Mycobacterium tuberculosis H37Rv
ccaugggaguucaucgcacga

SEQ ID NO: 3326674 - RNA, 20 nt, Mycobacterium tuberculosis H37Rv
ccaugggucuggcaggccag

SEQ ID NO: 3326675 - RNA, 13 nt, Mycobacterium tuberculosis H37Rv
cccaccaccaccg

SEQ ID NO: 3326676 - RNA, 15 nt, Mycobacterium tuberculosis H37Rv
cccaccaccgacagc

SEQ ID NO: 3326677 - RNA, 15 nt, Mycobacterium tuberculosis H37Rv
cccaccagcggcggc

SEQ ID NO: 3326678 - RNA, 22 nt, Mycobacterium tuberculosis H37Rv
cccaccagugcaucgaucaccg

SEQ ID NO: 3326679 - RNA, 16 nt, Mycobacterium tuberculosis H37Rv
cccaccaugugcgaca

SEQ ID NO: 3326680 - RNA, 13 nt, Mycobacterium tuberculosis H37Rv
cccacccacgccg

SEQ ID NO: 3326681 - RNA, 16 nt, Mycobacterium tuberculosis H37Rv
cccacccauggccucc

SEQ ID NO: 3326682 - RNA, 20 nt, Mycobacterium tuberculosis H37Rv
cccaccccccagcgccgccg

SEQ ID NO: 3326683 - RNA, 18 nt, Mycobacterium tuberculosis H37Rv
cccacccgcaccaccggc

SEQ ID NO: 3326684 - RNA, 21 nt, Mycobacterium tuberculosis H37Rv
cccacccgcaccaccggcccc

SEQ ID NO: 3326685 - RNA, 18 nt, Mycobacterium tuberculosis H37Rv
cccacccgcaccgccggc

SEQ ID NO: 3326686 - RNA, 15 nt, Mycobacterium tuberculosis H37Rv
cccacccgcaccgcg

SEQ ID NO: 3326687 - RNA, 16 nt, Mycobacterium tuberculosis H37Rv
cccacccgcggcgccg

SEQ ID NO: 3326688 - RNA, 13 nt, Mycobacterium tuberculosis H37Rv
cccaccgaaaccg

SEQ ID NO: 3326689 - RNA, 17 nt, Mycobacterium tuberculosis H37Rv
cccaccgaagcgaacgg

SEQ ID NO: 3326690 - RNA, 23 nt, Mycobacterium tuberculosis H37Rv
cccaccgacaagaauggccgccu

SEQ ID NO: 3326691 - RNA, 21 nt, Mycobacterium tuberculosis H37Rv
cccaccgacauguguggcagc

SEQ ID NO: 3326692 - RNA, 23 nt, Mycobacterium tuberculosis H37Rv
cccaccgacauguguggcagccc

SEQ ID NO: 3326693 - RNA, 21 nt, Mycobacterium tuberculosis H37Rv
cccaccgccguugggccgcgc

SEQ ID NO: 3326694 - RNA, 17 nt, Mycobacterium tuberculosis H37Rv
cccaccgcgccgagcag

SEQ ID NO: 3326695 - RNA, 18 nt, Mycobacterium tuberculosis H37Rv
cccaccgcugcggcacca

SEQ ID NO: 3326696 - RNA, 16 nt, Mycobacterium tuberculosis H37Rv
cccaccggccaccagg

SEQ ID NO: 3326697 - RNA, 12 nt, Mycobacterium tuberculosis H37Rv
cccaccggcccg

SEQ ID NO: 3326698 - RNA, 15 nt, Mycobacterium tuberculosis H37Rv
cccaccgguaccgcc

SEQ ID NO: 3326699 - RNA, 13 nt, Mycobacterium tuberculosis H37Rv
cccaccggucgcg

SEQ ID NO: 3326700 - RNA, 16 nt, Mycobacterium tuberculosis H37Rv
cccaccggugccgccc

SEQ ID NO: 3326701 - RNA, 22 nt, Mycobacterium tuberculosis H37Rv
cccaccgucgucguuucgccag

SEQ ID NO: 3326702 - RNA, 15 nt, Mycobacterium tuberculosis H37Rv
cccaccgucugcugg

SEQ ID NO: 3326703 - RNA, 13 nt, Mycobacterium tuberculosis H37Rv
cccaccuggauca

SEQ ID NO: 3326704 - RNA, 21 nt, Mycobacterium tuberculosis H37Rv
cccaccuucaucaacgacacc

SEQ ID NO: 3326705 - RNA, 22 nt, Mycobacterium tuberculosis H37Rv
cccaccuucaucaacgacacca

SEQ ID NO: 3326706 - RNA, 13 nt, Mycobacterium tuberculosis H37Rv
cccaccuucgagu

SEQ ID NO: 3326707 - RNA, 13 nt, Mycobacterium tuberculosis H37Rv
cccacgaauccca

SEQ ID NO: 3326708 - RNA, 12 nt, Mycobacterium tuberculosis H37Rv
cccacgagagcg

SEQ ID NO: 3326709 - RNA, 20 nt, Mycobacterium tuberculosis H37Rv
cccacgaggacugggugcgc

SEQ ID NO: 3326710 - RNA, 18 nt, Mycobacterium tuberculosis H37Rv
cccacgauaggugaacgc

SEQ ID NO: 3326711 - RNA, 14 nt, Mycobacterium tuberculosis H37Rv
cccacgaucagcag

SEQ ID NO: 3326712 - RNA, 19 nt, Mycobacterium tuberculosis H37Rv
cccacgaucagcagcgucg

SEQ ID NO: 3326713 - RNA, 13 nt, Mycobacterium tuberculosis H37Rv
cccacgcacagca

SEQ ID NO: 3326714 - RNA, 15 nt, Mycobacterium tuberculosis H37Rv
cccacgcccaauguc

SEQ ID NO: 3326715 - RNA, 12 nt, Mycobacterium tuberculosis H37Rv
cccacgccgccg

SEQ ID NO: 3326716 - RNA, 16 nt, Mycobacterium tuberculosis H37Rv
cccacgccgguggcac

SEQ ID NO: 3326717 - RNA, 21 nt, Mycobacterium tuberculosis H37Rv
cccacgccgguggcacggccc

SEQ ID NO: 3326718 - RNA, 22 nt, Mycobacterium tuberculosis H37Rv
cccacgcugcccacgggccggc

SEQ ID NO: 3326719 - RNA, 14 nt, Mycobacterium tuberculosis H37Rv
cccacgcuucggcc

SEQ ID NO: 3326720 - RNA, 19 nt, Mycobacterium tuberculosis H37Rv
cccacggcacccaauccgg

SEQ ID NO: 3326721 - RNA, 16 nt, Mycobacterium tuberculosis H37Rv
cccacggccggccgcu

SEQ ID NO: 3326722 - RNA, 20 nt, Mycobacterium tuberculosis H37Rv
cccacggcgaccacgccgcc

SEQ ID NO: 3326723 - RNA, 23 nt, Mycobacterium tuberculosis H37Rv
cccacggcgagaaaaugacccac

SEQ ID NO: 3326724 - RNA, 13 nt, Mycobacterium tuberculosis H37Rv
cccacgggccggc

SEQ ID NO: 3326725 - RNA, 15 nt, Mycobacterium tuberculosis H37Rv
cccacgggccggccg

SEQ ID NO: 3326726 - RNA, 22 nt, Mycobacterium tuberculosis H37Rv
cccacggugucccgcgaggcaa

SEQ ID NO: 3326727 - RNA, 14 nt, Mycobacterium tuberculosis H37Rv
cccacgucgagcag

SEQ ID NO: 3326728 - RNA, 14 nt, Mycobacterium tuberculosis H37Rv
cccacgugcugccu

SEQ ID NO: 3326729 - RNA, 16 nt, Mycobacterium tuberculosis H37Rv
cccacgugcugccuuu

SEQ ID NO: 3326730 - RNA, 14 nt, Mycobacterium tuberculosis H37Rv
cccacguugacggc

SEQ ID NO: 3326731 - RNA, 23 nt, Mycobacterium tuberculosis H37Rv
cccacguugaugaugccggcguu

SEQ ID NO: 3326732 - RNA, 16 nt, Mycobacterium tuberculosis H37Rv
cccacguuggccccgc

SEQ ID NO: 3326733 - RNA, 13 nt, Mycobacterium tuberculosis H37Rv
cccacucccgccc

SEQ ID NO: 3326734 - RNA, 13 nt, Mycobacterium tuberculosis H37Rv
cccacucggaccc

SEQ ID NO: 3326735 - RNA, 17 nt, Mycobacterium tuberculosis H37Rv
cccacucggggacggcg

SEQ ID NO: 3326736 - RNA, 17 nt, Mycobacterium tuberculosis H37Rv
cccacucgucgaacacc

SEQ ID NO: 3326737 - RNA, 18 nt, Mycobacterium tuberculosis H37Rv
cccacucgucgaacaccg

SEQ ID NO: 3326738 - RNA, 17 nt, Mycobacterium tuberculosis H37Rv
cccacugcaucacgccg

SEQ ID NO: 3326739 - RNA, 15 nt, Mycobacterium tuberculosis H37Rv
cccacugccacuccu

SEQ ID NO: 3326740 - RNA, 23 nt, Mycobacterium tuberculosis H37Rv
cccacugccgugccggugugucc

SEQ ID NO: 3326741 - RNA, 22 nt, Mycobacterium tuberculosis H37Rv
cccacuggaccaccgccgaagc

SEQ ID NO: 3326742 - RNA, 12 nt, Mycobacterium tuberculosis H37Rv
cccacuggaggu

SEQ ID NO: 3326743 - RNA, 15 nt, Mycobacterium tuberculosis H37Rv
cccacuugccgggca

SEQ ID NO: 3326744 - RNA, 19 nt, Mycobacterium tuberculosis H37Rv
cccagacaauccgccgccg

SEQ ID NO: 3326745 - RNA, 16 nt, Mycobacterium tuberculosis H37Rv
cccagacagaccccca

SEQ ID NO: 3326746 - RNA, 15 nt, Mycobacterium tuberculosis H37Rv
cccagaccgccgacg

SEQ ID NO: 3326747 - RNA, 24 nt, Mycobacterium tuberculosis H37Rv
cccagaccgccgacgccguugccc

SEQ ID NO: 3326748 - RNA, 19 nt, Mycobacterium tuberculosis H37Rv
cccagagccgcugcggcac

SEQ ID NO: 3326749 - RNA, 13 nt, Mycobacterium tuberculosis H37Rv
cccagagcugguc

SEQ ID NO: 3326750 - RNA, 15 nt, Mycobacterium tuberculosis H37Rv
cccagauacccgcgu

SEQ ID NO: 3326751 - RNA, 21 nt, Mycobacterium tuberculosis H37Rv
cccagauagagcuggugcaga

SEQ ID NO: 3326752 - RNA, 15 nt, Mycobacterium tuberculosis H37Rv
cccagauccgcagcg

SEQ ID NO: 3326753 - RNA, 16 nt, Mycobacterium tuberculosis H37Rv
cccagauccgcagcgu

SEQ ID NO: 3326754 - RNA, 18 nt, Mycobacterium tuberculosis H37Rv
cccagaucggcgacgccg

SEQ ID NO: 3326755 - RNA, 13 nt, Mycobacterium tuberculosis H37Rv
cccagaucggcgu

SEQ ID NO: 3326756 - RNA, 19 nt, Mycobacterium tuberculosis H37Rv
cccagaucuugcagugcgc

SEQ ID NO: 3326757 - RNA, 19 nt, Mycobacterium tuberculosis H37Rv
cccagaugcagcgguccag

SEQ ID NO: 3326758 - RNA, 19 nt, Mycobacterium tuberculosis H37Rv
cccagaugcaggcuuucau

SEQ ID NO: 3326759 - RNA, 19 nt, Mycobacterium tuberculosis H37Rv
cccagcaaaggggugugug

SEQ ID NO: 3326760 - RNA, 18 nt, Mycobacterium tuberculosis H37Rv
cccagcacacccccgucu

SEQ ID NO: 3326761 - RNA, 24 nt, Mycobacterium tuberculosis H37Rv
cccagcacauucugcagcgucucc

SEQ ID NO: 3326762 - RNA, 14 nt, Mycobacterium tuberculosis H37Rv
cccagcacccggcu

SEQ ID NO: 3326763 - RNA, 13 nt, Mycobacterium tuberculosis H37Rv
cccagcacccuca

SEQ ID NO: 3326764 - RNA, 21 nt, Mycobacterium tuberculosis H37Rv
cccagcacccuguuccagcgg

SEQ ID NO: 3326765 - RNA, 17 nt, Mycobacterium tuberculosis H37Rv
cccagcacgcuggcguu

SEQ ID NO: 3326766 - RNA, 12 nt, Mycobacterium tuberculosis H37Rv
cccagcagacca

SEQ ID NO: 3326767 - RNA, 21 nt, Mycobacterium tuberculosis H37Rv
cccagcagcaccugcaccgca

SEQ ID NO: 3326768 - RNA, 12 nt, Mycobacterium tuberculosis H37Rv
cccagcagcggc

SEQ ID NO: 3326769 - RNA, 15 nt, Mycobacterium tuberculosis H37Rv
cccagcagcggcacg

SEQ ID NO: 3326770 - RNA, 15 nt, Mycobacterium tuberculosis H37Rv
cccagcaggcccuug

SEQ ID NO: 3326771 - RNA, 22 nt, Mycobacterium tuberculosis H37Rv
cccagcaucuuuggcggccgca

SEQ ID NO: 3326772 - RNA, 14 nt, Mycobacterium tuberculosis H37Rv
cccaguagaucgcc

SEQ ID NO: 3326773 - RNA, 17 nt, Mycobacterium tuberculosis H37Rv
cccaguauaauucgaga

SEQ ID NO: 3326774 - RNA, 13 nt, Mycobacterium tuberculosis H37Rv
cccaguccaggac

SEQ ID NO: 3326775 - RNA, 21 nt, Mycobacterium tuberculosis H37Rv
cccagucccaacacggcgaca

SEQ ID NO: 3326776 - RNA, 16 nt, Mycobacterium tuberculosis H37Rv
cccagucggcgccgcc

SEQ ID NO: 3326777 - RNA, 20 nt, Mycobacterium tuberculosis H37Rv
cccagucguuccgccgccuc

SEQ ID NO: 3326778 - RNA, 21 nt, Mycobacterium tuberculosis H37Rv
cccagugaacucgugacagcg

SEQ ID NO: 3326779 - RNA, 19 nt, Mycobacterium tuberculosis H37Rv
cccagugaaucggaccgac

SEQ ID NO: 3326780 - RNA, 19 nt, Mycobacterium tuberculosis H37Rv
cccagugcacgcucggcgc

SEQ ID NO: 3326781 - RNA, 20 nt, Mycobacterium tuberculosis H37Rv
cccagugcgcaacccagccg

SEQ ID NO: 3326782 - RNA, 13 nt, Mycobacterium tuberculosis H37Rv
cccagugcggcca

SEQ ID NO: 3326783 - RNA, 16 nt, Mycobacterium tuberculosis H37Rv
cccagugcggccaccu

SEQ ID NO: 3326784 - RNA, 16 nt, Mycobacterium tuberculosis H37Rv
cccaguucgacggcgu

SEQ ID NO: 3326785 - RNA, 15 nt, Mycobacterium tuberculosis H37Rv
cccaguucggcgucu

SEQ ID NO: 3326786 - RNA, 13 nt, Mycobacterium tuberculosis H37Rv
cccaguucugcag

SEQ ID NO: 3326787 - RNA, 14 nt, Mycobacterium tuberculosis H37Rv
cccaguucugcagg

SEQ ID NO: 3326788 - RNA, 18 nt, Mycobacterium tuberculosis H37Rv
cccauaccuucggcgauc

SEQ ID NO: 3326789 - RNA, 12 nt, Mycobacterium tuberculosis H37Rv
cccauacgccgg

SEQ ID NO: 3326790 - RNA, 16 nt, Mycobacterium tuberculosis H37Rv
cccauacgugccgccg

SEQ ID NO: 3326791 - RNA, 22 nt, Mycobacterium tuberculosis H37Rv
cccauacgugccgccgaugucg

SEQ ID NO: 3326792 - RNA, 18 nt, Mycobacterium tuberculosis H37Rv
cccauacucggcggcuuc

SEQ ID NO: 3326793 - RNA, 14 nt, Mycobacterium tuberculosis H37Rv
cccauagcaccucg

SEQ ID NO: 3326794 - RNA, 22 nt, Mycobacterium tuberculosis H37Rv
cccauaucgaucggaucggcac

SEQ ID NO: 3326795 - RNA, 22 nt, Mycobacterium tuberculosis H37Rv
cccaucaacgccggcgacggcg

SEQ ID NO: 3326796 - RNA, 15 nt, Mycobacterium tuberculosis H37Rv
cccaucaccaccggc

SEQ ID NO: 3326797 - RNA, 18 nt, Mycobacterium tuberculosis H37Rv
cccaucaccaccggcacc

SEQ ID NO: 3326798 - RNA, 13 nt, Mycobacterium tuberculosis H37Rv
cccaucaccagcg

SEQ ID NO: 3326799 - RNA, 14 nt, Mycobacterium tuberculosis H37Rv
cccaucaccagcgg

SEQ ID NO: 3326800 - RNA, 15 nt, Mycobacterium tuberculosis H37Rv
cccaucaccgccagc

SEQ ID NO: 3326801 - RNA, 14 nt, Mycobacterium tuberculosis H37Rv
cccaucgaccgccc

SEQ ID NO: 3326802 - RNA, 16 nt, Mycobacterium tuberculosis H37Rv
cccaucgaccgcccgc

SEQ ID NO: 3326803 - RNA, 23 nt, Mycobacterium tuberculosis H37Rv
cccaucgcgacuagacgccgccg

SEQ ID NO: 3326804 - RNA, 13 nt, Mycobacterium tuberculosis H37Rv
cccaucgggcgcc

SEQ ID NO: 3326805 - RNA, 17 nt, Mycobacterium tuberculosis H37Rv
cccaucgucgagccgcc

SEQ ID NO: 3326806 - RNA, 16 nt, Mycobacterium tuberculosis H37Rv
cccaucugcucagggc

SEQ ID NO: 3326807 - RNA, 14 nt, Mycobacterium tuberculosis H37Rv
cccaugaaggagau

SEQ ID NO: 3326808 - RNA, 22 nt, Mycobacterium tuberculosis H37Rv
cccaugaucccgcugaccuggg

SEQ ID NO: 3326809 - RNA, 16 nt, Mycobacterium tuberculosis H37Rv
cccaugauggccgcgg

SEQ ID NO: 3326810 - RNA, 16 nt, Mycobacterium tuberculosis H37Rv
cccaugcaacacaccg

SEQ ID NO: 3326811 - RNA, 19 nt, Mycobacterium tuberculosis H37Rv
cccaugcaaucggauaggu

SEQ ID NO: 3326812 - RNA, 18 nt, Mycobacterium tuberculosis H37Rv
cccaugccgaccggcacc

SEQ ID NO: 3326813 - RNA, 15 nt, Mycobacterium tuberculosis H37Rv
cccaugccgucgggu

SEQ ID NO: 3326814 - RNA, 12 nt, Mycobacterium tuberculosis H37Rv
cccaugccucca

SEQ ID NO: 3326815 - RNA, 19 nt, Mycobacterium tuberculosis H37Rv
cccaugcgguuuggaucac

SEQ ID NO: 3326816 - RNA, 12 nt, Mycobacterium tuberculosis H37Rv
cccauggcauuc

SEQ ID NO: 3326817 - RNA, 14 nt, Mycobacterium tuberculosis H37Rv
cccauggccaccga

SEQ ID NO: 3326818 - RNA, 14 nt, Mycobacterium tuberculosis H37Rv
cccauggcgccugu

SEQ ID NO: 3326819 - RNA, 15 nt, Mycobacterium tuberculosis H37Rv
cccauggcuccgccc

SEQ ID NO: 3326820 - RNA, 17 nt, Mycobacterium tuberculosis H37Rv
cccaugucggcgcgccg

SEQ ID NO: 3326821 - RNA, 20 nt, Mycobacterium tuberculosis H37Rv
cccaugucggcgcgccgcac

SEQ ID NO: 3326822 - RNA, 16 nt, Mycobacterium tuberculosis H37Rv
cccauucaucuugcgg

SEQ ID NO: 3326823 - RNA, 16 nt, Mycobacterium tuberculosis H37Rv
cccauucccaacacag

SEQ ID NO: 3326824 - RNA, 23 nt, Mycobacterium tuberculosis H37Rv
cccauucccaacacagccgucgc

SEQ ID NO: 3326825 - RNA, 13 nt, Mycobacterium tuberculosis H37Rv
cccauucucggcc

SEQ ID NO: 3326826 - RNA, 18 nt, Mycobacterium tuberculosis H37Rv
cccauucucggccggcgg

SEQ ID NO: 3326827 - RNA, 12 nt, Mycobacterium tuberculosis H37Rv
cccauuggaccg

SEQ ID NO: 3326828 - RNA, 19 nt, Mycobacterium tuberculosis H37Rv
cccauuggccagguggcga

SEQ ID NO: 3326829 - RNA, 21 nt, Mycobacterium tuberculosis H37Rv
cccauuggguaaccagcgcca

SEQ ID NO: 3326830 - RNA, 22 nt, Mycobacterium tuberculosis H37Rv
cccauugucgaucaccugcagc

SEQ ID NO: 3326831 - RNA, 20 nt, Mycobacterium tuberculosis H37Rv
cccauuugccuugagccgcc

SEQ ID NO: 3326832 - RNA, 21 nt, Mycobacterium tuberculosis H37Rv
cccauuugccuugagccgccc

SEQ ID NO: 3326833 - RNA, 13 nt, Mycobacterium tuberculosis H37Rv
ccccaacaucccg

SEQ ID NO: 3326834 - RNA, 22 nt, Mycobacterium tuberculosis H37Rv
ccccaacccuaaaccagccacc

SEQ ID NO: 3326835 - RNA, 18 nt, Mycobacterium tuberculosis H37Rv
ccccaagcgccugagcgg

SEQ ID NO: 3326836 - RNA, 23 nt, Mycobacterium tuberculosis H37Rv
ccccaagcgccugagcggccucg

SEQ ID NO: 3326837 - RNA, 18 nt, Mycobacterium tuberculosis H37Rv
ccccaagcgugcugccgc

SEQ ID NO: 3326838 - RNA, 14 nt, Mycobacterium tuberculosis H37Rv
ccccaagucgacgg

SEQ ID NO: 3326839 - RNA, 17 nt, Mycobacterium tuberculosis H37Rv
ccccacccaccacagga

SEQ ID NO: 3326840 - RNA, 12 nt, Mycobacterium tuberculosis H37Rv
ccccaccggcac

SEQ ID NO: 3326841 - RNA, 13 nt, Mycobacterium tuberculosis H37Rv
ccccaccggcccg

SEQ ID NO: 3326842 - RNA, 16 nt, Mycobacterium tuberculosis H37Rv
ccccaccgguaccgcc

SEQ ID NO: 3326843 - RNA, 14 nt, Mycobacterium tuberculosis H37Rv
ccccaccggugccg

SEQ ID NO: 3326844 - RNA, 12 nt, Mycobacterium tuberculosis H37Rv
ccccacggccag

SEQ ID NO: 3326845 - RNA, 11 nt, Mycobacterium tuberculosis H37Rv
ccccacugccg

SEQ ID NO: 3326846 - RNA, 15 nt, Mycobacterium tuberculosis H37Rv
ccccacuggugcagc

SEQ ID NO: 3326847 - RNA, 16 nt, Mycobacterium tuberculosis H37Rv
ccccagaccgccacac

SEQ ID NO: 3326848 - RNA, 19 nt, Mycobacterium tuberculosis H37Rv
ccccagcacaaccagcugu

SEQ ID NO: 3326849 - RNA, 19 nt, Mycobacterium tuberculosis H37Rv
ccccagcacauucugcagc

SEQ ID NO: 3326850 - RNA, 17 nt, Mycobacterium tuberculosis H37Rv
ccccagcaccacgguga

SEQ ID NO: 3326851 - RNA, 14 nt, Mycobacterium tuberculosis H37Rv
ccccagcacccggc

SEQ ID NO: 3326852 - RNA, 13 nt, Mycobacterium tuberculosis H37Rv
ccccagcagcugc

SEQ ID NO: 3326853 - RNA, 13 nt, Mycobacterium tuberculosis H37Rv
ccccagccgcggc

SEQ ID NO: 3326854 - RNA, 17 nt, Mycobacterium tuberculosis H37Rv
ccccagccggcagcagc

SEQ ID NO: 3326855 - RNA, 18 nt, Mycobacterium tuberculosis H37Rv
ccccagccggcagcagcg

SEQ ID NO: 3326856 - RNA, 12 nt, Mycobacterium tuberculosis H37Rv
ccccagcgacgg

SEQ ID NO: 3326857 - RNA, 20 nt, Mycobacterium tuberculosis H37Rv
ccccagcgguuuccgcacga

SEQ ID NO: 3326858 - RNA, 11 nt, Mycobacterium tuberculosis H37Rv
ccccaggcacc

SEQ ID NO: 3326859 - RNA, 20 nt, Mycobacterium tuberculosis H37Rv
ccccaggccgcuugccccgc

SEQ ID NO: 3326860 - RNA, 15 nt, Mycobacterium tuberculosis H37Rv
ccccagggagugccg

SEQ ID NO: 3326861 - RNA, 20 nt, Mycobacterium tuberculosis H37Rv
ccccagggagugccgcacga

SEQ ID NO: 3326862 - RNA, 17 nt, Mycobacterium tuberculosis H37Rv
ccccagggggcgugccg

SEQ ID NO: 3326863 - RNA, 13 nt, Mycobacterium tuberculosis H37Rv
ccccagggugcgc

SEQ ID NO: 3326864 - RNA, 22 nt, Mycobacterium tuberculosis H37Rv
ccccagggugcgccauucgccc

SEQ ID NO: 3326865 - RNA, 23 nt, Mycobacterium tuberculosis H37Rv
ccccagugcagacaggcggcggc

SEQ ID NO: 3326866 - RNA, 12 nt, Mycobacterium tuberculosis H37Rv
ccccaguucggc

SEQ ID NO: 3326867 - RNA, 15 nt, Mycobacterium tuberculosis H37Rv
ccccaguucggcguc

SEQ ID NO: 3326868 - RNA, 16 nt, Mycobacterium tuberculosis H37Rv
ccccauacucggcggc

SEQ ID NO: 3326869 - RNA, 14 nt, Mycobacterium tuberculosis H37Rv
ccccggaccgcggc

SEQ ID NO: 3326870 - RNA, 16 nt, Mycobacterium tuberculosis H37Rv
ccccggacggcaggcu

SEQ ID NO: 3326871 - RNA, 14 nt, Mycobacterium tuberculosis H37Rv
ccccggagccagaa

SEQ ID NO: 3326872 - RNA, 17 nt, Mycobacterium tuberculosis H37Rv
ccccggagccucgaaca

SEQ ID NO: 3326873 - RNA, 14 nt, Mycobacterium tuberculosis H37Rv
ccccggcagcgccc

SEQ ID NO: 3326874 - RNA, 22 nt, Mycobacterium tuberculosis H37Rv
ccccggcauugcccgagcccag

SEQ ID NO: 3326875 - RNA, 12 nt, Mycobacterium tuberculosis H37Rv
ccccggccacca

SEQ ID NO: 3326876 - RNA, 12 nt, Mycobacterium tuberculosis H37Rv
ccccggccagga

SEQ ID NO: 3326877 - RNA, 13 nt, Mycobacterium tuberculosis H37Rv
ccccggccaggac

SEQ ID NO: 3326878 - RNA, 13 nt, Mycobacterium tuberculosis H37Rv
ccccggccgaucu

SEQ ID NO: 3326879 - RNA, 12 nt, Mycobacterium tuberculosis H37Rv
ccccggccggcu

SEQ ID NO: 3326880 - RNA, 13 nt, Mycobacterium tuberculosis H37Rv
ccccggcgacccg

SEQ ID NO: 3326881 - RNA, 23 nt, Mycobacterium tuberculosis H37Rv
ccccggcgagcagacgcauaagc

SEQ ID NO: 3326882 - RNA, 20 nt, Mycobacterium tuberculosis H37Rv
ccccggcgcuggugcgccac

SEQ ID NO: 3326883 - RNA, 13 nt, Mycobacterium tuberculosis H37Rv
ccccggcgguacc

SEQ ID NO: 3326884 - RNA, 20 nt, Mycobacterium tuberculosis H37Rv
ccccggcguccgaccgguac

SEQ ID NO: 3326885 - RNA, 14 nt, Mycobacterium tuberculosis H37Rv
ccccggcugccagc

SEQ ID NO: 3326886 - RNA, 22 nt, Mycobacterium tuberculosis H37Rv
ccccgggcggcgccggcgcaga

SEQ ID NO: 3326887 - RNA, 13 nt, Mycobacterium tuberculosis H37Rv
ccccgggcgguga

SEQ ID NO: 3326888 - RNA, 16 nt, Mycobacterium tuberculosis H37Rv
ccccgggcggugaggc

SEQ ID NO: 3326889 - RNA, 19 nt, Mycobacterium tuberculosis H37Rv
ccccgggcggugaggcagc

SEQ ID NO: 3326890 - RNA, 14 nt, Mycobacterium tuberculosis H37Rv
ccccggggguccac

SEQ ID NO: 3326891 - RNA, 14 nt, Mycobacterium tuberculosis H37Rv
ccccgguaccgccc

SEQ ID NO: 3326892 - RNA, 22 nt, Mycobacterium tuberculosis H37Rv
ccccgguacgucgagggugacc

SEQ ID NO: 3326893 - RNA, 13 nt, Mycobacterium tuberculosis H37Rv
ccccggucggcga

SEQ ID NO: 3326894 - RNA, 14 nt, Mycobacterium tuberculosis H37Rv
ccccggucggcgac

SEQ ID NO: 3326895 - RNA, 12 nt, Mycobacterium tuberculosis H37Rv
ccccggugacgc

SEQ ID NO: 3326896 - RNA, 23 nt, Mycobacterium tuberculosis H37Rv
ccccggugccguuggagccgcca

SEQ ID NO: 3326897 - RNA, 22 nt, Mycobacterium tuberculosis H37Rv
ccccgguugaucuuguccuccg

SEQ ID NO: 3326898 - RNA, 17 nt, Mycobacterium tuberculosis H37Rv
ccccgucagcgggcagc

SEQ ID NO: 3326899 - RNA, 14 nt, Mycobacterium tuberculosis H37Rv
ccccgucaggauga

SEQ ID NO: 3326900 - RNA, 16 nt, Mycobacterium tuberculosis H37Rv
ccccgucaggaugauc

SEQ ID NO: 3326901 - RNA, 14 nt, Mycobacterium tuberculosis H37Rv
ccccgucgaccucc

SEQ ID NO: 3326902 - RNA, 12 nt, Mycobacterium tuberculosis H37Rv
ccccgucgccac

SEQ ID NO: 3326903 - RNA, 13 nt, Mycobacterium tuberculosis H37Rv
ccccgucgccacc

SEQ ID NO: 3326904 - RNA, 15 nt, Mycobacterium tuberculosis H37Rv
ccccgucgccaccga

SEQ ID NO: 3326905 - RNA, 16 nt, Mycobacterium tuberculosis H37Rv
ccccgucgccaccgau

SEQ ID NO: 3326906 - RNA, 12 nt, Mycobacterium tuberculosis H37Rv
ccccgucgggac

SEQ ID NO: 3326907 - RNA, 13 nt, Mycobacterium tuberculosis H37Rv
ccccgucugcgug

SEQ ID NO: 3326908 - RNA, 19 nt, Mycobacterium tuberculosis H37Rv
ccccgugggguguggcggc

SEQ ID NO: 3326909 - RNA, 21 nt, Mycobacterium tuberculosis H37Rv
ccccguuaccgccgucgccga

SEQ ID NO: 3326910 - RNA, 16 nt, Mycobacterium tuberculosis H37Rv
ccccguuccacgauca

SEQ ID NO: 3326911 - RNA, 16 nt, Mycobacterium tuberculosis H37Rv
ccccguucuggaaccc

SEQ ID NO: 3326912 - RNA, 20 nt, Mycobacterium tuberculosis H37Rv
ccccguugacccagaccggc

SEQ ID NO: 3326913 - RNA, 15 nt, Mycobacterium tuberculosis H37Rv
ccccguugccgcccg

SEQ ID NO: 3326914 - RNA, 21 nt, Mycobacterium tuberculosis H37Rv
ccccguugccgccguugccgc

SEQ ID NO: 3326915 - RNA, 19 nt, Mycobacterium tuberculosis H37Rv
ccccguuggucagcgugga

SEQ ID NO: 3326916 - RNA, 13 nt, Mycobacterium tuberculosis H37Rv
ccccguuucgcca

SEQ ID NO: 3326917 - RNA, 17 nt, Mycobacterium tuberculosis H37Rv
ccccguuucggucgaca

SEQ ID NO: 3326918 - RNA, 20 nt, Mycobacterium tuberculosis H37Rv
ccccguuucggucgacaacg

SEQ ID NO: 3326919 - RNA, 11 nt, Mycobacterium tuberculosis H37Rv
ccccuaaaccg

SEQ ID NO: 3326920 - RNA, 15 nt, Mycobacterium tuberculosis H37Rv
ccccucccaccagcg

SEQ ID NO: 3326921 - RNA, 13 nt, Mycobacterium tuberculosis H37Rv
ccccucggccgcc

SEQ ID NO: 3326922 - RNA, 16 nt, Mycobacterium tuberculosis H37Rv
ccccucggccgcccgu

SEQ ID NO: 3326923 - RNA, 22 nt, Mycobacterium tuberculosis H37Rv
ccccucuugucuagcggucgcu

SEQ ID NO: 3326924 - RNA, 20 nt, Mycobacterium tuberculosis H37Rv
ccccuggaaagggccgccgc

SEQ ID NO: 3326925 - RNA, 21 nt, Mycobacterium tuberculosis H37Rv
ccccuggccagcagagcggca

SEQ ID NO: 3326926 - RNA, 13 nt, Mycobacterium tuberculosis H37Rv
ccccuggccgccg

SEQ ID NO: 3326927 - RNA, 15 nt, Mycobacterium tuberculosis H37Rv
ccccuggcgauuucg

SEQ ID NO: 3326928 - RNA, 22 nt, Mycobacterium tuberculosis H37Rv
ccccugucauguccugggccgc

SEQ ID NO: 3326929 - RNA, 15 nt, Mycobacterium tuberculosis H37Rv
ccccuguugccccuc

SEQ ID NO: 3326930 - RNA, 14 nt, Mycobacterium tuberculosis H37Rv
ccccuucaaagcgg

SEQ ID NO: 3326931 - RNA, 23 nt, Mycobacterium tuberculosis H37Rv
ccccuucaaagcggccucgaccu

SEQ ID NO: 3326932 - RNA, 13 nt, Mycobacterium tuberculosis H37Rv
ccccuugaccgcu

SEQ ID NO: 3326933 - RNA, 17 nt, Mycobacterium tuberculosis H37Rv
ccccuugaccgcugccc

SEQ ID NO: 3326934 - RNA, 19 nt, Mycobacterium tuberculosis H37Rv
ccccuuugacgccgagcac

SEQ ID NO: 3326935 - RNA, 19 nt, Mycobacterium tuberculosis H37Rv
ccccuuuugccgcagcauc

SEQ ID NO: 3326936 - RNA, 21 nt, Mycobacterium tuberculosis H37Rv
cccgaaaacccaacacccaga

SEQ ID NO: 3326937 - RNA, 18 nt, Mycobacterium tuberculosis H37Rv
cccgaaaacugacccccu

SEQ ID NO: 3326938 - RNA, 17 nt, Mycobacterium tuberculosis H37Rv
cccgaaacccgaugugg

SEQ ID NO: 3326939 - RNA, 18 nt, Mycobacterium tuberculosis H37Rv
cccgaaaccuguaccgcc

SEQ ID NO: 3326940 - RNA, 12 nt, Mycobacterium tuberculosis H37Rv
cccgaacacgcu

SEQ ID NO: 3326941 - RNA, 18 nt, Mycobacterium tuberculosis H37Rv
cccgaacauccgccgccc

SEQ ID NO: 3326942 - RNA, 14 nt, Mycobacterium tuberculosis H37Rv
cccgaaccaccacc

SEQ ID NO: 3326943 - RNA, 15 nt, Mycobacterium tuberculosis H37Rv
cccgaaccccgaccg

SEQ ID NO: 3326944 - RNA, 21 nt, Mycobacterium tuberculosis H37Rv
cccgaacgaggcgcccagcga

SEQ ID NO: 3326945 - RNA, 17 nt, Mycobacterium tuberculosis H37Rv
cccgaagaucuccuccu

SEQ ID NO: 3326946 - RNA, 17 nt, Mycobacterium tuberculosis H37Rv
cccgaagaugaccucgg

SEQ ID NO: 3326947 - RNA, 14 nt, Mycobacterium tuberculosis H37Rv
cccgaaggcggcuc

SEQ ID NO: 3326948 - RNA, 16 nt, Mycobacterium tuberculosis H37Rv
cccgaaguagaagccc

SEQ ID NO: 3326949 - RNA, 21 nt, Mycobacterium tuberculosis H37Rv
cccgaaguagaagcccaggac

SEQ ID NO: 3326950 - RNA, 13 nt, Mycobacterium tuberculosis H37Rv
cccgaagucucgg

SEQ ID NO: 3326951 - RNA, 17 nt, Mycobacterium tuberculosis H37Rv
cccgaaguggugaccga

SEQ ID NO: 3326952 - RNA, 19 nt, Mycobacterium tuberculosis H37Rv
cccgaaguggugaccgacg

SEQ ID NO: 3326953 - RNA, 22 nt, Mycobacterium tuberculosis H37Rv
cccgaaguggugaccgacgcgg

SEQ ID NO: 3326954 - RNA, 14 nt, Mycobacterium tuberculosis H37Rv
cccgaaucgccugc

SEQ ID NO: 3326955 - RNA, 19 nt, Mycobacterium tuberculosis H37Rv
cccgaaugccuucgaugaa

SEQ ID NO: 3326956 - RNA, 19 nt, Mycobacterium tuberculosis H37Rv
cccgaauuccuacgccgcc

SEQ ID NO: 3326957 - RNA, 19 nt, Mycobacterium tuberculosis H37Rv
cccgacaccacgucccgga

SEQ ID NO: 3326958 - RNA, 12 nt, Mycobacterium tuberculosis H37Rv
cccgacacccgu

SEQ ID NO: 3326959 - RNA, 17 nt, Mycobacterium tuberculosis H37Rv
cccgacacccguaagcg

SEQ ID NO: 3326960 - RNA, 17 nt, Mycobacterium tuberculosis H37Rv
cccgacaccgccccgcc

SEQ ID NO: 3326961 - RNA, 21 nt, Mycobacterium tuberculosis H37Rv
cccgacacgccgugcgugcgg

SEQ ID NO: 3326962 - RNA, 18 nt, Mycobacterium tuberculosis H37Rv
cccgacaucggccagcgc

SEQ ID NO: 3326963 - RNA, 18 nt, Mycobacterium tuberculosis H37Rv
cccgaccacugaucggca

SEQ ID NO: 3326964 - RNA, 14 nt, Mycobacterium tuberculosis H37Rv
cccgaccagcacca

SEQ ID NO: 3326965 - RNA, 18 nt, Mycobacterium tuberculosis H37Rv
cccgaccagcaccagaac

SEQ ID NO: 3326966 - RNA, 21 nt, Mycobacterium tuberculosis H37Rv
cccgcaggucgaucugcgcca

SEQ ID NO: 3326967 - RNA, 18 nt, Mycobacterium tuberculosis H37Rv
cccgcaggucgcaccaca

SEQ ID NO: 3326968 - RNA, 22 nt, Mycobacterium tuberculosis H37Rv
cccgcauaccguucacccagcg

SEQ ID NO: 3326969 - RNA, 15 nt, Mycobacterium tuberculosis H37Rv
cccgcaucgcccaag

SEQ ID NO: 3326970 - RNA, 13 nt, Mycobacterium tuberculosis H37Rv
cccgcaucgccuc

SEQ ID NO: 3326971 - RNA, 16 nt, Mycobacterium tuberculosis H37Rv
cccgcaucgcggcauc

SEQ ID NO: 3326972 - RNA, 22 nt, Mycobacterium tuberculosis H37Rv
cccgcaucgucgccgaccguca

SEQ ID NO: 3326973 - RNA, 22 nt, Mycobacterium tuberculosis H37Rv
cccgcaugcccuggaccagcgg

SEQ ID NO: 3326974 - RNA, 19 nt, Mycobacterium tuberculosis H37Rv
cccgcaugccggcgcacca

SEQ ID NO: 3326975 - RNA, 17 nt, Mycobacterium tuberculosis H37Rv
cccgcauugacgaaacc

SEQ ID NO: 3326976 - RNA, 18 nt, Mycobacterium tuberculosis H37Rv
cccgcauugaucucgacc

SEQ ID NO: 3326977 - RNA, 22 nt, Mycobacterium tuberculosis H37Rv
cccgcauugccaacgcccacgu

SEQ ID NO: 3326978 - RNA, 14 nt, Mycobacterium tuberculosis H37Rv
cccgcauugccguc

SEQ ID NO: 3326979 - RNA, 18 nt, Mycobacterium tuberculosis H37Rv
cccgcauugccgucgggg

SEQ ID NO: 3326980 - RNA, 14 nt, Mycobacterium tuberculosis H37Rv
cccgccaaccccaa

SEQ ID NO: 3326981 - RNA, 21 nt, Mycobacterium tuberculosis H37Rv
cccgccaaccccaacaucccg

SEQ ID NO: 3326982 - RNA, 14 nt, Mycobacterium tuberculosis H37Rv
cccgccacaccaac

SEQ ID NO: 3326983 - RNA, 14 nt, Mycobacterium tuberculosis H37Rv
cccgccaccgaaca

SEQ ID NO: 3326984 - RNA, 20 nt, Mycobacterium tuberculosis H37Rv
cccgccaccgcgacaccccg

SEQ ID NO: 3326985 - RNA, 14 nt, Mycobacterium tuberculosis H37Rv
cccgccaccggguu

SEQ ID NO: 3326986 - RNA, 19 nt, Mycobacterium tuberculosis H37Rv
cccgccacgaugucgucga

SEQ ID NO: 3326987 - RNA, 13 nt, Mycobacterium tuberculosis H37Rv
cccgccacgccga

SEQ ID NO: 3326988 - RNA, 20 nt, Mycobacterium tuberculosis H37Rv
cccgccacgguucgggcagc

SEQ ID NO: 3326989 - RNA, 20 nt, Mycobacterium tuberculosis H37Rv
cccgccacguacuccaccgc

SEQ ID NO: 3326990 - RNA, 16 nt, Mycobacterium tuberculosis H37Rv
cccgccacgucgccgg

SEQ ID NO: 3326991 - RNA, 17 nt, Mycobacterium tuberculosis H37Rv
cccgccagcagggccag

SEQ ID NO: 3326992 - RNA, 20 nt, Mycobacterium tuberculosis H37Rv
cccgccagcgauccaccaag

SEQ ID NO: 3326993 - RNA, 13 nt, Mycobacterium tuberculosis H37Rv
cccgccagcgccg

SEQ ID NO: 3326994 - RNA, 16 nt, Mycobacterium tuberculosis H37Rv
cccgccagcgccgccg

SEQ ID NO: 3326995 - RNA, 17 nt, Mycobacterium tuberculosis H37Rv
cccgccagcgccgccgc

SEQ ID NO: 3326996 - RNA, 15 nt, Mycobacterium tuberculosis H37Rv
cccgccagcgccgcu

SEQ ID NO: 3326997 - RNA, 17 nt, Mycobacterium tuberculosis H37Rv
cccgccagggcggcauc

SEQ ID NO: 3326998 - RNA, 14 nt, Mycobacterium tuberculosis H37Rv
cccgccauccgccg

SEQ ID NO: 3326999 - RNA, 14 nt, Mycobacterium tuberculosis H37Rv
cccgccaucugccu

SEQ ID NO: 3327000 - RNA, 15 nt, Mycobacterium tuberculosis H37Rv
cccgccaugcggcgc

SEQ ID NO: 3327001 - RNA, 16 nt, Mycobacterium tuberculosis H37Rv
cccgccauugccgccg

SEQ ID NO: 3327002 - RNA, 23 nt, Mycobacterium tuberculosis H37Rv
cccgccauugccgccggcgccgc

SEQ ID NO: 3327003 - RNA, 18 nt, Mycobacterium tuberculosis H37Rv
cccgccauugccgccguc

SEQ ID NO: 3327004 - RNA, 21 nt, Mycobacterium tuberculosis H37Rv
cccgccauugccgccgucgcc

SEQ ID NO: 3327005 - RNA, 13 nt, Mycobacterium tuberculosis H37Rv
cccgcccacggca

SEQ ID NO: 3327006 - RNA, 18 nt, Mycobacterium tuberculosis H37Rv
cccgcccacggcaccacc

SEQ ID NO: 3327007 - RNA, 16 nt, Mycobacterium tuberculosis H37Rv
cccgcccaggcgucca

SEQ ID NO: 3327008 - RNA, 18 nt, Mycobacterium tuberculosis H37Rv
cccgccccgggccaccag

SEQ ID NO: 3327009 - RNA, 14 nt, Mycobacterium tuberculosis H37Rv
cccgcccggcaguu

SEQ ID NO: 3327010 - RNA, 14 nt, Mycobacterium tuberculosis H37Rv
cccgcccggccagc

SEQ ID NO: 3327011 - RNA, 16 nt, Mycobacterium tuberculosis H37Rv
cccgcccugaccgccc

SEQ ID NO: 3327012 - RNA, 17 nt, Mycobacterium tuberculosis H37Rv
cccgcccugaccgcccg

SEQ ID NO: 3327013 - RNA, 18 nt, Mycobacterium tuberculosis H37Rv
cccgcccugaccgcccgc

SEQ ID NO: 3327014 - RNA, 18 nt, Mycobacterium tuberculosis H37Rv
cccgccgacgaccgccug

SEQ ID NO: 3327015 - RNA, 14 nt, Mycobacterium tuberculosis H37Rv
cccgccgacgccgc

SEQ ID NO: 3327016 - RNA, 16 nt, Mycobacterium tuberculosis H37Rv
cccgccgacgccgccg

SEQ ID NO: 3327017 - RNA, 18 nt, Mycobacterium tuberculosis H37Rv
cccgccgacgccgccggc

SEQ ID NO: 3327018 - RNA, 20 nt, Mycobacterium tuberculosis H37Rv
cccgccgacgccgccggccc

SEQ ID NO: 3327019 - RNA, 22 nt, Mycobacterium tuberculosis H37Rv
cccgccgacgccgccggccccg

SEQ ID NO: 3327020 - RNA, 21 nt, Mycobacterium tuberculosis H37Rv
cccgccgagcggugccggcgu

SEQ ID NO: 3327021 - RNA, 20 nt, Mycobacterium tuberculosis H37Rv
cccgccgagcgguugccuuc

SEQ ID NO: 3327022 - RNA, 14 nt, Mycobacterium tuberculosis H37Rv
cccgccgaucaccg

SEQ ID NO: 3327023 - RNA, 15 nt, Mycobacterium tuberculosis H37Rv
cccgccgaucaccgc

SEQ ID NO: 3327024 - RNA, 23 nt, Mycobacterium tuberculosis H37Rv
cccgccgaugaugcggcgcagcg

SEQ ID NO: 3327025 - RNA, 16 nt, Mycobacterium tuberculosis H37Rv
cccgccgaugccgccg

SEQ ID NO: 3327026 - RNA, 15 nt, Mycobacterium tuberculosis H37Rv
cccgccgccccacaa

SEQ ID NO: 3327027 - RNA, 17 nt, Mycobacterium tuberculosis H37Rv
cccgccgcgaccacgca

SEQ ID NO: 3327028 - RNA, 21 nt, Mycobacterium tuberculosis H37Rv
cccgccgcgaccacgcaccgc

SEQ ID NO: 3327029 - RNA, 13 nt, Mycobacterium tuberculosis H37Rv
cccgccgcgcauc

SEQ ID NO: 3327030 - RNA, 21 nt, Mycobacterium tuberculosis H37Rv
cccgccgcgcauccgcagccc

SEQ ID NO: 3327031 - RNA, 13 nt, Mycobacterium tuberculosis H37Rv
cccgccgcgcccg

SEQ ID NO: 3327032 - RNA, 15 nt, Mycobacterium tuberculosis H37Rv
cccgccgcugaacgg

SEQ ID NO: 3327033 - RNA, 15 nt, Mycobacterium tuberculosis H37Rv
cccgccggacccgcc

SEQ ID NO: 3327034 - RNA, 16 nt, Mycobacterium tuberculosis H37Rv
cccgccggauccgcca

SEQ ID NO: 3327035 - RNA, 22 nt, Mycobacterium tuberculosis H37Rv
cccgccggcacauugaucgacg

SEQ ID NO: 3327036 - RNA, 15 nt, Mycobacterium tuberculosis H37Rv
cccgccggcagugag

SEQ ID NO: 3327037 - RNA, 14 nt, Mycobacterium tuberculosis H37Rv
cccgccggccccgc

SEQ ID NO: 3327038 - RNA, 15 nt, Mycobacterium tuberculosis H37Rv
cccgccggccccgcc

SEQ ID NO: 3327039 - RNA, 21 nt, Mycobacterium tuberculosis H37Rv
cccgccggccgcgccggcccc

SEQ ID NO: 3327040 - RNA, 21 nt, Mycobacterium tuberculosis H37Rv
cccgccggccucuggaucacg

SEQ ID NO: 3327041 - RNA, 15 nt, Mycobacterium tuberculosis H37Rv
cccgccggcuccgcc

SEQ ID NO: 3327042 - RNA, 16 nt, Mycobacterium tuberculosis H37Rv
cccgccggcuccgcca

SEQ ID NO: 3327043 - RNA, 20 nt, Mycobacterium tuberculosis H37Rv
cccgccggcuccgccacugg

SEQ ID NO: 3327044 - RNA, 18 nt, Mycobacterium tuberculosis H37Rv
cccgccgggcuccacguc

SEQ ID NO: 3327045 - RNA, 13 nt, Mycobacterium tuberculosis H37Rv
cccgccggggccg

SEQ ID NO: 3327046 - RNA, 21 nt, Mycobacterium tuberculosis H37Rv
cccgccggguccgccgggccc

SEQ ID NO: 3327047 - RNA, 18 nt, Mycobacterium tuberculosis H37Rv
cccgccggguuggucuuc

SEQ ID NO: 3327048 - RNA, 14 nt, Mycobacterium tuberculosis H37Rv
cccgccgucacccc

SEQ ID NO: 3327049 - RNA, 16 nt, Mycobacterium tuberculosis H37Rv
cccgccgucacccccg

SEQ ID NO: 3327050 - RNA, 13 nt, Mycobacterium tuberculosis H37Rv
cccgccgucaccg

SEQ ID NO: 3327051 - RNA, 14 nt, Mycobacterium tuberculosis H37Rv
cccgccgucaccgc

SEQ ID NO: 3327052 - RNA, 18 nt, Mycobacterium tuberculosis H37Rv
cccgccguccggcgccca

SEQ ID NO: 3327053 - RNA, 20 nt, Mycobacterium tuberculosis H37Rv
cccgccgucuuggcccgguc

SEQ ID NO: 3327054 - RNA, 14 nt, Mycobacterium tuberculosis H37Rv
cccgccguugccgc

SEQ ID NO: 3327055 - RNA, 18 nt, Mycobacterium tuberculosis H37Rv
cccgccguugccgccguc

SEQ ID NO: 3327056 - RNA, 19 nt, Mycobacterium tuberculosis H37Rv
cccgccguuuccgccgccg

SEQ ID NO: 3327057 - RNA, 20 nt, Mycobacterium tuberculosis H37Rv
cccgccguuuccgccgccgc

SEQ ID NO: 3327058 - RNA, 22 nt, Mycobacterium tuberculosis H37Rv
cccgccguuuccgccgccgcca

SEQ ID NO: 3327059 - RNA, 21 nt, Mycobacterium tuberculosis H37Rv
cccgccuaaagcgugucgccc

SEQ ID NO: 3327060 - RNA, 12 nt, Mycobacterium tuberculosis H37Rv
cccgccucgacc

SEQ ID NO: 3327061 - RNA, 14 nt, Mycobacterium tuberculosis H37Rv
cccgccucgaccgc

SEQ ID NO: 3327062 - RNA, 23 nt, Mycobacterium tuberculosis H37Rv
cccggacaagguauccaacgcgc

SEQ ID NO: 3327063 - RNA, 14 nt, Mycobacterium tuberculosis H37Rv
cccggaccacuguu

SEQ ID NO: 3327064 - RNA, 14 nt, Mycobacterium tuberculosis H37Rv
cccggaccaucgcc

SEQ ID NO: 3327065 - RNA, 15 nt, Mycobacterium tuberculosis H37Rv
cccggaccgcggcca

SEQ ID NO: 3327066 - RNA, 14 nt, Mycobacterium tuberculosis H37Rv
cccggaccuucggc

SEQ ID NO: 3327067 - RNA, 16 nt, Mycobacterium tuberculosis H37Rv
cccggaccuucggcgg

SEQ ID NO: 3327068 - RNA, 17 nt, Mycobacterium tuberculosis H37Rv
cccggacguaggcaccc

SEQ ID NO: 3327069 - RNA, 18 nt, Mycobacterium tuberculosis H37Rv
cccggacguaggcacccc

SEQ ID NO: 3327070 - RNA, 19 nt, Mycobacterium tuberculosis H37Rv
cccggacucuccccuggcc

SEQ ID NO: 3327071 - RNA, 21 nt, Mycobacterium tuberculosis H37Rv
cccggacuucaugaucggacc

SEQ ID NO: 3327072 - RNA, 24 nt, Mycobacterium tuberculosis H37Rv
cccggagccgccaggugcucgucg

SEQ ID NO: 3327073 - RNA, 16 nt, Mycobacterium tuberculosis H37Rv
cccggagcggucagcg

SEQ ID NO: 3327074 - RNA, 18 nt, Mycobacterium tuberculosis H37Rv
cccggagcggucagcgga

SEQ ID NO: 3327075 - RNA, 15 nt, Mycobacterium tuberculosis H37Rv
cccggaggcaauccg

SEQ ID NO: 3327076 - RNA, 23 nt, Mycobacterium tuberculosis H37Rv
cccggaguggccaguuggccggc

SEQ ID NO: 3327077 - RNA, 14 nt, Mycobacterium tuberculosis H37Rv
cccggaugaucccg

SEQ ID NO: 3327078 - RNA, 18 nt, Mycobacterium tuberculosis H37Rv
cccggauguccgccgacg

SEQ ID NO: 3327079 - RNA, 14 nt, Mycobacterium tuberculosis H37Rv
cccggcaagcgcag

SEQ ID NO: 3327080 - RNA, 14 nt, Mycobacterium tuberculosis H37Rv
cccggcacacccuc

SEQ ID NO: 3327081 - RNA, 17 nt, Mycobacterium tuberculosis H37Rv
cccggcacacggccuug

SEQ ID NO: 3327082 - RNA, 22 nt, Mycobacterium tuberculosis H37Rv
cccggcacccaguuccacccgg

SEQ ID NO: 3327083 - RNA, 15 nt, Mycobacterium tuberculosis H37Rv
cccggcaccccuuug

SEQ ID NO: 3327084 - RNA, 17 nt, Mycobacterium tuberculosis H37Rv
cccggcaccccuuugac

SEQ ID NO: 3327085 - RNA, 19 nt, Mycobacterium tuberculosis H37Rv
cccggcaccccuuugacgc

SEQ ID NO: 3327086 - RNA, 17 nt, Mycobacterium tuberculosis H37Rv
cccggcacggugucgcg

SEQ ID NO: 3327087 - RNA, 17 nt, Mycobacterium tuberculosis H37Rv
cccggcacugaccgcga

SEQ ID NO: 3327088 - RNA, 14 nt, Mycobacterium tuberculosis H37Rv
cccggcagagcacg

SEQ ID NO: 3327089 - RNA, 21 nt, Mycobacterium tuberculosis H37Rv
cccggcagcaucggucacacc

SEQ ID NO: 3327090 - RNA, 12 nt, Mycobacterium tuberculosis H37Rv
cccggcauacaa

SEQ ID NO: 3327091 - RNA, 21 nt, Mycobacterium tuberculosis H37Rv
cccggcauacaacuggugggc

SEQ ID NO: 3327092 - RNA, 16 nt, Mycobacterium tuberculosis H37Rv
cccggcauacucuuug

SEQ ID NO: 3327093 - RNA, 21 nt, Mycobacterium tuberculosis H37Rv
cccggcauugcccgagcccag

SEQ ID NO: 3327094 - RNA, 14 nt, Mycobacterium tuberculosis H37Rv
cccggccaaaaugg

SEQ ID NO: 3327095 - RNA, 17 nt, Mycobacterium tuberculosis H37Rv
cccggccaaccaccaac

SEQ ID NO: 3327096 - RNA, 17 nt, Mycobacterium tuberculosis H37Rv
cccggccaccagcaugc

SEQ ID NO: 3327097 - RNA, 12 nt, Mycobacterium tuberculosis H37Rv
cccggccagcug

SEQ ID NO: 3327098 - RNA, 23 nt, Mycobacterium tuberculosis H37Rv
cccggccaggaguuugaccaccu

SEQ ID NO: 3327099 - RNA, 21 nt, Mycobacterium tuberculosis H37Rv
cccggcccagugggacagguc

SEQ ID NO: 3327100 - RNA, 22 nt, Mycobacterium tuberculosis H37Rv
cccggcccauugucgaucaccu

SEQ ID NO: 3327101 - RNA, 14 nt, Mycobacterium tuberculosis H37Rv
cccggcccgaucgg

SEQ ID NO: 3327102 - RNA, 15 nt, Mycobacterium tuberculosis H37Rv
cccggcccgccaccc

SEQ ID NO: 3327103 - RNA, 16 nt, Mycobacterium tuberculosis H37Rv
cccggcccgccacccc

SEQ ID NO: 3327104 - RNA, 15 nt, Mycobacterium tuberculosis H37Rv
cccggcccgcucagc

SEQ ID NO: 3327105 - RNA, 17 nt, Mycobacterium tuberculosis H37Rv
cccggcccgcucagccg

SEQ ID NO: 3327106 - RNA, 14 nt, Mycobacterium tuberculosis H37Rv
cccggcccguagcg

SEQ ID NO: 3327107 - RNA, 23 nt, Mycobacterium tuberculosis H37Rv
cccggcccguagcguccgcgccc

SEQ ID NO: 3327108 - RNA, 14 nt, Mycobacterium tuberculosis H37Rv
cccggccgcacccg

SEQ ID NO: 3327109 - RNA, 12 nt, Mycobacterium tuberculosis H37Rv
cccggccgccac

SEQ ID NO: 3327110 - RNA, 17 nt, Mycobacterium tuberculosis H37Rv
cccggccgccagcgcgc

SEQ ID NO: 3327111 - RNA, 18 nt, Mycobacterium tuberculosis H37Rv
cccggccgccagcgcgcc

SEQ ID NO: 3327112 - RNA, 11 nt, Mycobacterium tuberculosis H37Rv
cccggccgccg

SEQ ID NO: 3327113 - RNA, 12 nt, Mycobacterium tuberculosis H37Rv
cccggccgccga

SEQ ID NO: 3327114 - RNA, 13 nt, Mycobacterium tuberculosis H37Rv
cccggccgcgcac

SEQ ID NO: 3327115 - RNA, 16 nt, Mycobacterium tuberculosis H37Rv
cccggccgcgcacccg

SEQ ID NO: 3327116 - RNA, 18 nt, Mycobacterium tuberculosis H37Rv
cccggccgcgcacccguc

SEQ ID NO: 3327117 - RNA, 14 nt, Mycobacterium tuberculosis H37Rv
cccggccgcgcgca

SEQ ID NO: 3327118 - RNA, 14 nt, Mycobacterium tuberculosis H37Rv
cccggccgcgcggg

SEQ ID NO: 3327119 - RNA, 22 nt, Mycobacterium tuberculosis H37Rv
cccggccgcgucacggaccugg

SEQ ID NO: 3327120 - RNA, 19 nt, Mycobacterium tuberculosis H37Rv
cccggccgggucgagugcg

SEQ ID NO: 3327121 - RNA, 15 nt, Mycobacterium tuberculosis H37Rv
cccggccggucgaga

SEQ ID NO: 3327122 - RNA, 14 nt, Mycobacterium tuberculosis H37Rv
cccggccgucgcgc

SEQ ID NO: 3327123 - RNA, 15 nt, Mycobacterium tuberculosis H37Rv
cccggccgucgcgcg

SEQ ID NO: 3327124 - RNA, 23 nt, Mycobacterium tuberculosis H37Rv
cccggccgucgcgcgaccgacca

SEQ ID NO: 3327125 - RNA, 16 nt, Mycobacterium tuberculosis H37Rv
cccggccguugggcca

SEQ ID NO: 3327126 - RNA, 21 nt, Mycobacterium tuberculosis H37Rv
cccggccguugggccaccggc

SEQ ID NO: 3327127 - RNA, 14 nt, Mycobacterium tuberculosis H37Rv
cccggccugcgucg

SEQ ID NO: 3327128 - RNA, 16 nt, Mycobacterium tuberculosis H37Rv
cccggccuugccaccg

SEQ ID NO: 3327129 - RNA, 14 nt, Mycobacterium tuberculosis H37Rv
cccggccuugccgc

SEQ ID NO: 3327130 - RNA, 15 nt, Mycobacterium tuberculosis H37Rv
cccggccuugccgcc

SEQ ID NO: 3327131 - RNA, 16 nt, Mycobacterium tuberculosis H37Rv
cccggccuugccgccg

SEQ ID NO: 3327132 - RNA, 21 nt, Mycobacterium tuberculosis H37Rv
cccggccuuggcggcggcaua

SEQ ID NO: 3327133 - RNA, 15 nt, Mycobacterium tuberculosis H37Rv
cccggcgacccgguc

SEQ ID NO: 3327134 - RNA, 16 nt, Mycobacterium tuberculosis H37Rv
cccggcgacccgguca

SEQ ID NO: 3327135 - RNA, 19 nt, Mycobacterium tuberculosis H37Rv
cccggcgacggcguagccg

SEQ ID NO: 3327136 - RNA, 15 nt, Mycobacterium tuberculosis H37Rv
cccggcgacguuccg

SEQ ID NO: 3327137 - RNA, 16 nt, Mycobacterium tuberculosis H37Rv
cccggcgagcacccgc

SEQ ID NO: 3327138 - RNA, 13 nt, Mycobacterium tuberculosis H37Rv
cccggcgaucagc

SEQ ID NO: 3327139 - RNA, 21 nt, Mycobacterium tuberculosis H37Rv
cccggcgaugagcaugcccag

SEQ ID NO: 3327140 - RNA, 18 nt, Mycobacterium tuberculosis H37Rv
cccggcgaugcagccggg

SEQ ID NO: 3327141 - RNA, 18 nt, Mycobacterium tuberculosis H37Rv
cccggcgcaagcgccgcg

SEQ ID NO: 3327142 - RNA, 22 nt, Mycobacterium tuberculosis H37Rv
cccggcgcaagcgccgcgcuug

SEQ ID NO: 3327143 - RNA, 23 nt, Mycobacterium tuberculosis H37Rv
cccggcgccgcgggugcggcaug

SEQ ID NO: 3327144 - RNA, 15 nt, Mycobacterium tuberculosis H37Rv
cccggcgcgauggcg

SEQ ID NO: 3327145 - RNA, 12 nt, Mycobacterium tuberculosis H37Rv
cccggcgcgcca

SEQ ID NO: 3327146 - RNA, 12 nt, Mycobacterium tuberculosis H37Rv
cccggcgcgccg

SEQ ID NO: 3327147 - RNA, 16 nt, Mycobacterium tuberculosis H37Rv
cccggcgcggccagcu

SEQ ID NO: 3327148 - RNA, 22 nt, Mycobacterium tuberculosis H37Rv
cccggcgcggccgcaagccgcg

SEQ ID NO: 3327149 - RNA, 16 nt, Mycobacterium tuberculosis H37Rv
cccggcgcuagcgccg

SEQ ID NO: 3327150 - RNA, 18 nt, Mycobacterium tuberculosis H37Rv
cccggcgcuagcgccgcg

SEQ ID NO: 3327151 - RNA, 14 nt, Mycobacterium tuberculosis H37Rv
cccggcgcuccaac

SEQ ID NO: 3327152 - RNA, 14 nt, Mycobacterium tuberculosis H37Rv
cccggcggaucccg

SEQ ID NO: 3327153 - RNA, 22 nt, Mycobacterium tuberculosis H37Rv
cccggcggaucccgaggcgccc

SEQ ID NO: 3327154 - RNA, 23 nt, Mycobacterium tuberculosis H37Rv
cccggcggccaucccgcguucga

SEQ ID NO: 3327155 - RNA, 15 nt, Mycobacterium tuberculosis H37Rv
cccggcgggcccgcc

SEQ ID NO: 3327156 - RNA, 21 nt, Mycobacterium tuberculosis H37Rv
cccggcgggcccgccggcccc

SEQ ID NO: 3327157 - RNA, 18 nt, Mycobacterium tuberculosis H37Rv
cccggcgggcggugggca

SEQ ID NO: 3327158 - RNA, 20 nt, Mycobacterium tuberculosis H37Rv
cccggcguauugcaccgcca

SEQ ID NO: 3327159 - RNA, 16 nt, Mycobacterium tuberculosis H37Rv
cccgguggacagaauc

SEQ ID NO: 3327160 - RNA, 24 nt, Mycobacterium tuberculosis H37Rv
cccgguggacagaaucgaccgccg

SEQ ID NO: 3327161 - RNA, 15 nt, Mycobacterium tuberculosis H37Rv
cccgguggugcugcc

SEQ ID NO: 3327162 - RNA, 12 nt, Mycobacterium tuberculosis H37Rv
cccgguguugag

SEQ ID NO: 3327163 - RNA, 15 nt, Mycobacterium tuberculosis H37Rv
cccgguucagcgcug

SEQ ID NO: 3327164 - RNA, 17 nt, Mycobacterium tuberculosis H37Rv
cccgguucgacgucugc

SEQ ID NO: 3327165 - RNA, 21 nt, Mycobacterium tuberculosis H37Rv
cccgguugacgccgguccccg

SEQ ID NO: 3327166 - RNA, 12 nt, Mycobacterium tuberculosis H37Rv
cccgguugacuc

SEQ ID NO: 3327167 - RNA, 18 nt, Mycobacterium tuberculosis H37Rv
cccgguugggugugcccg

SEQ ID NO: 3327168 - RNA, 18 nt, Mycobacterium tuberculosis H37Rv
cccgguugugcgcgcgcc

SEQ ID NO: 3327169 - RNA, 19 nt, Mycobacterium tuberculosis H37Rv
cccgguugugcgcgcgccc

SEQ ID NO: 3327170 - RNA, 13 nt, Mycobacterium tuberculosis H37Rv
cccguacacgauc

SEQ ID NO: 3327171 - RNA, 14 nt, Mycobacterium tuberculosis H37Rv
cccguaccagcccg

SEQ ID NO: 3327172 - RNA, 15 nt, Mycobacterium tuberculosis H37Rv
cccguacgccggcgg

SEQ ID NO: 3327173 - RNA, 18 nt, Mycobacterium tuberculosis H37Rv
cccguagaccuucgagua

SEQ ID NO: 3327174 - RNA, 14 nt, Mycobacterium tuberculosis H37Rv
cccguagcugcgca

SEQ ID NO: 3327175 - RNA, 20 nt, Mycobacterium tuberculosis H37Rv
cccguaggugcacaacccgu

SEQ ID NO: 3327176 - RNA, 16 nt, Mycobacterium tuberculosis H37Rv
cccguauaaccggcca

SEQ ID NO: 3327177 - RNA, 20 nt, Mycobacterium tuberculosis H37Rv
cccguauugccaaagcccga

SEQ ID NO: 3327178 - RNA, 16 nt, Mycobacterium tuberculosis H37Rv
cccguauuucaccgaa

SEQ ID NO: 3327179 - RNA, 13 nt, Mycobacterium tuberculosis H37Rv
cccgucaccgccg

SEQ ID NO: 3327180 - RNA, 16 nt, Mycobacterium tuberculosis H37Rv
cccgucacgcccgcga

SEQ ID NO: 3327181 - RNA, 22 nt, Mycobacterium tuberculosis H37Rv
cccgucacgcccgcgaaccgcg

SEQ ID NO: 3327182 - RNA, 22 nt, Mycobacterium tuberculosis H37Rv
cccgucccagcugaccagcguc

SEQ ID NO: 3327183 - RNA, 23 nt, Mycobacterium tuberculosis H37Rv
cccguccugcggguaggugacga

SEQ ID NO: 3327184 - RNA, 16 nt, Mycobacterium tuberculosis H37Rv
cccgucgaacgcgcgc

SEQ ID NO: 3327185 - RNA, 12 nt, Mycobacterium tuberculosis H37Rv
cccgucgagcag

SEQ ID NO: 3327186 - RNA, 18 nt, Mycobacterium tuberculosis H37Rv
cccgucgaguagguaacg

SEQ ID NO: 3327187 - RNA, 13 nt, Mycobacterium tuberculosis H37Rv
cccgucgcggccg

SEQ ID NO: 3327188 - RNA, 13 nt, Mycobacterium tuberculosis H37Rv
cccgucggcgccg

SEQ ID NO: 3327189 - RNA, 14 nt, Mycobacterium tuberculosis H37Rv
cccgucgggcaguu

SEQ ID NO: 3327190 - RNA, 13 nt, Mycobacterium tuberculosis H37Rv
cccgucgugaccg

SEQ ID NO: 3327191 - RNA, 15 nt, Mycobacterium tuberculosis H37Rv
cccgucuccagcacc

SEQ ID NO: 3327192 - RNA, 16 nt, Mycobacterium tuberculosis H37Rv
cccgucucguugacca

SEQ ID NO: 3327193 - RNA, 12 nt, Mycobacterium tuberculosis H37Rv
cccgucuuccag

SEQ ID NO: 3327194 - RNA, 18 nt, Mycobacterium tuberculosis H37Rv
cccgugacauucugcagc

SEQ ID NO: 3327195 - RNA, 22 nt, Mycobacterium tuberculosis H37Rv
cccgugagauccuccaauugcg

SEQ ID NO: 3327196 - RNA, 17 nt, Mycobacterium tuberculosis H37Rv
cccgugcacgaucgcgg

SEQ ID NO: 3327197 - RNA, 13 nt, Mycobacterium tuberculosis H37Rv
cccgugcaggauc

SEQ ID NO: 3327198 - RNA, 13 nt, Mycobacterium tuberculosis H37Rv
cccgugccacagc

SEQ ID NO: 3327199 - RNA, 21 nt, Mycobacterium tuberculosis H37Rv
cccgugccgccgaugccgccg

SEQ ID NO: 3327200 - RNA, 22 nt, Mycobacterium tuberculosis H37Rv
cccgugccgucaacgauggugg

SEQ ID NO: 3327201 - RNA, 15 nt, Mycobacterium tuberculosis H37Rv
cccgugccgucgccc

SEQ ID NO: 3327202 - RNA, 21 nt, Mycobacterium tuberculosis H37Rv
cccgugccuggccggugcgca

SEQ ID NO: 3327203 - RNA, 14 nt, Mycobacterium tuberculosis H37Rv
cccgugcgcgcgca

SEQ ID NO: 3327204 - RNA, 15 nt, Mycobacterium tuberculosis H37Rv
cccgugcgcgcgcag

SEQ ID NO: 3327205 - RNA, 17 nt, Mycobacterium tuberculosis H37Rv
cccguggaaagugcguc

SEQ ID NO: 3327206 - RNA, 21 nt, Mycobacterium tuberculosis H37Rv
cccguggcggugagccgccag

SEQ ID NO: 3327207 - RNA, 20 nt, Mycobacterium tuberculosis H37Rv
cccgugggccucgaucagcg

SEQ ID NO: 3327208 - RNA, 16 nt, Mycobacterium tuberculosis H37Rv
cccguuaugcgccgcc

SEQ ID NO: 3327209 - RNA, 15 nt, Mycobacterium tuberculosis H37Rv
cccguucacgcucgu

SEQ ID NO: 3327210 - RNA, 16 nt, Mycobacterium tuberculosis H37Rv
cccguuccacgccggc

SEQ ID NO: 3327211 - RNA, 19 nt, Mycobacterium tuberculosis H37Rv
cccguuccacgccggcauc

SEQ ID NO: 3327212 - RNA, 20 nt, Mycobacterium tuberculosis H37Rv
cccguucgaggucggcgauc

SEQ ID NO: 3327213 - RNA, 12 nt, Mycobacterium tuberculosis H37Rv
cccguucgccgu

SEQ ID NO: 3327214 - RNA, 14 nt, Mycobacterium tuberculosis H37Rv
cccguucgccgucg

SEQ ID NO: 3327215 - RNA, 16 nt, Mycobacterium tuberculosis H37Rv
cccguucucgcggccg

SEQ ID NO: 3327216 - RNA, 12 nt, Mycobacterium tuberculosis H37Rv
cccguugacguu

SEQ ID NO: 3327217 - RNA, 22 nt, Mycobacterium tuberculosis H37Rv
cccguugagcauaugacgucgc

SEQ ID NO: 3327218 - RNA, 13 nt, Mycobacterium tuberculosis H37Rv
cccguugaucgcg

SEQ ID NO: 3327219 - RNA, 23 nt, Mycobacterium tuberculosis H37Rv
cccguugaucgcggacacugcga

SEQ ID NO: 3327220 - RNA, 13 nt, Mycobacterium tuberculosis H37Rv
cccguugcaggug

SEQ ID NO: 3327221 - RNA, 23 nt, Mycobacterium tuberculosis H37Rv
cccguugguagccggugaccgcg

SEQ ID NO: 3327222 - RNA, 23 nt, Mycobacterium tuberculosis H37Rv
cccguuguccagaacggcgauca

SEQ ID NO: 3327223 - RNA, 16 nt, Mycobacterium tuberculosis H37Rv
cccguugugucaccgg

SEQ ID NO: 3327224 - RNA, 19 nt, Mycobacterium tuberculosis H37Rv
cccuaucagccgagacacc

SEQ ID NO: 3327225 - RNA, 18 nt, Mycobacterium tuberculosis H37Rv
cccucaacgucccagccc

SEQ ID NO: 3327226 - RNA, 23 nt, Mycobacterium tuberculosis H37Rv
cccucaccgccugugccgccggc

SEQ ID NO: 3327227 - RNA, 19 nt, Mycobacterium tuberculosis H37Rv
cccucagcuagcgcgggcu

SEQ ID NO: 3327228 - RNA, 14 nt, Mycobacterium tuberculosis H37Rv
cccucaguucacgu

SEQ ID NO: 3327229 - RNA, 14 nt, Mycobacterium tuberculosis H37Rv
cccuccacagcggc

SEQ ID NO: 3327230 - RNA, 18 nt, Mycobacterium tuberculosis H37Rv
cccuccagauaccaccgc

SEQ ID NO: 3327231 - RNA, 19 nt, Mycobacterium tuberculosis H37Rv
cccuccagauaccaccgcc

SEQ ID NO: 3327232 - RNA, 21 nt, Mycobacterium tuberculosis H37Rv
cccuccagauaccaccgccgc

SEQ ID NO: 3327233 - RNA, 20 nt, Mycobacterium tuberculosis H37Rv
cccuccagggcccugcuggc

SEQ ID NO: 3327234 - RNA, 15 nt, Mycobacterium tuberculosis H37Rv
cccucccgggcccgc

SEQ ID NO: 3327235 - RNA, 13 nt, Mycobacterium tuberculosis H37Rv
cccuccgagcaca

SEQ ID NO: 3327236 - RNA, 16 nt, Mycobacterium tuberculosis H37Rv
cccuccgagcacagga

SEQ ID NO: 3327237 - RNA, 12 nt, Mycobacterium tuberculosis H37Rv
cccuccgcagcu

SEQ ID NO: 3327238 - RNA, 16 nt, Mycobacterium tuberculosis H37Rv
cccuccgcgccgauca

SEQ ID NO: 3327239 - RNA, 19 nt, Mycobacterium tuberculosis H37Rv
cccuccgcgccgaucagcg

SEQ ID NO: 3327240 - RNA, 16 nt, Mycobacterium tuberculosis H37Rv
cccuccgggcgcacca

SEQ ID NO: 3327241 - RNA, 15 nt, Mycobacterium tuberculosis H37Rv
cccuccgugggcagc

SEQ ID NO: 3327242 - RNA, 23 nt, Mycobacterium tuberculosis H37Rv
cccuccgugggcagcgcgcccga

SEQ ID NO: 3327243 - RNA, 12 nt, Mycobacterium tuberculosis H37Rv
cccuccucgaug

SEQ ID NO: 3327244 - RNA, 12 nt, Mycobacterium tuberculosis H37Rv
cccucgaucacg

SEQ ID NO: 3327245 - RNA, 22 nt, Mycobacterium tuberculosis H37Rv
cccucgccgaaguagacggugg

SEQ ID NO: 3327246 - RNA, 15 nt, Mycobacterium tuberculosis H37Rv
cccucgcgcgcgucg

SEQ ID NO: 3327247 - RNA, 22 nt, Mycobacterium tuberculosis H37Rv
cccucgcuguuggccgguccca

SEQ ID NO: 3327248 - RNA, 21 nt, Mycobacterium tuberculosis H37Rv
cccucggagggggaccucuuc

SEQ ID NO: 3327249 - RNA, 18 nt, Mycobacterium tuberculosis H37Rv
cccucggcacggucgccc

SEQ ID NO: 3327250 - RNA, 13 nt, Mycobacterium tuberculosis H37Rv
cccucggccgccc

SEQ ID NO: 3327251 - RNA, 22 nt, Mycobacterium tuberculosis H37Rv
cccucggcggagacggcggcca

SEQ ID NO: 3327252 - RNA, 16 nt, Mycobacterium tuberculosis H37Rv
cccucgggacggccgc

SEQ ID NO: 3327253 - RNA, 19 nt, Mycobacterium tuberculosis H37Rv
cccucgggacugcgcggcu

SEQ ID NO: 3327254 - RNA, 12 nt, Mycobacterium tuberculosis H37Rv
cccucggugcca

SEQ ID NO: 3327255 - RNA, 13 nt, Mycobacterium tuberculosis H37Rv
cccucggugccac

SEQ ID NO: 3327256 - RNA, 16 nt, Mycobacterium tuberculosis H37Rv
ccgaaacgaugcggcc

SEQ ID NO: 3327257 - RNA, 13 nt, Mycobacterium tuberculosis H37Rv
ccgaaacgauggc

SEQ ID NO: 3327258 - RNA, 15 nt, Mycobacterium tuberculosis H37Rv
ccgaaacgauggccg

SEQ ID NO: 3327259 - RNA, 12 nt, Mycobacterium tuberculosis H37Rv
ccgaaacgccgg

SEQ ID NO: 3327260 - RNA, 21 nt, Mycobacterium tuberculosis H37Rv
ccgaaacgcgcggaucgucga

SEQ ID NO: 3327261 - RNA, 19 nt, Mycobacterium tuberculosis H37Rv
ccgaaacuucgcccgggcc

SEQ ID NO: 3327262 - RNA, 22 nt, Mycobacterium tuberculosis H37Rv
ccgaaacuucgcccgggccgcg

SEQ ID NO: 3327263 - RNA, 13 nt, Mycobacterium tuberculosis H37Rv
ccgaaagccaggc

SEQ ID NO: 3327264 - RNA, 13 nt, Mycobacterium tuberculosis H37Rv
ccgaaagccucuc

SEQ ID NO: 3327265 - RNA, 21 nt, Mycobacterium tuberculosis H37Rv
ccgaaaucaguugcgcuccaa

SEQ ID NO: 3327266 - RNA, 14 nt, Mycobacterium tuberculosis H37Rv
ccgaaaucggccag

SEQ ID NO: 3327267 - RNA, 18 nt, Mycobacterium tuberculosis H37Rv
ccgaacaacagcggcaac

SEQ ID NO: 3327268 - RNA, 15 nt, Mycobacterium tuberculosis H37Rv
ccgaacaccacaccg

SEQ ID NO: 3327269 - RNA, 11 nt, Mycobacterium tuberculosis H37Rv
ccgaacaccga

SEQ ID NO: 3327270 - RNA, 22 nt, Mycobacterium tuberculosis H37Rv
ccgaacaccgagugcggugugu

SEQ ID NO: 3327271 - RNA, 11 nt, Mycobacterium tuberculosis H37Rv
ccgaacaccgu

SEQ ID NO: 3327272 - RNA, 22 nt, Mycobacterium tuberculosis H37Rv
ccgaacacgcacacgaucgcgg

SEQ ID NO: 3327273 - RNA, 18 nt, Mycobacterium tuberculosis H37Rv
ccgaacacgcuggagaug

SEQ ID NO: 3327274 - RNA, 23 nt, Mycobacterium tuberculosis H37Rv
ccgaacacuuugcgcacuaccgc

SEQ ID NO: 3327275 - RNA, 17 nt, Mycobacterium tuberculosis H37Rv
ccgaacagcaggccucc

SEQ ID NO: 3327276 - RNA, 12 nt, Mycobacterium tuberculosis H37Rv
ccgaacagcugg

SEQ ID NO: 3327277 - RNA, 21 nt, Mycobacterium tuberculosis H37Rv
ccgaacaguucggcgagcaca

SEQ ID NO: 3327278 - RNA, 11 nt, Mycobacterium tuberculosis H37Rv
ccgaacauggc

SEQ ID NO: 3327279 - RNA, 19 nt, Mycobacterium tuberculosis H37Rv
ccgaacauugcgcccagcg

SEQ ID NO: 3327280 - RNA, 20 nt, Mycobacterium tuberculosis H37Rv
ccgaaccaccuguccggugg

SEQ ID NO: 3327281 - RNA, 15 nt, Mycobacterium tuberculosis H37Rv
ccgaaccccgaccgc

SEQ ID NO: 3327282 - RNA, 17 nt, Mycobacterium tuberculosis H37Rv
ccgaaccccgggcggcg

SEQ ID NO: 3327283 - RNA, 18 nt, Mycobacterium tuberculosis H37Rv
ccgaaccccgggcggcgc

SEQ ID NO: 3327284 - RNA, 15 nt, Mycobacterium tuberculosis H37Rv
ccgaacccgccaccg

SEQ ID NO: 3327285 - RNA, 20 nt, Mycobacterium tuberculosis H37Rv
ccgaacccgccgucaccgcg

SEQ ID NO: 3327286 - RNA, 16 nt, Mycobacterium tuberculosis H37Rv
ccgaaccgcaaggccc

SEQ ID NO: 3327287 - RNA, 21 nt, Mycobacterium tuberculosis H37Rv
ccgaaccgcguuaugccaggc

SEQ ID NO: 3327288 - RNA, 16 nt, Mycobacterium tuberculosis H37Rv
ccgaaccggcaccagc

SEQ ID NO: 3327289 - RNA, 19 nt, Mycobacterium tuberculosis H37Rv
ccgaaccggcaccagcggc

SEQ ID NO: 3327290 - RNA, 18 nt, Mycobacterium tuberculosis H37Rv
ccgaaccggcgcauuccc

SEQ ID NO: 3327291 - RNA, 18 nt, Mycobacterium tuberculosis H37Rv
ccgaaccuggucuugacu

SEQ ID NO: 3327292 - RNA, 15 nt, Mycobacterium tuberculosis H37Rv
ccgaacgacccuggc

SEQ ID NO: 3327293 - RNA, 21 nt, Mycobacterium tuberculosis H37Rv
ccgaacgacccuggccuuuga

SEQ ID NO: 3327294 - RNA, 21 nt, Mycobacterium tuberculosis H37Rv
ccgaacgacggguccgggcca

SEQ ID NO: 3327295 - RNA, 16 nt, Mycobacterium tuberculosis H37Rv
ccgaacgaggcgccca

SEQ ID NO: 3327296 - RNA, 17 nt, Mycobacterium tuberculosis H37Rv
ccgaacgcaacgccgau

SEQ ID NO: 3327297 - RNA, 21 nt, Mycobacterium tuberculosis H37Rv
ccgaacgcacgucgaggcggc

SEQ ID NO: 3327298 - RNA, 23 nt, Mycobacterium tuberculosis H37Rv
ccgaacgcacgucgaggcggcag

SEQ ID NO: 3327299 - RNA, 15 nt, Mycobacterium tuberculosis H37Rv
ccgaacgccaccacc

SEQ ID NO: 3327300 - RNA, 15 nt, Mycobacterium tuberculosis H37Rv
ccgaacgccagaccg

SEQ ID NO: 3327301 - RNA, 15 nt, Mycobacterium tuberculosis H37Rv
ccgaacgcgauccgg

SEQ ID NO: 3327302 - RNA, 14 nt, Mycobacterium tuberculosis H37Rv
ccgaacgucgcggc

SEQ ID NO: 3327303 - RNA, 23 nt, Mycobacterium tuberculosis H37Rv
ccgaacgugcaaccacggcggca

SEQ ID NO: 3327304 - RNA, 19 nt, Mycobacterium tuberculosis H37Rv
ccgaacuccuuaucgucga

SEQ ID NO: 3327305 - RNA, 15 nt, Mycobacterium tuberculosis H37Rv
ccgaacugccgcgcc

SEQ ID NO: 3327306 - RNA, 14 nt, Mycobacterium tuberculosis H37Rv
ccgaacugggcgau

SEQ ID NO: 3327307 - RNA, 16 nt, Mycobacterium tuberculosis H37Rv
ccgaacuggucgacgc

SEQ ID NO: 3327308 - RNA, 18 nt, Mycobacterium tuberculosis H37Rv
ccgaacuugcggaccugg

SEQ ID NO: 3327309 - RNA, 15 nt, Mycobacterium tuberculosis H37Rv
ccgaagaaaacgaac

SEQ ID NO: 3327310 - RNA, 14 nt, Mycobacterium tuberculosis H37Rv
ccgaagaagcccga

SEQ ID NO: 3327311 - RNA, 20 nt, Mycobacterium tuberculosis H37Rv
ccgaagagcacgucaacagc

SEQ ID NO: 3327312 - RNA, 14 nt, Mycobacterium tuberculosis H37Rv
ccgaagagccagca

SEQ ID NO: 3327313 - RNA, 16 nt, Mycobacterium tuberculosis H37Rv
ccgaagagcgcgcgca

SEQ ID NO: 3327314 - RNA, 17 nt, Mycobacterium tuberculosis H37Rv
ccgaagaggagaacgag

SEQ ID NO: 3327315 - RNA, 20 nt, Mycobacterium tuberculosis H37Rv
ccgaagaugcacaggccgac

SEQ ID NO: 3327316 - RNA, 14 nt, Mycobacterium tuberculosis H37Rv
ccgaagauggccag

SEQ ID NO: 3327317 - RNA, 20 nt, Mycobacterium tuberculosis H37Rv
ccgaagauuucgggcgccga

SEQ ID NO: 3327318 - RNA, 14 nt, Mycobacterium tuberculosis H37Rv
ccgaagcagaacag

SEQ ID NO: 3327319 - RNA, 16 nt, Mycobacterium tuberculosis H37Rv
ccgaagccaucggguc

SEQ ID NO: 3327320 - RNA, 11 nt, Mycobacterium tuberculosis H37Rv
ccgaagccccc

SEQ ID NO: 3327321 - RNA, 16 nt, Mycobacterium tuberculosis H37Rv
ccgaagccccgauuga

SEQ ID NO: 3327322 - RNA, 15 nt, Mycobacterium tuberculosis H37Rv
ccgaagccgggcccc

SEQ ID NO: 3327323 - RNA, 17 nt, Mycobacterium tuberculosis H37Rv
ccgaagcgaacggcaca

SEQ ID NO: 3327324 - RNA, 22 nt, Mycobacterium tuberculosis H37Rv
ccgaagcgcccguuggccaaga

SEQ ID NO: 3327325 - RNA, 15 nt, Mycobacterium tuberculosis H37Rv
ccgaagcgcgcgcgu

SEQ ID NO: 3327326 - RNA, 14 nt, Mycobacterium tuberculosis H37Rv
ccgaagcggaucug

SEQ ID NO: 3327327 - RNA, 17 nt, Mycobacterium tuberculosis H37Rv
ccgaagcggaucuggcc

SEQ ID NO: 3327328 - RNA, 16 nt, Mycobacterium tuberculosis H37Rv
ccgaagcggccaccgc

SEQ ID NO: 3327329 - RNA, 21 nt, Mycobacterium tuberculosis H37Rv
ccgaagcggccaccgccgccg

SEQ ID NO: 3327330 - RNA, 15 nt, Mycobacterium tuberculosis H37Rv
ccgaagcggucgcgc

SEQ ID NO: 3327331 - RNA, 18 nt, Mycobacterium tuberculosis H37Rv
ccgaagcucaucaccggc

SEQ ID NO: 3327332 - RNA, 17 nt, Mycobacterium tuberculosis H37Rv
ccgaagcucaucgccgc

SEQ ID NO: 3327333 - RNA, 12 nt, Mycobacterium tuberculosis H37Rv
ccgaagcugccc

SEQ ID NO: 3327334 - RNA, 19 nt, Mycobacterium tuberculosis H37Rv
ccgaaggugggauugaagc

SEQ ID NO: 3327335 - RNA, 14 nt, Mycobacterium tuberculosis H37Rv
ccgaaguacuggcc

SEQ ID NO: 3327336 - RNA, 18 nt, Mycobacterium tuberculosis H37Rv
ccgaaguacuggccgccg

SEQ ID NO: 3327337 - RNA, 16 nt, Mycobacterium tuberculosis H37Rv
ccgaaguagaagccca

SEQ ID NO: 3327338 - RNA, 17 nt, Mycobacterium tuberculosis H37Rv
ccgaaguagaagcccag

SEQ ID NO: 3327339 - RNA, 17 nt, Mycobacterium tuberculosis H37Rv
ccgaaguccacgcacca

SEQ ID NO: 3327340 - RNA, 22 nt, Mycobacterium tuberculosis H37Rv
ccgaaguccacgcaccacgagc

SEQ ID NO: 3327341 - RNA, 15 nt, Mycobacterium tuberculosis H37Rv
ccgaagucucgguga

SEQ ID NO: 3327342 - RNA, 21 nt, Mycobacterium tuberculosis H37Rv
ccgaaguugcgucgacgcguu

SEQ ID NO: 3327343 - RNA, 18 nt, Mycobacterium tuberculosis H37Rv
ccgaaguuuuggaagccc

SEQ ID NO: 3327344 - RNA, 19 nt, Mycobacterium tuberculosis H37Rv
ccgaaguuuuggaagcccg

SEQ ID NO: 3327345 - RNA, 17 nt, Mycobacterium tuberculosis H37Rv
ccgaaucagcacggugu

SEQ ID NO: 3327346 - RNA, 18 nt, Mycobacterium tuberculosis H37Rv
ccgaauccgauagcccgg

SEQ ID NO: 3327347 - RNA, 15 nt, Mycobacterium tuberculosis H37Rv
ccgaaucgccggcgg

SEQ ID NO: 3327348 - RNA, 18 nt, Mycobacterium tuberculosis H37Rv
ccgaaucgccugccacag

SEQ ID NO: 3327349 - RNA, 16 nt, Mycobacterium tuberculosis H37Rv
ccgaaucgcgggcuga

SEQ ID NO: 3327350 - RNA, 22 nt, Mycobacterium tuberculosis H37Rv
ccgaaucgugcggcgaccguca

SEQ ID NO: 3327351 - RNA, 23 nt, Mycobacterium tuberculosis H37Rv
ccgaaucguuugaacuucgccgu

SEQ ID NO: 3327352 - RNA, 20 nt, Mycobacterium tuberculosis H37Rv
ccgaaucugccggccggcgg

SEQ ID NO: 3327353 - RNA, 20 nt, Mycobacterium tuberculosis H37Rv
ccgaccuaaagaucguugcc

SEQ ID NO: 3327354 - RNA, 20 nt, Mycobacterium tuberculosis H37Rv
ccgaccucgccgcgcgugac

SEQ ID NO: 3327355 - RNA, 19 nt, Mycobacterium tuberculosis H37Rv
ccgaccucguucgucacca

SEQ ID NO: 3327356 - RNA, 21 nt, Mycobacterium tuberculosis H37Rv
ccgaccucguucgucaccacg

SEQ ID NO: 3327357 - RNA, 16 nt, Mycobacterium tuberculosis H37Rv
ccgaccugcgcgacgg

SEQ ID NO: 3327358 - RNA, 22 nt, Mycobacterium tuberculosis H37Rv
ccgaccugguaugccgcccgca

SEQ ID NO: 3327359 - RNA, 19 nt, Mycobacterium tuberculosis H37Rv
ccgaccuguaugccgcggu

SEQ ID NO: 3327360 - RNA, 16 nt, Mycobacterium tuberculosis H37Rv
ccgaccuucggcccgc

SEQ ID NO: 3327361 - RNA, 15 nt, Mycobacterium tuberculosis H37Rv
ccgaccuucucggcg

SEQ ID NO: 3327362 - RNA, 16 nt, Mycobacterium tuberculosis H37Rv
ccgacgaacagcgguc

SEQ ID NO: 3327363 - RNA, 15 nt, Mycobacterium tuberculosis H37Rv
ccgacgaacgaaccg

SEQ ID NO: 3327364 - RNA, 14 nt, Mycobacterium tuberculosis H37Rv
ccgacgaacugcag

SEQ ID NO: 3327365 - RNA, 23 nt, Mycobacterium tuberculosis H37Rv
ccgacgaagguggcauucgucga

SEQ ID NO: 3327366 - RNA, 17 nt, Mycobacterium tuberculosis H37Rv
ccgacgacaucgguggc

SEQ ID NO: 3327367 - RNA, 12 nt, Mycobacterium tuberculosis H37Rv
ccgacgaccagc

SEQ ID NO: 3327368 - RNA, 13 nt, Mycobacterium tuberculosis H37Rv
ccgacgaccgccu

SEQ ID NO: 3327369 - RNA, 19 nt, Mycobacterium tuberculosis H37Rv
ccgacgaccgccugcaaca

SEQ ID NO: 3327370 - RNA, 15 nt, Mycobacterium tuberculosis H37Rv
ccgacgacgacguuc

SEQ ID NO: 3327371 - RNA, 16 nt, Mycobacterium tuberculosis H37Rv
ccgacgacggcaccga

SEQ ID NO: 3327372 - RNA, 18 nt, Mycobacterium tuberculosis H37Rv
ccgacgagauacggccac

SEQ ID NO: 3327373 - RNA, 20 nt, Mycobacterium tuberculosis H37Rv
ccgacgagauacggccacca

SEQ ID NO: 3327374 - RNA, 21 nt, Mycobacterium tuberculosis H37Rv
ccgacgaggacgucaccguca

SEQ ID NO: 3327375 - RNA, 15 nt, Mycobacterium tuberculosis H37Rv
ccgacgagucgccgc

SEQ ID NO: 3327376 - RNA, 17 nt, Mycobacterium tuberculosis H37Rv
ccgacgaucgacgccgc

SEQ ID NO: 3327377 - RNA, 18 nt, Mycobacterium tuberculosis H37Rv
ccgacgaucgacgccgcc

SEQ ID NO: 3327378 - RNA, 19 nt, Mycobacterium tuberculosis H37Rv
ccgacgaucgacgccgcca

SEQ ID NO: 3327379 - RNA, 15 nt, Mycobacterium tuberculosis H37Rv
ccgacgaugccgcgg

SEQ ID NO: 3327380 - RNA, 15 nt, Mycobacterium tuberculosis H37Rv
ccgacgaugcgcacu

SEQ ID NO: 3327381 - RNA, 18 nt, Mycobacterium tuberculosis H37Rv
ccgacgauuaccagcggc

SEQ ID NO: 3327382 - RNA, 16 nt, Mycobacterium tuberculosis H37Rv
ccgacgccaccgccac

SEQ ID NO: 3327383 - RNA, 21 nt, Mycobacterium tuberculosis H37Rv
ccgacgccagaacguggccau

SEQ ID NO: 3327384 - RNA, 21 nt, Mycobacterium tuberculosis H37Rv
ccgacgccagcugcccgacgu

SEQ ID NO: 3327385 - RNA, 16 nt, Mycobacterium tuberculosis H37Rv
ccgacgccauuggccu

SEQ ID NO: 3327386 - RNA, 13 nt, Mycobacterium tuberculosis H37Rv
ccgacgccgccag

SEQ ID NO: 3327387 - RNA, 18 nt, Mycobacterium tuberculosis H37Rv
ccgacgccgccggccccg

SEQ ID NO: 3327388 - RNA, 14 nt, Mycobacterium tuberculosis H37Rv
ccgacgccgguggg

SEQ ID NO: 3327389 - RNA, 14 nt, Mycobacterium tuberculosis H37Rv
ccgacgccgguguc

SEQ ID NO: 3327390 - RNA, 16 nt, Mycobacterium tuberculosis H37Rv
ccgacgccgucgagca

SEQ ID NO: 3327391 - RNA, 18 nt, Mycobacterium tuberculosis H37Rv
ccgacgccugggcacggc

SEQ ID NO: 3327392 - RNA, 21 nt, Mycobacterium tuberculosis H37Rv
ccgacgccugggcacggccgu

SEQ ID NO: 3327393 - RNA, 14 nt, Mycobacterium tuberculosis H37Rv
ccgacgcgaaccca

SEQ ID NO: 3327394 - RNA, 18 nt, Mycobacterium tuberculosis H37Rv
ccgacgcgaucuguccgc

SEQ ID NO: 3327395 - RNA, 16 nt, Mycobacterium tuberculosis H37Rv
ccgacgcgcggccagc

SEQ ID NO: 3327396 - RNA, 17 nt, Mycobacterium tuberculosis H37Rv
ccgacgcgcggccagcc

SEQ ID NO: 3327397 - RNA, 18 nt, Mycobacterium tuberculosis H37Rv
ccgacgcgcggccagccc

SEQ ID NO: 3327398 - RNA, 20 nt, Mycobacterium tuberculosis H37Rv
ccgacgcgcucggcgaucug

SEQ ID NO: 3327399 - RNA, 14 nt, Mycobacterium tuberculosis H37Rv
ccgacgcggacagg

SEQ ID NO: 3327400 - RNA, 17 nt, Mycobacterium tuberculosis H37Rv
ccgacgcgggccgcgaa

SEQ ID NO: 3327401 - RNA, 22 nt, Mycobacterium tuberculosis H37Rv
ccgacgcgucggcgacgcggag

SEQ ID NO: 3327402 - RNA, 18 nt, Mycobacterium tuberculosis H37Rv
ccgacggaaugucagccg

SEQ ID NO: 3327403 - RNA, 18 nt, Mycobacterium tuberculosis H37Rv
ccgacggacuucccgcgc

SEQ ID NO: 3327404 - RNA, 17 nt, Mycobacterium tuberculosis H37Rv
ccgacggaugaucagcg

SEQ ID NO: 3327405 - RNA, 20 nt, Mycobacterium tuberculosis H37Rv
ccgacggcaaaccaguuggc

SEQ ID NO: 3327406 - RNA, 15 nt, Mycobacterium tuberculosis H37Rv
ccgacggcagugcug

SEQ ID NO: 3327407 - RNA, 11 nt, Mycobacterium tuberculosis H37Rv
ccgacggccag

SEQ ID NO: 3327408 - RNA, 17 nt, Mycobacterium tuberculosis H37Rv
ccgacggccagcaagac

SEQ ID NO: 3327409 - RNA, 17 nt, Mycobacterium tuberculosis H37Rv
ccgacggccagcaggau

SEQ ID NO: 3327410 - RNA, 19 nt, Mycobacterium tuberculosis H37Rv
ccgacggccagcaggauga

SEQ ID NO: 3327411 - RNA, 15 nt, Mycobacterium tuberculosis H37Rv
ccgacggcccgguga

SEQ ID NO: 3327412 - RNA, 13 nt, Mycobacterium tuberculosis H37Rv
ccgacggcgccca

SEQ ID NO: 3327413 - RNA, 17 nt, Mycobacterium tuberculosis H37Rv
ccgacgggacaacccgu

SEQ ID NO: 3327414 - RNA, 16 nt, Mycobacterium tuberculosis H37Rv
ccgacgggccgucgcc

SEQ ID NO: 3327415 - RNA, 20 nt, Mycobacterium tuberculosis H37Rv
ccgacgggccgucgccgucc

SEQ ID NO: 3327416 - RNA, 22 nt, Mycobacterium tuberculosis H37Rv
ccgacggguaucccgucccagc

SEQ ID NO: 3327417 - RNA, 22 nt, Mycobacterium tuberculosis H37Rv
ccgacggugaugggggagccgg

SEQ ID NO: 3327418 - RNA, 13 nt, Mycobacterium tuberculosis H37Rv
ccgacgucaggca

SEQ ID NO: 3327419 - RNA, 19 nt, Mycobacterium tuberculosis H37Rv
ccgacgucaggcagcuccg

SEQ ID NO: 3327420 - RNA, 20 nt, Mycobacterium tuberculosis H37Rv
ccgacgucaggcagcuccgc

SEQ ID NO: 3327421 - RNA, 22 nt, Mycobacterium tuberculosis H37Rv
ccgacgucaggcagcuccgccg

SEQ ID NO: 3327422 - RNA, 23 nt, Mycobacterium tuberculosis H37Rv
ccgacgucaggcagcuccgccgc

SEQ ID NO: 3327423 - RNA, 18 nt, Mycobacterium tuberculosis H37Rv
ccgacgucgaccacugcc

SEQ ID NO: 3327424 - RNA, 13 nt, Mycobacterium tuberculosis H37Rv
ccgacgucgacga

SEQ ID NO: 3327425 - RNA, 15 nt, Mycobacterium tuberculosis H37Rv
ccgacgucgacgccg

SEQ ID NO: 3327426 - RNA, 17 nt, Mycobacterium tuberculosis H37Rv
ccgacgucgccaagacc

SEQ ID NO: 3327427 - RNA, 15 nt, Mycobacterium tuberculosis H37Rv
ccgacgucgccgacg

SEQ ID NO: 3327428 - RNA, 16 nt, Mycobacterium tuberculosis H37Rv
ccgacgucgccgacgg

SEQ ID NO: 3327429 - RNA, 22 nt, Mycobacterium tuberculosis H37Rv
ccgacgucgcggaguagccgca

SEQ ID NO: 3327430 - RNA, 14 nt, Mycobacterium tuberculosis H37Rv
ccgacgucggugac

SEQ ID NO: 3327431 - RNA, 18 nt, Mycobacterium tuberculosis H37Rv
ccgacguggccagcccgc

SEQ ID NO: 3327432 - RNA, 20 nt, Mycobacterium tuberculosis H37Rv
ccgacgugguugccccgcag

SEQ ID NO: 3327433 - RNA, 15 nt, Mycobacterium tuberculosis H37Rv
ccgacuaucggccgc

SEQ ID NO: 3327434 - RNA, 16 nt, Mycobacterium tuberculosis H37Rv
ccgacuaucggccgcc

SEQ ID NO: 3327435 - RNA, 21 nt, Mycobacterium tuberculosis H37Rv
ccgacuaucggccgccggauc

SEQ ID NO: 3327436 - RNA, 17 nt, Mycobacterium tuberculosis H37Rv
ccgacucaggucggugc

SEQ ID NO: 3327437 - RNA, 22 nt, Mycobacterium tuberculosis H37Rv
ccgacucaggucggugcgguca

SEQ ID NO: 3327438 - RNA, 15 nt, Mycobacterium tuberculosis H37Rv
ccgacucaucggccg

SEQ ID NO: 3327439 - RNA, 16 nt, Mycobacterium tuberculosis H37Rv
ccgacucaucggccgc

SEQ ID NO: 3327440 - RNA, 14 nt, Mycobacterium tuberculosis H37Rv
ccgacuccaguucg

SEQ ID NO: 3327441 - RNA, 13 nt, Mycobacterium tuberculosis H37Rv
ccgacucggcacc

SEQ ID NO: 3327442 - RNA, 15 nt, Mycobacterium tuberculosis H37Rv
ccgacucggcaccgc

SEQ ID NO: 3327443 - RNA, 19 nt, Mycobacterium tuberculosis H37Rv
ccgacucggcaccgcggcc

SEQ ID NO: 3327444 - RNA, 13 nt, Mycobacterium tuberculosis H37Rv
ccgacucggccgu

SEQ ID NO: 3327445 - RNA, 20 nt, Mycobacterium tuberculosis H37Rv
ccgacucggccgugaccgag

SEQ ID NO: 3327446 - RNA, 20 nt, Mycobacterium tuberculosis H37Rv
ccgacucgucggccugguac

SEQ ID NO: 3327447 - RNA, 19 nt, Mycobacterium tuberculosis H37Rv
ccgacucuccggcauccuc

SEQ ID NO: 3327448 - RNA, 18 nt, Mycobacterium tuberculosis H37Rv
ccgacugccgcgggcagc

SEQ ID NO: 3327449 - RNA, 18 nt, Mycobacterium tuberculosis H37Rv
ccgacugccguucagcgg

SEQ ID NO: 3327450 - RNA, 22 nt, Mycobacterium tuberculosis H37Rv
ccgacugccguucagcggcggg

SEQ ID NO: 3327451 - RNA, 15 nt, Mycobacterium tuberculosis H37Rv
ccgacugcgggccag

SEQ ID NO: 3327452 - RNA, 16 nt, Mycobacterium tuberculosis H37Rv
ccgacugcgggccagc

SEQ ID NO: 3327453 - RNA, 17 nt, Mycobacterium tuberculosis H37Rv
ccgacugcgggccagcg

SEQ ID NO: 3327454 - RNA, 21 nt, Mycobacterium tuberculosis H37Rv
ccgacugcgggccagcgcauc

SEQ ID NO: 3327455 - RNA, 19 nt, Mycobacterium tuberculosis H37Rv
ccgacugcggguucgccga

SEQ ID NO: 3327456 - RNA, 21 nt, Mycobacterium tuberculosis H37Rv
ccgacuggccccgccagcggc

SEQ ID NO: 3327457 - RNA, 18 nt, Mycobacterium tuberculosis H37Rv
ccgacugggcgcgacccc

SEQ ID NO: 3327458 - RNA, 17 nt, Mycobacterium tuberculosis H37Rv
ccgacuguccccguuga

SEQ ID NO: 3327459 - RNA, 19 nt, Mycobacterium tuberculosis H37Rv
ccgacuuaagcgaacccga

SEQ ID NO: 3327460 - RNA, 15 nt, Mycobacterium tuberculosis H37Rv
ccgacuucaagacag

SEQ ID NO: 3327461 - RNA, 21 nt, Mycobacterium tuberculosis H37Rv
ccgacuucgucaaccaccagg

SEQ ID NO: 3327462 - RNA, 15 nt, Mycobacterium tuberculosis H37Rv
ccgacuucuccaggc

SEQ ID NO: 3327463 - RNA, 14 nt, Mycobacterium tuberculosis H37Rv
ccgacuuggugacc

SEQ ID NO: 3327464 - RNA, 14 nt, Mycobacterium tuberculosis H37Rv
ccgagaacaccggc

SEQ ID NO: 3327465 - RNA, 14 nt, Mycobacterium tuberculosis H37Rv
ccgagaacggcggg

SEQ ID NO: 3327466 - RNA, 19 nt, Mycobacterium tuberculosis H37Rv
ccgagaagagauccuggag

SEQ ID NO: 3327467 - RNA, 16 nt, Mycobacterium tuberculosis H37Rv
ccgagaauuccccagc

SEQ ID NO: 3327468 - RNA, 21 nt, Mycobacterium tuberculosis H37Rv
ccgagaauuccccagccgcau

SEQ ID NO: 3327469 - RNA, 12 nt, Mycobacterium tuberculosis H37Rv
ccgagacaccac

SEQ ID NO: 3327470 - RNA, 16 nt, Mycobacterium tuberculosis H37Rv
ccgagacaccacguug

SEQ ID NO: 3327471 - RNA, 13 nt, Mycobacterium tuberculosis H37Rv
ccgagaccaacgc

SEQ ID NO: 3327472 - RNA, 16 nt, Mycobacterium tuberculosis H37Rv
ccgagaccaacgcgca

SEQ ID NO: 3327473 - RNA, 18 nt, Mycobacterium tuberculosis H37Rv
ccgagaccaugccgacga

SEQ ID NO: 3327474 - RNA, 23 nt, Mycobacterium tuberculosis H37Rv
ccgagaccgcgugcucgagcacc

SEQ ID NO: 3327475 - RNA, 17 nt, Mycobacterium tuberculosis H37Rv
ccgagaccgggcaacgg

SEQ ID NO: 3327476 - RNA, 23 nt, Mycobacterium tuberculosis H37Rv
ccgagacgaccuccucgaugacc

SEQ ID NO: 3327477 - RNA, 13 nt, Mycobacterium tuberculosis H37Rv
ccgagacggcguu

SEQ ID NO: 3327478 - RNA, 16 nt, Mycobacterium tuberculosis H37Rv
ccgagagcagccagcc

SEQ ID NO: 3327479 - RNA, 19 nt, Mycobacterium tuberculosis H37Rv
ccgagaucaccgccaccac

SEQ ID NO: 3327480 - RNA, 18 nt, Mycobacterium tuberculosis H37Rv
ccgagaucaugccggcga

SEQ ID NO: 3327481 - RNA, 20 nt, Mycobacterium tuberculosis H37Rv
ccgagauccacgccagagcg

SEQ ID NO: 3327482 - RNA, 14 nt, Mycobacterium tuberculosis H37Rv
ccgagaucgacauc

SEQ ID NO: 3327483 - RNA, 16 nt, Mycobacterium tuberculosis H37Rv
ccgagaucgucgcgac

SEQ ID NO: 3327484 - RNA, 16 nt, Mycobacterium tuberculosis H37Rv
ccgagaugcguuccgc

SEQ ID NO: 3327485 - RNA, 16 nt, Mycobacterium tuberculosis H37Rv
ccgagaugcugcaccc

SEQ ID NO: 3327486 - RNA, 20 nt, Mycobacterium tuberculosis H37Rv
ccgagaugcuggucggcgau

SEQ ID NO: 3327487 - RNA, 23 nt, Mycobacterium tuberculosis H37Rv
ccgagaugcuggucggcgaugau

SEQ ID NO: 3327488 - RNA, 17 nt, Mycobacterium tuberculosis H37Rv
ccgagcaaacacgccuc

SEQ ID NO: 3327489 - RNA, 22 nt, Mycobacterium tuberculosis H37Rv
ccgagcaacaccccuggguuga

SEQ ID NO: 3327490 - RNA, 15 nt, Mycobacterium tuberculosis H37Rv
ccgagcaacaccguc

SEQ ID NO: 3327491 - RNA, 21 nt, Mycobacterium tuberculosis H37Rv
ccgagcaacaccgucggcagc

SEQ ID NO: 3327492 - RNA, 15 nt, Mycobacterium tuberculosis H37Rv
ccgagcaaggggauc

SEQ ID NO: 3327493 - RNA, 16 nt, Mycobacterium tuberculosis H37Rv
ccgagcaccccagggg

SEQ ID NO: 3327494 - RNA, 15 nt, Mycobacterium tuberculosis H37Rv
ccgagcaccucggcc

SEQ ID NO: 3327495 - RNA, 19 nt, Mycobacterium tuberculosis H37Rv
ccgagcaccugaccguuga

SEQ ID NO: 3327496 - RNA, 18 nt, Mycobacterium tuberculosis H37Rv
ccgagcacgccgagcccg

SEQ ID NO: 3327497 - RNA, 16 nt, Mycobacterium tuberculosis H37Rv
ccgagcacgggcagau

SEQ ID NO: 3327498 - RNA, 19 nt, Mycobacterium tuberculosis H37Rv
ccgagcacugacgggccgu

SEQ ID NO: 3327499 - RNA, 19 nt, Mycobacterium tuberculosis H37Rv
ccgagcagacacagaaucg

SEQ ID NO: 3327500 - RNA, 19 nt, Mycobacterium tuberculosis H37Rv
ccgagcagacgcaaaaucg

SEQ ID NO: 3327501 - RNA, 14 nt, Mycobacterium tuberculosis H37Rv
ccgagcagacgcgg

SEQ ID NO: 3327502 - RNA, 19 nt, Mycobacterium tuberculosis H37Rv
ccgagcagacgcggaaucg

SEQ ID NO: 3327503 - RNA, 21 nt, Mycobacterium tuberculosis H37Rv
ccgagcagcuccuugagguca

SEQ ID NO: 3327504 - RNA, 16 nt, Mycobacterium tuberculosis H37Rv
ccgagcagggccggca

SEQ ID NO: 3327505 - RNA, 20 nt, Mycobacterium tuberculosis H37Rv
ccgagcagggccggcaccgc

SEQ ID NO: 3327506 - RNA, 16 nt, Mycobacterium tuberculosis H37Rv
ccgagcaucagauucg

SEQ ID NO: 3327507 - RNA, 14 nt, Mycobacterium tuberculosis H37Rv
ccgagccacgaccc

SEQ ID NO: 3327508 - RNA, 14 nt, Mycobacterium tuberculosis H37Rv
ccgagccagcaccc

SEQ ID NO: 3327509 - RNA, 15 nt, Mycobacterium tuberculosis H37Rv
ccgagcccagccggg

SEQ ID NO: 3327510 - RNA, 15 nt, Mycobacterium tuberculosis H37Rv
ccgagcccagcgccu

SEQ ID NO: 3327511 - RNA, 14 nt, Mycobacterium tuberculosis H37Rv
ccgagcccaggugg

SEQ ID NO: 3327512 - RNA, 14 nt, Mycobacterium tuberculosis H37Rv
ccgagcccgccagc

SEQ ID NO: 3327513 - RNA, 19 nt, Mycobacterium tuberculosis H37Rv
ccgagcccgccagcgccgc

SEQ ID NO: 3327514 - RNA, 16 nt, Mycobacterium tuberculosis H37Rv
ccgagcccgucagcuc

SEQ ID NO: 3327515 - RNA, 17 nt, Mycobacterium tuberculosis H37Rv
ccgagcccuccagggcc

SEQ ID NO: 3327516 - RNA, 20 nt, Mycobacterium tuberculosis H37Rv
ccgagccgaaguugaugucg

SEQ ID NO: 3327517 - RNA, 16 nt, Mycobacterium tuberculosis H37Rv
ccgagccgacaucgau

SEQ ID NO: 3327518 - RNA, 18 nt, Mycobacterium tuberculosis H37Rv
ccgagccgaccggcggca

SEQ ID NO: 3327519 - RNA, 15 nt, Mycobacterium tuberculosis H37Rv
ccgagccgcacagca

SEQ ID NO: 3327520 - RNA, 15 nt, Mycobacterium tuberculosis H37Rv
ccgagccgcccgccc

SEQ ID NO: 3327521 - RNA, 22 nt, Mycobacterium tuberculosis H37Rv
ccgagccgcuaggacggcgcga

SEQ ID NO: 3327522 - RNA, 18 nt, Mycobacterium tuberculosis H37Rv
ccgagccggugccacugc

SEQ ID NO: 3327523 - RNA, 16 nt, Mycobacterium tuberculosis H37Rv
ccgagccguccaagcc

SEQ ID NO: 3327524 - RNA, 16 nt, Mycobacterium tuberculosis H37Rv
ccgagccgucgucgag

SEQ ID NO: 3327525 - RNA, 17 nt, Mycobacterium tuberculosis H37Rv
ccgagccguugcgccuc

SEQ ID NO: 3327526 - RNA, 17 nt, Mycobacterium tuberculosis H37Rv
ccgagccuugagcgcgg

SEQ ID NO: 3327527 - RNA, 13 nt, Mycobacterium tuberculosis H37Rv
ccgagcgcgauga

SEQ ID NO: 3327528 - RNA, 20 nt, Mycobacterium tuberculosis H37Rv
ccgagcgcgccgaaggcggc

SEQ ID NO: 3327529 - RNA, 19 nt, Mycobacterium tuberculosis H37Rv
ccgagcgcucgaucacggc

SEQ ID NO: 3327530 - RNA, 19 nt, Mycobacterium tuberculosis H37Rv
ccgagcgcuugaccccgcc

SEQ ID NO: 3327531 - RNA, 15 nt, Mycobacterium tuberculosis H37Rv
ccgagcggaccaccg

SEQ ID NO: 3327532 - RNA, 16 nt, Mycobacterium tuberculosis H37Rv
ccgagcggaccaccgc

SEQ ID NO: 3327533 - RNA, 18 nt, Mycobacterium tuberculosis H37Rv
ccgagcggaccaccgcuc

SEQ ID NO: 3327534 - RNA, 22 nt, Mycobacterium tuberculosis H37Rv
ccgagcggaccaccgcucgcca

SEQ ID NO: 3327535 - RNA, 23 nt, Mycobacterium tuberculosis H37Rv
ccgagcggagccgccgacucggc

SEQ ID NO: 3327536 - RNA, 22 nt, Mycobacterium tuberculosis H37Rv
ccgagcgggaacgagccacgcc

SEQ ID NO: 3327537 - RNA, 22 nt, Mycobacterium tuberculosis H37Rv
ccgagcggguugucuuucacau

SEQ ID NO: 3327538 - RNA, 23 nt, Mycobacterium tuberculosis H37Rv
ccgagcggucaacgaguugcgga

SEQ ID NO: 3327539 - RNA, 16 nt, Mycobacterium tuberculosis H37Rv
ccgagcggugccggcg

SEQ ID NO: 3327540 - RNA, 14 nt, Mycobacterium tuberculosis H37Rv
ccgagcggugguga

SEQ ID NO: 3327541 - RNA, 17 nt, Mycobacterium tuberculosis H37Rv
ccgagcguaaugcugcu

SEQ ID NO: 3327542 - RNA, 23 nt, Mycobacterium tuberculosis H37Rv
ccgagcuagaucacggagcucuu

SEQ ID NO: 3327543 - RNA, 22 nt, Mycobacterium tuberculosis H37Rv
ccgagcucaccaaggucggcga

SEQ ID NO: 3327544 - RNA, 21 nt, Mycobacterium tuberculosis H37Rv
ccgagcucaccgcacaccugc

SEQ ID NO: 3327545 - RNA, 16 nt, Mycobacterium tuberculosis H37Rv
ccgaucagcguggcgc

SEQ ID NO: 3327546 - RNA, 20 nt, Mycobacterium tuberculosis H37Rv
ccgaucaucauauccgcccc

SEQ ID NO: 3327547 - RNA, 16 nt, Mycobacterium tuberculosis H37Rv
ccgaucaugucggccg

SEQ ID NO: 3327548 - RNA, 13 nt, Mycobacterium tuberculosis H37Rv
ccgauccagcagg

SEQ ID NO: 3327549 - RNA, 14 nt, Mycobacterium tuberculosis H37Rv
ccgauccagcaggc

SEQ ID NO: 3327550 - RNA, 16 nt, Mycobacterium tuberculosis H37Rv
ccgauccagcaggccg

SEQ ID NO: 3327551 - RNA, 15 nt, Mycobacterium tuberculosis H37Rv
ccgauccaggaguga

SEQ ID NO: 3327552 - RNA, 23 nt, Mycobacterium tuberculosis H37Rv
ccgauccagugguaggccgccgg

SEQ ID NO: 3327553 - RNA, 12 nt, Mycobacterium tuberculosis H37Rv
ccgauccccagg

SEQ ID NO: 3327554 - RNA, 13 nt, Mycobacterium tuberculosis H37Rv
ccgauccccaggc

SEQ ID NO: 3327555 - RNA, 14 nt, Mycobacterium tuberculosis H37Rv
ccgauccccaggcc

SEQ ID NO: 3327556 - RNA, 21 nt, Mycobacterium tuberculosis H37Rv
ccgaucccgauacgcacccgc

SEQ ID NO: 3327557 - RNA, 12 nt, Mycobacterium tuberculosis H37Rv
ccgaucccgccc

SEQ ID NO: 3327558 - RNA, 16 nt, Mycobacterium tuberculosis H37Rv
ccgaucccggcgagca

SEQ ID NO: 3327559 - RNA, 18 nt, Mycobacterium tuberculosis H37Rv
ccgaucccggcgagcacc

SEQ ID NO: 3327560 - RNA, 17 nt, Mycobacterium tuberculosis H37Rv
ccgauccgcucacccgc

SEQ ID NO: 3327561 - RNA, 18 nt, Mycobacterium tuberculosis H37Rv
ccgauccggaucccacca

SEQ ID NO: 3327562 - RNA, 15 nt, Mycobacterium tuberculosis H37Rv
ccgauccuggccacu

SEQ ID NO: 3327563 - RNA, 23 nt, Mycobacterium tuberculosis H37Rv
ccgauccuggccacucccagcca

SEQ ID NO: 3327564 - RNA, 18 nt, Mycobacterium tuberculosis H37Rv
ccgaucgaacagugccug

SEQ ID NO: 3327565 - RNA, 15 nt, Mycobacterium tuberculosis H37Rv
ccgaucgacacccgc

SEQ ID NO: 3327566 - RNA, 17 nt, Mycobacterium tuberculosis H37Rv
ccgaucgacacccgcuc

SEQ ID NO: 3327567 - RNA, 22 nt, Mycobacterium tuberculosis H37Rv
ccgaucgacacccgcucggccg

SEQ ID NO: 3327568 - RNA, 14 nt, Mycobacterium tuberculosis H37Rv
ccgaucgacugcag

SEQ ID NO: 3327569 - RNA, 22 nt, Mycobacterium tuberculosis H37Rv
ccgaucgaucagcaacucggcc

SEQ ID NO: 3327570 - RNA, 19 nt, Mycobacterium tuberculosis H37Rv
ccgaucggcaaaccgucgg

SEQ ID NO: 3327571 - RNA, 15 nt, Mycobacterium tuberculosis H37Rv
ccgaucggcaggccg

SEQ ID NO: 3327572 - RNA, 14 nt, Mycobacterium tuberculosis H37Rv
ccgaucggccaaca

SEQ ID NO: 3327573 - RNA, 12 nt, Mycobacterium tuberculosis H37Rv
ccgaucggccac

SEQ ID NO: 3327574 - RNA, 14 nt, Mycobacterium tuberculosis H37Rv
ccgaucggccugca

SEQ ID NO: 3327575 - RNA, 14 nt, Mycobacterium tuberculosis H37Rv
ccgaucggcgcgcc

SEQ ID NO: 3327576 - RNA, 22 nt, Mycobacterium tuberculosis H37Rv
ccgaucgucucggccacgaacc

SEQ ID NO: 3327577 - RNA, 19 nt, Mycobacterium tuberculosis H37Rv
ccgaucucgaccagcgccg

SEQ ID NO: 3327578 - RNA, 23 nt, Mycobacterium tuberculosis H37Rv
ccgaucucggugaccucaccaac

SEQ ID NO: 3327579 - RNA, 17 nt, Mycobacterium tuberculosis H37Rv
ccgaucugcuccucggu

SEQ ID NO: 3327580 - RNA, 23 nt, Mycobacterium tuberculosis H37Rv
ccgaucuggaugucccaugcacg

SEQ ID NO: 3327581 - RNA, 23 nt, Mycobacterium tuberculosis H37Rv
ccgaucugguaagucagcucgau

SEQ ID NO: 3327582 - RNA, 16 nt, Mycobacterium tuberculosis H37Rv
ccgaucuuggccaccg

SEQ ID NO: 3327583 - RNA, 16 nt, Mycobacterium tuberculosis H37Rv
ccgaugaagccaagaa

SEQ ID NO: 3327584 - RNA, 20 nt, Mycobacterium tuberculosis H37Rv
ccgaugaccagggucugcuc

SEQ ID NO: 3327585 - RNA, 15 nt, Mycobacterium tuberculosis H37Rv
ccgaugacccacugc

SEQ ID NO: 3327586 - RNA, 19 nt, Mycobacterium tuberculosis H37Rv
ccgaugacccacugcaggc

SEQ ID NO: 3327587 - RNA, 16 nt, Mycobacterium tuberculosis H37Rv
ccgaugacgaucggcg

SEQ ID NO: 3327588 - RNA, 18 nt, Mycobacterium tuberculosis H37Rv
ccgaugacgaucggcggc

SEQ ID NO: 3327589 - RNA, 22 nt, Mycobacterium tuberculosis H37Rv
ccgaugacgaucggcggcgcgc

SEQ ID NO: 3327590 - RNA, 14 nt, Mycobacterium tuberculosis H37Rv
ccgaugacgcguuc

SEQ ID NO: 3327591 - RNA, 21 nt, Mycobacterium tuberculosis H37Rv
ccgaugacuacuccugagaug

SEQ ID NO: 3327592 - RNA, 13 nt, Mycobacterium tuberculosis H37Rv
ccgaugaggcgcc

SEQ ID NO: 3327593 - RNA, 20 nt, Mycobacterium tuberculosis H37Rv
ccgaugauaauuccagcacc

SEQ ID NO: 3327594 - RNA, 17 nt, Mycobacterium tuberculosis H37Rv
ccgaugaucucacccag

SEQ ID NO: 3327595 - RNA, 18 nt, Mycobacterium tuberculosis H37Rv
ccgaugaucucacccagc

SEQ ID NO: 3327596 - RNA, 20 nt, Mycobacterium tuberculosis H37Rv
ccgaugcacuccaugaaucg

SEQ ID NO: 3327597 - RNA, 16 nt, Mycobacterium tuberculosis H37Rv
ccgaugccgaacuccg

SEQ ID NO: 3327598 - RNA, 17 nt, Mycobacterium tuberculosis H37Rv
ccgaugccgacggcgcc

SEQ ID NO: 3327599 - RNA, 11 nt, Mycobacterium tuberculosis H37Rv
ccgaugccgcc

SEQ ID NO: 3327600 - RNA, 22 nt, Mycobacterium tuberculosis H37Rv
ccgaugccgccgccgccgccgg

SEQ ID NO: 3327601 - RNA, 16 nt, Mycobacterium tuberculosis H37Rv
ccgaugccgccggcac

SEQ ID NO: 3327602 - RNA, 22 nt, Mycobacterium tuberculosis H37Rv
ccgaugcgaaacaucucggcgc

SEQ ID NO: 3327603 - RNA, 16 nt, Mycobacterium tuberculosis H37Rv
ccgaugcgugccgacc

SEQ ID NO: 3327604 - RNA, 18 nt, Mycobacterium tuberculosis H37Rv
ccgaugcgugccgacccg

SEQ ID NO: 3327605 - RNA, 19 nt, Mycobacterium tuberculosis H37Rv
ccgaugcgugccgacccgc

SEQ ID NO: 3327606 - RNA, 18 nt, Mycobacterium tuberculosis H37Rv
ccgaugcugacgaugcgg

SEQ ID NO: 3327607 - RNA, 14 nt, Mycobacterium tuberculosis H37Rv
ccgaugcugcgggc

SEQ ID NO: 3327608 - RNA, 22 nt, Mycobacterium tuberculosis H37Rv
ccgauggaugggcugcgcgucg

SEQ ID NO: 3327609 - RNA, 21 nt, Mycobacterium tuberculosis H37Rv
ccgauggcgcaccggcgucgg

SEQ ID NO: 3327610 - RNA, 14 nt, Mycobacterium tuberculosis H37Rv
ccgaugguacccgc

SEQ ID NO: 3327611 - RNA, 16 nt, Mycobacterium tuberculosis H37Rv
ccgaugguacccgcgc

SEQ ID NO: 3327612 - RNA, 22 nt, Mycobacterium tuberculosis H37Rv
ccgauggugaugggggagccgg

SEQ ID NO: 3327613 - RNA, 19 nt, Mycobacterium tuberculosis H37Rv
ccgauggugccgacccgcc

SEQ ID NO: 3327614 - RNA, 20 nt, Mycobacterium tuberculosis H37Rv
ccgauggugccgacccgccg

SEQ ID NO: 3327615 - RNA, 16 nt, Mycobacterium tuberculosis H37Rv
ccgaugguggugccaa

SEQ ID NO: 3327616 - RNA, 13 nt, Mycobacterium tuberculosis H37Rv
ccgaugucaacgc

SEQ ID NO: 3327617 - RNA, 14 nt, Mycobacterium tuberculosis H37Rv
ccgaugugcucggu

SEQ ID NO: 3327618 - RNA, 16 nt, Mycobacterium tuberculosis H37Rv
ccgauguuggcagggc

SEQ ID NO: 3327619 - RNA, 23 nt, Mycobacterium tuberculosis H37Rv
ccgauucagcgccccaugcaaca

SEQ ID NO: 3327620 - RNA, 15 nt, Mycobacterium tuberculosis H37Rv
ccgauuccaugcgcg

SEQ ID NO: 3327621 - RNA, 13 nt, Mycobacterium tuberculosis H37Rv
ccgauucggcgac

SEQ ID NO: 3327622 - RNA, 19 nt, Mycobacterium tuberculosis H37Rv
ccgauucugauaucgucgg

SEQ ID NO: 3327623 - RNA, 22 nt, Mycobacterium tuberculosis H37Rv
ccgauucugauaucgucggugc

SEQ ID NO: 3327624 - RNA, 22 nt, Mycobacterium tuberculosis H37Rv
ccgauucuucgaugaugccggc

SEQ ID NO: 3327625 - RNA, 18 nt, Mycobacterium tuberculosis H37Rv
ccgauugaguucggcggc

SEQ ID NO: 3327626 - RNA, 21 nt, Mycobacterium tuberculosis H37Rv
ccgauuuauccggaucggccu

SEQ ID NO: 3327627 - RNA, 17 nt, Mycobacterium tuberculosis H37Rv
ccgauuuggccgucauc

SEQ ID NO: 3327628 - RNA, 23 nt, Mycobacterium tuberculosis H37Rv
ccgauuuugggaucgugccggcg

SEQ ID NO: 3327629 - RNA, 20 nt, Mycobacterium tuberculosis H37Rv
ccgcaaaaucgucagcgccg

SEQ ID NO: 3327630 - RNA, 19 nt, Mycobacterium tuberculosis H37Rv
ccgcaaaguagacgugcca

SEQ ID NO: 3327631 - RNA, 12 nt, Mycobacterium tuberculosis H37Rv
ccgcaaccgccg

SEQ ID NO: 3327632 - RNA, 15 nt, Mycobacterium tuberculosis H37Rv
ccgcaaccggcgauc

SEQ ID NO: 3327633 - RNA, 17 nt, Mycobacterium tuberculosis H37Rv
ccgcaaccgguaucgcc

SEQ ID NO: 3327634 - RNA, 21 nt, Mycobacterium tuberculosis H37Rv
ccgcaacgcgucggucgcgga

SEQ ID NO: 3327635 - RNA, 15 nt, Mycobacterium tuberculosis H37Rv
ccgcaacgcuucggc

SEQ ID NO: 3327636 - RNA, 17 nt, Mycobacterium tuberculosis H37Rv
ccgcaacgcuucggcag

SEQ ID NO: 3327637 - RNA, 14 nt, Mycobacterium tuberculosis H37Rv
ccgcaacucgccga

SEQ ID NO: 3327638 - RNA, 16 nt, Mycobacterium tuberculosis H37Rv
ccgcaauacccgagcg

SEQ ID NO: 3327639 - RNA, 12 nt, Mycobacterium tuberculosis H37Rv
ccgcaaucgcga

SEQ ID NO: 3327640 - RNA, 14 nt, Mycobacterium tuberculosis H37Rv
ccgcaaugaccgcg

SEQ ID NO: 3327641 - RNA, 15 nt, Mycobacterium tuberculosis H37Rv
ccgcagggccgccgc

SEQ ID NO: 3327642 - RNA, 18 nt, Mycobacterium tuberculosis H37Rv
ccgcagggucccgucauc

SEQ ID NO: 3327643 - RNA, 19 nt, Mycobacterium tuberculosis H37Rv
ccgcaggucgaucugcgcc

SEQ ID NO: 3327644 - RNA, 15 nt, Mycobacterium tuberculosis H37Rv
ccgcaggucgcacca

SEQ ID NO: 3327645 - RNA, 22 nt, Mycobacterium tuberculosis H37Rv
ccgcaguacugguagaggcggc

SEQ ID NO: 3327646 - RNA, 13 nt, Mycobacterium tuberculosis H37Rv
ccgcagucccagc

SEQ ID NO: 3327647 - RNA, 12 nt, Mycobacterium tuberculosis H37Rv
ccgcagucccga

SEQ ID NO: 3327648 - RNA, 16 nt, Mycobacterium tuberculosis H37Rv
ccgcagucgcggcaga

SEQ ID NO: 3327649 - RNA, 22 nt, Mycobacterium tuberculosis H37Rv
ccgcaguggaugcauacacggu

SEQ ID NO: 3327650 - RNA, 22 nt, Mycobacterium tuberculosis H37Rv
ccgcaguuauccgguguccugg

SEQ ID NO: 3327651 - RNA, 15 nt, Mycobacterium tuberculosis H37Rv
ccgcauaaaucgggg

SEQ ID NO: 3327652 - RNA, 20 nt, Mycobacterium tuberculosis H37Rv
ccgcauaaaucgggguuccg

SEQ ID NO: 3327653 - RNA, 20 nt, Mycobacterium tuberculosis H37Rv
ccgcauaaggcccaugccgu

SEQ ID NO: 3327654 - RNA, 18 nt, Mycobacterium tuberculosis H37Rv
ccgcauaccaguaccguc

SEQ ID NO: 3327655 - RNA, 21 nt, Mycobacterium tuberculosis H37Rv
ccgcauaccaguaccgucauc

SEQ ID NO: 3327656 - RNA, 19 nt, Mycobacterium tuberculosis H37Rv
ccgcauaccuaacgagccg

SEQ ID NO: 3327657 - RNA, 16 nt, Mycobacterium tuberculosis H37Rv
ccgcauaggccccgcc

SEQ ID NO: 3327658 - RNA, 19 nt, Mycobacterium tuberculosis H37Rv
ccgcauaggccccgccagc

SEQ ID NO: 3327659 - RNA, 20 nt, Mycobacterium tuberculosis H37Rv
ccgcauaggccccgccagcg

SEQ ID NO: 3327660 - RNA, 23 nt, Mycobacterium tuberculosis H37Rv
ccgcauaggccccgccagcgccg

SEQ ID NO: 3327661 - RNA, 14 nt, Mycobacterium tuberculosis H37Rv
ccgcauauugcggc

SEQ ID NO: 3327662 - RNA, 19 nt, Mycobacterium tuberculosis H37Rv
ccgcauauugcggcgccgu

SEQ ID NO: 3327663 - RNA, 13 nt, Mycobacterium tuberculosis H37Rv
ccgcaucacccgg

SEQ ID NO: 3327664 - RNA, 20 nt, Mycobacterium tuberculosis H37Rv
ccgcaucauagacagggccg

SEQ ID NO: 3327665 - RNA, 12 nt, Mycobacterium tuberculosis H37Rv
ccgcauccacgu

SEQ ID NO: 3327666 - RNA, 20 nt, Mycobacterium tuberculosis H37Rv
ccgcauccacgucgcccagg

SEQ ID NO: 3327667 - RNA, 18 nt, Mycobacterium tuberculosis H37Rv
ccgcauccagccgugcgg

SEQ ID NO: 3327668 - RNA, 15 nt, Mycobacterium tuberculosis H37Rv
ccgcauccccgguac

SEQ ID NO: 3327669 - RNA, 18 nt, Mycobacterium tuberculosis H37Rv
ccgcauccgcgacggcgc

SEQ ID NO: 3327670 - RNA, 14 nt, Mycobacterium tuberculosis H37Rv
ccgcauccggucuc

SEQ ID NO: 3327671 - RNA, 19 nt, Mycobacterium tuberculosis H37Rv
ccgcauccggucucggccg

SEQ ID NO: 3327672 - RNA, 12 nt, Mycobacterium tuberculosis H37Rv
ccgcaucgccga

SEQ ID NO: 3327673 - RNA, 14 nt, Mycobacterium tuberculosis H37Rv
ccgcaucgccgaac

SEQ ID NO: 3327674 - RNA, 19 nt, Mycobacterium tuberculosis H37Rv
ccgcaucgccucaccacgu

SEQ ID NO: 3327675 - RNA, 17 nt, Mycobacterium tuberculosis H37Rv
ccgcaucgcggcgacgu

SEQ ID NO: 3327676 - RNA, 13 nt, Mycobacterium tuberculosis H37Rv
ccgcaucggcacg

SEQ ID NO: 3327677 - RNA, 16 nt, Mycobacterium tuberculosis H37Rv
ccgcaucggcccccaa

SEQ ID NO: 3327678 - RNA, 20 nt, Mycobacterium tuberculosis H37Rv
ccgcaucgggcuugcgcagc

SEQ ID NO: 3327679 - RNA, 19 nt, Mycobacterium tuberculosis H37Rv
ccgcaucgguggggcgccg

SEQ ID NO: 3327680 - RNA, 18 nt, Mycobacterium tuberculosis H37Rv
ccgcaucgucgccgaccg

SEQ ID NO: 3327681 - RNA, 19 nt, Mycobacterium tuberculosis H37Rv
ccgcaucgucgccgaccgu

SEQ ID NO: 3327682 - RNA, 17 nt, Mycobacterium tuberculosis H37Rv
ccgcaucguugccgacc

SEQ ID NO: 3327683 - RNA, 18 nt, Mycobacterium tuberculosis H37Rv
ccgcaucguugccgaccg

SEQ ID NO: 3327684 - RNA, 19 nt, Mycobacterium tuberculosis H37Rv
ccgcaucguugccgaccgu

SEQ ID NO: 3327685 - RNA, 22 nt, Mycobacterium tuberculosis H37Rv
ccgcaugccaccgagcaaacac

SEQ ID NO: 3327686 - RNA, 16 nt, Mycobacterium tuberculosis H37Rv
ccgcauggacgcgaug

SEQ ID NO: 3327687 - RNA, 22 nt, Mycobacterium tuberculosis H37Rv
ccgcauggacgcgaugaccgca

SEQ ID NO: 3327688 - RNA, 17 nt, Mycobacterium tuberculosis H37Rv
ccgcauucgcgacaacu

SEQ ID NO: 3327689 - RNA, 18 nt, Mycobacterium tuberculosis H37Rv
ccgcauucguggagccgg

SEQ ID NO: 3327690 - RNA, 22 nt, Mycobacterium tuberculosis H37Rv
ccgcauucguggagccggccgu

SEQ ID NO: 3327691 - RNA, 17 nt, Mycobacterium tuberculosis H37Rv
ccgcauugagcuggcgc

SEQ ID NO: 3327692 - RNA, 13 nt, Mycobacterium tuberculosis H37Rv
ccgcauugccaac

SEQ ID NO: 3327693 - RNA, 15 nt, Mycobacterium tuberculosis H37Rv
ccgcauugccgucgg

SEQ ID NO: 3327694 - RNA, 19 nt, Mycobacterium tuberculosis H37Rv
ccgccaacaucuccgcguc

SEQ ID NO: 3327695 - RNA, 14 nt, Mycobacterium tuberculosis H37Rv
ccgccaaccgcgug

SEQ ID NO: 3327696 - RNA, 21 nt, Mycobacterium tuberculosis H37Rv
ccgccaaccggguguggucgg

SEQ ID NO: 3327697 - RNA, 20 nt, Mycobacterium tuberculosis H37Rv
ccgccaauccgcgucgucga

SEQ ID NO: 3327698 - RNA, 21 nt, Mycobacterium tuberculosis H37Rv
ccgccaaugccaccauugccg

SEQ ID NO: 3327699 - RNA, 23 nt, Mycobacterium tuberculosis H37Rv
ccgccaauuacagcuugcgcagc

SEQ ID NO: 3327700 - RNA, 19 nt, Mycobacterium tuberculosis H37Rv
ccgccacaaccaccggauc

SEQ ID NO: 3327701 - RNA, 18 nt, Mycobacterium tuberculosis H37Rv
ccgccacaacggcggcgc

SEQ ID NO: 3327702 - RNA, 12 nt, Mycobacterium tuberculosis H37Rv
ccgccacaccgc

SEQ ID NO: 3327703 - RNA, 18 nt, Mycobacterium tuberculosis H37Rv
ccgccacacggggccgcc

SEQ ID NO: 3327704 - RNA, 19 nt, Mycobacterium tuberculosis H37Rv
ccgccacacggggccgcca

SEQ ID NO: 3327705 - RNA, 21 nt, Mycobacterium tuberculosis H37Rv
ccgccacacggggccgccagc

SEQ ID NO: 3327706 - RNA, 13 nt, Mycobacterium tuberculosis H37Rv
ccgccacagcccc

SEQ ID NO: 3327707 - RNA, 14 nt, Mycobacterium tuberculosis H37Rv
ccgccacagcccca

SEQ ID NO: 3327708 - RNA, 18 nt, Mycobacterium tuberculosis H37Rv
ccgccaccaccagggcaa

SEQ ID NO: 3327709 - RNA, 12 nt, Mycobacterium tuberculosis H37Rv
ccgccaccaccg

SEQ ID NO: 3327710 - RNA, 20 nt, Mycobacterium tuberculosis H37Rv
ccgccaccaccgcugccggc

SEQ ID NO: 3327711 - RNA, 22 nt, Mycobacterium tuberculosis H37Rv
ccgccaccaccgcugccggcgc

SEQ ID NO: 3327712 - RNA, 15 nt, Mycobacterium tuberculosis H37Rv
ccgccaccacgguca

SEQ ID NO: 3327713 - RNA, 12 nt, Mycobacterium tuberculosis H37Rv
ccgccaccagac

SEQ ID NO: 3327714 - RNA, 15 nt, Mycobacterium tuberculosis H37Rv
ccgccaccagcgcac

SEQ ID NO: 3327715 - RNA, 12 nt, Mycobacterium tuberculosis H37Rv
ccgccaccagcu

SEQ ID NO: 3327716 - RNA, 21 nt, Mycobacterium tuberculosis H37Rv
ccgccaccaucgccucggcgc

SEQ ID NO: 3327717 - RNA, 12 nt, Mycobacterium tuberculosis H37Rv
ccgccacccgca

SEQ ID NO: 3327718 - RNA, 12 nt, Mycobacterium tuberculosis H37Rv
ccgccacccgcc

SEQ ID NO: 3327719 - RNA, 20 nt, Mycobacterium tuberculosis H37Rv
ccgccacccgccaacgccaa

SEQ ID NO: 3327720 - RNA, 19 nt, Mycobacterium tuberculosis H37Rv
ccgccaccgaagccgccgg

SEQ ID NO: 3327721 - RNA, 16 nt, Mycobacterium tuberculosis H37Rv
ccgccaccgccaccgc

SEQ ID NO: 3327722 - RNA, 16 nt, Mycobacterium tuberculosis H37Rv
ccgccaccgccagcgu

SEQ ID NO: 3327723 - RNA, 23 nt, Mycobacterium tuberculosis H37Rv
ccgccaccgcgacgagcggccgu

SEQ ID NO: 3327724 - RNA, 12 nt, Mycobacterium tuberculosis H37Rv
ccgccaccgcug

SEQ ID NO: 3327725 - RNA, 19 nt, Mycobacterium tuberculosis H37Rv
ccgccaccggcgcgaccgc

SEQ ID NO: 3327726 - RNA, 21 nt, Mycobacterium tuberculosis H37Rv
ccgccaccggcguccaguccg

SEQ ID NO: 3327727 - RNA, 18 nt, Mycobacterium tuberculosis H37Rv
ccgccaccgucauggcgg

SEQ ID NO: 3327728 - RNA, 17 nt, Mycobacterium tuberculosis H37Rv
ccgccaccuuggcguug

SEQ ID NO: 3327729 - RNA, 22 nt, Mycobacterium tuberculosis H37Rv
ccgccaccuuggcugggcccgc

SEQ ID NO: 3327730 - RNA, 14 nt, Mycobacterium tuberculosis H37Rv
ccgccacgaugucg

SEQ ID NO: 3327731 - RNA, 13 nt, Mycobacterium tuberculosis H37Rv
ccgccacgggcgg

SEQ ID NO: 3327732 - RNA, 21 nt, Mycobacterium tuberculosis H37Rv
ccgccacgggcggccaccgca

SEQ ID NO: 3327733 - RNA, 19 nt, Mycobacterium tuberculosis H37Rv
ccgccacgguacauccaga

SEQ ID NO: 3327734 - RNA, 19 nt, Mycobacterium tuberculosis H37Rv
ccgccacgguucgggcagc

SEQ ID NO: 3327735 - RNA, 21 nt, Mycobacterium tuberculosis H37Rv
ccgccacgguucgggcagcac

SEQ ID NO: 3327736 - RNA, 20 nt, Mycobacterium tuberculosis H37Rv
ccgccacguaauuccccagg

SEQ ID NO: 3327737 - RNA, 23 nt, Mycobacterium tuberculosis H37Rv
ccgcccgaguuguggacgcccga

SEQ ID NO: 3327738 - RNA, 15 nt, Mycobacterium tuberculosis H37Rv
ccgcccgcacccccg

SEQ ID NO: 3327739 - RNA, 14 nt, Mycobacterium tuberculosis H37Rv
ccgcccgcacgacg

SEQ ID NO: 3327740 - RNA, 17 nt, Mycobacterium tuberculosis H37Rv
ccgcccgcagggccgcc

SEQ ID NO: 3327741 - RNA, 19 nt, Mycobacterium tuberculosis H37Rv
ccgcccgcaucgcggcauc

SEQ ID NO: 3327742 - RNA, 13 nt, Mycobacterium tuberculosis H37Rv
ccgcccgccagcg

SEQ ID NO: 3327743 - RNA, 14 nt, Mycobacterium tuberculosis H37Rv
ccgcccgcccaccu

SEQ ID NO: 3327744 - RNA, 21 nt, Mycobacterium tuberculosis H37Rv
ccgcccgcgcccccggugccg

SEQ ID NO: 3327745 - RNA, 19 nt, Mycobacterium tuberculosis H37Rv
ccgcccgcgccgccgcuac

SEQ ID NO: 3327746 - RNA, 16 nt, Mycobacterium tuberculosis H37Rv
ccgcccgcgccuccgu

SEQ ID NO: 3327747 - RNA, 21 nt, Mycobacterium tuberculosis H37Rv
ccgcccgcgccuccguugccc

SEQ ID NO: 3327748 - RNA, 12 nt, Mycobacterium tuberculosis H37Rv
ccgcccggcccg

SEQ ID NO: 3327749 - RNA, 14 nt, Mycobacterium tuberculosis H37Rv
ccgcccggcccggc

SEQ ID NO: 3327750 - RNA, 22 nt, Mycobacterium tuberculosis H37Rv
ccgcccggcuaggagaucagca

SEQ ID NO: 3327751 - RNA, 14 nt, Mycobacterium tuberculosis H37Rv
ccgcccggucgggc

SEQ ID NO: 3327752 - RNA, 23 nt, Mycobacterium tuberculosis H37Rv
ccgcccggucgggcgcggggcgg

SEQ ID NO: 3327753 - RNA, 19 nt, Mycobacterium tuberculosis H37Rv
ccgcccggugcuaaccgac

SEQ ID NO: 3327754 - RNA, 21 nt, Mycobacterium tuberculosis H37Rv
ccgcccggugcuaaccgacgc

SEQ ID NO: 3327755 - RNA, 12 nt, Mycobacterium tuberculosis H37Rv
ccgcccgguuga

SEQ ID NO: 3327756 - RNA, 21 nt, Mycobacterium tuberculosis H37Rv
ccgcccguagacccacagucg

SEQ ID NO: 3327757 - RNA, 18 nt, Mycobacterium tuberculosis H37Rv
ccgcccguaucggcuucg

SEQ ID NO: 3327758 - RNA, 22 nt, Mycobacterium tuberculosis H37Rv
ccgcccgucuuccagccaggcc

SEQ ID NO: 3327759 - RNA, 13 nt, Mycobacterium tuberculosis H37Rv
ccgcccgugccgc

SEQ ID NO: 3327760 - RNA, 22 nt, Mycobacterium tuberculosis H37Rv
ccgcccucccuggggccguccg

SEQ ID NO: 3327761 - RNA, 21 nt, Mycobacterium tuberculosis H37Rv
ccgcccucucacggcgguagc

SEQ ID NO: 3327762 - RNA, 15 nt, Mycobacterium tuberculosis H37Rv
ccgcccugaccgccc

SEQ ID NO: 3327763 - RNA, 18 nt, Mycobacterium tuberculosis H37Rv
ccgcccuugccgccagcc

SEQ ID NO: 3327764 - RNA, 21 nt, Mycobacterium tuberculosis H37Rv
ccgcccuugccgccagcccca

SEQ ID NO: 3327765 - RNA, 16 nt, Mycobacterium tuberculosis H37Rv
ccgcccuugccgccgg

SEQ ID NO: 3327766 - RNA, 17 nt, Mycobacterium tuberculosis H37Rv
ccgcccuugccgccggc

SEQ ID NO: 3327767 - RNA, 15 nt, Mycobacterium tuberculosis H37Rv
ccgcccuugccuccg

SEQ ID NO: 3327768 - RNA, 18 nt, Mycobacterium tuberculosis H37Rv
ccgcccuugccuccggcg

SEQ ID NO: 3327769 - RNA, 14 nt, Mycobacterium tuberculosis H37Rv
ccgccgaaaaccuc

SEQ ID NO: 3327770 - RNA, 18 nt, Mycobacterium tuberculosis H37Rv
ccgccgaaacucaccagc

SEQ ID NO: 3327771 - RNA, 20 nt, Mycobacterium tuberculosis H37Rv
ccgccgaaacucaccagcac

SEQ ID NO: 3327772 - RNA, 16 nt, Mycobacterium tuberculosis H37Rv
ccgccgaacagcugga

SEQ ID NO: 3327773 - RNA, 15 nt, Mycobacterium tuberculosis H37Rv
ccgccgaacggcaau

SEQ ID NO: 3327774 - RNA, 23 nt, Mycobacterium tuberculosis H37Rv
ccgccgaacgugaacucacggcg

SEQ ID NO: 3327775 - RNA, 20 nt, Mycobacterium tuberculosis H37Rv
ccgccgaacugcuugcgcau

SEQ ID NO: 3327776 - RNA, 19 nt, Mycobacterium tuberculosis H37Rv
ccgccgaagccgcgcaucu

SEQ ID NO: 3327777 - RNA, 22 nt, Mycobacterium tuberculosis H37Rv
ccgccgaagcucaucgccgcua

SEQ ID NO: 3327778 - RNA, 17 nt, Mycobacterium tuberculosis H37Rv
ccgccgacaaccccgcc

SEQ ID NO: 3327779 - RNA, 12 nt, Mycobacterium tuberculosis H37Rv
ccgccgacagcc

SEQ ID NO: 3327780 - RNA, 14 nt, Mycobacterium tuberculosis H37Rv
ccgccgacaggccg

SEQ ID NO: 3327781 - RNA, 12 nt, Mycobacterium tuberculosis H37Rv
ccgccgaccaga

SEQ ID NO: 3327782 - RNA, 14 nt, Mycobacterium tuberculosis H37Rv
ccgccgaccaggcc

SEQ ID NO: 3327783 - RNA, 13 nt, Mycobacterium tuberculosis H37Rv
ccgccgaccgaca

SEQ ID NO: 3327784 - RNA, 21 nt, Mycobacterium tuberculosis H37Rv
ccgccgaccggagccgccgga

SEQ ID NO: 3327785 - RNA, 14 nt, Mycobacterium tuberculosis H37Rv
ccgccgacgccgcc

SEQ ID NO: 3327786 - RNA, 14 nt, Mycobacterium tuberculosis H37Rv
ccgccgacuccccg

SEQ ID NO: 3327787 - RNA, 15 nt, Mycobacterium tuberculosis H37Rv
ccgccgacuccccgc

SEQ ID NO: 3327788 - RNA, 23 nt, Mycobacterium tuberculosis H37Rv
ccgccgagauagcaacgaagccg

SEQ ID NO: 3327789 - RNA, 12 nt, Mycobacterium tuberculosis H37Rv
ccgccgagcaga

SEQ ID NO: 3327790 - RNA, 15 nt, Mycobacterium tuberculosis H37Rv
ccgccgagcgcaacu

SEQ ID NO: 3327791 - RNA, 19 nt, Mycobacterium tuberculosis H37Rv
ccgccgagcggaccaccgc

SEQ ID NO: 3327792 - RNA, 22 nt, Mycobacterium tuberculosis H37Rv
ccgccgagcggaccaccgcucg

SEQ ID NO: 3327793 - RNA, 23 nt, Mycobacterium tuberculosis H37Rv
ccgccgagcggaccaccgcucgc

SEQ ID NO: 3327794 - RNA, 18 nt, Mycobacterium tuberculosis H37Rv
ccgccgagcggugccggc

SEQ ID NO: 3327795 - RNA, 17 nt, Mycobacterium tuberculosis H37Rv
ccgccgagcucggucac

SEQ ID NO: 3327796 - RNA, 23 nt, Mycobacterium tuberculosis H37Rv
ccgccgaggacacauugaccagg

SEQ ID NO: 3327797 - RNA, 20 nt, Mycobacterium tuberculosis H37Rv
ccgccgaggccgccguugcc

SEQ ID NO: 3327798 - RNA, 21 nt, Mycobacterium tuberculosis H37Rv
ccgccgaggucgguucggccg

SEQ ID NO: 3327799 - RNA, 15 nt, Mycobacterium tuberculosis H37Rv
ccgccgauaccgccg

SEQ ID NO: 3327800 - RNA, 20 nt, Mycobacterium tuberculosis H37Rv
ccgccgauaccgccggcccc

SEQ ID NO: 3327801 - RNA, 21 nt, Mycobacterium tuberculosis H37Rv
ccgccgauaccgccggcccca

SEQ ID NO: 3327802 - RNA, 12 nt, Mycobacterium tuberculosis H37Rv
ccgccgaucacu

SEQ ID NO: 3327803 - RNA, 18 nt, Mycobacterium tuberculosis H37Rv
ccgccgauccuagaucga

SEQ ID NO: 3327804 - RNA, 16 nt, Mycobacterium tuberculosis H37Rv
ccgccgaucggccaca

SEQ ID NO: 3327805 - RNA, 19 nt, Mycobacterium tuberculosis H37Rv
ccgccgaucugcugcagcg

SEQ ID NO: 3327806 - RNA, 21 nt, Mycobacterium tuberculosis H37Rv
ccgccgaucugcugcagcguc

SEQ ID NO: 3327807 - RNA, 18 nt, Mycobacterium tuberculosis H37Rv
ccgccgaugaugcggcgc

SEQ ID NO: 3327808 - RNA, 21 nt, Mycobacterium tuberculosis H37Rv
ccgccgaugaugcggcgcagc

SEQ ID NO: 3327809 - RNA, 21 nt, Mycobacterium tuberculosis H37Rv
ccgccgaugaugugcggugac

SEQ ID NO: 3327810 - RNA, 17 nt, Mycobacterium tuberculosis H37Rv
ccgccgaugccaccgcu

SEQ ID NO: 3327811 - RNA, 13 nt, Mycobacterium tuberculosis H37Rv
ccgccgaugccgc

SEQ ID NO: 3327812 - RNA, 16 nt, Mycobacterium tuberculosis H37Rv
ccgccgaugccgccgc

SEQ ID NO: 3327813 - RNA, 17 nt, Mycobacterium tuberculosis H37Rv
ccgccgaugccgccggc

SEQ ID NO: 3327814 - RNA, 18 nt, Mycobacterium tuberculosis H37Rv
ccgccgaugucgacgaca

SEQ ID NO: 3327815 - RNA, 12 nt, Mycobacterium tuberculosis H37Rv
ccgccgcacgca

SEQ ID NO: 3327816 - RNA, 19 nt, Mycobacterium tuberculosis H37Rv
ccgccgcagacgccgacuc

SEQ ID NO: 3327817 - RNA, 13 nt, Mycobacterium tuberculosis H37Rv
ccgccgcagcucc

SEQ ID NO: 3327818 - RNA, 19 nt, Mycobacterium tuberculosis H37Rv
ccgccgcagcuccccgacc

SEQ ID NO: 3327819 - RNA, 21 nt, Mycobacterium tuberculosis H37Rv
ccgccgcagcuuguccgguga

SEQ ID NO: 3327820 - RNA, 16 nt, Mycobacterium tuberculosis H37Rv
ccgccgcauucggcga

SEQ ID NO: 3327821 - RNA, 18 nt, Mycobacterium tuberculosis H37Rv
ccgccgccaagcucggcc

SEQ ID NO: 3327822 - RNA, 12 nt, Mycobacterium tuberculosis H37Rv
ccgccgccacca

SEQ ID NO: 3327823 - RNA, 17 nt, Mycobacterium tuberculosis H37Rv
ccgccgccaccagcugc

SEQ ID NO: 3327824 - RNA, 12 nt, Mycobacterium tuberculosis H37Rv
ccgccgccaccg

SEQ ID NO: 3327825 - RNA, 16 nt, Mycobacterium tuberculosis H37Rv
ccgccgccaucgccga

SEQ ID NO: 3327826 - RNA, 13 nt, Mycobacterium tuberculosis H37Rv
ccgccgcccagcg

SEQ ID NO: 3327827 - RNA, 23 nt, Mycobacterium tuberculosis H37Rv
ccgccgccccacaacaugcugga

SEQ ID NO: 3327828 - RNA, 12 nt, Mycobacterium tuberculosis H37Rv
ccgccgcccccg

SEQ ID NO: 3327829 - RNA, 13 nt, Mycobacterium tuberculosis H37Rv
ccgccgcccccgc

SEQ ID NO: 3327830 - RNA, 14 nt, Mycobacterium tuberculosis H37Rv
ccgccgcccccgcc

SEQ ID NO: 3327831 - RNA, 12 nt, Mycobacterium tuberculosis H37Rv
ccgccgcccgca

SEQ ID NO: 3327832 - RNA, 12 nt, Mycobacterium tuberculosis H37Rv
ccgccgccgaag

SEQ ID NO: 3327833 - RNA, 16 nt, Mycobacterium tuberculosis H37Rv
ccgccgccugcccggc

SEQ ID NO: 3327834 - RNA, 17 nt, Mycobacterium tuberculosis H37Rv
ccgccgccugcccggcc

SEQ ID NO: 3327835 - RNA, 22 nt, Mycobacterium tuberculosis H37Rv
ccgccgccugcuccucggccag

SEQ ID NO: 3327836 - RNA, 21 nt, Mycobacterium tuberculosis H37Rv
ccgccgccugcuggagcagcu

SEQ ID NO: 3327837 - RNA, 21 nt, Mycobacterium tuberculosis H37Rv
ccgccgcgaacgggucgggac

SEQ ID NO: 3327838 - RNA, 14 nt, Mycobacterium tuberculosis H37Rv
ccgccgcgaccacg

SEQ ID NO: 3327839 - RNA, 21 nt, Mycobacterium tuberculosis H37Rv
ccgccgcgacgcacugccccg

SEQ ID NO: 3327840 - RNA, 23 nt, Mycobacterium tuberculosis H37Rv
ccgccgcgacgcacugccccgca

SEQ ID NO: 3327841 - RNA, 15 nt, Mycobacterium tuberculosis H37Rv
ccgccgcgacggcac

SEQ ID NO: 3327842 - RNA, 23 nt, Mycobacterium tuberculosis H37Rv
ccgccgcgacggcacgaucaucg

SEQ ID NO: 3327843 - RNA, 14 nt, Mycobacterium tuberculosis H37Rv
ccgccgcgagcaga

SEQ ID NO: 3327844 - RNA, 15 nt, Mycobacterium tuberculosis H37Rv
ccgccgcgagcagaa

SEQ ID NO: 3327845 - RNA, 20 nt, Mycobacterium tuberculosis H37Rv
ccgccgcgaggaugcugagc

SEQ ID NO: 3327846 - RNA, 14 nt, Mycobacterium tuberculosis H37Rv
ccgccgcgauggcc

SEQ ID NO: 3327847 - RNA, 12 nt, Mycobacterium tuberculosis H37Rv
ccgccgcgcagc

SEQ ID NO: 3327848 - RNA, 15 nt, Mycobacterium tuberculosis H37Rv
ccgccgcgcauccgc

SEQ ID NO: 3327849 - RNA, 14 nt, Mycobacterium tuberculosis H37Rv
ccgccgcgcccggc

SEQ ID NO: 3327850 - RNA, 13 nt, Mycobacterium tuberculosis H37Rv
ccgccgcgccggc

SEQ ID NO: 3327851 - RNA, 15 nt, Mycobacterium tuberculosis H37Rv
ccgccgcgccggcac

SEQ ID NO: 3327852 - RNA, 16 nt, Mycobacterium tuberculosis H37Rv
ccgccgcgccggcacg

SEQ ID NO: 3327853 - RNA, 14 nt, Mycobacterium tuberculosis H37Rv
ccgccgcgccggug

SEQ ID NO: 3327854 - RNA, 17 nt, Mycobacterium tuberculosis H37Rv
ccgccgcgcguucggcg

SEQ ID NO: 3327855 - RNA, 15 nt, Mycobacterium tuberculosis H37Rv
ccgccgcggcagcau

SEQ ID NO: 3327856 - RNA, 13 nt, Mycobacterium tuberculosis H37Rv
ccgccgcggcagg

SEQ ID NO: 3327857 - RNA, 13 nt, Mycobacterium tuberculosis H37Rv
ccgccgcggccac

SEQ ID NO: 3327858 - RNA, 14 nt, Mycobacterium tuberculosis H37Rv
ccgccgcggccacc

SEQ ID NO: 3327859 - RNA, 15 nt, Mycobacterium tuberculosis H37Rv
ccgccgcggccacca

SEQ ID NO: 3327860 - RNA, 15 nt, Mycobacterium tuberculosis H37Rv
ccgccgcggccgccg

SEQ ID NO: 3327861 - RNA, 14 nt, Mycobacterium tuberculosis H37Rv
ccgccgcggccggc

SEQ ID NO: 3327862 - RNA, 12 nt, Mycobacterium tuberculosis H37Rv
ccgccgcggcgc

SEQ ID NO: 3327863 - RNA, 18 nt, Mycobacterium tuberculosis H37Rv
ccgccgcgggcgccgguu

SEQ ID NO: 3327864 - RNA, 20 nt, Mycobacterium tuberculosis H37Rv
ccgccgcgguuaucgccgag

SEQ ID NO: 3327865 - RNA, 16 nt, Mycobacterium tuberculosis H37Rv
ccgccgcuaccgaaca

SEQ ID NO: 3327866 - RNA, 17 nt, Mycobacterium tuberculosis H37Rv
ccgccgcuaccgcccgc

SEQ ID NO: 3327867 - RNA, 15 nt, Mycobacterium tuberculosis H37Rv
ccgccgcugccgccg

SEQ ID NO: 3327868 - RNA, 18 nt, Mycobacterium tuberculosis H37Rv
ccgccgcugccgccggug

SEQ ID NO: 3327869 - RNA, 17 nt, Mycobacterium tuberculosis H37Rv
ccgccgcugccgccugc

SEQ ID NO: 3327870 - RNA, 23 nt, Mycobacterium tuberculosis H37Rv
ccgccgcuguugaucgacaccga

SEQ ID NO: 3327871 - RNA, 15 nt, Mycobacterium tuberculosis H37Rv
ccgccggaacugcgc

SEQ ID NO: 3327872 - RNA, 15 nt, Mycobacterium tuberculosis H37Rv
ccgccggaaucgaga

SEQ ID NO: 3327873 - RNA, 15 nt, Mycobacterium tuberculosis H37Rv
ccgccggacccaccg

SEQ ID NO: 3327874 - RNA, 14 nt, Mycobacterium tuberculosis H37Rv
ccgccggacccgcc

SEQ ID NO: 3327875 - RNA, 14 nt, Mycobacterium tuberculosis H37Rv
ccgccggacccguc

SEQ ID NO: 3327876 - RNA, 22 nt, Mycobacterium tuberculosis H37Rv
ccgccggacccgucgagcagca

SEQ ID NO: 3327877 - RNA, 12 nt, Mycobacterium tuberculosis H37Rv
ccgccggcaacg

SEQ ID NO: 3327878 - RNA, 20 nt, Mycobacterium tuberculosis H37Rv
ccgccggcaauaccgccagc

SEQ ID NO: 3327879 - RNA, 12 nt, Mycobacterium tuberculosis H37Rv
ccgccggcacca

SEQ ID NO: 3327880 - RNA, 14 nt, Mycobacterium tuberculosis H37Rv
ccgccggcaccgcc

SEQ ID NO: 3327881 - RNA, 16 nt, Mycobacterium tuberculosis H37Rv
ccgccggcaccgccgc

SEQ ID NO: 3327882 - RNA, 15 nt, Mycobacterium tuberculosis H37Rv
ccgccggcaccuccg

SEQ ID NO: 3327883 - RNA, 13 nt, Mycobacterium tuberculosis H37Rv
ccgccggccaggu

SEQ ID NO: 3327884 - RNA, 13 nt, Mycobacterium tuberculosis H37Rv
ccgccggccaguc

SEQ ID NO: 3327885 - RNA, 16 nt, Mycobacterium tuberculosis H37Rv
ccgccggccaguccgc

SEQ ID NO: 3327886 - RNA, 19 nt, Mycobacterium tuberculosis H37Rv
ccgccggccccaccgguac

SEQ ID NO: 3327887 - RNA, 14 nt, Mycobacterium tuberculosis H37Rv
ccgccggccccgcc

SEQ ID NO: 3327888 - RNA, 16 nt, Mycobacterium tuberculosis H37Rv
ccgccggccccgccgc

SEQ ID NO: 3327889 - RNA, 13 nt, Mycobacterium tuberculosis H37Rv
ccgccggccgcca

SEQ ID NO: 3327890 - RNA, 14 nt, Mycobacterium tuberculosis H37Rv
ccgccggccgccag

SEQ ID NO: 3327891 - RNA, 17 nt, Mycobacterium tuberculosis H37Rv
ccgccggccggaacgcc

SEQ ID NO: 3327892 - RNA, 24 nt, Mycobacterium tuberculosis H37Rv
ccgccggccggaacgcccggcuga

SEQ ID NO: 3327893 - RNA, 18 nt, Mycobacterium tuberculosis H37Rv
ccgccggccgucggccgg

SEQ ID NO: 3327894 - RNA, 17 nt, Mycobacterium tuberculosis H37Rv
ccgccggcgccacccgc

SEQ ID NO: 3327895 - RNA, 18 nt, Mycobacterium tuberculosis H37Rv
ccgccggcgcccaggccg

SEQ ID NO: 3327896 - RNA, 23 nt, Mycobacterium tuberculosis H37Rv
ccgccggcgcccaggccgaucag

SEQ ID NO: 3327897 - RNA, 14 nt, Mycobacterium tuberculosis H37Rv
ccgccggcgccccc

SEQ ID NO: 3327898 - RNA, 15 nt, Mycobacterium tuberculosis H37Rv
ccgccggcgcccccg

SEQ ID NO: 3327899 - RNA, 22 nt, Mycobacterium tuberculosis H37Rv
ccgccggcgccgccauugccau

SEQ ID NO: 3327900 - RNA, 15 nt, Mycobacterium tuberculosis H37Rv
ccgccggcgccgccg

SEQ ID NO: 3327901 - RNA, 20 nt, Mycobacterium tuberculosis H37Rv
ccgccggcgccggagccgcc

SEQ ID NO: 3327902 - RNA, 14 nt, Mycobacterium tuberculosis H37Rv
ccgccggcgccggc

SEQ ID NO: 3327903 - RNA, 19 nt, Mycobacterium tuberculosis H37Rv
ccgccggcgccggugccgc

SEQ ID NO: 3327904 - RNA, 21 nt, Mycobacterium tuberculosis H37Rv
ccgccggcgcugaucgcgaag

SEQ ID NO: 3327905 - RNA, 14 nt, Mycobacterium tuberculosis H37Rv
ccgccggcggcggc

SEQ ID NO: 3327906 - RNA, 18 nt, Mycobacterium tuberculosis H37Rv
ccgccggcuccgccagcg

SEQ ID NO: 3327907 - RNA, 22 nt, Mycobacterium tuberculosis H37Rv
ccgccggcuccgccagcgccgc

SEQ ID NO: 3327908 - RNA, 12 nt, Mycobacterium tuberculosis H37Rv
ccgccggcugcg

SEQ ID NO: 3327909 - RNA, 23 nt, Mycobacterium tuberculosis H37Rv
ccgccgggaaauaucucggugac

SEQ ID NO: 3327910 - RNA, 13 nt, Mycobacterium tuberculosis H37Rv
ccgccgggaagcc

SEQ ID NO: 3327911 - RNA, 19 nt, Mycobacterium tuberculosis H37Rv
ccgccgggauaacccagca

SEQ ID NO: 3327912 - RNA, 21 nt, Mycobacterium tuberculosis H37Rv
ccgccgggaugccggccccca

SEQ ID NO: 3327913 - RNA, 19 nt, Mycobacterium tuberculosis H37Rv
ccgccgggcagugugguca

SEQ ID NO: 3327914 - RNA, 16 nt, Mycobacterium tuberculosis H37Rv
ccgccgggccaggccg

SEQ ID NO: 3327915 - RNA, 19 nt, Mycobacterium tuberculosis H37Rv
ccgccgggcccccgccuac

SEQ ID NO: 3327916 - RNA, 13 nt, Mycobacterium tuberculosis H37Rv
ccgccgggcccuc

SEQ ID NO: 3327917 - RNA, 17 nt, Mycobacterium tuberculosis H37Rv
ccgccgggcucagcugg

SEQ ID NO: 3327918 - RNA, 13 nt, Mycobacterium tuberculosis H37Rv
ccgccgggcucca

SEQ ID NO: 3327919 - RNA, 15 nt, Mycobacterium tuberculosis H37Rv
ccgccgggcuccacg

SEQ ID NO: 3327920 - RNA, 14 nt, Mycobacterium tuberculosis H37Rv
ccgccggggccgcc

SEQ ID NO: 3327921 - RNA, 19 nt, Mycobacterium tuberculosis H37Rv
ccgccggguccgccgggcc

SEQ ID NO: 3327922 - RNA, 20 nt, Mycobacterium tuberculosis H37Rv
ccgccggguccgccgggccc

SEQ ID NO: 3327923 - RNA, 13 nt, Mycobacterium tuberculosis H37Rv
ccgccgggugcgc

SEQ ID NO: 3327924 - RNA, 19 nt, Mycobacterium tuberculosis H37Rv
ccgccgggugucgguggua

SEQ ID NO: 3327925 - RNA, 15 nt, Mycobacterium tuberculosis H37Rv
ccgccggucacgacg

SEQ ID NO: 3327926 - RNA, 14 nt, Mycobacterium tuberculosis H37Rv
ccgccgguccaugg

SEQ ID NO: 3327927 - RNA, 19 nt, Mycobacterium tuberculosis H37Rv
ccgccgguccccucggugc

SEQ ID NO: 3327928 - RNA, 17 nt, Mycobacterium tuberculosis H37Rv
ccgccggugccaccggc

SEQ ID NO: 3327929 - RNA, 14 nt, Mycobacterium tuberculosis H37Rv
ccgccggugccgau

SEQ ID NO: 3327930 - RNA, 16 nt, Mycobacterium tuberculosis H37Rv
ccgccggugccgauca

SEQ ID NO: 3327931 - RNA, 19 nt, Mycobacterium tuberculosis H37Rv
ccgccggugccgaucagca

SEQ ID NO: 3327932 - RNA, 21 nt, Mycobacterium tuberculosis H37Rv
ccgccggugccgccgauaccg

SEQ ID NO: 3327933 - RNA, 21 nt, Mycobacterium tuberculosis H37Rv
ccgccggugccgccggugccg

SEQ ID NO: 3327934 - RNA, 15 nt, Mycobacterium tuberculosis H37Rv
ccgccgguggcgccg

SEQ ID NO: 3327935 - RNA, 21 nt, Mycobacterium tuberculosis H37Rv
ccgccgguggugccggcgccg

SEQ ID NO: 3327936 - RNA, 15 nt, Mycobacterium tuberculosis H37Rv
ccgccggugucgggc

SEQ ID NO: 3327937 - RNA, 21 nt, Mycobacterium tuberculosis H37Rv
ccgccgguguuagccccgaag

SEQ ID NO: 3327938 - RNA, 20 nt, Mycobacterium tuberculosis H37Rv
ccgccgguuccgccggcccc

SEQ ID NO: 3327939 - RNA, 16 nt, Mycobacterium tuberculosis H37Rv
ccgccgguuugggggc

SEQ ID NO: 3327940 - RNA, 21 nt, Mycobacterium tuberculosis H37Rv
ccgccguaugccgccaaccgc

SEQ ID NO: 3327941 - RNA, 15 nt, Mycobacterium tuberculosis H37Rv
ccgccgucaccgccg

SEQ ID NO: 3327942 - RNA, 18 nt, Mycobacterium tuberculosis H37Rv
ccgccgucaccgccgacc

SEQ ID NO: 3327943 - RNA, 16 nt, Mycobacterium tuberculosis H37Rv
ccgccgucaccgccgu

SEQ ID NO: 3327944 - RNA, 17 nt, Mycobacterium tuberculosis H37Rv
ccgccgucaccgccguu

SEQ ID NO: 3327945 - RNA, 19 nt, Mycobacterium tuberculosis H37Rv
ccgccgucaccgccguugc

SEQ ID NO: 3327946 - RNA, 20 nt, Mycobacterium tuberculosis H37Rv
ccgccgucaccgccguugcc

SEQ ID NO: 3327947 - RNA, 15 nt, Mycobacterium tuberculosis H37Rv
ccgccgucaccgcgc

SEQ ID NO: 3327948 - RNA, 17 nt, Mycobacterium tuberculosis H37Rv
ccgccguccagcgccgc

SEQ ID NO: 3327949 - RNA, 19 nt, Mycobacterium tuberculosis H37Rv
ccgccguccccaccgacgc

SEQ ID NO: 3327950 - RNA, 14 nt, Mycobacterium tuberculosis H37Rv
ccgccguccccgcc

SEQ ID NO: 3327951 - RNA, 15 nt, Mycobacterium tuberculosis H37Rv
ccgccguccccgccg

SEQ ID NO: 3327952 - RNA, 22 nt, Mycobacterium tuberculosis H37Rv
ccgccguccccgccgccguucc

SEQ ID NO: 3327953 - RNA, 21 nt, Mycobacterium tuberculosis H37Rv
ccgccgucgacguugaugacc

SEQ ID NO: 3327954 - RNA, 13 nt, Mycobacterium tuberculosis H37Rv
ccgccgucgccac

SEQ ID NO: 3327955 - RNA, 15 nt, Mycobacterium tuberculosis H37Rv
ccgccgucgccacca

SEQ ID NO: 3327956 - RNA, 18 nt, Mycobacterium tuberculosis H37Rv
ccgccgucgccaccggua

SEQ ID NO: 3327957 - RNA, 19 nt, Mycobacterium tuberculosis H37Rv
ccgccgucgccaccgguac

SEQ ID NO: 3327958 - RNA, 17 nt, Mycobacterium tuberculosis H37Rv
ccgccgucgccacgccc

SEQ ID NO: 3327959 - RNA, 13 nt, Mycobacterium tuberculosis H37Rv
ccgccgucgccga

SEQ ID NO: 3327960 - RNA, 15 nt, Mycobacterium tuberculosis H37Rv
ccgccgucgccgaac

SEQ ID NO: 3327961 - RNA, 22 nt, Mycobacterium tuberculosis H37Rv
ccgccgucgccgaucagcugcg

SEQ ID NO: 3327962 - RNA, 16 nt, Mycobacterium tuberculosis H37Rv
ccgccgucgccgccgc

SEQ ID NO: 3327963 - RNA, 18 nt, Mycobacterium tuberculosis H37Rv
ccgccgucgccgccgcua

SEQ ID NO: 3327964 - RNA, 13 nt, Mycobacterium tuberculosis H37Rv
ccgccgucgccgg

SEQ ID NO: 3327965 - RNA, 15 nt, Mycobacterium tuberculosis H37Rv
ccgccgucgccggug

SEQ ID NO: 3327966 - RNA, 17 nt, Mycobacterium tuberculosis H37Rv
ccgccgucgccggugcc

SEQ ID NO: 3327967 - RNA, 16 nt, Mycobacterium tuberculosis H37Rv
ccgccgucgccguaca

SEQ ID NO: 3327968 - RNA, 15 nt, Mycobacterium tuberculosis H37Rv
ccgccgucgccuccg

SEQ ID NO: 3327969 - RNA, 15 nt, Mycobacterium tuberculosis H37Rv
ccgccgucgugugac

SEQ ID NO: 3327970 - RNA, 22 nt, Mycobacterium tuberculosis H37Rv
ccgccgugcggguucacugccg

SEQ ID NO: 3327971 - RNA, 16 nt, Mycobacterium tuberculosis H37Rv
ccgccgugcugcggcg

SEQ ID NO: 3327972 - RNA, 18 nt, Mycobacterium tuberculosis H37Rv
ccgccgugcugcggcgac

SEQ ID NO: 3327973 - RNA, 21 nt, Mycobacterium tuberculosis H37Rv
ccgccgugcugcggcgacggu

SEQ ID NO: 3327974 - RNA, 21 nt, Mycobacterium tuberculosis H37Rv
ccgccguuaccgagcccgaag

SEQ ID NO: 3327975 - RNA, 16 nt, Mycobacterium tuberculosis H37Rv
ccgccguuaccgccgu

SEQ ID NO: 3327976 - RNA, 17 nt, Mycobacterium tuberculosis H37Rv
ccgccguuaccgccguu

SEQ ID NO: 3327977 - RNA, 20 nt, Mycobacterium tuberculosis H37Rv
ccgccguuaccgccguuacc

SEQ ID NO: 3327978 - RNA, 19 nt, Mycobacterium tuberculosis H37Rv
ccgccguuaccgccguugc

SEQ ID NO: 3327979 - RNA, 19 nt, Mycobacterium tuberculosis H37Rv
ccgccguuacggagggcac

SEQ ID NO: 3327980 - RNA, 20 nt, Mycobacterium tuberculosis H37Rv
ccgccguucccgccggcccc

SEQ ID NO: 3327981 - RNA, 21 nt, Mycobacterium tuberculosis H37Rv
ccgccguucccgccggccccg

SEQ ID NO: 3327982 - RNA, 22 nt, Mycobacterium tuberculosis H37Rv
ccgccguugaacggcaccagcg

SEQ ID NO: 3327983 - RNA, 21 nt, Mycobacterium tuberculosis H37Rv
ccgccguugccaccggugccg

SEQ ID NO: 3327984 - RNA, 22 nt, Mycobacterium tuberculosis H37Rv
ccgccguugccauugccucccg

SEQ ID NO: 3327985 - RNA, 23 nt, Mycobacterium tuberculosis H37Rv
ccgccguugccauugccucccgc

SEQ ID NO: 3327986 - RNA, 13 nt, Mycobacterium tuberculosis H37Rv
ccgccguugccga

SEQ ID NO: 3327987 - RNA, 17 nt, Mycobacterium tuberculosis H37Rv
ccgccguugccgaucag

SEQ ID NO: 3327988 - RNA, 21 nt, Mycobacterium tuberculosis H37Rv
ccgccguugccgaucagcccg

SEQ ID NO: 3327989 - RNA, 23 nt, Mycobacterium tuberculosis H37Rv
ccgccguugccgaucaguccggc

SEQ ID NO: 3327990 - RNA, 19 nt, Mycobacterium tuberculosis H37Rv
ccgccguugccgaugagca

SEQ ID NO: 3327991 - RNA, 16 nt, Mycobacterium tuberculosis H37Rv
ccgccguugccgccau

SEQ ID NO: 3327992 - RNA, 16 nt, Mycobacterium tuberculosis H37Rv
ccgccguugccgccgc

SEQ ID NO: 3327993 - RNA, 18 nt, Mycobacterium tuberculosis H37Rv
ccgccguugccgccguca

SEQ ID NO: 3327994 - RNA, 18 nt, Mycobacterium tuberculosis H37Rv
ccgccguugccgccguua

SEQ ID NO: 3327995 - RNA, 15 nt, Mycobacterium tuberculosis H37Rv
ccgccguugccgucg

SEQ ID NO: 3327996 - RNA, 19 nt, Mycobacterium tuberculosis H37Rv
ccgccguugccgucgucgc

SEQ ID NO: 3327997 - RNA, 16 nt, Mycobacterium tuberculosis H37Rv
ccgccguugccguugg

SEQ ID NO: 3327998 - RNA, 23 nt, Mycobacterium tuberculosis H37Rv
ccgccuaagcauucagcgcgccg

SEQ ID NO: 3327999 - RNA, 17 nt, Mycobacterium tuberculosis H37Rv
ccgccuaaucggccugc

SEQ ID NO: 3328000 - RNA, 19 nt, Mycobacterium tuberculosis H37Rv
ccgccuaaucggccugccg

SEQ ID NO: 3328001 - RNA, 21 nt, Mycobacterium tuberculosis H37Rv
ccgccuaggaguuccucgauc

SEQ ID NO: 3328002 - RNA, 22 nt, Mycobacterium tuberculosis H37Rv
ccgccuaggaguuccucgaucg

SEQ ID NO: 3328003 - RNA, 16 nt, Mycobacterium tuberculosis H37Rv
ccgccucaaugaccac

SEQ ID NO: 3328004 - RNA, 18 nt, Mycobacterium tuberculosis H37Rv
ccgccucaaugaccaccg

SEQ ID NO: 3328005 - RNA, 14 nt, Mycobacterium tuberculosis H37Rv
ccgccuccgccugc

SEQ ID NO: 3328006 - RNA, 16 nt, Mycobacterium tuberculosis H37Rv
ccgccuccgccugccc

SEQ ID NO: 3328007 - RNA, 14 nt, Mycobacterium tuberculosis H37Rv
ccgccuccucgaua

SEQ ID NO: 3328008 - RNA, 15 nt, Mycobacterium tuberculosis H37Rv
ccgccucgaccgcca

SEQ ID NO: 3328009 - RNA, 17 nt, Mycobacterium tuberculosis H37Rv
ccgccucgaccgccagc

SEQ ID NO: 3328010 - RNA, 13 nt, Mycobacterium tuberculosis H37Rv
ccgccucgccgua

SEQ ID NO: 3328011 - RNA, 22 nt, Mycobacterium tuberculosis H37Rv
ccgccucgcggaugagcucggc

SEQ ID NO: 3328012 - RNA, 15 nt, Mycobacterium tuberculosis H37Rv
ccgccucgggccggc

SEQ ID NO: 3328013 - RNA, 16 nt, Mycobacterium tuberculosis H37Rv
ccgccucugucuucag

SEQ ID NO: 3328014 - RNA, 12 nt, Mycobacterium tuberculosis H37Rv
ccgccugaccgc

SEQ ID NO: 3328015 - RNA, 15 nt, Mycobacterium tuberculosis H37Rv
ccgccugaccgccac

SEQ ID NO: 3328016 - RNA, 18 nt, Mycobacterium tuberculosis H37Rv
ccgccugaccgccaccgu

SEQ ID NO: 3328017 - RNA, 12 nt, Mycobacterium tuberculosis H37Rv
ccgccugcaccg

SEQ ID NO: 3328018 - RNA, 17 nt, Mycobacterium tuberculosis H37Rv
ccgccugcaccgccgcc

SEQ ID NO: 3328019 - RNA, 21 nt, Mycobacterium tuberculosis H37Rv
ccgccugcagguuuccggccu

SEQ ID NO: 3328020 - RNA, 17 nt, Mycobacterium tuberculosis H37Rv
ccgccugccccacccgc

SEQ ID NO: 3328021 - RNA, 17 nt, Mycobacterium tuberculosis H37Rv
ccgccugcccggcccgc

SEQ ID NO: 3328022 - RNA, 14 nt, Mycobacterium tuberculosis H37Rv
ccgccugccgacgg

SEQ ID NO: 3328023 - RNA, 14 nt, Mycobacterium tuberculosis H37Rv
ccgccugcgccgcc

SEQ ID NO: 3328024 - RNA, 17 nt, Mycobacterium tuberculosis H37Rv
ccgccugcgccgcccgc

SEQ ID NO: 3328025 - RNA, 16 nt, Mycobacterium tuberculosis H37Rv
ccgccuggacgccgcc

SEQ ID NO: 3328026 - RNA, 14 nt, Mycobacterium tuberculosis H37Rv
ccgccuggagcugu

SEQ ID NO: 3328027 - RNA, 21 nt, Mycobacterium tuberculosis H37Rv
ccgccuggagcuguggcgggc

SEQ ID NO: 3328028 - RNA, 15 nt, Mycobacterium tuberculosis H37Rv
ccgccuggaucagcg

SEQ ID NO: 3328029 - RNA, 20 nt, Mycobacterium tuberculosis H37Rv
ccgccuucgaucaucgaccu

SEQ ID NO: 3328030 - RNA, 13 nt, Mycobacterium tuberculosis H37Rv
ccgccuucgccgc

SEQ ID NO: 3328031 - RNA, 15 nt, Mycobacterium tuberculosis H37Rv
ccgccuucgccgccg

SEQ ID NO: 3328032 - RNA, 14 nt, Mycobacterium tuberculosis H37Rv
ccgccuucuccggc

SEQ ID NO: 3328033 - RNA, 12 nt, Mycobacterium tuberculosis H37Rv
ccgccuucuugg

SEQ ID NO: 3328034 - RNA, 14 nt, Mycobacterium tuberculosis H37Rv
ccgccuucuuggcg

SEQ ID NO: 3328035 - RNA, 22 nt, Mycobacterium tuberculosis H37Rv
ccgccuucuuggcggccuuugu

SEQ ID NO: 3328036 - RNA, 16 nt, Mycobacterium tuberculosis H37Rv
ccgccuuggucaccuu

SEQ ID NO: 3328037 - RNA, 22 nt, Mycobacterium tuberculosis H37Rv
ccgccuuggucaccuucuuggc

SEQ ID NO: 3328038 - RNA, 18 nt, Mycobacterium tuberculosis H37Rv
ccgccuuggucgcgucgg

SEQ ID NO: 3328039 - RNA, 22 nt, Mycobacterium tuberculosis H37Rv
ccgccuuggucgcgucggcugc

SEQ ID NO: 3328040 - RNA, 14 nt, Mycobacterium tuberculosis H37Rv
ccgccuuugccccc

SEQ ID NO: 3328041 - RNA, 15 nt, Mycobacterium tuberculosis H37Rv
ccgccuuugcccccg

SEQ ID NO: 3328042 - RNA, 17 nt, Mycobacterium tuberculosis H37Rv
ccgccuuugcccgccgc

SEQ ID NO: 3328043 - RNA, 19 nt, Mycobacterium tuberculosis H37Rv
ccgccuuugcccgccgcgu

SEQ ID NO: 3328044 - RNA, 20 nt, Mycobacterium tuberculosis H37Rv
ccgccuuugcccgccgcguc

SEQ ID NO: 3328045 - RNA, 16 nt, Mycobacterium tuberculosis H37Rv
ccgccuuugccgccgg

SEQ ID NO: 3328046 - RNA, 13 nt, Mycobacterium tuberculosis H37Rv
ccgcgaacauggu

SEQ ID NO: 3328047 - RNA, 20 nt, Mycobacterium tuberculosis H37Rv
ccgcgaacccgaucgucgag

SEQ ID NO: 3328048 - RNA, 22 nt, Mycobacterium tuberculosis H37Rv
ccgcgaacccgaucgucgagcc

SEQ ID NO: 3328049 - RNA, 18 nt, Mycobacterium tuberculosis H37Rv
ccgcgaaccgcggaucga

SEQ ID NO: 3328050 - RNA, 16 nt, Mycobacterium tuberculosis H37Rv
ccgcgaaccucacagc

SEQ ID NO: 3328051 - RNA, 20 nt, Mycobacterium tuberculosis H37Rv
ccgcgaacgauuucggccca

SEQ ID NO: 3328052 - RNA, 21 nt, Mycobacterium tuberculosis H37Rv
ccgcgaacgauuucggcccac

SEQ ID NO: 3328053 - RNA, 21 nt, Mycobacterium tuberculosis H37Rv
ccgcgaacgggucgggacgcu

SEQ ID NO: 3328054 - RNA, 19 nt, Mycobacterium tuberculosis H37Rv
ccgcgaagcgcucggcagc

SEQ ID NO: 3328055 - RNA, 23 nt, Mycobacterium tuberculosis H37Rv
ccgcgaagcugcgggucucgcug

SEQ ID NO: 3328056 - RNA, 20 nt, Mycobacterium tuberculosis H37Rv
ccgcgaaggggugcccggcg

SEQ ID NO: 3328057 - RNA, 19 nt, Mycobacterium tuberculosis H37Rv
ccgcgaaguugcgggugau

SEQ ID NO: 3328058 - RNA, 22 nt, Mycobacterium tuberculosis H37Rv
ccgcgaauacgaggacgacgau

SEQ ID NO: 3328059 - RNA, 18 nt, Mycobacterium tuberculosis H37Rv
ccgcgaaucaacaggacc

SEQ ID NO: 3328060 - RNA, 16 nt, Mycobacterium tuberculosis H37Rv
ccgcgaaugucgccgc

SEQ ID NO: 3328061 - RNA, 19 nt, Mycobacterium tuberculosis H37Rv
ccgcgaaugugaucacccg

SEQ ID NO: 3328062 - RNA, 20 nt, Mycobacterium tuberculosis H37Rv
ccgcgaaugugaucacccgc

SEQ ID NO: 3328063 - RNA, 23 nt, Mycobacterium tuberculosis H37Rv
ccgcgaauucggcauaacccugg

SEQ ID NO: 3328064 - RNA, 15 nt, Mycobacterium tuberculosis H37Rv
ccgcgacauccgcgg

SEQ ID NO: 3328065 - RNA, 21 nt, Mycobacterium tuberculosis H37Rv
ccgcgaccagcgccgcacccg

SEQ ID NO: 3328066 - RNA, 21 nt, Mycobacterium tuberculosis H37Rv
ccgcgaccccugguagcaccc

SEQ ID NO: 3328067 - RNA, 12 nt, Mycobacterium tuberculosis H37Rv
ccgcgacccggc

SEQ ID NO: 3328068 - RNA, 14 nt, Mycobacterium tuberculosis H37Rv
ccgcgaccgccucg

SEQ ID NO: 3328069 - RNA, 17 nt, Mycobacterium tuberculosis H37Rv
ccgcgaccgccucgccg

SEQ ID NO: 3328070 - RNA, 19 nt, Mycobacterium tuberculosis H37Rv
ccgcgaccgcgaccgcauu

SEQ ID NO: 3328071 - RNA, 14 nt, Mycobacterium tuberculosis H37Rv
ccgcgaccgcgcac

SEQ ID NO: 3328072 - RNA, 20 nt, Mycobacterium tuberculosis H37Rv
ccgcgaccgcgcacggcugg

SEQ ID NO: 3328073 - RNA, 15 nt, Mycobacterium tuberculosis H37Rv
ccgcgaccucgcggc

SEQ ID NO: 3328074 - RNA, 13 nt, Mycobacterium tuberculosis H37Rv
ccgcgacgacacg

SEQ ID NO: 3328075 - RNA, 19 nt, Mycobacterium tuberculosis H37Rv
ccgcgacgcucgcugcagc

SEQ ID NO: 3328076 - RNA, 20 nt, Mycobacterium tuberculosis H37Rv
ccgcgacgcucgcugcagca

SEQ ID NO: 3328077 - RNA, 14 nt, Mycobacterium tuberculosis H37Rv
ccgcgacggaacca

SEQ ID NO: 3328078 - RNA, 16 nt, Mycobacterium tuberculosis H37Rv
ccgcgacggcacgauc

SEQ ID NO: 3328079 - RNA, 13 nt, Mycobacterium tuberculosis H37Rv
ccgcgacggccuu

SEQ ID NO: 3328080 - RNA, 21 nt, Mycobacterium tuberculosis H37Rv
ccgcgacggccuuggcgacgu

SEQ ID NO: 3328081 - RNA, 16 nt, Mycobacterium tuberculosis H37Rv
ccgcgacggcgccggc

SEQ ID NO: 3328082 - RNA, 21 nt, Mycobacterium tuberculosis H37Rv
ccgcgacguugaacucgaguu

SEQ ID NO: 3328083 - RNA, 15 nt, Mycobacterium tuberculosis H37Rv
ccgcgacuuugccuu

SEQ ID NO: 3328084 - RNA, 17 nt, Mycobacterium tuberculosis H37Rv
ccgcgagagaguucgca

SEQ ID NO: 3328085 - RNA, 18 nt, Mycobacterium tuberculosis H37Rv
ccgcgagaucgggccggc

SEQ ID NO: 3328086 - RNA, 14 nt, Mycobacterium tuberculosis H37Rv
ccgcgagcagagga

SEQ ID NO: 3328087 - RNA, 12 nt, Mycobacterium tuberculosis H37Rv
ccgcgagcagca

SEQ ID NO: 3328088 - RNA, 13 nt, Mycobacterium tuberculosis H37Rv
ccgcgagcagcac

SEQ ID NO: 3328089 - RNA, 16 nt, Mycobacterium tuberculosis H37Rv
ccgcgagcagcccggc

SEQ ID NO: 3328090 - RNA, 15 nt, Mycobacterium tuberculosis H37Rv
ccgcgagcccggccu

SEQ ID NO: 3328091 - RNA, 12 nt, Mycobacterium tuberculosis H37Rv
ccgcgagcgcgc

SEQ ID NO: 3328092 - RNA, 23 nt, Mycobacterium tuberculosis H37Rv
ccgcgagcuuggccagcagcagc

SEQ ID NO: 3328093 - RNA, 18 nt, Mycobacterium tuberculosis H37Rv
ccgcgaggcaagaacccg

SEQ ID NO: 3328094 - RNA, 19 nt, Mycobacterium tuberculosis H37Rv
ccgcgaggugaaucgcguc

SEQ ID NO: 3328095 - RNA, 17 nt, Mycobacterium tuberculosis H37Rv
ccgcgagguugaccacc

SEQ ID NO: 3328096 - RNA, 21 nt, Mycobacterium tuberculosis H37Rv
ccgcgagguugaccaccagcg

SEQ ID NO: 3328097 - RNA, 22 nt, Mycobacterium tuberculosis H37Rv
ccgcgaguccaggcugaucccg

SEQ ID NO: 3328098 - RNA, 11 nt, Mycobacterium tuberculosis H37Rv
ccgcgaucacc

SEQ ID NO: 3328099 - RNA, 19 nt, Mycobacterium tuberculosis H37Rv
ccgcgaucaccaccggauc

SEQ ID NO: 3328100 - RNA, 15 nt, Mycobacterium tuberculosis H37Rv
ccgcgaucaccgacg

SEQ ID NO: 3328101 - RNA, 13 nt, Mycobacterium tuberculosis H37Rv
ccgcgauccccac

SEQ ID NO: 3328102 - RNA, 16 nt, Mycobacterium tuberculosis H37Rv
ccgcgaucgccgacgc

SEQ ID NO: 3328103 - RNA, 15 nt, Mycobacterium tuberculosis H37Rv
ccgcgaucgcgacac

SEQ ID NO: 3328104 - RNA, 19 nt, Mycobacterium tuberculosis H37Rv
ccgcgaucgcgacacggcc

SEQ ID NO: 3328105 - RNA, 14 nt, Mycobacterium tuberculosis H37Rv
ccgcgaucggcuga

SEQ ID NO: 3328106 - RNA, 15 nt, Mycobacterium tuberculosis H37Rv
ccgcgaucggcugac

SEQ ID NO: 3328107 - RNA, 17 nt, Mycobacterium tuberculosis H37Rv
ccgcgaucgggccgauc

SEQ ID NO: 3328108 - RNA, 20 nt, Mycobacterium tuberculosis H37Rv
ccgcgaucgugcagguugcc

SEQ ID NO: 3328109 - RNA, 15 nt, Mycobacterium tuberculosis H37Rv
ccgcgaucucggagc

SEQ ID NO: 3328110 - RNA, 21 nt, Mycobacterium tuberculosis H37Rv
ccgcgaugacggugccgaccg

SEQ ID NO: 3328111 - RNA, 13 nt, Mycobacterium tuberculosis H37Rv
ccgcgaugagcgg

SEQ ID NO: 3328112 - RNA, 19 nt, Mycobacterium tuberculosis H37Rv
ccgcgaugauaccugccca

SEQ ID NO: 3328113 - RNA, 21 nt, Mycobacterium tuberculosis H37Rv
ccgcgaugauaccugcccacg

SEQ ID NO: 3328114 - RNA, 14 nt, Mycobacterium tuberculosis H37Rv
ccgcgaugaucgca

SEQ ID NO: 3328115 - RNA, 14 nt, Mycobacterium tuberculosis H37Rv
ccgcgaugcgcacc

SEQ ID NO: 3328116 - RNA, 20 nt, Mycobacterium tuberculosis H37Rv
ccgcgaugcgcaccagcggc

SEQ ID NO: 3328117 - RNA, 20 nt, Mycobacterium tuberculosis H37Rv
ccgcgauggccgcgugcagc

SEQ ID NO: 3328118 - RNA, 14 nt, Mycobacterium tuberculosis H37Rv
ccgcgaugugccca

SEQ ID NO: 3328119 - RNA, 21 nt, Mycobacterium tuberculosis H37Rv
ccgcgauuagcaaaccgaccg

SEQ ID NO: 3328120 - RNA, 22 nt, Mycobacterium tuberculosis H37Rv
ccgcgauuagcaaaccgaccgu

SEQ ID NO: 3328121 - RNA, 20 nt, Mycobacterium tuberculosis H37Rv
ccgcgauucgcggcagccgg

SEQ ID NO: 3328122 - RNA, 15 nt, Mycobacterium tuberculosis H37Rv
ccgcgcaccaacacc

SEQ ID NO: 3328123 - RNA, 21 nt, Mycobacterium tuberculosis H37Rv
ccgcgcacccguccgccgcag

SEQ ID NO: 3328124 - RNA, 13 nt, Mycobacterium tuberculosis H37Rv
ccgcgcagcggug

SEQ ID NO: 3328125 - RNA, 14 nt, Mycobacterium tuberculosis H37Rv
ccgcgcagcgucaa

SEQ ID NO: 3328126 - RNA, 13 nt, Mycobacterium tuberculosis H37Rv
ccgcgcagcugcc

SEQ ID NO: 3328127 - RNA, 17 nt, Mycobacterium tuberculosis H37Rv
ccgcgcaucaucgccca

SEQ ID NO: 3328128 - RNA, 17 nt, Mycobacterium tuberculosis H37Rv
ccgcgcaucugucgcgc

SEQ ID NO: 3328129 - RNA, 20 nt, Mycobacterium tuberculosis H37Rv
ccgcgccagccuccaccagg

SEQ ID NO: 3328130 - RNA, 21 nt, Mycobacterium tuberculosis H37Rv
ccgcgccauagcagagccggg

SEQ ID NO: 3328131 - RNA, 17 nt, Mycobacterium tuberculosis H37Rv
ccgcgcccaccccggcc

SEQ ID NO: 3328132 - RNA, 17 nt, Mycobacterium tuberculosis H37Rv
ccgcgccccagacgcgc

SEQ ID NO: 3328133 - RNA, 19 nt, Mycobacterium tuberculosis H37Rv
ccgcgcccgagaccggcac

SEQ ID NO: 3328134 - RNA, 15 nt, Mycobacterium tuberculosis H37Rv
ccgcgcccgccgcgg

SEQ ID NO: 3328135 - RNA, 23 nt, Mycobacterium tuberculosis H37Rv
ccgcgcccgcgggcaguggcagc

SEQ ID NO: 3328136 - RNA, 22 nt, Mycobacterium tuberculosis H37Rv
ccgcgcccggcgcaagcgccgc

SEQ ID NO: 3328137 - RNA, 14 nt, Mycobacterium tuberculosis H37Rv
ccgcgccgaacacg

SEQ ID NO: 3328138 - RNA, 18 nt, Mycobacterium tuberculosis H37Rv
ccgcgccgaaucgcgggc

SEQ ID NO: 3328139 - RNA, 22 nt, Mycobacterium tuberculosis H37Rv
ccgcgccgacacguugcagcuc

SEQ ID NO: 3328140 - RNA, 18 nt, Mycobacterium tuberculosis H37Rv
ccgcgccgacgccgcgga

SEQ ID NO: 3328141 - RNA, 18 nt, Mycobacterium tuberculosis H37Rv
ccgcgccgacggccagca

SEQ ID NO: 3328142 - RNA, 13 nt, Mycobacterium tuberculosis H37Rv
ccgcgccgagcag

SEQ ID NO: 3328143 - RNA, 12 nt, Mycobacterium tuberculosis H37Rv
ccgcgccgagcc

SEQ ID NO: 3328144 - RNA, 17 nt, Mycobacterium tuberculosis H37Rv
ccgcgccgaucaccacc

SEQ ID NO: 3328145 - RNA, 21 nt, Mycobacterium tuberculosis H37Rv
ccgcgccgaucaccaccggca

SEQ ID NO: 3328146 - RNA, 16 nt, Mycobacterium tuberculosis H37Rv
ccgcgccgccccgcuc

SEQ ID NO: 3328147 - RNA, 19 nt, Mycobacterium tuberculosis H37Rv
ccgcgccgccccgcucggu

SEQ ID NO: 3328148 - RNA, 22 nt, Mycobacterium tuberculosis H37Rv
ccgcgccgcccgcuccuccggc

SEQ ID NO: 3328149 - RNA, 19 nt, Mycobacterium tuberculosis H37Rv
ccgcgccgccggacccacc

SEQ ID NO: 3328150 - RNA, 11 nt, Mycobacterium tuberculosis H37Rv
ccgcgccgccu

SEQ ID NO: 3328151 - RNA, 16 nt, Mycobacterium tuberculosis H37Rv
ccgcgccggcggaagc

SEQ ID NO: 3328152 - RNA, 15 nt, Mycobacterium tuberculosis H37Rv
ccgcgccgucggcga

SEQ ID NO: 3328153 - RNA, 23 nt, Mycobacterium tuberculosis H37Rv
ccgcgccgucgucgagcaccacc

SEQ ID NO: 3328154 - RNA, 15 nt, Mycobacterium tuberculosis H37Rv
ccgcgccgucgucgc

SEQ ID NO: 3328155 - RNA, 19 nt, Mycobacterium tuberculosis H37Rv
ccgcgccgucgucgcgcag

SEQ ID NO: 3328156 - RNA, 17 nt, Mycobacterium tuberculosis H37Rv
ccgcgccugccucaccg

SEQ ID NO: 3328157 - RNA, 20 nt, Mycobacterium tuberculosis H37Rv
ccgcgccugccucaccgccg

SEQ ID NO: 3328158 - RNA, 15 nt, Mycobacterium tuberculosis H37Rv
ccgcgcgacaggccc

SEQ ID NO: 3328159 - RNA, 18 nt, Mycobacterium tuberculosis H37Rv
ccgcgcgaccugaaugcg

SEQ ID NO: 3328160 - RNA, 21 nt, Mycobacterium tuberculosis H37Rv
ccgcgcgacgccguccucgcu

SEQ ID NO: 3328161 - RNA, 23 nt, Mycobacterium tuberculosis H37Rv
ccgcgcgagagccuccauggccu

SEQ ID NO: 3328162 - RNA, 13 nt, Mycobacterium tuberculosis H37Rv
ccgcgcgcaccgg

SEQ ID NO: 3328163 - RNA, 20 nt, Mycobacterium tuberculosis H37Rv
ccgcgcgcacggcgucggcc

SEQ ID NO: 3328164 - RNA, 21 nt, Mycobacterium tuberculosis H37Rv
ccgcgcgcaucgcgccuuuga

SEQ ID NO: 3328165 - RNA, 15 nt, Mycobacterium tuberculosis H37Rv
ccgcgcgcggacagc

SEQ ID NO: 3328166 - RNA, 17 nt, Mycobacterium tuberculosis H37Rv
ccgcgcgcucgagcagg

SEQ ID NO: 3328167 - RNA, 12 nt, Mycobacterium tuberculosis H37Rv
ccgcgcggcacu

SEQ ID NO: 3328168 - RNA, 17 nt, Mycobacterium tuberculosis H37Rv
ccgcgcggcgagagccu

SEQ ID NO: 3328169 - RNA, 18 nt, Mycobacterium tuberculosis H37Rv
ccgcgcggcgagagccuc

SEQ ID NO: 3328170 - RNA, 19 nt, Mycobacterium tuberculosis H37Rv
ccgcgcggcgagagccucg

SEQ ID NO: 3328171 - RNA, 13 nt, Mycobacterium tuberculosis H37Rv
ccgcgcggcgcau

SEQ ID NO: 3328172 - RNA, 19 nt, Mycobacterium tuberculosis H37Rv
ccgcgcggcgcauuccggc

SEQ ID NO: 3328173 - RNA, 14 nt, Mycobacterium tuberculosis H37Rv
ccgcgcggcggcgc

SEQ ID NO: 3328174 - RNA, 14 nt, Mycobacterium tuberculosis H37Rv
ccgcgcggcgugcu

SEQ ID NO: 3328175 - RNA, 15 nt, Mycobacterium tuberculosis H37Rv
ccgcgcgggccgccg

SEQ ID NO: 3328176 - RNA, 16 nt, Mycobacterium tuberculosis H37Rv
ccgcgcgggccgccgc

SEQ ID NO: 3328177 - RNA, 17 nt, Mycobacterium tuberculosis H37Rv
ccgcgcgguacugcgca

SEQ ID NO: 3328178 - RNA, 18 nt, Mycobacterium tuberculosis H37Rv
ccgcgcgguacugcgcag

SEQ ID NO: 3328179 - RNA, 20 nt, Mycobacterium tuberculosis H37Rv
ccgcgcguaauccgagcgcg

SEQ ID NO: 3328180 - RNA, 15 nt, Mycobacterium tuberculosis H37Rv
ccgcgcgucgcccag

SEQ ID NO: 3328181 - RNA, 13 nt, Mycobacterium tuberculosis H37Rv
ccgcgcguucggc

SEQ ID NO: 3328182 - RNA, 15 nt, Mycobacterium tuberculosis H37Rv
ccgcgcguucggcga

SEQ ID NO: 3328183 - RNA, 16 nt, Mycobacterium tuberculosis H37Rv
ccgcgcguucggcgag

SEQ ID NO: 3328184 - RNA, 20 nt, Mycobacterium tuberculosis H37Rv
ccgcgcguucggcgagcagc

SEQ ID NO: 3328185 - RNA, 22 nt, Mycobacterium tuberculosis H37Rv
ccgcgcguucggcgagcagcgc

SEQ ID NO: 3328186 - RNA, 20 nt, Mycobacterium tuberculosis H37Rv
ccgcgcuaaugucgauuucg

SEQ ID NO: 3328187 - RNA, 21 nt, Mycobacterium tuberculosis H37Rv
ccgcgcucaccggggccgucg

SEQ ID NO: 3328188 - RNA, 23 nt, Mycobacterium tuberculosis H37Rv
ccgcgcucaucugcgcgcggaag

SEQ ID NO: 3328189 - RNA, 13 nt, Mycobacterium tuberculosis H37Rv
ccgcgcucccggc

SEQ ID NO: 3328190 - RNA, 18 nt, Mycobacterium tuberculosis H37Rv
ccgcgcucgaacuccccg

SEQ ID NO: 3328191 - RNA, 21 nt, Mycobacterium tuberculosis H37Rv
ccgcgcucgaacuccccgguc

SEQ ID NO: 3328192 - RNA, 23 nt, Mycobacterium tuberculosis H37Rv
ccgcgcucgcacccgcucggcgc

SEQ ID NO: 3328193 - RNA, 13 nt, Mycobacterium tuberculosis H37Rv
ccgcgcucgccga

SEQ ID NO: 3328194 - RNA, 16 nt, Mycobacterium tuberculosis H37Rv
ccgcgcucucggucag

SEQ ID NO: 3328195 - RNA, 15 nt, Mycobacterium tuberculosis H37Rv
ccgcgcuggucagcc

SEQ ID NO: 3328196 - RNA, 23 nt, Mycobacterium tuberculosis H37Rv
ccgcgcuggucagccgugccgug

SEQ ID NO: 3328197 - RNA, 22 nt, Mycobacterium tuberculosis H37Rv
ccgcgcuggucggagaccagcg

SEQ ID NO: 3328198 - RNA, 20 nt, Mycobacterium tuberculosis H37Rv
ccgcgcuggugauucgcagc

SEQ ID NO: 3328199 - RNA, 23 nt, Mycobacterium tuberculosis H37Rv
ccgcgcugguugaacauguccag

SEQ ID NO: 3328200 - RNA, 22 nt, Mycobacterium tuberculosis H37Rv
ccgcgcuucacagccaccagcc

SEQ ID NO: 3328201 - RNA, 19 nt, Mycobacterium tuberculosis H37Rv
ccgcgcuugcgaucgccgc

SEQ ID NO: 3328202 - RNA, 20 nt, Mycobacterium tuberculosis H37Rv
ccgcgcuugcgaucggcacu

SEQ ID NO: 3328203 - RNA, 19 nt, Mycobacterium tuberculosis H37Rv
ccgcgcuugguccugcggu

SEQ ID NO: 3328204 - RNA, 16 nt, Mycobacterium tuberculosis H37Rv
ccgcggaaggccagcu

SEQ ID NO: 3328205 - RNA, 20 nt, Mycobacterium tuberculosis H37Rv
ccgcggaauccgcggcgauc

SEQ ID NO: 3328206 - RNA, 20 nt, Mycobacterium tuberculosis H37Rv
ccgcggaccggcgucggcug

SEQ ID NO: 3328207 - RNA, 22 nt, Mycobacterium tuberculosis H37Rv
ccgcggacgugccggucccccc

SEQ ID NO: 3328208 - RNA, 16 nt, Mycobacterium tuberculosis H37Rv
ccgcggacucgggcag

SEQ ID NO: 3328209 - RNA, 22 nt, Mycobacterium tuberculosis H37Rv
ccgcggacucgggcaggcccca

SEQ ID NO: 3328210 - RNA, 16 nt, Mycobacterium tuberculosis H37Rv
ccgcggacugguauuc

SEQ ID NO: 3328211 - RNA, 19 nt, Mycobacterium tuberculosis H37Rv
ccgcggacuugcgagccgu

SEQ ID NO: 3328212 - RNA, 20 nt, Mycobacterium tuberculosis H37Rv
ccgcggacuugcgagccgua

SEQ ID NO: 3328213 - RNA, 18 nt, Mycobacterium tuberculosis H37Rv
ccgcggacuuggcggucg

SEQ ID NO: 3328214 - RNA, 17 nt, Mycobacterium tuberculosis H37Rv
ccgcggaggcggccagc

SEQ ID NO: 3328215 - RNA, 18 nt, Mycobacterium tuberculosis H37Rv
ccgcggaggcggccagcc

SEQ ID NO: 3328216 - RNA, 17 nt, Mycobacterium tuberculosis H37Rv
ccgcggauaggccgcgc

SEQ ID NO: 3328217 - RNA, 20 nt, Mycobacterium tuberculosis H37Rv
ccgcggaucaccaucgccgc

SEQ ID NO: 3328218 - RNA, 23 nt, Mycobacterium tuberculosis H37Rv
ccgcggaucaccaucgccgccgc

SEQ ID NO: 3328219 - RNA, 21 nt, Mycobacterium tuberculosis H37Rv
ccgcggaucauccuucgccgg

SEQ ID NO: 3328220 - RNA, 22 nt, Mycobacterium tuberculosis H37Rv
ccgcggaucauccuucgccggc

SEQ ID NO: 3328221 - RNA, 21 nt, Mycobacterium tuberculosis H37Rv
ccgcggaucgaccgccagcgc

SEQ ID NO: 3328222 - RNA, 16 nt, Mycobacterium tuberculosis H37Rv
ccgcggcaacaccacc

SEQ ID NO: 3328223 - RNA, 14 nt, Mycobacterium tuberculosis H37Rv
ccgcggcacccggc

SEQ ID NO: 3328224 - RNA, 12 nt, Mycobacterium tuberculosis H37Rv
ccgcggcacgcu

SEQ ID NO: 3328225 - RNA, 13 nt, Mycobacterium tuberculosis H37Rv
ccgcggcagcacg

SEQ ID NO: 3328226 - RNA, 20 nt, Mycobacterium tuberculosis H37Rv
ccgcggcagcauccucgacu

SEQ ID NO: 3328227 - RNA, 15 nt, Mycobacterium tuberculosis H37Rv
ccgcggcagcggaua

SEQ ID NO: 3328228 - RNA, 22 nt, Mycobacterium tuberculosis H37Rv
ccgcggcagcguugacggucag

SEQ ID NO: 3328229 - RNA, 16 nt, Mycobacterium tuberculosis H37Rv
ccgcggcaugauuuuu

SEQ ID NO: 3328230 - RNA, 17 nt, Mycobacterium tuberculosis H37Rv
ccgcggcaugcaaugcu

SEQ ID NO: 3328231 - RNA, 18 nt, Mycobacterium tuberculosis H37Rv
ccgcggccacaucgccag

SEQ ID NO: 3328232 - RNA, 15 nt, Mycobacterium tuberculosis H37Rv
ccgcggccaccgccg

SEQ ID NO: 3328233 - RNA, 18 nt, Mycobacterium tuberculosis H37Rv
ccgcggccaccgccgccg

SEQ ID NO: 3328234 - RNA, 19 nt, Mycobacterium tuberculosis H37Rv
ccgcggccaccgccgccgc

SEQ ID NO: 3328235 - RNA, 15 nt, Mycobacterium tuberculosis H37Rv
ccgcggccagcagca

SEQ ID NO: 3328236 - RNA, 23 nt, Mycobacterium tuberculosis H37Rv
ccgcggcccucgaugccgcguag

SEQ ID NO: 3328237 - RNA, 15 nt, Mycobacterium tuberculosis H37Rv
ccgcggccgggccgc

SEQ ID NO: 3328238 - RNA, 23 nt, Mycobacterium tuberculosis H37Rv
ccgcggccucguagucccacugc

SEQ ID NO: 3328239 - RNA, 20 nt, Mycobacterium tuberculosis H37Rv
ccgcggcgaaccagcgcguc

SEQ ID NO: 3328240 - RNA, 14 nt, Mycobacterium tuberculosis H37Rv
ccgcggcgaagaua

SEQ ID NO: 3328241 - RNA, 15 nt, Mycobacterium tuberculosis H37Rv
ccgcggcgaagcaag

SEQ ID NO: 3328242 - RNA, 20 nt, Mycobacterium tuberculosis H37Rv
ccgcggcgaucuuggaucgg

SEQ ID NO: 3328243 - RNA, 13 nt, Mycobacterium tuberculosis H37Rv
ccgcggcgcagca

SEQ ID NO: 3328244 - RNA, 15 nt, Mycobacterium tuberculosis H37Rv
ccgcggcgcagcacg

SEQ ID NO: 3328245 - RNA, 19 nt, Mycobacterium tuberculosis H37Rv
ccgcggcgcagcacggcgg

SEQ ID NO: 3328246 - RNA, 14 nt, Mycobacterium tuberculosis H37Rv
ccgcggcgccaccc

SEQ ID NO: 3328247 - RNA, 15 nt, Mycobacterium tuberculosis H37Rv
ccgcggcgccgccac

SEQ ID NO: 3328248 - RNA, 18 nt, Mycobacterium tuberculosis H37Rv
ccgcggcgccguugccgc

SEQ ID NO: 3328249 - RNA, 13 nt, Mycobacterium tuberculosis H37Rv
ccgcggcgcgcaa

SEQ ID NO: 3328250 - RNA, 14 nt, Mycobacterium tuberculosis H37Rv
ccgcggcgcggaga

SEQ ID NO: 3328251 - RNA, 20 nt, Mycobacterium tuberculosis H37Rv
ccgcggcgcugaugccgucu

SEQ ID NO: 3328252 - RNA, 12 nt, Mycobacterium tuberculosis H37Rv
ccgcggcggaug

SEQ ID NO: 3328253 - RNA, 14 nt, Mycobacterium tuberculosis H37Rv
ccgcggcggcagcg

SEQ ID NO: 3328254 - RNA, 17 nt, Mycobacterium tuberculosis H37Rv
ccgcggcggcagcggcg

SEQ ID NO: 3328255 - RNA, 13 nt, Mycobacterium tuberculosis H37Rv
ccgcggcggccag

SEQ ID NO: 3328256 - RNA, 15 nt, Mycobacterium tuberculosis H37Rv
ccgcggcggccagcg

SEQ ID NO: 3328257 - RNA, 13 nt, Mycobacterium tuberculosis H37Rv
ccgcggcggcccc

SEQ ID NO: 3328258 - RNA, 11 nt, Mycobacterium tuberculosis H37Rv
ccgcggcggcg

SEQ ID NO: 3328259 - RNA, 16 nt, Mycobacterium tuberculosis H37Rv
ccgcggcgucgugaga

SEQ ID NO: 3328260 - RNA, 15 nt, Mycobacterium tuberculosis H37Rv
ccgcggcuaggccag

SEQ ID NO: 3328261 - RNA, 19 nt, Mycobacterium tuberculosis H37Rv
ccgcggcugggggauaccg

SEQ ID NO: 3328262 - RNA, 19 nt, Mycobacterium tuberculosis H37Rv
ccgcggcugucacgccugc

SEQ ID NO: 3328263 - RNA, 19 nt, Mycobacterium tuberculosis H37Rv
ccgcgggacagauggcggc

SEQ ID NO: 3328264 - RNA, 16 nt, Mycobacterium tuberculosis H37Rv
ccgcgggacaucaccg

SEQ ID NO: 3328265 - RNA, 16 nt, Mycobacterium tuberculosis H37Rv
ccgcgggaucgguggc

SEQ ID NO: 3328266 - RNA, 19 nt, Mycobacterium tuberculosis H37Rv
ccgcgggaucgguggcggc

SEQ ID NO: 3328267 - RNA, 21 nt, Mycobacterium tuberculosis H37Rv
ccgcgggcaccuuccacgauc

SEQ ID NO: 3328268 - RNA, 13 nt, Mycobacterium tuberculosis H37Rv
ccgcgggccgcca

SEQ ID NO: 3328269 - RNA, 14 nt, Mycobacterium tuberculosis H37Rv
ccgcgggcgaaccg

SEQ ID NO: 3328270 - RNA, 14 nt, Mycobacterium tuberculosis H37Rv
ccgcgggcggcauc

SEQ ID NO: 3328271 - RNA, 17 nt, Mycobacterium tuberculosis H37Rv
ccgcgggcggcaucgcc

SEQ ID NO: 3328272 - RNA, 20 nt, Mycobacterium tuberculosis H37Rv
ccgcgggcggcaucgccgag

SEQ ID NO: 3328273 - RNA, 15 nt, Mycobacterium tuberculosis H37Rv
ccgcgggggaccgcc

SEQ ID NO: 3328274 - RNA, 16 nt, Mycobacterium tuberculosis H37Rv
ccgcgggggaccgccc

SEQ ID NO: 3328275 - RNA, 23 nt, Mycobacterium tuberculosis H37Rv
ccgcggguagcgguucaucaccg

SEQ ID NO: 3328276 - RNA, 16 nt, Mycobacterium tuberculosis H37Rv
ccgcgggucgugccag

SEQ ID NO: 3328277 - RNA, 17 nt, Mycobacterium tuberculosis H37Rv
ccgcgggugcggcaugg

SEQ ID NO: 3328278 - RNA, 21 nt, Mycobacterium tuberculosis H37Rv
ccgcggguuugaucuccaccu

SEQ ID NO: 3328279 - RNA, 18 nt, Mycobacterium tuberculosis H37Rv
ccgcgguacgccggucgg

SEQ ID NO: 3328280 - RNA, 21 nt, Mycobacterium tuberculosis H37Rv
ccgcgguacgccggucggugc

SEQ ID NO: 3328281 - RNA, 17 nt, Mycobacterium tuberculosis H37Rv
ccgcgguaggugcaugu

SEQ ID NO: 3328282 - RNA, 19 nt, Mycobacterium tuberculosis H37Rv
ccgcggucagcucggcagc

SEQ ID NO: 3328283 - RNA, 13 nt, Mycobacterium tuberculosis H37Rv
ccgcggucgauca

SEQ ID NO: 3328284 - RNA, 23 nt, Mycobacterium tuberculosis H37Rv
ccgcggucgaucaggccguguac

SEQ ID NO: 3328285 - RNA, 14 nt, Mycobacterium tuberculosis H37Rv
ccgcggucgcagca

SEQ ID NO: 3328286 - RNA, 22 nt, Mycobacterium tuberculosis H37Rv
ccgcggucgccaagaucgggug

SEQ ID NO: 3328287 - RNA, 14 nt, Mycobacterium tuberculosis H37Rv
ccgcggucggacca

SEQ ID NO: 3328288 - RNA, 20 nt, Mycobacterium tuberculosis H37Rv
ccgcggucggaccacccggc

SEQ ID NO: 3328289 - RNA, 13 nt, Mycobacterium tuberculosis H37Rv
ccgcggucggcgu

SEQ ID NO: 3328290 - RNA, 13 nt, Mycobacterium tuberculosis H37Rv
ccgcggucugcgc

SEQ ID NO: 3328291 - RNA, 21 nt, Mycobacterium tuberculosis H37Rv
ccgcggucugcgccuucgcca

SEQ ID NO: 3328292 - RNA, 22 nt, Mycobacterium tuberculosis H37Rv
ccgcggucuucuucaccgccuu

SEQ ID NO: 3328293 - RNA, 20 nt, Mycobacterium tuberculosis H37Rv
ccgcggugaccaccccggcc

SEQ ID NO: 3328294 - RNA, 14 nt, Mycobacterium tuberculosis H37Rv
ccgcggugacgcaa

SEQ ID NO: 3328295 - RNA, 16 nt, Mycobacterium tuberculosis H37Rv
ccgcggugacgcaaca

SEQ ID NO: 3328296 - RNA, 17 nt, Mycobacterium tuberculosis H37Rv
ccgcggugacgccagcc

SEQ ID NO: 3328297 - RNA, 18 nt, Mycobacterium tuberculosis H37Rv
ccgcgguggaccgggcaa

SEQ ID NO: 3328298 - RNA, 21 nt, Mycobacterium tuberculosis H37Rv
ccgcgguguauccgacgucgg

SEQ ID NO: 3328299 - RNA, 21 nt, Mycobacterium tuberculosis H37Rv
ccgcggugugcacgucacgcg

SEQ ID NO: 3328300 - RNA, 17 nt, Mycobacterium tuberculosis H37Rv
ccgcgguuggcaguggc

SEQ ID NO: 3328301 - RNA, 22 nt, Mycobacterium tuberculosis H37Rv
ccgcgguuggcaguggcgcggc

SEQ ID NO: 3328302 - RNA, 22 nt, Mycobacterium tuberculosis H37Rv
ccgcgguugugcugggugccgc

SEQ ID NO: 3328303 - RNA, 23 nt, Mycobacterium tuberculosis H37Rv
ccgcgguugugcugggugccgca

SEQ ID NO: 3328304 - RNA, 23 nt, Mycobacterium tuberculosis H37Rv
ccgcguaauucgacuucgggguc

SEQ ID NO: 3328305 - RNA, 20 nt, Mycobacterium tuberculosis H37Rv
ccgcguagaccagugaccgc

SEQ ID NO: 3328306 - RNA, 15 nt, Mycobacterium tuberculosis H37Rv
ccgcguagagcagca

SEQ ID NO: 3328307 - RNA, 17 nt, Mycobacterium tuberculosis H37Rv
ccgcguagagcagcagc

SEQ ID NO: 3328308 - RNA, 17 nt, Mycobacterium tuberculosis H37Rv
ccgcguagguggccagc

SEQ ID NO: 3328309 - RNA, 17 nt, Mycobacterium tuberculosis H37Rv
ccgcguaguccaggccg

SEQ ID NO: 3328310 - RNA, 20 nt, Mycobacterium tuberculosis H37Rv
ccgcguagugguggaagugu

SEQ ID NO: 3328311 - RNA, 18 nt, Mycobacterium tuberculosis H37Rv
ccgcguaugccaggacug

SEQ ID NO: 3328312 - RNA, 18 nt, Mycobacterium tuberculosis H37Rv
ccgcgucaaccgaucggu

SEQ ID NO: 3328313 - RNA, 19 nt, Mycobacterium tuberculosis H37Rv
ccgcgucaaccgaucgguc

SEQ ID NO: 3328314 - RNA, 13 nt, Mycobacterium tuberculosis H37Rv
ccgcgucacccgu

SEQ ID NO: 3328315 - RNA, 12 nt, Mycobacterium tuberculosis H37Rv
ccgcgucaccgg

SEQ ID NO: 3328316 - RNA, 20 nt, Mycobacterium tuberculosis H37Rv
ccgcgucaccggaggccgcc

SEQ ID NO: 3328317 - RNA, 17 nt, Mycobacterium tuberculosis H37Rv
ccgcgucacggaccugg

SEQ ID NO: 3328318 - RNA, 19 nt, Mycobacterium tuberculosis H37Rv
ccgcguccuuuuccgccgg

SEQ ID NO: 3328319 - RNA, 22 nt, Mycobacterium tuberculosis H37Rv
ccgcgucgaacugggcgcccgc

SEQ ID NO: 3328320 - RNA, 15 nt, Mycobacterium tuberculosis H37Rv
ccgcgucgagcaccu

SEQ ID NO: 3328321 - RNA, 15 nt, Mycobacterium tuberculosis H37Rv
ccgcgucgccggccu

SEQ ID NO: 3328322 - RNA, 12 nt, Mycobacterium tuberculosis H37Rv
ccgcgucggccg

SEQ ID NO: 3328323 - RNA, 20 nt, Mycobacterium tuberculosis H37Rv
ccgcgucggccgaacaaccu

SEQ ID NO: 3328324 - RNA, 16 nt, Mycobacterium tuberculosis H37Rv
ccgcgucggcggccag

SEQ ID NO: 3328325 - RNA, 12 nt, Mycobacterium tuberculosis H37Rv
ccgcgucggcgu

SEQ ID NO: 3328326 - RNA, 15 nt, Mycobacterium tuberculosis H37Rv
ccgcgucgggccgca

SEQ ID NO: 3328327 - RNA, 14 nt, Mycobacterium tuberculosis H37Rv
ccgcgucgucggcc

SEQ ID NO: 3328328 - RNA, 19 nt, Mycobacterium tuberculosis H37Rv
ccgcgucuacgucguccag

SEQ ID NO: 3328329 - RNA, 18 nt, Mycobacterium tuberculosis H37Rv
ccgcgucucggugcagca

SEQ ID NO: 3328330 - RNA, 13 nt, Mycobacterium tuberculosis H37Rv
ccgcgucugcucg

SEQ ID NO: 3328331 - RNA, 23 nt, Mycobacterium tuberculosis H37Rv
ccgcgucuuggugcgcgucagcc

SEQ ID NO: 3328332 - RNA, 17 nt, Mycobacterium tuberculosis H37Rv
ccgcgugagcagacgca

SEQ ID NO: 3328333 - RNA, 17 nt, Mycobacterium tuberculosis H37Rv
ccgcgugcaccgagccg

SEQ ID NO: 3328334 - RNA, 20 nt, Mycobacterium tuberculosis H37Rv
ccgcgugcaccgagccgucg

SEQ ID NO: 3328335 - RNA, 14 nt, Mycobacterium tuberculosis H37Rv
ccgcgugcgucagc

SEQ ID NO: 3328336 - RNA, 20 nt, Mycobacterium tuberculosis H37Rv
ccgcgugcucgagcaccucg

SEQ ID NO: 3328337 - RNA, 21 nt, Mycobacterium tuberculosis H37Rv
ccgcgugcugcggcugguguc

SEQ ID NO: 3328338 - RNA, 19 nt, Mycobacterium tuberculosis H37Rv
ccgcgugggcaugcggauu

SEQ ID NO: 3328339 - RNA, 19 nt, Mycobacterium tuberculosis H37Rv
ccgcguggucggcgaacgc

SEQ ID NO: 3328340 - RNA, 19 nt, Mycobacterium tuberculosis H37Rv
ccgcguggugcugaccgcg

SEQ ID NO: 3328341 - RNA, 19 nt, Mycobacterium tuberculosis H37Rv
ccgcgugguuccggcgugc

SEQ ID NO: 3328342 - RNA, 21 nt, Mycobacterium tuberculosis H37Rv
ccgcguucugguuguugccga

SEQ ID NO: 3328343 - RNA, 23 nt, Mycobacterium tuberculosis H37Rv
ccgcguucugguuguugccgacg

SEQ ID NO: 3328344 - RNA, 16 nt, Mycobacterium tuberculosis H37Rv
ccgcguugaaggcgcc

SEQ ID NO: 3328345 - RNA, 18 nt, Mycobacterium tuberculosis H37Rv
ccgcguugaugaccaggu

SEQ ID NO: 3328346 - RNA, 15 nt, Mycobacterium tuberculosis H37Rv
ccgcguugaugaccg

SEQ ID NO: 3328347 - RNA, 21 nt, Mycobacterium tuberculosis H37Rv
ccgcguugccaaagcccacac

SEQ ID NO: 3328348 - RNA, 13 nt, Mycobacterium tuberculosis H37Rv
ccgcguuguccgc

SEQ ID NO: 3328349 - RNA, 23 nt, Mycobacterium tuberculosis H37Rv
ccgcguuuauaccucgccgcccu

SEQ ID NO: 3328350 - RNA, 23 nt, Mycobacterium tuberculosis H37Rv
ccgcguuucgcgacgucugccag

SEQ ID NO: 3328351 - RNA, 16 nt, Mycobacterium tuberculosis H37Rv
ccgcguuucggucguu

SEQ ID NO: 3328352 - RNA, 13 nt, Mycobacterium tuberculosis H37Rv
ccgcguuugcgaa

SEQ ID NO: 3328353 - RNA, 22 nt, Mycobacterium tuberculosis H37Rv
ccgcuaacuggcccggacaugc

SEQ ID NO: 3328354 - RNA, 14 nt, Mycobacterium tuberculosis H37Rv
ccgcuaauggaucc

SEQ ID NO: 3328355 - RNA, 16 nt, Mycobacterium tuberculosis H37Rv
ccgcuacaccugcggc

SEQ ID NO: 3328356 - RNA, 16 nt, Mycobacterium tuberculosis H37Rv
ccgcuaccagcugggc

SEQ ID NO: 3328357 - RNA, 18 nt, Mycobacterium tuberculosis H37Rv
ccgcuaccagcugggcga

SEQ ID NO: 3328358 - RNA, 12 nt, Mycobacterium tuberculosis H37Rv
ccgcuacccccg

SEQ ID NO: 3328359 - RNA, 21 nt, Mycobacterium tuberculosis H37Rv
ccgcuacccggacagggcggc

SEQ ID NO: 3328360 - RNA, 13 nt, Mycobacterium tuberculosis H37Rv
ccgcuaccgcaca

SEQ ID NO: 3328361 - RNA, 21 nt, Mycobacterium tuberculosis H37Rv
ccgcuaccguuguugaggaug

SEQ ID NO: 3328362 - RNA, 14 nt, Mycobacterium tuberculosis H37Rv
ccgcuacgccggcc

SEQ ID NO: 3328363 - RNA, 14 nt, Mycobacterium tuberculosis H37Rv
ccgcuacgcgcgcu

SEQ ID NO: 3328364 - RNA, 20 nt, Mycobacterium tuberculosis H37Rv
ccgcuacgcgcgcucgcuca

SEQ ID NO: 3328365 - RNA, 21 nt, Mycobacterium tuberculosis H37Rv
ccgcuacgcgcgcucgcucac

SEQ ID NO: 3328366 - RNA, 22 nt, Mycobacterium tuberculosis H37Rv
ccgcuacucgugaagugcuuug

SEQ ID NO: 3328367 - RNA, 20 nt, Mycobacterium tuberculosis H37Rv
ccgcuagcgcuugcgacccc

SEQ ID NO: 3328368 - RNA, 13 nt, Mycobacterium tuberculosis H37Rv
ccgcuagcggauu

SEQ ID NO: 3328369 - RNA, 15 nt, Mycobacterium tuberculosis H37Rv
ccgcuagcggauuca

SEQ ID NO: 3328370 - RNA, 16 nt, Mycobacterium tuberculosis H37Rv
ccgcuaggucagguga

SEQ ID NO: 3328371 - RNA, 19 nt, Mycobacterium tuberculosis H37Rv
ccgcuaggugacgccgcca

SEQ ID NO: 3328372 - RNA, 21 nt, Mycobacterium tuberculosis H37Rv
ccgcuaugcaggucacugggu

SEQ ID NO: 3328373 - RNA, 16 nt, Mycobacterium tuberculosis H37Rv
ccgcuauggcccgggc

SEQ ID NO: 3328374 - RNA, 20 nt, Mycobacterium tuberculosis H37Rv
ccgcuauggcccgggccgaa

SEQ ID NO: 3328375 - RNA, 20 nt, Mycobacterium tuberculosis H37Rv
ccgcucaacaaucggugguc

SEQ ID NO: 3328376 - RNA, 18 nt, Mycobacterium tuberculosis H37Rv
ccgcucacaagccgugca

SEQ ID NO: 3328377 - RNA, 15 nt, Mycobacterium tuberculosis H37Rv
ccgcucaccccgcgc

SEQ ID NO: 3328378 - RNA, 13 nt, Mycobacterium tuberculosis H37Rv
ccgcucacccgcc

SEQ ID NO: 3328379 - RNA, 14 nt, Mycobacterium tuberculosis H37Rv
ccgcucacccgccc

SEQ ID NO: 3328380 - RNA, 22 nt, Mycobacterium tuberculosis H37Rv
ccgcucacccgcccggaacggg

SEQ ID NO: 3328381 - RNA, 17 nt, Mycobacterium tuberculosis H37Rv
ccgcucacgaagaccgc

SEQ ID NO: 3328382 - RNA, 14 nt, Mycobacterium tuberculosis H37Rv
ccgcucacgcucac

SEQ ID NO: 3328383 - RNA, 15 nt, Mycobacterium tuberculosis H37Rv
ccgcucagccguccg

SEQ ID NO: 3328384 - RNA, 20 nt, Mycobacterium tuberculosis H37Rv
ccgcucagggugcgccgcag

SEQ ID NO: 3328385 - RNA, 22 nt, Mycobacterium tuberculosis H37Rv
ccgcucagggugcgccgcagca

SEQ ID NO: 3328386 - RNA, 14 nt, Mycobacterium tuberculosis H37Rv
ccgcucauccagcg

SEQ ID NO: 3328387 - RNA, 16 nt, Mycobacterium tuberculosis H37Rv
ccgcucaucgaucccg

SEQ ID NO: 3328388 - RNA, 17 nt, Mycobacterium tuberculosis H37Rv
ccgcucaucgaucccgu

SEQ ID NO: 3328389 - RNA, 13 nt, Mycobacterium tuberculosis H37Rv
ccgcuccaagcgc

SEQ ID NO: 3328390 - RNA, 21 nt, Mycobacterium tuberculosis H37Rv
ccgcuccacguacgcggcugc

SEQ ID NO: 3328391 - RNA, 21 nt, Mycobacterium tuberculosis H37Rv
ccgcucccucuacacccggac

SEQ ID NO: 3328392 - RNA, 15 nt, Mycobacterium tuberculosis H37Rv
ccgcucccugcaccc

SEQ ID NO: 3328393 - RNA, 14 nt, Mycobacterium tuberculosis H37Rv
ccgcuccgagcacc

SEQ ID NO: 3328394 - RNA, 13 nt, Mycobacterium tuberculosis H37Rv
ccgcuccgccguc

SEQ ID NO: 3328395 - RNA, 14 nt, Mycobacterium tuberculosis H37Rv
ccgcuccgccgucg

SEQ ID NO: 3328396 - RNA, 14 nt, Mycobacterium tuberculosis H37Rv
ccgcuccuccggca

SEQ ID NO: 3328397 - RNA, 17 nt, Mycobacterium tuberculosis H37Rv
ccgcuccuccggcacca

SEQ ID NO: 3328398 - RNA, 22 nt, Mycobacterium tuberculosis H37Rv
ccgcucgaccagacgcugccca

SEQ ID NO: 3328399 - RNA, 17 nt, Mycobacterium tuberculosis H37Rv
ccgcucgacggcccgcc

SEQ ID NO: 3328400 - RNA, 23 nt, Mycobacterium tuberculosis H37Rv
ccgcucgagcuacgacgaguggu

SEQ ID NO: 3328401 - RNA, 17 nt, Mycobacterium tuberculosis H37Rv
ccgcucgaucggcagcc

SEQ ID NO: 3328402 - RNA, 21 nt, Mycobacterium tuberculosis H37Rv
ccgcucgaucggcagccaggg

SEQ ID NO: 3328403 - RNA, 14 nt, Mycobacterium tuberculosis H37Rv
ccgcucgcacagcc

SEQ ID NO: 3328404 - RNA, 15 nt, Mycobacterium tuberculosis H37Rv
ccgcucgcccgccgc

SEQ ID NO: 3328405 - RNA, 20 nt, Mycobacterium tuberculosis H37Rv
ccgcucgccgguaggcggcc

SEQ ID NO: 3328406 - RNA, 16 nt, Mycobacterium tuberculosis H37Rv
ccgcucgcugaaccgg

SEQ ID NO: 3328407 - RNA, 19 nt, Mycobacterium tuberculosis H37Rv
ccgcucgcugaaccggauc

SEQ ID NO: 3328408 - RNA, 16 nt, Mycobacterium tuberculosis H37Rv
ccgcucggaguugagc

SEQ ID NO: 3328409 - RNA, 16 nt, Mycobacterium tuberculosis H37Rv
ccgcucggccgcagcc

SEQ ID NO: 3328410 - RNA, 15 nt, Mycobacterium tuberculosis H37Rv
ccgcucggccgccgg

SEQ ID NO: 3328411 - RNA, 19 nt, Mycobacterium tuberculosis H37Rv
ccgcucgggcgcgaggacg

SEQ ID NO: 3328412 - RNA, 15 nt, Mycobacterium tuberculosis H37Rv
ccgcucgguccagcc

SEQ ID NO: 3328413 - RNA, 22 nt, Mycobacterium tuberculosis H37Rv
ccgcucgucgccgguggcaccc

SEQ ID NO: 3328414 - RNA, 14 nt, Mycobacterium tuberculosis H37Rv
ccgcucguggucgg

SEQ ID NO: 3328415 - RNA, 18 nt, Mycobacterium tuberculosis H37Rv
ccgcucguggucgguggc

SEQ ID NO: 3328416 - RNA, 22 nt, Mycobacterium tuberculosis H37Rv
ccgcucguuacgccgagcacac

SEQ ID NO: 3328417 - RNA, 14 nt, Mycobacterium tuberculosis H37Rv
ccgcucuagcgucg

SEQ ID NO: 3328418 - RNA, 13 nt, Mycobacterium tuberculosis H37Rv
ccgcucucggcga

SEQ ID NO: 3328419 - RNA, 23 nt, Mycobacterium tuberculosis H37Rv
ccgcugaacucaacgggaccgau

SEQ ID NO: 3328420 - RNA, 22 nt, Mycobacterium tuberculosis H37Rv
ccgcugaagccaggauugccgc

SEQ ID NO: 3328421 - RNA, 13 nt, Mycobacterium tuberculosis H37Rv
ccgcugaccccgg

SEQ ID NO: 3328422 - RNA, 17 nt, Mycobacterium tuberculosis H37Rv
ccgcugaccccggcagc

SEQ ID NO: 3328423 - RNA, 20 nt, Mycobacterium tuberculosis H37Rv
ccgcugaccccggcagcgcc

SEQ ID NO: 3328424 - RNA, 15 nt, Mycobacterium tuberculosis H37Rv
ccgcugacgguucgg

SEQ ID NO: 3328425 - RNA, 14 nt, Mycobacterium tuberculosis H37Rv
ccgcugacuccugc

SEQ ID NO: 3328426 - RNA, 17 nt, Mycobacterium tuberculosis H37Rv
ccgcugacuccugcggc

SEQ ID NO: 3328427 - RNA, 16 nt, Mycobacterium tuberculosis H37Rv
ccgcugagccagcucc

SEQ ID NO: 3328428 - RNA, 18 nt, Mycobacterium tuberculosis H37Rv
ccgcugagccagcuccac

SEQ ID NO: 3328429 - RNA, 13 nt, Mycobacterium tuberculosis H37Rv
ccgcugagccccc

SEQ ID NO: 3328430 - RNA, 21 nt, Mycobacterium tuberculosis H37Rv
ccgcugagccccccgagcccg

SEQ ID NO: 3328431 - RNA, 13 nt, Mycobacterium tuberculosis H37Rv
ccgcugagcccug

SEQ ID NO: 3328432 - RNA, 16 nt, Mycobacterium tuberculosis H37Rv
ccgcugagcccugcgc

SEQ ID NO: 3328433 - RNA, 14 nt, Mycobacterium tuberculosis H37Rv
ccgcugaggaaccc

SEQ ID NO: 3328434 - RNA, 17 nt, Mycobacterium tuberculosis H37Rv
ccgcugauagcggucgg

SEQ ID NO: 3328435 - RNA, 14 nt, Mycobacterium tuberculosis H37Rv
ccgcugaucgccga

SEQ ID NO: 3328436 - RNA, 15 nt, Mycobacterium tuberculosis H37Rv
ccgcugaucugccgc

SEQ ID NO: 3328437 - RNA, 18 nt, Mycobacterium tuberculosis H37Rv
ccgcugaucugccgccgc

SEQ ID NO: 3328438 - RNA, 17 nt, Mycobacterium tuberculosis H37Rv
ccgcugaugagccgcag

SEQ ID NO: 3328439 - RNA, 21 nt, Mycobacterium tuberculosis H37Rv
ccgcugcagacgccccuuccc

SEQ ID NO: 3328440 - RNA, 20 nt, Mycobacterium tuberculosis H37Rv
ccgcugcauccgcagcacca

SEQ ID NO: 3328441 - RNA, 24 nt, Mycobacterium tuberculosis H37Rv
ccgcugccacccaucgcacggaug

SEQ ID NO: 3328442 - RNA, 15 nt, Mycobacterium tuberculosis H37Rv
ccgcugccaucgccu

SEQ ID NO: 3328443 - RNA, 23 nt, Mycobacterium tuberculosis H37Rv
ccgcugccaugcgggugucgggc

SEQ ID NO: 3328444 - RNA, 14 nt, Mycobacterium tuberculosis H37Rv
ccgcugccauugcc

SEQ ID NO: 3328445 - RNA, 18 nt, Mycobacterium tuberculosis H37Rv
ccgcugccauugccuggg

SEQ ID NO: 3328446 - RNA, 15 nt, Mycobacterium tuberculosis H37Rv
ccgcugccgaagcgg

SEQ ID NO: 3328447 - RNA, 20 nt, Mycobacterium tuberculosis H37Rv
ccgcugccgaagcggccacc

SEQ ID NO: 3328448 - RNA, 14 nt, Mycobacterium tuberculosis H37Rv
ccgcugccgcccgc

SEQ ID NO: 3328449 - RNA, 19 nt, Mycobacterium tuberculosis H37Rv
ccgcugccgcccuugccgc

SEQ ID NO: 3328450 - RNA, 13 nt, Mycobacterium tuberculosis H37Rv
ccgcugccgccgg

SEQ ID NO: 3328451 - RNA, 15 nt, Mycobacterium tuberculosis H37Rv
ccgcugccggcacgc

SEQ ID NO: 3328452 - RNA, 14 nt, Mycobacterium tuberculosis H37Rv
ccgcugccggcagc

SEQ ID NO: 3328453 - RNA, 19 nt, Mycobacterium tuberculosis H37Rv
ccgcugccggugucucccu

SEQ ID NO: 3328454 - RNA, 18 nt, Mycobacterium tuberculosis H37Rv
ccgcugccuuggcgcggc

SEQ ID NO: 3328455 - RNA, 19 nt, Mycobacterium tuberculosis H37Rv
ccgcugcgagaucgcggcg

SEQ ID NO: 3328456 - RNA, 14 nt, Mycobacterium tuberculosis H37Rv
ccgcugcggcacca

SEQ ID NO: 3328457 - RNA, 16 nt, Mycobacterium tuberculosis H37Rv
ccgcugcggcaccacc

SEQ ID NO: 3328458 - RNA, 14 nt, Mycobacterium tuberculosis H37Rv
ccgcugcggcaccg

SEQ ID NO: 3328459 - RNA, 17 nt, Mycobacterium tuberculosis H37Rv
ccgcugcggugccggcc

SEQ ID NO: 3328460 - RNA, 19 nt, Mycobacterium tuberculosis H37Rv
ccgcugcggugccggcccu

SEQ ID NO: 3328461 - RNA, 19 nt, Mycobacterium tuberculosis H37Rv
ccgcugcugcugcccccca

SEQ ID NO: 3328462 - RNA, 22 nt, Mycobacterium tuberculosis H37Rv
ccgcuggacaguuacgcuggca

SEQ ID NO: 3328463 - RNA, 16 nt, Mycobacterium tuberculosis H37Rv
ccgcuggacggaucug

SEQ ID NO: 3328464 - RNA, 15 nt, Mycobacterium tuberculosis H37Rv
ccgcuggaucgacuu

SEQ ID NO: 3328465 - RNA, 15 nt, Mycobacterium tuberculosis H37Rv
ccgcuggaucgcgua

SEQ ID NO: 3328466 - RNA, 12 nt, Mycobacterium tuberculosis H37Rv
ccgcuggccagc

SEQ ID NO: 3328467 - RNA, 15 nt, Mycobacterium tuberculosis H37Rv
ccgcuggcccgccag

SEQ ID NO: 3328468 - RNA, 14 nt, Mycobacterium tuberculosis H37Rv
ccgcuggccuccug

SEQ ID NO: 3328469 - RNA, 17 nt, Mycobacterium tuberculosis H37Rv
ccgcuggggcgcccgag

SEQ ID NO: 3328470 - RNA, 17 nt, Mycobacterium tuberculosis H37Rv
ccgcugggggcggucgc

SEQ ID NO: 3328471 - RNA, 20 nt, Mycobacterium tuberculosis H37Rv
ccgcuggucgagcagugccu

SEQ ID NO: 3328472 - RNA, 19 nt, Mycobacterium tuberculosis H37Rv
ccgcuggucguggcggugc

SEQ ID NO: 3328473 - RNA, 16 nt, Mycobacterium tuberculosis H37Rv
ccgcugguggucagca

SEQ ID NO: 3328474 - RNA, 23 nt, Mycobacterium tuberculosis H37Rv
ccgcuggugugucccggggugaa

SEQ ID NO: 3328475 - RNA, 19 nt, Mycobacterium tuberculosis H37Rv
ccgcugucaccccugggcg

SEQ ID NO: 3328476 - RNA, 14 nt, Mycobacterium tuberculosis H37Rv
ccgcugucgagccg

SEQ ID NO: 3328477 - RNA, 19 nt, Mycobacterium tuberculosis H37Rv
ccgcugucgagccggugcc

SEQ ID NO: 3328478 - RNA, 24 nt, Mycobacterium tuberculosis H37Rv
ccgcugucguaccgcucggcggca

SEQ ID NO: 3328479 - RNA, 23 nt, Mycobacterium tuberculosis H37Rv
ccgcugugauagcgccguacagc

SEQ ID NO: 3328480 - RNA, 17 nt, Mycobacterium tuberculosis H37Rv
ccgcuguguucagcgca

SEQ ID NO: 3328481 - RNA, 16 nt, Mycobacterium tuberculosis H37Rv
ccgcuguugaucgaca

SEQ ID NO: 3328482 - RNA, 14 nt, Mycobacterium tuberculosis H37Rv
ccgcuuacgggugu

SEQ ID NO: 3328483 - RNA, 16 nt, Mycobacterium tuberculosis H37Rv
ccgcuucaggcgccac

SEQ ID NO: 3328484 - RNA, 13 nt, Mycobacterium tuberculosis H37Rv
ccgcuucccccgg

SEQ ID NO: 3328485 - RNA, 15 nt, Mycobacterium tuberculosis H37Rv
ccgcuucccccgguc

SEQ ID NO: 3328486 - RNA, 14 nt, Mycobacterium tuberculosis H37Rv
ccgcuucgcccggc

SEQ ID NO: 3328487 - RNA, 15 nt, Mycobacterium tuberculosis H37Rv
ccgcuucgcccggcu

SEQ ID NO: 3328488 - RNA, 19 nt, Mycobacterium tuberculosis H37Rv
ccgcuugaccccuggccgc

SEQ ID NO: 3328489 - RNA, 22 nt, Mycobacterium tuberculosis H37Rv
ccgcuugaccccuggccgccgg

SEQ ID NO: 3328490 - RNA, 14 nt, Mycobacterium tuberculosis H37Rv
ccgcuugccccgcc

SEQ ID NO: 3328491 - RNA, 15 nt, Mycobacterium tuberculosis H37Rv
ccgcuugccccgccu

SEQ ID NO: 3328492 - RNA, 16 nt, Mycobacterium tuberculosis H37Rv
ccgcuugcggggccgg

SEQ ID NO: 3328493 - RNA, 21 nt, Mycobacterium tuberculosis H37Rv
ccgcuuggaccguugccgaug

SEQ ID NO: 3328494 - RNA, 14 nt, Mycobacterium tuberculosis H37Rv
ccgcuuggcgugac

SEQ ID NO: 3328495 - RNA, 15 nt, Mycobacterium tuberculosis H37Rv
ccgcuuguccaccgu

SEQ ID NO: 3328496 - RNA, 20 nt, Mycobacterium tuberculosis H37Rv
ccgcuuugaauugcgcgccc

SEQ ID NO: 3328497 - RNA, 18 nt, Mycobacterium tuberculosis H37Rv
ccgcuuugcgcggucagc

SEQ ID NO: 3328498 - RNA, 21 nt, Mycobacterium tuberculosis H37Rv
ccggaaaaauuucuucgccga

SEQ ID NO: 3328499 - RNA, 15 nt, Mycobacterium tuberculosis H37Rv
ccggaaacgccaggg

SEQ ID NO: 3328500 - RNA, 17 nt, Mycobacterium tuberculosis H37Rv
ccggaaagaucucgguc

SEQ ID NO: 3328501 - RNA, 13 nt, Mycobacterium tuberculosis H37Rv
ccggaaagcucuc

SEQ ID NO: 3328502 - RNA, 15 nt, Mycobacterium tuberculosis H37Rv
ccggaaaggccgcgg

SEQ ID NO: 3328503 - RNA, 14 nt, Mycobacterium tuberculosis H37Rv
ccggaaccaccagu

SEQ ID NO: 3328504 - RNA, 16 nt, Mycobacterium tuberculosis H37Rv
ccggaaccagccgcgg

SEQ ID NO: 3328505 - RNA, 14 nt, Mycobacterium tuberculosis H37Rv
ccggaacccccagc

SEQ ID NO: 3328506 - RNA, 17 nt, Mycobacterium tuberculosis H37Rv
ccggaacccccagcugc

SEQ ID NO: 3328507 - RNA, 16 nt, Mycobacterium tuberculosis H37Rv
ccggaaccggcgugca

SEQ ID NO: 3328508 - RNA, 22 nt, Mycobacterium tuberculosis H37Rv
ccggaaccggcgugcagcacuu

SEQ ID NO: 3328509 - RNA, 23 nt, Mycobacterium tuberculosis H37Rv
ccggaacugcgcaacaccgugca

SEQ ID NO: 3328510 - RNA, 17 nt, Mycobacterium tuberculosis H37Rv
ccggaagaacucguuga

SEQ ID NO: 3328511 - RNA, 17 nt, Mycobacterium tuberculosis H37Rv
ccggaagauccgggccu

SEQ ID NO: 3328512 - RNA, 16 nt, Mycobacterium tuberculosis H37Rv
ccggaaggcucgccag

SEQ ID NO: 3328513 - RNA, 23 nt, Mycobacterium tuberculosis H37Rv
ccggaaguugaucuugccgcccu

SEQ ID NO: 3328514 - RNA, 18 nt, Mycobacterium tuberculosis H37Rv
ccggaauacaccagcgac

SEQ ID NO: 3328515 - RNA, 20 nt, Mycobacterium tuberculosis H37Rv
ccggaauacccgcuggcccg

SEQ ID NO: 3328516 - RNA, 19 nt, Mycobacterium tuberculosis H37Rv
ccggaauagcaacgcugca

SEQ ID NO: 3328517 - RNA, 18 nt, Mycobacterium tuberculosis H37Rv
ccggaauccccaagcccg

SEQ ID NO: 3328518 - RNA, 18 nt, Mycobacterium tuberculosis H37Rv
ccggaauccgggccgccg

SEQ ID NO: 3328519 - RNA, 14 nt, Mycobacterium tuberculosis H37Rv
ccggaaucgcgaaa

SEQ ID NO: 3328520 - RNA, 13 nt, Mycobacterium tuberculosis H37Rv
ccggaaucggcgg

SEQ ID NO: 3328521 - RNA, 19 nt, Mycobacterium tuberculosis H37Rv
ccggaaucggcggcggauu

SEQ ID NO: 3328522 - RNA, 23 nt, Mycobacterium tuberculosis H37Rv
ccggacaacagagucaccgcgcu

SEQ ID NO: 3328523 - RNA, 20 nt, Mycobacterium tuberculosis H37Rv
ccggacaaccuggggccacc

SEQ ID NO: 3328524 - RNA, 23 nt, Mycobacterium tuberculosis H37Rv
ccggacaaccuggggccaccaga

SEQ ID NO: 3328525 - RNA, 17 nt, Mycobacterium tuberculosis H37Rv
ccggacacuccugcaca

SEQ ID NO: 3328526 - RNA, 14 nt, Mycobacterium tuberculosis H37Rv
ccggacagcgcauc

SEQ ID NO: 3328527 - RNA, 20 nt, Mycobacterium tuberculosis H37Rv
ccggacagcguaucucccaa

SEQ ID NO: 3328528 - RNA, 21 nt, Mycobacterium tuberculosis H37Rv
ccggacaggcuugacugcaca

SEQ ID NO: 3328529 - RNA, 15 nt, Mycobacterium tuberculosis H37Rv
ccggacagggcggcg

SEQ ID NO: 3328530 - RNA, 18 nt, Mycobacterium tuberculosis H37Rv
ccggacagggugggggca

SEQ ID NO: 3328531 - RNA, 17 nt, Mycobacterium tuberculosis H37Rv
ccggacauagccgcgcu

SEQ ID NO: 3328532 - RNA, 13 nt, Mycobacterium tuberculosis H37Rv
ccggacauccgau

SEQ ID NO: 3328533 - RNA, 23 nt, Mycobacterium tuberculosis H37Rv
ccggacaugcgggcagcacucuu

SEQ ID NO: 3328534 - RNA, 13 nt, Mycobacterium tuberculosis H37Rv
ccggaccaccagg

SEQ ID NO: 3328535 - RNA, 22 nt, Mycobacterium tuberculosis H37Rv
ccggaccacuguuggugccgcc

SEQ ID NO: 3328536 - RNA, 20 nt, Mycobacterium tuberculosis H37Rv
ccggaccaucgacaacgccu

SEQ ID NO: 3328537 - RNA, 21 nt, Mycobacterium tuberculosis H37Rv
ccggaccaucgacaacgccuu

SEQ ID NO: 3328538 - RNA, 18 nt, Mycobacterium tuberculosis H37Rv
ccggacccaaagcacuuc

SEQ ID NO: 3328539 - RNA, 18 nt, Mycobacterium tuberculosis H37Rv
ccggacccauuggaccga

SEQ ID NO: 3328540 - RNA, 22 nt, Mycobacterium tuberculosis H37Rv
ccggacccgcccuugccgccga

SEQ ID NO: 3328541 - RNA, 20 nt, Mycobacterium tuberculosis H37Rv
ccggacccgccggguccgcc

SEQ ID NO: 3328542 - RNA, 11 nt, Mycobacterium tuberculosis H37Rv
ccggacccgcu

SEQ ID NO: 3328543 - RNA, 14 nt, Mycobacterium tuberculosis H37Rv
ccggaccgaccacc

SEQ ID NO: 3328544 - RNA, 16 nt, Mycobacterium tuberculosis H37Rv
ccggaccgaccaccgc

SEQ ID NO: 3328545 - RNA, 16 nt, Mycobacterium tuberculosis H37Rv
ccggaccgaugguuga

SEQ ID NO: 3328546 - RNA, 20 nt, Mycobacterium tuberculosis H37Rv
ccggaccgcggccaccgccu

SEQ ID NO: 3328547 - RNA, 14 nt, Mycobacterium tuberculosis H37Rv
ccggaccugaccgg

SEQ ID NO: 3328548 - RNA, 23 nt, Mycobacterium tuberculosis H37Rv
ccggacgaaacgaucgcgccauc

SEQ ID NO: 3328549 - RNA, 23 nt, Mycobacterium tuberculosis H37Rv
ccggacgaacgccgucgacgcgg

SEQ ID NO: 3328550 - RNA, 23 nt, Mycobacterium tuberculosis H37Rv
ccggacgaucagggugucgaaga

SEQ ID NO: 3328551 - RNA, 12 nt, Mycobacterium tuberculosis H37Rv
ccggacgauggc

SEQ ID NO: 3328552 - RNA, 20 nt, Mycobacterium tuberculosis H37Rv
ccggacgauggcgucggcca

SEQ ID NO: 3328553 - RNA, 21 nt, Mycobacterium tuberculosis H37Rv
ccggacgauggcgucggccag

SEQ ID NO: 3328554 - RNA, 22 nt, Mycobacterium tuberculosis H37Rv
ccggacgcacgauccgcacccg

SEQ ID NO: 3328555 - RNA, 15 nt, Mycobacterium tuberculosis H37Rv
ccggacgccaugccc

SEQ ID NO: 3328556 - RNA, 19 nt, Mycobacterium tuberculosis H37Rv
ccggacgcugauugcgacc

SEQ ID NO: 3328557 - RNA, 19 nt, Mycobacterium tuberculosis H37Rv
ccggacgggugcgggccga

SEQ ID NO: 3328558 - RNA, 17 nt, Mycobacterium tuberculosis H37Rv
ccggacggugucagccg

SEQ ID NO: 3328559 - RNA, 14 nt, Mycobacterium tuberculosis H37Rv
ccggacgucggcgg

SEQ ID NO: 3328560 - RNA, 15 nt, Mycobacterium tuberculosis H37Rv
ccggacguucuggau

SEQ ID NO: 3328561 - RNA, 19 nt, Mycobacterium tuberculosis H37Rv
ccggacguucuggaucgug

SEQ ID NO: 3328562 - RNA, 12 nt, Mycobacterium tuberculosis H37Rv
ccggacuaccgc

SEQ ID NO: 3328563 - RNA, 18 nt, Mycobacterium tuberculosis H37Rv
ccggacucuccccuggcc

SEQ ID NO: 3328564 - RNA, 18 nt, Mycobacterium tuberculosis H37Rv
ccggacuugaccagagca

SEQ ID NO: 3328565 - RNA, 17 nt, Mycobacterium tuberculosis H37Rv
ccggagacccgggugcu

SEQ ID NO: 3328566 - RNA, 16 nt, Mycobacterium tuberculosis H37Rv
ccggagacgucgccgc

SEQ ID NO: 3328567 - RNA, 21 nt, Mycobacterium tuberculosis H37Rv
ccggagaugacaaucucggcg

SEQ ID NO: 3328568 - RNA, 21 nt, Mycobacterium tuberculosis H37Rv
ccggagauguaguccucggug

SEQ ID NO: 3328569 - RNA, 14 nt, Mycobacterium tuberculosis H37Rv
ccggagcacccggg

SEQ ID NO: 3328570 - RNA, 15 nt, Mycobacterium tuberculosis H37Rv
ccggagccgaaccca

SEQ ID NO: 3328571 - RNA, 18 nt, Mycobacterium tuberculosis H37Rv
ccggagccgccggccccg

SEQ ID NO: 3328572 - RNA, 22 nt, Mycobacterium tuberculosis H37Rv
ccggagccggugccgacggcgc

SEQ ID NO: 3328573 - RNA, 16 nt, Mycobacterium tuberculosis H37Rv
ccggagcggucagcgg

SEQ ID NO: 3328574 - RNA, 19 nt, Mycobacterium tuberculosis H37Rv
ccggagcggucagcggauc

SEQ ID NO: 3328575 - RNA, 19 nt, Mycobacterium tuberculosis H37Rv
ccggagcuuguugcagcgg

SEQ ID NO: 3328576 - RNA, 14 nt, Mycobacterium tuberculosis H37Rv
ccggaggcaagcaa

SEQ ID NO: 3328577 - RNA, 13 nt, Mycobacterium tuberculosis H37Rv
ccggaggcaaucc

SEQ ID NO: 3328578 - RNA, 23 nt, Mycobacterium tuberculosis H37Rv
ccggaggcauuagcacgcuguca

SEQ ID NO: 3328579 - RNA, 15 nt, Mycobacterium tuberculosis H37Rv
ccggagucgacgacg

SEQ ID NO: 3328580 - RNA, 11 nt, Mycobacterium tuberculosis H37Rv
ccggaguugaa

SEQ ID NO: 3328581 - RNA, 15 nt, Mycobacterium tuberculosis H37Rv
ccggaguugaagaag

SEQ ID NO: 3328582 - RNA, 21 nt, Mycobacterium tuberculosis H37Rv
ccggaguugguguuauugaug

SEQ ID NO: 3328583 - RNA, 14 nt, Mycobacterium tuberculosis H37Rv
ccggauaacccagc

SEQ ID NO: 3328584 - RNA, 19 nt, Mycobacterium tuberculosis H37Rv
ccggauaacccagcggcgc

SEQ ID NO: 3328585 - RNA, 14 nt, Mycobacterium tuberculosis H37Rv
ccggauacaccggc

SEQ ID NO: 3328586 - RNA, 16 nt, Mycobacterium tuberculosis H37Rv
ccggauacaccggcac

SEQ ID NO: 3328587 - RNA, 14 nt, Mycobacterium tuberculosis H37Rv
ccggauacagccac

SEQ ID NO: 3328588 - RNA, 15 nt, Mycobacterium tuberculosis H37Rv
ccggauacagccacg

SEQ ID NO: 3328589 - RNA, 15 nt, Mycobacterium tuberculosis H37Rv
ccggauacgggcguu

SEQ ID NO: 3328590 - RNA, 23 nt, Mycobacterium tuberculosis H37Rv
ccggauacgucagcccgauacgg

SEQ ID NO: 3328591 - RNA, 18 nt, Mycobacterium tuberculosis H37Rv
ccggauagacgugcacca

SEQ ID NO: 3328592 - RNA, 17 nt, Mycobacterium tuberculosis H37Rv
ccggauagcaccggcac

SEQ ID NO: 3328593 - RNA, 20 nt, Mycobacterium tuberculosis H37Rv
ccggauagcgucgucccagc

SEQ ID NO: 3328594 - RNA, 17 nt, Mycobacterium tuberculosis H37Rv
ccggaucccaccaccgc

SEQ ID NO: 3328595 - RNA, 18 nt, Mycobacterium tuberculosis H37Rv
ccggaucccaccaccgcu

SEQ ID NO: 3328596 - RNA, 16 nt, Mycobacterium tuberculosis H37Rv
ccggaucccagugcca

SEQ ID NO: 3328597 - RNA, 19 nt, Mycobacterium tuberculosis H37Rv
ccggaucccugugccagca

SEQ ID NO: 3328598 - RNA, 15 nt, Mycobacterium tuberculosis H37Rv
ccggauccucggccg

SEQ ID NO: 3328599 - RNA, 19 nt, Mycobacterium tuberculosis H37Rv
ccggaucgccgaaucggca

SEQ ID NO: 3328600 - RNA, 14 nt, Mycobacterium tuberculosis H37Rv
ccggaucgcucccg

SEQ ID NO: 3328601 - RNA, 13 nt, Mycobacterium tuberculosis H37Rv
ccggaucggccug

SEQ ID NO: 3328602 - RNA, 20 nt, Mycobacterium tuberculosis H37Rv
ccggaucggccuguccaccg

SEQ ID NO: 3328603 - RNA, 18 nt, Mycobacterium tuberculosis H37Rv
ccggaucgggaccgggaa

SEQ ID NO: 3328604 - RNA, 16 nt, Mycobacterium tuberculosis H37Rv
ccggaucggucggcac

SEQ ID NO: 3328605 - RNA, 23 nt, Mycobacterium tuberculosis H37Rv
ccggaucggucggcaccagguug

SEQ ID NO: 3328606 - RNA, 22 nt, Mycobacterium tuberculosis H37Rv
ccggaucgucgaacagcaccgc

SEQ ID NO: 3328607 - RNA, 23 nt, Mycobacterium tuberculosis H37Rv
ccggaucgucgaacagcaccgcc

SEQ ID NO: 3328608 - RNA, 16 nt, Mycobacterium tuberculosis H37Rv
ccggaucugacggcgc

SEQ ID NO: 3328609 - RNA, 23 nt, Mycobacterium tuberculosis H37Rv
ccggaucuggugggugcggccag

SEQ ID NO: 3328610 - RNA, 17 nt, Mycobacterium tuberculosis H37Rv
ccggaugacaccgaccg

SEQ ID NO: 3328611 - RNA, 20 nt, Mycobacterium tuberculosis H37Rv
ccggaugacaccgaccgggu

SEQ ID NO: 3328612 - RNA, 19 nt, Mycobacterium tuberculosis H37Rv
ccggaugcggccgaacucg

SEQ ID NO: 3328613 - RNA, 13 nt, Mycobacterium tuberculosis H37Rv
ccggaugcggucc

SEQ ID NO: 3328614 - RNA, 19 nt, Mycobacterium tuberculosis H37Rv
ccggaugcggucccugauc

SEQ ID NO: 3328615 - RNA, 17 nt, Mycobacterium tuberculosis H37Rv
ccggaugcugucagcag

SEQ ID NO: 3328616 - RNA, 18 nt, Mycobacterium tuberculosis H37Rv
ccggauggguggccagca

SEQ ID NO: 3328617 - RNA, 17 nt, Mycobacterium tuberculosis H37Rv
ccggauguauuccaggc

SEQ ID NO: 3328618 - RNA, 19 nt, Mycobacterium tuberculosis H37Rv
ccggauguauuccaggcgu

SEQ ID NO: 3328619 - RNA, 14 nt, Mycobacterium tuberculosis H37Rv
ccggaugucgacga

SEQ ID NO: 3328620 - RNA, 19 nt, Mycobacterium tuberculosis H37Rv
ccggaugucgacgagcacc

SEQ ID NO: 3328621 - RNA, 20 nt, Mycobacterium tuberculosis H37Rv
ccggaugucgugcgggcgca

SEQ ID NO: 3328622 - RNA, 15 nt, Mycobacterium tuberculosis H37Rv
ccggauguugaccgg

SEQ ID NO: 3328623 - RNA, 23 nt, Mycobacterium tuberculosis H37Rv
ccggauguugaccggcucgaucu

SEQ ID NO: 3328624 - RNA, 15 nt, Mycobacterium tuberculosis H37Rv
ccggauucuccgccc

SEQ ID NO: 3328625 - RNA, 18 nt, Mycobacterium tuberculosis H37Rv
ccggauugaagucgucgg

SEQ ID NO: 3328626 - RNA, 15 nt, Mycobacterium tuberculosis H37Rv
ccggauugacgccga

SEQ ID NO: 3328627 - RNA, 17 nt, Mycobacterium tuberculosis H37Rv
ccggauugacgccgaau

SEQ ID NO: 3328628 - RNA, 15 nt, Mycobacterium tuberculosis H37Rv
ccggauugagcacgc

SEQ ID NO: 3328629 - RNA, 15 nt, Mycobacterium tuberculosis H37Rv
ccggauuggcgauga

SEQ ID NO: 3328630 - RNA, 16 nt, Mycobacterium tuberculosis H37Rv
ccggauuucgucgggc

SEQ ID NO: 3328631 - RNA, 18 nt, Mycobacterium tuberculosis H37Rv
ccggauuuguauuagacu

SEQ ID NO: 3328632 - RNA, 17 nt, Mycobacterium tuberculosis H37Rv
ccggcaacagcucgccu

SEQ ID NO: 3328633 - RNA, 20 nt, Mycobacterium tuberculosis H37Rv
ccggcaacaucgagcgccag

SEQ ID NO: 3328634 - RNA, 21 nt, Mycobacterium tuberculosis H37Rv
ccggcaacaucgagcgccagc

SEQ ID NO: 3328635 - RNA, 14 nt, Mycobacterium tuberculosis H37Rv
ccggcaacgcggcc

SEQ ID NO: 3328636 - RNA, 15 nt, Mycobacterium tuberculosis H37Rv
ccggcaacgcggcuc

SEQ ID NO: 3328637 - RNA, 16 nt, Mycobacterium tuberculosis H37Rv
ccggcaacgugcggug

SEQ ID NO: 3328638 - RNA, 16 nt, Mycobacterium tuberculosis H37Rv
ccggcaagcacaccgc

SEQ ID NO: 3328639 - RNA, 23 nt, Mycobacterium tuberculosis H37Rv
ccggcaagcacaccgccagcggc

SEQ ID NO: 3328640 - RNA, 15 nt, Mycobacterium tuberculosis H37Rv
ccggcaagcgcagac

SEQ ID NO: 3328641 - RNA, 17 nt, Mycobacterium tuberculosis H37Rv
ccggcaagcgcagacac

SEQ ID NO: 3328642 - RNA, 16 nt, Mycobacterium tuberculosis H37Rv
ccggcaaucggcggca

SEQ ID NO: 3328643 - RNA, 17 nt, Mycobacterium tuberculosis H37Rv
ccggcaaucggcggcac

SEQ ID NO: 3328644 - RNA, 16 nt, Mycobacterium tuberculosis H37Rv
ccggcaaugccacggu

SEQ ID NO: 3328645 - RNA, 15 nt, Mycobacterium tuberculosis H37Rv
ccggcaaugccgcgg

SEQ ID NO: 3328646 - RNA, 14 nt, Mycobacterium tuberculosis H37Rv
ccggcacacccucc

SEQ ID NO: 3328647 - RNA, 16 nt, Mycobacterium tuberculosis H37Rv
ccggcacacggccuug

SEQ ID NO: 3328648 - RNA, 19 nt, Mycobacterium tuberculosis H37Rv
ccggcaccaacgccaccgu

SEQ ID NO: 3328649 - RNA, 13 nt, Mycobacterium tuberculosis H37Rv
ccggcaccacgau

SEQ ID NO: 3328650 - RNA, 14 nt, Mycobacterium tuberculosis H37Rv
ccggcaccacgauc

SEQ ID NO: 3328651 - RNA, 13 nt, Mycobacterium tuberculosis H37Rv
ccggcaccagcgg

SEQ ID NO: 3328652 - RNA, 14 nt, Mycobacterium tuberculosis H37Rv
ccggcaccagcggc

SEQ ID NO: 3328653 - RNA, 16 nt, Mycobacterium tuberculosis H37Rv
ccggcaccagcggcac

SEQ ID NO: 3328654 - RNA, 19 nt, Mycobacterium tuberculosis H37Rv
ccggcaccagcggcaccgc

SEQ ID NO: 3328655 - RNA, 13 nt, Mycobacterium tuberculosis H37Rv
ccggcacccacca

SEQ ID NO: 3328656 - RNA, 14 nt, Mycobacterium tuberculosis H37Rv
ccggcacccaccag

SEQ ID NO: 3328657 - RNA, 13 nt, Mycobacterium tuberculosis H37Rv
ccggcacccaguu

SEQ ID NO: 3328658 - RNA, 16 nt, Mycobacterium tuberculosis H37Rv
ccggcaccccacggcc

SEQ ID NO: 3328659 - RNA, 15 nt, Mycobacterium tuberculosis H37Rv
ccggcaccccuuuga

SEQ ID NO: 3328660 - RNA, 16 nt, Mycobacterium tuberculosis H37Rv
ccggcacccgaguuau

SEQ ID NO: 3328661 - RNA, 20 nt, Mycobacterium tuberculosis H37Rv
ccggcacccgcacggccucc

SEQ ID NO: 3328662 - RNA, 20 nt, Mycobacterium tuberculosis H37Rv
ccggcacccgcggcgaaccg

SEQ ID NO: 3328663 - RNA, 14 nt, Mycobacterium tuberculosis H37Rv
ccggcacccgcugg

SEQ ID NO: 3328664 - RNA, 16 nt, Mycobacterium tuberculosis H37Rv
ccggcacccggugaga

SEQ ID NO: 3328665 - RNA, 15 nt, Mycobacterium tuberculosis H37Rv
ccggcaccgagucua

SEQ ID NO: 3328666 - RNA, 17 nt, Mycobacterium tuberculosis H37Rv
ccggcaccgcccuugcc

SEQ ID NO: 3328667 - RNA, 15 nt, Mycobacterium tuberculosis H37Rv
ccggcaccgccgccc

SEQ ID NO: 3328668 - RNA, 17 nt, Mycobacterium tuberculosis H37Rv
ccggcaccgccgccccc

SEQ ID NO: 3328669 - RNA, 15 nt, Mycobacterium tuberculosis H37Rv
ccggcaccgccggca

SEQ ID NO: 3328670 - RNA, 16 nt, Mycobacterium tuberculosis H37Rv
ccggcaccgccggcac

SEQ ID NO: 3328671 - RNA, 16 nt, Mycobacterium tuberculosis H37Rv
ccggcaccgccggcgc

SEQ ID NO: 3328672 - RNA, 21 nt, Mycobacterium tuberculosis H37Rv
ccggcaccgccggcgcccagg

SEQ ID NO: 3328673 - RNA, 13 nt, Mycobacterium tuberculosis H37Rv
ccggcaccgccug

SEQ ID NO: 3328674 - RNA, 21 nt, Mycobacterium tuberculosis H37Rv
ccggcaccgccugcgccgccc

SEQ ID NO: 3328675 - RNA, 20 nt, Mycobacterium tuberculosis H37Rv
ccggcaccggggcugcccgc

SEQ ID NO: 3328676 - RNA, 21 nt, Mycobacterium tuberculosis H37Rv
ccggcaccguagagcaugccg

SEQ ID NO: 3328677 - RNA, 20 nt, Mycobacterium tuberculosis H37Rv
ccggcaccuccagcaccacc

SEQ ID NO: 3328678 - RNA, 13 nt, Mycobacterium tuberculosis H37Rv
ccggcaccucccu

SEQ ID NO: 3328679 - RNA, 18 nt, Mycobacterium tuberculosis H37Rv
ccggcaccucccuggccc

SEQ ID NO: 3328680 - RNA, 17 nt, Mycobacterium tuberculosis H37Rv
ccggcaccuccgccggc

SEQ ID NO: 3328681 - RNA, 18 nt, Mycobacterium tuberculosis H37Rv
ccggcaccuccgccggca

SEQ ID NO: 3328682 - RNA, 22 nt, Mycobacterium tuberculosis H37Rv
ccggcaccugguccaaucgcga

SEQ ID NO: 3328683 - RNA, 14 nt, Mycobacterium tuberculosis H37Rv
ccggcacgcagcca

SEQ ID NO: 3328684 - RNA, 15 nt, Mycobacterium tuberculosis H37Rv
ccggcacgcaugccg

SEQ ID NO: 3328685 - RNA, 15 nt, Mycobacterium tuberculosis H37Rv
ccggcacgccggcgg

SEQ ID NO: 3328686 - RNA, 13 nt, Mycobacterium tuberculosis H37Rv
ccggcacgggcgu

SEQ ID NO: 3328687 - RNA, 19 nt, Mycobacterium tuberculosis H37Rv
ccggcacgggcgucgucgg

SEQ ID NO: 3328688 - RNA, 22 nt, Mycobacterium tuberculosis H37Rv
ccggcacggugaacaauccgag

SEQ ID NO: 3328689 - RNA, 17 nt, Mycobacterium tuberculosis H37Rv
ccggcacugcccagcag

SEQ ID NO: 3328690 - RNA, 16 nt, Mycobacterium tuberculosis H37Rv
ccggcacugcggccag

SEQ ID NO: 3328691 - RNA, 19 nt, Mycobacterium tuberculosis H37Rv
ccggcagaugcagcggguc

SEQ ID NO: 3328692 - RNA, 17 nt, Mycobacterium tuberculosis H37Rv
ccggcagcagccggcgg

SEQ ID NO: 3328693 - RNA, 19 nt, Mycobacterium tuberculosis H37Rv
ccggcagcaucggcacccc

SEQ ID NO: 3328694 - RNA, 13 nt, Mycobacterium tuberculosis H37Rv
ccggcagcccggc

SEQ ID NO: 3328695 - RNA, 12 nt, Mycobacterium tuberculosis H37Rv
ccggcagcgaug

SEQ ID NO: 3328696 - RNA, 20 nt, Mycobacterium tuberculosis H37Rv
ccggcagcgcgaucgauucc

SEQ ID NO: 3328697 - RNA, 13 nt, Mycobacterium tuberculosis H37Rv
ccggcagcggcgc

SEQ ID NO: 3328698 - RNA, 15 nt, Mycobacterium tuberculosis H37Rv
ccggcagcggcuggg

SEQ ID NO: 3328699 - RNA, 13 nt, Mycobacterium tuberculosis H37Rv
ccggcagcgucgg

SEQ ID NO: 3328700 - RNA, 15 nt, Mycobacterium tuberculosis H37Rv
ccggcagcgucggcc

SEQ ID NO: 3328701 - RNA, 19 nt, Mycobacterium tuberculosis H37Rv
ccggcaggcccgacggcgc

SEQ ID NO: 3328702 - RNA, 22 nt, Mycobacterium tuberculosis H37Rv
ccggcaggcccgacggcgccca

SEQ ID NO: 3328703 - RNA, 19 nt, Mycobacterium tuberculosis H37Rv
ccggcaggcuaaucagcca

SEQ ID NO: 3328704 - RNA, 15 nt, Mycobacterium tuberculosis H37Rv
ccggcagugagucgg

SEQ ID NO: 3328705 - RNA, 18 nt, Mycobacterium tuberculosis H37Rv
ccggcagugagucgguga

SEQ ID NO: 3328706 - RNA, 20 nt, Mycobacterium tuberculosis H37Rv
ccggcaguucgcggccaucg

SEQ ID NO: 3328707 - RNA, 17 nt, Mycobacterium tuberculosis H37Rv
ccggcauaacgaucccg

SEQ ID NO: 3328708 - RNA, 15 nt, Mycobacterium tuberculosis H37Rv
ccggcauacagccgg

SEQ ID NO: 3328709 - RNA, 17 nt, Mycobacterium tuberculosis H37Rv
ccggcauaccgaacagc

SEQ ID NO: 3328710 - RNA, 17 nt, Mycobacterium tuberculosis H37Rv
ccggcauagaucggguc

SEQ ID NO: 3328711 - RNA, 15 nt, Mycobacterium tuberculosis H37Rv
ccggcauagaugccg

SEQ ID NO: 3328712 - RNA, 16 nt, Mycobacterium tuberculosis H37Rv
ccggcaucgagacgca

SEQ ID NO: 3328713 - RNA, 15 nt, Mycobacterium tuberculosis H37Rv
ccggcaucgaucaac

SEQ ID NO: 3328714 - RNA, 12 nt, Mycobacterium tuberculosis H37Rv
ccggcaucgcgc

SEQ ID NO: 3328715 - RNA, 17 nt, Mycobacterium tuberculosis H37Rv
ccggcaucggucagcgc

SEQ ID NO: 3328716 - RNA, 19 nt, Mycobacterium tuberculosis H37Rv
ccggcaucggucagcgcgg

SEQ ID NO: 3328717 - RNA, 16 nt, Mycobacterium tuberculosis H37Rv
ccggcaucgucgacgc

SEQ ID NO: 3328718 - RNA, 21 nt, Mycobacterium tuberculosis H37Rv
ccggcaucgucgacgcccgau

SEQ ID NO: 3328719 - RNA, 12 nt, Mycobacterium tuberculosis H37Rv
ccggcaugccag

SEQ ID NO: 3328720 - RNA, 13 nt, Mycobacterium tuberculosis H37Rv
ccggcaugcccgc

SEQ ID NO: 3328721 - RNA, 14 nt, Mycobacterium tuberculosis H37Rv
ccggcaugccgcca

SEQ ID NO: 3328722 - RNA, 18 nt, Mycobacterium tuberculosis H37Rv
ccggcaugcgugccggca

SEQ ID NO: 3328723 - RNA, 24 nt, Mycobacterium tuberculosis H37Rv
ccggcaugcuggcgaucgcgacga

SEQ ID NO: 3328724 - RNA, 23 nt, Mycobacterium tuberculosis H37Rv
ccggcauggcggcauagccgaac

SEQ ID NO: 3328725 - RNA, 22 nt, Mycobacterium tuberculosis H37Rv
ccggcauuccguaggccacagc

SEQ ID NO: 3328726 - RNA, 21 nt, Mycobacterium tuberculosis H37Rv
ccggccaaaauuuugucggcc

SEQ ID NO: 3328727 - RNA, 13 nt, Mycobacterium tuberculosis H37Rv
ccggccaaccacc

SEQ ID NO: 3328728 - RNA, 18 nt, Mycobacterium tuberculosis H37Rv
ccggccaacggcacccug

SEQ ID NO: 3328729 - RNA, 18 nt, Mycobacterium tuberculosis H37Rv
ccggccaagaccgcggcc

SEQ ID NO: 3328730 - RNA, 17 nt, Mycobacterium tuberculosis H37Rv
ccggccaauggccugca

SEQ ID NO: 3328731 - RNA, 17 nt, Mycobacterium tuberculosis H37Rv
ccggccaccaccgcgcc

SEQ ID NO: 3328732 - RNA, 12 nt, Mycobacterium tuberculosis H37Rv
ccggccaccagg

SEQ ID NO: 3328733 - RNA, 20 nt, Mycobacterium tuberculosis H37Rv
ccggccaccagggccaccgc

SEQ ID NO: 3328734 - RNA, 13 nt, Mycobacterium tuberculosis H37Rv
ccggccacgaccu

SEQ ID NO: 3328735 - RNA, 15 nt, Mycobacterium tuberculosis H37Rv
ccggccacgaccucg

SEQ ID NO: 3328736 - RNA, 18 nt, Mycobacterium tuberculosis H37Rv
ccggccacgaccucggga

SEQ ID NO: 3328737 - RNA, 13 nt, Mycobacterium tuberculosis H37Rv
ccggccacggucc

SEQ ID NO: 3328738 - RNA, 21 nt, Mycobacterium tuberculosis H37Rv
ccggccacgguccggcccacc

SEQ ID NO: 3328739 - RNA, 22 nt, Mycobacterium tuberculosis H37Rv
ccggccacgucgaugugcgccc

SEQ ID NO: 3328740 - RNA, 16 nt, Mycobacterium tuberculosis H37Rv
ccggccacuccaguac

SEQ ID NO: 3328741 - RNA, 19 nt, Mycobacterium tuberculosis H37Rv
ccggccacuccaugagccg

SEQ ID NO: 3328742 - RNA, 13 nt, Mycobacterium tuberculosis H37Rv
ccggccagauggu

SEQ ID NO: 3328743 - RNA, 22 nt, Mycobacterium tuberculosis H37Rv
ccggccagcagguccgccaccg

SEQ ID NO: 3328744 - RNA, 15 nt, Mycobacterium tuberculosis H37Rv
ccggccagccgacgc

SEQ ID NO: 3328745 - RNA, 20 nt, Mycobacterium tuberculosis H37Rv
ccggccagccgacgcggcgg

SEQ ID NO: 3328746 - RNA, 21 nt, Mycobacterium tuberculosis H37Rv
ccggccagccgcacgguugcc

SEQ ID NO: 3328747 - RNA, 14 nt, Mycobacterium tuberculosis H37Rv
ccggccagccgcgg

SEQ ID NO: 3328748 - RNA, 12 nt, Mycobacterium tuberculosis H37Rv
ccggccagcggc

SEQ ID NO: 3328749 - RNA, 15 nt, Mycobacterium tuberculosis H37Rv
ccggccagcggcagg

SEQ ID NO: 3328750 - RNA, 18 nt, Mycobacterium tuberculosis H37Rv
ccggccagcuccucagcc

SEQ ID NO: 3328751 - RNA, 19 nt, Mycobacterium tuberculosis H37Rv
ccggccaggaguuugacca

SEQ ID NO: 3328752 - RNA, 15 nt, Mycobacterium tuberculosis H37Rv
ccggccaggauuucg

SEQ ID NO: 3328753 - RNA, 17 nt, Mycobacterium tuberculosis H37Rv
ccggccaggauuucgca

SEQ ID NO: 3328754 - RNA, 13 nt, Mycobacterium tuberculosis H37Rv
ccggccaggccgg

SEQ ID NO: 3328755 - RNA, 20 nt, Mycobacterium tuberculosis H37Rv
ccggccaggccggcggcggc

SEQ ID NO: 3328756 - RNA, 20 nt, Mycobacterium tuberculosis H37Rv
ccggccaggcuauggugccg

SEQ ID NO: 3328757 - RNA, 14 nt, Mycobacterium tuberculosis H37Rv
ccggccaggggauc

SEQ ID NO: 3328758 - RNA, 18 nt, Mycobacterium tuberculosis H37Rv
ccggccauaccgcucgcc

SEQ ID NO: 3328759 - RNA, 14 nt, Mycobacterium tuberculosis H37Rv
ccggccaucuugag

SEQ ID NO: 3328760 - RNA, 21 nt, Mycobacterium tuberculosis H37Rv
ccggccaugccuucggugccg

SEQ ID NO: 3328761 - RNA, 20 nt, Mycobacterium tuberculosis H37Rv
ccggccauucuuggugaucg

SEQ ID NO: 3328762 - RNA, 12 nt, Mycobacterium tuberculosis H37Rv
ccggcccaagga

SEQ ID NO: 3328763 - RNA, 21 nt, Mycobacterium tuberculosis H37Rv
ccggcccaaggaacggcgucg

SEQ ID NO: 3328764 - RNA, 13 nt, Mycobacterium tuberculosis H37Rv
ccggcccaccagc

SEQ ID NO: 3328765 - RNA, 13 nt, Mycobacterium tuberculosis H37Rv
ccggcccaccgcc

SEQ ID NO: 3328766 - RNA, 18 nt, Mycobacterium tuberculosis H37Rv
ccggcccaccgccgauac

SEQ ID NO: 3328767 - RNA, 18 nt, Mycobacterium tuberculosis H37Rv
ccggcccagaucgguuga

SEQ ID NO: 3328768 - RNA, 22 nt, Mycobacterium tuberculosis H37Rv
ccggcccaucuucggacgccag

SEQ ID NO: 3328769 - RNA, 22 nt, Mycobacterium tuberculosis H37Rv
ccggcccauucaucuugcggca

SEQ ID NO: 3328770 - RNA, 21 nt, Mycobacterium tuberculosis H37Rv
ccggcccauugucgaucaccu

SEQ ID NO: 3328771 - RNA, 17 nt, Mycobacterium tuberculosis H37Rv
ccggccccccgacuccg

SEQ ID NO: 3328772 - RNA, 19 nt, Mycobacterium tuberculosis H37Rv
ccggccccccgacuccggc

SEQ ID NO: 3328773 - RNA, 22 nt, Mycobacterium tuberculosis H37Rv
ccggcccccgaggcuggcaucc

SEQ ID NO: 3328774 - RNA, 17 nt, Mycobacterium tuberculosis H37Rv
ccggccccgcaagcgga

SEQ ID NO: 3328775 - RNA, 18 nt, Mycobacterium tuberculosis H37Rv
ccggccccgcaagcggau

SEQ ID NO: 3328776 - RNA, 16 nt, Mycobacterium tuberculosis H37Rv
ccggccccgccggcgc

SEQ ID NO: 3328777 - RNA, 15 nt, Mycobacterium tuberculosis H37Rv
ccggccccgccguca

SEQ ID NO: 3328778 - RNA, 21 nt, Mycobacterium tuberculosis H37Rv
ccggccccgccguuuccgccg

SEQ ID NO: 3328779 - RNA, 17 nt, Mycobacterium tuberculosis H37Rv
ccggcccgaucggcaac

SEQ ID NO: 3328780 - RNA, 23 nt, Mycobacterium tuberculosis H37Rv
ccggcccgaugccgaggaucgcg

SEQ ID NO: 3328781 - RNA, 13 nt, Mycobacterium tuberculosis H37Rv
ccggcccgcaucc

SEQ ID NO: 3328782 - RNA, 13 nt, Mycobacterium tuberculosis H37Rv
ccggcccgccacc

SEQ ID NO: 3328783 - RNA, 15 nt, Mycobacterium tuberculosis H37Rv
ccggcccgccacccc

SEQ ID NO: 3328784 - RNA, 16 nt, Mycobacterium tuberculosis H37Rv
ccggcccgccaccccg

SEQ ID NO: 3328785 - RNA, 23 nt, Mycobacterium tuberculosis H37Rv
ccggcccggguaucgccaguggu

SEQ ID NO: 3328786 - RNA, 17 nt, Mycobacterium tuberculosis H37Rv
ccggcccgguccagccc

SEQ ID NO: 3328787 - RNA, 14 nt, Mycobacterium tuberculosis H37Rv
ccggcccggugaug

SEQ ID NO: 3328788 - RNA, 23 nt, Mycobacterium tuberculosis H37Rv
ccggcccguagcguccgcgcccg

SEQ ID NO: 3328789 - RNA, 19 nt, Mycobacterium tuberculosis H37Rv
ccggcccguagcugcgcag

SEQ ID NO: 3328790 - RNA, 20 nt, Mycobacterium tuberculosis H37Rv
ccggcccguagcugcgcagc

SEQ ID NO: 3328791 - RNA, 14 nt, Mycobacterium tuberculosis H37Rv
ccggcccucgccag

SEQ ID NO: 3328792 - RNA, 23 nt, Mycobacterium tuberculosis H37Rv
ccggcccugagcugccgagcggu

SEQ ID NO: 3328793 - RNA, 21 nt, Mycobacterium tuberculosis H37Rv
ccggcccugccgccggccccg

SEQ ID NO: 3328794 - RNA, 16 nt, Mycobacterium tuberculosis H37Rv
ccggcccugcucggcc

SEQ ID NO: 3328795 - RNA, 16 nt, Mycobacterium tuberculosis H37Rv
ccggccgacacgccga

SEQ ID NO: 3328796 - RNA, 14 nt, Mycobacterium tuberculosis H37Rv
ccggccgagccguu

SEQ ID NO: 3328797 - RNA, 19 nt, Mycobacterium tuberculosis H37Rv
ccggccgaugcgacccgca

SEQ ID NO: 3328798 - RNA, 15 nt, Mycobacterium tuberculosis H37Rv
ccggccgcacccguu

SEQ ID NO: 3328799 - RNA, 23 nt, Mycobacterium tuberculosis H37Rv
ccggccgcacgccgaccagcacc

SEQ ID NO: 3328800 - RNA, 21 nt, Mycobacterium tuberculosis H37Rv
ccggccgcacgccggccagcg

SEQ ID NO: 3328801 - RNA, 13 nt, Mycobacterium tuberculosis H37Rv
ccggccgccgaga

SEQ ID NO: 3328802 - RNA, 16 nt, Mycobacterium tuberculosis H37Rv
ccggccgcgacgacac

SEQ ID NO: 3328803 - RNA, 14 nt, Mycobacterium tuberculosis H37Rv
ccggccgcgcagau

SEQ ID NO: 3328804 - RNA, 16 nt, Mycobacterium tuberculosis H37Rv
ccggccgcgccggccc

SEQ ID NO: 3328805 - RNA, 11 nt, Mycobacterium tuberculosis H37Rv
ccggccgcgcg

SEQ ID NO: 3328806 - RNA, 14 nt, Mycobacterium tuberculosis H37Rv
ccggccgcgggcgu

SEQ ID NO: 3328807 - RNA, 20 nt, Mycobacterium tuberculosis H37Rv
ccggccgcguaaaccggcug

SEQ ID NO: 3328808 - RNA, 15 nt, Mycobacterium tuberculosis H37Rv
ccggccgcucacccc

SEQ ID NO: 3328809 - RNA, 18 nt, Mycobacterium tuberculosis H37Rv
ccggccggaacgcccggc

SEQ ID NO: 3328810 - RNA, 23 nt, Mycobacterium tuberculosis H37Rv
ccggccggacaacagagucaccg

SEQ ID NO: 3328811 - RNA, 12 nt, Mycobacterium tuberculosis H37Rv
ccggccggcaau

SEQ ID NO: 3328812 - RNA, 19 nt, Mycobacterium tuberculosis H37Rv
ccggccgguaguagcugac

SEQ ID NO: 3328813 - RNA, 22 nt, Mycobacterium tuberculosis H37Rv
ccggccggugaugaucggaaag

SEQ ID NO: 3328814 - RNA, 17 nt, Mycobacterium tuberculosis H37Rv
ccggccgguggccagca

SEQ ID NO: 3328815 - RNA, 14 nt, Mycobacterium tuberculosis H37Rv
ccggccgguucuug

SEQ ID NO: 3328816 - RNA, 17 nt, Mycobacterium tuberculosis H37Rv
ccggccgguucuuggcg

SEQ ID NO: 3328817 - RNA, 12 nt, Mycobacterium tuberculosis H37Rv
ccggccgguugg

SEQ ID NO: 3328818 - RNA, 17 nt, Mycobacterium tuberculosis H37Rv
ccggccgguuggccagc

SEQ ID NO: 3328819 - RNA, 18 nt, Mycobacterium tuberculosis H37Rv
ccggccgguuggccagcc

SEQ ID NO: 3328820 - RNA, 19 nt, Mycobacterium tuberculosis H37Rv
ccggccgguuggccagcca

SEQ ID NO: 3328821 - RNA, 21 nt, Mycobacterium tuberculosis H37Rv
ccggccgguuggccagccaca

SEQ ID NO: 3328822 - RNA, 21 nt, Mycobacterium tuberculosis H37Rv
ccggccgucccgcgagcagcc

SEQ ID NO: 3328823 - RNA, 14 nt, Mycobacterium tuberculosis H37Rv
ccggccgucgacgc

SEQ ID NO: 3328824 - RNA, 20 nt, Mycobacterium tuberculosis H37Rv
ccggccgucgacgcaugggu

SEQ ID NO: 3328825 - RNA, 14 nt, Mycobacterium tuberculosis H37Rv
ccggccgucggccg

SEQ ID NO: 3328826 - RNA, 21 nt, Mycobacterium tuberculosis H37Rv
ccggccgugagcccggcgauc

SEQ ID NO: 3328827 - RNA, 20 nt, Mycobacterium tuberculosis H37Rv
ccggccgugaugucccgcaa

SEQ ID NO: 3328828 - RNA, 13 nt, Mycobacterium tuberculosis H37Rv
ccggccguuggga

SEQ ID NO: 3328829 - RNA, 17 nt, Mycobacterium tuberculosis H37Rv
ccggccguugggccacc

SEQ ID NO: 3328830 - RNA, 14 nt, Mycobacterium tuberculosis H37Rv
ccggccuagccgau

SEQ ID NO: 3328831 - RNA, 13 nt, Mycobacterium tuberculosis H37Rv
ccggccucgccga

SEQ ID NO: 3328832 - RNA, 20 nt, Mycobacterium tuberculosis H37Rv
ccggccucgccgaagcgggc

SEQ ID NO: 3328833 - RNA, 16 nt, Mycobacterium tuberculosis H37Rv
ccggccucggcgagca

SEQ ID NO: 3328834 - RNA, 23 nt, Mycobacterium tuberculosis H37Rv
ccggccucuggaucacgucgaug

SEQ ID NO: 3328835 - RNA, 17 nt, Mycobacterium tuberculosis H37Rv
ccggccugcgacgagcc

SEQ ID NO: 3328836 - RNA, 18 nt, Mycobacterium tuberculosis H37Rv
ccggccugcgcgaccgac

SEQ ID NO: 3328837 - RNA, 23 nt, Mycobacterium tuberculosis H37Rv
ccggccugcgcgaccgaccagcc

SEQ ID NO: 3328838 - RNA, 15 nt, Mycobacterium tuberculosis H37Rv
ccggccuggccgcca

SEQ ID NO: 3328839 - RNA, 19 nt, Mycobacterium tuberculosis H37Rv
ccggccugucccgcacccg

SEQ ID NO: 3328840 - RNA, 18 nt, Mycobacterium tuberculosis H37Rv
ccggccuucaaggaagcc

SEQ ID NO: 3328841 - RNA, 19 nt, Mycobacterium tuberculosis H37Rv
ccggccuugagcacccgau

SEQ ID NO: 3328842 - RNA, 16 nt, Mycobacterium tuberculosis H37Rv
ccggccuugccgccgg

SEQ ID NO: 3328843 - RNA, 17 nt, Mycobacterium tuberculosis H37Rv
ccggccuuggcggcggc

SEQ ID NO: 3328844 - RNA, 21 nt, Mycobacterium tuberculosis H37Rv
ccggccuuuacccgggcggcg

SEQ ID NO: 3328845 - RNA, 23 nt, Mycobacterium tuberculosis H37Rv
ccggccuuuacccgggcggcggc

SEQ ID NO: 3328846 - RNA, 17 nt, Mycobacterium tuberculosis H37Rv
ccggccuuuccagcacc

SEQ ID NO: 3328847 - RNA, 22 nt, Mycobacterium tuberculosis H37Rv
ccggcgaaaagacugcgccgcc

SEQ ID NO: 3328848 - RNA, 15 nt, Mycobacterium tuberculosis H37Rv
ccggcgaaccccagc

SEQ ID NO: 3328849 - RNA, 15 nt, Mycobacterium tuberculosis H37Rv
ccggcgaagccggcc

SEQ ID NO: 3328850 - RNA, 18 nt, Mycobacterium tuberculosis H37Rv
ccggcgaaguuggugaca

SEQ ID NO: 3328851 - RNA, 19 nt, Mycobacterium tuberculosis H37Rv
ccggcgaccaaggccgacc

SEQ ID NO: 3328852 - RNA, 15 nt, Mycobacterium tuberculosis H37Rv
ccggcgacccgggua

SEQ ID NO: 3328853 - RNA, 20 nt, Mycobacterium tuberculosis H37Rv
ccggcgaccggcgagcccgc

SEQ ID NO: 3328854 - RNA, 21 nt, Mycobacterium tuberculosis H37Rv
ccggcgaccggcgagcccgca

SEQ ID NO: 3328855 - RNA, 14 nt, Mycobacterium tuberculosis H37Rv
ccggcgacgacccg

SEQ ID NO: 3328856 - RNA, 23 nt, Mycobacterium tuberculosis H37Rv
ccggcgacgacccgggucggcac

SEQ ID NO: 3328857 - RNA, 22 nt, Mycobacterium tuberculosis H37Rv
ccggcgacgauauagggcuccu

SEQ ID NO: 3328858 - RNA, 16 nt, Mycobacterium tuberculosis H37Rv
ccggcgacgggucggg

SEQ ID NO: 3328859 - RNA, 15 nt, Mycobacterium tuberculosis H37Rv
ccggcgagcacccgc

SEQ ID NO: 3328860 - RNA, 12 nt, Mycobacterium tuberculosis H37Rv
ccggcgagcucg

SEQ ID NO: 3328861 - RNA, 19 nt, Mycobacterium tuberculosis H37Rv
ccggcgagggccacggcug

SEQ ID NO: 3328862 - RNA, 20 nt, Mycobacterium tuberculosis H37Rv
ccggcgagggcgcggauacg

SEQ ID NO: 3328863 - RNA, 23 nt, Mycobacterium tuberculosis H37Rv
ccggcgagggugagcauggcuag

SEQ ID NO: 3328864 - RNA, 23 nt, Mycobacterium tuberculosis H37Rv
ccggcgaggucggagagcaugcg

SEQ ID NO: 3328865 - RNA, 22 nt, Mycobacterium tuberculosis H37Rv
ccggcgagugguccagccagau

SEQ ID NO: 3328866 - RNA, 13 nt, Mycobacterium tuberculosis H37Rv
ccggcgaucaccg

SEQ ID NO: 3328867 - RNA, 14 nt, Mycobacterium tuberculosis H37Rv
ccggcgaucaccgu

SEQ ID NO: 3328868 - RNA, 14 nt, Mycobacterium tuberculosis H37Rv
ccggcgaucagcag

SEQ ID NO: 3328869 - RNA, 16 nt, Mycobacterium tuberculosis H37Rv
ccggcgauccgguagg

SEQ ID NO: 3328870 - RNA, 15 nt, Mycobacterium tuberculosis H37Rv
ccggcgaucucgacc

SEQ ID NO: 3328871 - RNA, 13 nt, Mycobacterium tuberculosis H37Rv
ccggcgaugagca

SEQ ID NO: 3328872 - RNA, 14 nt, Mycobacterium tuberculosis H37Rv
ccggcgaugcagcc

SEQ ID NO: 3328873 - RNA, 20 nt, Mycobacterium tuberculosis H37Rv
ccggcgauuaccggcacgcc

SEQ ID NO: 3328874 - RNA, 15 nt, Mycobacterium tuberculosis H37Rv
ccggcgcaacaaccg

SEQ ID NO: 3328875 - RNA, 19 nt, Mycobacterium tuberculosis H37Rv
ccggcgcaagcgccgcgcu

SEQ ID NO: 3328876 - RNA, 21 nt, Mycobacterium tuberculosis H37Rv
ccggcgcaccaucgcggccgc

SEQ ID NO: 3328877 - RNA, 17 nt, Mycobacterium tuberculosis H37Rv
ccggcgcaccugggcug

SEQ ID NO: 3328878 - RNA, 18 nt, Mycobacterium tuberculosis H37Rv
ccggcgcagauagcgcuc

SEQ ID NO: 3328879 - RNA, 21 nt, Mycobacterium tuberculosis H37Rv
ccggcgcaguagccgaccagg

SEQ ID NO: 3328880 - RNA, 22 nt, Mycobacterium tuberculosis H37Rv
ccggcgcaguagccgaccagga

SEQ ID NO: 3328881 - RNA, 19 nt, Mycobacterium tuberculosis H37Rv
ccggcgcauaccggcgucg

SEQ ID NO: 3328882 - RNA, 13 nt, Mycobacterium tuberculosis H37Rv
ccggcgcauuccc

SEQ ID NO: 3328883 - RNA, 13 nt, Mycobacterium tuberculosis H37Rv
ccggcgccaccgc

SEQ ID NO: 3328884 - RNA, 20 nt, Mycobacterium tuberculosis H37Rv
ccggcgccaccgccgcugcc

SEQ ID NO: 3328885 - RNA, 14 nt, Mycobacterium tuberculosis H37Rv
ccggcgccaccggc

SEQ ID NO: 3328886 - RNA, 20 nt, Mycobacterium tuberculosis H37Rv
ccggcgccaccggcgccgcc

SEQ ID NO: 3328887 - RNA, 22 nt, Mycobacterium tuberculosis H37Rv
ccggcgccaccgugguggacga

SEQ ID NO: 3328888 - RNA, 16 nt, Mycobacterium tuberculosis H37Rv
ccggcgccaccguugc

SEQ ID NO: 3328889 - RNA, 17 nt, Mycobacterium tuberculosis H37Rv
ccggcgccagcgccgcc

SEQ ID NO: 3328890 - RNA, 19 nt, Mycobacterium tuberculosis H37Rv
ccggcgccagcgccgccac

SEQ ID NO: 3328891 - RNA, 15 nt, Mycobacterium tuberculosis H37Rv
ccggcgccaggaucg

SEQ ID NO: 3328892 - RNA, 13 nt, Mycobacterium tuberculosis H37Rv
ccggcgccaucgg

SEQ ID NO: 3328893 - RNA, 16 nt, Mycobacterium tuberculosis H37Rv
ccggcgccaucggguc

SEQ ID NO: 3328894 - RNA, 17 nt, Mycobacterium tuberculosis H37Rv
ccggcgcccagcgccuc

SEQ ID NO: 3328895 - RNA, 15 nt, Mycobacterium tuberculosis H37Rv
ccggcgcccaggccg

SEQ ID NO: 3328896 - RNA, 16 nt, Mycobacterium tuberculosis H37Rv
ccggcgcccaggccga

SEQ ID NO: 3328897 - RNA, 18 nt, Mycobacterium tuberculosis H37Rv
ccggcgcccaggccgauc

SEQ ID NO: 3328898 - RNA, 22 nt, Mycobacterium tuberculosis H37Rv
ccggcgcccaggccgaucagcg

SEQ ID NO: 3328899 - RNA, 17 nt, Mycobacterium tuberculosis H37Rv
ccggcgcccccguuacc

SEQ ID NO: 3328900 - RNA, 19 nt, Mycobacterium tuberculosis H37Rv
ccggcgccgcaaucagacg

SEQ ID NO: 3328901 - RNA, 21 nt, Mycobacterium tuberculosis H37Rv
ccggcgccgcaaucagacggc

SEQ ID NO: 3328902 - RNA, 13 nt, Mycobacterium tuberculosis H37Rv
ccggcgccgcacc

SEQ ID NO: 3328903 - RNA, 17 nt, Mycobacterium tuberculosis H37Rv
ccggcgccgcaccaagc

SEQ ID NO: 3328904 - RNA, 13 nt, Mycobacterium tuberculosis H37Rv
ccggcgccgccag

SEQ ID NO: 3328905 - RNA, 17 nt, Mycobacterium tuberculosis H37Rv
ccggcgccgccagcacc

SEQ ID NO: 3328906 - RNA, 12 nt, Mycobacterium tuberculosis H37Rv
ccggcgccgccc

SEQ ID NO: 3328907 - RNA, 13 nt, Mycobacterium tuberculosis H37Rv
ccggcgccgccgg

SEQ ID NO: 3328908 - RNA, 20 nt, Mycobacterium tuberculosis H37Rv
ccggcgccgccggcaccggg

SEQ ID NO: 3328909 - RNA, 17 nt, Mycobacterium tuberculosis H37Rv
ccggcgccgccgucgcc

SEQ ID NO: 3328910 - RNA, 19 nt, Mycobacterium tuberculosis H37Rv
ccggcgccgccgucgccgc

SEQ ID NO: 3328911 - RNA, 20 nt, Mycobacterium tuberculosis H37Rv
ccggcgccgcgggugcggca

SEQ ID NO: 3328912 - RNA, 17 nt, Mycobacterium tuberculosis H37Rv
ccggcgccggagccgcc

SEQ ID NO: 3328913 - RNA, 23 nt, Mycobacterium tuberculosis H37Rv
ccggcgccggaguugaagaagcc

SEQ ID NO: 3328914 - RNA, 17 nt, Mycobacterium tuberculosis H37Rv
ccggcgccggugccgcc

SEQ ID NO: 3328915 - RNA, 18 nt, Mycobacterium tuberculosis H37Rv
ccggcgccucaucggaca

SEQ ID NO: 3328916 - RNA, 19 nt, Mycobacterium tuberculosis H37Rv
ccggcgccucaucggacag

SEQ ID NO: 3328917 - RNA, 14 nt, Mycobacterium tuberculosis H37Rv
ccggcgccuccggc

SEQ ID NO: 3328918 - RNA, 15 nt, Mycobacterium tuberculosis H37Rv
ccggcgccuccggca

SEQ ID NO: 3328919 - RNA, 23 nt, Mycobacterium tuberculosis H37Rv
ccggcgccuccggcaccuccagc

SEQ ID NO: 3328920 - RNA, 15 nt, Mycobacterium tuberculosis H37Rv
ccggcgccugcugcg

SEQ ID NO: 3328921 - RNA, 22 nt, Mycobacterium tuberculosis H37Rv
ccggcgccugcugcggccaggg

SEQ ID NO: 3328922 - RNA, 19 nt, Mycobacterium tuberculosis H37Rv
ccggcgccuuggucgccgc

SEQ ID NO: 3328923 - RNA, 18 nt, Mycobacterium tuberculosis H37Rv
ccggcgcgagcagacgca

SEQ ID NO: 3328924 - RNA, 14 nt, Mycobacterium tuberculosis H37Rv
ccggcgcgaucccc

SEQ ID NO: 3328925 - RNA, 15 nt, Mycobacterium tuberculosis H37Rv
ccggcgcgauccccg

SEQ ID NO: 3328926 - RNA, 13 nt, Mycobacterium tuberculosis H37Rv
ccggcgcgauggu

SEQ ID NO: 3328927 - RNA, 12 nt, Mycobacterium tuberculosis H37Rv
ccggcgcgcacc

SEQ ID NO: 3328928 - RNA, 15 nt, Mycobacterium tuberculosis H37Rv
ccggcgcgcaccccg

SEQ ID NO: 3328929 - RNA, 13 nt, Mycobacterium tuberculosis H37Rv
ccggcgcgcccca

SEQ ID NO: 3328930 - RNA, 15 nt, Mycobacterium tuberculosis H37Rv
ccggcgcgccccacc

SEQ ID NO: 3328931 - RNA, 22 nt, Mycobacterium tuberculosis H37Rv
ccggcgcgccccaccgcgccga

SEQ ID NO: 3328932 - RNA, 13 nt, Mycobacterium tuberculosis H37Rv
ccggcgcgccccg

SEQ ID NO: 3328933 - RNA, 17 nt, Mycobacterium tuberculosis H37Rv
ccggcgcgccccgccgc

SEQ ID NO: 3328934 - RNA, 19 nt, Mycobacterium tuberculosis H37Rv
ccggcgcgccccgccgcac

SEQ ID NO: 3328935 - RNA, 13 nt, Mycobacterium tuberculosis H37Rv
ccggcgcggccag

SEQ ID NO: 3328936 - RNA, 14 nt, Mycobacterium tuberculosis H37Rv
ccggcgcggccagc

SEQ ID NO: 3328937 - RNA, 17 nt, Mycobacterium tuberculosis H37Rv
ccggcgcggccggccgc

SEQ ID NO: 3328938 - RNA, 14 nt, Mycobacterium tuberculosis H37Rv
ccggcgcggcggac

SEQ ID NO: 3328939 - RNA, 16 nt, Mycobacterium tuberculosis H37Rv
ccggcgcggcggcguc

SEQ ID NO: 3328940 - RNA, 20 nt, Mycobacterium tuberculosis H37Rv
ccggcgcguaguaaugcucg

SEQ ID NO: 3328941 - RNA, 19 nt, Mycobacterium tuberculosis H37Rv
ccggcgcuagcgccgcgcu

SEQ ID NO: 3328942 - RNA, 16 nt, Mycobacterium tuberculosis H37Rv
ccggcgcucaucgcgu

SEQ ID NO: 3328943 - RNA, 19 nt, Mycobacterium tuberculosis H37Rv
ccggcgcuccaacgcacac

SEQ ID NO: 3328944 - RNA, 19 nt, Mycobacterium tuberculosis H37Rv
ccggcgcuccacugaccag

SEQ ID NO: 3328945 - RNA, 20 nt, Mycobacterium tuberculosis H37Rv
ccggcgcuccacugaccagg

SEQ ID NO: 3328946 - RNA, 15 nt, Mycobacterium tuberculosis H37Rv
ccggcgcuccgccag

SEQ ID NO: 3328947 - RNA, 18 nt, Mycobacterium tuberculosis H37Rv
ccggcgcuccgccagaau

SEQ ID NO: 3328948 - RNA, 12 nt, Mycobacterium tuberculosis H37Rv
ccggcgcugccc

SEQ ID NO: 3328949 - RNA, 20 nt, Mycobacterium tuberculosis H37Rv
ccggcgcugcccgggcugcc

SEQ ID NO: 3328950 - RNA, 16 nt, Mycobacterium tuberculosis H37Rv
ccggcgcugcugccau

SEQ ID NO: 3328951 - RNA, 18 nt, Mycobacterium tuberculosis H37Rv
ccggcgcuggcguggcca

SEQ ID NO: 3328952 - RNA, 17 nt, Mycobacterium tuberculosis H37Rv
ccggcggacaccucggg

SEQ ID NO: 3328953 - RNA, 18 nt, Mycobacterium tuberculosis H37Rv
ccggcggacccucgccga

SEQ ID NO: 3328954 - RNA, 22 nt, Mycobacterium tuberculosis H37Rv
ccggcggacgcccggcgcacca

SEQ ID NO: 3328955 - RNA, 19 nt, Mycobacterium tuberculosis H37Rv
ccggcggcaaagagcagcc

SEQ ID NO: 3328956 - RNA, 20 nt, Mycobacterium tuberculosis H37Rv
ccggcggcaaagagcagccg

SEQ ID NO: 3328957 - RNA, 23 nt, Mycobacterium tuberculosis H37Rv
ccggcggcaaagagcagccggcc

SEQ ID NO: 3328958 - RNA, 11 nt, Mycobacterium tuberculosis H37Rv
ccggcggcagc

SEQ ID NO: 3328959 - RNA, 16 nt, Mycobacterium tuberculosis H37Rv
ccggcggcagcggcgc

SEQ ID NO: 3328960 - RNA, 23 nt, Mycobacterium tuberculosis H37Rv
ccggcggcaucgaguucggcccg

SEQ ID NO: 3328961 - RNA, 13 nt, Mycobacterium tuberculosis H37Rv
ccggcggccagcu

SEQ ID NO: 3328962 - RNA, 13 nt, Mycobacterium tuberculosis H37Rv
ccggcggcccgau

SEQ ID NO: 3328963 - RNA, 13 nt, Mycobacterium tuberculosis H37Rv
ccggcggccgcca

SEQ ID NO: 3328964 - RNA, 18 nt, Mycobacterium tuberculosis H37Rv
ccggcggccgccaucagc

SEQ ID NO: 3328965 - RNA, 20 nt, Mycobacterium tuberculosis H37Rv
ccggcggccgccaucagccg

SEQ ID NO: 3328966 - RNA, 23 nt, Mycobacterium tuberculosis H37Rv
ccggcggccgccaucagccgcug

SEQ ID NO: 3328967 - RNA, 13 nt, Mycobacterium tuberculosis H37Rv
ccggcggccgccc

SEQ ID NO: 3328968 - RNA, 15 nt, Mycobacterium tuberculosis H37Rv
ccggcggccgcccag

SEQ ID NO: 3328969 - RNA, 13 nt, Mycobacterium tuberculosis H37Rv
ccggcggccgcgg

SEQ ID NO: 3328970 - RNA, 15 nt, Mycobacterium tuberculosis H37Rv
ccggcggcgaccaga

SEQ ID NO: 3328971 - RNA, 21 nt, Mycobacterium tuberculosis H37Rv
ccggcggcgaccagcucagcu

SEQ ID NO: 3328972 - RNA, 23 nt, Mycobacterium tuberculosis H37Rv
ccggcggcgagcggccuccagca

SEQ ID NO: 3328973 - RNA, 15 nt, Mycobacterium tuberculosis H37Rv
ccggcggcgcaucac

SEQ ID NO: 3328974 - RNA, 22 nt, Mycobacterium tuberculosis H37Rv
ccggcggcgcccaucgcgacgg

SEQ ID NO: 3328975 - RNA, 16 nt, Mycobacterium tuberculosis H37Rv
ccggcggcgccgaaac

SEQ ID NO: 3328976 - RNA, 14 nt, Mycobacterium tuberculosis H37Rv
ccggcggcgguacc

SEQ ID NO: 3328977 - RNA, 22 nt, Mycobacterium tuberculosis H37Rv
ccggcggcggugguaccggcgc

SEQ ID NO: 3328978 - RNA, 20 nt, Mycobacterium tuberculosis H37Rv
ccggcggcuggucucuggcg

SEQ ID NO: 3328979 - RNA, 18 nt, Mycobacterium tuberculosis H37Rv
ccggcgggaugcgcgccc

SEQ ID NO: 3328980 - RNA, 19 nt, Mycobacterium tuberculosis H37Rv
ccggcgggcacaccgcacc

SEQ ID NO: 3328981 - RNA, 23 nt, Mycobacterium tuberculosis H37Rv
ccggcgggcacaccgcaccuggg

SEQ ID NO: 3328982 - RNA, 14 nt, Mycobacterium tuberculosis H37Rv
ccggcgggcagaug

SEQ ID NO: 3328983 - RNA, 15 nt, Mycobacterium tuberculosis H37Rv
ccggcgggcagaugg

SEQ ID NO: 3328984 - RNA, 13 nt, Mycobacterium tuberculosis H37Rv
ccggcgggcccgc

SEQ ID NO: 3328985 - RNA, 19 nt, Mycobacterium tuberculosis H37Rv
ccggcgggcccgccggccc

SEQ ID NO: 3328986 - RNA, 21 nt, Mycobacterium tuberculosis H37Rv
ccggcgggcccgccggccccg

SEQ ID NO: 3328987 - RNA, 15 nt, Mycobacterium tuberculosis H37Rv
ccggcgggccugccc

SEQ ID NO: 3328988 - RNA, 22 nt, Mycobacterium tuberculosis H37Rv
ccggcgggcgcgggcgccggga

SEQ ID NO: 3328989 - RNA, 14 nt, Mycobacterium tuberculosis H37Rv
ccggcgggcggugg

SEQ ID NO: 3328990 - RNA, 20 nt, Mycobacterium tuberculosis H37Rv
ccggcgggcucgcccgcuac

SEQ ID NO: 3328991 - RNA, 15 nt, Mycobacterium tuberculosis H37Rv
ccggcgggcucgguc

SEQ ID NO: 3328992 - RNA, 21 nt, Mycobacterium tuberculosis H37Rv
ccggcgggcucuacucgcggc

SEQ ID NO: 3328993 - RNA, 15 nt, Mycobacterium tuberculosis H37Rv
ccggcggggauccgg

SEQ ID NO: 3328994 - RNA, 18 nt, Mycobacterium tuberculosis H37Rv
ccggcggggugcgcccac

SEQ ID NO: 3328995 - RNA, 23 nt, Mycobacterium tuberculosis H37Rv
ccggcggggugcgcccaccgacc

SEQ ID NO: 3328996 - RNA, 14 nt, Mycobacterium tuberculosis H37Rv
ccggcgggugccga

SEQ ID NO: 3328997 - RNA, 17 nt, Mycobacterium tuberculosis H37Rv
ccggcgggugccgagcu

SEQ ID NO: 3328998 - RNA, 20 nt, Mycobacterium tuberculosis H37Rv
ccggcgggugccgagcuggc

SEQ ID NO: 3328999 - RNA, 20 nt, Mycobacterium tuberculosis H37Rv
ccggcgguaccagagcagcu

SEQ ID NO: 3329000 - RNA, 18 nt, Mycobacterium tuberculosis H37Rv
ccggcgguaccgccgcgg

SEQ ID NO: 3329001 - RNA, 13 nt, Mycobacterium tuberculosis H37Rv
ccggcgguagcca

SEQ ID NO: 3329002 - RNA, 15 nt, Mycobacterium tuberculosis H37Rv
ccggcgguagucggc

SEQ ID NO: 3329003 - RNA, 18 nt, Mycobacterium tuberculosis H37Rv
ccggcgguagucggccag

SEQ ID NO: 3329004 - RNA, 20 nt, Mycobacterium tuberculosis H37Rv
ccggcgguagucggccagcu

SEQ ID NO: 3329005 - RNA, 13 nt, Mycobacterium tuberculosis H37Rv
ccggcggucgcca

SEQ ID NO: 3329006 - RNA, 19 nt, Mycobacterium tuberculosis H37Rv
ccggcggucgccagucgau

SEQ ID NO: 3329007 - RNA, 23 nt, Mycobacterium tuberculosis H37Rv
ccggcggucgcguaccgguggaa

SEQ ID NO: 3329008 - RNA, 14 nt, Mycobacterium tuberculosis H37Rv
ccggcgguggccga

SEQ ID NO: 3329009 - RNA, 17 nt, Mycobacterium tuberculosis H37Rv
ccggcgguggggccggc

SEQ ID NO: 3329010 - RNA, 12 nt, Mycobacterium tuberculosis H37Rv
ccggcgguggug

SEQ ID NO: 3329011 - RNA, 16 nt, Mycobacterium tuberculosis H37Rv
ccggcgguguuggcgc

SEQ ID NO: 3329012 - RNA, 19 nt, Mycobacterium tuberculosis H37Rv
ccggcgguucugcggccgc

SEQ ID NO: 3329013 - RNA, 13 nt, Mycobacterium tuberculosis H37Rv
ccggcguacuucg

SEQ ID NO: 3329014 - RNA, 14 nt, Mycobacterium tuberculosis H37Rv
ccggcguagcggcg

SEQ ID NO: 3329015 - RNA, 22 nt, Mycobacterium tuberculosis H37Rv
ccggcguaggcaggaucgccug

SEQ ID NO: 3329016 - RNA, 23 nt, Mycobacterium tuberculosis H37Rv
ccggcguaggcaggaucgccuga

SEQ ID NO: 3329017 - RNA, 22 nt, Mycobacterium tuberculosis H37Rv
ccggcguauagcccguagccga

SEQ ID NO: 3329018 - RNA, 14 nt, Mycobacterium tuberculosis H37Rv
ccggcgucagcccc

SEQ ID NO: 3329019 - RNA, 19 nt, Mycobacterium tuberculosis H37Rv
ccggcgucgaaggugacca

SEQ ID NO: 3329020 - RNA, 22 nt, Mycobacterium tuberculosis H37Rv
ccggcgucgaaggugaccaggc

SEQ ID NO: 3329021 - RNA, 20 nt, Mycobacterium tuberculosis H37Rv
ccggcgucgacccugcccag

SEQ ID NO: 3329022 - RNA, 13 nt, Mycobacterium tuberculosis H37Rv
ccggcgucgacga

SEQ ID NO: 3329023 - RNA, 18 nt, Mycobacterium tuberculosis H37Rv
ccggcgucgacgucggcc

SEQ ID NO: 3329024 - RNA, 16 nt, Mycobacterium tuberculosis H37Rv
ccggcgucgaugacga

SEQ ID NO: 3329025 - RNA, 19 nt, Mycobacterium tuberculosis H37Rv
ccggcgucggcgcccagcu

SEQ ID NO: 3329026 - RNA, 22 nt, Mycobacterium tuberculosis H37Rv
ccggcgucggucgucggguagg

SEQ ID NO: 3329027 - RNA, 20 nt, Mycobacterium tuberculosis H37Rv
ccggcgucugcccgcccagc

SEQ ID NO: 3329028 - RNA, 21 nt, Mycobacterium tuberculosis H37Rv
ccggcgucugcccgcccagcc

SEQ ID NO: 3329029 - RNA, 14 nt, Mycobacterium tuberculosis H37Rv
ccggcgugcacucc

SEQ ID NO: 3329030 - RNA, 16 nt, Mycobacterium tuberculosis H37Rv
ccggcgugcagaaucc

SEQ ID NO: 3329031 - RNA, 16 nt, Mycobacterium tuberculosis H37Rv
ccggcgugcggcgagg

SEQ ID NO: 3329032 - RNA, 15 nt, Mycobacterium tuberculosis H37Rv
ccggcgugcucggga

SEQ ID NO: 3329033 - RNA, 14 nt, Mycobacterium tuberculosis H37Rv
ccggcgugucgccg

SEQ ID NO: 3329034 - RNA, 18 nt, Mycobacterium tuberculosis H37Rv
ccggcgugucgccgccac

SEQ ID NO: 3329035 - RNA, 13 nt, Mycobacterium tuberculosis H37Rv
ccggcguguucug

SEQ ID NO: 3329036 - RNA, 17 nt, Mycobacterium tuberculosis H37Rv
ccggcguucccacugga

SEQ ID NO: 3329037 - RNA, 20 nt, Mycobacterium tuberculosis H37Rv
ccggcguucccgccauugcc

SEQ ID NO: 3329038 - RNA, 16 nt, Mycobacterium tuberculosis H37Rv
ccggcguugccgaaac

SEQ ID NO: 3329039 - RNA, 19 nt, Mycobacterium tuberculosis H37Rv
ccggcguugccgccguccc

SEQ ID NO: 3329040 - RNA, 20 nt, Mycobacterium tuberculosis H37Rv
ccggcguugccgccgucccc

SEQ ID NO: 3329041 - RNA, 19 nt, Mycobacterium tuberculosis H37Rv
ccggcguugccgccguugc

SEQ ID NO: 3329042 - RNA, 22 nt, Mycobacterium tuberculosis H37Rv
ccggcguuguaguugcccacgu

SEQ ID NO: 3329043 - RNA, 19 nt, Mycobacterium tuberculosis H37Rv
ccggcguuguugaccagca

SEQ ID NO: 3329044 - RNA, 16 nt, Mycobacterium tuberculosis H37Rv
ccggcguuugggcauc

SEQ ID NO: 3329045 - RNA, 22 nt, Mycobacterium tuberculosis H37Rv
ccggcuaccgccuugucggcga

SEQ ID NO: 3329046 - RNA, 14 nt, Mycobacterium tuberculosis H37Rv
ccggcuaccgcgcu

SEQ ID NO: 3329047 - RNA, 16 nt, Mycobacterium tuberculosis H37Rv
ccggcuacgacggcgc

SEQ ID NO: 3329048 - RNA, 19 nt, Mycobacterium tuberculosis H37Rv
ccggcuaggagaucagcac

SEQ ID NO: 3329049 - RNA, 23 nt, Mycobacterium tuberculosis H37Rv
ccggcuagggcagcagcccgggc

SEQ ID NO: 3329050 - RNA, 18 nt, Mycobacterium tuberculosis H37Rv
ccggcuauaucccgcccc

SEQ ID NO: 3329051 - RNA, 17 nt, Mycobacterium tuberculosis H37Rv
ccggcuauuagcggcuu

SEQ ID NO: 3329052 - RNA, 20 nt, Mycobacterium tuberculosis H37Rv
ccggcucacagcacagcgca

SEQ ID NO: 3329053 - RNA, 22 nt, Mycobacterium tuberculosis H37Rv
ccggcucacagcacagcgcagc

SEQ ID NO: 3329054 - RNA, 17 nt, Mycobacterium tuberculosis H37Rv
ccggcucaccgaucccg

SEQ ID NO: 3329055 - RNA, 23 nt, Mycobacterium tuberculosis H37Rv
ccggcucaggggcuacuaggccc

SEQ ID NO: 3329056 - RNA, 18 nt, Mycobacterium tuberculosis H37Rv
ccggcucauccgacggga

SEQ ID NO: 3329057 - RNA, 14 nt, Mycobacterium tuberculosis H37Rv
ccggcucaucgcag

SEQ ID NO: 3329058 - RNA, 19 nt, Mycobacterium tuberculosis H37Rv
ccggcucaucgcagccggu

SEQ ID NO: 3329059 - RNA, 20 nt, Mycobacterium tuberculosis H37Rv
ccggcucccgggggcacucc

SEQ ID NO: 3329060 - RNA, 12 nt, Mycobacterium tuberculosis H37Rv
ccggcuccgccg

SEQ ID NO: 3329061 - RNA, 17 nt, Mycobacterium tuberculosis H37Rv
ccggcuccgccguugac

SEQ ID NO: 3329062 - RNA, 16 nt, Mycobacterium tuberculosis H37Rv
ccggcuccuccccggc

SEQ ID NO: 3329063 - RNA, 16 nt, Mycobacterium tuberculosis H37Rv
ccggcucgacugccac

SEQ ID NO: 3329064 - RNA, 12 nt, Mycobacterium tuberculosis H37Rv
ccggcucgccgg

SEQ ID NO: 3329065 - RNA, 19 nt, Mycobacterium tuberculosis H37Rv
ccggcucggaaaccgcccc

SEQ ID NO: 3329066 - RNA, 14 nt, Mycobacterium tuberculosis H37Rv
ccggcucggccagc

SEQ ID NO: 3329067 - RNA, 21 nt, Mycobacterium tuberculosis H37Rv
ccggcucggccagccagcggg

SEQ ID NO: 3329068 - RNA, 16 nt, Mycobacterium tuberculosis H37Rv
ccggcucgucgggcag

SEQ ID NO: 3329069 - RNA, 18 nt, Mycobacterium tuberculosis H37Rv
ccggcucucagcgacagc

SEQ ID NO: 3329070 - RNA, 19 nt, Mycobacterium tuberculosis H37Rv
ccggcucucuucgcgcgcu

SEQ ID NO: 3329071 - RNA, 20 nt, Mycobacterium tuberculosis H37Rv
ccggcucuuuuucgaucgcu

SEQ ID NO: 3329072 - RNA, 21 nt, Mycobacterium tuberculosis H37Rv
ccggcugaaacguccuugaac

SEQ ID NO: 3329073 - RNA, 12 nt, Mycobacterium tuberculosis H37Rv
ccggcugaccgg

SEQ ID NO: 3329074 - RNA, 15 nt, Mycobacterium tuberculosis H37Rv
ccggcugaucuacca

SEQ ID NO: 3329075 - RNA, 20 nt, Mycobacterium tuberculosis H37Rv
ccggcugcaaccagcggcac

SEQ ID NO: 3329076 - RNA, 13 nt, Mycobacterium tuberculosis H37Rv
ccggcugccacac

SEQ ID NO: 3329077 - RNA, 15 nt, Mycobacterium tuberculosis H37Rv
ccggcugccacacag

SEQ ID NO: 3329078 - RNA, 17 nt, Mycobacterium tuberculosis H37Rv
ccggcugccagcgccgc

SEQ ID NO: 3329079 - RNA, 20 nt, Mycobacterium tuberculosis H37Rv
ccggcugccagcgccgccgc

SEQ ID NO: 3329080 - RNA, 22 nt, Mycobacterium tuberculosis H37Rv
ccggcugccagcgccgccgccg

SEQ ID NO: 3329081 - RNA, 13 nt, Mycobacterium tuberculosis H37Rv
ccggcugccgcac

SEQ ID NO: 3329082 - RNA, 19 nt, Mycobacterium tuberculosis H37Rv
ccggcugccgucagcugac

SEQ ID NO: 3329083 - RNA, 13 nt, Mycobacterium tuberculosis H37Rv
ccggcugcgccgg

SEQ ID NO: 3329084 - RNA, 19 nt, Mycobacterium tuberculosis H37Rv
ccggcugcgccgggcucgc

SEQ ID NO: 3329085 - RNA, 22 nt, Mycobacterium tuberculosis H37Rv
ccggcugcgguaaucgccaccg

SEQ ID NO: 3329086 - RNA, 16 nt, Mycobacterium tuberculosis H37Rv
ccggcugcugaggaga

SEQ ID NO: 3329087 - RNA, 19 nt, Mycobacterium tuberculosis H37Rv
ccggcugggcgccaccauc

SEQ ID NO: 3329088 - RNA, 23 nt, Mycobacterium tuberculosis H37Rv
ccggcuggugccuuaccaccguc

SEQ ID NO: 3329089 - RNA, 13 nt, Mycobacterium tuberculosis H37Rv
ccggcuguucucg

SEQ ID NO: 3329090 - RNA, 16 nt, Mycobacterium tuberculosis H37Rv
ccggcuguucucgccg

SEQ ID NO: 3329091 - RNA, 20 nt, Mycobacterium tuberculosis H37Rv
ccggcuuaccggcgggcgaa

SEQ ID NO: 3329092 - RNA, 13 nt, Mycobacterium tuberculosis H37Rv
ccggcuucgccgc

SEQ ID NO: 3329093 - RNA, 12 nt, Mycobacterium tuberculosis H37Rv
ccggcuucggcg

SEQ ID NO: 3329094 - RNA, 13 nt, Mycobacterium tuberculosis H37Rv
ccggcuucggcga

SEQ ID NO: 3329095 - RNA, 20 nt, Mycobacterium tuberculosis H37Rv
ccggcuucggugagcgggca

SEQ ID NO: 3329096 - RNA, 17 nt, Mycobacterium tuberculosis H37Rv
ccggcuucgucggccag

SEQ ID NO: 3329097 - RNA, 18 nt, Mycobacterium tuberculosis H37Rv
ccggcuucgucggccagc

SEQ ID NO: 3329098 - RNA, 16 nt, Mycobacterium tuberculosis H37Rv
ccggcuuggcggcgau

SEQ ID NO: 3329099 - RNA, 13 nt, Mycobacterium tuberculosis H37Rv
ccggcuugggcca

SEQ ID NO: 3329100 - RNA, 20 nt, Mycobacterium tuberculosis H37Rv
ccggcuugggccaggcccag

SEQ ID NO: 3329101 - RNA, 24 nt, Mycobacterium tuberculosis H37Rv
ccggcuugggcgguagccgacgac

SEQ ID NO: 3329102 - RNA, 20 nt, Mycobacterium tuberculosis H37Rv
ccggcuugucgaccacgacc

SEQ ID NO: 3329103 - RNA, 18 nt, Mycobacterium tuberculosis H37Rv
ccggcuuucccaccgcuu

SEQ ID NO: 3329104 - RNA, 19 nt, Mycobacterium tuberculosis H37Rv
ccggcuuugcuugccgcau

SEQ ID NO: 3329105 - RNA, 16 nt, Mycobacterium tuberculosis H37Rv
ccggcuuuugcgccca

SEQ ID NO: 3329106 - RNA, 15 nt, Mycobacterium tuberculosis H37Rv
ccgggaaccaacacc

SEQ ID NO: 3329107 - RNA, 16 nt, Mycobacterium tuberculosis H37Rv
ccgggaacccgagcuu

SEQ ID NO: 3329108 - RNA, 13 nt, Mycobacterium tuberculosis H37Rv
ccgggaacgaggu

SEQ ID NO: 3329109 - RNA, 18 nt, Mycobacterium tuberculosis H37Rv
ccgggaacgccucagggg

SEQ ID NO: 3329110 - RNA, 19 nt, Mycobacterium tuberculosis H37Rv
ccgggaacgcugacgcccu

SEQ ID NO: 3329111 - RNA, 16 nt, Mycobacterium tuberculosis H37Rv
ccgggaaggaaccggg

SEQ ID NO: 3329112 - RNA, 14 nt, Mycobacterium tuberculosis H37Rv
ccgggaagucgcug

SEQ ID NO: 3329113 - RNA, 15 nt, Mycobacterium tuberculosis H37Rv
ccgggaagucgcuga

SEQ ID NO: 3329114 - RNA, 21 nt, Mycobacterium tuberculosis H37Rv
ccgggaagucgcugaagccgu

SEQ ID NO: 3329115 - RNA, 16 nt, Mycobacterium tuberculosis H37Rv
ccgggaauggacaggu

SEQ ID NO: 3329116 - RNA, 21 nt, Mycobacterium tuberculosis H37Rv
ccgggaauggacaggucgggc

SEQ ID NO: 3329117 - RNA, 21 nt, Mycobacterium tuberculosis H37Rv
ccgggacaaccgcgccgacag

SEQ ID NO: 3329118 - RNA, 18 nt, Mycobacterium tuberculosis H37Rv
ccgggacaaucucggccg

SEQ ID NO: 3329119 - RNA, 22 nt, Mycobacterium tuberculosis H37Rv
ccgggaccauagccugcgccga

SEQ ID NO: 3329120 - RNA, 19 nt, Mycobacterium tuberculosis H37Rv
ccgggaccauagucgccgu

SEQ ID NO: 3329121 - RNA, 21 nt, Mycobacterium tuberculosis H37Rv
ccgggaccauagucgccgucg

SEQ ID NO: 3329122 - RNA, 18 nt, Mycobacterium tuberculosis H37Rv
ccgggaccgcgaacccgu

SEQ ID NO: 3329123 - RNA, 13 nt, Mycobacterium tuberculosis H37Rv
ccgggacggcgau

SEQ ID NO: 3329124 - RNA, 17 nt, Mycobacterium tuberculosis H37Rv
ccgggacgugucgguga

SEQ ID NO: 3329125 - RNA, 19 nt, Mycobacterium tuberculosis H37Rv
ccgggacgugucggugaac

SEQ ID NO: 3329126 - RNA, 20 nt, Mycobacterium tuberculosis H37Rv
ccgggacguuguccaccgcc

SEQ ID NO: 3329127 - RNA, 16 nt, Mycobacterium tuberculosis H37Rv
ccgggagucgucggca

SEQ ID NO: 3329128 - RNA, 16 nt, Mycobacterium tuberculosis H37Rv
ccgggagugcgccggc

SEQ ID NO: 3329129 - RNA, 15 nt, Mycobacterium tuberculosis H37Rv
ccgggauaacccagc

SEQ ID NO: 3329130 - RNA, 18 nt, Mycobacterium tuberculosis H37Rv
ccgggauaacccagcacc

SEQ ID NO: 3329131 - RNA, 23 nt, Mycobacterium tuberculosis H37Rv
ccgggaucuagaugcggaacgcc

SEQ ID NO: 3329132 - RNA, 21 nt, Mycobacterium tuberculosis H37Rv
ccgggaugcgacagcgcuggg

SEQ ID NO: 3329133 - RNA, 17 nt, Mycobacterium tuberculosis H37Rv
ccgggaugugcggcugc

SEQ ID NO: 3329134 - RNA, 17 nt, Mycobacterium tuberculosis H37Rv
ccgggauugccgccacc

SEQ ID NO: 3329135 - RNA, 16 nt, Mycobacterium tuberculosis H37Rv
ccgggcaaaucaagca

SEQ ID NO: 3329136 - RNA, 18 nt, Mycobacterium tuberculosis H37Rv
ccgggcaaccagcagcag

SEQ ID NO: 3329137 - RNA, 22 nt, Mycobacterium tuberculosis H37Rv
ccgggcaacgcgaaccggccau

SEQ ID NO: 3329138 - RNA, 24 nt, Mycobacterium tuberculosis H37Rv
ccgggcaacgcgaaccggccaucg

SEQ ID NO: 3329139 - RNA, 14 nt, Mycobacterium tuberculosis H37Rv
ccgggcaacggcgg

SEQ ID NO: 3329140 - RNA, 21 nt, Mycobacterium tuberculosis H37Rv
ccgggcaacggcggggccggc

SEQ ID NO: 3329141 - RNA, 15 nt, Mycobacterium tuberculosis H37Rv
ccgggcaaggcccgg

SEQ ID NO: 3329142 - RNA, 14 nt, Mycobacterium tuberculosis H37Rv
ccgggcaaucgcuc

SEQ ID NO: 3329143 - RNA, 23 nt, Mycobacterium tuberculosis H37Rv
ccgggcaccaauaccgcacccgc

SEQ ID NO: 3329144 - RNA, 20 nt, Mycobacterium tuberculosis H37Rv
ccgggcaccacccuugccga

SEQ ID NO: 3329145 - RNA, 23 nt, Mycobacterium tuberculosis H37Rv
ccgggcaccacuuggguggcgcc

SEQ ID NO: 3329146 - RNA, 18 nt, Mycobacterium tuberculosis H37Rv
ccgggcaccggccggugg

SEQ ID NO: 3329147 - RNA, 14 nt, Mycobacterium tuberculosis H37Rv
ccgggcaccgucgg

SEQ ID NO: 3329148 - RNA, 16 nt, Mycobacterium tuberculosis H37Rv
ccgggcaccgucggaa

SEQ ID NO: 3329149 - RNA, 23 nt, Mycobacterium tuberculosis H37Rv
ccgggcacgaacaucagaucgcc

SEQ ID NO: 3329150 - RNA, 13 nt, Mycobacterium tuberculosis H37Rv
ccgggcacgcgag

SEQ ID NO: 3329151 - RNA, 19 nt, Mycobacterium tuberculosis H37Rv
ccgggcagaugaugccguu

SEQ ID NO: 3329152 - RNA, 23 nt, Mycobacterium tuberculosis H37Rv
ccgggcagaugaugccguucgga

SEQ ID NO: 3329153 - RNA, 15 nt, Mycobacterium tuberculosis H37Rv
ccgggcagccccucc

SEQ ID NO: 3329154 - RNA, 19 nt, Mycobacterium tuberculosis H37Rv
ccgggcagccccuccgcgc

SEQ ID NO: 3329155 - RNA, 14 nt, Mycobacterium tuberculosis H37Rv
ccgggcagccgcgc

SEQ ID NO: 3329156 - RNA, 16 nt, Mycobacterium tuberculosis H37Rv
ccgggcagccgcgccg

SEQ ID NO: 3329157 - RNA, 14 nt, Mycobacterium tuberculosis H37Rv
ccgggcagcugggc

SEQ ID NO: 3329158 - RNA, 18 nt, Mycobacterium tuberculosis H37Rv
ccgggcagcugggcagga

SEQ ID NO: 3329159 - RNA, 17 nt, Mycobacterium tuberculosis H37Rv
ccgggcagucaggccua

SEQ ID NO: 3329160 - RNA, 17 nt, Mycobacterium tuberculosis H37Rv
ccgggcaguccaggcac

SEQ ID NO: 3329161 - RNA, 19 nt, Mycobacterium tuberculosis H37Rv
ccgggcauccuucaccagc

SEQ ID NO: 3329162 - RNA, 19 nt, Mycobacterium tuberculosis H37Rv
ccgggccaagacggcgggc

SEQ ID NO: 3329163 - RNA, 12 nt, Mycobacterium tuberculosis H37Rv
ccgggccaaugc

SEQ ID NO: 3329164 - RNA, 15 nt, Mycobacterium tuberculosis H37Rv
ccgggccaaugccgu

SEQ ID NO: 3329165 - RNA, 21 nt, Mycobacterium tuberculosis H37Rv
ccgggccaaugccguugaucg

SEQ ID NO: 3329166 - RNA, 11 nt, Mycobacterium tuberculosis H37Rv
ccgggccaccg

SEQ ID NO: 3329167 - RNA, 21 nt, Mycobacterium tuberculosis H37Rv
ccgggccacgucgagcacccg

SEQ ID NO: 3329168 - RNA, 17 nt, Mycobacterium tuberculosis H37Rv
ccgggccaggcugcgca

SEQ ID NO: 3329169 - RNA, 19 nt, Mycobacterium tuberculosis H37Rv
ccgggccaguucgucggcg

SEQ ID NO: 3329170 - RNA, 17 nt, Mycobacterium tuberculosis H37Rv
ccgggccaucgcauccc

SEQ ID NO: 3329171 - RNA, 17 nt, Mycobacterium tuberculosis H37Rv
ccgggccauucaccgcg

SEQ ID NO: 3329172 - RNA, 19 nt, Mycobacterium tuberculosis H37Rv
ccgggccauucaccgcgca

SEQ ID NO: 3329173 - RNA, 21 nt, Mycobacterium tuberculosis H37Rv
ccgggccccggggugcccccg

SEQ ID NO: 3329174 - RNA, 20 nt, Mycobacterium tuberculosis H37Rv
ccgggccccuucgcagcaug

SEQ ID NO: 3329175 - RNA, 17 nt, Mycobacterium tuberculosis H37Rv
ccgggcccgccgucccc

SEQ ID NO: 3329176 - RNA, 16 nt, Mycobacterium tuberculosis H37Rv
ccgggccgagcgcacc

SEQ ID NO: 3329177 - RNA, 21 nt, Mycobacterium tuberculosis H37Rv
ccgggccgagugcccagcgau

SEQ ID NO: 3329178 - RNA, 14 nt, Mycobacterium tuberculosis H37Rv
ccgggccgaucacc

SEQ ID NO: 3329179 - RNA, 16 nt, Mycobacterium tuberculosis H37Rv
ccgggccgccagggcc

SEQ ID NO: 3329180 - RNA, 13 nt, Mycobacterium tuberculosis H37Rv
ccgggccgccgcc

SEQ ID NO: 3329181 - RNA, 14 nt, Mycobacterium tuberculosis H37Rv
ccgggccgccgccc

SEQ ID NO: 3329182 - RNA, 16 nt, Mycobacterium tuberculosis H37Rv
ccgggccgccgccccg

SEQ ID NO: 3329183 - RNA, 14 nt, Mycobacterium tuberculosis H37Rv
ccgggccgccgcga

SEQ ID NO: 3329184 - RNA, 12 nt, Mycobacterium tuberculosis H37Rv
ccgggccgcgcg

SEQ ID NO: 3329185 - RNA, 17 nt, Mycobacterium tuberculosis H37Rv
ccgggccgcggccacau

SEQ ID NO: 3329186 - RNA, 15 nt, Mycobacterium tuberculosis H37Rv
ccgggccgcggcggc

SEQ ID NO: 3329187 - RNA, 15 nt, Mycobacterium tuberculosis H37Rv
ccgggccggcgagcu

SEQ ID NO: 3329188 - RNA, 15 nt, Mycobacterium tuberculosis H37Rv
ccgggccguagaaau

SEQ ID NO: 3329189 - RNA, 15 nt, Mycobacterium tuberculosis H37Rv
ccgggccguccggcg

SEQ ID NO: 3329190 - RNA, 18 nt, Mycobacterium tuberculosis H37Rv
ccgggccguguccgccgg

SEQ ID NO: 3329191 - RNA, 13 nt, Mycobacterium tuberculosis H37Rv
ccgggccuggccu

SEQ ID NO: 3329192 - RNA, 15 nt, Mycobacterium tuberculosis H37Rv
ccgggccuggccugc

SEQ ID NO: 3329193 - RNA, 18 nt, Mycobacterium tuberculosis H37Rv
ccgggccuggccugccca

SEQ ID NO: 3329194 - RNA, 20 nt, Mycobacterium tuberculosis H37Rv
ccgggccugggacggcggca

SEQ ID NO: 3329195 - RNA, 20 nt, Mycobacterium tuberculosis H37Rv
ccgggccuguaccggcaaac

SEQ ID NO: 3329196 - RNA, 18 nt, Mycobacterium tuberculosis H37Rv
ccgggccuugcgcgcgca

SEQ ID NO: 3329197 - RNA, 16 nt, Mycobacterium tuberculosis H37Rv
ccgggcgaccaccacc

SEQ ID NO: 3329198 - RNA, 20 nt, Mycobacterium tuberculosis H37Rv
ccgggcgaguacaggcgcag

SEQ ID NO: 3329199 - RNA, 16 nt, Mycobacterium tuberculosis H37Rv
ccgggcgagucccggc

SEQ ID NO: 3329200 - RNA, 22 nt, Mycobacterium tuberculosis H37Rv
ccgggcgaucaaagccagcacc

SEQ ID NO: 3329201 - RNA, 23 nt, Mycobacterium tuberculosis H37Rv
ccgggcgauucgcaaucagcugg

SEQ ID NO: 3329202 - RNA, 15 nt, Mycobacterium tuberculosis H37Rv
ccgggcgcaagcagc

SEQ ID NO: 3329203 - RNA, 16 nt, Mycobacterium tuberculosis H37Rv
ccgggcgccgaucacg

SEQ ID NO: 3329204 - RNA, 18 nt, Mycobacterium tuberculosis H37Rv
ccgggcgcuugcaccagg

SEQ ID NO: 3329205 - RNA, 23 nt, Mycobacterium tuberculosis H37Rv
ccgggcgcuugcaccaggggcgc

SEQ ID NO: 3329206 - RNA, 17 nt, Mycobacterium tuberculosis H37Rv
ccgggcggaacgccggc

SEQ ID NO: 3329207 - RNA, 23 nt, Mycobacterium tuberculosis H37Rv
ccgggcggccaaccccgaugagg

SEQ ID NO: 3329208 - RNA, 16 nt, Mycobacterium tuberculosis H37Rv
ccgggcggccagcugc

SEQ ID NO: 3329209 - RNA, 21 nt, Mycobacterium tuberculosis H37Rv
ccgggcggccaggcgcgacgu

SEQ ID NO: 3329210 - RNA, 15 nt, Mycobacterium tuberculosis H37Rv
ccgggcggccucccg

SEQ ID NO: 3329211 - RNA, 17 nt, Mycobacterium tuberculosis H37Rv
ccgggcggccucccggg

SEQ ID NO: 3329212 - RNA, 19 nt, Mycobacterium tuberculosis H37Rv
ccgggcggccucccgggcc

SEQ ID NO: 3329213 - RNA, 17 nt, Mycobacterium tuberculosis H37Rv
ccgggcggccucguuga

SEQ ID NO: 3329214 - RNA, 23 nt, Mycobacterium tuberculosis H37Rv
ccgggcggcggcggauuccggca

SEQ ID NO: 3329215 - RNA, 20 nt, Mycobacterium tuberculosis H37Rv
ccgggcggcggugcgucagc

SEQ ID NO: 3329216 - RNA, 19 nt, Mycobacterium tuberculosis H37Rv
ccgggcgggauccacccag

SEQ ID NO: 3329217 - RNA, 21 nt, Mycobacterium tuberculosis H37Rv
ccgggcgggauccacccagug

SEQ ID NO: 3329218 - RNA, 14 nt, Mycobacterium tuberculosis H37Rv
ccgggcggucgaag

SEQ ID NO: 3329219 - RNA, 17 nt, Mycobacterium tuberculosis H37Rv
ccgggcgugcggcggcc

SEQ ID NO: 3329220 - RNA, 20 nt, Mycobacterium tuberculosis H37Rv
ccgggcgugcggcggcccau

SEQ ID NO: 3329221 - RNA, 22 nt, Mycobacterium tuberculosis H37Rv
ccgggcgugggugucggcgaag

SEQ ID NO: 3329222 - RNA, 14 nt, Mycobacterium tuberculosis H37Rv
ccgggcguuucccu

SEQ ID NO: 3329223 - RNA, 22 nt, Mycobacterium tuberculosis H37Rv
ccgggcucagacuuucgcccag

SEQ ID NO: 3329224 - RNA, 17 nt, Mycobacterium tuberculosis H37Rv
ccgggcucagcugggcc

SEQ ID NO: 3329225 - RNA, 18 nt, Mycobacterium tuberculosis H37Rv
ccgggcucagcugggccg

SEQ ID NO: 3329226 - RNA, 11 nt, Mycobacterium tuberculosis H37Rv
ccgggcucgcg

SEQ ID NO: 3329227 - RNA, 14 nt, Mycobacterium tuberculosis H37Rv
ccgggcucgcgauc

SEQ ID NO: 3329228 - RNA, 17 nt, Mycobacterium tuberculosis H37Rv
ccgggcucgcgaucguc

SEQ ID NO: 3329229 - RNA, 14 nt, Mycobacterium tuberculosis H37Rv
ccgggcucggcgaa

SEQ ID NO: 3329230 - RNA, 15 nt, Mycobacterium tuberculosis H37Rv
ccgggcucggcgaag

SEQ ID NO: 3329231 - RNA, 22 nt, Mycobacterium tuberculosis H37Rv
ccgggcucggcgaaggccgcgc

SEQ ID NO: 3329232 - RNA, 17 nt, Mycobacterium tuberculosis H37Rv
ccgggcucuggccaguc

SEQ ID NO: 3329233 - RNA, 21 nt, Mycobacterium tuberculosis H37Rv
ccgggcugaggcggcgacgac

SEQ ID NO: 3329234 - RNA, 23 nt, Mycobacterium tuberculosis H37Rv
ccgggcugccgcccaugccggga

SEQ ID NO: 3329235 - RNA, 19 nt, Mycobacterium tuberculosis H37Rv
ccgggcuggccagcgcgcu

SEQ ID NO: 3329236 - RNA, 22 nt, Mycobacterium tuberculosis H37Rv
ccgggcuguagcgaaugaucuu

SEQ ID NO: 3329237 - RNA, 17 nt, Mycobacterium tuberculosis H37Rv
ccgggcuguuggccacc

SEQ ID NO: 3329238 - RNA, 15 nt, Mycobacterium tuberculosis H37Rv
ccgggcuuaggccgc

SEQ ID NO: 3329239 - RNA, 18 nt, Mycobacterium tuberculosis H37Rv
ccggggaagaucucggcc

SEQ ID NO: 3329240 - RNA, 20 nt, Mycobacterium tuberculosis H37Rv
ccggggaagaucucggccag

SEQ ID NO: 3329241 - RNA, 12 nt, Mycobacterium tuberculosis H37Rv
ccggggaaugag

SEQ ID NO: 3329242 - RNA, 15 nt, Mycobacterium tuberculosis H37Rv
ccggggacgcgcccc

SEQ ID NO: 3329243 - RNA, 18 nt, Mycobacterium tuberculosis H37Rv
ccggggacgggucggcag

SEQ ID NO: 3329244 - RNA, 16 nt, Mycobacterium tuberculosis H37Rv
ccggggacgucgacuu

SEQ ID NO: 3329245 - RNA, 19 nt, Mycobacterium tuberculosis H37Rv
ccggggauaccggucagca

SEQ ID NO: 3329246 - RNA, 18 nt, Mycobacterium tuberculosis H37Rv
ccggggauaucacgacgc

SEQ ID NO: 3329247 - RNA, 13 nt, Mycobacterium tuberculosis H37Rv
ccggggccacccg

SEQ ID NO: 3329248 - RNA, 15 nt, Mycobacterium tuberculosis H37Rv
ccggggccccaugcc

SEQ ID NO: 3329249 - RNA, 19 nt, Mycobacterium tuberculosis H37Rv
ccggggccccaugccgacc

SEQ ID NO: 3329250 - RNA, 12 nt, Mycobacterium tuberculosis H37Rv
ccggggccgcaa

SEQ ID NO: 3329251 - RNA, 17 nt, Mycobacterium tuberculosis H37Rv
ccggggccgccgaugcc

SEQ ID NO: 3329252 - RNA, 17 nt, Mycobacterium tuberculosis H37Rv
ccggggccgccgucgcc

SEQ ID NO: 3329253 - RNA, 15 nt, Mycobacterium tuberculosis H37Rv
ccggggccgucggca

SEQ ID NO: 3329254 - RNA, 15 nt, Mycobacterium tuberculosis H37Rv
ccggggcgcccggcc

SEQ ID NO: 3329255 - RNA, 19 nt, Mycobacterium tuberculosis H37Rv
ccggggcgcccggccaggu

SEQ ID NO: 3329256 - RNA, 15 nt, Mycobacterium tuberculosis H37Rv
ccggggcgcucgcgc

SEQ ID NO: 3329257 - RNA, 20 nt, Mycobacterium tuberculosis H37Rv
ccggggcgggauauagccgg

SEQ ID NO: 3329258 - RNA, 21 nt, Mycobacterium tuberculosis H37Rv
ccggggcuggcuguggcgcgc

SEQ ID NO: 3329259 - RNA, 18 nt, Mycobacterium tuberculosis H37Rv
ccggggcugggggccggc

SEQ ID NO: 3329260 - RNA, 20 nt, Mycobacterium tuberculosis H37Rv
ccgggggaagcgccaacccg

SEQ ID NO: 3329261 - RNA, 13 nt, Mycobacterium tuberculosis H37Rv
ccggggggcugcu

SEQ ID NO: 3329262 - RNA, 23 nt, Mycobacterium tuberculosis H37Rv
ccggggggcugcugcucggccug

SEQ ID NO: 3329263 - RNA, 13 nt, Mycobacterium tuberculosis H37Rv
ccgggggguugau

SEQ ID NO: 3329264 - RNA, 17 nt, Mycobacterium tuberculosis H37Rv
ccgggguagacgccccg

SEQ ID NO: 3329265 - RNA, 14 nt, Mycobacterium tuberculosis H37Rv
ccggggucgaacgc

SEQ ID NO: 3329266 - RNA, 15 nt, Mycobacterium tuberculosis H37Rv
ccggggucgaacgcg

SEQ ID NO: 3329267 - RNA, 12 nt, Mycobacterium tuberculosis H37Rv
ccggggucggcc

SEQ ID NO: 3329268 - RNA, 14 nt, Mycobacterium tuberculosis H37Rv
ccggggucggcccg

SEQ ID NO: 3329269 - RNA, 15 nt, Mycobacterium tuberculosis H37Rv
ccggggucggcccgc

SEQ ID NO: 3329270 - RNA, 14 nt, Mycobacterium tuberculosis H37Rv
ccggggucggccug

SEQ ID NO: 3329271 - RNA, 22 nt, Mycobacterium tuberculosis H37Rv
ccggggugaaaaucgccaucgg

SEQ ID NO: 3329272 - RNA, 19 nt, Mycobacterium tuberculosis H37Rv
ccggggugcccccggugcc

SEQ ID NO: 3329273 - RNA, 22 nt, Mycobacterium tuberculosis H37Rv
ccggggugcccccggugccgcc

SEQ ID NO: 3329274 - RNA, 12 nt, Mycobacterium tuberculosis H37Rv
ccgggguggcgc

SEQ ID NO: 3329275 - RNA, 15 nt, Mycobacterium tuberculosis H37Rv
ccggggugugcgggc

SEQ ID NO: 3329276 - RNA, 13 nt, Mycobacterium tuberculosis H37Rv
ccgggguucaccg

SEQ ID NO: 3329277 - RNA, 17 nt, Mycobacterium tuberculosis H37Rv
ccgggguugcccgcgac

SEQ ID NO: 3329278 - RNA, 17 nt, Mycobacterium tuberculosis H37Rv
ccgggguuggucgucgc

SEQ ID NO: 3329279 - RNA, 23 nt, Mycobacterium tuberculosis H37Rv
ccggguaaagcgaugggaacggg

SEQ ID NO: 3329280 - RNA, 12 nt, Mycobacterium tuberculosis H37Rv
ccggguaccgag

SEQ ID NO: 3329281 - RNA, 20 nt, Mycobacterium tuberculosis H37Rv
ccggguacggaugucggaca

SEQ ID NO: 3329282 - RNA, 17 nt, Mycobacterium tuberculosis H37Rv
ccggguagacaccgcga

SEQ ID NO: 3329283 - RNA, 19 nt, Mycobacterium tuberculosis H37Rv
ccggguagacaugggugaa

SEQ ID NO: 3329284 - RNA, 20 nt, Mycobacterium tuberculosis H37Rv
ccggguagcggcgccgcccu

SEQ ID NO: 3329285 - RNA, 14 nt, Mycobacterium tuberculosis H37Rv
ccggguauggcggc

SEQ ID NO: 3329286 - RNA, 17 nt, Mycobacterium tuberculosis H37Rv
ccgggucaacgccauca

SEQ ID NO: 3329287 - RNA, 13 nt, Mycobacterium tuberculosis H37Rv
ccgggucaccagc

SEQ ID NO: 3329288 - RNA, 16 nt, Mycobacterium tuberculosis H37Rv
ccgggucaccagcgca

SEQ ID NO: 3329289 - RNA, 17 nt, Mycobacterium tuberculosis H37Rv
ccgggucacgugggcca

SEQ ID NO: 3329290 - RNA, 19 nt, Mycobacterium tuberculosis H37Rv
ccgggucacgugggccaug

SEQ ID NO: 3329291 - RNA, 19 nt, Mycobacterium tuberculosis H37Rv
ccgggucagcccggcgcga

SEQ ID NO: 3329292 - RNA, 22 nt, Mycobacterium tuberculosis H37Rv
ccggguccaagaaccacgacgu

SEQ ID NO: 3329293 - RNA, 23 nt, Mycobacterium tuberculosis H37Rv
ccggguccaagaaccacgacguu

SEQ ID NO: 3329294 - RNA, 23 nt, Mycobacterium tuberculosis H37Rv
ccgggucccauuugccuugagcc

SEQ ID NO: 3329295 - RNA, 13 nt, Mycobacterium tuberculosis H37Rv
ccggguccgccgg

SEQ ID NO: 3329296 - RNA, 17 nt, Mycobacterium tuberculosis H37Rv
ccggguccgccgggccc

SEQ ID NO: 3329297 - RNA, 23 nt, Mycobacterium tuberculosis H37Rv
ccggguccgccguugccgauccc

SEQ ID NO: 3329298 - RNA, 17 nt, Mycobacterium tuberculosis H37Rv
ccggguccggaaccggu

SEQ ID NO: 3329299 - RNA, 15 nt, Mycobacterium tuberculosis H37Rv
ccggguccggcguac

SEQ ID NO: 3329300 - RNA, 14 nt, Mycobacterium tuberculosis H37Rv
ccgggucgaacagg

SEQ ID NO: 3329301 - RNA, 22 nt, Mycobacterium tuberculosis H37Rv
ccgggucgaacaggccggccgc

SEQ ID NO: 3329302 - RNA, 20 nt, Mycobacterium tuberculosis H37Rv
ccgggucgacgacgucgcgc

SEQ ID NO: 3329303 - RNA, 15 nt, Mycobacterium tuberculosis H37Rv
ccgggucgacgcgau

SEQ ID NO: 3329304 - RNA, 17 nt, Mycobacterium tuberculosis H37Rv
ccgggucgacgcgauga

SEQ ID NO: 3329305 - RNA, 12 nt, Mycobacterium tuberculosis H37Rv
ccgggucgaugc

SEQ ID NO: 3329306 - RNA, 18 nt, Mycobacterium tuberculosis H37Rv
ccgggucgaugucggggc

SEQ ID NO: 3329307 - RNA, 22 nt, Mycobacterium tuberculosis H37Rv
ccgggucgaugucggggccguc

SEQ ID NO: 3329308 - RNA, 19 nt, Mycobacterium tuberculosis H37Rv
ccgggucgcaaccgccgcc

SEQ ID NO: 3329309 - RNA, 13 nt, Mycobacterium tuberculosis H37Rv
ccgggucggcacg

SEQ ID NO: 3329310 - RNA, 12 nt, Mycobacterium tuberculosis H37Rv
ccgggucggcga

SEQ ID NO: 3329311 - RNA, 14 nt, Mycobacterium tuberculosis H37Rv
ccgggucggcgaac

SEQ ID NO: 3329312 - RNA, 15 nt, Mycobacterium tuberculosis H37Rv
ccgggucgggcaccg

SEQ ID NO: 3329313 - RNA, 15 nt, Mycobacterium tuberculosis H37Rv
ccgggucggugacga

SEQ ID NO: 3329314 - RNA, 17 nt, Mycobacterium tuberculosis H37Rv
ccgggucguagccgaac

SEQ ID NO: 3329315 - RNA, 14 nt, Mycobacterium tuberculosis H37Rv
ccgggucucggugc

SEQ ID NO: 3329316 - RNA, 18 nt, Mycobacterium tuberculosis H37Rv
ccgggucuguuggugaca

SEQ ID NO: 3329317 - RNA, 22 nt, Mycobacterium tuberculosis H37Rv
ccgggugaaacgauggcgauga

SEQ ID NO: 3329318 - RNA, 20 nt, Mycobacterium tuberculosis H37Rv
ccgggugaaguuggcguggu

SEQ ID NO: 3329319 - RNA, 19 nt, Mycobacterium tuberculosis H37Rv
ccgggugaggcggugacga

SEQ ID NO: 3329320 - RNA, 17 nt, Mycobacterium tuberculosis H37Rv
ccgggugaguucggcgu

SEQ ID NO: 3329321 - RNA, 22 nt, Mycobacterium tuberculosis H37Rv
ccgggugcaacggcguuggcgc

SEQ ID NO: 3329322 - RNA, 15 nt, Mycobacterium tuberculosis H37Rv
ccgggugcagaucgc

SEQ ID NO: 3329323 - RNA, 14 nt, Mycobacterium tuberculosis H37Rv
ccgggugccgcgcc

SEQ ID NO: 3329324 - RNA, 17 nt, Mycobacterium tuberculosis H37Rv
ccgggugcgagcgacac

SEQ ID NO: 3329325 - RNA, 21 nt, Mycobacterium tuberculosis H37Rv
ccgggugcgccguugccgccg

SEQ ID NO: 3329326 - RNA, 22 nt, Mycobacterium tuberculosis H37Rv
ccgggugcugugaacgaaggga

SEQ ID NO: 3329327 - RNA, 23 nt, Mycobacterium tuberculosis H37Rv
ccggguggcggcggcggagcgau

SEQ ID NO: 3329328 - RNA, 22 nt, Mycobacterium tuberculosis H37Rv
ccggguguagcucggacccuca

SEQ ID NO: 3329329 - RNA, 19 nt, Mycobacterium tuberculosis H37Rv
ccggguguuggggaucgca

SEQ ID NO: 3329330 - RNA, 13 nt, Mycobacterium tuberculosis H37Rv
ccggguucgccgg

SEQ ID NO: 3329331 - RNA, 16 nt, Mycobacterium tuberculosis H37Rv
ccggguugagccgccg

SEQ ID NO: 3329332 - RNA, 20 nt, Mycobacterium tuberculosis H37Rv
ccggguugagccgccgcgac

SEQ ID NO: 3329333 - RNA, 19 nt, Mycobacterium tuberculosis H37Rv
ccggguuggaagccgcacc

SEQ ID NO: 3329334 - RNA, 13 nt, Mycobacterium tuberculosis H37Rv
ccggguuggccga

SEQ ID NO: 3329335 - RNA, 15 nt, Mycobacterium tuberculosis H37Rv
ccggguuggccgaac

SEQ ID NO: 3329336 - RNA, 16 nt, Mycobacterium tuberculosis H37Rv
ccggguuggccggcgc

SEQ ID NO: 3329337 - RNA, 17 nt, Mycobacterium tuberculosis H37Rv
ccggguuggccggcgcu

SEQ ID NO: 3329338 - RNA, 13 nt, Mycobacterium tuberculosis H37Rv
ccggguuggcgcc

SEQ ID NO: 3329339 - RNA, 19 nt, Mycobacterium tuberculosis H37Rv
ccggguuggcgccggccag

SEQ ID NO: 3329340 - RNA, 19 nt, Mycobacterium tuberculosis H37Rv
ccggguugguacccaccag

SEQ ID NO: 3329341 - RNA, 17 nt, Mycobacterium tuberculosis H37Rv
ccggguuugaucagcuc

SEQ ID NO: 3329342 - RNA, 21 nt, Mycobacterium tuberculosis H37Rv
ccggguuugaucagcucgguc

SEQ ID NO: 3329343 - RNA, 20 nt, Mycobacterium tuberculosis H37Rv
ccgguacaacccccaggcgc

SEQ ID NO: 3329344 - RNA, 11 nt, Mycobacterium tuberculosis H37Rv
ccgguaccgcc

SEQ ID NO: 3329345 - RNA, 21 nt, Mycobacterium tuberculosis H37Rv
ccgguaccgcccgcaccgugg

SEQ ID NO: 3329346 - RNA, 14 nt, Mycobacterium tuberculosis H37Rv
ccgguaccggcgac

SEQ ID NO: 3329347 - RNA, 22 nt, Mycobacterium tuberculosis H37Rv
ccgguacgcaaccaaccgucgg

SEQ ID NO: 3329348 - RNA, 17 nt, Mycobacterium tuberculosis H37Rv
ccgguacgccgcgccga

SEQ ID NO: 3329349 - RNA, 18 nt, Mycobacterium tuberculosis H37Rv
ccgguagaucagcgccug

SEQ ID NO: 3329350 - RNA, 18 nt, Mycobacterium tuberculosis H37Rv
ccgguagaucuucggccg

SEQ ID NO: 3329351 - RNA, 15 nt, Mycobacterium tuberculosis H37Rv
ccgguagcagcgcuc

SEQ ID NO: 3329352 - RNA, 15 nt, Mycobacterium tuberculosis H37Rv
ccgguagcggcggca

SEQ ID NO: 3329353 - RNA, 15 nt, Mycobacterium tuberculosis H37Rv
ccgguaggcggccag

SEQ ID NO: 3329354 - RNA, 18 nt, Mycobacterium tuberculosis H37Rv
ccgguaggcggccagcgc

SEQ ID NO: 3329355 - RNA, 17 nt, Mycobacterium tuberculosis H37Rv
ccgguaguacuagcacg

SEQ ID NO: 3329356 - RNA, 17 nt, Mycobacterium tuberculosis H37Rv
ccgguaguagcugacca

SEQ ID NO: 3329357 - RNA, 14 nt, Mycobacterium tuberculosis H37Rv
ccgguaguccgcgc

SEQ ID NO: 3329358 - RNA, 16 nt, Mycobacterium tuberculosis H37Rv
ccgguagucgccgucg

SEQ ID NO: 3329359 - RNA, 17 nt, Mycobacterium tuberculosis H37Rv
ccgguagucgccgucgg

SEQ ID NO: 3329360 - RNA, 19 nt, Mycobacterium tuberculosis H37Rv
ccgguagucgccgucgggu

SEQ ID NO: 3329361 - RNA, 21 nt, Mycobacterium tuberculosis H37Rv
ccgguaucgccaaauccggug

SEQ ID NO: 3329362 - RNA, 16 nt, Mycobacterium tuberculosis H37Rv
ccgguaucgucccggc

SEQ ID NO: 3329363 - RNA, 19 nt, Mycobacterium tuberculosis H37Rv
ccgguaucgucccggcgac

SEQ ID NO: 3329364 - RNA, 12 nt, Mycobacterium tuberculosis H37Rv
ccgguaugcgcg

SEQ ID NO: 3329365 - RNA, 16 nt, Mycobacterium tuberculosis H37Rv
ccgguauuaccgccgu

SEQ ID NO: 3329366 - RNA, 18 nt, Mycobacterium tuberculosis H37Rv
ccgguauuaccgccgugg

SEQ ID NO: 3329367 - RNA, 16 nt, Mycobacterium tuberculosis H37Rv
ccggucaccgcgcagc

SEQ ID NO: 3329368 - RNA, 19 nt, Mycobacterium tuberculosis H37Rv
ccggucaccucgccggcgg

SEQ ID NO: 3329369 - RNA, 12 nt, Mycobacterium tuberculosis H37Rv
ccggucagccgg

SEQ ID NO: 3329370 - RNA, 17 nt, Mycobacterium tuberculosis H37Rv
ccggucagcgacgcacg

SEQ ID NO: 3329371 - RNA, 21 nt, Mycobacterium tuberculosis H37Rv
ccggucagcgcgcggcucggg

SEQ ID NO: 3329372 - RNA, 13 nt, Mycobacterium tuberculosis H37Rv
ccggucagcgcgg

SEQ ID NO: 3329373 - RNA, 16 nt, Mycobacterium tuberculosis H37Rv
ccggucagcgcggcgc

SEQ ID NO: 3329374 - RNA, 15 nt, Mycobacterium tuberculosis H37Rv
ccggucaggccgccg

SEQ ID NO: 3329375 - RNA, 16 nt, Mycobacterium tuberculosis H37Rv
ccggucaggccgccgc

SEQ ID NO: 3329376 - RNA, 18 nt, Mycobacterium tuberculosis H37Rv
ccggucaggccgccgcgg

SEQ ID NO: 3329377 - RNA, 16 nt, Mycobacterium tuberculosis H37Rv
ccggucauaccaagcg

SEQ ID NO: 3329378 - RNA, 17 nt, Mycobacterium tuberculosis H37Rv
ccggucauaccaagcgc

SEQ ID NO: 3329379 - RNA, 14 nt, Mycobacterium tuberculosis H37Rv
ccggucaucggccg

SEQ ID NO: 3329380 - RNA, 20 nt, Mycobacterium tuberculosis H37Rv
ccgguccacugucagcgauc

SEQ ID NO: 3329381 - RNA, 18 nt, Mycobacterium tuberculosis H37Rv
ccgguccagcccagcgcg

SEQ ID NO: 3329382 - RNA, 15 nt, Mycobacterium tuberculosis H37Rv
ccgguccagccccau

SEQ ID NO: 3329383 - RNA, 13 nt, Mycobacterium tuberculosis H37Rv
ccgguccccgccg

SEQ ID NO: 3329384 - RNA, 17 nt, Mycobacterium tuberculosis H37Rv
ccgguccccgccggcgg

SEQ ID NO: 3329385 - RNA, 23 nt, Mycobacterium tuberculosis H37Rv
ccgguccgauucgugcggucauc

SEQ ID NO: 3329386 - RNA, 14 nt, Mycobacterium tuberculosis H37Rv
ccgguccggcgucg

SEQ ID NO: 3329387 - RNA, 19 nt, Mycobacterium tuberculosis H37Rv
ccgguccggggcaacgauc

SEQ ID NO: 3329388 - RNA, 18 nt, Mycobacterium tuberculosis H37Rv
ccgguccgucaccaccgc

SEQ ID NO: 3329389 - RNA, 23 nt, Mycobacterium tuberculosis H37Rv
ccgguccgucaccaccgccgcca

SEQ ID NO: 3329390 - RNA, 14 nt, Mycobacterium tuberculosis H37Rv
ccgguccgucgggu

SEQ ID NO: 3329391 - RNA, 19 nt, Mycobacterium tuberculosis H37Rv
ccggucgacgggucggcgc

SEQ ID NO: 3329392 - RNA, 16 nt, Mycobacterium tuberculosis H37Rv
ccggucgacuccagca

SEQ ID NO: 3329393 - RNA, 22 nt, Mycobacterium tuberculosis H37Rv
ccggucgagugccucgaccugg

SEQ ID NO: 3329394 - RNA, 17 nt, Mycobacterium tuberculosis H37Rv
ccggucgaugaccucca

SEQ ID NO: 3329395 - RNA, 11 nt, Mycobacterium tuberculosis H37Rv
ccggucgaugu

SEQ ID NO: 3329396 - RNA, 17 nt, Mycobacterium tuberculosis H37Rv
ccggucgaugucggcga

SEQ ID NO: 3329397 - RNA, 20 nt, Mycobacterium tuberculosis H37Rv
ccggucgccaagugcagggc

SEQ ID NO: 3329398 - RNA, 22 nt, Mycobacterium tuberculosis H37Rv
ccggucgcccgagucgaaaccg

SEQ ID NO: 3329399 - RNA, 11 nt, Mycobacterium tuberculosis H37Rv
ccggucgccgc

SEQ ID NO: 3329400 - RNA, 12 nt, Mycobacterium tuberculosis H37Rv
ccggucgccgcg

SEQ ID NO: 3329401 - RNA, 13 nt, Mycobacterium tuberculosis H37Rv
ccggucgccgcga

SEQ ID NO: 3329402 - RNA, 13 nt, Mycobacterium tuberculosis H37Rv
ccggucgccgcgu

SEQ ID NO: 3329403 - RNA, 15 nt, Mycobacterium tuberculosis H37Rv
ccggucgccgcgucu

SEQ ID NO: 3329404 - RNA, 16 nt, Mycobacterium tuberculosis H37Rv
ccggucgccgcgucua

SEQ ID NO: 3329405 - RNA, 14 nt, Mycobacterium tuberculosis H37Rv
ccggucgccucacc

SEQ ID NO: 3329406 - RNA, 16 nt, Mycobacterium tuberculosis H37Rv
ccggucgccucaccgg

SEQ ID NO: 3329407 - RNA, 20 nt, Mycobacterium tuberculosis H37Rv
ccggucgcuguccacugcca

SEQ ID NO: 3329408 - RNA, 13 nt, Mycobacterium tuberculosis H37Rv
ccggucggaucgg

SEQ ID NO: 3329409 - RNA, 13 nt, Mycobacterium tuberculosis H37Rv
ccggucggcacca

SEQ ID NO: 3329410 - RNA, 12 nt, Mycobacterium tuberculosis H37Rv
ccggucggcagc

SEQ ID NO: 3329411 - RNA, 22 nt, Mycobacterium tuberculosis H37Rv
ccggucggcagcuucucgccga

SEQ ID NO: 3329412 - RNA, 14 nt, Mycobacterium tuberculosis H37Rv
ccggucggccagca

SEQ ID NO: 3329413 - RNA, 15 nt, Mycobacterium tuberculosis H37Rv
ccggucggccaggcc

SEQ ID NO: 3329414 - RNA, 12 nt, Mycobacterium tuberculosis H37Rv
ccggucggccau

SEQ ID NO: 3329415 - RNA, 17 nt, Mycobacterium tuberculosis H37Rv
ccggucggccauccacc

SEQ ID NO: 3329416 - RNA, 13 nt, Mycobacterium tuberculosis H37Rv
ccggucggcgaaa

SEQ ID NO: 3329417 - RNA, 19 nt, Mycobacterium tuberculosis H37Rv
ccggucggcgaaaggccag

SEQ ID NO: 3329418 - RNA, 14 nt, Mycobacterium tuberculosis H37Rv
ccggucggcgucga

SEQ ID NO: 3329419 - RNA, 18 nt, Mycobacterium tuberculosis H37Rv
ccggucggucucggcgag

SEQ ID NO: 3329420 - RNA, 19 nt, Mycobacterium tuberculosis H37Rv
ccggucggugagccgugcc

SEQ ID NO: 3329421 - RNA, 13 nt, Mycobacterium tuberculosis H37Rv
ccggucguggucc

SEQ ID NO: 3329422 - RNA, 17 nt, Mycobacterium tuberculosis H37Rv
ccggucuacgacgucgc

SEQ ID NO: 3329423 - RNA, 23 nt, Mycobacterium tuberculosis H37Rv
ccggucucgacggcggccgcgau

SEQ ID NO: 3329424 - RNA, 12 nt, Mycobacterium tuberculosis H37Rv
ccggucucggcc

SEQ ID NO: 3329425 - RNA, 20 nt, Mycobacterium tuberculosis H37Rv
ccggucugcugggcacgaug

SEQ ID NO: 3329426 - RNA, 16 nt, Mycobacterium tuberculosis H37Rv
ccggucuggcgaugac

SEQ ID NO: 3329427 - RNA, 18 nt, Mycobacterium tuberculosis H37Rv
ccggucuggcgaugacga

SEQ ID NO: 3329428 - RNA, 23 nt, Mycobacterium tuberculosis H37Rv
ccggucuugcaucgccgaugcgg

SEQ ID NO: 3329429 - RNA, 22 nt, Mycobacterium tuberculosis H37Rv
ccggugaaccgggacagcagcc

SEQ ID NO: 3329430 - RNA, 16 nt, Mycobacterium tuberculosis H37Rv
ccggugaacgguagca

SEQ ID NO: 3329431 - RNA, 23 nt, Mycobacterium tuberculosis H37Rv
ccggugaacgguagcacugucga

SEQ ID NO: 3329432 - RNA, 13 nt, Mycobacterium tuberculosis H37Rv
ccggugaccagca

SEQ ID NO: 3329433 - RNA, 21 nt, Mycobacterium tuberculosis H37Rv
ccggugacccgcugggccgca

SEQ ID NO: 3329434 - RNA, 18 nt, Mycobacterium tuberculosis H37Rv
ccggugacgacgucgccg

SEQ ID NO: 3329435 - RNA, 13 nt, Mycobacterium tuberculosis H37Rv
ccggugacgccgu

SEQ ID NO: 3329436 - RNA, 15 nt, Mycobacterium tuberculosis H37Rv
ccggugacggggcug

SEQ ID NO: 3329437 - RNA, 14 nt, Mycobacterium tuberculosis H37Rv
ccggugagcaccgg

SEQ ID NO: 3329438 - RNA, 21 nt, Mycobacterium tuberculosis H37Rv
ccggugagcgagcgcgcguag

SEQ ID NO: 3329439 - RNA, 16 nt, Mycobacterium tuberculosis H37Rv
ccggugagucgcuguc

SEQ ID NO: 3329440 - RNA, 20 nt, Mycobacterium tuberculosis H37Rv
ccggugauccaacuggccgc

SEQ ID NO: 3329441 - RNA, 22 nt, Mycobacterium tuberculosis H37Rv
ccggugauccaacuggccgcgu

SEQ ID NO: 3329442 - RNA, 19 nt, Mycobacterium tuberculosis H37Rv
ccggugaugaccgcguaga

SEQ ID NO: 3329443 - RNA, 14 nt, Mycobacterium tuberculosis H37Rv
ccggugaugaccgg

SEQ ID NO: 3329444 - RNA, 22 nt, Mycobacterium tuberculosis H37Rv
ccggugaugaucgcgccgggcu

SEQ ID NO: 3329445 - RNA, 16 nt, Mycobacterium tuberculosis H37Rv
ccggugauggccgacc

SEQ ID NO: 3329446 - RNA, 19 nt, Mycobacterium tuberculosis H37Rv
ccggugauggccgaccagc

SEQ ID NO: 3329447 - RNA, 16 nt, Mycobacterium tuberculosis H37Rv
ccggugauggugacca

SEQ ID NO: 3329448 - RNA, 23 nt, Mycobacterium tuberculosis H37Rv
ccggugauggugaccagcaggcc

SEQ ID NO: 3329449 - RNA, 19 nt, Mycobacterium tuberculosis H37Rv
ccggugauggugugcagca

SEQ ID NO: 3329450 - RNA, 20 nt, Mycobacterium tuberculosis H37Rv
ccggugauggugugcagcag

SEQ ID NO: 3329451 - RNA, 23 nt, Mycobacterium tuberculosis H37Rv
ccggugcaaccccaaguccagca

SEQ ID NO: 3329452 - RNA, 13 nt, Mycobacterium tuberculosis H37Rv
ccggugcaccagg

SEQ ID NO: 3329453 - RNA, 20 nt, Mycobacterium tuberculosis H37Rv
ccggugcacgguaucggugc

SEQ ID NO: 3329454 - RNA, 21 nt, Mycobacterium tuberculosis H37Rv
ccggugcagaugcggcugaau

SEQ ID NO: 3329455 - RNA, 17 nt, Mycobacterium tuberculosis H37Rv
ccggugccacccuugcc

SEQ ID NO: 3329456 - RNA, 22 nt, Mycobacterium tuberculosis H37Rv
ccggugccacccuugccgccgg

SEQ ID NO: 3329457 - RNA, 14 nt, Mycobacterium tuberculosis H37Rv
ccggugccaccggc

SEQ ID NO: 3329458 - RNA, 20 nt, Mycobacterium tuberculosis H37Rv
ccggugccacugccguugcc

SEQ ID NO: 3329459 - RNA, 14 nt, Mycobacterium tuberculosis H37Rv
ccggugccagucca

SEQ ID NO: 3329460 - RNA, 22 nt, Mycobacterium tuberculosis H37Rv
ccggugcccaccaccgacagca

SEQ ID NO: 3329461 - RNA, 19 nt, Mycobacterium tuberculosis H37Rv
ccggugcccaucggcauga

SEQ ID NO: 3329462 - RNA, 15 nt, Mycobacterium tuberculosis H37Rv
ccggugcccgcacca

SEQ ID NO: 3329463 - RNA, 18 nt, Mycobacterium tuberculosis H37Rv
ccggugccgacggcgccg

SEQ ID NO: 3329464 - RNA, 13 nt, Mycobacterium tuberculosis H37Rv
ccggugccgcagc

SEQ ID NO: 3329465 - RNA, 21 nt, Mycobacterium tuberculosis H37Rv
ccggugccgccaucgccgccg

SEQ ID NO: 3329466 - RNA, 17 nt, Mycobacterium tuberculosis H37Rv
ccggugccgccauugac

SEQ ID NO: 3329467 - RNA, 12 nt, Mycobacterium tuberculosis H37Rv
ccggugccgccc

SEQ ID NO: 3329468 - RNA, 17 nt, Mycobacterium tuberculosis H37Rv
ccggugccgcccgagcc

SEQ ID NO: 3329469 - RNA, 15 nt, Mycobacterium tuberculosis H37Rv
ccggugccgccgcgg

SEQ ID NO: 3329470 - RNA, 23 nt, Mycobacterium tuberculosis H37Rv
ccggugccgccgcggccaccacc

SEQ ID NO: 3329471 - RNA, 13 nt, Mycobacterium tuberculosis H37Rv
ccggugccgccgg

SEQ ID NO: 3329472 - RNA, 19 nt, Mycobacterium tuberculosis H37Rv
ccggugccgccgucgccgc

SEQ ID NO: 3329473 - RNA, 22 nt, Mycobacterium tuberculosis H37Rv
ccggugccgccguucccaccac

SEQ ID NO: 3329474 - RNA, 23 nt, Mycobacterium tuberculosis H37Rv
ccggugccgccguugccauugcc

SEQ ID NO: 3329475 - RNA, 12 nt, Mycobacterium tuberculosis H37Rv
ccggugccgccu

SEQ ID NO: 3329476 - RNA, 21 nt, Mycobacterium tuberculosis H37Rv
ccggugccgccugcgccgcca

SEQ ID NO: 3329477 - RNA, 13 nt, Mycobacterium tuberculosis H37Rv
ccggugccgcggu

SEQ ID NO: 3329478 - RNA, 15 nt, Mycobacterium tuberculosis H37Rv
ccggugccgcgguag

SEQ ID NO: 3329479 - RNA, 12 nt, Mycobacterium tuberculosis H37Rv
ccggugccggcg

SEQ ID NO: 3329480 - RNA, 13 nt, Mycobacterium tuberculosis H37Rv
ccggugccggcgg

SEQ ID NO: 3329481 - RNA, 15 nt, Mycobacterium tuberculosis H37Rv
ccggugccggcguug

SEQ ID NO: 3329482 - RNA, 21 nt, Mycobacterium tuberculosis H37Rv
ccggugccggcguugccgccg

SEQ ID NO: 3329483 - RNA, 20 nt, Mycobacterium tuberculosis H37Rv
ccggugccgggaugccgccg

SEQ ID NO: 3329484 - RNA, 20 nt, Mycobacterium tuberculosis H37Rv
ccggugccguuggagccgcc

SEQ ID NO: 3329485 - RNA, 22 nt, Mycobacterium tuberculosis H37Rv
ccggugccguuggagccgccac

SEQ ID NO: 3329486 - RNA, 16 nt, Mycobacterium tuberculosis H37Rv
ccggugcgaucccacc

SEQ ID NO: 3329487 - RNA, 19 nt, Mycobacterium tuberculosis H37Rv
ccggugcgaucccacccuc

SEQ ID NO: 3329488 - RNA, 13 nt, Mycobacterium tuberculosis H37Rv
ccggugcgccgau

SEQ ID NO: 3329489 - RNA, 17 nt, Mycobacterium tuberculosis H37Rv
ccggugcgcgcggucga

SEQ ID NO: 3329490 - RNA, 20 nt, Mycobacterium tuberculosis H37Rv
ccggugcgcgcugacccgcc

SEQ ID NO: 3329491 - RNA, 14 nt, Mycobacterium tuberculosis H37Rv
ccggugcggcgggc

SEQ ID NO: 3329492 - RNA, 18 nt, Mycobacterium tuberculosis H37Rv
ccggugcgguggugcgca

SEQ ID NO: 3329493 - RNA, 18 nt, Mycobacterium tuberculosis H37Rv
ccggugcgucacagccgg

SEQ ID NO: 3329494 - RNA, 20 nt, Mycobacterium tuberculosis H37Rv
ccggugcuaaccgacgcuga

SEQ ID NO: 3329495 - RNA, 18 nt, Mycobacterium tuberculosis H37Rv
ccggugcucaagcgcguc

SEQ ID NO: 3329496 - RNA, 20 nt, Mycobacterium tuberculosis H37Rv
ccggugcucaagcgcgucgu

SEQ ID NO: 3329497 - RNA, 17 nt, Mycobacterium tuberculosis H37Rv
ccggugcucgucgagca

SEQ ID NO: 3329498 - RNA, 22 nt, Mycobacterium tuberculosis H37Rv
ccggugcugcgggaauccggug

SEQ ID NO: 3329499 - RNA, 19 nt, Mycobacterium tuberculosis H37Rv
ccggugcugucgacgucgg

SEQ ID NO: 3329500 - RNA, 17 nt, Mycobacterium tuberculosis H37Rv
ccgguggaauccaccag

SEQ ID NO: 3329501 - RNA, 18 nt, Mycobacterium tuberculosis H37Rv
ccgguggacagaugcauc

SEQ ID NO: 3329502 - RNA, 23 nt, Mycobacterium tuberculosis H37Rv
ccgguggacagaugcauccagcu

SEQ ID NO: 3329503 - RNA, 15 nt, Mycobacterium tuberculosis H37Rv
ccgguggcacggccc

SEQ ID NO: 3329504 - RNA, 20 nt, Mycobacterium tuberculosis H37Rv
ccgguggcacggccccugcc

SEQ ID NO: 3329505 - RNA, 17 nt, Mycobacterium tuberculosis H37Rv
ccgguggcagagccgcc

SEQ ID NO: 3329506 - RNA, 18 nt, Mycobacterium tuberculosis H37Rv
ccgguggcagagccgccg

SEQ ID NO: 3329507 - RNA, 13 nt, Mycobacterium tuberculosis H37Rv
ccgguggcauucg

SEQ ID NO: 3329508 - RNA, 14 nt, Mycobacterium tuberculosis H37Rv
ccgguggccaacac

SEQ ID NO: 3329509 - RNA, 21 nt, Mycobacterium tuberculosis H37Rv
ccgguggccaacaccgccagc

SEQ ID NO: 3329510 - RNA, 16 nt, Mycobacterium tuberculosis H37Rv
ccgguggccagcacgu

SEQ ID NO: 3329511 - RNA, 14 nt, Mycobacterium tuberculosis H37Rv
ccgguggcccgccg

SEQ ID NO: 3329512 - RNA, 17 nt, Mycobacterium tuberculosis H37Rv
ccgguggcccgccggca

SEQ ID NO: 3329513 - RNA, 20 nt, Mycobacterium tuberculosis H37Rv
ccgguggcccgccggcagug

SEQ ID NO: 3329514 - RNA, 14 nt, Mycobacterium tuberculosis H37Rv
ccgguggcgccgcc

SEQ ID NO: 3329515 - RNA, 15 nt, Mycobacterium tuberculosis H37Rv
ccgguggcgccgccg

SEQ ID NO: 3329516 - RNA, 21 nt, Mycobacterium tuberculosis H37Rv
ccgguggcgccggggccgccg

SEQ ID NO: 3329517 - RNA, 22 nt, Mycobacterium tuberculosis H37Rv
ccgguggcguggucucggucag

SEQ ID NO: 3329518 - RNA, 13 nt, Mycobacterium tuberculosis H37Rv
ccgguggcguuug

SEQ ID NO: 3329519 - RNA, 15 nt, Mycobacterium tuberculosis H37Rv
ccggugggccgccca

SEQ ID NO: 3329520 - RNA, 13 nt, Mycobacterium tuberculosis H37Rv
ccggugggcggcu

SEQ ID NO: 3329521 - RNA, 15 nt, Mycobacterium tuberculosis H37Rv
ccggugggggcggcg

SEQ ID NO: 3329522 - RNA, 16 nt, Mycobacterium tuberculosis H37Rv
ccggugggggcggcgc

SEQ ID NO: 3329523 - RNA, 14 nt, Mycobacterium tuberculosis H37Rv
ccgguggguagcca

SEQ ID NO: 3329524 - RNA, 19 nt, Mycobacterium tuberculosis H37Rv
ccggugguagcgacgaugu

SEQ ID NO: 3329525 - RNA, 14 nt, Mycobacterium tuberculosis H37Rv
ccgguggucugcgc

SEQ ID NO: 3329526 - RNA, 13 nt, Mycobacterium tuberculosis H37Rv
ccgguggugagga

SEQ ID NO: 3329527 - RNA, 24 nt, Mycobacterium tuberculosis H37Rv
ccgguggugaggaucauggcgucg

SEQ ID NO: 3329528 - RNA, 16 nt, Mycobacterium tuberculosis H37Rv
ccgguggugccggcgc

SEQ ID NO: 3329529 - RNA, 21 nt, Mycobacterium tuberculosis H37Rv
ccgguggugccggcgccgcca

SEQ ID NO: 3329530 - RNA, 17 nt, Mycobacterium tuberculosis H37Rv
ccgguggugggccgugg

SEQ ID NO: 3329531 - RNA, 19 nt, Mycobacterium tuberculosis H37Rv
ccgguguagcagcgccagc

SEQ ID NO: 3329532 - RNA, 23 nt, Mycobacterium tuberculosis H37Rv
ccgguguagcagcgccagcagcu

SEQ ID NO: 3329533 - RNA, 16 nt, Mycobacterium tuberculosis H37Rv
ccgguguaggggcgcc

SEQ ID NO: 3329534 - RNA, 20 nt, Mycobacterium tuberculosis H37Rv
ccgguguccagugcauuccc

SEQ ID NO: 3329535 - RNA, 21 nt, Mycobacterium tuberculosis H37Rv
ccggugucucccuugccgcca

SEQ ID NO: 3329536 - RNA, 13 nt, Mycobacterium tuberculosis H37Rv
ccggugugcgcac

SEQ ID NO: 3329537 - RNA, 16 nt, Mycobacterium tuberculosis H37Rv
ccgguguguuuggcau

SEQ ID NO: 3329538 - RNA, 19 nt, Mycobacterium tuberculosis H37Rv
ccgguguuagugaggcccg

SEQ ID NO: 3329539 - RNA, 21 nt, Mycobacterium tuberculosis H37Rv
ccgguguugagcgaacccgcg

SEQ ID NO: 3329540 - RNA, 11 nt, Mycobacterium tuberculosis H37Rv
ccgguguugau

SEQ ID NO: 3329541 - RNA, 20 nt, Mycobacterium tuberculosis H37Rv
ccgguguugauguugccgga

SEQ ID NO: 3329542 - RNA, 13 nt, Mycobacterium tuberculosis H37Rv
ccgguguugccga

SEQ ID NO: 3329543 - RNA, 19 nt, Mycobacterium tuberculosis H37Rv
ccgguguugccgaagcccg

SEQ ID NO: 3329544 - RNA, 22 nt, Mycobacterium tuberculosis H37Rv
ccgguguuuccgaaacccgccg

SEQ ID NO: 3329545 - RNA, 20 nt, Mycobacterium tuberculosis H37Rv
ccgguuaugcgguacccgau

SEQ ID NO: 3329546 - RNA, 13 nt, Mycobacterium tuberculosis H37Rv
ccgguucagcgcu

SEQ ID NO: 3329547 - RNA, 16 nt, Mycobacterium tuberculosis H37Rv
ccgguuccgccggccc

SEQ ID NO: 3329548 - RNA, 20 nt, Mycobacterium tuberculosis H37Rv
ccgguuccgccggccccacc

SEQ ID NO: 3329549 - RNA, 14 nt, Mycobacterium tuberculosis H37Rv
ccgguuccucagcg

SEQ ID NO: 3329550 - RNA, 13 nt, Mycobacterium tuberculosis H37Rv
ccgguucggugag

SEQ ID NO: 3329551 - RNA, 16 nt, Mycobacterium tuberculosis H37Rv
ccgguugacacccggg

SEQ ID NO: 3329552 - RNA, 18 nt, Mycobacterium tuberculosis H37Rv
ccgguugaccgccgacac

SEQ ID NO: 3329553 - RNA, 18 nt, Mycobacterium tuberculosis H37Rv
ccgguugccaccugugcg

SEQ ID NO: 3329554 - RNA, 14 nt, Mycobacterium tuberculosis H37Rv
ccgguugcggcugc

SEQ ID NO: 3329555 - RNA, 24 nt, Mycobacterium tuberculosis H37Rv
ccgguugcggucagacgccggccg

SEQ ID NO: 3329556 - RNA, 19 nt, Mycobacterium tuberculosis H37Rv
ccgguuggacugacgucga

SEQ ID NO: 3329557 - RNA, 12 nt, Mycobacterium tuberculosis H37Rv
ccgguuggcccc

SEQ ID NO: 3329558 - RNA, 18 nt, Mycobacterium tuberculosis H37Rv
ccgguuggcgcgggcgag

SEQ ID NO: 3329559 - RNA, 20 nt, Mycobacterium tuberculosis H37Rv
ccgguuggcugccggcaaca

SEQ ID NO: 3329560 - RNA, 17 nt, Mycobacterium tuberculosis H37Rv
ccgguugucgcagcgca

SEQ ID NO: 3329561 - RNA, 18 nt, Mycobacterium tuberculosis H37Rv
ccgguugugcgcgcgccc

SEQ ID NO: 3329562 - RNA, 20 nt, Mycobacterium tuberculosis H37Rv
ccgguugugcgcgcgcccga

SEQ ID NO: 3329563 - RNA, 19 nt, Mycobacterium tuberculosis H37Rv
ccgguuucuucggccagcu

SEQ ID NO: 3329564 - RNA, 15 nt, Mycobacterium tuberculosis H37Rv
ccgguuucuucuuca

SEQ ID NO: 3329565 - RNA, 19 nt, Mycobacterium tuberculosis H37Rv
ccgguuugcacgcaccaca

SEQ ID NO: 3329566 - RNA, 14 nt, Mycobacterium tuberculosis H37Rv
ccguaaaagccgau

SEQ ID NO: 3329567 - RNA, 16 nt, Mycobacterium tuberculosis H37Rv
ccguaaagccguugau

SEQ ID NO: 3329568 - RNA, 19 nt, Mycobacterium tuberculosis H37Rv
ccguaaaugguggcguguu

SEQ ID NO: 3329569 - RNA, 20 nt, Mycobacterium tuberculosis H37Rv
ccguaacagccggccggauc

SEQ ID NO: 3329570 - RNA, 20 nt, Mycobacterium tuberculosis H37Rv
ccguaacgcggaucgggcac

SEQ ID NO: 3329571 - RNA, 15 nt, Mycobacterium tuberculosis H37Rv
ccguaagcaccagcc

SEQ ID NO: 3329572 - RNA, 16 nt, Mycobacterium tuberculosis H37Rv
ccguaagcaccagcca

SEQ ID NO: 3329573 - RNA, 17 nt, Mycobacterium tuberculosis H37Rv
ccguaagcaccagccag

SEQ ID NO: 3329574 - RNA, 18 nt, Mycobacterium tuberculosis H37Rv
ccguacagcggcggcguc

SEQ ID NO: 3329575 - RNA, 19 nt, Mycobacterium tuberculosis H37Rv
ccguagaagcgcuccagcu

SEQ ID NO: 3329576 - RNA, 13 nt, Mycobacterium tuberculosis H37Rv
ccguagaccagcc

SEQ ID NO: 3329577 - RNA, 19 nt, Mycobacterium tuberculosis H37Rv
ccguagacgccgagcaagg

SEQ ID NO: 3329578 - RNA, 19 nt, Mycobacterium tuberculosis H37Rv
ccguagagcaugccgcccg

SEQ ID NO: 3329579 - RNA, 15 nt, Mycobacterium tuberculosis H37Rv
ccguagcaccacauc

SEQ ID NO: 3329580 - RNA, 14 nt, Mycobacterium tuberculosis H37Rv
ccguagccagcagg

SEQ ID NO: 3329581 - RNA, 19 nt, Mycobacterium tuberculosis H37Rv
ccguagccagcaggaacgc

SEQ ID NO: 3329582 - RNA, 17 nt, Mycobacterium tuberculosis H37Rv
ccguagccggccggccc

SEQ ID NO: 3329583 - RNA, 22 nt, Mycobacterium tuberculosis H37Rv
ccguagcggucuccccagagcu

SEQ ID NO: 3329584 - RNA, 17 nt, Mycobacterium tuberculosis H37Rv
ccguagcguccgcgccc

SEQ ID NO: 3329585 - RNA, 18 nt, Mycobacterium tuberculosis H37Rv
ccguagcugcgcagcgca

SEQ ID NO: 3329586 - RNA, 13 nt, Mycobacterium tuberculosis H37Rv
ccguaggccacag

SEQ ID NO: 3329587 - RNA, 14 nt, Mycobacterium tuberculosis H37Rv
ccguaggccacagc

SEQ ID NO: 3329588 - RNA, 11 nt, Mycobacterium tuberculosis H37Rv
ccguaggcggc

SEQ ID NO: 3329589 - RNA, 16 nt, Mycobacterium tuberculosis H37Rv
ccguaggguggccgac

SEQ ID NO: 3329590 - RNA, 18 nt, Mycobacterium tuberculosis H37Rv
ccguaggugcacaacccg

SEQ ID NO: 3329591 - RNA, 23 nt, Mycobacterium tuberculosis H37Rv
ccguaguaaggagccgggccguc

SEQ ID NO: 3329592 - RNA, 16 nt, Mycobacterium tuberculosis H37Rv
ccguaguaccaaagcg

SEQ ID NO: 3329593 - RNA, 14 nt, Mycobacterium tuberculosis H37Rv
ccguaguaguggcc

SEQ ID NO: 3329594 - RNA, 23 nt, Mycobacterium tuberculosis H37Rv
ccguaguaguggccgccacccgc

SEQ ID NO: 3329595 - RNA, 22 nt, Mycobacterium tuberculosis H37Rv
ccguaguaguucagccaggccg

SEQ ID NO: 3329596 - RNA, 21 nt, Mycobacterium tuberculosis H37Rv
ccguagugcacgucggcgggc

SEQ ID NO: 3329597 - RNA, 15 nt, Mycobacterium tuberculosis H37Rv
ccguaguggccggcu

SEQ ID NO: 3329598 - RNA, 15 nt, Mycobacterium tuberculosis H37Rv
ccguagugucggcgu

SEQ ID NO: 3329599 - RNA, 14 nt, Mycobacterium tuberculosis H37Rv
ccguauagcgugac

SEQ ID NO: 3329600 - RNA, 22 nt, Mycobacterium tuberculosis H37Rv
ccguaucacgguugccgcgauc

SEQ ID NO: 3329601 - RNA, 13 nt, Mycobacterium tuberculosis H37Rv
ccguauccaggcg

SEQ ID NO: 3329602 - RNA, 14 nt, Mycobacterium tuberculosis H37Rv
ccguauccaggcgu

SEQ ID NO: 3329603 - RNA, 17 nt, Mycobacterium tuberculosis H37Rv
ccguaugucccggugcg

SEQ ID NO: 3329604 - RNA, 22 nt, Mycobacterium tuberculosis H37Rv
ccguauugauacugcccgcguu

SEQ ID NO: 3329605 - RNA, 17 nt, Mycobacterium tuberculosis H37Rv
ccguauugccaaagccc

SEQ ID NO: 3329606 - RNA, 19 nt, Mycobacterium tuberculosis H37Rv
ccgucaaccugcugcagaa

SEQ ID NO: 3329607 - RNA, 12 nt, Mycobacterium tuberculosis H37Rv
ccgucaacgaug

SEQ ID NO: 3329608 - RNA, 22 nt, Mycobacterium tuberculosis H37Rv
ccgucaaucgcaaugaccugca

SEQ ID NO: 3329609 - RNA, 13 nt, Mycobacterium tuberculosis H37Rv
ccgucacaggccg

SEQ ID NO: 3329610 - RNA, 14 nt, Mycobacterium tuberculosis H37Rv
ccgucaccaccgcc

SEQ ID NO: 3329611 - RNA, 17 nt, Mycobacterium tuberculosis H37Rv
ccgucaccgccgaccag

SEQ ID NO: 3329612 - RNA, 20 nt, Mycobacterium tuberculosis H37Rv
ccgucaccgccgucaccgcc

SEQ ID NO: 3329613 - RNA, 20 nt, Mycobacterium tuberculosis H37Rv
ccgucaccgccguugccgau

SEQ ID NO: 3329614 - RNA, 16 nt, Mycobacterium tuberculosis H37Rv
ccgucaccgcgacccc

SEQ ID NO: 3329615 - RNA, 16 nt, Mycobacterium tuberculosis H37Rv
ccgucaccgcgcggcu

SEQ ID NO: 3329616 - RNA, 19 nt, Mycobacterium tuberculosis H37Rv
ccgucaccgcugagccccc

SEQ ID NO: 3329617 - RNA, 18 nt, Mycobacterium tuberculosis H37Rv
ccgucaccggucggccau

SEQ ID NO: 3329618 - RNA, 13 nt, Mycobacterium tuberculosis H37Rv
ccgucacgcccgc

SEQ ID NO: 3329619 - RNA, 17 nt, Mycobacterium tuberculosis H37Rv
ccgucacgucguuuggc

SEQ ID NO: 3329620 - RNA, 17 nt, Mycobacterium tuberculosis H37Rv
ccgucacugaugggccg

SEQ ID NO: 3329621 - RNA, 18 nt, Mycobacterium tuberculosis H37Rv
ccgucacugaugggccgg

SEQ ID NO: 3329622 - RNA, 19 nt, Mycobacterium tuberculosis H37Rv
ccgucagaacaccggccag

SEQ ID NO: 3329623 - RNA, 20 nt, Mycobacterium tuberculosis H37Rv
ccgucagaacaccggccagg

SEQ ID NO: 3329624 - RNA, 18 nt, Mycobacterium tuberculosis H37Rv
ccgucagccaggugccca

SEQ ID NO: 3329625 - RNA, 12 nt, Mycobacterium tuberculosis H37Rv
ccgucagcgccg

SEQ ID NO: 3329626 - RNA, 17 nt, Mycobacterium tuberculosis H37Rv
ccgucagcgccgcgcgc

SEQ ID NO: 3329627 - RNA, 21 nt, Mycobacterium tuberculosis H37Rv
ccgucagcgccgcugacuccu

SEQ ID NO: 3329628 - RNA, 22 nt, Mycobacterium tuberculosis H37Rv
ccgucagcgccgcugacuccug

SEQ ID NO: 3329629 - RNA, 15 nt, Mycobacterium tuberculosis H37Rv
ccgucagcggacagu

SEQ ID NO: 3329630 - RNA, 17 nt, Mycobacterium tuberculosis H37Rv
ccgucagcggcggccac

SEQ ID NO: 3329631 - RNA, 18 nt, Mycobacterium tuberculosis H37Rv
ccgucagcggcggccacg

SEQ ID NO: 3329632 - RNA, 19 nt, Mycobacterium tuberculosis H37Rv
ccgucagggucagcuggga

SEQ ID NO: 3329633 - RNA, 21 nt, Mycobacterium tuberculosis H37Rv
ccgucagguucuaccaaaucg

SEQ ID NO: 3329634 - RNA, 21 nt, Mycobacterium tuberculosis H37Rv
ccgucaguucggugugcggcg

SEQ ID NO: 3329635 - RNA, 15 nt, Mycobacterium tuberculosis H37Rv
ccgucauacucgaca

SEQ ID NO: 3329636 - RNA, 21 nt, Mycobacterium tuberculosis H37Rv
ccgucauacucgacaccgacu

SEQ ID NO: 3329637 - RNA, 21 nt, Mycobacterium tuberculosis H37Rv
ccgucaucgcggugugccggu

SEQ ID NO: 3329638 - RNA, 23 nt, Mycobacterium tuberculosis H37Rv
ccgucaugaagccguugccgcca

SEQ ID NO: 3329639 - RNA, 15 nt, Mycobacterium tuberculosis H37Rv
ccgucaugccguuga

SEQ ID NO: 3329640 - RNA, 12 nt, Mycobacterium tuberculosis H37Rv
ccgucauggcga

SEQ ID NO: 3329641 - RNA, 18 nt, Mycobacterium tuberculosis H37Rv
ccgucaugggcggcuucg

SEQ ID NO: 3329642 - RNA, 14 nt, Mycobacterium tuberculosis H37Rv
ccgucauuggcuug

SEQ ID NO: 3329643 - RNA, 15 nt, Mycobacterium tuberculosis H37Rv
ccguccaauuccgca

SEQ ID NO: 3329644 - RNA, 22 nt, Mycobacterium tuberculosis H37Rv
ccguccaauuggcgucgucggc

SEQ ID NO: 3329645 - RNA, 16 nt, Mycobacterium tuberculosis H37Rv
ccguccagcgccgcgg

SEQ ID NO: 3329646 - RNA, 19 nt, Mycobacterium tuberculosis H37Rv
ccguccagcgccgcggccc

SEQ ID NO: 3329647 - RNA, 12 nt, Mycobacterium tuberculosis H37Rv
ccguccaggacg

SEQ ID NO: 3329648 - RNA, 19 nt, Mycobacterium tuberculosis H37Rv
ccguccaggcgcugcagca

SEQ ID NO: 3329649 - RNA, 18 nt, Mycobacterium tuberculosis H37Rv
ccgucccagcugaccagc

SEQ ID NO: 3329650 - RNA, 20 nt, Mycobacterium tuberculosis H37Rv
ccgucccagcugaccagcgu

SEQ ID NO: 3329651 - RNA, 20 nt, Mycobacterium tuberculosis H37Rv
ccgucccaggugcaagcggu

SEQ ID NO: 3329652 - RNA, 14 nt, Mycobacterium tuberculosis H37Rv
ccguccccgcagcg

SEQ ID NO: 3329653 - RNA, 15 nt, Mycobacterium tuberculosis H37Rv
ccguccccgccgccg

SEQ ID NO: 3329654 - RNA, 19 nt, Mycobacterium tuberculosis H37Rv
ccgucccgauacggccggc

SEQ ID NO: 3329655 - RNA, 17 nt, Mycobacterium tuberculosis H37Rv
ccgucccgccggccccg

SEQ ID NO: 3329656 - RNA, 14 nt, Mycobacterium tuberculosis H37Rv
ccgucccggccucg

SEQ ID NO: 3329657 - RNA, 14 nt, Mycobacterium tuberculosis H37Rv
ccgucccggcucga

SEQ ID NO: 3329658 - RNA, 14 nt, Mycobacterium tuberculosis H37Rv
ccguccgcaccggc

SEQ ID NO: 3329659 - RNA, 19 nt, Mycobacterium tuberculosis H37Rv
ccguccgcggguagcgguu

SEQ ID NO: 3329660 - RNA, 21 nt, Mycobacterium tuberculosis H37Rv
ccguccgcugguggucagcac

SEQ ID NO: 3329661 - RNA, 18 nt, Mycobacterium tuberculosis H37Rv
ccguccgguggaccgccg

SEQ ID NO: 3329662 - RNA, 18 nt, Mycobacterium tuberculosis H37Rv
ccguccgguggacgcaga

SEQ ID NO: 3329663 - RNA, 16 nt, Mycobacterium tuberculosis H37Rv
ccguccucccacaggu

SEQ ID NO: 3329664 - RNA, 19 nt, Mycobacterium tuberculosis H37Rv
ccguccucgcuauugggug

SEQ ID NO: 3329665 - RNA, 13 nt, Mycobacterium tuberculosis H37Rv
ccguccucgguca

SEQ ID NO: 3329666 - RNA, 16 nt, Mycobacterium tuberculosis H37Rv
ccguccucggucagcu

SEQ ID NO: 3329667 - RNA, 17 nt, Mycobacterium tuberculosis H37Rv
ccguccucgucggugug

SEQ ID NO: 3329668 - RNA, 23 nt, Mycobacterium tuberculosis H37Rv
ccguccugacuuuugucacugcg

SEQ ID NO: 3329669 - RNA, 14 nt, Mycobacterium tuberculosis H37Rv
ccguccuuuccagg

SEQ ID NO: 3329670 - RNA, 17 nt, Mycobacterium tuberculosis H37Rv
ccgucgaaauacccggu

SEQ ID NO: 3329671 - RNA, 18 nt, Mycobacterium tuberculosis H37Rv
ccgucgaaauacccgguc

SEQ ID NO: 3329672 - RNA, 19 nt, Mycobacterium tuberculosis H37Rv
ccgucgaaccagaggucac

SEQ ID NO: 3329673 - RNA, 18 nt, Mycobacterium tuberculosis H37Rv
ccgucgacaacaaacccg

SEQ ID NO: 3329674 - RNA, 20 nt, Mycobacterium tuberculosis H37Rv
ccgucgacaacaaacccggc

SEQ ID NO: 3329675 - RNA, 21 nt, Mycobacterium tuberculosis H37Rv
ccgucgacaacaaacccggcc

SEQ ID NO: 3329676 - RNA, 14 nt, Mycobacterium tuberculosis H37Rv
ccgucgacagcguc

SEQ ID NO: 3329677 - RNA, 23 nt, Mycobacterium tuberculosis H37Rv
ccgucgacagucaacagggccag

SEQ ID NO: 3329678 - RNA, 14 nt, Mycobacterium tuberculosis H37Rv
ccgucgacgcggcc

SEQ ID NO: 3329679 - RNA, 17 nt, Mycobacterium tuberculosis H37Rv
ccgucgacgucgauggu

SEQ ID NO: 3329680 - RNA, 21 nt, Mycobacterium tuberculosis H37Rv
ccgucgagcaacgugacccgg

SEQ ID NO: 3329681 - RNA, 13 nt, Mycobacterium tuberculosis H37Rv
ccgucgagcgucu

SEQ ID NO: 3329682 - RNA, 22 nt, Mycobacterium tuberculosis H37Rv
ccgucgagcgucugcgaucccg

SEQ ID NO: 3329683 - RNA, 15 nt, Mycobacterium tuberculosis H37Rv
ccgucgaguccaggc

SEQ ID NO: 3329684 - RNA, 20 nt, Mycobacterium tuberculosis H37Rv
ccgucgaguccaggccggca

SEQ ID NO: 3329685 - RNA, 16 nt, Mycobacterium tuberculosis H37Rv
ccgucgagucgacggc

SEQ ID NO: 3329686 - RNA, 19 nt, Mycobacterium tuberculosis H37Rv
ccgucgagucgacggcauc

SEQ ID NO: 3329687 - RNA, 20 nt, Mycobacterium tuberculosis H37Rv
ccgucgagucgacggcaucg

SEQ ID NO: 3329688 - RNA, 15 nt, Mycobacterium tuberculosis H37Rv
ccgucgagucgccga

SEQ ID NO: 3329689 - RNA, 19 nt, Mycobacterium tuberculosis H37Rv
ccgucgaguuccggccggu

SEQ ID NO: 3329690 - RNA, 17 nt, Mycobacterium tuberculosis H37Rv
ccgucgauagucgccgu

SEQ ID NO: 3329691 - RNA, 19 nt, Mycobacterium tuberculosis H37Rv
ccgucgaucagcggcagca

SEQ ID NO: 3329692 - RNA, 15 nt, Mycobacterium tuberculosis H37Rv
ccgucgaucccgguc

SEQ ID NO: 3329693 - RNA, 19 nt, Mycobacterium tuberculosis H37Rv
ccgucgaugugcgguacau

SEQ ID NO: 3329694 - RNA, 19 nt, Mycobacterium tuberculosis H37Rv
ccgucgauguggcgcuccg

SEQ ID NO: 3329695 - RNA, 18 nt, Mycobacterium tuberculosis H37Rv
ccgucgauguugcccagc

SEQ ID NO: 3329696 - RNA, 20 nt, Mycobacterium tuberculosis H37Rv
ccgucgauugcaggucggcc

SEQ ID NO: 3329697 - RNA, 22 nt, Mycobacterium tuberculosis H37Rv
ccgucgauuucgacgaccaccu

SEQ ID NO: 3329698 - RNA, 13 nt, Mycobacterium tuberculosis H37Rv
ccgucgcaccaga

SEQ ID NO: 3329699 - RNA, 22 nt, Mycobacterium tuberculosis H37Rv
ccgucgcagccagcugaacacg

SEQ ID NO: 3329700 - RNA, 22 nt, Mycobacterium tuberculosis H37Rv
ccgucgcaucaggucggugguc

SEQ ID NO: 3329701 - RNA, 23 nt, Mycobacterium tuberculosis H37Rv
ccgucgcccggguggcgucgauc

SEQ ID NO: 3329702 - RNA, 22 nt, Mycobacterium tuberculosis H37Rv
ccgucgcccuuagggucgccgc

SEQ ID NO: 3329703 - RNA, 18 nt, Mycobacterium tuberculosis H37Rv
ccgucgccgcccgugccg

SEQ ID NO: 3329704 - RNA, 12 nt, Mycobacterium tuberculosis H37Rv
ccgucgccgccg

SEQ ID NO: 3329705 - RNA, 20 nt, Mycobacterium tuberculosis H37Rv
ccgucgccggauagcgcagc

SEQ ID NO: 3329706 - RNA, 12 nt, Mycobacterium tuberculosis H37Rv
ccgucgccgguc

SEQ ID NO: 3329707 - RNA, 22 nt, Mycobacterium tuberculosis H37Rv
ccgucgccuccagcagguccgc

SEQ ID NO: 3329708 - RNA, 14 nt, Mycobacterium tuberculosis H37Rv
ccgucgccuccgcu

SEQ ID NO: 3329709 - RNA, 18 nt, Mycobacterium tuberculosis H37Rv
ccgucgcggcggcacuac

SEQ ID NO: 3329710 - RNA, 13 nt, Mycobacterium tuberculosis H37Rv
ccgucgcguccgc

SEQ ID NO: 3329711 - RNA, 13 nt, Mycobacterium tuberculosis H37Rv
ccgucgcguuggc

SEQ ID NO: 3329712 - RNA, 18 nt, Mycobacterium tuberculosis H37Rv
ccgucgcguuggcgguag

SEQ ID NO: 3329713 - RNA, 14 nt, Mycobacterium tuberculosis H37Rv
ccgucgcuacccgc

SEQ ID NO: 3329714 - RNA, 18 nt, Mycobacterium tuberculosis H37Rv
ccgucgcuaugcgccgca

SEQ ID NO: 3329715 - RNA, 15 nt, Mycobacterium tuberculosis H37Rv
ccgucgcugggaggc

SEQ ID NO: 3329716 - RNA, 13 nt, Mycobacterium tuberculosis H37Rv
ccgucggaacuga

SEQ ID NO: 3329717 - RNA, 13 nt, Mycobacterium tuberculosis H37Rv
ccgucggacaccg

SEQ ID NO: 3329718 - RNA, 16 nt, Mycobacterium tuberculosis H37Rv
ccgucggauggaaggc

SEQ ID NO: 3329719 - RNA, 23 nt, Mycobacterium tuberculosis H37Rv
ccgucggauggaaggcggccagg

SEQ ID NO: 3329720 - RNA, 18 nt, Mycobacterium tuberculosis H37Rv
ccgucggcaccagcagcc

SEQ ID NO: 3329721 - RNA, 12 nt, Mycobacterium tuberculosis H37Rv
ccgucggcagca

SEQ ID NO: 3329722 - RNA, 17 nt, Mycobacterium tuberculosis H37Rv
ccgucggcagcagcggu

SEQ ID NO: 3329723 - RNA, 14 nt, Mycobacterium tuberculosis H37Rv
ccgucggcccgcuc

SEQ ID NO: 3329724 - RNA, 13 nt, Mycobacterium tuberculosis H37Rv
ccgucggcgagca

SEQ ID NO: 3329725 - RNA, 16 nt, Mycobacterium tuberculosis H37Rv
ccgucggcgaugaagu

SEQ ID NO: 3329726 - RNA, 14 nt, Mycobacterium tuberculosis H37Rv
ccgucggcgcccgg

SEQ ID NO: 3329727 - RNA, 19 nt, Mycobacterium tuberculosis H37Rv
ccgucggcgugcagcagcu

SEQ ID NO: 3329728 - RNA, 20 nt, Mycobacterium tuberculosis H37Rv
ccgucggcgugcagcagcuu

SEQ ID NO: 3329729 - RNA, 22 nt, Mycobacterium tuberculosis H37Rv
ccgucgggauggacggcagcca

SEQ ID NO: 3329730 - RNA, 24 nt, Mycobacterium tuberculosis H37Rv
ccgucgggauggacggcagccagc

SEQ ID NO: 3329731 - RNA, 19 nt, Mycobacterium tuberculosis H37Rv
ccgucgggcacaccgacgc

SEQ ID NO: 3329732 - RNA, 13 nt, Mycobacterium tuberculosis H37Rv
ccgucgggcccac

SEQ ID NO: 3329733 - RNA, 14 nt, Mycobacterium tuberculosis H37Rv
ccgucgggcccagc

SEQ ID NO: 3329734 - RNA, 16 nt, Mycobacterium tuberculosis H37Rv
ccgucgggcccagccg

SEQ ID NO: 3329735 - RNA, 22 nt, Mycobacterium tuberculosis H37Rv
ccgucggggaguucgcgcagca

SEQ ID NO: 3329736 - RNA, 18 nt, Mycobacterium tuberculosis H37Rv
ccgucggggaugccgaac

SEQ ID NO: 3329737 - RNA, 23 nt, Mycobacterium tuberculosis H37Rv
ccgucgggugcagcacggcgccg

SEQ ID NO: 3329738 - RNA, 19 nt, Mycobacterium tuberculosis H37Rv
ccgucgguaaagggcucga

SEQ ID NO: 3329739 - RNA, 22 nt, Mycobacterium tuberculosis H37Rv
ccgucgguaaagggcucgaugg

SEQ ID NO: 3329740 - RNA, 22 nt, Mycobacterium tuberculosis H37Rv
ccgucggugagcugcgccagaa

SEQ ID NO: 3329741 - RNA, 16 nt, Mycobacterium tuberculosis H37Rv
ccgucggugccgccgc

SEQ ID NO: 3329742 - RNA, 18 nt, Mycobacterium tuberculosis H37Rv
ccgucggugccgccgccg

SEQ ID NO: 3329743 - RNA, 17 nt, Mycobacterium tuberculosis H37Rv
ccgucggugccgcggac

SEQ ID NO: 3329744 - RNA, 20 nt, Mycobacterium tuberculosis H37Rv
ccgucggugggugccagccg

SEQ ID NO: 3329745 - RNA, 22 nt, Mycobacterium tuberculosis H37Rv
ccgucggugggugccagccggu

SEQ ID NO: 3329746 - RNA, 24 nt, Mycobacterium tuberculosis H37Rv
ccgucggugggugccagccggucg

SEQ ID NO: 3329747 - RNA, 22 nt, Mycobacterium tuberculosis H37Rv
ccgucguacucgaccgcgagca

SEQ ID NO: 3329748 - RNA, 19 nt, Mycobacterium tuberculosis H37Rv
ccgucguaugcggugacga

SEQ ID NO: 3329749 - RNA, 17 nt, Mycobacterium tuberculosis H37Rv
ccgucgucaaguccuuc

SEQ ID NO: 3329750 - RNA, 21 nt, Mycobacterium tuberculosis H37Rv
ccgucguccgcugacccgcca

SEQ ID NO: 3329751 - RNA, 15 nt, Mycobacterium tuberculosis H37Rv
ccgucgucgaccacg

SEQ ID NO: 3329752 - RNA, 19 nt, Mycobacterium tuberculosis H37Rv
ccgucgucgaccacgacgu

SEQ ID NO: 3329753 - RNA, 21 nt, Mycobacterium tuberculosis H37Rv
ccgucgucgagcaccacccgg

SEQ ID NO: 3329754 - RNA, 22 nt, Mycobacterium tuberculosis H37Rv
ccgucgucgagcaccacccggg

SEQ ID NO: 3329755 - RNA, 13 nt, Mycobacterium tuberculosis H37Rv
ccgucgucgagcc

SEQ ID NO: 3329756 - RNA, 13 nt, Mycobacterium tuberculosis H37Rv
ccgucgucgccgu

SEQ ID NO: 3329757 - RNA, 19 nt, Mycobacterium tuberculosis H37Rv
ccgucgucgccgucggugc

SEQ ID NO: 3329758 - RNA, 14 nt, Mycobacterium tuberculosis H37Rv
ccgucgucggucuc

SEQ ID NO: 3329759 - RNA, 16 nt, Mycobacterium tuberculosis H37Rv
ccgucgucgucgacac

SEQ ID NO: 3329760 - RNA, 15 nt, Mycobacterium tuberculosis H37Rv
ccgucgucgucgaga

SEQ ID NO: 3329761 - RNA, 16 nt, Mycobacterium tuberculosis H37Rv
ccgucgucgucggcag

SEQ ID NO: 3329762 - RNA, 21 nt, Mycobacterium tuberculosis H37Rv
ccgucgucgugcacgacgaca

SEQ ID NO: 3329763 - RNA, 22 nt, Mycobacterium tuberculosis H37Rv
ccgucgucguuucgccagccgg

SEQ ID NO: 3329764 - RNA, 15 nt, Mycobacterium tuberculosis H37Rv
ccgucgugccaccgu

SEQ ID NO: 3329765 - RNA, 19 nt, Mycobacterium tuberculosis H37Rv
ccgucguugcccgacccgc

SEQ ID NO: 3329766 - RNA, 17 nt, Mycobacterium tuberculosis H37Rv
ccgucguugugccgguc

SEQ ID NO: 3329767 - RNA, 22 nt, Mycobacterium tuberculosis H37Rv
ccgucguugugccggucgauga

SEQ ID NO: 3329768 - RNA, 20 nt, Mycobacterium tuberculosis H37Rv
ccgucuccgguuucuacaac

SEQ ID NO: 3329769 - RNA, 22 nt, Mycobacterium tuberculosis H37Rv
ccgucucgaagcucagcuucuu

SEQ ID NO: 3329770 - RNA, 13 nt, Mycobacterium tuberculosis H37Rv
ccgucucgccccc

SEQ ID NO: 3329771 - RNA, 15 nt, Mycobacterium tuberculosis H37Rv
ccgucucgccgcgca

SEQ ID NO: 3329772 - RNA, 14 nt, Mycobacterium tuberculosis H37Rv
ccgucucgccgugg

SEQ ID NO: 3329773 - RNA, 20 nt, Mycobacterium tuberculosis H37Rv
ccgucucggcaugcucgaca

SEQ ID NO: 3329774 - RNA, 21 nt, Mycobacterium tuberculosis H37Rv
ccgucucgguggugaguacca

SEQ ID NO: 3329775 - RNA, 12 nt, Mycobacterium tuberculosis H37Rv
ccgucucugcca

SEQ ID NO: 3329776 - RNA, 14 nt, Mycobacterium tuberculosis H37Rv
ccgucugacagcau

SEQ ID NO: 3329777 - RNA, 16 nt, Mycobacterium tuberculosis H37Rv
ccgucugacagcaucc

SEQ ID NO: 3329778 - RNA, 19 nt, Mycobacterium tuberculosis H37Rv
ccgucugacagcauccuuc

SEQ ID NO: 3329779 - RNA, 23 nt, Mycobacterium tuberculosis H37Rv
ccgucugacagcauccuucgcgu

SEQ ID NO: 3329780 - RNA, 19 nt, Mycobacterium tuberculosis H37Rv
ccgucugacccaccgcccc

SEQ ID NO: 3329781 - RNA, 12 nt, Mycobacterium tuberculosis H37Rv
ccgucugaucac

SEQ ID NO: 3329782 - RNA, 15 nt, Mycobacterium tuberculosis H37Rv
ccgucugcgacccgg

SEQ ID NO: 3329783 - RNA, 17 nt, Mycobacterium tuberculosis H37Rv
ccgucugcgacccgggc

SEQ ID NO: 3329784 - RNA, 18 nt, Mycobacterium tuberculosis H37Rv
ccgucugcgacccgggcc

SEQ ID NO: 3329785 - RNA, 21 nt, Mycobacterium tuberculosis H37Rv
ccgucugcggaccggcgcgcu

SEQ ID NO: 3329786 - RNA, 20 nt, Mycobacterium tuberculosis H37Rv
ccgucugcggggugagugac

SEQ ID NO: 3329787 - RNA, 13 nt, Mycobacterium tuberculosis H37Rv
ccgucuggccguu

SEQ ID NO: 3329788 - RNA, 13 nt, Mycobacterium tuberculosis H37Rv
ccgucuucgccgc

SEQ ID NO: 3329789 - RNA, 14 nt, Mycobacterium tuberculosis H37Rv
ccgucuugccggcc

SEQ ID NO: 3329790 - RNA, 16 nt, Mycobacterium tuberculosis H37Rv
ccgugaaucgagcacc

SEQ ID NO: 3329791 - RNA, 23 nt, Mycobacterium tuberculosis H37Rv
ccgugacaccggggacgucgacu

SEQ ID NO: 3329792 - RNA, 20 nt, Mycobacterium tuberculosis H37Rv
ccgugacauucugcagcguc

SEQ ID NO: 3329793 - RNA, 14 nt, Mycobacterium tuberculosis H37Rv
ccgugaccagccgg

SEQ ID NO: 3329794 - RNA, 17 nt, Mycobacterium tuberculosis H37Rv
ccgugaccgccgcgccg

SEQ ID NO: 3329795 - RNA, 16 nt, Mycobacterium tuberculosis H37Rv
ccgugacguagggcag

SEQ ID NO: 3329796 - RNA, 14 nt, Mycobacterium tuberculosis H37Rv
ccgugagcaccagc

SEQ ID NO: 3329797 - RNA, 17 nt, Mycobacterium tuberculosis H37Rv
ccgugaucagcgcguag

SEQ ID NO: 3329798 - RNA, 13 nt, Mycobacterium tuberculosis H37Rv
ccgugaucagcuc

SEQ ID NO: 3329799 - RNA, 17 nt, Mycobacterium tuberculosis H37Rv
ccgugauccgccgacag

SEQ ID NO: 3329800 - RNA, 15 nt, Mycobacterium tuberculosis H37Rv
ccgugcaccuccagg

SEQ ID NO: 3329801 - RNA, 18 nt, Mycobacterium tuberculosis H37Rv
ccgugcaccuccagguag

SEQ ID NO: 3329802 - RNA, 17 nt, Mycobacterium tuberculosis H37Rv
ccgugcacgaucgcggu

SEQ ID NO: 3329803 - RNA, 16 nt, Mycobacterium tuberculosis H37Rv
ccgugcacgucagcgg

SEQ ID NO: 3329804 - RNA, 16 nt, Mycobacterium tuberculosis H37Rv
ccgugcagcucgguca

SEQ ID NO: 3329805 - RNA, 14 nt, Mycobacterium tuberculosis H37Rv
ccgugccagcaggg

SEQ ID NO: 3329806 - RNA, 14 nt, Mycobacterium tuberculosis H37Rv
ccgugcccggugcg

SEQ ID NO: 3329807 - RNA, 14 nt, Mycobacterium tuberculosis H37Rv
ccgugccgaccacc

SEQ ID NO: 3329808 - RNA, 15 nt, Mycobacterium tuberculosis H37Rv
ccgugccgaccacca

SEQ ID NO: 3329809 - RNA, 18 nt, Mycobacterium tuberculosis H37Rv
ccgugccgaugccggcga

SEQ ID NO: 3329810 - RNA, 15 nt, Mycobacterium tuberculosis H37Rv
ccgugccgcacagcg

SEQ ID NO: 3329811 - RNA, 13 nt, Mycobacterium tuberculosis H37Rv
ccgugccgcccgg

SEQ ID NO: 3329812 - RNA, 20 nt, Mycobacterium tuberculosis H37Rv
ccgugccgccgaugccgccg

SEQ ID NO: 3329813 - RNA, 16 nt, Mycobacterium tuberculosis H37Rv
ccgugccgggcgacgg

SEQ ID NO: 3329814 - RNA, 22 nt, Mycobacterium tuberculosis H37Rv
ccgugccgguguguccagcgga

SEQ ID NO: 3329815 - RNA, 23 nt, Mycobacterium tuberculosis H37Rv
ccgugccgguguguccagcggau

SEQ ID NO: 3329816 - RNA, 12 nt, Mycobacterium tuberculosis H37Rv
ccgugccgucgg

SEQ ID NO: 3329817 - RNA, 15 nt, Mycobacterium tuberculosis H37Rv
ccgugccgucggcgu

SEQ ID NO: 3329818 - RNA, 18 nt, Mycobacterium tuberculosis H37Rv
ccgugccuggccggugcg

SEQ ID NO: 3329819 - RNA, 18 nt, Mycobacterium tuberculosis H37Rv
ccgugcgaucgucaacga

SEQ ID NO: 3329820 - RNA, 19 nt, Mycobacterium tuberculosis H37Rv
ccgugcgcgcgcagcugac

SEQ ID NO: 3329821 - RNA, 17 nt, Mycobacterium tuberculosis H37Rv
ccgugcggcggcugccg

SEQ ID NO: 3329822 - RNA, 14 nt, Mycobacterium tuberculosis H37Rv
ccgugcggucgcgc

SEQ ID NO: 3329823 - RNA, 20 nt, Mycobacterium tuberculosis H37Rv
ccgugcgucgauggcgucgg

SEQ ID NO: 3329824 - RNA, 22 nt, Mycobacterium tuberculosis H37Rv
ccgugcugggcaucaccgacgc

SEQ ID NO: 3329825 - RNA, 19 nt, Mycobacterium tuberculosis H37Rv
ccgugcugggugacaccgg

SEQ ID NO: 3329826 - RNA, 18 nt, Mycobacterium tuberculosis H37Rv
ccgugcuguuccagcguc

SEQ ID NO: 3329827 - RNA, 21 nt, Mycobacterium tuberculosis H37Rv
ccgugcuuuccuugcgcgcca

SEQ ID NO: 3329828 - RNA, 14 nt, Mycobacterium tuberculosis H37Rv
ccguggaaagugcg

SEQ ID NO: 3329829 - RNA, 14 nt, Mycobacterium tuberculosis H37Rv
ccguggaucggcag

SEQ ID NO: 3329830 - RNA, 18 nt, Mycobacterium tuberculosis H37Rv
ccguggccaaacuuucgg

SEQ ID NO: 3329831 - RNA, 19 nt, Mycobacterium tuberculosis H37Rv
ccguggccaaacuuucggg

SEQ ID NO: 3329832 - RNA, 14 nt, Mycobacterium tuberculosis H37Rv
ccguggccaucgau

SEQ ID NO: 3329833 - RNA, 11 nt, Mycobacterium tuberculosis H37Rv
ccguggcccaa

SEQ ID NO: 3329834 - RNA, 18 nt, Mycobacterium tuberculosis H37Rv
ccguggccgcacugcugg

SEQ ID NO: 3329835 - RNA, 13 nt, Mycobacterium tuberculosis H37Rv
ccguggccgcagg

SEQ ID NO: 3329836 - RNA, 18 nt, Mycobacterium tuberculosis H37Rv
ccguggccggacccauug

SEQ ID NO: 3329837 - RNA, 21 nt, Mycobacterium tuberculosis H37Rv
ccguggccggacccauuggac

SEQ ID NO: 3329838 - RNA, 19 nt, Mycobacterium tuberculosis H37Rv
ccguggccugaaacggcug

SEQ ID NO: 3329839 - RNA, 13 nt, Mycobacterium tuberculosis H37Rv
ccguggcgcccgc

SEQ ID NO: 3329840 - RNA, 18 nt, Mycobacterium tuberculosis H37Rv
ccguggcgccggucgccg

SEQ ID NO: 3329841 - RNA, 19 nt, Mycobacterium tuberculosis H37Rv
ccguggcgccggucgccgg

SEQ ID NO: 3329842 - RNA, 21 nt, Mycobacterium tuberculosis H37Rv
ccguggcggugagccgccagg

SEQ ID NO: 3329843 - RNA, 22 nt, Mycobacterium tuberculosis H37Rv
ccguggcggugagccgccagga

SEQ ID NO: 3329844 - RNA, 20 nt, Mycobacterium tuberculosis H37Rv
ccgugggcagcgcgcccgac

SEQ ID NO: 3329845 - RNA, 13 nt, Mycobacterium tuberculosis H37Rv
ccgugggcggguu

SEQ ID NO: 3329846 - RNA, 17 nt, Mycobacterium tuberculosis H37Rv
ccguggguagcgaagaa

SEQ ID NO: 3329847 - RNA, 12 nt, Mycobacterium tuberculosis H37Rv
ccguggugauca

SEQ ID NO: 3329848 - RNA, 19 nt, Mycobacterium tuberculosis H37Rv
ccguggugcuagcgccgcc

SEQ ID NO: 3329849 - RNA, 19 nt, Mycobacterium tuberculosis H37Rv
ccgugguggcguaucgggc

SEQ ID NO: 3329850 - RNA, 15 nt, Mycobacterium tuberculosis H37Rv
ccgugguggucgggc

SEQ ID NO: 3329851 - RNA, 20 nt, Mycobacterium tuberculosis H37Rv
ccguggugguugaucagcca

SEQ ID NO: 3329852 - RNA, 23 nt, Mycobacterium tuberculosis H37Rv
ccguggugguugaucagccagac

SEQ ID NO: 3329853 - RNA, 15 nt, Mycobacterium tuberculosis H37Rv
ccguguaaccaucgu

SEQ ID NO: 3329854 - RNA, 17 nt, Mycobacterium tuberculosis H37Rv
ccguguaggccauguug

SEQ ID NO: 3329855 - RNA, 13 nt, Mycobacterium tuberculosis H37Rv
ccgugucaaccgg

SEQ ID NO: 3329856 - RNA, 21 nt, Mycobacterium tuberculosis H37Rv
ccgugucacgcgaccaccgcc

SEQ ID NO: 3329857 - RNA, 17 nt, Mycobacterium tuberculosis H37Rv
ccgugucgccgccgcga

SEQ ID NO: 3329858 - RNA, 12 nt, Mycobacterium tuberculosis H37Rv
ccgugucgccgg

SEQ ID NO: 3329859 - RNA, 23 nt, Mycobacterium tuberculosis H37Rv
ccgugugcggacaguucccggcc

SEQ ID NO: 3329860 - RNA, 16 nt, Mycobacterium tuberculosis H37Rv
ccgugugugcgaucca

SEQ ID NO: 3329861 - RNA, 19 nt, Mycobacterium tuberculosis H37Rv
ccgugugugcgauccaggg

SEQ ID NO: 3329862 - RNA, 15 nt, Mycobacterium tuberculosis H37Rv
ccguguucgccacac

SEQ ID NO: 3329863 - RNA, 19 nt, Mycobacterium tuberculosis H37Rv
ccguguugagggugcccga

SEQ ID NO: 3329864 - RNA, 16 nt, Mycobacterium tuberculosis H37Rv
ccguuaccgccgucgc

SEQ ID NO: 3329865 - RNA, 21 nt, Mycobacterium tuberculosis H37Rv
ccguuagcuuagcugccgucg

SEQ ID NO: 3329866 - RNA, 16 nt, Mycobacterium tuberculosis H37Rv
ccguuauccgacgaac

SEQ ID NO: 3329867 - RNA, 22 nt, Mycobacterium tuberculosis H37Rv
ccguucaacguggaaaccgcuc

SEQ ID NO: 3329868 - RNA, 21 nt, Mycobacterium tuberculosis H37Rv
ccguucacccagcggaaccga

SEQ ID NO: 3329869 - RNA, 16 nt, Mycobacterium tuberculosis H37Rv
ccguuccacgccggca

SEQ ID NO: 3329870 - RNA, 18 nt, Mycobacterium tuberculosis H37Rv
ccguucccgccggccccg

SEQ ID NO: 3329871 - RNA, 17 nt, Mycobacterium tuberculosis H37Rv
ccguucgacccagcggu

SEQ ID NO: 3329872 - RNA, 20 nt, Mycobacterium tuberculosis H37Rv
ccguucgacccagcgguuga

SEQ ID NO: 3329873 - RNA, 13 nt, Mycobacterium tuberculosis H37Rv
ccguucgaggucg

SEQ ID NO: 3329874 - RNA, 19 nt, Mycobacterium tuberculosis H37Rv
ccguucgaggucggcgauc

SEQ ID NO: 3329875 - RNA, 22 nt, Mycobacterium tuberculosis H37Rv
ccguucgcccgcccgucuucca

SEQ ID NO: 3329876 - RNA, 14 nt, Mycobacterium tuberculosis H37Rv
ccguucgccgucgg

SEQ ID NO: 3329877 - RNA, 12 nt, Mycobacterium tuberculosis H37Rv
ccguucggcgcc

SEQ ID NO: 3329878 - RNA, 16 nt, Mycobacterium tuberculosis H37Rv
ccguucggcuaagccu

SEQ ID NO: 3329879 - RNA, 20 nt, Mycobacterium tuberculosis H37Rv
ccguucggcugccgcgcgcu

SEQ ID NO: 3329880 - RNA, 14 nt, Mycobacterium tuberculosis H37Rv
ccguucggggcgcg

SEQ ID NO: 3329881 - RNA, 19 nt, Mycobacterium tuberculosis H37Rv
ccguucgugagcggccagg

SEQ ID NO: 3329882 - RNA, 20 nt, Mycobacterium tuberculosis H37Rv
ccguucgugggcauugcggc

SEQ ID NO: 3329883 - RNA, 18 nt, Mycobacterium tuberculosis H37Rv
ccguucucgcccacccgc

SEQ ID NO: 3329884 - RNA, 15 nt, Mycobacterium tuberculosis H37Rv
ccguucugcccaggc

SEQ ID NO: 3329885 - RNA, 16 nt, Mycobacterium tuberculosis H37Rv
ccguucugcccaggca

SEQ ID NO: 3329886 - RNA, 20 nt, Mycobacterium tuberculosis H37Rv
ccguucuucgcgauguccuc

SEQ ID NO: 3329887 - RNA, 20 nt, Mycobacterium tuberculosis H37Rv
ccguugaccucuucgggcag

SEQ ID NO: 3329888 - RNA, 16 nt, Mycobacterium tuberculosis H37Rv
ccguugaggucgauca

SEQ ID NO: 3329889 - RNA, 19 nt, Mycobacterium tuberculosis H37Rv
ccguugaguguguuugagu

SEQ ID NO: 3329890 - RNA, 20 nt, Mycobacterium tuberculosis H37Rv
ccguugaucgucucggcuag

SEQ ID NO: 3329891 - RNA, 17 nt, Mycobacterium tuberculosis H37Rv
ccguugaucuugacggu

SEQ ID NO: 3329892 - RNA, 15 nt, Mycobacterium tuberculosis H37Rv
ccguugcccaacccg

SEQ ID NO: 3329893 - RNA, 18 nt, Mycobacterium tuberculosis H37Rv
ccguugcccccauugccg

SEQ ID NO: 3329894 - RNA, 21 nt, Mycobacterium tuberculosis H37Rv
ccguugcccccauugccgccg

SEQ ID NO: 3329895 - RNA, 12 nt, Mycobacterium tuberculosis H37Rv
ccguugcccccg

SEQ ID NO: 3329896 - RNA, 24 nt, Mycobacterium tuberculosis H37Rv
ccguugccgaaccacgcgcccgca

SEQ ID NO: 3329897 - RNA, 13 nt, Mycobacterium tuberculosis H37Rv
ccguugccgauca

SEQ ID NO: 3329898 - RNA, 17 nt, Mycobacterium tuberculosis H37Rv
ccguugccgaucagccc

SEQ ID NO: 3329899 - RNA, 21 nt, Mycobacterium tuberculosis H37Rv
ccguugccgaucagcccggcc

SEQ ID NO: 3329900 - RNA, 17 nt, Mycobacterium tuberculosis H37Rv
ccguugccgaucagucc

SEQ ID NO: 3329901 - RNA, 17 nt, Mycobacterium tuberculosis H37Rv
ccguugccgaucgcucc

SEQ ID NO: 3329902 - RNA, 17 nt, Mycobacterium tuberculosis H37Rv
ccguugccgccauuggc

SEQ ID NO: 3329903 - RNA, 16 nt, Mycobacterium tuberculosis H37Rv
ccguugccgcccacua

SEQ ID NO: 3329904 - RNA, 19 nt, Mycobacterium tuberculosis H37Rv
ccguugccgccgacgccgc

SEQ ID NO: 3329905 - RNA, 21 nt, Mycobacterium tuberculosis H37Rv
ccguugccgccgacgccgccg

SEQ ID NO: 3329906 - RNA, 22 nt, Mycobacterium tuberculosis H37Rv
ccguugccgccggugccacccu

SEQ ID NO: 3329907 - RNA, 23 nt, Mycobacterium tuberculosis H37Rv
ccguugccgccguuaccgagccc

SEQ ID NO: 3329908 - RNA, 20 nt, Mycobacterium tuberculosis H37Rv
ccguugccgccguugccacc

SEQ ID NO: 3329909 - RNA, 21 nt, Mycobacterium tuberculosis H37Rv
ccguugccgccguugccgccg

SEQ ID NO: 3329910 - RNA, 14 nt, Mycobacterium tuberculosis H37Rv
ccguugccggcguu

SEQ ID NO: 3329911 - RNA, 21 nt, Mycobacterium tuberculosis H37Rv
ccguugccggcguugccgccg

SEQ ID NO: 3329912 - RNA, 20 nt, Mycobacterium tuberculosis H37Rv
ccguugcucccacggcaccc

SEQ ID NO: 3329913 - RNA, 21 nt, Mycobacterium tuberculosis H37Rv
ccguugcugagcguaggccag

SEQ ID NO: 3329914 - RNA, 17 nt, Mycobacterium tuberculosis H37Rv
ccguuggagacgucgca

SEQ ID NO: 3329915 - RNA, 15 nt, Mycobacterium tuberculosis H37Rv
ccguuggcaaugacc

SEQ ID NO: 3329916 - RNA, 21 nt, Mycobacterium tuberculosis H37Rv
ccguuggcgacguuggcggga

SEQ ID NO: 3329917 - RNA, 22 nt, Mycobacterium tuberculosis H37Rv
ccguuggcggcgguggccagcg

SEQ ID NO: 3329918 - RNA, 14 nt, Mycobacterium tuberculosis H37Rv
ccguugggccgacu

SEQ ID NO: 3329919 - RNA, 15 nt, Mycobacterium tuberculosis H37Rv
ccguuggggccguuc

SEQ ID NO: 3329920 - RNA, 22 nt, Mycobacterium tuberculosis H37Rv
ccguuggugccgccugugccac

SEQ ID NO: 3329921 - RNA, 15 nt, Mycobacterium tuberculosis H37Rv
ccguuguccagcgcg

SEQ ID NO: 3329922 - RNA, 18 nt, Mycobacterium tuberculosis H37Rv
ccguuguggaccaucuuc

SEQ ID NO: 3329923 - RNA, 19 nt, Mycobacterium tuberculosis H37Rv
ccguuguucuugucggagc

SEQ ID NO: 3329924 - RNA, 16 nt, Mycobacterium tuberculosis H37Rv
ccguuuccgccgccgc

SEQ ID NO: 3329925 - RNA, 13 nt, Mycobacterium tuberculosis H37Rv
ccguuucggcgcc

SEQ ID NO: 3329926 - RNA, 18 nt, Mycobacterium tuberculosis H37Rv
ccguuugagcggccaccg

SEQ ID NO: 3329927 - RNA, 18 nt, Mycobacterium tuberculosis H37Rv
ccuaaaccagccaccacc

SEQ ID NO: 3329928 - RNA, 19 nt, Mycobacterium tuberculosis H37Rv
ccuaaaccggcgcuaaacc

SEQ ID NO: 3329929 - RNA, 19 nt, Mycobacterium tuberculosis H37Rv
ccuaaauugccgggcccag

SEQ ID NO: 3329930 - RNA, 17 nt, Mycobacterium tuberculosis H37Rv
ccuaacaucguugaucu

SEQ ID NO: 3329931 - RNA, 21 nt, Mycobacterium tuberculosis H37Rv
ccuaacccugcccuagcccga

SEQ ID NO: 3329932 - RNA, 15 nt, Mycobacterium tuberculosis H37Rv
ccuaaggcucaccag

SEQ ID NO: 3329933 - RNA, 12 nt, Mycobacterium tuberculosis H37Rv
ccuaccaggcgc

SEQ ID NO: 3329934 - RNA, 15 nt, Mycobacterium tuberculosis H37Rv
ccuaccgucgaccac

SEQ ID NO: 3329935 - RNA, 15 nt, Mycobacterium tuberculosis H37Rv
ccuacgaugacguuu

SEQ ID NO: 3329936 - RNA, 22 nt, Mycobacterium tuberculosis H37Rv
ccuagauccaaacacccuugcc

SEQ ID NO: 3329937 - RNA, 21 nt, Mycobacterium tuberculosis H37Rv
ccuagcagggugccggcgccg

SEQ ID NO: 3329938 - RNA, 19 nt, Mycobacterium tuberculosis H37Rv
ccuagccccugaaggccag

SEQ ID NO: 3329939 - RNA, 13 nt, Mycobacterium tuberculosis H37Rv
ccuagccgcagcc

SEQ ID NO: 3329940 - RNA, 17 nt, Mycobacterium tuberculosis H37Rv
ccuagccgcggcaccgc

SEQ ID NO: 3329941 - RNA, 18 nt, Mycobacterium tuberculosis H37Rv
ccuagccggcgcgcccca

SEQ ID NO: 3329942 - RNA, 21 nt, Mycobacterium tuberculosis H37Rv
ccuaggccgucucgacacugc

SEQ ID NO: 3329943 - RNA, 16 nt, Mycobacterium tuberculosis H37Rv
ccuagggaaaggcgcc

SEQ ID NO: 3329944 - RNA, 22 nt, Mycobacterium tuberculosis H37Rv
ccuagguagucggccuccucgu

SEQ ID NO: 3329945 - RNA, 14 nt, Mycobacterium tuberculosis H37Rv
ccuagguucgccac

SEQ ID NO: 3329946 - RNA, 16 nt, Mycobacterium tuberculosis H37Rv
ccuaguacgccgagca

SEQ ID NO: 3329947 - RNA, 20 nt, Mycobacterium tuberculosis H37Rv
ccuaguccggcacugcggcc

SEQ ID NO: 3329948 - RNA, 21 nt, Mycobacterium tuberculosis H37Rv
ccuaguccggcacugcggcca

SEQ ID NO: 3329949 - RNA, 14 nt, Mycobacterium tuberculosis H37Rv
ccuagucgcggccg

SEQ ID NO: 3329950 - RNA, 20 nt, Mycobacterium tuberculosis H37Rv
ccuauccaaagaccccuacc

SEQ ID NO: 3329951 - RNA, 16 nt, Mycobacterium tuberculosis H37Rv
ccuaucccgaaucuca

SEQ ID NO: 3329952 - RNA, 13 nt, Mycobacterium tuberculosis H37Rv
ccuauccgggccc

SEQ ID NO: 3329953 - RNA, 17 nt, Mycobacterium tuberculosis H37Rv
ccuaucugccgguaccg

SEQ ID NO: 3329954 - RNA, 13 nt, Mycobacterium tuberculosis H37Rv
ccucaacaccagg

SEQ ID NO: 3329955 - RNA, 15 nt, Mycobacterium tuberculosis H37Rv
ccucaacaccaggcc

SEQ ID NO: 3329956 - RNA, 16 nt, Mycobacterium tuberculosis H37Rv
ccucaacaccaggccg

SEQ ID NO: 3329957 - RNA, 18 nt, Mycobacterium tuberculosis H37Rv
ccucaacgaucgcgccgu

SEQ ID NO: 3329958 - RNA, 15 nt, Mycobacterium tuberculosis H37Rv
ccucaacgucccagc

SEQ ID NO: 3329959 - RNA, 23 nt, Mycobacterium tuberculosis H37Rv
ccucaagcgaagagcgcacugaa

SEQ ID NO: 3329960 - RNA, 17 nt, Mycobacterium tuberculosis H37Rv
ccucaaggucggccagg

SEQ ID NO: 3329961 - RNA, 20 nt, Mycobacterium tuberculosis H37Rv
ccucaaggucggccaggcug

SEQ ID NO: 3329962 - RNA, 16 nt, Mycobacterium tuberculosis H37Rv
ccucacaugcccggac

SEQ ID NO: 3329963 - RNA, 17 nt, Mycobacterium tuberculosis H37Rv
ccucaccaaccgcccga

SEQ ID NO: 3329964 - RNA, 17 nt, Mycobacterium tuberculosis H37Rv
ccucacccacccgcggu

SEQ ID NO: 3329965 - RNA, 19 nt, Mycobacterium tuberculosis H37Rv
ccucaccgaucucgaccag

SEQ ID NO: 3329966 - RNA, 20 nt, Mycobacterium tuberculosis H37Rv
ccucaccgaucucgaccagc

SEQ ID NO: 3329967 - RNA, 21 nt, Mycobacterium tuberculosis H37Rv
ccucaccgaugugaccgaaca

SEQ ID NO: 3329968 - RNA, 20 nt, Mycobacterium tuberculosis H37Rv
ccucaccgccugugccgccg

SEQ ID NO: 3329969 - RNA, 14 nt, Mycobacterium tuberculosis H37Rv
ccucacgggcgccg

SEQ ID NO: 3329970 - RNA, 15 nt, Mycobacterium tuberculosis H37Rv
ccucacugcggcgcc

SEQ ID NO: 3329971 - RNA, 16 nt, Mycobacterium tuberculosis H37Rv
ccucagaggucgccgg

SEQ ID NO: 3329972 - RNA, 16 nt, Mycobacterium tuberculosis H37Rv
ccucagccaccgcggu

SEQ ID NO: 3329973 - RNA, 20 nt, Mycobacterium tuberculosis H37Rv
ccucagccaccgcggucagc

SEQ ID NO: 3329974 - RNA, 20 nt, Mycobacterium tuberculosis H37Rv
ccucagccaccgggcgugcg

SEQ ID NO: 3329975 - RNA, 19 nt, Mycobacterium tuberculosis H37Rv
ccucagccgccugucgggc

SEQ ID NO: 3329976 - RNA, 17 nt, Mycobacterium tuberculosis H37Rv
ccucagccggcggcugg

SEQ ID NO: 3329977 - RNA, 17 nt, Mycobacterium tuberculosis H37Rv
ccucagcgaugcucacu

SEQ ID NO: 3329978 - RNA, 11 nt, Mycobacterium tuberculosis H37Rv
ccucagcugcu

SEQ ID NO: 3329979 - RNA, 14 nt, Mycobacterium tuberculosis H37Rv
ccucaucgagcgcg

SEQ ID NO: 3329980 - RNA, 15 nt, Mycobacterium tuberculosis H37Rv
ccucaucggacagcg

SEQ ID NO: 3329981 - RNA, 23 nt, Mycobacterium tuberculosis H37Rv
ccucaucggacagcgccuggccg

SEQ ID NO: 3329982 - RNA, 13 nt, Mycobacterium tuberculosis H37Rv
ccucaugcacgcc

SEQ ID NO: 3329983 - RNA, 21 nt, Mycobacterium tuberculosis H37Rv
ccucaugcacgccguagcauc

SEQ ID NO: 3329984 - RNA, 14 nt, Mycobacterium tuberculosis H37Rv
ccuccaagcccgcc

SEQ ID NO: 3329985 - RNA, 20 nt, Mycobacterium tuberculosis H37Rv
ccuccaagcccgccggaccc

SEQ ID NO: 3329986 - RNA, 22 nt, Mycobacterium tuberculosis H37Rv
ccuccaagcccgccggacccgc

SEQ ID NO: 3329987 - RNA, 17 nt, Mycobacterium tuberculosis H37Rv
ccuccaccagugccccg

SEQ ID NO: 3329988 - RNA, 18 nt, Mycobacterium tuberculosis H37Rv
ccuccacccgccacgguu

SEQ ID NO: 3329989 - RNA, 15 nt, Mycobacterium tuberculosis H37Rv
ccuccacgcccuggc

SEQ ID NO: 3329990 - RNA, 23 nt, Mycobacterium tuberculosis H37Rv
ccuccacugcgagcgccggcuuc

SEQ ID NO: 3329991 - RNA, 19 nt, Mycobacterium tuberculosis H37Rv
ccuccacuuuuccgccggc

SEQ ID NO: 3329992 - RNA, 21 nt, Mycobacterium tuberculosis H37Rv
ccuccagaaccgaagccucgg

SEQ ID NO: 3329993 - RNA, 22 nt, Mycobacterium tuberculosis H37Rv
ccuccagauacaggaacaacgc

SEQ ID NO: 3329994 - RNA, 16 nt, Mycobacterium tuberculosis H37Rv
ccuccagauucgccgc

SEQ ID NO: 3329995 - RNA, 20 nt, Mycobacterium tuberculosis H37Rv
ccuccagcaccacggcgcgc

SEQ ID NO: 3329996 - RNA, 15 nt, Mycobacterium tuberculosis H37Rv
ccuccagcacccggu

SEQ ID NO: 3329997 - RNA, 19 nt, Mycobacterium tuberculosis H37Rv
ccuccagcacgccguccag

SEQ ID NO: 3329998 - RNA, 16 nt, Mycobacterium tuberculosis H37Rv
ccuccagcagcgacgg

SEQ ID NO: 3329999 - RNA, 19 nt, Mycobacterium tuberculosis H37Rv
ccuccagcagcgacgguca

SEQ ID NO: 3330000 - RNA, 19 nt, Mycobacterium tuberculosis H37Rv
ccuccagcaggucgccugc

SEQ ID NO: 3330001 - RNA, 16 nt, Mycobacterium tuberculosis H37Rv
ccuccagcgcaccggu

SEQ ID NO: 3330002 - RNA, 16 nt, Mycobacterium tuberculosis H37Rv
ccuccaggaucucuuc

SEQ ID NO: 3330003 - RNA, 17 nt, Mycobacterium tuberculosis H37Rv
ccuccagugcggccuug

SEQ ID NO: 3330004 - RNA, 17 nt, Mycobacterium tuberculosis H37Rv
ccuccauaucgcagcgu

SEQ ID NO: 3330005 - RNA, 15 nt, Mycobacterium tuberculosis H37Rv
ccucccacagguaga

SEQ ID NO: 3330006 - RNA, 22 nt, Mycobacterium tuberculosis H37Rv
ccucccaccagcggcggcccuu

SEQ ID NO: 3330007 - RNA, 15 nt, Mycobacterium tuberculosis H37Rv
ccucccacgccgccg

SEQ ID NO: 3330008 - RNA, 21 nt, Mycobacterium tuberculosis H37Rv
ccucccauucccaacacagcc

SEQ ID NO: 3330009 - RNA, 15 nt, Mycobacterium tuberculosis H37Rv
ccuccccgaccgcca

SEQ ID NO: 3330010 - RNA, 20 nt, Mycobacterium tuberculosis H37Rv
ccuccccgaccgccaccgcc

SEQ ID NO: 3330011 - RNA, 16 nt, Mycobacterium tuberculosis H37Rv
ccucccgcagccgggc

SEQ ID NO: 3330012 - RNA, 14 nt, Mycobacterium tuberculosis H37Rv
ccucccgcggcacc

SEQ ID NO: 3330013 - RNA, 15 nt, Mycobacterium tuberculosis H37Rv
ccucccgcggcaccu

SEQ ID NO: 3330014 - RNA, 21 nt, Mycobacterium tuberculosis H37Rv
ccucccggacuucaugaucgg

SEQ ID NO: 3330015 - RNA, 19 nt, Mycobacterium tuberculosis H37Rv
ccucccgggcccgcugggc

SEQ ID NO: 3330016 - RNA, 21 nt, Mycobacterium tuberculosis H37Rv
ccucccgggcccgcugggcuu

SEQ ID NO: 3330017 - RNA, 13 nt, Mycobacterium tuberculosis H37Rv
ccucccgggccgc

SEQ ID NO: 3330018 - RNA, 15 nt, Mycobacterium tuberculosis H37Rv
ccucccgggccgccg

SEQ ID NO: 3330019 - RNA, 15 nt, Mycobacterium tuberculosis H37Rv
ccucccuggcccccg

SEQ ID NO: 3330020 - RNA, 15 nt, Mycobacterium tuberculosis H37Rv
ccucccuuccgcgcu

SEQ ID NO: 3330021 - RNA, 13 nt, Mycobacterium tuberculosis H37Rv
ccuccgagcacag

SEQ ID NO: 3330022 - RNA, 20 nt, Mycobacterium tuberculosis H37Rv
ccuccgaggaauacagcuug

SEQ ID NO: 3330023 - RNA, 13 nt, Mycobacterium tuberculosis H37Rv
ccuccgaggccgc

SEQ ID NO: 3330024 - RNA, 21 nt, Mycobacterium tuberculosis H37Rv
ccuccgaggccgccaucgccg

SEQ ID NO: 3330025 - RNA, 17 nt, Mycobacterium tuberculosis H37Rv
ccuccgcaaucgcgacg

SEQ ID NO: 3330026 - RNA, 19 nt, Mycobacterium tuberculosis H37Rv
ccuccgcaucgcggcgacg

SEQ ID NO: 3330027 - RNA, 22 nt, Mycobacterium tuberculosis H37Rv
ccuccgccaaggaggccaucau

SEQ ID NO: 3330028 - RNA, 21 nt, Mycobacterium tuberculosis H37Rv
ccuccgccgaggaaaccacca

SEQ ID NO: 3330029 - RNA, 18 nt, Mycobacterium tuberculosis H37Rv
ccuccgccggcaccuccg

SEQ ID NO: 3330030 - RNA, 20 nt, Mycobacterium tuberculosis H37Rv
ccuccgccggucaugauccg

SEQ ID NO: 3330031 - RNA, 14 nt, Mycobacterium tuberculosis H37Rv
ccuccgccugcccc

SEQ ID NO: 3330032 - RNA, 15 nt, Mycobacterium tuberculosis H37Rv
ccuccgccugcccca

SEQ ID NO: 3330033 - RNA, 17 nt, Mycobacterium tuberculosis H37Rv
ccuccgccugccccacc

SEQ ID NO: 3330034 - RNA, 15 nt, Mycobacterium tuberculosis H37Rv
ccuccgcgaucaccg

SEQ ID NO: 3330035 - RNA, 17 nt, Mycobacterium tuberculosis H37Rv
ccuccgcgccgaucagc

SEQ ID NO: 3330036 - RNA, 18 nt, Mycobacterium tuberculosis H37Rv
ccuccgcguagagcagca

SEQ ID NO: 3330037 - RNA, 15 nt, Mycobacterium tuberculosis H37Rv
ccuccgcuagaacag

SEQ ID NO: 3330038 - RNA, 15 nt, Mycobacterium tuberculosis H37Rv
ccuccgcugccgccc

SEQ ID NO: 3330039 - RNA, 17 nt, Mycobacterium tuberculosis H37Rv
ccuccgcugccgcccgc

SEQ ID NO: 3330040 - RNA, 23 nt, Mycobacterium tuberculosis H37Rv
ccuccggaaagcucucggcaccc

SEQ ID NO: 3330041 - RNA, 17 nt, Mycobacterium tuberculosis H37Rv
ccuccggauccucggcc

SEQ ID NO: 3330042 - RNA, 22 nt, Mycobacterium tuberculosis H37Rv
ccuccggauccucggccgccau

SEQ ID NO: 3330043 - RNA, 15 nt, Mycobacterium tuberculosis H37Rv
ccuccggcaccgccc

SEQ ID NO: 3330044 - RNA, 12 nt, Mycobacterium tuberculosis H37Rv
ccuccggcagca

SEQ ID NO: 3330045 - RNA, 15 nt, Mycobacterium tuberculosis H37Rv
ccuccggcagcagca

SEQ ID NO: 3330046 - RNA, 17 nt, Mycobacterium tuberculosis H37Rv
ccuccggccgugagccc

SEQ ID NO: 3330047 - RNA, 15 nt, Mycobacterium tuberculosis H37Rv
ccuccggcgccgccc

SEQ ID NO: 3330048 - RNA, 17 nt, Mycobacterium tuberculosis H37Rv
ccuccggcgccgcccga

SEQ ID NO: 3330049 - RNA, 11 nt, Mycobacterium tuberculosis H37Rv
ccuccgggcca

SEQ ID NO: 3330050 - RNA, 20 nt, Mycobacterium tuberculosis H37Rv
ccuccggguccaggaacggc

SEQ ID NO: 3330051 - RNA, 20 nt, Mycobacterium tuberculosis H37Rv
ccuccgguaucggcgaccag

SEQ ID NO: 3330052 - RNA, 21 nt, Mycobacterium tuberculosis H37Rv
ccuccgguaucggcgaccagc

SEQ ID NO: 3330053 - RNA, 17 nt, Mycobacterium tuberculosis H37Rv
ccuccguaacgccaagc

SEQ ID NO: 3330054 - RNA, 16 nt, Mycobacterium tuberculosis H37Rv
ccuccgucagcgccgc

SEQ ID NO: 3330055 - RNA, 16 nt, Mycobacterium tuberculosis H37Rv
ccuccguugcccccau

SEQ ID NO: 3330056 - RNA, 14 nt, Mycobacterium tuberculosis H37Rv
ccuccuccguuugg

SEQ ID NO: 3330057 - RNA, 23 nt, Mycobacterium tuberculosis H37Rv
ccuccucgauagcggcgccugac

SEQ ID NO: 3330058 - RNA, 13 nt, Mycobacterium tuberculosis H37Rv
ccuccucggugag

SEQ ID NO: 3330059 - RNA, 13 nt, Mycobacterium tuberculosis H37Rv
ccuccugccgccg

SEQ ID NO: 3330060 - RNA, 19 nt, Mycobacterium tuberculosis H37Rv
ccuccugccgccgcuccau

SEQ ID NO: 3330061 - RNA, 21 nt, Mycobacterium tuberculosis H37Rv
ccuccuugagccgggcaacca

SEQ ID NO: 3330062 - RNA, 20 nt, Mycobacterium tuberculosis H37Rv
ccuccuuuguccucccggac

SEQ ID NO: 3330063 - RNA, 17 nt, Mycobacterium tuberculosis H37Rv
ccucgaaggcacugcga

SEQ ID NO: 3330064 - RNA, 19 nt, Mycobacterium tuberculosis H37Rv
ccucgaaggcacugcgauc

SEQ ID NO: 3330065 - RNA, 15 nt, Mycobacterium tuberculosis H37Rv
ccucgaauucggccg

SEQ ID NO: 3330066 - RNA, 13 nt, Mycobacterium tuberculosis H37Rv
ccucgacacccag

SEQ ID NO: 3330067 - RNA, 18 nt, Mycobacterium tuberculosis H37Rv
ccucgacacccagccgca

SEQ ID NO: 3330068 - RNA, 17 nt, Mycobacterium tuberculosis H37Rv
ccucgacccggcgcagc

SEQ ID NO: 3330069 - RNA, 21 nt, Mycobacterium tuberculosis H37Rv
ccucgaccgcggccuuggcgg

SEQ ID NO: 3330070 - RNA, 16 nt, Mycobacterium tuberculosis H37Rv
ccucgacgaucagcac

SEQ ID NO: 3330071 - RNA, 17 nt, Mycobacterium tuberculosis H37Rv
ccucgacgaucagcacg

SEQ ID NO: 3330072 - RNA, 14 nt, Mycobacterium tuberculosis H37Rv
ccucgacgccccag

SEQ ID NO: 3330073 - RNA, 15 nt, Mycobacterium tuberculosis H37Rv
ccucgacgccgcgca

SEQ ID NO: 3330074 - RNA, 16 nt, Mycobacterium tuberculosis H37Rv
ccucgacgccgcgcag

SEQ ID NO: 3330075 - RNA, 18 nt, Mycobacterium tuberculosis H37Rv
ccucgacgccgcgcagcc

SEQ ID NO: 3330076 - RNA, 15 nt, Mycobacterium tuberculosis H37Rv
ccucgacgcggcagg

SEQ ID NO: 3330077 - RNA, 20 nt, Mycobacterium tuberculosis H37Rv
ccucgacgcggcaggccggu

SEQ ID NO: 3330078 - RNA, 22 nt, Mycobacterium tuberculosis H37Rv
ccucgacguaggccaggucgcc

SEQ ID NO: 3330079 - RNA, 19 nt, Mycobacterium tuberculosis H37Rv
ccucgacguccaucccggc

SEQ ID NO: 3330080 - RNA, 15 nt, Mycobacterium tuberculosis H37Rv
ccucgacgucggcga

SEQ ID NO: 3330081 - RNA, 16 nt, Mycobacterium tuberculosis H37Rv
ccucgacgucggcgag

SEQ ID NO: 3330082 - RNA, 17 nt, Mycobacterium tuberculosis H37Rv
ccucgacguggccgacg

SEQ ID NO: 3330083 - RNA, 14 nt, Mycobacterium tuberculosis H37Rv
ccucgagcaccgcg

SEQ ID NO: 3330084 - RNA, 15 nt, Mycobacterium tuberculosis H37Rv
ccucgagccagcucc

SEQ ID NO: 3330085 - RNA, 16 nt, Mycobacterium tuberculosis H37Rv
ccucgagccagcuccg

SEQ ID NO: 3330086 - RNA, 14 nt, Mycobacterium tuberculosis H37Rv
ccucgagcggcaga

SEQ ID NO: 3330087 - RNA, 18 nt, Mycobacterium tuberculosis H37Rv
ccucgagcugcuggcgcg

SEQ ID NO: 3330088 - RNA, 13 nt, Mycobacterium tuberculosis H37Rv
ccucgagcuugcc

SEQ ID NO: 3330089 - RNA, 14 nt, Mycobacterium tuberculosis H37Rv
ccucgaggcuggua

SEQ ID NO: 3330090 - RNA, 14 nt, Mycobacterium tuberculosis H37Rv
ccucgagugccgcc

SEQ ID NO: 3330091 - RNA, 16 nt, Mycobacterium tuberculosis H37Rv
ccucgaguuuggccag

SEQ ID NO: 3330092 - RNA, 22 nt, Mycobacterium tuberculosis H37Rv
ccucgauaaccgcaguucuuga

SEQ ID NO: 3330093 - RNA, 14 nt, Mycobacterium tuberculosis H37Rv
ccucgauaucgucg

SEQ ID NO: 3330094 - RNA, 17 nt, Mycobacterium tuberculosis H37Rv
ccucgauaucgucggga

SEQ ID NO: 3330095 - RNA, 16 nt, Mycobacterium tuberculosis H37Rv
ccucgaucacggcggc

SEQ ID NO: 3330096 - RNA, 20 nt, Mycobacterium tuberculosis H37Rv
ccucgaucgacucgaaccgu

SEQ ID NO: 3330097 - RNA, 19 nt, Mycobacterium tuberculosis H37Rv
ccucgaugacaucggucag

SEQ ID NO: 3330098 - RNA, 21 nt, Mycobacterium tuberculosis H37Rv
ccucgaugaggcgcagcgcca

SEQ ID NO: 3330099 - RNA, 22 nt, Mycobacterium tuberculosis H37Rv
ccucgaugaggcgcagcgccag

SEQ ID NO: 3330100 - RNA, 13 nt, Mycobacterium tuberculosis H37Rv
ccucgaugaugcg

SEQ ID NO: 3330101 - RNA, 20 nt, Mycobacterium tuberculosis H37Rv
ccucgaugcccuuggcgaug

SEQ ID NO: 3330102 - RNA, 13 nt, Mycobacterium tuberculosis H37Rv
ccucgauggccag

SEQ ID NO: 3330103 - RNA, 15 nt, Mycobacterium tuberculosis H37Rv
ccucgauggcggugg

SEQ ID NO: 3330104 - RNA, 16 nt, Mycobacterium tuberculosis H37Rv
ccucgauggcguccau

SEQ ID NO: 3330105 - RNA, 16 nt, Mycobacterium tuberculosis H37Rv
ccucgauggucucccg

SEQ ID NO: 3330106 - RNA, 18 nt, Mycobacterium tuberculosis H37Rv
ccucgauggucucccggc

SEQ ID NO: 3330107 - RNA, 16 nt, Mycobacterium tuberculosis H37Rv
ccucgauuguggccag

SEQ ID NO: 3330108 - RNA, 20 nt, Mycobacterium tuberculosis H37Rv
ccucgcacaauggcggcgcc

SEQ ID NO: 3330109 - RNA, 16 nt, Mycobacterium tuberculosis H37Rv
ccucgcacgacaccuc

SEQ ID NO: 3330110 - RNA, 19 nt, Mycobacterium tuberculosis H37Rv
ccucgcagguggugacacg

SEQ ID NO: 3330111 - RNA, 22 nt, Mycobacterium tuberculosis H37Rv
ccucgcagguggugacacgacg

SEQ ID NO: 3330112 - RNA, 22 nt, Mycobacterium tuberculosis H37Rv
ccucgccacgcucggcggccag

SEQ ID NO: 3330113 - RNA, 13 nt, Mycobacterium tuberculosis H37Rv
ccucgcccagcaa

SEQ ID NO: 3330114 - RNA, 21 nt, Mycobacterium tuberculosis H37Rv
ccucgcccagcaaggcccgaa

SEQ ID NO: 3330115 - RNA, 16 nt, Mycobacterium tuberculosis H37Rv
ccucgccccaccggcc

SEQ ID NO: 3330116 - RNA, 14 nt, Mycobacterium tuberculosis H37Rv
ccucgcccgcacca

SEQ ID NO: 3330117 - RNA, 12 nt, Mycobacterium tuberculosis H37Rv
ccucgcccuccc

SEQ ID NO: 3330118 - RNA, 21 nt, Mycobacterium tuberculosis H37Rv
ccucgcccucccgggcccgcu

SEQ ID NO: 3330119 - RNA, 19 nt, Mycobacterium tuberculosis H37Rv
ccucgcccugcagacgggu

SEQ ID NO: 3330120 - RNA, 16 nt, Mycobacterium tuberculosis H37Rv
ccucgcccuggccgcu

SEQ ID NO: 3330121 - RNA, 14 nt, Mycobacterium tuberculosis H37Rv
ccucgccgcggcgg

SEQ ID NO: 3330122 - RNA, 15 nt, Mycobacterium tuberculosis H37Rv
ccucgccggccaccc

SEQ ID NO: 3330123 - RNA, 15 nt, Mycobacterium tuberculosis H37Rv
ccucgccggccgcca

SEQ ID NO: 3330124 - RNA, 16 nt, Mycobacterium tuberculosis H37Rv
ccucgccggccgccag

SEQ ID NO: 3330125 - RNA, 19 nt, Mycobacterium tuberculosis H37Rv
ccucgccggucagcgugca

SEQ ID NO: 3330126 - RNA, 14 nt, Mycobacterium tuberculosis H37Rv
ccucgccggugacg

SEQ ID NO: 3330127 - RNA, 15 nt, Mycobacterium tuberculosis H37Rv
ccucgccugcacgcc

SEQ ID NO: 3330128 - RNA, 19 nt, Mycobacterium tuberculosis H37Rv
ccucgccugcacgcccggc

SEQ ID NO: 3330129 - RNA, 23 nt, Mycobacterium tuberculosis H37Rv
ccucgccugcccgaaccaccacc

SEQ ID NO: 3330130 - RNA, 19 nt, Mycobacterium tuberculosis H37Rv
ccucgcgcaccggcuggcc

SEQ ID NO: 3330131 - RNA, 16 nt, Mycobacterium tuberculosis H37Rv
ccucgcgcgccacggu

SEQ ID NO: 3330132 - RNA, 18 nt, Mycobacterium tuberculosis H37Rv
ccucgcggaugagcucgg

SEQ ID NO: 3330133 - RNA, 19 nt, Mycobacterium tuberculosis H37Rv
ccucgcgggcuuaugcacg

SEQ ID NO: 3330134 - RNA, 20 nt, Mycobacterium tuberculosis H37Rv
ccucgcguagggccagcgcc

SEQ ID NO: 3330135 - RNA, 15 nt, Mycobacterium tuberculosis H37Rv
ccucggacugcagcg

SEQ ID NO: 3330136 - RNA, 23 nt, Mycobacterium tuberculosis H37Rv
ccucggagaugaacucggcgauc

SEQ ID NO: 3330137 - RNA, 23 nt, Mycobacterium tuberculosis H37Rv
ccucggcaagucgacgccgcagc

SEQ ID NO: 3330138 - RNA, 15 nt, Mycobacterium tuberculosis H37Rv
ccucggcaugcagcc

SEQ ID NO: 3330139 - RNA, 17 nt, Mycobacterium tuberculosis H37Rv
ccucggcaugcagcccc

SEQ ID NO: 3330140 - RNA, 12 nt, Mycobacterium tuberculosis H37Rv
ccucggccaccc

SEQ ID NO: 3330141 - RNA, 21 nt, Mycobacterium tuberculosis H37Rv
ccucggccagcgucagcuguu

SEQ ID NO: 3330142 - RNA, 12 nt, Mycobacterium tuberculosis H37Rv
ccucggccgcca

SEQ ID NO: 3330143 - RNA, 13 nt, Mycobacterium tuberculosis H37Rv
ccucggccgccau

SEQ ID NO: 3330144 - RNA, 13 nt, Mycobacterium tuberculosis H37Rv
ccucggccgcccg

SEQ ID NO: 3330145 - RNA, 13 nt, Mycobacterium tuberculosis H37Rv
ccucggccgccug

SEQ ID NO: 3330146 - RNA, 22 nt, Mycobacterium tuberculosis H37Rv
ccucggcgaccaucugaucggg

SEQ ID NO: 3330147 - RNA, 12 nt, Mycobacterium tuberculosis H37Rv
ccucggcgaugu

SEQ ID NO: 3330148 - RNA, 16 nt, Mycobacterium tuberculosis H37Rv
ccucggcgaugucgcg

SEQ ID NO: 3330149 - RNA, 13 nt, Mycobacterium tuberculosis H37Rv
ccucggcgccgcc

SEQ ID NO: 3330150 - RNA, 16 nt, Mycobacterium tuberculosis H37Rv
ccucggcgccgcccag

SEQ ID NO: 3330151 - RNA, 16 nt, Mycobacterium tuberculosis H37Rv
ccucggcgccgucgga

SEQ ID NO: 3330152 - RNA, 23 nt, Mycobacterium tuberculosis H37Rv
ccucggcgccgucggagccggcc

SEQ ID NO: 3330153 - RNA, 21 nt, Mycobacterium tuberculosis H37Rv
ccucggcgcgaaaccagucca

SEQ ID NO: 3330154 - RNA, 16 nt, Mycobacterium tuberculosis H37Rv
ccucggcgcugcgcac

SEQ ID NO: 3330155 - RNA, 18 nt, Mycobacterium tuberculosis H37Rv
ccucggcgcugcgcaccg

SEQ ID NO: 3330156 - RNA, 17 nt, Mycobacterium tuberculosis H37Rv
ccucggcggagacggcg

SEQ ID NO: 3330157 - RNA, 20 nt, Mycobacterium tuberculosis H37Rv
ccucggcggccagcucggcc

SEQ ID NO: 3330158 - RNA, 14 nt, Mycobacterium tuberculosis H37Rv
ccucggcgggaucc

SEQ ID NO: 3330159 - RNA, 19 nt, Mycobacterium tuberculosis H37Rv
ccucggcgggauccucgaa

SEQ ID NO: 3330160 - RNA, 20 nt, Mycobacterium tuberculosis H37Rv
ccucggcgguaaaugccugc

SEQ ID NO: 3330161 - RNA, 19 nt, Mycobacterium tuberculosis H37Rv
ccucggcguaggcgauggc

SEQ ID NO: 3330162 - RNA, 16 nt, Mycobacterium tuberculosis H37Rv
ccucggcuuggccggc

SEQ ID NO: 3330163 - RNA, 16 nt, Mycobacterium tuberculosis H37Rv
ccucgggacggccgcc

SEQ ID NO: 3330164 - RNA, 20 nt, Mycobacterium tuberculosis H37Rv
ccucgggacggccgccgccg

SEQ ID NO: 3330165 - RNA, 15 nt, Mycobacterium tuberculosis H37Rv
ccucgggacugcgcg

SEQ ID NO: 3330166 - RNA, 15 nt, Mycobacterium tuberculosis H37Rv
ccucgggaucggcgg

SEQ ID NO: 3330167 - RNA, 16 nt, Mycobacterium tuberculosis H37Rv
ccucgggguagccaac

SEQ ID NO: 3330168 - RNA, 16 nt, Mycobacterium tuberculosis H37Rv
ccucggguacaucgag

SEQ ID NO: 3330169 - RNA, 20 nt, Mycobacterium tuberculosis H37Rv
ccucggguguggucaccagg

SEQ ID NO: 3330170 - RNA, 15 nt, Mycobacterium tuberculosis H37Rv
ccucggucaccgagg

SEQ ID NO: 3330171 - RNA, 16 nt, Mycobacterium tuberculosis H37Rv
ccucggucaccgaggg

SEQ ID NO: 3330172 - RNA, 19 nt, Mycobacterium tuberculosis H37Rv
ccucggucacgaucacgau

SEQ ID NO: 3330173 - RNA, 14 nt, Mycobacterium tuberculosis H37Rv
ccucggucugcucc

SEQ ID NO: 3330174 - RNA, 20 nt, Mycobacterium tuberculosis H37Rv
ccucggugaccaggccggcc

SEQ ID NO: 3330175 - RNA, 16 nt, Mycobacterium tuberculosis H37Rv
ccucggugacgucgcc

SEQ ID NO: 3330176 - RNA, 21 nt, Mycobacterium tuberculosis H37Rv
ccucggugagaaucgacuccg

SEQ ID NO: 3330177 - RNA, 16 nt, Mycobacterium tuberculosis H37Rv
ccucggugccggccgc

SEQ ID NO: 3330178 - RNA, 23 nt, Mycobacterium tuberculosis H37Rv
ccucggugcggaacaccgcccgg

SEQ ID NO: 3330179 - RNA, 22 nt, Mycobacterium tuberculosis H37Rv
ccucggugugcucgccgaccag

SEQ ID NO: 3330180 - RNA, 23 nt, Mycobacterium tuberculosis H37Rv
ccucguacucaucgacguuccag

SEQ ID NO: 3330181 - RNA, 19 nt, Mycobacterium tuberculosis H37Rv
ccucguagucccacugcca

SEQ ID NO: 3330182 - RNA, 20 nt, Mycobacterium tuberculosis H37Rv
ccucguaugccguggccgcc

SEQ ID NO: 3330183 - RNA, 23 nt, Mycobacterium tuberculosis H37Rv
ccucgucaaucaccaccgccagc

SEQ ID NO: 3330184 - RNA, 13 nt, Mycobacterium tuberculosis H37Rv
ccucgucacccgg

SEQ ID NO: 3330185 - RNA, 14 nt, Mycobacterium tuberculosis H37Rv
ccucgucaccgcga

SEQ ID NO: 3330186 - RNA, 13 nt, Mycobacterium tuberculosis H37Rv
ccucgucccggac

SEQ ID NO: 3330187 - RNA, 23 nt, Mycobacterium tuberculosis H37Rv
ccucguccugcgagaggugcugc

SEQ ID NO: 3330188 - RNA, 15 nt, Mycobacterium tuberculosis H37Rv
ccucgucgacgucgg

SEQ ID NO: 3330189 - RNA, 21 nt, Mycobacterium tuberculosis H37Rv
ccucgucgagagguucgccgu

SEQ ID NO: 3330190 - RNA, 22 nt, Mycobacterium tuberculosis H37Rv
ccucgucgagagguucgccguc

SEQ ID NO: 3330191 - RNA, 19 nt, Mycobacterium tuberculosis H37Rv
ccucgucgagcgugcgcac

SEQ ID NO: 3330192 - RNA, 19 nt, Mycobacterium tuberculosis H37Rv
ccucgucgagguccucguc

SEQ ID NO: 3330193 - RNA, 20 nt, Mycobacterium tuberculosis H37Rv
ccucgucgaucgccgcgaug

SEQ ID NO: 3330194 - RNA, 19 nt, Mycobacterium tuberculosis H37Rv
ccucgucgaucgccgcgcc

SEQ ID NO: 3330195 - RNA, 18 nt, Mycobacterium tuberculosis H37Rv
ccucgucgaucucgaucg

SEQ ID NO: 3330196 - RNA, 15 nt, Mycobacterium tuberculosis H37Rv
ccucgucgauguucg

SEQ ID NO: 3330197 - RNA, 16 nt, Mycobacterium tuberculosis H37Rv
ccucgucgauguucgc

SEQ ID NO: 3330198 - RNA, 12 nt, Mycobacterium tuberculosis H37Rv
ccucgucgccgc

SEQ ID NO: 3330199 - RNA, 15 nt, Mycobacterium tuberculosis H37Rv
ccucgucgccgcggu

SEQ ID NO: 3330200 - RNA, 22 nt, Mycobacterium tuberculosis H37Rv
ccucgucgccgcgguagacgcc

SEQ ID NO: 3330201 - RNA, 15 nt, Mycobacterium tuberculosis H37Rv
ccucgucgccuagcc

SEQ ID NO: 3330202 - RNA, 15 nt, Mycobacterium tuberculosis H37Rv
ccucgucgcgggcca

SEQ ID NO: 3330203 - RNA, 22 nt, Mycobacterium tuberculosis H37Rv
ccucgucgcgggccaccgcugu

SEQ ID NO: 3330204 - RNA, 15 nt, Mycobacterium tuberculosis H37Rv
ccucgucgcugccca

SEQ ID NO: 3330205 - RNA, 19 nt, Mycobacterium tuberculosis H37Rv
ccucgucggccgacaccgc

SEQ ID NO: 3330206 - RNA, 21 nt, Mycobacterium tuberculosis H37Rv
ccucgucggccgacaccgcca

SEQ ID NO: 3330207 - RNA, 23 nt, Mycobacterium tuberculosis H37Rv
ccucgucggccgacaccgccacc

SEQ ID NO: 3330208 - RNA, 19 nt, Mycobacterium tuberculosis H37Rv
ccucgucuucgucgguguc

SEQ ID NO: 3330209 - RNA, 14 nt, Mycobacterium tuberculosis H37Rv
ccucgugcggcgcu

SEQ ID NO: 3330210 - RNA, 16 nt, Mycobacterium tuberculosis H37Rv
ccucguuaucgaccgc

SEQ ID NO: 3330211 - RNA, 22 nt, Mycobacterium tuberculosis H37Rv
ccucguuaucgaccgccgcgag

SEQ ID NO: 3330212 - RNA, 21 nt, Mycobacterium tuberculosis H37Rv
ccucuagcuugacaacccugu

SEQ ID NO: 3330213 - RNA, 23 nt, Mycobacterium tuberculosis H37Rv
ccucucagcacgguuguuguaga

SEQ ID NO: 3330214 - RNA, 14 nt, Mycobacterium tuberculosis H37Rv
ccucucugcgccag

SEQ ID NO: 3330215 - RNA, 21 nt, Mycobacterium tuberculosis H37Rv
ccucucuucccaaccgcccgu

SEQ ID NO: 3330216 - RNA, 14 nt, Mycobacterium tuberculosis H37Rv
ccucugaaccugcu

SEQ ID NO: 3330217 - RNA, 14 nt, Mycobacterium tuberculosis H37Rv
ccucugcguccagc

SEQ ID NO: 3330218 - RNA, 12 nt, Mycobacterium tuberculosis H37Rv
ccucugcucagc

SEQ ID NO: 3330219 - RNA, 13 nt, Mycobacterium tuberculosis H37Rv
ccucugcucagcc

SEQ ID NO: 3330220 - RNA, 20 nt, Mycobacterium tuberculosis H37Rv
ccucugcugagcugcucgcc

SEQ ID NO: 3330221 - RNA, 19 nt, Mycobacterium tuberculosis H37Rv
ccucugggcuguccuccug

SEQ ID NO: 3330222 - RNA, 18 nt, Mycobacterium tuberculosis H37Rv
ccucugucuucagcugcg

SEQ ID NO: 3330223 - RNA, 17 nt, Mycobacterium tuberculosis H37Rv
ccucuucgggcagcgcg

SEQ ID NO: 3330224 - RNA, 22 nt, Mycobacterium tuberculosis H37Rv
ccucuucgggguagaccuucuc

SEQ ID NO: 3330225 - RNA, 18 nt, Mycobacterium tuberculosis H37Rv
ccucuucgggugcagcca

SEQ ID NO: 3330226 - RNA, 16 nt, Mycobacterium tuberculosis H37Rv
ccucuucgguguggca

SEQ ID NO: 3330227 - RNA, 16 nt, Mycobacterium tuberculosis H37Rv
ccugaaacggcugcag

SEQ ID NO: 3330228 - RNA, 14 nt, Mycobacterium tuberculosis H37Rv
ccugaagccgcgcu

SEQ ID NO: 3330229 - RNA, 22 nt, Mycobacterium tuberculosis H37Rv
ccugaaucaccggagcgccgag

SEQ ID NO: 3330230 - RNA, 19 nt, Mycobacterium tuberculosis H37Rv
ccugaaucgguucggccag

SEQ ID NO: 3330231 - RNA, 22 nt, Mycobacterium tuberculosis H37Rv
ccugaaucuuguuguucgccac

SEQ ID NO: 3330232 - RNA, 18 nt, Mycobacterium tuberculosis H37Rv
ccugaaugcggccuucgg

SEQ ID NO: 3330233 - RNA, 12 nt, Mycobacterium tuberculosis H37Rv
ccugacacccau

SEQ ID NO: 3330234 - RNA, 16 nt, Mycobacterium tuberculosis H37Rv
ccugacccggagccgc

SEQ ID NO: 3330235 - RNA, 21 nt, Mycobacterium tuberculosis H37Rv
ccugaccgaagucugcagacg

SEQ ID NO: 3330236 - RNA, 20 nt, Mycobacterium tuberculosis H37Rv
ccugaccgcccgcacccccg

SEQ ID NO: 3330237 - RNA, 18 nt, Mycobacterium tuberculosis H37Rv
ccugaccggcucgccggc

SEQ ID NO: 3330238 - RNA, 19 nt, Mycobacterium tuberculosis H37Rv
ccugacgaaggucuccggc

SEQ ID NO: 3330239 - RNA, 16 nt, Mycobacterium tuberculosis H37Rv
ccugacgaucauugca

SEQ ID NO: 3330240 - RNA, 23 nt, Mycobacterium tuberculosis H37Rv
ccugacgccccgccacaauggac

SEQ ID NO: 3330241 - RNA, 19 nt, Mycobacterium tuberculosis H37Rv
ccugacgcucggucgccac

SEQ ID NO: 3330242 - RNA, 23 nt, Mycobacterium tuberculosis H37Rv
ccugacgguaaaugucgaacagg

SEQ ID NO: 3330243 - RNA, 17 nt, Mycobacterium tuberculosis H37Rv
ccugacgguacagcucc

SEQ ID NO: 3330244 - RNA, 19 nt, Mycobacterium tuberculosis H37Rv
ccugacgucacguucggcg

SEQ ID NO: 3330245 - RNA, 19 nt, Mycobacterium tuberculosis H37Rv
ccugacuuuugucacugcg

SEQ ID NO: 3330246 - RNA, 12 nt, Mycobacterium tuberculosis H37Rv
ccugagcggcca

SEQ ID NO: 3330247 - RNA, 13 nt, Mycobacterium tuberculosis H37Rv
ccugagcggccau

SEQ ID NO: 3330248 - RNA, 19 nt, Mycobacterium tuberculosis H37Rv
ccugauaugacuugcgcgc

SEQ ID NO: 3330249 - RNA, 22 nt, Mycobacterium tuberculosis H37Rv
ccugaucaaggaccgcucugcg

SEQ ID NO: 3330250 - RNA, 18 nt, Mycobacterium tuberculosis H37Rv
ccugauccgccugccgac

SEQ ID NO: 3330251 - RNA, 16 nt, Mycobacterium tuberculosis H37Rv
ccugaucgagcgccag

SEQ ID NO: 3330252 - RNA, 13 nt, Mycobacterium tuberculosis H37Rv
ccugaugagggac

SEQ ID NO: 3330253 - RNA, 13 nt, Mycobacterium tuberculosis H37Rv
ccugauggacccg

SEQ ID NO: 3330254 - RNA, 15 nt, Mycobacterium tuberculosis H37Rv
ccugauggacccgau

SEQ ID NO: 3330255 - RNA, 21 nt, Mycobacterium tuberculosis H37Rv
ccugauggcgcugcaccguag

SEQ ID NO: 3330256 - RNA, 19 nt, Mycobacterium tuberculosis H37Rv
ccugcaagcuaagcgccug

SEQ ID NO: 3330257 - RNA, 14 nt, Mycobacterium tuberculosis H37Rv
ccugcacagcagcg

SEQ ID NO: 3330258 - RNA, 19 nt, Mycobacterium tuberculosis H37Rv
ccugcaccacggcggccac

SEQ ID NO: 3330259 - RNA, 22 nt, Mycobacterium tuberculosis H37Rv
ccugcaccacggcggccaccug

SEQ ID NO: 3330260 - RNA, 17 nt, Mycobacterium tuberculosis H37Rv
ccugcacccgacccgau

SEQ ID NO: 3330261 - RNA, 21 nt, Mycobacterium tuberculosis H37Rv
ccugcaccgccgccgcccgua

SEQ ID NO: 3330262 - RNA, 22 nt, Mycobacterium tuberculosis H37Rv
ccugcaccgucacgucguuugg

SEQ ID NO: 3330263 - RNA, 15 nt, Mycobacterium tuberculosis H37Rv
ccugcacgccggcgc

SEQ ID NO: 3330264 - RNA, 17 nt, Mycobacterium tuberculosis H37Rv
ccugcagcccgggcagc

SEQ ID NO: 3330265 - RNA, 12 nt, Mycobacterium tuberculosis H37Rv
ccugcagccgau

SEQ ID NO: 3330266 - RNA, 14 nt, Mycobacterium tuberculosis H37Rv
ccugcagcucgggc

SEQ ID NO: 3330267 - RNA, 16 nt, Mycobacterium tuberculosis H37Rv
ccugcagcucgggcag

SEQ ID NO: 3330268 - RNA, 12 nt, Mycobacterium tuberculosis H37Rv
ccugcagcuggc

SEQ ID NO: 3330269 - RNA, 20 nt, Mycobacterium tuberculosis H37Rv
ccugcaggaucaaaaccucg

SEQ ID NO: 3330270 - RNA, 20 nt, Mycobacterium tuberculosis H37Rv
ccugcaggccgccggccagc

SEQ ID NO: 3330271 - RNA, 19 nt, Mycobacterium tuberculosis H37Rv
ccugcagguuuccggccug

SEQ ID NO: 3330272 - RNA, 16 nt, Mycobacterium tuberculosis H37Rv
ccugcaguucggcgua

SEQ ID NO: 3330273 - RNA, 13 nt, Mycobacterium tuberculosis H37Rv
ccugcaugcccag

SEQ ID NO: 3330274 - RNA, 18 nt, Mycobacterium tuberculosis H37Rv
ccugccaaugcugcaggu

SEQ ID NO: 3330275 - RNA, 14 nt, Mycobacterium tuberculosis H37Rv
ccugccacagcgac

SEQ ID NO: 3330276 - RNA, 17 nt, Mycobacterium tuberculosis H37Rv
ccugccacagcgacagc

SEQ ID NO: 3330277 - RNA, 19 nt, Mycobacterium tuberculosis H37Rv
ccugccacagcgacagcgu

SEQ ID NO: 3330278 - RNA, 14 nt, Mycobacterium tuberculosis H37Rv
ccugccacccggcc

SEQ ID NO: 3330279 - RNA, 14 nt, Mycobacterium tuberculosis H37Rv
ccugccaccggcgc

SEQ ID NO: 3330280 - RNA, 21 nt, Mycobacterium tuberculosis H37Rv
ccugccacgacgaacaccagc

SEQ ID NO: 3330281 - RNA, 16 nt, Mycobacterium tuberculosis H37Rv
ccugccaguccgcagc

SEQ ID NO: 3330282 - RNA, 13 nt, Mycobacterium tuberculosis H37Rv
ccugccaguccug

SEQ ID NO: 3330283 - RNA, 15 nt, Mycobacterium tuberculosis H37Rv
ccugccauaggccca

SEQ ID NO: 3330284 - RNA, 21 nt, Mycobacterium tuberculosis H37Rv
ccugccaucacgcgcucaccg

SEQ ID NO: 3330285 - RNA, 14 nt, Mycobacterium tuberculosis H37Rv
ccugcccaccuucg

SEQ ID NO: 3330286 - RNA, 14 nt, Mycobacterium tuberculosis H37Rv
ccugcccacgcgga

SEQ ID NO: 3330287 - RNA, 13 nt, Mycobacterium tuberculosis H37Rv
ccugcccagcacc

SEQ ID NO: 3330288 - RNA, 16 nt, Mycobacterium tuberculosis H37Rv
ccugcccagcaccacc

SEQ ID NO: 3330289 - RNA, 12 nt, Mycobacterium tuberculosis H37Rv
ccugcccggccc

SEQ ID NO: 3330290 - RNA, 13 nt, Mycobacterium tuberculosis H37Rv
ccugcccggcccg

SEQ ID NO: 3330291 - RNA, 19 nt, Mycobacterium tuberculosis H37Rv
ccugcccggcccgcccgua

SEQ ID NO: 3330292 - RNA, 20 nt, Mycobacterium tuberculosis H37Rv
ccugcccggcccgcucagcc

SEQ ID NO: 3330293 - RNA, 12 nt, Mycobacterium tuberculosis H37Rv
ccugcccuccgu

SEQ ID NO: 3330294 - RNA, 13 nt, Mycobacterium tuberculosis H37Rv
ccugcccuccgug

SEQ ID NO: 3330295 - RNA, 22 nt, Mycobacterium tuberculosis H37Rv
ccugccgaaacgccgaccgcgc

SEQ ID NO: 3330296 - RNA, 19 nt, Mycobacterium tuberculosis H37Rv
ccugccgaucccguggugg

SEQ ID NO: 3330297 - RNA, 13 nt, Mycobacterium tuberculosis H37Rv
ccugccgaucggg

SEQ ID NO: 3330298 - RNA, 18 nt, Mycobacterium tuberculosis H37Rv
ccugccgaugacgauggc

SEQ ID NO: 3330299 - RNA, 16 nt, Mycobacterium tuberculosis H37Rv
ccugccgccggccccg

SEQ ID NO: 3330300 - RNA, 14 nt, Mycobacterium tuberculosis H37Rv
ccugccggaccacc

SEQ ID NO: 3330301 - RNA, 15 nt, Mycobacterium tuberculosis H37Rv
ccugccggaccaccg

SEQ ID NO: 3330302 - RNA, 20 nt, Mycobacterium tuberculosis H37Rv
ccugccggaccaccgggccg

SEQ ID NO: 3330303 - RNA, 13 nt, Mycobacterium tuberculosis H37Rv
ccugccggcagcg

SEQ ID NO: 3330304 - RNA, 12 nt, Mycobacterium tuberculosis H37Rv
ccugccgggcca

SEQ ID NO: 3330305 - RNA, 13 nt, Mycobacterium tuberculosis H37Rv
ccugccguuccgg

SEQ ID NO: 3330306 - RNA, 16 nt, Mycobacterium tuberculosis H37Rv
ccugccucaccgccgc

SEQ ID NO: 3330307 - RNA, 20 nt, Mycobacterium tuberculosis H37Rv
ccugccucggcgagccgcuc

SEQ ID NO: 3330308 - RNA, 19 nt, Mycobacterium tuberculosis H37Rv
ccugcgaaacgcuggccac

SEQ ID NO: 3330309 - RNA, 22 nt, Mycobacterium tuberculosis H37Rv
ccugcgaauagccaccaagcac

SEQ ID NO: 3330310 - RNA, 23 nt, Mycobacterium tuberculosis H37Rv
ccugcgacuaagggcacuccacc

SEQ ID NO: 3330311 - RNA, 17 nt, Mycobacterium tuberculosis H37Rv
ccugcgagugcggcacg

SEQ ID NO: 3330312 - RNA, 22 nt, Mycobacterium tuberculosis H37Rv
ccugcgcaaauugcaacagagc

SEQ ID NO: 3330313 - RNA, 15 nt, Mycobacterium tuberculosis H37Rv
ccugcgcagccgccu

SEQ ID NO: 3330314 - RNA, 16 nt, Mycobacterium tuberculosis H37Rv
ccugcgcagccgccuc

SEQ ID NO: 3330315 - RNA, 18 nt, Mycobacterium tuberculosis H37Rv
ccugcgcaucaccacugg

SEQ ID NO: 3330316 - RNA, 17 nt, Mycobacterium tuberculosis H37Rv
ccugcgccgccacagca

SEQ ID NO: 3330317 - RNA, 13 nt, Mycobacterium tuberculosis H37Rv
ccugcgccgcccg

SEQ ID NO: 3330318 - RNA, 19 nt, Mycobacterium tuberculosis H37Rv
ccugcgccuuggucgccgg

SEQ ID NO: 3330319 - RNA, 22 nt, Mycobacterium tuberculosis H37Rv
ccugcgccuuggucgccggcgu

SEQ ID NO: 3330320 - RNA, 16 nt, Mycobacterium tuberculosis H37Rv
ccugcgcgaccgacca

SEQ ID NO: 3330321 - RNA, 22 nt, Mycobacterium tuberculosis H37Rv
ccugcgcgaccgaccagccgug

SEQ ID NO: 3330322 - RNA, 19 nt, Mycobacterium tuberculosis H37Rv
ccugcgcgacggcgcugug

SEQ ID NO: 3330323 - RNA, 17 nt, Mycobacterium tuberculosis H37Rv
ccugcgcgagugccagu

SEQ ID NO: 3330324 - RNA, 18 nt, Mycobacterium tuberculosis H37Rv
ccugcgcgcggccgcgcu

SEQ ID NO: 3330325 - RNA, 22 nt, Mycobacterium tuberculosis H37Rv
ccugcgcggcgcgggucacgcc

SEQ ID NO: 3330326 - RNA, 23 nt, Mycobacterium tuberculosis H37Rv
ccugcgcggcgugcgcggugaug

SEQ ID NO: 3330327 - RNA, 13 nt, Mycobacterium tuberculosis H37Rv
ccugcgcugcagc

SEQ ID NO: 3330328 - RNA, 17 nt, Mycobacterium tuberculosis H37Rv
ccugcgcuguucggcac

SEQ ID NO: 3330329 - RNA, 19 nt, Mycobacterium tuberculosis H37Rv
ccugcggcagcggaccgcu

SEQ ID NO: 3330330 - RNA, 20 nt, Mycobacterium tuberculosis H37Rv
ccugcggcaggugcggucaa

SEQ ID NO: 3330331 - RNA, 23 nt, Mycobacterium tuberculosis H37Rv
ccugcggcugcuuggucgcccag

SEQ ID NO: 3330332 - RNA, 19 nt, Mycobacterium tuberculosis H37Rv
ccugcgggaaguugcccag

SEQ ID NO: 3330333 - RNA, 23 nt, Mycobacterium tuberculosis H37Rv
ccugcgggaaguugcccagguga

SEQ ID NO: 3330334 - RNA, 15 nt, Mycobacterium tuberculosis H37Rv
ccugcgggaggcagc

SEQ ID NO: 3330335 - RNA, 15 nt, Mycobacterium tuberculosis H37Rv
ccugcgggcccacgc

SEQ ID NO: 3330336 - RNA, 21 nt, Mycobacterium tuberculosis H37Rv
ccugcguccgacgccugggca

SEQ ID NO: 3330337 - RNA, 20 nt, Mycobacterium tuberculosis H37Rv
ccugcgucucgaugagcgcg

SEQ ID NO: 3330338 - RNA, 23 nt, Mycobacterium tuberculosis H37Rv
ccugcucagcuaaaaaccgcugc

SEQ ID NO: 3330339 - RNA, 13 nt, Mycobacterium tuberculosis H37Rv
ccugcucauccac

SEQ ID NO: 3330340 - RNA, 16 nt, Mycobacterium tuberculosis H37Rv
ccugcuccucggccag

SEQ ID NO: 3330341 - RNA, 20 nt, Mycobacterium tuberculosis H37Rv
ccugcucgaaaucgcacagc

SEQ ID NO: 3330342 - RNA, 14 nt, Mycobacterium tuberculosis H37Rv
ccugcucgcacagc

SEQ ID NO: 3330343 - RNA, 20 nt, Mycobacterium tuberculosis H37Rv
ccugcucgcacagcaccacg

SEQ ID NO: 3330344 - RNA, 15 nt, Mycobacterium tuberculosis H37Rv
ccugcucgcugguga

SEQ ID NO: 3330345 - RNA, 20 nt, Mycobacterium tuberculosis H37Rv
ccugcucgggcgugaucccg

SEQ ID NO: 3330346 - RNA, 16 nt, Mycobacterium tuberculosis H37Rv
ccugcucgucggccac

SEQ ID NO: 3330347 - RNA, 19 nt, Mycobacterium tuberculosis H37Rv
ccugcugcaaccgacuucg

SEQ ID NO: 3330348 - RNA, 15 nt, Mycobacterium tuberculosis H37Rv
ccugcuggaucucgg

SEQ ID NO: 3330349 - RNA, 19 nt, Mycobacterium tuberculosis H37Rv
ccugcuggcccugcuccuc

SEQ ID NO: 3330350 - RNA, 22 nt, Mycobacterium tuberculosis H37Rv
ccugcuggccguaacgcggauc

SEQ ID NO: 3330351 - RNA, 17 nt, Mycobacterium tuberculosis H37Rv
ccugcuggugucggcuc

SEQ ID NO: 3330352 - RNA, 18 nt, Mycobacterium tuberculosis H37Rv
ccugcugugggauucggg

SEQ ID NO: 3330353 - RNA, 16 nt, Mycobacterium tuberculosis H37Rv
ccugcuucaggaucgg

SEQ ID NO: 3330354 - RNA, 13 nt, Mycobacterium tuberculosis H37Rv
ccugcuuggccac

SEQ ID NO: 3330355 - RNA, 20 nt, Mycobacterium tuberculosis H37Rv
ccugcuuguagcgcaucgcc

SEQ ID NO: 3330356 - RNA, 19 nt, Mycobacterium tuberculosis H37Rv
ccuggaacugcaugguggc

SEQ ID NO: 3330357 - RNA, 23 nt, Mycobacterium tuberculosis H37Rv
ccuggaaguacacggcggcccgc

SEQ ID NO: 3330358 - RNA, 18 nt, Mycobacterium tuberculosis H37Rv
ccuggacaaccucgucga

SEQ ID NO: 3330359 - RNA, 18 nt, Mycobacterium tuberculosis H37Rv
ccuggacauaccggcccg

SEQ ID NO: 3330360 - RNA, 12 nt, Mycobacterium tuberculosis H37Rv
ccuggaccucgu

SEQ ID NO: 3330361 - RNA, 16 nt, Mycobacterium tuberculosis H37Rv
ccuggacgucggcgau

SEQ ID NO: 3330362 - RNA, 14 nt, Mycobacterium tuberculosis H37Rv
ccuggacugcagcg

SEQ ID NO: 3330363 - RNA, 13 nt, Mycobacterium tuberculosis H37Rv
ccuggauggcgcc

SEQ ID NO: 3330364 - RNA, 16 nt, Mycobacterium tuberculosis H37Rv
ccuggcaacgacacgc

SEQ ID NO: 3330365 - RNA, 19 nt, Mycobacterium tuberculosis H37Rv
ccuggcaacgacacgccgc

SEQ ID NO: 3330366 - RNA, 15 nt, Mycobacterium tuberculosis H37Rv
ccuggcaccucgccc

SEQ ID NO: 3330367 - RNA, 19 nt, Mycobacterium tuberculosis H37Rv
ccuggcaccucgcccuccc

SEQ ID NO: 3330368 - RNA, 22 nt, Mycobacterium tuberculosis H37Rv
ccuggcagacgcccuugccuug

SEQ ID NO: 3330369 - RNA, 14 nt, Mycobacterium tuberculosis H37Rv
ccuggccacccaga

SEQ ID NO: 3330370 - RNA, 22 nt, Mycobacterium tuberculosis H37Rv
ccuggccaucgagggcaucggg

SEQ ID NO: 3330371 - RNA, 16 nt, Mycobacterium tuberculosis H37Rv
ccuggcccgccacgau

SEQ ID NO: 3330372 - RNA, 23 nt, Mycobacterium tuberculosis H37Rv
ccuggcccgccacgaugucgucg

SEQ ID NO: 3330373 - RNA, 19 nt, Mycobacterium tuberculosis H37Rv
ccuggccgcccuggccgcc

SEQ ID NO: 3330374 - RNA, 17 nt, Mycobacterium tuberculosis H37Rv
ccuggccgccggcgccg

SEQ ID NO: 3330375 - RNA, 17 nt, Mycobacterium tuberculosis H37Rv
ccuggccgggaccgccc

SEQ ID NO: 3330376 - RNA, 16 nt, Mycobacterium tuberculosis H37Rv
ccuggccugcccagca

SEQ ID NO: 3330377 - RNA, 23 nt, Mycobacterium tuberculosis H37Rv
ccuggcgacgcgacacacgccgc

SEQ ID NO: 3330378 - RNA, 23 nt, Mycobacterium tuberculosis H37Rv
ccuggcggaacagcuucgcgcag

SEQ ID NO: 3330379 - RNA, 13 nt, Mycobacterium tuberculosis H37Rv
ccuggcggcccgg

SEQ ID NO: 3330380 - RNA, 19 nt, Mycobacterium tuberculosis H37Rv
ccuggcggcccggguuggc

SEQ ID NO: 3330381 - RNA, 17 nt, Mycobacterium tuberculosis H37Rv
ccuggcggcugcagccg

SEQ ID NO: 3330382 - RNA, 12 nt, Mycobacterium tuberculosis H37Rv
ccuggcgggcgc

SEQ ID NO: 3330383 - RNA, 13 nt, Mycobacterium tuberculosis H37Rv
ccuggcggucccg

SEQ ID NO: 3330384 - RNA, 21 nt, Mycobacterium tuberculosis H37Rv
ccuggcguagaucaucuggcu

SEQ ID NO: 3330385 - RNA, 18 nt, Mycobacterium tuberculosis H37Rv
ccuggcguagugcagcug

SEQ ID NO: 3330386 - RNA, 21 nt, Mycobacterium tuberculosis H37Rv
ccuggcgugucgccgccacca

SEQ ID NO: 3330387 - RNA, 17 nt, Mycobacterium tuberculosis H37Rv
ccuggcuacgcgcgccc

SEQ ID NO: 3330388 - RNA, 15 nt, Mycobacterium tuberculosis H37Rv
ccuggcuggucagga

SEQ ID NO: 3330389 - RNA, 14 nt, Mycobacterium tuberculosis H37Rv
ccugggaaacuggg

SEQ ID NO: 3330390 - RNA, 21 nt, Mycobacterium tuberculosis H37Rv
ccugggauccggcggcaggua

SEQ ID NO: 3330391 - RNA, 15 nt, Mycobacterium tuberculosis H37Rv
ccugggccgccgccc

SEQ ID NO: 3330392 - RNA, 16 nt, Mycobacterium tuberculosis H37Rv
ccugggccgccgcccu

SEQ ID NO: 3330393 - RNA, 17 nt, Mycobacterium tuberculosis H37Rv
ccugggcgacuaccggc

SEQ ID NO: 3330394 - RNA, 12 nt, Mycobacterium tuberculosis H37Rv
ccugggcgcgcu

SEQ ID NO: 3330395 - RNA, 19 nt, Mycobacterium tuberculosis H37Rv
ccugggcgcgcuggcgggc

SEQ ID NO: 3330396 - RNA, 16 nt, Mycobacterium tuberculosis H37Rv
ccugggcggccgggcu

SEQ ID NO: 3330397 - RNA, 12 nt, Mycobacterium tuberculosis H37Rv
ccuggggcagcc

SEQ ID NO: 3330398 - RNA, 16 nt, Mycobacterium tuberculosis H37Rv
ccuggggguggcagcg

SEQ ID NO: 3330399 - RNA, 18 nt, Mycobacterium tuberculosis H37Rv
ccuggggguggcagcgcg

SEQ ID NO: 3330400 - RNA, 15 nt, Mycobacterium tuberculosis H37Rv
ccuggggugcucggg

SEQ ID NO: 3330401 - RNA, 21 nt, Mycobacterium tuberculosis H37Rv
ccuggggugucaaucacccag

SEQ ID NO: 3330402 - RNA, 18 nt, Mycobacterium tuberculosis H37Rv
ccuggguauccaccgcga

SEQ ID NO: 3330403 - RNA, 14 nt, Mycobacterium tuberculosis H37Rv
ccuggguggcgucg

SEQ ID NO: 3330404 - RNA, 19 nt, Mycobacterium tuberculosis H37Rv
ccuggguuggcauccaaaa

SEQ ID NO: 3330405 - RNA, 16 nt, Mycobacterium tuberculosis H37Rv
ccugguaaggccggcc

SEQ ID NO: 3330406 - RNA, 17 nt, Mycobacterium tuberculosis H37Rv
ccugguaaggccggccg

SEQ ID NO: 3330407 - RNA, 20 nt, Mycobacterium tuberculosis H37Rv
ccugguaaggccggccggug

SEQ ID NO: 3330408 - RNA, 14 nt, Mycobacterium tuberculosis H37Rv
ccugguacucccgc

SEQ ID NO: 3330409 - RNA, 17 nt, Mycobacterium tuberculosis H37Rv
ccugguagucgcccgug

SEQ ID NO: 3330410 - RNA, 21 nt, Mycobacterium tuberculosis H37Rv
ccugguaugccgcccgcagcg

SEQ ID NO: 3330411 - RNA, 20 nt, Mycobacterium tuberculosis H37Rv
ccuggucaagucccucggcg

SEQ ID NO: 3330412 - RNA, 13 nt, Mycobacterium tuberculosis H37Rv
ccuggucaccagc

SEQ ID NO: 3330413 - RNA, 17 nt, Mycobacterium tuberculosis H37Rv
ccuggucaccagccacc

SEQ ID NO: 3330414 - RNA, 21 nt, Mycobacterium tuberculosis H37Rv
ccuggucacgccggcggaauc

SEQ ID NO: 3330415 - RNA, 19 nt, Mycobacterium tuberculosis H37Rv
ccugguccaggcccuggcc

SEQ ID NO: 3330416 - RNA, 23 nt, Mycobacterium tuberculosis H37Rv
ccugguccggaucacuuucgaag

SEQ ID NO: 3330417 - RNA, 12 nt, Mycobacterium tuberculosis H37Rv
ccuggucgagca

SEQ ID NO: 3330418 - RNA, 14 nt, Mycobacterium tuberculosis H37Rv
ccuggucgagcacg

SEQ ID NO: 3330419 - RNA, 13 nt, Mycobacterium tuberculosis H37Rv
ccuggucggccag

SEQ ID NO: 3330420 - RNA, 15 nt, Mycobacterium tuberculosis H37Rv
ccuggucggccaggu

SEQ ID NO: 3330421 - RNA, 20 nt, Mycobacterium tuberculosis H37Rv
ccuggugagauugguggccc

SEQ ID NO: 3330422 - RNA, 18 nt, Mycobacterium tuberculosis H37Rv
ccugguggcagacauggc

SEQ ID NO: 3330423 - RNA, 13 nt, Mycobacterium tuberculosis H37Rv
ccugguggcggga

SEQ ID NO: 3330424 - RNA, 13 nt, Mycobacterium tuberculosis H37Rv
ccugguguaccag

SEQ ID NO: 3330425 - RNA, 17 nt, Mycobacterium tuberculosis H37Rv
ccugguguaccagacga

SEQ ID NO: 3330426 - RNA, 14 nt, Mycobacterium tuberculosis H37Rv
ccuggugucgaucg

SEQ ID NO: 3330427 - RNA, 19 nt, Mycobacterium tuberculosis H37Rv
ccugguucgacucaugccg

SEQ ID NO: 3330428 - RNA, 15 nt, Mycobacterium tuberculosis H37Rv
ccugguugcugacga

SEQ ID NO: 3330429 - RNA, 20 nt, Mycobacterium tuberculosis H37Rv
ccugguuguccguaucgggc

SEQ ID NO: 3330430 - RNA, 18 nt, Mycobacterium tuberculosis H37Rv
ccuguaccgccacggcgg

SEQ ID NO: 3330431 - RNA, 19 nt, Mycobacterium tuberculosis H37Rv
ccuguacgagcagaucgcg

SEQ ID NO: 3330432 - RNA, 19 nt, Mycobacterium tuberculosis H37Rv
ccugucauguccugggccg

SEQ ID NO: 3330433 - RNA, 21 nt, Mycobacterium tuberculosis H37Rv
ccugucauguccugggccgcc

SEQ ID NO: 3330434 - RNA, 22 nt, Mycobacterium tuberculosis H37Rv
ccugucauguccugggccgccg

SEQ ID NO: 3330435 - RNA, 17 nt, Mycobacterium tuberculosis H37Rv
ccugucccgcacccggc

SEQ ID NO: 3330436 - RNA, 13 nt, Mycobacterium tuberculosis H37Rv
ccuguccggcgcc

SEQ ID NO: 3330437 - RNA, 20 nt, Mycobacterium tuberculosis H37Rv
ccuguccggcgccgaggucg

SEQ ID NO: 3330438 - RNA, 23 nt, Mycobacterium tuberculosis H37Rv
ccuguccggugauccaacuggcc

SEQ ID NO: 3330439 - RNA, 16 nt, Mycobacterium tuberculosis H37Rv
ccuguccugcgggagg

SEQ ID NO: 3330440 - RNA, 20 nt, Mycobacterium tuberculosis H37Rv
ccuguccugcgggaggcagc

SEQ ID NO: 3330441 - RNA, 23 nt, Mycobacterium tuberculosis H37Rv
ccugucgaccgccacguaauucc

SEQ ID NO: 3330442 - RNA, 13 nt, Mycobacterium tuberculosis H37Rv
ccugucgcaccag

SEQ ID NO: 3330443 - RNA, 13 nt, Mycobacterium tuberculosis H37Rv
ccugucgcgcacc

SEQ ID NO: 3330444 - RNA, 20 nt, Mycobacterium tuberculosis H37Rv
ccugugccagcagcagcgcc

SEQ ID NO: 3330445 - RNA, 15 nt, Mycobacterium tuberculosis H37Rv
ccugugcugccaacg

SEQ ID NO: 3330446 - RNA, 16 nt, Mycobacterium tuberculosis H37Rv
ccugugucgccgucgc

SEQ ID NO: 3330447 - RNA, 16 nt, Mycobacterium tuberculosis H37Rv
ccuguucacccacucc

SEQ ID NO: 3330448 - RNA, 18 nt, Mycobacterium tuberculosis H37Rv
ccuguuccagcgugccug

SEQ ID NO: 3330449 - RNA, 16 nt, Mycobacterium tuberculosis H37Rv
ccuguucgccgucgcu

SEQ ID NO: 3330450 - RNA, 16 nt, Mycobacterium tuberculosis H37Rv
ccuguucggcggcugc

SEQ ID NO: 3330451 - RNA, 23 nt, Mycobacterium tuberculosis H37Rv
ccuguugacccaucaugguccgg

SEQ ID NO: 3330452 - RNA, 21 nt, Mycobacterium tuberculosis H37Rv
ccuguuggcaugccgcccgcu

SEQ ID NO: 3330453 - RNA, 14 nt, Mycobacterium tuberculosis H37Rv
ccuguuguugucgg

SEQ ID NO: 3330454 - RNA, 21 nt, Mycobacterium tuberculosis H37Rv
ccuuagggucgccgcauugca

SEQ ID NO: 3330455 - RNA, 21 nt, Mycobacterium tuberculosis H37Rv
ccuuaugcgcggugaccgggu

SEQ ID NO: 3330456 - RNA, 22 nt, Mycobacterium tuberculosis H37Rv
ccuuauugccgagcucggcuag

SEQ ID NO: 3330457 - RNA, 13 nt, Mycobacterium tuberculosis H37Rv
ccuuauuggacug

SEQ ID NO: 3330458 - RNA, 15 nt, Mycobacterium tuberculosis H37Rv
ccuucaccagcugcg

SEQ ID NO: 3330459 - RNA, 17 nt, Mycobacterium tuberculosis H37Rv
ccuucaccgccguucca

SEQ ID NO: 3330460 - RNA, 22 nt, Mycobacterium tuberculosis H37Rv
ccuucagcacggugaucagcag

SEQ ID NO: 3330461 - RNA, 19 nt, Mycobacterium tuberculosis H37Rv
ccuucagcgaagccggguc

SEQ ID NO: 3330462 - RNA, 15 nt, Mycobacterium tuberculosis H37Rv
ccuucagcguccagg

SEQ ID NO: 3330463 - RNA, 15 nt, Mycobacterium tuberculosis H37Rv
ccuucaucaacgaca

SEQ ID NO: 3330464 - RNA, 14 nt, Mycobacterium tuberculosis H37Rv
ccuuccagaucgcg

SEQ ID NO: 3330465 - RNA, 19 nt, Mycobacterium tuberculosis H37Rv
ccuucgaguuuggugucga

SEQ ID NO: 3330466 - RNA, 22 nt, Mycobacterium tuberculosis H37Rv
ccuucgaugaaauccuccuccg

SEQ ID NO: 3330467 - RNA, 23 nt, Mycobacterium tuberculosis H37Rv
ccuucgcagcauguggccgccgu

SEQ ID NO: 3330468 - RNA, 23 nt, Mycobacterium tuberculosis H37Rv
ccuucgcgggagaacgugccgag

SEQ ID NO: 3330469 - RNA, 19 nt, Mycobacterium tuberculosis H37Rv
ccuucggccgaccgggcuc

SEQ ID NO: 3330470 - RNA, 17 nt, Mycobacterium tuberculosis H37Rv
ccuucgggugugacgcg

SEQ ID NO: 3330471 - RNA, 22 nt, Mycobacterium tuberculosis H37Rv
ccuucggugccggaaacgccag

SEQ ID NO: 3330472 - RNA, 15 nt, Mycobacterium tuberculosis H37Rv
ccuucguagaaggac

SEQ ID NO: 3330473 - RNA, 23 nt, Mycobacterium tuberculosis H37Rv
ccuucguagcggccgcaggcgaa

SEQ ID NO: 3330474 - RNA, 17 nt, Mycobacterium tuberculosis H37Rv
ccuucgucacauugcca

SEQ ID NO: 3330475 - RNA, 19 nt, Mycobacterium tuberculosis H37Rv
ccuucuccagauccacgcc

SEQ ID NO: 3330476 - RNA, 13 nt, Mycobacterium tuberculosis H37Rv
ccuucucccgcac

SEQ ID NO: 3330477 - RNA, 14 nt, Mycobacterium tuberculosis H37Rv
ccuucucgccgugu

SEQ ID NO: 3330478 - RNA, 19 nt, Mycobacterium tuberculosis H37Rv
ccuucucguaacgcggcac

SEQ ID NO: 3330479 - RNA, 21 nt, Mycobacterium tuberculosis H37Rv
ccuucucguaacgcggcacca

SEQ ID NO: 3330480 - RNA, 18 nt, Mycobacterium tuberculosis H37Rv
ccuucugacuaucucgcu

SEQ ID NO: 3330481 - RNA, 11 nt, Mycobacterium tuberculosis H37Rv
ccuucuuggca

SEQ ID NO: 3330482 - RNA, 15 nt, Mycobacterium tuberculosis H37Rv
ccuucuuggcaggug

SEQ ID NO: 3330483 - RNA, 22 nt, Mycobacterium tuberculosis H37Rv
ccuucuuggcaggugccuucuu

SEQ ID NO: 3330484 - RNA, 11 nt, Mycobacterium tuberculosis H37Rv
ccuucuuggcg

SEQ ID NO: 3330485 - RNA, 15 nt, Mycobacterium tuberculosis H37Rv
ccuucuuugccggcg

SEQ ID NO: 3330486 - RNA, 17 nt, Mycobacterium tuberculosis H37Rv
ccuugacagcuuucuug

SEQ ID NO: 3330487 - RNA, 20 nt, Mycobacterium tuberculosis H37Rv
ccuugacagcuuucuuggcg

SEQ ID NO: 3330488 - RNA, 21 nt, Mycobacterium tuberculosis H37Rv
ccuugaccacagcggagacga

SEQ ID NO: 3330489 - RNA, 12 nt, Mycobacterium tuberculosis H37Rv
ccuugacccucc

SEQ ID NO: 3330490 - RNA, 21 nt, Mycobacterium tuberculosis H37Rv
ccuugaccgcggucuucuuca

SEQ ID NO: 3330491 - RNA, 15 nt, Mycobacterium tuberculosis H37Rv
ccuugacgcggccac

SEQ ID NO: 3330492 - RNA, 19 nt, Mycobacterium tuberculosis H37Rv
ccuugacgcggccacauac

SEQ ID NO: 3330493 - RNA, 21 nt, Mycobacterium tuberculosis H37Rv
ccuugaggauccgcaccacgc

SEQ ID NO: 3330494 - RNA, 20 nt, Mycobacterium tuberculosis H37Rv
ccuugaggcccugcggccac

SEQ ID NO: 3330495 - RNA, 22 nt, Mycobacterium tuberculosis H37Rv
ccuugaucgagcagggugacca

SEQ ID NO: 3330496 - RNA, 14 nt, Mycobacterium tuberculosis H37Rv
ccuugaucggcgag

SEQ ID NO: 3330497 - RNA, 17 nt, Mycobacterium tuberculosis H37Rv
ccuugaucgugcuggcg

SEQ ID NO: 3330498 - RNA, 16 nt, Mycobacterium tuberculosis H37Rv
ccuugaugcgccccau

SEQ ID NO: 3330499 - RNA, 12 nt, Mycobacterium tuberculosis H37Rv
ccuugcagcgcc

SEQ ID NO: 3330500 - RNA, 15 nt, Mycobacterium tuberculosis H37Rv
ccuugcagcgccccc

SEQ ID NO: 3330501 - RNA, 18 nt, Mycobacterium tuberculosis H37Rv
ccuugcccacggcgacca

SEQ ID NO: 3330502 - RNA, 22 nt, Mycobacterium tuberculosis H37Rv
ccuugcccacggcgaccacgcc

SEQ ID NO: 3330503 - RNA, 21 nt, Mycobacterium tuberculosis H37Rv
ccuugccgaugacgaugcccu

SEQ ID NO: 3330504 - RNA, 17 nt, Mycobacterium tuberculosis H37Rv
ccuugccgccagcccca

SEQ ID NO: 3330505 - RNA, 16 nt, Mycobacterium tuberculosis H37Rv
ccuugccgccauucca

SEQ ID NO: 3330506 - RNA, 21 nt, Mycobacterium tuberculosis H37Rv
ccuugccgccggcuccgccag

SEQ ID NO: 3330507 - RNA, 23 nt, Mycobacterium tuberculosis H37Rv
ccuugccgccuuggcccccgggu

SEQ ID NO: 3330508 - RNA, 17 nt, Mycobacterium tuberculosis H37Rv
ccuugccuagccgcagc

SEQ ID NO: 3330509 - RNA, 13 nt, Mycobacterium tuberculosis H37Rv
ccuugccuccggc

SEQ ID NO: 3330510 - RNA, 23 nt, Mycobacterium tuberculosis H37Rv
ccuugcgcgccauuggcgccgcc

SEQ ID NO: 3330511 - RNA, 20 nt, Mycobacterium tuberculosis H37Rv
ccuugcgguccaggccggca

SEQ ID NO: 3330512 - RNA, 17 nt, Mycobacterium tuberculosis H37Rv
ccuugcucagccggccc

SEQ ID NO: 3330513 - RNA, 15 nt, Mycobacterium tuberculosis H37Rv
ccuugcucguccagg

SEQ ID NO: 3330514 - RNA, 13 nt, Mycobacterium tuberculosis H37Rv
ccuugcugcgcga

SEQ ID NO: 3330515 - RNA, 19 nt, Mycobacterium tuberculosis H37Rv
ccuugcugcgcgauggccg

SEQ ID NO: 3330516 - RNA, 17 nt, Mycobacterium tuberculosis H37Rv
ccuuggacugucccacc

SEQ ID NO: 3330517 - RNA, 14 nt, Mycobacterium tuberculosis H37Rv
ccuuggcaguccag

SEQ ID NO: 3330518 - RNA, 18 nt, Mycobacterium tuberculosis H37Rv
ccuuggcaguccagccgg

SEQ ID NO: 3330519 - RNA, 21 nt, Mycobacterium tuberculosis H37Rv
ccuuggccaccaucgccgccg

SEQ ID NO: 3330520 - RNA, 20 nt, Mycobacterium tuberculosis H37Rv
ccuuggccagacccaccacc

SEQ ID NO: 3330521 - RNA, 22 nt, Mycobacterium tuberculosis H37Rv
ccuuggccguucggcgcccgcu

SEQ ID NO: 3330522 - RNA, 14 nt, Mycobacterium tuberculosis H37Rv
ccuuggccuucuga

SEQ ID NO: 3330523 - RNA, 16 nt, Mycobacterium tuberculosis H37Rv
ccuuggcgcggcaccc

SEQ ID NO: 3330524 - RNA, 15 nt, Mycobacterium tuberculosis H37Rv
ccuuggcgggaucga

SEQ ID NO: 3330525 - RNA, 17 nt, Mycobacterium tuberculosis H37Rv
ccuuggcugggcccgcc

SEQ ID NO: 3330526 - RNA, 20 nt, Mycobacterium tuberculosis H37Rv
ccuuggcuucgacgcuuccu

SEQ ID NO: 3330527 - RNA, 15 nt, Mycobacterium tuberculosis H37Rv
ccuugggaccgcgcc

SEQ ID NO: 3330528 - RNA, 14 nt, Mycobacterium tuberculosis H37Rv
ccuugggcaccacc

SEQ ID NO: 3330529 - RNA, 16 nt, Mycobacterium tuberculosis H37Rv
ccuuggucaccuucuu

SEQ ID NO: 3330530 - RNA, 23 nt, Mycobacterium tuberculosis H37Rv
ccuuggucaccuucuuggcgggu

SEQ ID NO: 3330531 - RNA, 17 nt, Mycobacterium tuberculosis H37Rv
ccuuggucgccgccuuc

SEQ ID NO: 3330532 - RNA, 16 nt, Mycobacterium tuberculosis H37Rv
ccuuggugcccagcag

SEQ ID NO: 3330533 - RNA, 12 nt, Mycobacterium tuberculosis H37Rv
ccuuggugggca

SEQ ID NO: 3330534 - RNA, 15 nt, Mycobacterium tuberculosis H37Rv
ccuugguuagccgcg

SEQ ID NO: 3330535 - RNA, 20 nt, Mycobacterium tuberculosis H37Rv
ccuugguuagccgcggcccg

SEQ ID NO: 3330536 - RNA, 19 nt, Mycobacterium tuberculosis H37Rv
ccuugucaaaggugcacug

SEQ ID NO: 3330537 - RNA, 21 nt, Mycobacterium tuberculosis H37Rv
ccuugucggccccggccgcgu

SEQ ID NO: 3330538 - RNA, 21 nt, Mycobacterium tuberculosis H37Rv
ccuugucuaguugacgcagcc

SEQ ID NO: 3330539 - RNA, 12 nt, Mycobacterium tuberculosis H37Rv
ccuugugacccc

SEQ ID NO: 3330540 - RNA, 13 nt, Mycobacterium tuberculosis H37Rv
ccuuguggacccg

SEQ ID NO: 3330541 - RNA, 19 nt, Mycobacterium tuberculosis H37Rv
ccuuguggcacacccgcac

SEQ ID NO: 3330542 - RNA, 21 nt, Mycobacterium tuberculosis H37Rv
ccuuguguggcgaaucuuugg

SEQ ID NO: 3330543 - RNA, 15 nt, Mycobacterium tuberculosis H37Rv
ccuuguucccgaaac

SEQ ID NO: 3330544 - RNA, 18 nt, Mycobacterium tuberculosis H37Rv
ccuuguucccgaaacccg

SEQ ID NO: 3330545 - RNA, 17 nt, Mycobacterium tuberculosis H37Rv
ccuuguugaccaccacc

SEQ ID NO: 3330546 - RNA, 18 nt, Mycobacterium tuberculosis H37Rv
ccuuguuggccugcaacg

SEQ ID NO: 3330547 - RNA, 21 nt, Mycobacterium tuberculosis H37Rv
ccuuguuggcgcccgggccca

SEQ ID NO: 3330548 - RNA, 21 nt, Mycobacterium tuberculosis H37Rv
ccuuguugugguggagcggcg

SEQ ID NO: 3330549 - RNA, 15 nt, Mycobacterium tuberculosis H37Rv
ccuuuccggccgccu

SEQ ID NO: 3330550 - RNA, 23 nt, Mycobacterium tuberculosis H37Rv
ccuuugagucgagaaugcugacg

SEQ ID NO: 3330551 - RNA, 13 nt, Mycobacterium tuberculosis H37Rv
ccuuugccaccuc

SEQ ID NO: 3330552 - RNA, 13 nt, Mycobacterium tuberculosis H37Rv
ccuuugccgccga

SEQ ID NO: 3330553 - RNA, 20 nt, Mycobacterium tuberculosis H37Rv
ccuuuggcucccuuuuccaa

SEQ ID NO: 3330554 - RNA, 18 nt, Mycobacterium tuberculosis H37Rv
ccuuuugccgcagcaucc

SEQ ID NO: 3330555 - RNA, 15 nt, Mycobacterium tuberculosis H37Rv
cgaaaaacaccagcg

SEQ ID NO: 3330556 - RNA, 16 nt, Mycobacterium tuberculosis H37Rv
cgaaaaacaccagcga

SEQ ID NO: 3330557 - RNA, 13 nt, Mycobacterium tuberculosis H37Rv
cgaaaaaccucga

SEQ ID NO: 3330558 - RNA, 23 nt, Mycobacterium tuberculosis H37Rv
cgaaaaacgaccccucacccagc

SEQ ID NO: 3330559 - RNA, 17 nt, Mycobacterium tuberculosis H37Rv
cgaaaacaacccgaaca

SEQ ID NO: 3330560 - RNA, 14 nt, Mycobacterium tuberculosis H37Rv
cgaaaacagcgauc

SEQ ID NO: 3330561 - RNA, 17 nt, Mycobacterium tuberculosis H37Rv
cgaaaaccuccgggucc

SEQ ID NO: 3330562 - RNA, 21 nt, Mycobacterium tuberculosis H37Rv
cgaaaacgacaucaccaccgc

SEQ ID NO: 3330563 - RNA, 14 nt, Mycobacterium tuberculosis H37Rv
cgaaaagccuugac

SEQ ID NO: 3330564 - RNA, 13 nt, Mycobacterium tuberculosis H37Rv
cgaaaauugcucc

SEQ ID NO: 3330565 - RNA, 19 nt, Mycobacterium tuberculosis H37Rv
cgaaacagcuugcugcgca

SEQ ID NO: 3330566 - RNA, 18 nt, Mycobacterium tuberculosis H37Rv
cgaaacaucucggcgcag

SEQ ID NO: 3330567 - RNA, 15 nt, Mycobacterium tuberculosis H37Rv
cgaaacccgauguua

SEQ ID NO: 3330568 - RNA, 15 nt, Mycobacterium tuberculosis H37Rv
cgaaaccggaccuga

SEQ ID NO: 3330569 - RNA, 16 nt, Mycobacterium tuberculosis H37Rv
cgaaacgauggccggg

SEQ ID NO: 3330570 - RNA, 21 nt, Mycobacterium tuberculosis H37Rv
cgaaacgcccgggcggcgucg

SEQ ID NO: 3330571 - RNA, 20 nt, Mycobacterium tuberculosis H37Rv
cgaaacgcgcggaucgucga

SEQ ID NO: 3330572 - RNA, 19 nt, Mycobacterium tuberculosis H37Rv
cgaaacgcuuacccagccc

SEQ ID NO: 3330573 - RNA, 17 nt, Mycobacterium tuberculosis H37Rv
cgaaacucaccagcacc

SEQ ID NO: 3330574 - RNA, 22 nt, Mycobacterium tuberculosis H37Rv
cgaaacucaccagcaccccgag

SEQ ID NO: 3330575 - RNA, 22 nt, Mycobacterium tuberculosis H37Rv
cgaaacucagcccgucgggcag

SEQ ID NO: 3330576 - RNA, 16 nt, Mycobacterium tuberculosis H37Rv
cgaaacucgacgugaa

SEQ ID NO: 3330577 - RNA, 14 nt, Mycobacterium tuberculosis H37Rv
cgaaagcgccgaaa

SEQ ID NO: 3330578 - RNA, 24 nt, Mycobacterium tuberculosis H37Rv
cgaaaucagcccgcgcagcggucc

SEQ ID NO: 3330579 - RNA, 19 nt, Mycobacterium tuberculosis H37Rv
cgaaaucaguugcgcucca

SEQ ID NO: 3330580 - RNA, 15 nt, Mycobacterium tuberculosis H37Rv
cgaaaucccccgaca

SEQ ID NO: 3330581 - RNA, 22 nt, Mycobacterium tuberculosis H37Rv
cgaaauccccugcgcugcagcu

SEQ ID NO: 3330582 - RNA, 16 nt, Mycobacterium tuberculosis H37Rv
cgaaauccugguggca

SEQ ID NO: 3330583 - RNA, 18 nt, Mycobacterium tuberculosis H37Rv
cgaaaucgacagcagcgc

SEQ ID NO: 3330584 - RNA, 20 nt, Mycobacterium tuberculosis H37Rv
cgaaaucgacagcagcgcga

SEQ ID NO: 3330585 - RNA, 14 nt, Mycobacterium tuberculosis H37Rv
cgaaaucgcacagc

SEQ ID NO: 3330586 - RNA, 16 nt, Mycobacterium tuberculosis H37Rv
cgaaaucgcacagcgc

SEQ ID NO: 3330587 - RNA, 24 nt, Mycobacterium tuberculosis H37Rv
cgaaaucggcggcguccagcagcg

SEQ ID NO: 3330588 - RNA, 16 nt, Mycobacterium tuberculosis H37Rv
cgaaaucucaucgauu

SEQ ID NO: 3330589 - RNA, 22 nt, Mycobacterium tuberculosis H37Rv
cgaaauuccgggccuggccugc

SEQ ID NO: 3330590 - RNA, 17 nt, Mycobacterium tuberculosis H37Rv
cgaacaaccccgguuga

SEQ ID NO: 3330591 - RNA, 15 nt, Mycobacterium tuberculosis H37Rv
cgaacaaccgguccu

SEQ ID NO: 3330592 - RNA, 18 nt, Mycobacterium tuberculosis H37Rv
cgaacaaguggccagcgc

SEQ ID NO: 3330593 - RNA, 19 nt, Mycobacterium tuberculosis H37Rv
cgaacaauaaggccgcacg

SEQ ID NO: 3330594 - RNA, 24 nt, Mycobacterium tuberculosis H37Rv
cgaacaauaaggccgcacgggcga

SEQ ID NO: 3330595 - RNA, 13 nt, Mycobacterium tuberculosis H37Rv
cgaacaauucacg

SEQ ID NO: 3330596 - RNA, 20 nt, Mycobacterium tuberculosis H37Rv
cgaacaauucacgcaccaca

SEQ ID NO: 3330597 - RNA, 16 nt, Mycobacterium tuberculosis H37Rv
cgaacaccacaccgag

SEQ ID NO: 3330598 - RNA, 17 nt, Mycobacterium tuberculosis H37Rv
cgaacaccagauggcuc

SEQ ID NO: 3330599 - RNA, 13 nt, Mycobacterium tuberculosis H37Rv
cgaacaccagcgc

SEQ ID NO: 3330600 - RNA, 23 nt, Mycobacterium tuberculosis H37Rv
cgaacaccagcgcgccguagacc

SEQ ID NO: 3330601 - RNA, 23 nt, Mycobacterium tuberculosis H37Rv
cgaacaccguccaauuggcgucg

SEQ ID NO: 3330602 - RNA, 16 nt, Mycobacterium tuberculosis H37Rv
cgaacacgucggccag

SEQ ID NO: 3330603 - RNA, 20 nt, Mycobacterium tuberculosis H37Rv
cgaacacgucuaucuggucg

SEQ ID NO: 3330604 - RNA, 15 nt, Mycobacterium tuberculosis H37Rv
cgaacacguucgggu

SEQ ID NO: 3330605 - RNA, 16 nt, Mycobacterium tuberculosis H37Rv
cgaacacuuugcgcac

SEQ ID NO: 3330606 - RNA, 17 nt, Mycobacterium tuberculosis H37Rv
cgaacagacaugcgcac

SEQ ID NO: 3330607 - RNA, 13 nt, Mycobacterium tuberculosis H37Rv
cgaacagcaccgc

SEQ ID NO: 3330608 - RNA, 16 nt, Mycobacterium tuberculosis H37Rv
cgaacagcagcccgcc

SEQ ID NO: 3330609 - RNA, 12 nt, Mycobacterium tuberculosis H37Rv
cgaacagcccca

SEQ ID NO: 3330610 - RNA, 13 nt, Mycobacterium tuberculosis H37Rv
cgaacagccccag

SEQ ID NO: 3330611 - RNA, 18 nt, Mycobacterium tuberculosis H37Rv
cgaacagccccagggugc

SEQ ID NO: 3330612 - RNA, 18 nt, Mycobacterium tuberculosis H37Rv
cgaacagcgaagcaacgg

SEQ ID NO: 3330613 - RNA, 22 nt, Mycobacterium tuberculosis H37Rv
cgaacagcggcacgaucggcag

SEQ ID NO: 3330614 - RNA, 20 nt, Mycobacterium tuberculosis H37Rv
cgaacagcgggggcagcgcg

SEQ ID NO: 3330615 - RNA, 22 nt, Mycobacterium tuberculosis H37Rv
cgaacagcgguccagccaccgc

SEQ ID NO: 3330616 - RNA, 14 nt, Mycobacterium tuberculosis H37Rv
cgaacagcucgaac

SEQ ID NO: 3330617 - RNA, 17 nt, Mycobacterium tuberculosis H37Rv
cgaacagcucgaucagc

SEQ ID NO: 3330618 - RNA, 15 nt, Mycobacterium tuberculosis H37Rv
cgaacaggccggccg

SEQ ID NO: 3330619 - RNA, 19 nt, Mycobacterium tuberculosis H37Rv
cgaacagggaggucgccgc

SEQ ID NO: 3330620 - RNA, 15 nt, Mycobacterium tuberculosis H37Rv
cgaacagggcugcga

SEQ ID NO: 3330621 - RNA, 18 nt, Mycobacterium tuberculosis H37Rv
cgaacaguaggccuccgc

SEQ ID NO: 3330622 - RNA, 19 nt, Mycobacterium tuberculosis H37Rv
cgaacaguaggccuccgcu

SEQ ID NO: 3330623 - RNA, 11 nt, Mycobacterium tuberculosis H37Rv
cgaacagucga

SEQ ID NO: 3330624 - RNA, 17 nt, Mycobacterium tuberculosis H37Rv
cgaacagucgagugaag

SEQ ID NO: 3330625 - RNA, 14 nt, Mycobacterium tuberculosis H37Rv
cgaacagucgcagc

SEQ ID NO: 3330626 - RNA, 20 nt, Mycobacterium tuberculosis H37Rv
cgaacagugccucgcguucg

SEQ ID NO: 3330627 - RNA, 17 nt, Mycobacterium tuberculosis H37Rv
cgaacagugccugggug

SEQ ID NO: 3330628 - RNA, 21 nt, Mycobacterium tuberculosis H37Rv
cgaacauggccagcaucagcg

SEQ ID NO: 3330629 - RNA, 13 nt, Mycobacterium tuberculosis H37Rv
cgaacauugcgcc

SEQ ID NO: 3330630 - RNA, 13 nt, Mycobacterium tuberculosis H37Rv
cgaaccaccaccg

SEQ ID NO: 3330631 - RNA, 14 nt, Mycobacterium tuberculosis H37Rv
cgaaccaccgcguu

SEQ ID NO: 3330632 - RNA, 15 nt, Mycobacterium tuberculosis H37Rv
cgaaccaccgcguug

SEQ ID NO: 3330633 - RNA, 23 nt, Mycobacterium tuberculosis H37Rv
cgaaccacgccaucgagcagcag

SEQ ID NO: 3330634 - RNA, 21 nt, Mycobacterium tuberculosis H37Rv
cgaaccagcuugcgccgcagc

SEQ ID NO: 3330635 - RNA, 22 nt, Mycobacterium tuberculosis H37Rv
cgaaccagcuugcgccgcagcg

SEQ ID NO: 3330636 - RNA, 20 nt, Mycobacterium tuberculosis H37Rv
cgaaccagucgaagaagacc

SEQ ID NO: 3330637 - RNA, 15 nt, Mycobacterium tuberculosis H37Rv
cgaacccaccgugcc

SEQ ID NO: 3330638 - RNA, 19 nt, Mycobacterium tuberculosis H37Rv
cgaacccacugcccgccga

SEQ ID NO: 3330639 - RNA, 22 nt, Mycobacterium tuberculosis H37Rv
cgaacccacugcccgccgacgc

SEQ ID NO: 3330640 - RNA, 14 nt, Mycobacterium tuberculosis H37Rv
cgaacccaggcaca

SEQ ID NO: 3330641 - RNA, 15 nt, Mycobacterium tuberculosis H37Rv
cgaacccaggcacaa

SEQ ID NO: 3330642 - RNA, 21 nt, Mycobacterium tuberculosis H37Rv
cgaaccccgggcggcgccggc

SEQ ID NO: 3330643 - RNA, 15 nt, Mycobacterium tuberculosis H37Rv
cgaacccgccaccgc

SEQ ID NO: 3330644 - RNA, 21 nt, Mycobacterium tuberculosis H37Rv
cgaacccgccgaugccgccgc

SEQ ID NO: 3330645 - RNA, 14 nt, Mycobacterium tuberculosis H37Rv
cgaacccgguguug

SEQ ID NO: 3330646 - RNA, 16 nt, Mycobacterium tuberculosis H37Rv
cgaacccucagccgcg

SEQ ID NO: 3330647 - RNA, 15 nt, Mycobacterium tuberculosis H37Rv
cgaacccuccgcagc

SEQ ID NO: 3330648 - RNA, 17 nt, Mycobacterium tuberculosis H37Rv
cgaacccuucgcggugu

SEQ ID NO: 3330649 - RNA, 14 nt, Mycobacterium tuberculosis H37Rv
cgaaccgcacggug

SEQ ID NO: 3330650 - RNA, 23 nt, Mycobacterium tuberculosis H37Rv
cgaaccgcagacccucgucgucg

SEQ ID NO: 3330651 - RNA, 14 nt, Mycobacterium tuberculosis H37Rv
cgaaccgcugcggg

SEQ ID NO: 3330652 - RNA, 15 nt, Mycobacterium tuberculosis H37Rv
cgaaccggaucaucg

SEQ ID NO: 3330653 - RNA, 16 nt, Mycobacterium tuberculosis H37Rv
cgaaccggaucaucgc

SEQ ID NO: 3330654 - RNA, 16 nt, Mycobacterium tuberculosis H37Rv
cgaaccggcaccagcg

SEQ ID NO: 3330655 - RNA, 18 nt, Mycobacterium tuberculosis H37Rv
cgaaccggccgucgacgc

SEQ ID NO: 3330656 - RNA, 14 nt, Mycobacterium tuberculosis H37Rv
cgaaccggcugggc

SEQ ID NO: 3330657 - RNA, 13 nt, Mycobacterium tuberculosis H37Rv
cgaaccgggacaa

SEQ ID NO: 3330658 - RNA, 17 nt, Mycobacterium tuberculosis H37Rv
cgaaccgggacaaccgc

SEQ ID NO: 3330659 - RNA, 19 nt, Mycobacterium tuberculosis H37Rv
cgaaccgguguagcagcgc

SEQ ID NO: 3330660 - RNA, 21 nt, Mycobacterium tuberculosis H37Rv
cgaaccgguguagcagcgcca

SEQ ID NO: 3330661 - RNA, 16 nt, Mycobacterium tuberculosis H37Rv
cgaaccguucggcgac

SEQ ID NO: 3330662 - RNA, 19 nt, Mycobacterium tuberculosis H37Rv
cgaaccucaccugacacgc

SEQ ID NO: 3330663 - RNA, 13 nt, Mycobacterium tuberculosis H37Rv
cgaaccucggcgg

SEQ ID NO: 3330664 - RNA, 23 nt, Mycobacterium tuberculosis H37Rv
cgaaccucggcgggauccucgaa

SEQ ID NO: 3330665 - RNA, 19 nt, Mycobacterium tuberculosis H37Rv
cgaaccugccgcagugaca

SEQ ID NO: 3330666 - RNA, 16 nt, Mycobacterium tuberculosis H37Rv
cgaaccugcggcagcg

SEQ ID NO: 3330667 - RNA, 17 nt, Mycobacterium tuberculosis H37Rv
cgaacgaauccgcucga

SEQ ID NO: 3330668 - RNA, 16 nt, Mycobacterium tuberculosis H37Rv
cgaacgaucccgccga

SEQ ID NO: 3330669 - RNA, 17 nt, Mycobacterium tuberculosis H37Rv
cgaacgauuucggccca

SEQ ID NO: 3330670 - RNA, 17 nt, Mycobacterium tuberculosis H37Rv
cgaacgcaacgccgaug

SEQ ID NO: 3330671 - RNA, 22 nt, Mycobacterium tuberculosis H37Rv
cgaacgcaccgaaacgccgacc

SEQ ID NO: 3330672 - RNA, 18 nt, Mycobacterium tuberculosis H37Rv
cgaacgcaugcucgaucg

SEQ ID NO: 3330673 - RNA, 19 nt, Mycobacterium tuberculosis H37Rv
cgaacgcaugcucgaucgc

SEQ ID NO: 3330674 - RNA, 23 nt, Mycobacterium tuberculosis H37Rv
cgaacgcaugcucgaucgcguuc

SEQ ID NO: 3330675 - RNA, 21 nt, Mycobacterium tuberculosis H37Rv
cgaacgccacggcaucggcca

SEQ ID NO: 3330676 - RNA, 15 nt, Mycobacterium tuberculosis H37Rv
cgaacgccagcagcu

SEQ ID NO: 3330677 - RNA, 18 nt, Mycobacterium tuberculosis H37Rv
cgaacgccagugaacgcg

SEQ ID NO: 3330678 - RNA, 17 nt, Mycobacterium tuberculosis H37Rv
cgaacgcccgcugcggg

SEQ ID NO: 3330679 - RNA, 16 nt, Mycobacterium tuberculosis H37Rv
cgaacgcccugacggu

SEQ ID NO: 3330680 - RNA, 21 nt, Mycobacterium tuberculosis H37Rv
cgaacgccgucagaacaccgg

SEQ ID NO: 3330681 - RNA, 15 nt, Mycobacterium tuberculosis H37Rv
cgaacgccgucgacg

SEQ ID NO: 3330682 - RNA, 17 nt, Mycobacterium tuberculosis H37Rv
cgaacgccgucgacgcg

SEQ ID NO: 3330683 - RNA, 17 nt, Mycobacterium tuberculosis H37Rv
cgaacgccugcucgucg

SEQ ID NO: 3330684 - RNA, 13 nt, Mycobacterium tuberculosis H37Rv
cgaacgcgcgcgu

SEQ ID NO: 3330685 - RNA, 18 nt, Mycobacterium tuberculosis H37Rv
cgaacggauaccugggac

SEQ ID NO: 3330686 - RNA, 17 nt, Mycobacterium tuberculosis H37Rv
cgaacggaucucggugg

SEQ ID NO: 3330687 - RNA, 15 nt, Mycobacterium tuberculosis H37Rv
cgaacggauucccgc

SEQ ID NO: 3330688 - RNA, 21 nt, Mycobacterium tuberculosis H37Rv
cgaacggcgcaguuggcacca

SEQ ID NO: 3330689 - RNA, 18 nt, Mycobacterium tuberculosis H37Rv
cgaacgggucggcgacca

SEQ ID NO: 3330690 - RNA, 21 nt, Mycobacterium tuberculosis H37Rv
cgaacgggucggcgaccaccc

SEQ ID NO: 3330691 - RNA, 18 nt, Mycobacterium tuberculosis H37Rv
cgaacgguagcacggucu

SEQ ID NO: 3330692 - RNA, 19 nt, Mycobacterium tuberculosis H37Rv
cgaacgguagcacggucug

SEQ ID NO: 3330693 - RNA, 13 nt, Mycobacterium tuberculosis H37Rv
cgaacgucaaccg

SEQ ID NO: 3330694 - RNA, 14 nt, Mycobacterium tuberculosis H37Rv
cgaacgucaaccgg

SEQ ID NO: 3330695 - RNA, 15 nt, Mycobacterium tuberculosis H37Rv
cgaacgucaccaucg

SEQ ID NO: 3330696 - RNA, 18 nt, Mycobacterium tuberculosis H37Rv
cgaacgucgcggccagca

SEQ ID NO: 3330697 - RNA, 15 nt, Mycobacterium tuberculosis H37Rv
cgaacgucucggcca

SEQ ID NO: 3330698 - RNA, 16 nt, Mycobacterium tuberculosis H37Rv
cgaacgugcgguggcu

SEQ ID NO: 3330699 - RNA, 13 nt, Mycobacterium tuberculosis H37Rv
cgaacucaccgcc

SEQ ID NO: 3330700 - RNA, 20 nt, Mycobacterium tuberculosis H37Rv
cgaacucaucgugguaacca

SEQ ID NO: 3330701 - RNA, 18 nt, Mycobacterium tuberculosis H37Rv
cgaacucaugcccgacga

SEQ ID NO: 3330702 - RNA, 19 nt, Mycobacterium tuberculosis H37Rv
cgaacuccagcagcccggu

SEQ ID NO: 3330703 - RNA, 15 nt, Mycobacterium tuberculosis H37Rv
cgaacuccaucacca

SEQ ID NO: 3330704 - RNA, 15 nt, Mycobacterium tuberculosis H37Rv
cgaacuccaugccgc

SEQ ID NO: 3330705 - RNA, 13 nt, Mycobacterium tuberculosis H37Rv
cgaacuccgcgga

SEQ ID NO: 3330706 - RNA, 14 nt, Mycobacterium tuberculosis H37Rv
cgaacuccgcguug

SEQ ID NO: 3330707 - RNA, 21 nt, Mycobacterium tuberculosis H37Rv
cgaacuccuuaucgucgacgc

SEQ ID NO: 3330708 - RNA, 15 nt, Mycobacterium tuberculosis H37Rv
cgaacucgaggucaa

SEQ ID NO: 3330709 - RNA, 14 nt, Mycobacterium tuberculosis H37Rv
cgaacucgccccgc

SEQ ID NO: 3330710 - RNA, 18 nt, Mycobacterium tuberculosis H37Rv
cgaacucgcgggcgacca

SEQ ID NO: 3330711 - RNA, 22 nt, Mycobacterium tuberculosis H37Rv
cgaacucgcgggcgaccaccgc

SEQ ID NO: 3330712 - RNA, 19 nt, Mycobacterium tuberculosis H37Rv
cgaacucggcggccagcgc

SEQ ID NO: 3330713 - RNA, 13 nt, Mycobacterium tuberculosis H37Rv
cgaacucgggcga

SEQ ID NO: 3330714 - RNA, 17 nt, Mycobacterium tuberculosis H37Rv
cgaacucgggcgacugg

SEQ ID NO: 3330715 - RNA, 19 nt, Mycobacterium tuberculosis H37Rv
cgaacugccggacuaccgc

SEQ ID NO: 3330716 - RNA, 19 nt, Mycobacterium tuberculosis H37Rv
cgaacuggucgacgccgag

SEQ ID NO: 3330717 - RNA, 21 nt, Mycobacterium tuberculosis H37Rv
cgaacugguuucgcaccgugu

SEQ ID NO: 3330718 - RNA, 17 nt, Mycobacterium tuberculosis H37Rv
cgaacuuaacuacggug

SEQ ID NO: 3330719 - RNA, 23 nt, Mycobacterium tuberculosis H37Rv
cgaacuuccauucauggccgcga

SEQ ID NO: 3330720 - RNA, 15 nt, Mycobacterium tuberculosis H37Rv
cgaacuugaucaccg

SEQ ID NO: 3330721 - RNA, 14 nt, Mycobacterium tuberculosis H37Rv
cgaacuuugucgcg

SEQ ID NO: 3330722 - RNA, 15 nt, Mycobacterium tuberculosis H37Rv
cgaagaaccggucgc

SEQ ID NO: 3330723 - RNA, 16 nt, Mycobacterium tuberculosis H37Rv
cgaagaaccggucgca

SEQ ID NO: 3330724 - RNA, 18 nt, Mycobacterium tuberculosis H37Rv
cgaagaaccggucgcagu

SEQ ID NO: 3330725 - RNA, 17 nt, Mycobacterium tuberculosis H37Rv
cgaagaagaacucggcg

SEQ ID NO: 3330726 - RNA, 16 nt, Mycobacterium tuberculosis H37Rv
cgaagaauaugccgau

SEQ ID NO: 3330727 - RNA, 17 nt, Mycobacterium tuberculosis H37Rv
cgaagaauaugccgaug

SEQ ID NO: 3330728 - RNA, 23 nt, Mycobacterium tuberculosis H37Rv
cgaagaaugggauggcaccaccc

SEQ ID NO: 3330729 - RNA, 18 nt, Mycobacterium tuberculosis H37Rv
cgaagaccaggccgguga

SEQ ID NO: 3330730 - RNA, 20 nt, Mycobacterium tuberculosis H37Rv
cgaagaccuggccugcggca

SEQ ID NO: 3330731 - RNA, 19 nt, Mycobacterium tuberculosis H37Rv
cgaagacuagcugcuagcc

SEQ ID NO: 3330732 - RNA, 14 nt, Mycobacterium tuberculosis H37Rv
cgaagagccagcaa

SEQ ID NO: 3330733 - RNA, 17 nt, Mycobacterium tuberculosis H37Rv
cgaagagccagcaacgg

SEQ ID NO: 3330734 - RNA, 15 nt, Mycobacterium tuberculosis H37Rv
cgaagaggagaacga

SEQ ID NO: 3330735 - RNA, 14 nt, Mycobacterium tuberculosis H37Rv
cgaagauaucggca

SEQ ID NO: 3330736 - RNA, 21 nt, Mycobacterium tuberculosis H37Rv
cgaagauccagcgcaccggcg

SEQ ID NO: 3330737 - RNA, 15 nt, Mycobacterium tuberculosis H37Rv
cgaagaucgccuggg

SEQ ID NO: 3330738 - RNA, 20 nt, Mycobacterium tuberculosis H37Rv
cgaagaucgcgugccacagc

SEQ ID NO: 3330739 - RNA, 22 nt, Mycobacterium tuberculosis H37Rv
cgaagaucggcgcuagccaggg

SEQ ID NO: 3330740 - RNA, 18 nt, Mycobacterium tuberculosis H37Rv
cgaagaugaccgcucgug

SEQ ID NO: 3330741 - RNA, 15 nt, Mycobacterium tuberculosis H37Rv
cgaagaugaccucgg

SEQ ID NO: 3330742 - RNA, 19 nt, Mycobacterium tuberculosis H37Rv
cgaagaugccuggaaucgc

SEQ ID NO: 3330743 - RNA, 13 nt, Mycobacterium tuberculosis H37Rv
cgaagauggccag

SEQ ID NO: 3330744 - RNA, 17 nt, Mycobacterium tuberculosis H37Rv
cgaagauggccagcgcg

SEQ ID NO: 3330745 - RNA, 18 nt, Mycobacterium tuberculosis H37Rv
cgaagauggccagcgcgg

SEQ ID NO: 3330746 - RNA, 20 nt, Mycobacterium tuberculosis H37Rv
cgaagauggccagcgcggcg

SEQ ID NO: 3330747 - RNA, 15 nt, Mycobacterium tuberculosis H37Rv
cgaagcaucgcguug

SEQ ID NO: 3330748 - RNA, 14 nt, Mycobacterium tuberculosis H37Rv
cgaagccaccaggu

SEQ ID NO: 3330749 - RNA, 14 nt, Mycobacterium tuberculosis H37Rv
cgaagcccacguuu

SEQ ID NO: 3330750 - RNA, 21 nt, Mycobacterium tuberculosis H37Rv
cgaagcccagcaccaccaccc

SEQ ID NO: 3330751 - RNA, 17 nt, Mycobacterium tuberculosis H37Rv
cgaagcccccgacguug

SEQ ID NO: 3330752 - RNA, 19 nt, Mycobacterium tuberculosis H37Rv
cgaagccccgguggcaggg

SEQ ID NO: 3330753 - RNA, 23 nt, Mycobacterium tuberculosis H37Rv
cgaagccccucaccucggcuuug

SEQ ID NO: 3330754 - RNA, 15 nt, Mycobacterium tuberculosis H37Rv
cgaagcccgacugua

SEQ ID NO: 3330755 - RNA, 23 nt, Mycobacterium tuberculosis H37Rv
cgaagcccgacuguagaaaaccc

SEQ ID NO: 3330756 - RNA, 23 nt, Mycobacterium tuberculosis H37Rv
cgaagccgccgggugcgccguug

SEQ ID NO: 3330757 - RNA, 22 nt, Mycobacterium tuberculosis H37Rv
cgaagccgcgcaucugucgcgc

SEQ ID NO: 3330758 - RNA, 19 nt, Mycobacterium tuberculosis H37Rv
cgaagccgggucucggugc

SEQ ID NO: 3330759 - RNA, 22 nt, Mycobacterium tuberculosis H37Rv
cgaagccgggucuguuggugac

SEQ ID NO: 3330760 - RNA, 19 nt, Mycobacterium tuberculosis H37Rv
cgaagccgguucgcccagc

SEQ ID NO: 3330761 - RNA, 22 nt, Mycobacterium tuberculosis H37Rv
cgaagccgguucgcccagcagg

SEQ ID NO: 3330762 - RNA, 22 nt, Mycobacterium tuberculosis H37Rv
cgaagccucggcaugcagcccc

SEQ ID NO: 3330763 - RNA, 20 nt, Mycobacterium tuberculosis H37Rv
cgaagccuguagucccucau

SEQ ID NO: 3330764 - RNA, 17 nt, Mycobacterium tuberculosis H37Rv
cgaagccuugcagcgcc

SEQ ID NO: 3330765 - RNA, 18 nt, Mycobacterium tuberculosis H37Rv
cgaagccuugcagcgccc

SEQ ID NO: 3330766 - RNA, 15 nt, Mycobacterium tuberculosis H37Rv
cgaagcggccaccgc

SEQ ID NO: 3330767 - RNA, 17 nt, Mycobacterium tuberculosis H37Rv
cgaagcggccaccgccg

SEQ ID NO: 3330768 - RNA, 16 nt, Mycobacterium tuberculosis H37Rv
cgaagcggcugcugcg

SEQ ID NO: 3330769 - RNA, 18 nt, Mycobacterium tuberculosis H37Rv
cgaagcgggacugcagcg

SEQ ID NO: 3330770 - RNA, 15 nt, Mycobacterium tuberculosis H37Rv
cgaagcgggcggaaa

SEQ ID NO: 3330771 - RNA, 22 nt, Mycobacterium tuberculosis H37Rv
cgaagcgggcuugagcgccgau

SEQ ID NO: 3330772 - RNA, 18 nt, Mycobacterium tuberculosis H37Rv
cgaagcguucccgguccu

SEQ ID NO: 3330773 - RNA, 21 nt, Mycobacterium tuberculosis H37Rv
cgaagcuacgucggcucgucg

SEQ ID NO: 3330774 - RNA, 18 nt, Mycobacterium tuberculosis H37Rv
cgaagcucaucgccgcua

SEQ ID NO: 3330775 - RNA, 19 nt, Mycobacterium tuberculosis H37Rv
cgaagcugcccaaccgguc

SEQ ID NO: 3330776 - RNA, 20 nt, Mycobacterium tuberculosis H37Rv
cgaagcugcgggucagcgcc

SEQ ID NO: 3330777 - RNA, 15 nt, Mycobacterium tuberculosis H37Rv
cgaagcugcgggucu

SEQ ID NO: 3330778 - RNA, 20 nt, Mycobacterium tuberculosis H37Rv
cgaagcugcugcugcuugac

SEQ ID NO: 3330779 - RNA, 15 nt, Mycobacterium tuberculosis H37Rv
cgaagcuggcgugca

SEQ ID NO: 3330780 - RNA, 14 nt, Mycobacterium tuberculosis H37Rv
cgaagcuugacguu

SEQ ID NO: 3330781 - RNA, 23 nt, Mycobacterium tuberculosis H37Rv
cgaagcuugacguugccgggcuu

SEQ ID NO: 3330782 - RNA, 17 nt, Mycobacterium tuberculosis H37Rv
cgaaggaugcugucaga

SEQ ID NO: 3330783 - RNA, 17 nt, Mycobacterium tuberculosis H37Rv
cgaaggcaaagcgagca

SEQ ID NO: 3330784 - RNA, 12 nt, Mycobacterium tuberculosis H37Rv
cgaaggccaccc

SEQ ID NO: 3330785 - RNA, 13 nt, Mycobacterium tuberculosis H37Rv
cgaaggccgccaa

SEQ ID NO: 3330786 - RNA, 19 nt, Mycobacterium tuberculosis H37Rv
cgaaggccgccaaccguuc

SEQ ID NO: 3330787 - RNA, 17 nt, Mycobacterium tuberculosis H37Rv
cgaaggcguucgacucg

SEQ ID NO: 3330788 - RNA, 20 nt, Mycobacterium tuberculosis H37Rv
cgaaggcguucgacucgacc

SEQ ID NO: 3330789 - RNA, 22 nt, Mycobacterium tuberculosis H37Rv
cgaaggcguucgacucgaccgc

SEQ ID NO: 3330790 - RNA, 20 nt, Mycobacterium tuberculosis H37Rv
cgaagggaucacgaccgcgc

SEQ ID NO: 3330791 - RNA, 20 nt, Mycobacterium tuberculosis H37Rv
cgaagggcuugucgccggca

SEQ ID NO: 3330792 - RNA, 20 nt, Mycobacterium tuberculosis H37Rv
cgaagguccgugccgaugcc

SEQ ID NO: 3330793 - RNA, 14 nt, Mycobacterium tuberculosis H37Rv
cgaaggucuccggc

SEQ ID NO: 3330794 - RNA, 20 nt, Mycobacterium tuberculosis H37Rv
cgaaggucucgaaagccgcg

SEQ ID NO: 3330795 - RNA, 19 nt, Mycobacterium tuberculosis H37Rv
cgaaggugaacgacauggg

SEQ ID NO: 3330796 - RNA, 22 nt, Mycobacterium tuberculosis H37Rv
cgaaggugaacgacaugggcag

SEQ ID NO: 3330797 - RNA, 16 nt, Mycobacterium tuberculosis H37Rv
cgaagguguccuccag

SEQ ID NO: 3330798 - RNA, 17 nt, Mycobacterium tuberculosis H37Rv
cgaaguacgacgacccg

SEQ ID NO: 3330799 - RNA, 20 nt, Mycobacterium tuberculosis H37Rv
cgaaguagaagcccaggacg

SEQ ID NO: 3330800 - RNA, 17 nt, Mycobacterium tuberculosis H37Rv
cgaagucacgcacccgg

SEQ ID NO: 3330801 - RNA, 18 nt, Mycobacterium tuberculosis H37Rv
cgaaguccacgcaccacg

SEQ ID NO: 3330802 - RNA, 15 nt, Mycobacterium tuberculosis H37Rv
cgaaguccuggcaga

SEQ ID NO: 3330803 - RNA, 15 nt, Mycobacterium tuberculosis H37Rv
cgaagucgcauggcg

SEQ ID NO: 3330804 - RNA, 15 nt, Mycobacterium tuberculosis H37Rv
cgaagucuugaccgc

SEQ ID NO: 3330805 - RNA, 21 nt, Mycobacterium tuberculosis H37Rv
cgaagucuugaccgcaccggc

SEQ ID NO: 3330806 - RNA, 22 nt, Mycobacterium tuberculosis H37Rv
cgaagugggucaagaucggugc

SEQ ID NO: 3330807 - RNA, 13 nt, Mycobacterium tuberculosis H37Rv
cgaaguucucggu

SEQ ID NO: 3330808 - RNA, 17 nt, Mycobacterium tuberculosis H37Rv
cgaaguucucuagcucg

SEQ ID NO: 3330809 - RNA, 17 nt, Mycobacterium tuberculosis H37Rv
cgaaguugaugucgcgu

SEQ ID NO: 3330810 - RNA, 14 nt, Mycobacterium tuberculosis H37Rv
cgaauaccagaccg

SEQ ID NO: 3330811 - RNA, 21 nt, Mycobacterium tuberculosis H37Rv
cgaauaccgguggcagccugc

SEQ ID NO: 3330812 - RNA, 18 nt, Mycobacterium tuberculosis H37Rv
cgaauacgaggacgacga

SEQ ID NO: 3330813 - RNA, 19 nt, Mycobacterium tuberculosis H37Rv
cgaauagccaccaagcaca

SEQ ID NO: 3330814 - RNA, 16 nt, Mycobacterium tuberculosis H37Rv
cgaaucaacaggaccg

SEQ ID NO: 3330815 - RNA, 14 nt, Mycobacterium tuberculosis H37Rv
cgaaucccaucggg

SEQ ID NO: 3330816 - RNA, 17 nt, Mycobacterium tuberculosis H37Rv
cgaaucccccggacggc

SEQ ID NO: 3330817 - RNA, 18 nt, Mycobacterium tuberculosis H37Rv
cgaauccgacgucgacga

SEQ ID NO: 3330818 - RNA, 16 nt, Mycobacterium tuberculosis H37Rv
cgaaucgcugaccgcg

SEQ ID NO: 3330819 - RNA, 15 nt, Mycobacterium tuberculosis H37Rv
cgaaucgcugccgcc

SEQ ID NO: 3330820 - RNA, 23 nt, Mycobacterium tuberculosis H37Rv
cgaaucggcaguugaacucgacc

SEQ ID NO: 3330821 - RNA, 14 nt, Mycobacterium tuberculosis H37Rv
cgaaucgucacgga

SEQ ID NO: 3330822 - RNA, 19 nt, Mycobacterium tuberculosis H37Rv
cgaaucuucugagacugcc

SEQ ID NO: 3330823 - RNA, 18 nt, Mycobacterium tuberculosis H37Rv
cgaaugccaccucgacgc

SEQ ID NO: 3330824 - RNA, 19 nt, Mycobacterium tuberculosis H37Rv
cgaaugccauaaccggugg

SEQ ID NO: 3330825 - RNA, 22 nt, Mycobacterium tuberculosis H37Rv
cgaaugccauaaccggugggga

SEQ ID NO: 3330826 - RNA, 16 nt, Mycobacterium tuberculosis H37Rv
cgaaugcgguccucga

SEQ ID NO: 3330827 - RNA, 14 nt, Mycobacterium tuberculosis H37Rv
cgaaugcugacaug

SEQ ID NO: 3330828 - RNA, 23 nt, Mycobacterium tuberculosis H37Rv
cgaaugcugggcccgccagccca

SEQ ID NO: 3330829 - RNA, 18 nt, Mycobacterium tuberculosis H37Rv
cgaauggccgaaccguuc

SEQ ID NO: 3330830 - RNA, 21 nt, Mycobacterium tuberculosis H37Rv
cgaauggggcagcucaucgcg

SEQ ID NO: 3330831 - RNA, 17 nt, Mycobacterium tuberculosis H37Rv
cgaaugguaucgagugg

SEQ ID NO: 3330832 - RNA, 15 nt, Mycobacterium tuberculosis H37Rv
cgaaugucacaccgg

SEQ ID NO: 3330833 - RNA, 15 nt, Mycobacterium tuberculosis H37Rv
cgaaugucugcgcag

SEQ ID NO: 3330834 - RNA, 17 nt, Mycobacterium tuberculosis H37Rv
cgaaugucugcgcaggu

SEQ ID NO: 3330835 - RNA, 21 nt, Mycobacterium tuberculosis H37Rv
cgaauguugcgaucugcggcg

SEQ ID NO: 3330836 - RNA, 14 nt, Mycobacterium tuberculosis H37Rv
cgaauuccggcuca

SEQ ID NO: 3330837 - RNA, 19 nt, Mycobacterium tuberculosis H37Rv
cgaauugcguucgccgccc

SEQ ID NO: 3330838 - RNA, 18 nt, Mycobacterium tuberculosis H37Rv
cgaauuggugcgcaucga

SEQ ID NO: 3330839 - RNA, 21 nt, Mycobacterium tuberculosis H37Rv
cgaauuggugcgcaucgagcg

SEQ ID NO: 3330840 - RNA, 21 nt, Mycobacterium tuberculosis H37Rv
cgacaaacguguugaccgggu

SEQ ID NO: 3330841 - RNA, 19 nt, Mycobacterium tuberculosis H37Rv
cgacaaaucggucgacgau

SEQ ID NO: 3330842 - RNA, 13 nt, Mycobacterium tuberculosis H37Rv
cgacaacaccacg

SEQ ID NO: 3330843 - RNA, 16 nt, Mycobacterium tuberculosis H37Rv
cgacaacaccacggug

SEQ ID NO: 3330844 - RNA, 21 nt, Mycobacterium tuberculosis H37Rv
cgacaacacccacgugcugcc

SEQ ID NO: 3330845 - RNA, 15 nt, Mycobacterium tuberculosis H37Rv
cgacaacacgccguc

SEQ ID NO: 3330846 - RNA, 17 nt, Mycobacterium tuberculosis H37Rv
cgacaacacgccgucga

SEQ ID NO: 3330847 - RNA, 14 nt, Mycobacterium tuberculosis H37Rv
cgacaacagcacgu

SEQ ID NO: 3330848 - RNA, 22 nt, Mycobacterium tuberculosis H37Rv
cgacaaccgcccgccaggccgu

SEQ ID NO: 3330849 - RNA, 16 nt, Mycobacterium tuberculosis H37Rv
cgacaacgcugggcgg

SEQ ID NO: 3330850 - RNA, 17 nt, Mycobacterium tuberculosis H37Rv
cgacaagaauggccgcc

SEQ ID NO: 3330851 - RNA, 14 nt, Mycobacterium tuberculosis H37Rv
cgacaagaccggcg

SEQ ID NO: 3330852 - RNA, 16 nt, Mycobacterium tuberculosis H37Rv
cgacaagaccggcggg

SEQ ID NO: 3330853 - RNA, 14 nt, Mycobacterium tuberculosis H37Rv
cgacaagccgucgg

SEQ ID NO: 3330854 - RNA, 17 nt, Mycobacterium tuberculosis H37Rv
cgacacaccccagcaac

SEQ ID NO: 3330855 - RNA, 13 nt, Mycobacterium tuberculosis H37Rv
cgacacacgccgc

SEQ ID NO: 3330856 - RNA, 18 nt, Mycobacterium tuberculosis H37Rv
cgacacacgccgccggug

SEQ ID NO: 3330857 - RNA, 21 nt, Mycobacterium tuberculosis H37Rv
cgacacauagugcggcaccgc

SEQ ID NO: 3330858 - RNA, 14 nt, Mycobacterium tuberculosis H37Rv
cgacaccaccggcg

SEQ ID NO: 3330859 - RNA, 14 nt, Mycobacterium tuberculosis H37Rv
cgacaccaccuugg

SEQ ID NO: 3330860 - RNA, 20 nt, Mycobacterium tuberculosis H37Rv
cgacaccacggcgcgcagcg

SEQ ID NO: 3330861 - RNA, 18 nt, Mycobacterium tuberculosis H37Rv
cgacacccagccgcagcc

SEQ ID NO: 3330862 - RNA, 23 nt, Mycobacterium tuberculosis H37Rv
cgacacccccggugccggcggug

SEQ ID NO: 3330863 - RNA, 20 nt, Mycobacterium tuberculosis H37Rv
cgacacccgaugugcccggc

SEQ ID NO: 3330864 - RNA, 14 nt, Mycobacterium tuberculosis H37Rv
cgacacccgcacga

SEQ ID NO: 3330865 - RNA, 14 nt, Mycobacterium tuberculosis H37Rv
cgacacccgcucgg

SEQ ID NO: 3330866 - RNA, 14 nt, Mycobacterium tuberculosis H37Rv
cgacacccugggug

SEQ ID NO: 3330867 - RNA, 15 nt, Mycobacterium tuberculosis H37Rv
cgacaccgacucgca

SEQ ID NO: 3330868 - RNA, 20 nt, Mycobacterium tuberculosis H37Rv
cgacaccgagccacgaccca

SEQ ID NO: 3330869 - RNA, 20 nt, Mycobacterium tuberculosis H37Rv
cgacaccgcaggugccgugg

SEQ ID NO: 3330870 - RNA, 14 nt, Mycobacterium tuberculosis H37Rv
cgacaccgccacca

SEQ ID NO: 3330871 - RNA, 13 nt, Mycobacterium tuberculosis H37Rv
cgacaccgcccga

SEQ ID NO: 3330872 - RNA, 16 nt, Mycobacterium tuberculosis H37Rv
cgacaccgcccgaccc

SEQ ID NO: 3330873 - RNA, 11 nt, Mycobacterium tuberculosis H37Rv
cgacaccgccg

SEQ ID NO: 3330874 - RNA, 15 nt, Mycobacterium tuberculosis H37Rv
cgacaccgcgcagcg

SEQ ID NO: 3330875 - RNA, 15 nt, Mycobacterium tuberculosis H37Rv
cgacaccgcggaccc

SEQ ID NO: 3330876 - RNA, 18 nt, Mycobacterium tuberculosis H37Rv
cgacaccgcggacccgca

SEQ ID NO: 3330877 - RNA, 19 nt, Mycobacterium tuberculosis H37Rv
cgacaccgcggugccccgg

SEQ ID NO: 3330878 - RNA, 20 nt, Mycobacterium tuberculosis H37Rv
cgacaccgcggugccccgga

SEQ ID NO: 3330879 - RNA, 14 nt, Mycobacterium tuberculosis H37Rv
cgacaccggccgcg

SEQ ID NO: 3330880 - RNA, 16 nt, Mycobacterium tuberculosis H37Rv
cgacaccggccgcgac

SEQ ID NO: 3330881 - RNA, 19 nt, Mycobacterium tuberculosis H37Rv
cgacaccggcggcaucgag

SEQ ID NO: 3330882 - RNA, 23 nt, Mycobacterium tuberculosis H37Rv
cgacaccguaggcgaucucacgc

SEQ ID NO: 3330883 - RNA, 15 nt, Mycobacterium tuberculosis H37Rv
cgacaccgugucgcc

SEQ ID NO: 3330884 - RNA, 16 nt, Mycobacterium tuberculosis H37Rv
cgacaccguguugcug

SEQ ID NO: 3330885 - RNA, 17 nt, Mycobacterium tuberculosis H37Rv
cgacaccuccgucagcg

SEQ ID NO: 3330886 - RNA, 16 nt, Mycobacterium tuberculosis H37Rv
cgacacgaacgcugcu

SEQ ID NO: 3330887 - RNA, 15 nt, Mycobacterium tuberculosis H37Rv
cgacacgccagguga

SEQ ID NO: 3330888 - RNA, 13 nt, Mycobacterium tuberculosis H37Rv
cgacacgccgaac

SEQ ID NO: 3330889 - RNA, 15 nt, Mycobacterium tuberculosis H37Rv
cgacacgccggcggg

SEQ ID NO: 3330890 - RNA, 16 nt, Mycobacterium tuberculosis H37Rv
cgacacgccugggcga

SEQ ID NO: 3330891 - RNA, 15 nt, Mycobacterium tuberculosis H37Rv
cgacacgcggcccga

SEQ ID NO: 3330892 - RNA, 22 nt, Mycobacterium tuberculosis H37Rv
cgacacggcggcugcggcgucg

SEQ ID NO: 3330893 - RNA, 19 nt, Mycobacterium tuberculosis H37Rv
cgacacggcucgccggcuc

SEQ ID NO: 3330894 - RNA, 12 nt, Mycobacterium tuberculosis H37Rv
cgacacggugcu

SEQ ID NO: 3330895 - RNA, 15 nt, Mycobacterium tuberculosis H37Rv
cgacacggugcugcc

SEQ ID NO: 3330896 - RNA, 17 nt, Mycobacterium tuberculosis H37Rv
cgacacguugacgaugu

SEQ ID NO: 3330897 - RNA, 20 nt, Mycobacterium tuberculosis H37Rv
cgacacguuucacguggucg

SEQ ID NO: 3330898 - RNA, 16 nt, Mycobacterium tuberculosis H37Rv
cgacagacagcaccgc

SEQ ID NO: 3330899 - RNA, 20 nt, Mycobacterium tuberculosis H37Rv
cgacagaugccgggcugagg

SEQ ID NO: 3330900 - RNA, 21 nt, Mycobacterium tuberculosis H37Rv
cgacagauggucacccacguu

SEQ ID NO: 3330901 - RNA, 19 nt, Mycobacterium tuberculosis H37Rv
cgacagauggucggucgcu

SEQ ID NO: 3330902 - RNA, 20 nt, Mycobacterium tuberculosis H37Rv
cgacagcacccggccaccgg

SEQ ID NO: 3330903 - RNA, 14 nt, Mycobacterium tuberculosis H37Rv
cgacagcaccgaau

SEQ ID NO: 3330904 - RNA, 23 nt, Mycobacterium tuberculosis H37Rv
cgacagcagccggugccggucga

SEQ ID NO: 3330905 - RNA, 16 nt, Mycobacterium tuberculosis H37Rv
cgacagcaucacgccc

SEQ ID NO: 3330906 - RNA, 17 nt, Mycobacterium tuberculosis H37Rv
cgacagccccaucacca

SEQ ID NO: 3330907 - RNA, 17 nt, Mycobacterium tuberculosis H37Rv
cgacagccgauccgauc

SEQ ID NO: 3330908 - RNA, 14 nt, Mycobacterium tuberculosis H37Rv
cgacagcgcggcgc

SEQ ID NO: 3330909 - RNA, 16 nt, Mycobacterium tuberculosis H37Rv
cgacagcuuggccggu

SEQ ID NO: 3330910 - RNA, 17 nt, Mycobacterium tuberculosis H37Rv
cgacaggacgucggcga

SEQ ID NO: 3330911 - RNA, 19 nt, Mycobacterium tuberculosis H37Rv
cgacaggacgucggcgaau

SEQ ID NO: 3330912 - RNA, 16 nt, Mycobacterium tuberculosis H37Rv
cgacaggccgagcaga

SEQ ID NO: 3330913 - RNA, 17 nt, Mycobacterium tuberculosis H37Rv
cgacaggccggccacca

SEQ ID NO: 3330914 - RNA, 19 nt, Mycobacterium tuberculosis H37Rv
cgacaggccggccaccagu

SEQ ID NO: 3330915 - RNA, 18 nt, Mycobacterium tuberculosis H37Rv
cgacaggcgcccacaaau

SEQ ID NO: 3330916 - RNA, 19 nt, Mycobacterium tuberculosis H37Rv
cgacagggacccgagauca

SEQ ID NO: 3330917 - RNA, 13 nt, Mycobacterium tuberculosis H37Rv
cgacaggucgccc

SEQ ID NO: 3330918 - RNA, 18 nt, Mycobacterium tuberculosis H37Rv
cgacaggugccagaccag

SEQ ID NO: 3330919 - RNA, 23 nt, Mycobacterium tuberculosis H37Rv
cgacaggugccagaccagggcag

SEQ ID NO: 3330920 - RNA, 15 nt, Mycobacterium tuberculosis H37Rv
cgacagucaacaggg

SEQ ID NO: 3330921 - RNA, 18 nt, Mycobacterium tuberculosis H37Rv
cgacagucaacagggcca

SEQ ID NO: 3330922 - RNA, 18 nt, Mycobacterium tuberculosis H37Rv
cgacaguggucccgguga

SEQ ID NO: 3330923 - RNA, 18 nt, Mycobacterium tuberculosis H37Rv
cgacagugugaagaccac

SEQ ID NO: 3330924 - RNA, 23 nt, Mycobacterium tuberculosis H37Rv
cgacaguuuaccgugccgcccgg

SEQ ID NO: 3330925 - RNA, 15 nt, Mycobacterium tuberculosis H37Rv
cgacauaggccaccu

SEQ ID NO: 3330926 - RNA, 16 nt, Mycobacterium tuberculosis H37Rv
cgacauaggccaccuc

SEQ ID NO: 3330927 - RNA, 12 nt, Mycobacterium tuberculosis H37Rv
cgacaucaccac

SEQ ID NO: 3330928 - RNA, 14 nt, Mycobacterium tuberculosis H37Rv
cgacaucaccaccg

SEQ ID NO: 3330929 - RNA, 20 nt, Mycobacterium tuberculosis H37Rv
cgacaucaccaccgaccugg

SEQ ID NO: 3330930 - RNA, 15 nt, Mycobacterium tuberculosis H37Rv
cgacaucaccaccgc

SEQ ID NO: 3330931 - RNA, 17 nt, Mycobacterium tuberculosis H37Rv
cgacaucacucgcgcca

SEQ ID NO: 3330932 - RNA, 15 nt, Mycobacterium tuberculosis H37Rv
cgacaucauggugaa

SEQ ID NO: 3330933 - RNA, 12 nt, Mycobacterium tuberculosis H37Rv
cgacaucgccau

SEQ ID NO: 3330934 - RNA, 22 nt, Mycobacterium tuberculosis H37Rv
cgacaucgcugcgacuggccgu

SEQ ID NO: 3330935 - RNA, 17 nt, Mycobacterium tuberculosis H37Rv
cgacaucgguggcggcc

SEQ ID NO: 3330936 - RNA, 16 nt, Mycobacterium tuberculosis H37Rv
cgacaucgucaucagc

SEQ ID NO: 3330937 - RNA, 17 nt, Mycobacterium tuberculosis H37Rv
cgacaucgucauccagg

SEQ ID NO: 3330938 - RNA, 17 nt, Mycobacterium tuberculosis H37Rv
cgacaucgucgcgacga

SEQ ID NO: 3330939 - RNA, 20 nt, Mycobacterium tuberculosis H37Rv
cgacaugaaccggucgaucc

SEQ ID NO: 3330940 - RNA, 14 nt, Mycobacterium tuberculosis H37Rv
cgacaugaccgaca

SEQ ID NO: 3330941 - RNA, 20 nt, Mycobacterium tuberculosis H37Rv
cgacaugagcgccacgccga

SEQ ID NO: 3330942 - RNA, 16 nt, Mycobacterium tuberculosis H37Rv
cgacaugcgccgagau

SEQ ID NO: 3330943 - RNA, 18 nt, Mycobacterium tuberculosis H37Rv
cgacaugggucggcuguc

SEQ ID NO: 3330944 - RNA, 16 nt, Mycobacterium tuberculosis H37Rv
cgacaugguugguguc

SEQ ID NO: 3330945 - RNA, 17 nt, Mycobacterium tuberculosis H37Rv
cgacauguguggcagcc

SEQ ID NO: 3330946 - RNA, 21 nt, Mycobacterium tuberculosis H37Rv
cgacauuggccgucaucgccg

SEQ ID NO: 3330947 - RNA, 21 nt, Mycobacterium tuberculosis H37Rv
cgacauuugcccgaugguacc

SEQ ID NO: 3330948 - RNA, 20 nt, Mycobacterium tuberculosis H37Rv
cgaccaaaccgacgcgggcc

SEQ ID NO: 3330949 - RNA, 16 nt, Mycobacterium tuberculosis H37Rv
cgaccaacacgucgag

SEQ ID NO: 3330950 - RNA, 14 nt, Mycobacterium tuberculosis H37Rv
cgaccaagagacgu

SEQ ID NO: 3330951 - RNA, 19 nt, Mycobacterium tuberculosis H37Rv
cgaccaaggccgaccugua

SEQ ID NO: 3330952 - RNA, 18 nt, Mycobacterium tuberculosis H37Rv
cgaccaagucaugcccac

SEQ ID NO: 3330953 - RNA, 24 nt, Mycobacterium tuberculosis H37Rv
cgaccaagucaugcccacgcugcc

SEQ ID NO: 3330954 - RNA, 23 nt, Mycobacterium tuberculosis H37Rv
cgaccaaguugaccuucaccugg

SEQ ID NO: 3330955 - RNA, 17 nt, Mycobacterium tuberculosis H37Rv
cgaccaauaccaguccg

SEQ ID NO: 3330956 - RNA, 15 nt, Mycobacterium tuberculosis H37Rv
cgaccaauagcacgg

SEQ ID NO: 3330957 - RNA, 17 nt, Mycobacterium tuberculosis H37Rv
cgaccaauaggucccca

SEQ ID NO: 3330958 - RNA, 15 nt, Mycobacterium tuberculosis H37Rv
cgaccaauuggucga

SEQ ID NO: 3330959 - RNA, 20 nt, Mycobacterium tuberculosis H37Rv
cgaccaauuggucgagucga

SEQ ID NO: 3330960 - RNA, 22 nt, Mycobacterium tuberculosis H37Rv
cgaccacaucaugccagccguc

SEQ ID NO: 3330961 - RNA, 12 nt, Mycobacterium tuberculosis H37Rv
cgaccaccaccg

SEQ ID NO: 3330962 - RNA, 14 nt, Mycobacterium tuberculosis H37Rv
cgaccaccaccgcc

SEQ ID NO: 3330963 - RNA, 20 nt, Mycobacterium tuberculosis H37Rv
cgaccaccaccgccgccgaa

SEQ ID NO: 3330964 - RNA, 18 nt, Mycobacterium tuberculosis H37Rv
cgaccaccagagcgucga

SEQ ID NO: 3330965 - RNA, 18 nt, Mycobacterium tuberculosis H37Rv
cgaccaccagcgccgacc

SEQ ID NO: 3330966 - RNA, 20 nt, Mycobacterium tuberculosis H37Rv
cgaccaccgccgggcuguga

SEQ ID NO: 3330967 - RNA, 18 nt, Mycobacterium tuberculosis H37Rv
cgaccaccggguagccgg

SEQ ID NO: 3330968 - RNA, 22 nt, Mycobacterium tuberculosis H37Rv
cgaccaccggguagccggcgug

SEQ ID NO: 3330969 - RNA, 19 nt, Mycobacterium tuberculosis H37Rv
cgaccaccucagcugcgga

SEQ ID NO: 3330970 - RNA, 22 nt, Mycobacterium tuberculosis H37Rv
cgaccaccugcugcacggucau

SEQ ID NO: 3330971 - RNA, 19 nt, Mycobacterium tuberculosis H37Rv
cgaccaccuucugacgcgg

SEQ ID NO: 3330972 - RNA, 12 nt, Mycobacterium tuberculosis H37Rv
cgaccacgacgu

SEQ ID NO: 3330973 - RNA, 16 nt, Mycobacterium tuberculosis H37Rv
cgaccacgccgccggc

SEQ ID NO: 3330974 - RNA, 19 nt, Mycobacterium tuberculosis H37Rv
cgaccacgccgccggcgcu

SEQ ID NO: 3330975 - RNA, 12 nt, Mycobacterium tuberculosis H37Rv
cgaccacggcac

SEQ ID NO: 3330976 - RNA, 13 nt, Mycobacterium tuberculosis H37Rv
cgaccacgguguc

SEQ ID NO: 3330977 - RNA, 22 nt, Mycobacterium tuberculosis H37Rv
cgaccacgucggcgaacgcguc

SEQ ID NO: 3330978 - RNA, 14 nt, Mycobacterium tuberculosis H37Rv
cgaccacuccacgc

SEQ ID NO: 3330979 - RNA, 18 nt, Mycobacterium tuberculosis H37Rv
cgaccacuccacgcagcc

SEQ ID NO: 3330980 - RNA, 20 nt, Mycobacterium tuberculosis H37Rv
cgaccacucgagcgcucaca

SEQ ID NO: 3330981 - RNA, 22 nt, Mycobacterium tuberculosis H37Rv
cgaccacugcccgggguccauc

SEQ ID NO: 3330982 - RNA, 16 nt, Mycobacterium tuberculosis H37Rv
cgaccacuucccgcuu

SEQ ID NO: 3330983 - RNA, 15 nt, Mycobacterium tuberculosis H37Rv
cgaccagaacgccag

SEQ ID NO: 3330984 - RNA, 19 nt, Mycobacterium tuberculosis H37Rv
cgaccagauagaacaacgu

SEQ ID NO: 3330985 - RNA, 12 nt, Mycobacterium tuberculosis H37Rv
cgaccagcagau

SEQ ID NO: 3330986 - RNA, 13 nt, Mycobacterium tuberculosis H37Rv
cgaccagccccgc

SEQ ID NO: 3330987 - RNA, 22 nt, Mycobacterium tuberculosis H37Rv
cgaccagccccgcuggucgacc

SEQ ID NO: 3330988 - RNA, 16 nt, Mycobacterium tuberculosis H37Rv
cgaccagcccgcucuu

SEQ ID NO: 3330989 - RNA, 14 nt, Mycobacterium tuberculosis H37Rv
cgaccagcgccgca

SEQ ID NO: 3330990 - RNA, 19 nt, Mycobacterium tuberculosis H37Rv
cgaccagcgccgcacccgc

SEQ ID NO: 3330991 - RNA, 13 nt, Mycobacterium tuberculosis H37Rv
cgaccagcgcggc

SEQ ID NO: 3330992 - RNA, 16 nt, Mycobacterium tuberculosis H37Rv
cgaccagcggccgacc

SEQ ID NO: 3330993 - RNA, 18 nt, Mycobacterium tuberculosis H37Rv
cgaccagcggccgaccgc

SEQ ID NO: 3330994 - RNA, 20 nt, Mycobacterium tuberculosis H37Rv
cgaccagcucagcugcggau

SEQ ID NO: 3330995 - RNA, 22 nt, Mycobacterium tuberculosis H37Rv
cgaccagcugugaacaggccga

SEQ ID NO: 3330996 - RNA, 13 nt, Mycobacterium tuberculosis H37Rv
cgaccaggccacu

SEQ ID NO: 3330997 - RNA, 19 nt, Mycobacterium tuberculosis H37Rv
cgaccaggccagagccgcc

SEQ ID NO: 3330998 - RNA, 22 nt, Mycobacterium tuberculosis H37Rv
cgaccaggccagagccgcccuu

SEQ ID NO: 3330999 - RNA, 20 nt, Mycobacterium tuberculosis H37Rv
cgaccagggccgccgcugcc

SEQ ID NO: 3331000 - RNA, 16 nt, Mycobacterium tuberculosis H37Rv
cgaccagggcggugcu

SEQ ID NO: 3331001 - RNA, 22 nt, Mycobacterium tuberculosis H37Rv
cgaccauauuggcgcggccgaa

SEQ ID NO: 3331002 - RNA, 20 nt, Mycobacterium tuberculosis H37Rv
cgaccaucaccacggccgcc

SEQ ID NO: 3331003 - RNA, 16 nt, Mycobacterium tuberculosis H37Rv
cgaccaucgggacgcc

SEQ ID NO: 3331004 - RNA, 13 nt, Mycobacterium tuberculosis H37Rv
cgaccaugaugcc

SEQ ID NO: 3331005 - RNA, 16 nt, Mycobacterium tuberculosis H37Rv
cgaccaugguagcgcc

SEQ ID NO: 3331006 - RNA, 17 nt, Mycobacterium tuberculosis H37Rv
cgaccaugguagcgccc

SEQ ID NO: 3331007 - RNA, 16 nt, Mycobacterium tuberculosis H37Rv
cgacccaagucgccga

SEQ ID NO: 3331008 - RNA, 13 nt, Mycobacterium tuberculosis H37Rv
cgacccagcgcgc

SEQ ID NO: 3331009 - RNA, 13 nt, Mycobacterium tuberculosis H37Rv
cgacccagcggua

SEQ ID NO: 3331010 - RNA, 17 nt, Mycobacterium tuberculosis H37Rv
cgacccagcugaccuga

SEQ ID NO: 3331011 - RNA, 13 nt, Mycobacterium tuberculosis H37Rv
cgacccaucacca

SEQ ID NO: 3331012 - RNA, 15 nt, Mycobacterium tuberculosis H37Rv
cgacccaucaccagc

SEQ ID NO: 3331013 - RNA, 17 nt, Mycobacterium tuberculosis H37Rv
cgaccccaggcgcucau

SEQ ID NO: 3331014 - RNA, 20 nt, Mycobacterium tuberculosis H37Rv
cgaccccgaacauccgccgc

SEQ ID NO: 3331015 - RNA, 15 nt, Mycobacterium tuberculosis H37Rv
cgaccccgccgagcg

SEQ ID NO: 3331016 - RNA, 17 nt, Mycobacterium tuberculosis H37Rv
cgaccccgccgagcggu

SEQ ID NO: 3331017 - RNA, 12 nt, Mycobacterium tuberculosis H37Rv
cgaccccgcgcu

SEQ ID NO: 3331018 - RNA, 13 nt, Mycobacterium tuberculosis H37Rv
cgaccccggcggu

SEQ ID NO: 3331019 - RNA, 21 nt, Mycobacterium tuberculosis H37Rv
cgaccccggcgguaccgccgc

SEQ ID NO: 3331020 - RNA, 15 nt, Mycobacterium tuberculosis H37Rv
cgaccccggcugcgc

SEQ ID NO: 3331021 - RNA, 17 nt, Mycobacterium tuberculosis H37Rv
cgaccccggcugcgcuu

SEQ ID NO: 3331022 - RNA, 21 nt, Mycobacterium tuberculosis H37Rv
cgaccccggugagcucuucgg

SEQ ID NO: 3331023 - RNA, 19 nt, Mycobacterium tuberculosis H37Rv
cgaccccucacccagcugg

SEQ ID NO: 3331024 - RNA, 13 nt, Mycobacterium tuberculosis H37Rv
cgacccgaucacc

SEQ ID NO: 3331025 - RNA, 20 nt, Mycobacterium tuberculosis H37Rv
cgacccgcagaccgccaccg

SEQ ID NO: 3331026 - RNA, 22 nt, Mycobacterium tuberculosis H37Rv
cgacccgccgacgccgccggcc

SEQ ID NO: 3331027 - RNA, 22 nt, Mycobacterium tuberculosis H37Rv
cgacccgccgaugaugcggcgc

SEQ ID NO: 3331028 - RNA, 13 nt, Mycobacterium tuberculosis H37Rv
cgacccgccgccc

SEQ ID NO: 3331029 - RNA, 15 nt, Mycobacterium tuberculosis H37Rv
cgacccgccgcgccc

SEQ ID NO: 3331030 - RNA, 18 nt, Mycobacterium tuberculosis H37Rv
cgacccgccgcgcccggc

SEQ ID NO: 3331031 - RNA, 22 nt, Mycobacterium tuberculosis H37Rv
cgacccgccgcgcccggcgcaa

SEQ ID NO: 3331032 - RNA, 21 nt, Mycobacterium tuberculosis H37Rv
cgacccgccgcgcccggcgcu

SEQ ID NO: 3331033 - RNA, 16 nt, Mycobacterium tuberculosis H37Rv
cgacccgcgcgccggc

SEQ ID NO: 3331034 - RNA, 18 nt, Mycobacterium tuberculosis H37Rv
cgacccgcgcgccggcga

SEQ ID NO: 3331035 - RNA, 17 nt, Mycobacterium tuberculosis H37Rv
cgacccgcugccaccca

SEQ ID NO: 3331036 - RNA, 15 nt, Mycobacterium tuberculosis H37Rv
cgacccggccagcgg

SEQ ID NO: 3331037 - RNA, 18 nt, Mycobacterium tuberculosis H37Rv
cgacccggcccagcgccc

SEQ ID NO: 3331038 - RNA, 13 nt, Mycobacterium tuberculosis H37Rv
cgacccggcgcag

SEQ ID NO: 3331039 - RNA, 16 nt, Mycobacterium tuberculosis H37Rv
cgacccgggaaggaac

SEQ ID NO: 3331040 - RNA, 17 nt, Mycobacterium tuberculosis H37Rv
cgacccgggaaggaacc

SEQ ID NO: 3331041 - RNA, 18 nt, Mycobacterium tuberculosis H37Rv
cgacccgggaaggaaccg

SEQ ID NO: 3331042 - RNA, 11 nt, Mycobacterium tuberculosis H37Rv
cgacccgggcc

SEQ ID NO: 3331043 - RNA, 20 nt, Mycobacterium tuberculosis H37Rv
cgacccgggccggucgguga

SEQ ID NO: 3331044 - RNA, 14 nt, Mycobacterium tuberculosis H37Rv
cgacccgggcgucc

SEQ ID NO: 3331045 - RNA, 14 nt, Mycobacterium tuberculosis H37Rv
cgacccgggucggc

SEQ ID NO: 3331046 - RNA, 16 nt, Mycobacterium tuberculosis H37Rv
cgacccgggucggcac

SEQ ID NO: 3331047 - RNA, 15 nt, Mycobacterium tuberculosis H37Rv
cgacccggucgacgg

SEQ ID NO: 3331048 - RNA, 17 nt, Mycobacterium tuberculosis H37Rv
cgacccggucgacgggu

SEQ ID NO: 3331049 - RNA, 14 nt, Mycobacterium tuberculosis H37Rv
cgacccguaccagc

SEQ ID NO: 3331050 - RNA, 18 nt, Mycobacterium tuberculosis H37Rv
cgacccuaguucagcgcc

SEQ ID NO: 3331051 - RNA, 13 nt, Mycobacterium tuberculosis H37Rv
cgacccuccagca

SEQ ID NO: 3331052 - RNA, 20 nt, Mycobacterium tuberculosis H37Rv
cgacccuucgggcuggucgg

SEQ ID NO: 3331053 - RNA, 16 nt, Mycobacterium tuberculosis H37Rv
cgaccgaaagccgcac

SEQ ID NO: 3331054 - RNA, 17 nt, Mycobacterium tuberculosis H37Rv
cgaccgaaccgucagcg

SEQ ID NO: 3331055 - RNA, 12 nt, Mycobacterium tuberculosis H37Rv
cgaccgacggac

SEQ ID NO: 3331056 - RNA, 19 nt, Mycobacterium tuberculosis H37Rv
cgaccgacuuuggccaucu

SEQ ID NO: 3331057 - RNA, 14 nt, Mycobacterium tuberculosis H37Rv
cgaccgagacggcg

SEQ ID NO: 3331058 - RNA, 19 nt, Mycobacterium tuberculosis H37Rv
cgaccgauaacacccgggc

SEQ ID NO: 3331059 - RNA, 20 nt, Mycobacterium tuberculosis H37Rv
cgaccgaugaucucacccag

SEQ ID NO: 3331060 - RNA, 14 nt, Mycobacterium tuberculosis H37Rv
cgaccgcacgaucg

SEQ ID NO: 3331061 - RNA, 21 nt, Mycobacterium tuberculosis H37Rv
cgaccgcacgaucgcaccgag

SEQ ID NO: 3331062 - RNA, 18 nt, Mycobacterium tuberculosis H37Rv
cgaccgcauugaacagcg

SEQ ID NO: 3331063 - RNA, 14 nt, Mycobacterium tuberculosis H37Rv
cgaccgccaccgcc

SEQ ID NO: 3331064 - RNA, 15 nt, Mycobacterium tuberculosis H37Rv
cgaccgccaccgcca

SEQ ID NO: 3331065 - RNA, 16 nt, Mycobacterium tuberculosis H37Rv
cgaccgccaccgccag

SEQ ID NO: 3331066 - RNA, 17 nt, Mycobacterium tuberculosis H37Rv
cgaccgccaccgccagc

SEQ ID NO: 3331067 - RNA, 14 nt, Mycobacterium tuberculosis H37Rv
cgaccgccagccgc

SEQ ID NO: 3331068 - RNA, 11 nt, Mycobacterium tuberculosis H37Rv
cgaccgcccgc

SEQ ID NO: 3331069 - RNA, 15 nt, Mycobacterium tuberculosis H37Rv
cgaccgcccgccagc

SEQ ID NO: 3331070 - RNA, 15 nt, Mycobacterium tuberculosis H37Rv
cgaccgccgagcggg

SEQ ID NO: 3331071 - RNA, 16 nt, Mycobacterium tuberculosis H37Rv
cgaccgccgagcgggu

SEQ ID NO: 3331072 - RNA, 12 nt, Mycobacterium tuberculosis H37Rv
cgaccgccuccu

SEQ ID NO: 3331073 - RNA, 14 nt, Mycobacterium tuberculosis H37Rv
cgaccgccugcaac

SEQ ID NO: 3331074 - RNA, 18 nt, Mycobacterium tuberculosis H37Rv
cgaccgcgacccggccca

SEQ ID NO: 3331075 - RNA, 21 nt, Mycobacterium tuberculosis H37Rv
cgaccgcgagggccagcaagu

SEQ ID NO: 3331076 - RNA, 19 nt, Mycobacterium tuberculosis H37Rv
cgaccgcgaguaaucgacc

SEQ ID NO: 3331077 - RNA, 13 nt, Mycobacterium tuberculosis H37Rv
cgaccgcgccgca

SEQ ID NO: 3331078 - RNA, 14 nt, Mycobacterium tuberculosis H37Rv
cgaccgcgcucacc

SEQ ID NO: 3331079 - RNA, 15 nt, Mycobacterium tuberculosis H37Rv
cgaccgcggccccgc

SEQ ID NO: 3331080 - RNA, 15 nt, Mycobacterium tuberculosis H37Rv
cgaccgcggccgggu

SEQ ID NO: 3331081 - RNA, 18 nt, Mycobacterium tuberculosis H37Rv
cgaccgcgggccgacgca

SEQ ID NO: 3331082 - RNA, 19 nt, Mycobacterium tuberculosis H37Rv
cgaccgcgggccgacgcag

SEQ ID NO: 3331083 - RNA, 20 nt, Mycobacterium tuberculosis H37Rv
cgaccgcguacaggccggcc

SEQ ID NO: 3331084 - RNA, 21 nt, Mycobacterium tuberculosis H37Rv
cgaccgcguacaggccggcca

SEQ ID NO: 3331085 - RNA, 17 nt, Mycobacterium tuberculosis H37Rv
cgaccgcgugcaccgag

SEQ ID NO: 3331086 - RNA, 14 nt, Mycobacterium tuberculosis H37Rv
cgaccgcucccggu

SEQ ID NO: 3331087 - RNA, 14 nt, Mycobacterium tuberculosis H37Rv
cgaccgcuccgacc

SEQ ID NO: 3331088 - RNA, 14 nt, Mycobacterium tuberculosis H37Rv
cgaccggacacucc

SEQ ID NO: 3331089 - RNA, 21 nt, Mycobacterium tuberculosis H37Rv
cgaccggacacuccugcacac

SEQ ID NO: 3331090 - RNA, 18 nt, Mycobacterium tuberculosis H37Rv
cgaccggacgagcgucag

SEQ ID NO: 3331091 - RNA, 19 nt, Mycobacterium tuberculosis H37Rv
cgaccggacgagcgucaga

SEQ ID NO: 3331092 - RNA, 12 nt, Mycobacterium tuberculosis H37Rv
cgaccggcaccc

SEQ ID NO: 3331093 - RNA, 14 nt, Mycobacterium tuberculosis H37Rv
cgaccggcacggug

SEQ ID NO: 3331094 - RNA, 20 nt, Mycobacterium tuberculosis H37Rv
cgaccggcccgcauccgcac

SEQ ID NO: 3331095 - RNA, 13 nt, Mycobacterium tuberculosis H37Rv
cgaccggccggcc

SEQ ID NO: 3331096 - RNA, 21 nt, Mycobacterium tuberculosis H37Rv
cgaccggcgggacgucgccgc

SEQ ID NO: 3331097 - RNA, 21 nt, Mycobacterium tuberculosis H37Rv
cgaccggcgggaugcgcgccc

SEQ ID NO: 3331098 - RNA, 16 nt, Mycobacterium tuberculosis H37Rv
cgaccggcuaccggcg

SEQ ID NO: 3331099 - RNA, 18 nt, Mycobacterium tuberculosis H37Rv
cgaccggcuaccggcgug

SEQ ID NO: 3331100 - RNA, 20 nt, Mycobacterium tuberculosis H37Rv
cgaccggcuugcccuccggg

SEQ ID NO: 3331101 - RNA, 21 nt, Mycobacterium tuberculosis H37Rv
cgaccgggaaccacggucagc

SEQ ID NO: 3331102 - RNA, 20 nt, Mycobacterium tuberculosis H37Rv
cgaccgggccgcacggucag

SEQ ID NO: 3331103 - RNA, 19 nt, Mycobacterium tuberculosis H37Rv
cgaccgggcucuggccagu

SEQ ID NO: 3331104 - RNA, 22 nt, Mycobacterium tuberculosis H37Rv
cgaccgguaauccguugccguu

SEQ ID NO: 3331105 - RNA, 22 nt, Mycobacterium tuberculosis H37Rv
cgaccgguacccguagcaccac

SEQ ID NO: 3331106 - RNA, 15 nt, Mycobacterium tuberculosis H37Rv
cgaccgguccagcca

SEQ ID NO: 3331107 - RNA, 18 nt, Mycobacterium tuberculosis H37Rv
cgaccggucuggcgauga

SEQ ID NO: 3331108 - RNA, 19 nt, Mycobacterium tuberculosis H37Rv
cgaccgguucggcguacaa

SEQ ID NO: 3331109 - RNA, 16 nt, Mycobacterium tuberculosis H37Rv
cgaccguauugaccag

SEQ ID NO: 3331110 - RNA, 17 nt, Mycobacterium tuberculosis H37Rv
cgaccguauugaccagc

SEQ ID NO: 3331111 - RNA, 16 nt, Mycobacterium tuberculosis H37Rv
cgaccgucacugaugg

SEQ ID NO: 3331112 - RNA, 21 nt, Mycobacterium tuberculosis H37Rv
cgaccgucacugaugggccgg

SEQ ID NO: 3331113 - RNA, 17 nt, Mycobacterium tuberculosis H37Rv
cgaccgucagggucacc

SEQ ID NO: 3331114 - RNA, 18 nt, Mycobacterium tuberculosis H37Rv
cgaccguccgggucacca

SEQ ID NO: 3331115 - RNA, 21 nt, Mycobacterium tuberculosis H37Rv
cgaccguccgggucaccagcg

SEQ ID NO: 3331116 - RNA, 16 nt, Mycobacterium tuberculosis H37Rv
cgaccgucgcgcugcc

SEQ ID NO: 3331117 - RNA, 19 nt, Mycobacterium tuberculosis H37Rv
cgaccgucgcgcugccggc

SEQ ID NO: 3331118 - RNA, 19 nt, Mycobacterium tuberculosis H37Rv
cgaccgucggcuccagguc

SEQ ID NO: 3331119 - RNA, 19 nt, Mycobacterium tuberculosis H37Rv
cgaccgucgggacggccaa

SEQ ID NO: 3331120 - RNA, 16 nt, Mycobacterium tuberculosis H37Rv
cgaccgucgucaccgc

SEQ ID NO: 3331121 - RNA, 17 nt, Mycobacterium tuberculosis H37Rv
cgaccgucgucgugcag

SEQ ID NO: 3331122 - RNA, 17 nt, Mycobacterium tuberculosis H37Rv
cgaccgugcugggcgcc

SEQ ID NO: 3331123 - RNA, 17 nt, Mycobacterium tuberculosis H37Rv
cgaccguggcggccucc

SEQ ID NO: 3331124 - RNA, 18 nt, Mycobacterium tuberculosis H37Rv
cgaccgugguggucgggc

SEQ ID NO: 3331125 - RNA, 19 nt, Mycobacterium tuberculosis H37Rv
cgaccgugguggucgggcg

SEQ ID NO: 3331126 - RNA, 21 nt, Mycobacterium tuberculosis H37Rv
cgaccgugguggucgggcgca

SEQ ID NO: 3331127 - RNA, 15 nt, Mycobacterium tuberculosis H37Rv
cgaccuaccgucgac

SEQ ID NO: 3331128 - RNA, 17 nt, Mycobacterium tuberculosis H37Rv
cgaccuaccgucgacca

SEQ ID NO: 3331129 - RNA, 15 nt, Mycobacterium tuberculosis H37Rv
cgaccuacugcgguc

SEQ ID NO: 3331130 - RNA, 14 nt, Mycobacterium tuberculosis H37Rv
cgaccuagcucgcg

SEQ ID NO: 3331131 - RNA, 17 nt, Mycobacterium tuberculosis H37Rv
cgaccucacccacccgc

SEQ ID NO: 3331132 - RNA, 15 nt, Mycobacterium tuberculosis H37Rv
cgaccucacugcggc

SEQ ID NO: 3331133 - RNA, 17 nt, Mycobacterium tuberculosis H37Rv
cgaccucacugcggcgc

SEQ ID NO: 3331134 - RNA, 22 nt, Mycobacterium tuberculosis H37Rv
cgaccucaucggcaccgucucg

SEQ ID NO: 3331135 - RNA, 15 nt, Mycobacterium tuberculosis H37Rv
cgaccuccaccaaug

SEQ ID NO: 3331136 - RNA, 18 nt, Mycobacterium tuberculosis H37Rv
cgaccuccaccaaugcuc

SEQ ID NO: 3331137 - RNA, 18 nt, Mycobacterium tuberculosis H37Rv
cgaccuccacgcccuggc

SEQ ID NO: 3331138 - RNA, 17 nt, Mycobacterium tuberculosis H37Rv
cgaccuccgcgaucacc

SEQ ID NO: 3331139 - RNA, 19 nt, Mycobacterium tuberculosis H37Rv
cgaccuccggaaucgcccg

SEQ ID NO: 3331140 - RNA, 21 nt, Mycobacterium tuberculosis H37Rv
cgaccuccucgaugaccggcg

SEQ ID NO: 3331141 - RNA, 15 nt, Mycobacterium tuberculosis H37Rv
cgaccucgagugcga

SEQ ID NO: 3331142 - RNA, 15 nt, Mycobacterium tuberculosis H37Rv
cgaccucgcggcgcu

SEQ ID NO: 3331143 - RNA, 16 nt, Mycobacterium tuberculosis H37Rv
cgaccucgcgggcgau

SEQ ID NO: 3331144 - RNA, 20 nt, Mycobacterium tuberculosis H37Rv
cgaccucggguugcagcagc

SEQ ID NO: 3331145 - RNA, 16 nt, Mycobacterium tuberculosis H37Rv
cgaccucgucggccga

SEQ ID NO: 3331146 - RNA, 19 nt, Mycobacterium tuberculosis H37Rv
cgaccucgucggccgacac

SEQ ID NO: 3331147 - RNA, 15 nt, Mycobacterium tuberculosis H37Rv
cgaccugaggcaccu

SEQ ID NO: 3331148 - RNA, 23 nt, Mycobacterium tuberculosis H37Rv
cgaccugaggcaccucggccuug

SEQ ID NO: 3331149 - RNA, 20 nt, Mycobacterium tuberculosis H37Rv
cgaccugagucggcauugcu

SEQ ID NO: 3331150 - RNA, 21 nt, Mycobacterium tuberculosis H37Rv
cgaccuggacaaccucgucga

SEQ ID NO: 3331151 - RNA, 19 nt, Mycobacterium tuberculosis H37Rv
cgaccuggacgcggccaau

SEQ ID NO: 3331152 - RNA, 22 nt, Mycobacterium tuberculosis H37Rv
cgaccuggacgcggccaauggc

SEQ ID NO: 3331153 - RNA, 18 nt, Mycobacterium tuberculosis H37Rv
cgaccuggauugccacca

SEQ ID NO: 3331154 - RNA, 16 nt, Mycobacterium tuberculosis H37Rv
cgaccugguaugccgc

SEQ ID NO: 3331155 - RNA, 18 nt, Mycobacterium tuberculosis H37Rv
cgaccugguaugccgccc

SEQ ID NO: 3331156 - RNA, 15 nt, Mycobacterium tuberculosis H37Rv
cgaccuguaugccgc

SEQ ID NO: 3331157 - RNA, 16 nt, Mycobacterium tuberculosis H37Rv
cgaccuguaugccgcg

SEQ ID NO: 3331158 - RNA, 18 nt, Mycobacterium tuberculosis H37Rv
cgaccuuauugccgagcu

SEQ ID NO: 3331159 - RNA, 14 nt, Mycobacterium tuberculosis H37Rv
cgaccuucaccgcg

SEQ ID NO: 3331160 - RNA, 17 nt, Mycobacterium tuberculosis H37Rv
cgacgaaaggcgcguug

SEQ ID NO: 3331161 - RNA, 15 nt, Mycobacterium tuberculosis H37Rv
cgacgaacaccagcg

SEQ ID NO: 3331162 - RNA, 16 nt, Mycobacterium tuberculosis H37Rv
cgacgaacaccagcgc

SEQ ID NO: 3331163 - RNA, 16 nt, Mycobacterium tuberculosis H37Rv
cgacgaacagcggugg

SEQ ID NO: 3331164 - RNA, 14 nt, Mycobacterium tuberculosis H37Rv
cgacgaaccgccag

SEQ ID NO: 3331165 - RNA, 14 nt, Mycobacterium tuberculosis H37Rv
cgacgaacgccguc

SEQ ID NO: 3331166 - RNA, 17 nt, Mycobacterium tuberculosis H37Rv
cgacgaacuccgcguug

SEQ ID NO: 3331167 - RNA, 13 nt, Mycobacterium tuberculosis H37Rv
cgacgaacucgcc

SEQ ID NO: 3331168 - RNA, 16 nt, Mycobacterium tuberculosis H37Rv
cgacgaacucgcccag

SEQ ID NO: 3331169 - RNA, 13 nt, Mycobacterium tuberculosis H37Rv
cgacgaagaucgc

SEQ ID NO: 3331170 - RNA, 23 nt, Mycobacterium tuberculosis H37Rv
cgacgaagaucgcgugccacagc

SEQ ID NO: 3331171 - RNA, 23 nt, Mycobacterium tuberculosis H37Rv
cgacgaagaucuucaccggccgg

SEQ ID NO: 3331172 - RNA, 13 nt, Mycobacterium tuberculosis H37Rv
cgacgaagucgca

SEQ ID NO: 3331173 - RNA, 17 nt, Mycobacterium tuberculosis H37Rv
cgacgaauaccgggaug

SEQ ID NO: 3331174 - RNA, 14 nt, Mycobacterium tuberculosis H37Rv
cgacgaauguccgc

SEQ ID NO: 3331175 - RNA, 16 nt, Mycobacterium tuberculosis H37Rv
cgacgacaacagccag

SEQ ID NO: 3331176 - RNA, 18 nt, Mycobacterium tuberculosis H37Rv
cgacgacaacagccagcu

SEQ ID NO: 3331177 - RNA, 17 nt, Mycobacterium tuberculosis H37Rv
cgacgacaaccggccag

SEQ ID NO: 3331178 - RNA, 19 nt, Mycobacterium tuberculosis H37Rv
cgacgacaaggugugguga

SEQ ID NO: 3331179 - RNA, 12 nt, Mycobacterium tuberculosis H37Rv
cgacgacaccgc

SEQ ID NO: 3331180 - RNA, 14 nt, Mycobacterium tuberculosis H37Rv
cgacgacaccgcgc

SEQ ID NO: 3331181 - RNA, 16 nt, Mycobacterium tuberculosis H37Rv
cgacgacaccgcgcag

SEQ ID NO: 3331182 - RNA, 17 nt, Mycobacterium tuberculosis H37Rv
cgacgacaccgcgcagc

SEQ ID NO: 3331183 - RNA, 21 nt, Mycobacterium tuberculosis H37Rv
cgacgacaccgcgcagcggug

SEQ ID NO: 3331184 - RNA, 19 nt, Mycobacterium tuberculosis H37Rv
cgacgacacgccugggcga

SEQ ID NO: 3331185 - RNA, 22 nt, Mycobacterium tuberculosis H37Rv
cgacgacacguugacgaugugc

SEQ ID NO: 3331186 - RNA, 13 nt, Mycobacterium tuberculosis H37Rv
cgacgacauuggu

SEQ ID NO: 3331187 - RNA, 20 nt, Mycobacterium tuberculosis H37Rv
cgacgacauuggugcugaca

SEQ ID NO: 3331188 - RNA, 19 nt, Mycobacterium tuberculosis H37Rv
cgacgaccacaccacgaug

SEQ ID NO: 3331189 - RNA, 21 nt, Mycobacterium tuberculosis H37Rv
cgacgaccacaccacgauggc

SEQ ID NO: 3331190 - RNA, 12 nt, Mycobacterium tuberculosis H37Rv
cgacgaccaccu

SEQ ID NO: 3331191 - RNA, 15 nt, Mycobacterium tuberculosis H37Rv
cgacgaccaccuucu

SEQ ID NO: 3331192 - RNA, 13 nt, Mycobacterium tuberculosis H37Rv
cgacgaccagcag

SEQ ID NO: 3331193 - RNA, 14 nt, Mycobacterium tuberculosis H37Rv
cgacgaccagcaga

SEQ ID NO: 3331194 - RNA, 19 nt, Mycobacterium tuberculosis H37Rv
cgacgacccgggucggcac

SEQ ID NO: 3331195 - RNA, 21 nt, Mycobacterium tuberculosis H37Rv
cgacgacccgggucggcacga

SEQ ID NO: 3331196 - RNA, 23 nt, Mycobacterium tuberculosis H37Rv
cgacgacccgggucggcacgacc

SEQ ID NO: 3331197 - RNA, 13 nt, Mycobacterium tuberculosis H37Rv
cgacgaccgccug

SEQ ID NO: 3331198 - RNA, 13 nt, Mycobacterium tuberculosis H37Rv
cgacgacgccaau

SEQ ID NO: 3331199 - RNA, 17 nt, Mycobacterium tuberculosis H37Rv
cgacgacgccaaugccg

SEQ ID NO: 3331200 - RNA, 13 nt, Mycobacterium tuberculosis H37Rv
cgacgacgcgcgc

SEQ ID NO: 3331201 - RNA, 13 nt, Mycobacterium tuberculosis H37Rv
cgacgacggcacc

SEQ ID NO: 3331202 - RNA, 14 nt, Mycobacterium tuberculosis H37Rv
cgacgacggccugc

SEQ ID NO: 3331203 - RNA, 18 nt, Mycobacterium tuberculosis H37Rv
cgacgacguccucgacga

SEQ ID NO: 3331204 - RNA, 23 nt, Mycobacterium tuberculosis H37Rv
cgacgacguccucgacgaucagc

SEQ ID NO: 3331205 - RNA, 11 nt, Mycobacterium tuberculosis H37Rv
cgacgacugga

SEQ ID NO: 3331206 - RNA, 22 nt, Mycobacterium tuberculosis H37Rv
cgacgacuggacaggucgccca

SEQ ID NO: 3331207 - RNA, 14 nt, Mycobacterium tuberculosis H37Rv
cgacgacuucgaau

SEQ ID NO: 3331208 - RNA, 22 nt, Mycobacterium tuberculosis H37Rv
cgacgacuucgaaucaggcucc

SEQ ID NO: 3331209 - RNA, 21 nt, Mycobacterium tuberculosis H37Rv
cgacgagauacggccaccagg

SEQ ID NO: 3331210 - RNA, 17 nt, Mycobacterium tuberculosis H37Rv
cgacgagaucagccucg

SEQ ID NO: 3331211 - RNA, 23 nt, Mycobacterium tuberculosis H37Rv
cgacgagaucagccucgcgggca

SEQ ID NO: 3331212 - RNA, 16 nt, Mycobacterium tuberculosis H37Rv
cgacgagauccagcgc

SEQ ID NO: 3331213 - RNA, 13 nt, Mycobacterium tuberculosis H37Rv
cgacgagcaacgc

SEQ ID NO: 3331214 - RNA, 13 nt, Mycobacterium tuberculosis H37Rv
cgacgagcaccau

SEQ ID NO: 3331215 - RNA, 18 nt, Mycobacterium tuberculosis H37Rv
cgacgagcaccgcgccgc

SEQ ID NO: 3331216 - RNA, 14 nt, Mycobacterium tuberculosis H37Rv
cgacgagcgcagcg

SEQ ID NO: 3331217 - RNA, 16 nt, Mycobacterium tuberculosis H37Rv
cgacgagcgcagcgug

SEQ ID NO: 3331218 - RNA, 15 nt, Mycobacterium tuberculosis H37Rv
cgacgagcgccucaa

SEQ ID NO: 3331219 - RNA, 21 nt, Mycobacterium tuberculosis H37Rv
cgacgagcggcuucagcacgu

SEQ ID NO: 3331220 - RNA, 22 nt, Mycobacterium tuberculosis H37Rv
cgacgagcggcuucagcacguu

SEQ ID NO: 3331221 - RNA, 16 nt, Mycobacterium tuberculosis H37Rv
cgacgaggacggcuug

SEQ ID NO: 3331222 - RNA, 16 nt, Mycobacterium tuberculosis H37Rv
cgacgaggcaaugcga

SEQ ID NO: 3331223 - RNA, 18 nt, Mycobacterium tuberculosis H37Rv
cgacgaggccacggggcu

SEQ ID NO: 3331224 - RNA, 12 nt, Mycobacterium tuberculosis H37Rv
cgacgagucgcc

SEQ ID NO: 3331225 - RNA, 22 nt, Mycobacterium tuberculosis H37Rv
cgacgauagcggcccgaucacc

SEQ ID NO: 3331226 - RNA, 19 nt, Mycobacterium tuberculosis H37Rv
cgacgauaucgggagcggc

SEQ ID NO: 3331227 - RNA, 15 nt, Mycobacterium tuberculosis H37Rv
cgacgauccacggcg

SEQ ID NO: 3331228 - RNA, 19 nt, Mycobacterium tuberculosis H37Rv
cgacgauccacggcgaugc

SEQ ID NO: 3331229 - RNA, 17 nt, Mycobacterium tuberculosis H37Rv
cgacgaucucgccggcg

SEQ ID NO: 3331230 - RNA, 23 nt, Mycobacterium tuberculosis H37Rv
cgacgaucucgccggcgaagacc

SEQ ID NO: 3331231 - RNA, 15 nt, Mycobacterium tuberculosis H37Rv
cgacgaucugcagca

SEQ ID NO: 3331232 - RNA, 14 nt, Mycobacterium tuberculosis H37Rv
cgacgaugacgcgc

SEQ ID NO: 3331233 - RNA, 16 nt, Mycobacterium tuberculosis H37Rv
cgacgaugacgcgcga

SEQ ID NO: 3331234 - RNA, 18 nt, Mycobacterium tuberculosis H37Rv
cgacgaugccccgguuga

SEQ ID NO: 3331235 - RNA, 11 nt, Mycobacterium tuberculosis H37Rv
cgacgaugccg

SEQ ID NO: 3331236 - RNA, 17 nt, Mycobacterium tuberculosis H37Rv
cgacgaugccgcgggac

SEQ ID NO: 3331237 - RNA, 15 nt, Mycobacterium tuberculosis H37Rv
cgacgaugcgcacuc

SEQ ID NO: 3331238 - RNA, 20 nt, Mycobacterium tuberculosis H37Rv
cgacgauguaaacaacgcga

SEQ ID NO: 3331239 - RNA, 15 nt, Mycobacterium tuberculosis H37Rv
cgacgaugucgagcg

SEQ ID NO: 3331240 - RNA, 14 nt, Mycobacterium tuberculosis H37Rv
cgacgaugucggca

SEQ ID NO: 3331241 - RNA, 22 nt, Mycobacterium tuberculosis H37Rv
cgacgauuaccagcggcaccgc

SEQ ID NO: 3331242 - RNA, 15 nt, Mycobacterium tuberculosis H37Rv
cgacgcaaagcagcg

SEQ ID NO: 3331243 - RNA, 12 nt, Mycobacterium tuberculosis H37Rv
cgacgcacaccc

SEQ ID NO: 3331244 - RNA, 14 nt, Mycobacterium tuberculosis H37Rv
cgacgcaccaacgc

SEQ ID NO: 3331245 - RNA, 15 nt, Mycobacterium tuberculosis H37Rv
cgacgcacucggggc

SEQ ID NO: 3331246 - RNA, 12 nt, Mycobacterium tuberculosis H37Rv
cgacgcacugcc

SEQ ID NO: 3331247 - RNA, 17 nt, Mycobacterium tuberculosis H37Rv
cgacgcagaccguccag

SEQ ID NO: 3331248 - RNA, 23 nt, Mycobacterium tuberculosis H37Rv
cgacgcagaccguccagcaacag

SEQ ID NO: 3331249 - RNA, 19 nt, Mycobacterium tuberculosis H37Rv
cgacgcagcuugcccgacg

SEQ ID NO: 3331250 - RNA, 22 nt, Mycobacterium tuberculosis H37Rv
cgacgcagcuugcccgacggcg

SEQ ID NO: 3331251 - RNA, 21 nt, Mycobacterium tuberculosis H37Rv
cgacgcaggugaacgccggug

SEQ ID NO: 3331252 - RNA, 16 nt, Mycobacterium tuberculosis H37Rv
cgacgcauaaccggcg

SEQ ID NO: 3331253 - RNA, 21 nt, Mycobacterium tuberculosis H37Rv
cgacgcauuccucgacggugu

SEQ ID NO: 3331254 - RNA, 21 nt, Mycobacterium tuberculosis H37Rv
cgacgccaaugccgcggaggc

SEQ ID NO: 3331255 - RNA, 15 nt, Mycobacterium tuberculosis H37Rv
cgacgccacgcgucu

SEQ ID NO: 3331256 - RNA, 17 nt, Mycobacterium tuberculosis H37Rv
cgacgccagcugcccga

SEQ ID NO: 3331257 - RNA, 22 nt, Mycobacterium tuberculosis H37Rv
cgacgccaucugcuggcuggga

SEQ ID NO: 3331258 - RNA, 23 nt, Mycobacterium tuberculosis H37Rv
cgacgccaucugcuggcugggaa

SEQ ID NO: 3331259 - RNA, 23 nt, Mycobacterium tuberculosis H37Rv
cgacgccaugucgauguccacgc

SEQ ID NO: 3331260 - RNA, 14 nt, Mycobacterium tuberculosis H37Rv
cgacgcccauggcg

SEQ ID NO: 3331261 - RNA, 18 nt, Mycobacterium tuberculosis H37Rv
cgacgcccauggcgucga

SEQ ID NO: 3331262 - RNA, 16 nt, Mycobacterium tuberculosis H37Rv
cgacgccccaggacac

SEQ ID NO: 3331263 - RNA, 18 nt, Mycobacterium tuberculosis H37Rv
cgacgcccgacgaugugc

SEQ ID NO: 3331264 - RNA, 19 nt, Mycobacterium tuberculosis H37Rv
cgacgcccgauacgccacc

SEQ ID NO: 3331265 - RNA, 15 nt, Mycobacterium tuberculosis H37Rv
cgacgcccgcccugg

SEQ ID NO: 3331266 - RNA, 14 nt, Mycobacterium tuberculosis H37Rv
cgacgcccucacaa

SEQ ID NO: 3331267 - RNA, 18 nt, Mycobacterium tuberculosis H37Rv
cgacgcccucacaacgau

SEQ ID NO: 3331268 - RNA, 21 nt, Mycobacterium tuberculosis H37Rv
cgacgccgaaaaugccgccca

SEQ ID NO: 3331269 - RNA, 18 nt, Mycobacterium tuberculosis H37Rv
cgacgccgagaccgccgc

SEQ ID NO: 3331270 - RNA, 20 nt, Mycobacterium tuberculosis H37Rv
cgacgccgagaccgccgcug

SEQ ID NO: 3331271 - RNA, 14 nt, Mycobacterium tuberculosis H37Rv
cgacgccgaucgcg

SEQ ID NO: 3331272 - RNA, 21 nt, Mycobacterium tuberculosis H37Rv
cgacgccgccacccggcgggc

SEQ ID NO: 3331273 - RNA, 22 nt, Mycobacterium tuberculosis H37Rv
cgacgccgccacccggcgggcg

SEQ ID NO: 3331274 - RNA, 23 nt, Mycobacterium tuberculosis H37Rv
cgacgccgccggcgccaccguug

SEQ ID NO: 3331275 - RNA, 13 nt, Mycobacterium tuberculosis H37Rv
cgacgccgcgcag

SEQ ID NO: 3331276 - RNA, 21 nt, Mycobacterium tuberculosis H37Rv
cgacgccgcuggagaucacgc

SEQ ID NO: 3331277 - RNA, 15 nt, Mycobacterium tuberculosis H37Rv
cgacgccggauugcu

SEQ ID NO: 3331278 - RNA, 20 nt, Mycobacterium tuberculosis H37Rv
cgacgccggccagcggccau

SEQ ID NO: 3331279 - RNA, 16 nt, Mycobacterium tuberculosis H37Rv
cgacgccggcccgacg

SEQ ID NO: 3331280 - RNA, 21 nt, Mycobacterium tuberculosis H37Rv
cgacgccggugucggcugguc

SEQ ID NO: 3331281 - RNA, 22 nt, Mycobacterium tuberculosis H37Rv
cgacgccugggcacggccgucg

SEQ ID NO: 3331282 - RNA, 17 nt, Mycobacterium tuberculosis H37Rv
cgacgccuugucggcgu

SEQ ID NO: 3331283 - RNA, 18 nt, Mycobacterium tuberculosis H37Rv
cgacgccuugucggcgug

SEQ ID NO: 3331284 - RNA, 13 nt, Mycobacterium tuberculosis H37Rv
cgacgcgacacgc

SEQ ID NO: 3331285 - RNA, 15 nt, Mycobacterium tuberculosis H37Rv
cgacgcgaccgcgau

SEQ ID NO: 3331286 - RNA, 12 nt, Mycobacterium tuberculosis H37Rv
cgacgcgauggc

SEQ ID NO: 3331287 - RNA, 18 nt, Mycobacterium tuberculosis H37Rv
cgacgcgauggccgccag

SEQ ID NO: 3331288 - RNA, 18 nt, Mycobacterium tuberculosis H37Rv
cgacgcgcggccagccca

SEQ ID NO: 3331289 - RNA, 15 nt, Mycobacterium tuberculosis H37Rv
cgacgcgcucggcga

SEQ ID NO: 3331290 - RNA, 20 nt, Mycobacterium tuberculosis H37Rv
cgacgcgcucggcgaucugc

SEQ ID NO: 3331291 - RNA, 15 nt, Mycobacterium tuberculosis H37Rv
cgacgcgcucgggcg

SEQ ID NO: 3331292 - RNA, 22 nt, Mycobacterium tuberculosis H37Rv
cgacgcgcucgggcgagaucuu

SEQ ID NO: 3331293 - RNA, 14 nt, Mycobacterium tuberculosis H37Rv
cgacgcggcgucgg

SEQ ID NO: 3331294 - RNA, 14 nt, Mycobacterium tuberculosis H37Rv
cgacgcgggcguug

SEQ ID NO: 3331295 - RNA, 23 nt, Mycobacterium tuberculosis H37Rv
cgacgcgggcguugacgaacacc

SEQ ID NO: 3331296 - RNA, 22 nt, Mycobacterium tuberculosis H37Rv
cgacgcggucaucgagcugacc

SEQ ID NO: 3331297 - RNA, 17 nt, Mycobacterium tuberculosis H37Rv
cgacgcguagcacggcg

SEQ ID NO: 3331298 - RNA, 19 nt, Mycobacterium tuberculosis H37Rv
cgacgcguccggugcacca

SEQ ID NO: 3331299 - RNA, 17 nt, Mycobacterium tuberculosis H37Rv
cgacgcgucgccggccg

SEQ ID NO: 3331300 - RNA, 17 nt, Mycobacterium tuberculosis H37Rv
cgacgcgucggcgacgc

SEQ ID NO: 3331301 - RNA, 15 nt, Mycobacterium tuberculosis H37Rv
cgacgcguggcaucc

SEQ ID NO: 3331302 - RNA, 22 nt, Mycobacterium tuberculosis H37Rv
cgacgcguggcauccagcagcg

SEQ ID NO: 3331303 - RNA, 22 nt, Mycobacterium tuberculosis H37Rv
cgacgcuaaauuuugcgccgac

SEQ ID NO: 3331304 - RNA, 17 nt, Mycobacterium tuberculosis H37Rv
cgacgcuaaguccccgc

SEQ ID NO: 3331305 - RNA, 14 nt, Mycobacterium tuberculosis H37Rv
cgacgcuaccgccg

SEQ ID NO: 3331306 - RNA, 17 nt, Mycobacterium tuberculosis H37Rv
cgacgcuaccgccggag

SEQ ID NO: 3331307 - RNA, 21 nt, Mycobacterium tuberculosis H37Rv
cgacgcucgccgagcagacac

SEQ ID NO: 3331308 - RNA, 16 nt, Mycobacterium tuberculosis H37Rv
cgacgcugccgccagg

SEQ ID NO: 3331309 - RNA, 23 nt, Mycobacterium tuberculosis H37Rv
cgacgcugccgccaggcucgagg

SEQ ID NO: 3331310 - RNA, 16 nt, Mycobacterium tuberculosis H37Rv
cgacgcuguggcucga

SEQ ID NO: 3331311 - RNA, 18 nt, Mycobacterium tuberculosis H37Rv
cgacgcuguggcucgacg

SEQ ID NO: 3331312 - RNA, 19 nt, Mycobacterium tuberculosis H37Rv
cgacgcuguggcucgacga

SEQ ID NO: 3331313 - RNA, 23 nt, Mycobacterium tuberculosis H37Rv
cgacgcuguggcucgacgaugcg

SEQ ID NO: 3331314 - RNA, 23 nt, Mycobacterium tuberculosis H37Rv
cgacgcugugggcuuugccgucg

SEQ ID NO: 3331315 - RNA, 17 nt, Mycobacterium tuberculosis H37Rv
cgacgcuuucccgauga

SEQ ID NO: 3331316 - RNA, 18 nt, Mycobacterium tuberculosis H37Rv
cgacgcuuucccgaugac

SEQ ID NO: 3331317 - RNA, 19 nt, Mycobacterium tuberculosis H37Rv
cgacggaaucgucggcgcg

SEQ ID NO: 3331318 - RNA, 16 nt, Mycobacterium tuberculosis H37Rv
cgacggacacccuggg

SEQ ID NO: 3331319 - RNA, 21 nt, Mycobacterium tuberculosis H37Rv
cgacggacucccucgaucacg

SEQ ID NO: 3331320 - RNA, 22 nt, Mycobacterium tuberculosis H37Rv
cgacggacuccggccggccuag

SEQ ID NO: 3331321 - RNA, 13 nt, Mycobacterium tuberculosis H37Rv
cgacggagaucga

SEQ ID NO: 3331322 - RNA, 16 nt, Mycobacterium tuberculosis H37Rv
cgacggaguucgacgu

SEQ ID NO: 3331323 - RNA, 18 nt, Mycobacterium tuberculosis H37Rv
cgacggaucgcccugaca

SEQ ID NO: 3331324 - RNA, 16 nt, Mycobacterium tuberculosis H37Rv
cgacggaugaucagcg

SEQ ID NO: 3331325 - RNA, 23 nt, Mycobacterium tuberculosis H37Rv
cgacggcaagcgcaucgcacagc

SEQ ID NO: 3331326 - RNA, 18 nt, Mycobacterium tuberculosis H37Rv
cgacggcaaugcggggca

SEQ ID NO: 3331327 - RNA, 13 nt, Mycobacterium tuberculosis H37Rv
cgacggcagugcu

SEQ ID NO: 3331328 - RNA, 20 nt, Mycobacterium tuberculosis H37Rv
cgacggcaucaacgcgggcg

SEQ ID NO: 3331329 - RNA, 22 nt, Mycobacterium tuberculosis H37Rv
cgacggcaucaacgcgggcgcu

SEQ ID NO: 3331330 - RNA, 20 nt, Mycobacterium tuberculosis H37Rv
cgacggcauguaccgaccgc

SEQ ID NO: 3331331 - RNA, 21 nt, Mycobacterium tuberculosis H37Rv
cgacggcauguaccgaccgcg

SEQ ID NO: 3331332 - RNA, 13 nt, Mycobacterium tuberculosis H37Rv
cgacggccaagau

SEQ ID NO: 3331333 - RNA, 12 nt, Mycobacterium tuberculosis H37Rv
cgacggccaccc

SEQ ID NO: 3331334 - RNA, 13 nt, Mycobacterium tuberculosis H37Rv
cgacggccacccc

SEQ ID NO: 3331335 - RNA, 15 nt, Mycobacterium tuberculosis H37Rv
cgacggccacggugg

SEQ ID NO: 3331336 - RNA, 19 nt, Mycobacterium tuberculosis H37Rv
cgacggccacgguggagcg

SEQ ID NO: 3331337 - RNA, 21 nt, Mycobacterium tuberculosis H37Rv
cgacggccagcaagacgauga

SEQ ID NO: 3331338 - RNA, 13 nt, Mycobacterium tuberculosis H37Rv
cgacggccagcag

SEQ ID NO: 3331339 - RNA, 15 nt, Mycobacterium tuberculosis H37Rv
cgacggccagcagga

SEQ ID NO: 3331340 - RNA, 15 nt, Mycobacterium tuberculosis H37Rv
cgacggccagcgcgu

SEQ ID NO: 3331341 - RNA, 20 nt, Mycobacterium tuberculosis H37Rv
cgacggccgcucgggccagc

SEQ ID NO: 3331342 - RNA, 16 nt, Mycobacterium tuberculosis H37Rv
cgacggccggcaagca

SEQ ID NO: 3331343 - RNA, 23 nt, Mycobacterium tuberculosis H37Rv
cgacggccuggggcagccgggcg

SEQ ID NO: 3331344 - RNA, 13 nt, Mycobacterium tuberculosis H37Rv
cgacggcgcaugc

SEQ ID NO: 3331345 - RNA, 12 nt, Mycobacterium tuberculosis H37Rv
cgacggcgccca

SEQ ID NO: 3331346 - RNA, 14 nt, Mycobacterium tuberculosis H37Rv
cgacggcgcccagc

SEQ ID NO: 3331347 - RNA, 13 nt, Mycobacterium tuberculosis H37Rv
cgacggcgccgaa

SEQ ID NO: 3331348 - RNA, 14 nt, Mycobacterium tuberculosis H37Rv
cgacggcgccgcuc

SEQ ID NO: 3331349 - RNA, 14 nt, Mycobacterium tuberculosis H37Rv
cgacggcgccggca

SEQ ID NO: 3331350 - RNA, 14 nt, Mycobacterium tuberculosis H37Rv
cgacggcggcgucg

SEQ ID NO: 3331351 - RNA, 15 nt, Mycobacterium tuberculosis H37Rv
cgacggcggcgucga

SEQ ID NO: 3331352 - RNA, 13 nt, Mycobacterium tuberculosis H37Rv
cgacggcggucag

SEQ ID NO: 3331353 - RNA, 13 nt, Mycobacterium tuberculosis H37Rv
cgacggcgucacc

SEQ ID NO: 3331354 - RNA, 17 nt, Mycobacterium tuberculosis H37Rv
cgacggcucuaccgguc

SEQ ID NO: 3331355 - RNA, 12 nt, Mycobacterium tuberculosis H37Rv
cgacggcugacc

SEQ ID NO: 3331356 - RNA, 20 nt, Mycobacterium tuberculosis H37Rv
cgacgggaaccagcggucgg

SEQ ID NO: 3331357 - RNA, 15 nt, Mycobacterium tuberculosis H37Rv
cgacgggaaccucga

SEQ ID NO: 3331358 - RNA, 23 nt, Mycobacterium tuberculosis H37Rv
cgacgggaaccucgaccgucacc

SEQ ID NO: 3331359 - RNA, 18 nt, Mycobacterium tuberculosis H37Rv
cgacgggagcgacgucgg

SEQ ID NO: 3331360 - RNA, 19 nt, Mycobacterium tuberculosis H37Rv
cgacgggcacccgagccgc

SEQ ID NO: 3331361 - RNA, 17 nt, Mycobacterium tuberculosis H37Rv
cgacgggucguucuccg

SEQ ID NO: 3331362 - RNA, 18 nt, Mycobacterium tuberculosis H37Rv
cgacggucaaggugcgcc

SEQ ID NO: 3331363 - RNA, 20 nt, Mycobacterium tuberculosis H37Rv
cgacggucaccggcgcaccg

SEQ ID NO: 3331364 - RNA, 19 nt, Mycobacterium tuberculosis H37Rv
cgacggucagauggccacc

SEQ ID NO: 3331365 - RNA, 22 nt, Mycobacterium tuberculosis H37Rv
cgacggucagauggccacccgc

SEQ ID NO: 3331366 - RNA, 18 nt, Mycobacterium tuberculosis H37Rv
cgacggucagguccuggg

SEQ ID NO: 3331367 - RNA, 20 nt, Mycobacterium tuberculosis H37Rv
cgacggucccggcacgucga

SEQ ID NO: 3331368 - RNA, 18 nt, Mycobacterium tuberculosis H37Rv
cgacggugaccggaucca

SEQ ID NO: 3331369 - RNA, 14 nt, Mycobacterium tuberculosis H37Rv
cgacggugaugggg

SEQ ID NO: 3331370 - RNA, 14 nt, Mycobacterium tuberculosis H37Rv
cgacggugccgucg

SEQ ID NO: 3331371 - RNA, 22 nt, Mycobacterium tuberculosis H37Rv
cgacggugccgucggugccgcg

SEQ ID NO: 3331372 - RNA, 15 nt, Mycobacterium tuberculosis H37Rv
cgacgguguagccca

SEQ ID NO: 3331373 - RNA, 13 nt, Mycobacterium tuberculosis H37Rv
cgacgguguccgg

SEQ ID NO: 3331374 - RNA, 22 nt, Mycobacterium tuberculosis H37Rv
cgacgguuacccagccgugcuu

SEQ ID NO: 3331375 - RNA, 17 nt, Mycobacterium tuberculosis H37Rv
cgacguaccaggguguc

SEQ ID NO: 3331376 - RNA, 21 nt, Mycobacterium tuberculosis H37Rv
cgacguacgaguagugcggug

SEQ ID NO: 3331377 - RNA, 17 nt, Mycobacterium tuberculosis H37Rv
cgacguagacgacgucg

SEQ ID NO: 3331378 - RNA, 20 nt, Mycobacterium tuberculosis H37Rv
cgacguaggccaggucgcca

SEQ ID NO: 3331379 - RNA, 23 nt, Mycobacterium tuberculosis H37Rv
cgacguaguagcgaugcacccca

SEQ ID NO: 3331380 - RNA, 21 nt, Mycobacterium tuberculosis H37Rv
cgacguauaccgcacccuggg

SEQ ID NO: 3331381 - RNA, 20 nt, Mycobacterium tuberculosis H37Rv
cgacgucaggguauccacgc

SEQ ID NO: 3331382 - RNA, 17 nt, Mycobacterium tuberculosis H37Rv
cgacgucaucgccgacc

SEQ ID NO: 3331383 - RNA, 15 nt, Mycobacterium tuberculosis H37Rv
cgacgucaucgucgg

SEQ ID NO: 3331384 - RNA, 14 nt, Mycobacterium tuberculosis H37Rv
cgacguccaccagc

SEQ ID NO: 3331385 - RNA, 18 nt, Mycobacterium tuberculosis H37Rv
cgacguccgaucgguguc

SEQ ID NO: 3331386 - RNA, 24 nt, Mycobacterium tuberculosis H37Rv
cgacguccucgacgaucagcacgu

SEQ ID NO: 3331387 - RNA, 14 nt, Mycobacterium tuberculosis H37Rv
cgacgucgauuucg

SEQ ID NO: 3331388 - RNA, 13 nt, Mycobacterium tuberculosis H37Rv
cgacgucgcccau

SEQ ID NO: 3331389 - RNA, 14 nt, Mycobacterium tuberculosis H37Rv
cgacgucgccgccg

SEQ ID NO: 3331390 - RNA, 16 nt, Mycobacterium tuberculosis H37Rv
cgacgucgcgcaucgc

SEQ ID NO: 3331391 - RNA, 14 nt, Mycobacterium tuberculosis H37Rv
cgacgucgcggcgc

SEQ ID NO: 3331392 - RNA, 19 nt, Mycobacterium tuberculosis H37Rv
cgacgucgcuagaucccag

SEQ ID NO: 3331393 - RNA, 14 nt, Mycobacterium tuberculosis H37Rv
cgacgucggccgca

SEQ ID NO: 3331394 - RNA, 19 nt, Mycobacterium tuberculosis H37Rv
cgacgucggccgcaucgcc

SEQ ID NO: 3331395 - RNA, 22 nt, Mycobacterium tuberculosis H37Rv
cgacgucggccgcaucgcccaa

SEQ ID NO: 3331396 - RNA, 23 nt, Mycobacterium tuberculosis H37Rv
cgacgucggccgcaucgcccaac

SEQ ID NO: 3331397 - RNA, 14 nt, Mycobacterium tuberculosis H37Rv
cgacgucggcggug

SEQ ID NO: 3331398 - RNA, 17 nt, Mycobacterium tuberculosis H37Rv
cgacgucggcuucaccu

SEQ ID NO: 3331399 - RNA, 12 nt, Mycobacterium tuberculosis H37Rv
cgacgucgguga

SEQ ID NO: 3331400 - RNA, 17 nt, Mycobacterium tuberculosis H37Rv
cgacgucggugaccucg

SEQ ID NO: 3331401 - RNA, 22 nt, Mycobacterium tuberculosis H37Rv
cgacgucguagaccuccagugc

SEQ ID NO: 3331402 - RNA, 18 nt, Mycobacterium tuberculosis H37Rv
cgacgucgucgucgacgg

SEQ ID NO: 3331403 - RNA, 14 nt, Mycobacterium tuberculosis H37Rv
cgacgucguuacug

SEQ ID NO: 3331404 - RNA, 20 nt, Mycobacterium tuberculosis H37Rv
cgacgucucgcaugcucacg

SEQ ID NO: 3331405 - RNA, 22 nt, Mycobacterium tuberculosis H37Rv
cgacgucugccaggcgcagcug

SEQ ID NO: 3331406 - RNA, 14 nt, Mycobacterium tuberculosis H37Rv
cgacgucugccauc

SEQ ID NO: 3331407 - RNA, 12 nt, Mycobacterium tuberculosis H37Rv
cgacgucugccc

SEQ ID NO: 3331408 - RNA, 21 nt, Mycobacterium tuberculosis H37Rv
cgacgucuucgaccucaccca

SEQ ID NO: 3331409 - RNA, 23 nt, Mycobacterium tuberculosis H37Rv
cgacgugauggugacuucggugg

SEQ ID NO: 3331410 - RNA, 14 nt, Mycobacterium tuberculosis H37Rv
cgacgugcgcggca

SEQ ID NO: 3331411 - RNA, 15 nt, Mycobacterium tuberculosis H37Rv
cgacguggauggugg

SEQ ID NO: 3331412 - RNA, 19 nt, Mycobacterium tuberculosis H37Rv
cgacguggccagcccgccc

SEQ ID NO: 3331413 - RNA, 15 nt, Mycobacterium tuberculosis H37Rv
cgacguggccgacgu

SEQ ID NO: 3331414 - RNA, 23 nt, Mycobacterium tuberculosis H37Rv
cgacguggcugcguucgccggaa

SEQ ID NO: 3331415 - RNA, 24 nt, Mycobacterium tuberculosis H37Rv
cgacguggcugcguucgccggaau

SEQ ID NO: 3331416 - RNA, 17 nt, Mycobacterium tuberculosis H37Rv
cgacgugguugccccgc

SEQ ID NO: 3331417 - RNA, 15 nt, Mycobacterium tuberculosis H37Rv
cgacgugugccgucc

SEQ ID NO: 3331418 - RNA, 19 nt, Mycobacterium tuberculosis H37Rv
cgacguguugcacguacgg

SEQ ID NO: 3331419 - RNA, 21 nt, Mycobacterium tuberculosis H37Rv
cgacguguugcacguacgggc

SEQ ID NO: 3331420 - RNA, 13 nt, Mycobacterium tuberculosis H37Rv
cgacguuaacugc

SEQ ID NO: 3331421 - RNA, 15 nt, Mycobacterium tuberculosis H37Rv
cgacguuccagcagu

SEQ ID NO: 3331422 - RNA, 15 nt, Mycobacterium tuberculosis H37Rv
cgacguuccgcucga

SEQ ID NO: 3331423 - RNA, 16 nt, Mycobacterium tuberculosis H37Rv
cgacguucgacgacag

SEQ ID NO: 3331424 - RNA, 13 nt, Mycobacterium tuberculosis H37Rv
cgacguucggguc

SEQ ID NO: 3331425 - RNA, 14 nt, Mycobacterium tuberculosis H37Rv
cgacguucgguggc

SEQ ID NO: 3331426 - RNA, 23 nt, Mycobacterium tuberculosis H37Rv
cgacguugaagccgccggaguug

SEQ ID NO: 3331427 - RNA, 16 nt, Mycobacterium tuberculosis H37Rv
cgacguugaucgccau

SEQ ID NO: 3331428 - RNA, 15 nt, Mycobacterium tuberculosis H37Rv
cgacguugcggacgg

SEQ ID NO: 3331429 - RNA, 16 nt, Mycobacterium tuberculosis H37Rv
cgacguugcguagcag

SEQ ID NO: 3331430 - RNA, 17 nt, Mycobacterium tuberculosis H37Rv
cgacguuggcgggagca

SEQ ID NO: 3331431 - RNA, 21 nt, Mycobacterium tuberculosis H37Rv
cgacguuguuuuugcacugaa

SEQ ID NO: 3331432 - RNA, 13 nt, Mycobacterium tuberculosis H37Rv
cgacuaccaucgc

SEQ ID NO: 3331433 - RNA, 19 nt, Mycobacterium tuberculosis H37Rv
cgacuacccagccagccgc

SEQ ID NO: 3331434 - RNA, 12 nt, Mycobacterium tuberculosis H37Rv
cgacuacggccu

SEQ ID NO: 3331435 - RNA, 14 nt, Mycobacterium tuberculosis H37Rv
cgacuagacgccgc

SEQ ID NO: 3331436 - RNA, 19 nt, Mycobacterium tuberculosis H37Rv
cgacuagacgccgccgcug

SEQ ID NO: 3331437 - RNA, 21 nt, Mycobacterium tuberculosis H37Rv
cgacucacccacccgcaccgc

SEQ ID NO: 3331438 - RNA, 17 nt, Mycobacterium tuberculosis H37Rv
cgacucagcccggcacu

SEQ ID NO: 3331439 - RNA, 17 nt, Mycobacterium tuberculosis H37Rv
cgacucaguucugcaca

SEQ ID NO: 3331440 - RNA, 21 nt, Mycobacterium tuberculosis H37Rv
cgacucaucggccgcggucgg

SEQ ID NO: 3331441 - RNA, 18 nt, Mycobacterium tuberculosis H37Rv
cgacuccaccccacccag

SEQ ID NO: 3331442 - RNA, 23 nt, Mycobacterium tuberculosis H37Rv
cgacuccggcaggcccgacggcg

SEQ ID NO: 3331443 - RNA, 19 nt, Mycobacterium tuberculosis H37Rv
cgacucgccacauuucacc

SEQ ID NO: 3331444 - RNA, 22 nt, Mycobacterium tuberculosis H37Rv
cgacucgccggcgaauccgcac

SEQ ID NO: 3331445 - RNA, 14 nt, Mycobacterium tuberculosis H37Rv
cgacucggcaccgc

SEQ ID NO: 3331446 - RNA, 14 nt, Mycobacterium tuberculosis H37Rv
cgacucucaucgac

SEQ ID NO: 3331447 - RNA, 19 nt, Mycobacterium tuberculosis H37Rv
cgacucugcgucugcucac

SEQ ID NO: 3331448 - RNA, 20 nt, Mycobacterium tuberculosis H37Rv
cgacucugcgucugcucacc

SEQ ID NO: 3331449 - RNA, 23 nt, Mycobacterium tuberculosis H37Rv
cgacucugugacgggcacaacca

SEQ ID NO: 3331450 - RNA, 19 nt, Mycobacterium tuberculosis H37Rv
cgacugacgaguccgugga

SEQ ID NO: 3331451 - RNA, 13 nt, Mycobacterium tuberculosis H37Rv
cgacugagaucgc

SEQ ID NO: 3331452 - RNA, 12 nt, Mycobacterium tuberculosis H37Rv
cgacugaucgcc

SEQ ID NO: 3331453 - RNA, 16 nt, Mycobacterium tuberculosis H37Rv
cgacugaucgccaccc

SEQ ID NO: 3331454 - RNA, 23 nt, Mycobacterium tuberculosis H37Rv
cgacugcagaaacagccgcagcg

SEQ ID NO: 3331455 - RNA, 18 nt, Mycobacterium tuberculosis H37Rv
cgacugccgcgggcagcg

SEQ ID NO: 3331456 - RNA, 18 nt, Mycobacterium tuberculosis H37Rv
cgacugcgaaugcugggc

SEQ ID NO: 3331457 - RNA, 18 nt, Mycobacterium tuberculosis H37Rv
cgacugcgcaccuggguc

SEQ ID NO: 3331458 - RNA, 17 nt, Mycobacterium tuberculosis H37Rv
cgacugcgucggcggcu

SEQ ID NO: 3331459 - RNA, 20 nt, Mycobacterium tuberculosis H37Rv
cgacugcguuccgaucggca

SEQ ID NO: 3331460 - RNA, 16 nt, Mycobacterium tuberculosis H37Rv
cgacugcugucaccgc

SEQ ID NO: 3331461 - RNA, 19 nt, Mycobacterium tuberculosis H37Rv
cgacuggaucgcgauggcc

SEQ ID NO: 3331462 - RNA, 13 nt, Mycobacterium tuberculosis H37Rv
cgacuggccccgc

SEQ ID NO: 3331463 - RNA, 17 nt, Mycobacterium tuberculosis H37Rv
cgacuggccccgccagc

SEQ ID NO: 3331464 - RNA, 21 nt, Mycobacterium tuberculosis H37Rv
cgacuggccccgccagcggca

SEQ ID NO: 3331465 - RNA, 15 nt, Mycobacterium tuberculosis H37Rv
cgacuggcgcccagc

SEQ ID NO: 3331466 - RNA, 14 nt, Mycobacterium tuberculosis H37Rv
cgacugggcgccca

SEQ ID NO: 3331467 - RNA, 23 nt, Mycobacterium tuberculosis H37Rv
cgacuguacaccgacacgccguu

SEQ ID NO: 3331468 - RNA, 16 nt, Mycobacterium tuberculosis H37Rv
cgacugucccagcucc

SEQ ID NO: 3331469 - RNA, 16 nt, Mycobacterium tuberculosis H37Rv
cgacugucccgcgcaa

SEQ ID NO: 3331470 - RNA, 17 nt, Mycobacterium tuberculosis H37Rv
cgacuguggcgccgccg

SEQ ID NO: 3331471 - RNA, 19 nt, Mycobacterium tuberculosis H37Rv
cgacuguggcgccgccggc

SEQ ID NO: 3331472 - RNA, 22 nt, Mycobacterium tuberculosis H37Rv
cgacuguggcgccgccggcacc

SEQ ID NO: 3331473 - RNA, 12 nt, Mycobacterium tuberculosis H37Rv
cgacuucgaugg

SEQ ID NO: 3331474 - RNA, 17 nt, Mycobacterium tuberculosis H37Rv
cgacuucuccaggcuga

SEQ ID NO: 3331475 - RNA, 12 nt, Mycobacterium tuberculosis H37Rv
cgacuugccgcc

SEQ ID NO: 3331476 - RNA, 19 nt, Mycobacterium tuberculosis H37Rv
cgacuugcggugcucacca

SEQ ID NO: 3331477 - RNA, 14 nt, Mycobacterium tuberculosis H37Rv
cgacuuggcaucgc

SEQ ID NO: 3331478 - RNA, 17 nt, Mycobacterium tuberculosis H37Rv
cgacuuggugacaccga

SEQ ID NO: 3331479 - RNA, 18 nt, Mycobacterium tuberculosis H37Rv
cgacuuggugacaccgag

SEQ ID NO: 3331480 - RNA, 17 nt, Mycobacterium tuberculosis H37Rv
cgacuuguacgcaucgc

SEQ ID NO: 3331481 - RNA, 12 nt, Mycobacterium tuberculosis H37Rv
cgacuugucgcc

SEQ ID NO: 3331482 - RNA, 16 nt, Mycobacterium tuberculosis H37Rv
cgacuugucgccguug

SEQ ID NO: 3331483 - RNA, 17 nt, Mycobacterium tuberculosis H37Rv
cgacuugugacggucgu

SEQ ID NO: 3331484 - RNA, 17 nt, Mycobacterium tuberculosis H37Rv
cgacuuguugggcgcga

SEQ ID NO: 3331485 - RNA, 23 nt, Mycobacterium tuberculosis H37Rv
cgacuuugagucguuggacggca

SEQ ID NO: 3331486 - RNA, 23 nt, Mycobacterium tuberculosis H37Rv
cgagaaaaugacccacacaccga

SEQ ID NO: 3331487 - RNA, 20 nt, Mycobacterium tuberculosis H37Rv
cgagaaacacgacagccagu

SEQ ID NO: 3331488 - RNA, 18 nt, Mycobacterium tuberculosis H37Rv
cgagaacaccggccaaca

SEQ ID NO: 3331489 - RNA, 23 nt, Mycobacterium tuberculosis H37Rv
cgagaacaccggccaacagucgc

SEQ ID NO: 3331490 - RNA, 18 nt, Mycobacterium tuberculosis H37Rv
cgagaacccacgcaugca

SEQ ID NO: 3331491 - RNA, 15 nt, Mycobacterium tuberculosis H37Rv
cgagaacgcccgcug

SEQ ID NO: 3331492 - RNA, 16 nt, Mycobacterium tuberculosis H37Rv
cgagaagacaccgcgc

SEQ ID NO: 3331493 - RNA, 13 nt, Mycobacterium tuberculosis H37Rv
cgagaagaucucg

SEQ ID NO: 3331494 - RNA, 14 nt, Mycobacterium tuberculosis H37Rv
cgagaagcugugcc

SEQ ID NO: 3331495 - RNA, 20 nt, Mycobacterium tuberculosis H37Rv
cgagaauuccccagccgcau

SEQ ID NO: 3331496 - RNA, 18 nt, Mycobacterium tuberculosis H37Rv
cgagaccaacgcgcaggc

SEQ ID NO: 3331497 - RNA, 19 nt, Mycobacterium tuberculosis H37Rv
cgagaccgccgcugccgcc

SEQ ID NO: 3331498 - RNA, 15 nt, Mycobacterium tuberculosis H37Rv
cgagaccggcaccgg

SEQ ID NO: 3331499 - RNA, 21 nt, Mycobacterium tuberculosis H37Rv
cgagaccucucugcgccaggc

SEQ ID NO: 3331500 - RNA, 23 nt, Mycobacterium tuberculosis H37Rv
cgagaccucucugcgccaggcgg

SEQ ID NO: 3331501 - RNA, 16 nt, Mycobacterium tuberculosis H37Rv
cgagacgcacggccac

SEQ ID NO: 3331502 - RNA, 23 nt, Mycobacterium tuberculosis H37Rv
cgagacgcacggccaccgcgcaa

SEQ ID NO: 3331503 - RNA, 12 nt, Mycobacterium tuberculosis H37Rv
cgagacgcucca

SEQ ID NO: 3331504 - RNA, 14 nt, Mycobacterium tuberculosis H37Rv
cgagacggcgucgg

SEQ ID NO: 3331505 - RNA, 13 nt, Mycobacterium tuberculosis H37Rv
cgagacggcguug

SEQ ID NO: 3331506 - RNA, 19 nt, Mycobacterium tuberculosis H37Rv
cgagacgguguugccuagg

SEQ ID NO: 3331507 - RNA, 16 nt, Mycobacterium tuberculosis H37Rv
cgagacuucgguguag

SEQ ID NO: 3331508 - RNA, 19 nt, Mycobacterium tuberculosis H37Rv
cgagacuuggugauccgag

SEQ ID NO: 3331509 - RNA, 14 nt, Mycobacterium tuberculosis H37Rv
cgagagcagccagc

SEQ ID NO: 3331510 - RNA, 16 nt, Mycobacterium tuberculosis H37Rv
cgagagcagccagcca

SEQ ID NO: 3331511 - RNA, 19 nt, Mycobacterium tuberculosis H37Rv
cgagagcagccagccaccg

SEQ ID NO: 3331512 - RNA, 21 nt, Mycobacterium tuberculosis H37Rv
cgagagcagccagccaccgau

SEQ ID NO: 3331513 - RNA, 17 nt, Mycobacterium tuberculosis H37Rv
cgagagccccgaccagc

SEQ ID NO: 3331514 - RNA, 20 nt, Mycobacterium tuberculosis H37Rv
cgagagccccgaccagcaga

SEQ ID NO: 3331515 - RNA, 22 nt, Mycobacterium tuberculosis H37Rv
cgagagccccgaccagcagacc

SEQ ID NO: 3331516 - RNA, 23 nt, Mycobacterium tuberculosis H37Rv
cgagagccccgaccagcagacca

SEQ ID NO: 3331517 - RNA, 22 nt, Mycobacterium tuberculosis H37Rv
cgagaggagggcggccgcggug

SEQ ID NO: 3331518 - RNA, 22 nt, Mycobacterium tuberculosis H37Rv
cgagagggcggggcagaagucg

SEQ ID NO: 3331519 - RNA, 16 nt, Mycobacterium tuberculosis H37Rv
cgagauacggccacca

SEQ ID NO: 3331520 - RNA, 17 nt, Mycobacterium tuberculosis H37Rv
cgagaucaccgccacca

SEQ ID NO: 3331521 - RNA, 13 nt, Mycobacterium tuberculosis H37Rv
cgagaucaccggu

SEQ ID NO: 3331522 - RNA, 16 nt, Mycobacterium tuberculosis H37Rv
cgagaucagcaugccc

SEQ ID NO: 3331523 - RNA, 16 nt, Mycobacterium tuberculosis H37Rv
cgagaucagccucgcg

SEQ ID NO: 3331524 - RNA, 23 nt, Mycobacterium tuberculosis H37Rv
cgagaucagccucgcgggcaggg

SEQ ID NO: 3331525 - RNA, 24 nt, Mycobacterium tuberculosis H37Rv
cgagaucccagcgggacaaaauca

SEQ ID NO: 3331526 - RNA, 15 nt, Mycobacterium tuberculosis H37Rv
cgagauccucgucga

SEQ ID NO: 3331527 - RNA, 17 nt, Mycobacterium tuberculosis H37Rv
cgagauccuucgcguug

SEQ ID NO: 3331528 - RNA, 15 nt, Mycobacterium tuberculosis H37Rv
cgagaucgccgagca

SEQ ID NO: 3331529 - RNA, 18 nt, Mycobacterium tuberculosis H37Rv
cgagaucgcgugcgacga

SEQ ID NO: 3331530 - RNA, 16 nt, Mycobacterium tuberculosis H37Rv
cgagaucugcgauggg

SEQ ID NO: 3331531 - RNA, 14 nt, Mycobacterium tuberculosis H37Rv
cgagaugccaucgg

SEQ ID NO: 3331532 - RNA, 18 nt, Mycobacterium tuberculosis H37Rv
cgagaugccaucggugau

SEQ ID NO: 3331533 - RNA, 20 nt, Mycobacterium tuberculosis H37Rv
cgagaugccaucggugauga

SEQ ID NO: 3331534 - RNA, 13 nt, Mycobacterium tuberculosis H37Rv
cgagaugccgcga

SEQ ID NO: 3331535 - RNA, 22 nt, Mycobacterium tuberculosis H37Rv
cgagaugccgcgaucgugcagg

SEQ ID NO: 3331536 - RNA, 15 nt, Mycobacterium tuberculosis H37Rv
cgagaugcugcaccc

SEQ ID NO: 3331537 - RNA, 22 nt, Mycobacterium tuberculosis H37Rv
cgagauggaauggcugagcccg

SEQ ID NO: 3331538 - RNA, 23 nt, Mycobacterium tuberculosis H37Rv
cgagauggcgaucaugagcagca

SEQ ID NO: 3331539 - RNA, 21 nt, Mycobacterium tuberculosis H37Rv
cgagauucuccugaguugcgg

SEQ ID NO: 3331540 - RNA, 18 nt, Mycobacterium tuberculosis H37Rv
cgagauugccgggccgcc

SEQ ID NO: 3331541 - RNA, 13 nt, Mycobacterium tuberculosis H37Rv
cgagauuggugca

SEQ ID NO: 3331542 - RNA, 21 nt, Mycobacterium tuberculosis H37Rv
cgagcaacucguccagcagug

SEQ ID NO: 3331543 - RNA, 16 nt, Mycobacterium tuberculosis H37Rv
cgagcacaagauccgc

SEQ ID NO: 3331544 - RNA, 23 nt, Mycobacterium tuberculosis H37Rv
cgagcacacaacacccaacgcaa

SEQ ID NO: 3331545 - RNA, 18 nt, Mycobacterium tuberculosis H37Rv
cgagcacaggaucaccca

SEQ ID NO: 3331546 - RNA, 17 nt, Mycobacterium tuberculosis H37Rv
cgagcacaugcucgacg

SEQ ID NO: 3331547 - RNA, 15 nt, Mycobacterium tuberculosis H37Rv
cgagcacaugcugcc

SEQ ID NO: 3331548 - RNA, 18 nt, Mycobacterium tuberculosis H37Rv
cgagcacaugcugccgcu

SEQ ID NO: 3331549 - RNA, 12 nt, Mycobacterium tuberculosis H37Rv
cgagcaccaccc

SEQ ID NO: 3331550 - RNA, 22 nt, Mycobacterium tuberculosis H37Rv
cgagcaccacccgggccucggc

SEQ ID NO: 3331551 - RNA, 15 nt, Mycobacterium tuberculosis H37Rv
cgagcaccccagggg

SEQ ID NO: 3331552 - RNA, 16 nt, Mycobacterium tuberculosis H37Rv
cgagcacccgcaaugc

SEQ ID NO: 3331553 - RNA, 15 nt, Mycobacterium tuberculosis H37Rv
cgagcacccgcucca

SEQ ID NO: 3331554 - RNA, 13 nt, Mycobacterium tuberculosis H37Rv
cgagcacccgcug

SEQ ID NO: 3331555 - RNA, 21 nt, Mycobacterium tuberculosis H37Rv
cgagcacccgcuggucgagca

SEQ ID NO: 3331556 - RNA, 15 nt, Mycobacterium tuberculosis H37Rv
cgagcaccgacaccg

SEQ ID NO: 3331557 - RNA, 18 nt, Mycobacterium tuberculosis H37Rv
cgagcaccgacaccggcc

SEQ ID NO: 3331558 - RNA, 18 nt, Mycobacterium tuberculosis H37Rv
cgagcaccgcaaccacgc

SEQ ID NO: 3331559 - RNA, 16 nt, Mycobacterium tuberculosis H37Rv
cgagcaccggcugcgg

SEQ ID NO: 3331560 - RNA, 16 nt, Mycobacterium tuberculosis H37Rv
cgagcaccuccacugg

SEQ ID NO: 3331561 - RNA, 17 nt, Mycobacterium tuberculosis H37Rv
cgagcaccucggccucg

SEQ ID NO: 3331562 - RNA, 21 nt, Mycobacterium tuberculosis H37Rv
cgagcaccucggccucgucgu

SEQ ID NO: 3331563 - RNA, 22 nt, Mycobacterium tuberculosis H37Rv
cgagcaccuugcgauugcgcac

SEQ ID NO: 3331564 - RNA, 18 nt, Mycobacterium tuberculosis H37Rv
cgagcacgcugcugcggg

SEQ ID NO: 3331565 - RNA, 14 nt, Mycobacterium tuberculosis H37Rv
cgagcacucggcca

SEQ ID NO: 3331566 - RNA, 15 nt, Mycobacterium tuberculosis H37Rv
cgagcacucggccac

SEQ ID NO: 3331567 - RNA, 20 nt, Mycobacterium tuberculosis H37Rv
cgagcacucggccacgacga

SEQ ID NO: 3331568 - RNA, 22 nt, Mycobacterium tuberculosis H37Rv
cgagcacucggccacgacgacu

SEQ ID NO: 3331569 - RNA, 20 nt, Mycobacterium tuberculosis H37Rv
cgagcacugaggagaugagc

SEQ ID NO: 3331570 - RNA, 16 nt, Mycobacterium tuberculosis H37Rv
cgagcagaaacaacgu

SEQ ID NO: 3331571 - RNA, 18 nt, Mycobacterium tuberculosis H37Rv
cgagcagacgcaaaaucg

SEQ ID NO: 3331572 - RNA, 15 nt, Mycobacterium tuberculosis H37Rv
cgagcagacgcagaa

SEQ ID NO: 3331573 - RNA, 19 nt, Mycobacterium tuberculosis H37Rv
cgagcagacgcagaaucgc

SEQ ID NO: 3331574 - RNA, 14 nt, Mycobacterium tuberculosis H37Rv
cgagcagacgccgc

SEQ ID NO: 3331575 - RNA, 17 nt, Mycobacterium tuberculosis H37Rv
cgagcagacgccgcguu

SEQ ID NO: 3331576 - RNA, 13 nt, Mycobacterium tuberculosis H37Rv
cgagcagacgcga

SEQ ID NO: 3331577 - RNA, 19 nt, Mycobacterium tuberculosis H37Rv
cgagcagacgcgaaauccc

SEQ ID NO: 3331578 - RNA, 16 nt, Mycobacterium tuberculosis H37Rv
cgagcagacgcggaau

SEQ ID NO: 3331579 - RNA, 18 nt, Mycobacterium tuberculosis H37Rv
cgagcagacgcggaaucg

SEQ ID NO: 3331580 - RNA, 19 nt, Mycobacterium tuberculosis H37Rv
cgagcagacgcggaaucgc

SEQ ID NO: 3331581 - RNA, 20 nt, Mycobacterium tuberculosis H37Rv
cgagcagacgcggaaucgca

SEQ ID NO: 3331582 - RNA, 22 nt, Mycobacterium tuberculosis H37Rv
cgagcagagaacuccgccacca

SEQ ID NO: 3331583 - RNA, 14 nt, Mycobacterium tuberculosis H37Rv
cgagcagaggauca

SEQ ID NO: 3331584 - RNA, 14 nt, Mycobacterium tuberculosis H37Rv
cgagcagauacucc

SEQ ID NO: 3331585 - RNA, 16 nt, Mycobacterium tuberculosis H37Rv
cgagcagauacuccgc

SEQ ID NO: 3331586 - RNA, 10 nt, Mycobacterium tuberculosis H37Rv
cgagcagcaa

SEQ ID NO: 3331587 - RNA, 17 nt, Mycobacterium tuberculosis H37Rv
cgagcagcaccacccgc

SEQ ID NO: 3331588 - RNA, 18 nt, Mycobacterium tuberculosis H37Rv
cgagcagcagaaacggcg

SEQ ID NO: 3331589 - RNA, 12 nt, Mycobacterium tuberculosis H37Rv
cgagcagcaggu

SEQ ID NO: 3331590 - RNA, 13 nt, Mycobacterium tuberculosis H37Rv
cgagcagcaggua

SEQ ID NO: 3331591 - RNA, 14 nt, Mycobacterium tuberculosis H37Rv
cgagcagcccggcg

SEQ ID NO: 3331592 - RNA, 15 nt, Mycobacterium tuberculosis H37Rv
cgagcagccgaugcu

SEQ ID NO: 3331593 - RNA, 17 nt, Mycobacterium tuberculosis H37Rv
cgagcagccgaugcugc

SEQ ID NO: 3331594 - RNA, 20 nt, Mycobacterium tuberculosis H37Rv
cgagcagccgaugcugcggg

SEQ ID NO: 3331595 - RNA, 13 nt, Mycobacterium tuberculosis H37Rv
cgagcagcuacag

SEQ ID NO: 3331596 - RNA, 21 nt, Mycobacterium tuberculosis H37Rv
cgagcagcuagcccggcagca

SEQ ID NO: 3331597 - RNA, 22 nt, Mycobacterium tuberculosis H37Rv
cgagcagcuccuugaggucacc

SEQ ID NO: 3331598 - RNA, 23 nt, Mycobacterium tuberculosis H37Rv
cgagcagcuccuugaggucaccc

SEQ ID NO: 3331599 - RNA, 13 nt, Mycobacterium tuberculosis H37Rv
cgagcaggcuggc

SEQ ID NO: 3331600 - RNA, 18 nt, Mycobacterium tuberculosis H37Rv
cgagcaggcuggcugcca

SEQ ID NO: 3331601 - RNA, 17 nt, Mycobacterium tuberculosis H37Rv
cgagcagggccggcacc

SEQ ID NO: 3331602 - RNA, 18 nt, Mycobacterium tuberculosis H37Rv
cgagcagggccggcaccg

SEQ ID NO: 3331603 - RNA, 19 nt, Mycobacterium tuberculosis H37Rv
cgagcagggccggcaccgc

SEQ ID NO: 3331604 - RNA, 15 nt, Mycobacterium tuberculosis H37Rv
cgagcagggugacca

SEQ ID NO: 3331605 - RNA, 20 nt, Mycobacterium tuberculosis H37Rv
cgagcagguguugcacgagc

SEQ ID NO: 3331606 - RNA, 19 nt, Mycobacterium tuberculosis H37Rv
cgagcagguuccgcacgau

SEQ ID NO: 3331607 - RNA, 21 nt, Mycobacterium tuberculosis H37Rv
cgagcagguuccgcacgauca

SEQ ID NO: 3331608 - RNA, 17 nt, Mycobacterium tuberculosis H37Rv
cgagcagugaccgcugg

SEQ ID NO: 3331609 - RNA, 16 nt, Mycobacterium tuberculosis H37Rv
cgagcagugccgugcg

SEQ ID NO: 3331610 - RNA, 18 nt, Mycobacterium tuberculosis H37Rv
cgagcagugccucggcga

SEQ ID NO: 3331611 - RNA, 17 nt, Mycobacterium tuberculosis H37Rv
cgagcaguuccagcucg

SEQ ID NO: 3331612 - RNA, 20 nt, Mycobacterium tuberculosis H37Rv
cgagcaguuccagcucgcgg

SEQ ID NO: 3331613 - RNA, 23 nt, Mycobacterium tuberculosis H37Rv
cgagcaguuccagcucgcggugg

SEQ ID NO: 3331614 - RNA, 17 nt, Mycobacterium tuberculosis H37Rv
cgagcauaccgccgcug

SEQ ID NO: 3331615 - RNA, 19 nt, Mycobacterium tuberculosis H37Rv
cgagcauaccgccgcugcc

SEQ ID NO: 3331616 - RNA, 22 nt, Mycobacterium tuberculosis H37Rv
cgagcaucaacgaaccagcuug

SEQ ID NO: 3331617 - RNA, 16 nt, Mycobacterium tuberculosis H37Rv
cgagcaucagauucgc

SEQ ID NO: 3331618 - RNA, 17 nt, Mycobacterium tuberculosis H37Rv
cgagcauccgacacugc

SEQ ID NO: 3331619 - RNA, 19 nt, Mycobacterium tuberculosis H37Rv
cgagcauccgacacugcgg

SEQ ID NO: 3331620 - RNA, 15 nt, Mycobacterium tuberculosis H37Rv
cgagcaucgacgaac

SEQ ID NO: 3331621 - RNA, 15 nt, Mycobacterium tuberculosis H37Rv
cgagcaucucgucgg

SEQ ID NO: 3331622 - RNA, 16 nt, Mycobacterium tuberculosis H37Rv
cgagcaucucgucguc

SEQ ID NO: 3331623 - RNA, 19 nt, Mycobacterium tuberculosis H37Rv
cgagcaugauguccuccca

SEQ ID NO: 3331624 - RNA, 19 nt, Mycobacterium tuberculosis H37Rv
cgagcaugccguugacaac

SEQ ID NO: 3331625 - RNA, 17 nt, Mycobacterium tuberculosis H37Rv
cgagccaacgcgcagag

SEQ ID NO: 3331626 - RNA, 21 nt, Mycobacterium tuberculosis H37Rv
cgagccaacuccacccaacgc

SEQ ID NO: 3331627 - RNA, 22 nt, Mycobacterium tuberculosis H37Rv
cgagccacaugaccugauccgg

SEQ ID NO: 3331628 - RNA, 15 nt, Mycobacterium tuberculosis H37Rv
cgagccacgccagcg

SEQ ID NO: 3331629 - RNA, 19 nt, Mycobacterium tuberculosis H37Rv
cgagccacgccagcgucga

SEQ ID NO: 3331630 - RNA, 15 nt, Mycobacterium tuberculosis H37Rv
cgagccagcacccgc

SEQ ID NO: 3331631 - RNA, 13 nt, Mycobacterium tuberculosis H37Rv
cgagccagcggag

SEQ ID NO: 3331632 - RNA, 14 nt, Mycobacterium tuberculosis H37Rv
cgagccagcuccgg

SEQ ID NO: 3331633 - RNA, 18 nt, Mycobacterium tuberculosis H37Rv
cgagccagcuccggcgcu

SEQ ID NO: 3331634 - RNA, 16 nt, Mycobacterium tuberculosis H37Rv
cgagccagcuccggua

SEQ ID NO: 3331635 - RNA, 21 nt, Mycobacterium tuberculosis H37Rv
cgagccagcugcuccacccga

SEQ ID NO: 3331636 - RNA, 16 nt, Mycobacterium tuberculosis H37Rv
cgagccaucgucgagc

SEQ ID NO: 3331637 - RNA, 15 nt, Mycobacterium tuberculosis H37Rv
cgagcccaccgucgc

SEQ ID NO: 3331638 - RNA, 14 nt, Mycobacterium tuberculosis H37Rv
cgagcccaccuggg

SEQ ID NO: 3331639 - RNA, 16 nt, Mycobacterium tuberculosis H37Rv
cgagcccagccgggca

SEQ ID NO: 3331640 - RNA, 13 nt, Mycobacterium tuberculosis H37Rv
cgagcccagcugc

SEQ ID NO: 3331641 - RNA, 14 nt, Mycobacterium tuberculosis H37Rv
cgagcccgaaccac

SEQ ID NO: 3331642 - RNA, 17 nt, Mycobacterium tuberculosis H37Rv
cgagcccgaaccaccgc

SEQ ID NO: 3331643 - RNA, 21 nt, Mycobacterium tuberculosis H37Rv
cgagcccgaaccaccgcguug

SEQ ID NO: 3331644 - RNA, 18 nt, Mycobacterium tuberculosis H37Rv
cgagcccgaaggcggcuc

SEQ ID NO: 3331645 - RNA, 22 nt, Mycobacterium tuberculosis H37Rv
cgagcccgaugguggugccgac

SEQ ID NO: 3331646 - RNA, 15 nt, Mycobacterium tuberculosis H37Rv
cgagcccgcaucgca

SEQ ID NO: 3331647 - RNA, 17 nt, Mycobacterium tuberculosis H37Rv
cgagcccgccacagccc

SEQ ID NO: 3331648 - RNA, 20 nt, Mycobacterium tuberculosis H37Rv
cgagcccgccacagccccag

SEQ ID NO: 3331649 - RNA, 21 nt, Mycobacterium tuberculosis H37Rv
cgagcccgccacagccccagg

SEQ ID NO: 3331650 - RNA, 22 nt, Mycobacterium tuberculosis H37Rv
cgagcccgccacagccccaggg

SEQ ID NO: 3331651 - RNA, 17 nt, Mycobacterium tuberculosis H37Rv
cgagcccgccggccucu

SEQ ID NO: 3331652 - RNA, 22 nt, Mycobacterium tuberculosis H37Rv
cgagcccgccggccucuggauc

SEQ ID NO: 3331653 - RNA, 16 nt, Mycobacterium tuberculosis H37Rv
cgagcccgccggguug

SEQ ID NO: 3331654 - RNA, 14 nt, Mycobacterium tuberculosis H37Rv
cgagcccggccucg

SEQ ID NO: 3331655 - RNA, 14 nt, Mycobacterium tuberculosis H37Rv
cgagcccguccucg

SEQ ID NO: 3331656 - RNA, 18 nt, Mycobacterium tuberculosis H37Rv
cgagcccguccucgucgg

SEQ ID NO: 3331657 - RNA, 14 nt, Mycobacterium tuberculosis H37Rv
cgagcccuccaggg

SEQ ID NO: 3331658 - RNA, 16 nt, Mycobacterium tuberculosis H37Rv
cgagccgacaucgaug

SEQ ID NO: 3331659 - RNA, 19 nt, Mycobacterium tuberculosis H37Rv
cgagccgacccgacgcugg

SEQ ID NO: 3331660 - RNA, 13 nt, Mycobacterium tuberculosis H37Rv
cgagccgaccgcg

SEQ ID NO: 3331661 - RNA, 19 nt, Mycobacterium tuberculosis H37Rv
cgagccgccaccguacgac

SEQ ID NO: 3331662 - RNA, 14 nt, Mycobacterium tuberculosis H37Rv
cgagccgcccgccc

SEQ ID NO: 3331663 - RNA, 24 nt, Mycobacterium tuberculosis H37Rv
cgagccgccggaucgccacggugg

SEQ ID NO: 3331664 - RNA, 15 nt, Mycobacterium tuberculosis H37Rv
cgagccgcgugggcc

SEQ ID NO: 3331665 - RNA, 21 nt, Mycobacterium tuberculosis H37Rv
cgagccgcgugggccgcugca

SEQ ID NO: 3331666 - RNA, 12 nt, Mycobacterium tuberculosis H37Rv
cgagccgcucca

SEQ ID NO: 3331667 - RNA, 19 nt, Mycobacterium tuberculosis H37Rv
cgagccggaacagugccac

SEQ ID NO: 3331668 - RNA, 21 nt, Mycobacterium tuberculosis H37Rv
cgagccggaacagugccaccu

SEQ ID NO: 3331669 - RNA, 13 nt, Mycobacterium tuberculosis H37Rv
cgagccggcgcgc

SEQ ID NO: 3331670 - RNA, 13 nt, Mycobacterium tuberculosis H37Rv
cgagccguagacc

SEQ ID NO: 3331671 - RNA, 14 nt, Mycobacterium tuberculosis H37Rv
cgagccguagacca

SEQ ID NO: 3331672 - RNA, 21 nt, Mycobacterium tuberculosis H37Rv
cgagccguccaagccagcguu

SEQ ID NO: 3331673 - RNA, 22 nt, Mycobacterium tuberculosis H37Rv
cgagccguccaauuccgcagag

SEQ ID NO: 3331674 - RNA, 17 nt, Mycobacterium tuberculosis H37Rv
cgagccgucgucgagcc

SEQ ID NO: 3331675 - RNA, 20 nt, Mycobacterium tuberculosis H37Rv
cgagccuguucgccgcgaau

SEQ ID NO: 3331676 - RNA, 13 nt, Mycobacterium tuberculosis H37Rv
cgagcgaaccgaa

SEQ ID NO: 3331677 - RNA, 17 nt, Mycobacterium tuberculosis H37Rv
cgagcgacccccagcgc

SEQ ID NO: 3331678 - RNA, 17 nt, Mycobacterium tuberculosis H37Rv
cgagcgaccgucccagc

SEQ ID NO: 3331679 - RNA, 16 nt, Mycobacterium tuberculosis H37Rv
cgagcgauacgucguc

SEQ ID NO: 3331680 - RNA, 21 nt, Mycobacterium tuberculosis H37Rv
cgagcgauacgucgucagcca

SEQ ID NO: 3331681 - RNA, 22 nt, Mycobacterium tuberculosis H37Rv
cgagcgauacgucgucagccag

SEQ ID NO: 3331682 - RNA, 16 nt, Mycobacterium tuberculosis H37Rv
cgagcgaugcgaccga

SEQ ID NO: 3331683 - RNA, 18 nt, Mycobacterium tuberculosis H37Rv
cgagcgcaagagccgucc

SEQ ID NO: 3331684 - RNA, 16 nt, Mycobacterium tuberculosis H37Rv
cgagcgcacaccggcu

SEQ ID NO: 3331685 - RNA, 12 nt, Mycobacterium tuberculosis H37Rv
cgagcgcaccac

SEQ ID NO: 3331686 - RNA, 12 nt, Mycobacterium tuberculosis H37Rv
cgagcgcaccgc

SEQ ID NO: 3331687 - RNA, 19 nt, Mycobacterium tuberculosis H37Rv
cgagcgcacuggggaggcc

SEQ ID NO: 3331688 - RNA, 14 nt, Mycobacterium tuberculosis H37Rv
cgagcgcagcgugu

SEQ ID NO: 3331689 - RNA, 15 nt, Mycobacterium tuberculosis H37Rv
cgagcgcaucagggu

SEQ ID NO: 3331690 - RNA, 19 nt, Mycobacterium tuberculosis H37Rv
cgagcgcaucagggugggc

SEQ ID NO: 3331691 - RNA, 16 nt, Mycobacterium tuberculosis H37Rv
cgagcgcaucggccaa

SEQ ID NO: 3331692 - RNA, 19 nt, Mycobacterium tuberculosis H37Rv
cgagcgcauguugcaggcg

SEQ ID NO: 3331693 - RNA, 21 nt, Mycobacterium tuberculosis H37Rv
cgagcgccaguucgcggcugc

SEQ ID NO: 3331694 - RNA, 18 nt, Mycobacterium tuberculosis H37Rv
cgagcgcccgcagcgcuu

SEQ ID NO: 3331695 - RNA, 20 nt, Mycobacterium tuberculosis H37Rv
cgagcgcccgcagcgcuucc

SEQ ID NO: 3331696 - RNA, 15 nt, Mycobacterium tuberculosis H37Rv
cgagcgcccuccucg

SEQ ID NO: 3331697 - RNA, 11 nt, Mycobacterium tuberculosis H37Rv
cgagcgccggc

SEQ ID NO: 3331698 - RNA, 20 nt, Mycobacterium tuberculosis H37Rv
cgagcgccuugucgaucucg

SEQ ID NO: 3331699 - RNA, 17 nt, Mycobacterium tuberculosis H37Rv
cgagcgcgaucgggccg

SEQ ID NO: 3331700 - RNA, 19 nt, Mycobacterium tuberculosis H37Rv
cgagcgcgaugcagugcga

SEQ ID NO: 3331701 - RNA, 11 nt, Mycobacterium tuberculosis H37Rv
cgagcgcgcca

SEQ ID NO: 3331702 - RNA, 16 nt, Mycobacterium tuberculosis H37Rv
cgagcgcgccaaucgc

SEQ ID NO: 3331703 - RNA, 20 nt, Mycobacterium tuberculosis H37Rv
cgagcgcgccaaucgcccag

SEQ ID NO: 3331704 - RNA, 14 nt, Mycobacterium tuberculosis H37Rv
cgagcgcgccguug

SEQ ID NO: 3331705 - RNA, 19 nt, Mycobacterium tuberculosis H37Rv
cgagcgcgccguugccgcc

SEQ ID NO: 3331706 - RNA, 16 nt, Mycobacterium tuberculosis H37Rv
cgagcgcgcgcuguug

SEQ ID NO: 3331707 - RNA, 20 nt, Mycobacterium tuberculosis H37Rv
cgagcgcggugccgccaccg

SEQ ID NO: 3331708 - RNA, 21 nt, Mycobacterium tuberculosis H37Rv
cgagcgcggugccgccaccgg

SEQ ID NO: 3331709 - RNA, 19 nt, Mycobacterium tuberculosis H37Rv
cgagcgcgucggucaccga

SEQ ID NO: 3331710 - RNA, 22 nt, Mycobacterium tuberculosis H37Rv
cgagcgcgucggucaccgaacg

SEQ ID NO: 3331711 - RNA, 19 nt, Mycobacterium tuberculosis H37Rv
cgagcgcuaucaccgccuc

SEQ ID NO: 3331712 - RNA, 14 nt, Mycobacterium tuberculosis H37Rv
cgagcgcucgauca

SEQ ID NO: 3331713 - RNA, 16 nt, Mycobacterium tuberculosis H37Rv
cgagcgcuguggccca

SEQ ID NO: 3331714 - RNA, 13 nt, Mycobacterium tuberculosis H37Rv
cgagcgcuucguc

SEQ ID NO: 3331715 - RNA, 20 nt, Mycobacterium tuberculosis H37Rv
cgagcgcuucgucgccgaac

SEQ ID NO: 3331716 - RNA, 17 nt, Mycobacterium tuberculosis H37Rv
cgagcgcuugaccccgc

SEQ ID NO: 3331717 - RNA, 20 nt, Mycobacterium tuberculosis H37Rv
cgagcggaacgucacugcga

SEQ ID NO: 3331718 - RNA, 20 nt, Mycobacterium tuberculosis H37Rv
cgagcggaccaccgcucgcc

SEQ ID NO: 3331719 - RNA, 17 nt, Mycobacterium tuberculosis H37Rv
cgagcggagccgccgac

SEQ ID NO: 3331720 - RNA, 19 nt, Mycobacterium tuberculosis H37Rv
cgagcggaugaaaucggca

SEQ ID NO: 3331721 - RNA, 17 nt, Mycobacterium tuberculosis H37Rv
cgagcggcaucggucac

SEQ ID NO: 3331722 - RNA, 23 nt, Mycobacterium tuberculosis H37Rv
cgagcggccuccagcacccgguc

SEQ ID NO: 3331723 - RNA, 14 nt, Mycobacterium tuberculosis H37Rv
cgagcggcugaggc

SEQ ID NO: 3331724 - RNA, 15 nt, Mycobacterium tuberculosis H37Rv
cgagcggcugaggcu

SEQ ID NO: 3331725 - RNA, 17 nt, Mycobacterium tuberculosis H37Rv
cgagcggcuucagcacg

SEQ ID NO: 3331726 - RNA, 17 nt, Mycobacterium tuberculosis H37Rv
cgagcgggaucgggccc

SEQ ID NO: 3331727 - RNA, 15 nt, Mycobacterium tuberculosis H37Rv
cgagcgguacgcccg

SEQ ID NO: 3331728 - RNA, 20 nt, Mycobacterium tuberculosis H37Rv
cgagcgguacgcccgaaucg

SEQ ID NO: 3331729 - RNA, 22 nt, Mycobacterium tuberculosis H37Rv
cgagcggucaacgaguugcgga

SEQ ID NO: 3331730 - RNA, 14 nt, Mycobacterium tuberculosis H37Rv
cgagcggucgacgu

SEQ ID NO: 3331731 - RNA, 22 nt, Mycobacterium tuberculosis H37Rv
cgagcgguggugagugcgucuc

SEQ ID NO: 3331732 - RNA, 14 nt, Mycobacterium tuberculosis H37Rv
cgagcgguugccau

SEQ ID NO: 3331733 - RNA, 17 nt, Mycobacterium tuberculosis H37Rv
cgagcguaacgguaacc

SEQ ID NO: 3331734 - RNA, 20 nt, Mycobacterium tuberculosis H37Rv
cgagcguaacguggcugcga

SEQ ID NO: 3331735 - RNA, 17 nt, Mycobacterium tuberculosis H37Rv
cgagcgucagauccggc

SEQ ID NO: 3331736 - RNA, 18 nt, Mycobacterium tuberculosis H37Rv
cgagcgucagauccggcc

SEQ ID NO: 3331737 - RNA, 20 nt, Mycobacterium tuberculosis H37Rv
cgagcguccgggucgacgcg

SEQ ID NO: 3331738 - RNA, 21 nt, Mycobacterium tuberculosis H37Rv
cgagcguccgggucgacgcga

SEQ ID NO: 3331739 - RNA, 13 nt, Mycobacterium tuberculosis H37Rv
cgagcgucgggca

SEQ ID NO: 3331740 - RNA, 16 nt, Mycobacterium tuberculosis H37Rv
cgagcgucgggcacau

SEQ ID NO: 3331741 - RNA, 17 nt, Mycobacterium tuberculosis H37Rv
cgagcgucgggcacauc

SEQ ID NO: 3331742 - RNA, 20 nt, Mycobacterium tuberculosis H37Rv
cgagcgugaagucacggcgg

SEQ ID NO: 3331743 - RNA, 20 nt, Mycobacterium tuberculosis H37Rv
cgagcgugcaaucacugcga

SEQ ID NO: 3331744 - RNA, 12 nt, Mycobacterium tuberculosis H37Rv
cgagcgugcgca

SEQ ID NO: 3331745 - RNA, 23 nt, Mycobacterium tuberculosis H37Rv
cgagcgugcgcugguggcggcga

SEQ ID NO: 3331746 - RNA, 17 nt, Mycobacterium tuberculosis H37Rv
cgagcguuuggacgggc

SEQ ID NO: 3331747 - RNA, 23 nt, Mycobacterium tuberculosis H37Rv
cgagcucaacgacggcugaccuu

SEQ ID NO: 3331748 - RNA, 20 nt, Mycobacterium tuberculosis H37Rv
cgagcucaccgcacaccugc

SEQ ID NO: 3331749 - RNA, 16 nt, Mycobacterium tuberculosis H37Rv
cgagcucccgggcgcu

SEQ ID NO: 3331750 - RNA, 17 nt, Mycobacterium tuberculosis H37Rv
cgagcuccgaugccgac

SEQ ID NO: 3331751 - RNA, 18 nt, Mycobacterium tuberculosis H37Rv
cgagcuccgaugccgacg

SEQ ID NO: 3331752 - RNA, 13 nt, Mycobacterium tuberculosis H37Rv
cgagcuccgcggc

SEQ ID NO: 3331753 - RNA, 15 nt, Mycobacterium tuberculosis H37Rv
cgagcuccuccacca

SEQ ID NO: 3331754 - RNA, 18 nt, Mycobacterium tuberculosis H37Rv
cgagcuccuccaccaacu

SEQ ID NO: 3331755 - RNA, 15 nt, Mycobacterium tuberculosis H37Rv
cgagcucgaagcccg

SEQ ID NO: 3331756 - RNA, 16 nt, Mycobacterium tuberculosis H37Rv
cgagcucgaagcccgg

SEQ ID NO: 3331757 - RNA, 15 nt, Mycobacterium tuberculosis H37Rv
cgagcucggcgaugc

SEQ ID NO: 3331758 - RNA, 15 nt, Mycobacterium tuberculosis H37Rv
cgagcucgggugcga

SEQ ID NO: 3331759 - RNA, 13 nt, Mycobacterium tuberculosis H37Rv
cgagcucggucac

SEQ ID NO: 3331760 - RNA, 15 nt, Mycobacterium tuberculosis H37Rv
cgagcucggucacca

SEQ ID NO: 3331761 - RNA, 17 nt, Mycobacterium tuberculosis H37Rv
cgagcucggucaccacg

SEQ ID NO: 3331762 - RNA, 14 nt, Mycobacterium tuberculosis H37Rv
cgagcucguccucg

SEQ ID NO: 3331763 - RNA, 16 nt, Mycobacterium tuberculosis H37Rv
cgagcucguccucguc

SEQ ID NO: 3331764 - RNA, 20 nt, Mycobacterium tuberculosis H37Rv
cgagcucguccucgucuucg

SEQ ID NO: 3331765 - RNA, 22 nt, Mycobacterium tuberculosis H37Rv
cgagcucguccucgucuucguc

SEQ ID NO: 3331766 - RNA, 14 nt, Mycobacterium tuberculosis H37Rv
cgagcucgucgagc

SEQ ID NO: 3331767 - RNA, 17 nt, Mycobacterium tuberculosis H37Rv
cgagcugagcggccagc

SEQ ID NO: 3331768 - RNA, 21 nt, Mycobacterium tuberculosis H37Rv
cgagcugagcggccagcaucg

SEQ ID NO: 3331769 - RNA, 17 nt, Mycobacterium tuberculosis H37Rv
cgagcugauccgggugg

SEQ ID NO: 3331770 - RNA, 21 nt, Mycobacterium tuberculosis H37Rv
cgagcugcgggucgcguuucg

SEQ ID NO: 3331771 - RNA, 17 nt, Mycobacterium tuberculosis H37Rv
cgagcuggcaacgccgc

SEQ ID NO: 3331772 - RNA, 14 nt, Mycobacterium tuberculosis H37Rv
cgagcuggcguucc

SEQ ID NO: 3331773 - RNA, 23 nt, Mycobacterium tuberculosis H37Rv
cgagcugucggcuuccuccucgg

SEQ ID NO: 3331774 - RNA, 14 nt, Mycobacterium tuberculosis H37Rv
cgagcuucagcgcg

SEQ ID NO: 3331775 - RNA, 18 nt, Mycobacterium tuberculosis H37Rv
cgagcuucagcgcgcugc

SEQ ID NO: 3331776 - RNA, 12 nt, Mycobacterium tuberculosis H37Rv
cgagcuugccgu

SEQ ID NO: 3331777 - RNA, 15 nt, Mycobacterium tuberculosis H37Rv
cgagcuugccgucgc

SEQ ID NO: 3331778 - RNA, 18 nt, Mycobacterium tuberculosis H37Rv
cgagcuugccgucgcuga

SEQ ID NO: 3331779 - RNA, 22 nt, Mycobacterium tuberculosis H37Rv
cgagcuugccgucgcugacgcc

SEQ ID NO: 3331780 - RNA, 15 nt, Mycobacterium tuberculosis H37Rv
cgagcuugucgagca

SEQ ID NO: 3331781 - RNA, 19 nt, Mycobacterium tuberculosis H37Rv
cgagcuugucgagcaggcc

SEQ ID NO: 3331782 - RNA, 23 nt, Mycobacterium tuberculosis H37Rv
cgagcuuuucgaccuucaccgcg

SEQ ID NO: 3331783 - RNA, 15 nt, Mycobacterium tuberculosis H37Rv
cgaggaaaccaccag

SEQ ID NO: 3331784 - RNA, 23 nt, Mycobacterium tuberculosis H37Rv
cgaggaaaucgcccucgucgcgg

SEQ ID NO: 3331785 - RNA, 24 nt, Mycobacterium tuberculosis H37Rv
cgaggaacuggaccggugccagca

SEQ ID NO: 3331786 - RNA, 22 nt, Mycobacterium tuberculosis H37Rv
cgaggaauacucucgcgacauc

SEQ ID NO: 3331787 - RNA, 20 nt, Mycobacterium tuberculosis H37Rv
cgaggacacauugaccaggu

SEQ ID NO: 3331788 - RNA, 22 nt, Mycobacterium tuberculosis H37Rv
cgaggaccaccacuaggucgcc

SEQ ID NO: 3331789 - RNA, 17 nt, Mycobacterium tuberculosis H37Rv
cgaggacccgucgagcg

SEQ ID NO: 3331790 - RNA, 12 nt, Mycobacterium tuberculosis H37Rv
cgaggaccucgu

SEQ ID NO: 3331791 - RNA, 18 nt, Mycobacterium tuberculosis H37Rv
cgaggaccugcucgggcg

SEQ ID NO: 3331792 - RNA, 20 nt, Mycobacterium tuberculosis H37Rv
cgaggacgccggcgccgcca

SEQ ID NO: 3331793 - RNA, 14 nt, Mycobacterium tuberculosis H37Rv
cgaggacggcguag

SEQ ID NO: 3331794 - RNA, 14 nt, Mycobacterium tuberculosis H37Rv
cgaggacgucaccg

SEQ ID NO: 3331795 - RNA, 19 nt, Mycobacterium tuberculosis H37Rv
cgaggacugggugcgcggc

SEQ ID NO: 3331796 - RNA, 12 nt, Mycobacterium tuberculosis H37Rv
cgaggagcccgg

SEQ ID NO: 3331797 - RNA, 20 nt, Mycobacterium tuberculosis H37Rv
cgaggauauuuccuacggug

SEQ ID NO: 3331798 - RNA, 18 nt, Mycobacterium tuberculosis H37Rv
cgaggaucccgcugcacg

SEQ ID NO: 3331799 - RNA, 19 nt, Mycobacterium tuberculosis H37Rv
cgaggaucccgcugcacga

SEQ ID NO: 3331800 - RNA, 17 nt, Mycobacterium tuberculosis H37Rv
cgaggaugccgaaccgc

SEQ ID NO: 3331801 - RNA, 19 nt, Mycobacterium tuberculosis H37Rv
cgaggaugccgaaccgcgc

SEQ ID NO: 3331802 - RNA, 17 nt, Mycobacterium tuberculosis H37Rv
cgaggaugucgaugacc

SEQ ID NO: 3331803 - RNA, 15 nt, Mycobacterium tuberculosis H37Rv
cgaggaugugguugg

SEQ ID NO: 3331804 - RNA, 15 nt, Mycobacterium tuberculosis H37Rv
cgaggauguugugcc

SEQ ID NO: 3331805 - RNA, 22 nt, Mycobacterium tuberculosis H37Rv
cgaggauguugugccgaucggc

SEQ ID NO: 3331806 - RNA, 24 nt, Mycobacterium tuberculosis H37Rv
cgaggauguugugccgaucggcca

SEQ ID NO: 3331807 - RNA, 15 nt, Mycobacterium tuberculosis H37Rv
cgaggauucauggcg

SEQ ID NO: 3331808 - RNA, 14 nt, Mycobacterium tuberculosis H37Rv
cgaggcaacaagca

SEQ ID NO: 3331809 - RNA, 18 nt, Mycobacterium tuberculosis H37Rv
cgaggcaaugcgagcacc

SEQ ID NO: 3331810 - RNA, 20 nt, Mycobacterium tuberculosis H37Rv
cgaggcacaaucaccgccgc

SEQ ID NO: 3331811 - RNA, 16 nt, Mycobacterium tuberculosis H37Rv
cgaggcacccgugccg

SEQ ID NO: 3331812 - RNA, 22 nt, Mycobacterium tuberculosis H37Rv
cgaggcacccgugccgccgaug

SEQ ID NO: 3331813 - RNA, 17 nt, Mycobacterium tuberculosis H37Rv
cgaggcagcacccgcac

SEQ ID NO: 3331814 - RNA, 17 nt, Mycobacterium tuberculosis H37Rv
cgaggcagcgucgucga

SEQ ID NO: 3331815 - RNA, 21 nt, Mycobacterium tuberculosis H37Rv
cgaggcagcgucgucgacgac

SEQ ID NO: 3331816 - RNA, 17 nt, Mycobacterium tuberculosis H37Rv
cgaggcauucucccggu

SEQ ID NO: 3331817 - RNA, 18 nt, Mycobacterium tuberculosis H37Rv
cgaggccaaguugcagcg

SEQ ID NO: 3331818 - RNA, 23 nt, Mycobacterium tuberculosis H37Rv
cgaggccaaguugcagcgggcca

SEQ ID NO: 3331819 - RNA, 15 nt, Mycobacterium tuberculosis H37Rv
cgaggccacgccagc

SEQ ID NO: 3331820 - RNA, 12 nt, Mycobacterium tuberculosis H37Rv
cgaggccagcgg

SEQ ID NO: 3331821 - RNA, 14 nt, Mycobacterium tuberculosis H37Rv
cgaggccagcggua

SEQ ID NO: 3331822 - RNA, 22 nt, Mycobacterium tuberculosis H37Rv
cgaggccagcgguaaugccagc

SEQ ID NO: 3331823 - RNA, 15 nt, Mycobacterium tuberculosis H37Rv
cgaggcccgggugcu

SEQ ID NO: 3331824 - RNA, 24 nt, Mycobacterium tuberculosis H37Rv
cgaggcccgggugcuacugggugg

SEQ ID NO: 3331825 - RNA, 21 nt, Mycobacterium tuberculosis H37Rv
cgaggcccucgcgcgcgucga

SEQ ID NO: 3331826 - RNA, 18 nt, Mycobacterium tuberculosis H37Rv
cgaggccgcacgucgacc

SEQ ID NO: 3331827 - RNA, 14 nt, Mycobacterium tuberculosis H37Rv
cgaggccgccaucg

SEQ ID NO: 3331828 - RNA, 20 nt, Mycobacterium tuberculosis H37Rv
cgaggccgccaucgccgcca

SEQ ID NO: 3331829 - RNA, 14 nt, Mycobacterium tuberculosis H37Rv
cgaggccgccguug

SEQ ID NO: 3331830 - RNA, 17 nt, Mycobacterium tuberculosis H37Rv
cgaggccgcugccaggg

SEQ ID NO: 3331831 - RNA, 22 nt, Mycobacterium tuberculosis H37Rv
cgaggccuaccaggcgcggccc

SEQ ID NO: 3331832 - RNA, 20 nt, Mycobacterium tuberculosis H37Rv
cgaggccucggccagcguca

SEQ ID NO: 3331833 - RNA, 21 nt, Mycobacterium tuberculosis H37Rv
cgaggcgacgucguucuuugu

SEQ ID NO: 3331834 - RNA, 18 nt, Mycobacterium tuberculosis H37Rv
cgaggcgaguucgcgcac

SEQ ID NO: 3331835 - RNA, 17 nt, Mycobacterium tuberculosis H37Rv
cgaggcgaucaccgcgc

SEQ ID NO: 3331836 - RNA, 21 nt, Mycobacterium tuberculosis H37Rv
cgaggcgaucaccgcgccgga

SEQ ID NO: 3331837 - RNA, 13 nt, Mycobacterium tuberculosis H37Rv
cgaggcgcccaac

SEQ ID NO: 3331838 - RNA, 18 nt, Mycobacterium tuberculosis H37Rv
cgaggcggaugcgguaag

SEQ ID NO: 3331839 - RNA, 14 nt, Mycobacterium tuberculosis H37Rv
cgaggcggcggucg

SEQ ID NO: 3331840 - RNA, 21 nt, Mycobacterium tuberculosis H37Rv
cgaggcgggcagaagaguguc

SEQ ID NO: 3331841 - RNA, 18 nt, Mycobacterium tuberculosis H37Rv
cgaggcguaaucaagcag

SEQ ID NO: 3331842 - RNA, 18 nt, Mycobacterium tuberculosis H37Rv
cgaggcguucaccacgau

SEQ ID NO: 3331843 - RNA, 21 nt, Mycobacterium tuberculosis H37Rv
cgaggcguucaccacgaucgc

SEQ ID NO: 3331844 - RNA, 22 nt, Mycobacterium tuberculosis H37Rv
cgaggcguucaccacgaucgcg

SEQ ID NO: 3331845 - RNA, 14 nt, Mycobacterium tuberculosis H37Rv
cgaggcguucagug

SEQ ID NO: 3331846 - RNA, 19 nt, Mycobacterium tuberculosis H37Rv
cgaggcucccccaccaggg

SEQ ID NO: 3331847 - RNA, 19 nt, Mycobacterium tuberculosis H37Rv
cgaggcucgcguggccgcc

SEQ ID NO: 3331848 - RNA, 14 nt, Mycobacterium tuberculosis H37Rv
cgaggcuggcaucc

SEQ ID NO: 3331849 - RNA, 22 nt, Mycobacterium tuberculosis H37Rv
cgaggcuggcaucccgggcagu

SEQ ID NO: 3331850 - RNA, 17 nt, Mycobacterium tuberculosis H37Rv
cgaggcuugcggcacaa

SEQ ID NO: 3331851 - RNA, 17 nt, Mycobacterium tuberculosis H37Rv
cgagggaacggugcaca

SEQ ID NO: 3331852 - RNA, 19 nt, Mycobacterium tuberculosis H37Rv
cgagggcaacggcacuagc

SEQ ID NO: 3331853 - RNA, 14 nt, Mycobacterium tuberculosis H37Rv
cgagggccagcagc

SEQ ID NO: 3331854 - RNA, 19 nt, Mycobacterium tuberculosis H37Rv
cgagggccagcagccgcga

SEQ ID NO: 3331855 - RNA, 20 nt, Mycobacterium tuberculosis H37Rv
cgagggccagcagccgcgac

SEQ ID NO: 3331856 - RNA, 14 nt, Mycobacterium tuberculosis H37Rv
cgagggcgcguguc

SEQ ID NO: 3331857 - RNA, 15 nt, Mycobacterium tuberculosis H37Rv
cgagggcgggacccg

SEQ ID NO: 3331858 - RNA, 16 nt, Mycobacterium tuberculosis H37Rv
cgagggcgggacccgu

SEQ ID NO: 3331859 - RNA, 19 nt, Mycobacterium tuberculosis H37Rv
cgagggcggucagcggcca

SEQ ID NO: 3331860 - RNA, 20 nt, Mycobacterium tuberculosis H37Rv
cgagggcgucgccgccguug

SEQ ID NO: 3331861 - RNA, 17 nt, Mycobacterium tuberculosis H37Rv
cgagggcuuuagugucu

SEQ ID NO: 3331862 - RNA, 21 nt, Mycobacterium tuberculosis H37Rv
cgaggguagacggggcgagca

SEQ ID NO: 3331863 - RNA, 23 nt, Mycobacterium tuberculosis H37Rv
cgaggguaucgucauugcgaaaa

SEQ ID NO: 3331864 - RNA, 22 nt, Mycobacterium tuberculosis H37Rv
cgagguauaaacgcggcgcgcu

SEQ ID NO: 3331865 - RNA, 23 nt, Mycobacterium tuberculosis H37Rv
cgagguauaaacgcggcgcgcug

SEQ ID NO: 3331866 - RNA, 14 nt, Mycobacterium tuberculosis H37Rv
cgaggucacccggu

SEQ ID NO: 3331867 - RNA, 12 nt, Mycobacterium tuberculosis H37Rv
cgaggucagcuc

SEQ ID NO: 3331868 - RNA, 20 nt, Mycobacterium tuberculosis H37Rv
cgagguccagcaugcucgug

SEQ ID NO: 3331869 - RNA, 17 nt, Mycobacterium tuberculosis H37Rv
cgagguccucagcgaug

SEQ ID NO: 3331870 - RNA, 22 nt, Mycobacterium tuberculosis H37Rv
cgagguccucgagguccucguc

SEQ ID NO: 3331871 - RNA, 19 nt, Mycobacterium tuberculosis H37Rv
cgagguccucgucggcguc

SEQ ID NO: 3331872 - RNA, 21 nt, Mycobacterium tuberculosis H37Rv
cgagguccucgucggcgucga

SEQ ID NO: 3331873 - RNA, 17 nt, Mycobacterium tuberculosis H37Rv
cgagguccucgucgucg

SEQ ID NO: 3331874 - RNA, 15 nt, Mycobacterium tuberculosis H37Rv
cgaggucgagcgccg

SEQ ID NO: 3331875 - RNA, 17 nt, Mycobacterium tuberculosis H37Rv
cgaggucgagcgccgcg

SEQ ID NO: 3331876 - RNA, 14 nt, Mycobacterium tuberculosis H37Rv
cgaggucgccaacc

SEQ ID NO: 3331877 - RNA, 15 nt, Mycobacterium tuberculosis H37Rv
cgaggucgccaaccc

SEQ ID NO: 3331878 - RNA, 22 nt, Mycobacterium tuberculosis H37Rv
cgaggucgcccgugucguacca

SEQ ID NO: 3331879 - RNA, 23 nt, Mycobacterium tuberculosis H37Rv
cgaggucgcggucuuugagccgg

SEQ ID NO: 3331880 - RNA, 17 nt, Mycobacterium tuberculosis H37Rv
cgaggucggcgaucugc

SEQ ID NO: 3331881 - RNA, 22 nt, Mycobacterium tuberculosis H37Rv
cgaggucggugaggucgaugcc

SEQ ID NO: 3331882 - RNA, 16 nt, Mycobacterium tuberculosis H37Rv
cgaggugagguugacc

SEQ ID NO: 3331883 - RNA, 20 nt, Mycobacterium tuberculosis H37Rv
cgaggugagguugacccccg

SEQ ID NO: 3331884 - RNA, 19 nt, Mycobacterium tuberculosis H37Rv
cgaggugauguuggccgcc

SEQ ID NO: 3331885 - RNA, 21 nt, Mycobacterium tuberculosis H37Rv
cgaggugauguuggccgccac

SEQ ID NO: 3331886 - RNA, 14 nt, Mycobacterium tuberculosis H37Rv
cgaggugcccaagg

SEQ ID NO: 3331887 - RNA, 14 nt, Mycobacterium tuberculosis H37Rv
cgagguggcgcaca

SEQ ID NO: 3331888 - RNA, 20 nt, Mycobacterium tuberculosis H37Rv
cgagguggcgcacaucgcga

SEQ ID NO: 3331889 - RNA, 15 nt, Mycobacterium tuberculosis H37Rv
cgaggugggcgucau

SEQ ID NO: 3331890 - RNA, 23 nt, Mycobacterium tuberculosis H37Rv
cgagguguagcccuccgagcaca

SEQ ID NO: 3331891 - RNA, 20 nt, Mycobacterium tuberculosis H37Rv
cgagguuccacuuggucacc

SEQ ID NO: 3331892 - RNA, 24 nt, Mycobacterium tuberculosis H37Rv
cgagguugccgcaccagucgcgca

SEQ ID NO: 3331893 - RNA, 15 nt, Mycobacterium tuberculosis H37Rv
cgaguaccaggacga

SEQ ID NO: 3331894 - RNA, 14 nt, Mycobacterium tuberculosis H37Rv
cgaguaccgauagc

SEQ ID NO: 3331895 - RNA, 19 nt, Mycobacterium tuberculosis H37Rv
cgaguaccgauagccugcg

SEQ ID NO: 3331896 - RNA, 22 nt, Mycobacterium tuberculosis H37Rv
cgaguacggccugccgcucgcc

SEQ ID NO: 3331897 - RNA, 20 nt, Mycobacterium tuberculosis H37Rv
cgaguagaagauggcaccgc

SEQ ID NO: 3331898 - RNA, 17 nt, Mycobacterium tuberculosis H37Rv
cgaguagcugacccgcg

SEQ ID NO: 3331899 - RNA, 17 nt, Mycobacterium tuberculosis H37Rv
cgaguaggcggcuccga

SEQ ID NO: 3331900 - RNA, 16 nt, Mycobacterium tuberculosis H37Rv
cgaguagugcaggugc

SEQ ID NO: 3331901 - RNA, 15 nt, Mycobacterium tuberculosis H37Rv
cgaguaucucggcuc

SEQ ID NO: 3331902 - RNA, 16 nt, Mycobacterium tuberculosis H37Rv
cgaguaucucggcucc

SEQ ID NO: 3331903 - RNA, 16 nt, Mycobacterium tuberculosis H37Rv
cgaguaugggggugcu

SEQ ID NO: 3331904 - RNA, 15 nt, Mycobacterium tuberculosis H37Rv
cgaguauuuuucgac

SEQ ID NO: 3331905 - RNA, 20 nt, Mycobacterium tuberculosis H37Rv
cgaguauuuuucgaccagcc

SEQ ID NO: 3331906 - RNA, 20 nt, Mycobacterium tuberculosis H37Rv
cgagucaccggguccaccgc

SEQ ID NO: 3331907 - RNA, 14 nt, Mycobacterium tuberculosis H37Rv
cgaguccaccaccu

SEQ ID NO: 3331908 - RNA, 17 nt, Mycobacterium tuberculosis H37Rv
cgaguccagcgcaucgu

SEQ ID NO: 3331909 - RNA, 14 nt, Mycobacterium tuberculosis H37Rv
cgaguccaggcagc

SEQ ID NO: 3331910 - RNA, 16 nt, Mycobacterium tuberculosis H37Rv
cgaguccaggccggca

SEQ ID NO: 3331911 - RNA, 18 nt, Mycobacterium tuberculosis H37Rv
cgaguccccuuagcucca

SEQ ID NO: 3331912 - RNA, 17 nt, Mycobacterium tuberculosis H37Rv
cgaguccgcugcuucuc

SEQ ID NO: 3331913 - RNA, 19 nt, Mycobacterium tuberculosis H37Rv
cgaguccguacuugccacc

SEQ ID NO: 3331914 - RNA, 23 nt, Mycobacterium tuberculosis H37Rv
cgaguccucgagugccgccgucg

SEQ ID NO: 3331915 - RNA, 19 nt, Mycobacterium tuberculosis H37Rv
cgagucgaacccgcgagca

SEQ ID NO: 3331916 - RNA, 21 nt, Mycobacterium tuberculosis H37Rv
cgagucgaaugucccgguguc

SEQ ID NO: 3331917 - RNA, 18 nt, Mycobacterium tuberculosis H37Rv
cgagucgacaagccgucg

SEQ ID NO: 3331918 - RNA, 13 nt, Mycobacterium tuberculosis H37Rv
cgagucgaugacc

SEQ ID NO: 3331919 - RNA, 18 nt, Mycobacterium tuberculosis H37Rv
cgagucgaugaccccggu

SEQ ID NO: 3331920 - RNA, 14 nt, Mycobacterium tuberculosis H37Rv
cgagucgcacgugg

SEQ ID NO: 3331921 - RNA, 15 nt, Mycobacterium tuberculosis H37Rv
cgagucgccagaccg

SEQ ID NO: 3331922 - RNA, 20 nt, Mycobacterium tuberculosis H37Rv
cgagucgccgaggacgccgg

SEQ ID NO: 3331923 - RNA, 20 nt, Mycobacterium tuberculosis H37Rv
cgagucgccgcgggcagcga

SEQ ID NO: 3331924 - RNA, 15 nt, Mycobacterium tuberculosis H37Rv
cgagucucgucgggu

SEQ ID NO: 3331925 - RNA, 14 nt, Mycobacterium tuberculosis H37Rv
cgagucugcgagca

SEQ ID NO: 3331926 - RNA, 14 nt, Mycobacterium tuberculosis H37Rv
cgagugcacgcuug

SEQ ID NO: 3331927 - RNA, 15 nt, Mycobacterium tuberculosis H37Rv
cgagugcaugaacgc

SEQ ID NO: 3331928 - RNA, 15 nt, Mycobacterium tuberculosis H37Rv
cgagugccgccaccg

SEQ ID NO: 3331929 - RNA, 16 nt, Mycobacterium tuberculosis H37Rv
cgagugccgccaccgc

SEQ ID NO: 3331930 - RNA, 21 nt, Mycobacterium tuberculosis H37Rv
cgagugcggacuucgccgccc

SEQ ID NO: 3331931 - RNA, 21 nt, Mycobacterium tuberculosis H37Rv
cgagugcggcacgaucgccaa

SEQ ID NO: 3331932 - RNA, 19 nt, Mycobacterium tuberculosis H37Rv
cgagugcguugacucugcg

SEQ ID NO: 3331933 - RNA, 18 nt, Mycobacterium tuberculosis H37Rv
cgaguggaucauguucgg

SEQ ID NO: 3331934 - RNA, 17 nt, Mycobacterium tuberculosis H37Rv
cgaguggcugacacugc

SEQ ID NO: 3331935 - RNA, 21 nt, Mycobacterium tuberculosis H37Rv
cgagugggugaggccaaccac

SEQ ID NO: 3331936 - RNA, 21 nt, Mycobacterium tuberculosis H37Rv
cgagugucacugggccggucg

SEQ ID NO: 3331937 - RNA, 13 nt, Mycobacterium tuberculosis H37Rv
cgagugucagcag

SEQ ID NO: 3331938 - RNA, 13 nt, Mycobacterium tuberculosis H37Rv
cgaguuaccggug

SEQ ID NO: 3331939 - RNA, 14 nt, Mycobacterium tuberculosis H37Rv
cgaguuaccgguga

SEQ ID NO: 3331940 - RNA, 14 nt, Mycobacterium tuberculosis H37Rv
cgaguuaccggugg

SEQ ID NO: 3331941 - RNA, 15 nt, Mycobacterium tuberculosis H37Rv
cgaguuaggccgcca

SEQ ID NO: 3331942 - RNA, 17 nt, Mycobacterium tuberculosis H37Rv
cgaguuaggccgccagc

SEQ ID NO: 3331943 - RNA, 22 nt, Mycobacterium tuberculosis H37Rv
cgaguuaggccgccagccggcg

SEQ ID NO: 3331944 - RNA, 19 nt, Mycobacterium tuberculosis H37Rv
cgaguucgcagucgaugag

SEQ ID NO: 3331945 - RNA, 16 nt, Mycobacterium tuberculosis H37Rv
cgaguucggcccgcaa

SEQ ID NO: 3331946 - RNA, 23 nt, Mycobacterium tuberculosis H37Rv
cgaguugaagaagccgguguuga

SEQ ID NO: 3331947 - RNA, 14 nt, Mycobacterium tuberculosis H37Rv
cgaguugagaaccg

SEQ ID NO: 3331948 - RNA, 12 nt, Mycobacterium tuberculosis H37Rv
cgaguugcccgg

SEQ ID NO: 3331949 - RNA, 14 nt, Mycobacterium tuberculosis H37Rv
cgaguugcucgaca

SEQ ID NO: 3331950 - RNA, 17 nt, Mycobacterium tuberculosis H37Rv
cgaguuggcgaagcccg

SEQ ID NO: 3331951 - RNA, 21 nt, Mycobacterium tuberculosis H37Rv
cgaguuggucguggcugugcg

SEQ ID NO: 3331952 - RNA, 13 nt, Mycobacterium tuberculosis H37Rv
cgaguuucucggc

SEQ ID NO: 3331953 - RNA, 20 nt, Mycobacterium tuberculosis H37Rv
cgaguuucugaagcccgaca

SEQ ID NO: 3331954 - RNA, 19 nt, Mycobacterium tuberculosis H37Rv
cgaguuucugcucgaccgu

SEQ ID NO: 3331955 - RNA, 15 nt, Mycobacterium tuberculosis H37Rv
cgauaaaaaccaccc

SEQ ID NO: 3331956 - RNA, 13 nt, Mycobacterium tuberculosis H37Rv
cgauaaaugccgc

SEQ ID NO: 3331957 - RNA, 12 nt, Mycobacterium tuberculosis H37Rv
cgauaacacccg

SEQ ID NO: 3331958 - RNA, 16 nt, Mycobacterium tuberculosis H37Rv
cgauaaccucagcgcg

SEQ ID NO: 3331959 - RNA, 22 nt, Mycobacterium tuberculosis H37Rv
cgauaaccuggcggucccgcau

SEQ ID NO: 3331960 - RNA, 21 nt, Mycobacterium tuberculosis H37Rv
cgauaaugaucucggcaagga

SEQ ID NO: 3331961 - RNA, 14 nt, Mycobacterium tuberculosis H37Rv
cgauacccaggaug

SEQ ID NO: 3331962 - RNA, 13 nt, Mycobacterium tuberculosis H37Rv
cgauaccggcgug

SEQ ID NO: 3331963 - RNA, 15 nt, Mycobacterium tuberculosis H37Rv
cgauaccggcgugca

SEQ ID NO: 3331964 - RNA, 23 nt, Mycobacterium tuberculosis H37Rv
cgauaccgguugcggucaucggc

SEQ ID NO: 3331965 - RNA, 16 nt, Mycobacterium tuberculosis H37Rv
cgauaccgucagcgcc

SEQ ID NO: 3331966 - RNA, 20 nt, Mycobacterium tuberculosis H37Rv
cgauaccgucagcgccgcug

SEQ ID NO: 3331967 - RNA, 22 nt, Mycobacterium tuberculosis H37Rv
cgauacgaagccgccgcgacca

SEQ ID NO: 3331968 - RNA, 14 nt, Mycobacterium tuberculosis H37Rv
cgauacgcgcaccg

SEQ ID NO: 3331969 - RNA, 18 nt, Mycobacterium tuberculosis H37Rv
cgauacggccggccguug

SEQ ID NO: 3331970 - RNA, 16 nt, Mycobacterium tuberculosis H37Rv
cgauacgucgucagcc

SEQ ID NO: 3331971 - RNA, 16 nt, Mycobacterium tuberculosis H37Rv
cgauagaacguagcgc

SEQ ID NO: 3331972 - RNA, 19 nt, Mycobacterium tuberculosis H37Rv
cgauagaacguagcgccca

SEQ ID NO: 3331973 - RNA, 15 nt, Mycobacterium tuberculosis H37Rv
cgauagaucgcgugg

SEQ ID NO: 3331974 - RNA, 12 nt, Mycobacterium tuberculosis H37Rv
cgauagcccgcc

SEQ ID NO: 3331975 - RNA, 16 nt, Mycobacterium tuberculosis H37Rv
cgauagcccgccaccc

SEQ ID NO: 3331976 - RNA, 23 nt, Mycobacterium tuberculosis H37Rv
cgauagcggcccgaucaccagcc

SEQ ID NO: 3331977 - RNA, 15 nt, Mycobacterium tuberculosis H37Rv
cgauaggugaacgcu

SEQ ID NO: 3331978 - RNA, 14 nt, Mycobacterium tuberculosis H37Rv
cgauaggugagcgc

SEQ ID NO: 3331979 - RNA, 20 nt, Mycobacterium tuberculosis H37Rv
cgauagucauucgcuccggu

SEQ ID NO: 3331980 - RNA, 16 nt, Mycobacterium tuberculosis H37Rv
cgauauaggacgccgc

SEQ ID NO: 3331981 - RNA, 16 nt, Mycobacterium tuberculosis H37Rv
cgauaucggcccccaa

SEQ ID NO: 3331982 - RNA, 22 nt, Mycobacterium tuberculosis H37Rv
cgauaucgggcucagcggcgac

SEQ ID NO: 3331983 - RNA, 21 nt, Mycobacterium tuberculosis H37Rv
cgauaucguuggcgaccaccg

SEQ ID NO: 3331984 - RNA, 20 nt, Mycobacterium tuberculosis H37Rv
cgauauuggacgcgcaugcc

SEQ ID NO: 3331985 - RNA, 23 nt, Mycobacterium tuberculosis H37Rv
cgauauuggaugcgcuaggugcg

SEQ ID NO: 3331986 - RNA, 13 nt, Mycobacterium tuberculosis H37Rv
cgauauugggaua

SEQ ID NO: 3331987 - RNA, 16 nt, Mycobacterium tuberculosis H37Rv
cgaucaacaccaaucg

SEQ ID NO: 3331988 - RNA, 18 nt, Mycobacterium tuberculosis H37Rv
cgaucaaccgcugucacc

SEQ ID NO: 3331989 - RNA, 14 nt, Mycobacterium tuberculosis H37Rv
cgaucaacgcguug

SEQ ID NO: 3331990 - RNA, 13 nt, Mycobacterium tuberculosis H37Rv
cgaucaacggauc

SEQ ID NO: 3331991 - RNA, 13 nt, Mycobacterium tuberculosis H37Rv
cgaucaagccuuc

SEQ ID NO: 3331992 - RNA, 20 nt, Mycobacterium tuberculosis H37Rv
cgaucaauccgcccuugccg

SEQ ID NO: 3331993 - RNA, 21 nt, Mycobacterium tuberculosis H37Rv
cgaucaaugcgaugcggucgu

SEQ ID NO: 3331994 - RNA, 22 nt, Mycobacterium tuberculosis H37Rv
cgaucacaccacgguuggccac

SEQ ID NO: 3331995 - RNA, 12 nt, Mycobacterium tuberculosis H37Rv
cgaucaccagcc

SEQ ID NO: 3331996 - RNA, 17 nt, Mycobacterium tuberculosis H37Rv
cgaucacccacauggug

SEQ ID NO: 3331997 - RNA, 14 nt, Mycobacterium tuberculosis H37Rv
cgaucacccccugg

SEQ ID NO: 3331998 - RNA, 15 nt, Mycobacterium tuberculosis H37Rv
cgaucacccccugga

SEQ ID NO: 3331999 - RNA, 14 nt, Mycobacterium tuberculosis H37Rv
cgaucaccccgcca

SEQ ID NO: 3332000 - RNA, 23 nt, Mycobacterium tuberculosis H37Rv
cgaucacccgcacuccacgaucg

SEQ ID NO: 3332001 - RNA, 18 nt, Mycobacterium tuberculosis H37Rv
cgaucaccgacaccgugu

SEQ ID NO: 3332002 - RNA, 16 nt, Mycobacterium tuberculosis H37Rv
cgaucaccgcaucggu

SEQ ID NO: 3332003 - RNA, 15 nt, Mycobacterium tuberculosis H37Rv
cgaucaccgcuugcu

SEQ ID NO: 3332004 - RNA, 15 nt, Mycobacterium tuberculosis H37Rv
cgaucaccugcagca

SEQ ID NO: 3332005 - RNA, 14 nt, Mycobacterium tuberculosis H37Rv
cgaucacggcaccg

SEQ ID NO: 3332006 - RNA, 16 nt, Mycobacterium tuberculosis H37Rv
cgaucacggccgucga

SEQ ID NO: 3332007 - RNA, 19 nt, Mycobacterium tuberculosis H37Rv
cgaucacgucgucagccac

SEQ ID NO: 3332008 - RNA, 16 nt, Mycobacterium tuberculosis H37Rv
cgaucacgucgucucg

SEQ ID NO: 3332009 - RNA, 22 nt, Mycobacterium tuberculosis H37Rv
cgaucacgucgucucggcggug

SEQ ID NO: 3332010 - RNA, 23 nt, Mycobacterium tuberculosis H37Rv
cgaucacgucgucucggcggugg

SEQ ID NO: 3332011 - RNA, 23 nt, Mycobacterium tuberculosis H37Rv
cgaucacgugguccaaccgggcc

SEQ ID NO: 3332012 - RNA, 20 nt, Mycobacterium tuberculosis H37Rv
cgaucacuagcgccccuggc

SEQ ID NO: 3332013 - RNA, 23 nt, Mycobacterium tuberculosis H37Rv
cgaucacuagucguagacggcga

SEQ ID NO: 3332014 - RNA, 23 nt, Mycobacterium tuberculosis H37Rv
cgaucacuguuccgggugccgcg

SEQ ID NO: 3332015 - RNA, 19 nt, Mycobacterium tuberculosis H37Rv
cgaucagcaacucggccac

SEQ ID NO: 3332016 - RNA, 21 nt, Mycobacterium tuberculosis H37Rv
cgaucagcaccgacggcgcau

SEQ ID NO: 3332017 - RNA, 17 nt, Mycobacterium tuberculosis H37Rv
cgaucagcagccgccga

SEQ ID NO: 3332018 - RNA, 18 nt, Mycobacterium tuberculosis H37Rv
cgaucagcagccgccgau

SEQ ID NO: 3332019 - RNA, 12 nt, Mycobacterium tuberculosis H37Rv
cgaucagcagcg

SEQ ID NO: 3332020 - RNA, 13 nt, Mycobacterium tuberculosis H37Rv
cgaucagcagcgu

SEQ ID NO: 3332021 - RNA, 12 nt, Mycobacterium tuberculosis H37Rv
cgaucagcaggg

SEQ ID NO: 3332022 - RNA, 20 nt, Mycobacterium tuberculosis H37Rv
cgaucagcagggcggcguua

SEQ ID NO: 3332023 - RNA, 17 nt, Mycobacterium tuberculosis H37Rv
cgaucagcccggccuug

SEQ ID NO: 3332024 - RNA, 21 nt, Mycobacterium tuberculosis H37Rv
cgaucagccgggugcgcaccc

SEQ ID NO: 3332025 - RNA, 17 nt, Mycobacterium tuberculosis H37Rv
cgaucagcgaguagccg

SEQ ID NO: 3332026 - RNA, 12 nt, Mycobacterium tuberculosis H37Rv
cgaucagcgccg

SEQ ID NO: 3332027 - RNA, 20 nt, Mycobacterium tuberculosis H37Rv
cgaucagcgcgcacacggcu

SEQ ID NO: 3332028 - RNA, 18 nt, Mycobacterium tuberculosis H37Rv
cgaucagcggcagcaccg

SEQ ID NO: 3332029 - RNA, 21 nt, Mycobacterium tuberculosis H37Rv
cgaucagcuccuguaacugcu

SEQ ID NO: 3332030 - RNA, 19 nt, Mycobacterium tuberculosis H37Rv
cgaucagcugcgcaucgcc

SEQ ID NO: 3332031 - RNA, 17 nt, Mycobacterium tuberculosis H37Rv
cgaucaggccgacgucg

SEQ ID NO: 3332032 - RNA, 14 nt, Mycobacterium tuberculosis H37Rv
cgaucaggcugccg

SEQ ID NO: 3332033 - RNA, 15 nt, Mycobacterium tuberculosis H37Rv
cgaucaggggcccac

SEQ ID NO: 3332034 - RNA, 21 nt, Mycobacterium tuberculosis H37Rv
cgaucaggggcccacccgaau

SEQ ID NO: 3332035 - RNA, 16 nt, Mycobacterium tuberculosis H37Rv
cgaucagggugucgaa

SEQ ID NO: 3332036 - RNA, 15 nt, Mycobacterium tuberculosis H37Rv
cgaucagguacuccc

SEQ ID NO: 3332037 - RNA, 18 nt, Mycobacterium tuberculosis H37Rv
cgaucaggucgucacgcc

SEQ ID NO: 3332038 - RNA, 20 nt, Mycobacterium tuberculosis H37Rv
cgaucagguuggcggcugca

SEQ ID NO: 3332039 - RNA, 20 nt, Mycobacterium tuberculosis H37Rv
cgaucagguuggugcucagc

SEQ ID NO: 3332040 - RNA, 17 nt, Mycobacterium tuberculosis H37Rv
cgaucaguccggcguuc

SEQ ID NO: 3332041 - RNA, 18 nt, Mycobacterium tuberculosis H37Rv
cgaucagucgucuugaug

SEQ ID NO: 3332042 - RNA, 18 nt, Mycobacterium tuberculosis H37Rv
cgaucaguuccuguagcc

SEQ ID NO: 3332043 - RNA, 20 nt, Mycobacterium tuberculosis H37Rv
cgaucaucaugucggcgcag

SEQ ID NO: 3332044 - RNA, 16 nt, Mycobacterium tuberculosis H37Rv
cgaucaucgaccuggc

SEQ ID NO: 3332045 - RNA, 15 nt, Mycobacterium tuberculosis H37Rv
cgaucaugagcagca

SEQ ID NO: 3332046 - RNA, 18 nt, Mycobacterium tuberculosis H37Rv
cgaucaugagcagcacgu

SEQ ID NO: 3332047 - RNA, 15 nt, Mycobacterium tuberculosis H37Rv
cgaucauugcaccca

SEQ ID NO: 3332048 - RNA, 13 nt, Mycobacterium tuberculosis H37Rv
cgauccacaggcu

SEQ ID NO: 3332049 - RNA, 20 nt, Mycobacterium tuberculosis H37Rv
cgauccacggcgaugcagcc

SEQ ID NO: 3332050 - RNA, 13 nt, Mycobacterium tuberculosis H37Rv
cgauccagcaggc

SEQ ID NO: 3332051 - RNA, 15 nt, Mycobacterium tuberculosis H37Rv
cgauccagcaggccg

SEQ ID NO: 3332052 - RNA, 13 nt, Mycobacterium tuberculosis H37Rv
cgauccaggagug

SEQ ID NO: 3332053 - RNA, 13 nt, Mycobacterium tuberculosis H37Rv
cgauccagggccg

SEQ ID NO: 3332054 - RNA, 17 nt, Mycobacterium tuberculosis H37Rv
cgauccagggccgacgc

SEQ ID NO: 3332055 - RNA, 22 nt, Mycobacterium tuberculosis H37Rv
cgauccagggucaccucgucgc

SEQ ID NO: 3332056 - RNA, 17 nt, Mycobacterium tuberculosis H37Rv
cgaucccaacgcccggg

SEQ ID NO: 3332057 - RNA, 17 nt, Mycobacterium tuberculosis H37Rv
cgauccccagcaccacg

SEQ ID NO: 3332058 - RNA, 19 nt, Mycobacterium tuberculosis H37Rv
cgauccccagcaccacggu

SEQ ID NO: 3332059 - RNA, 15 nt, Mycobacterium tuberculosis H37Rv
cgauccccgcgcuga

SEQ ID NO: 3332060 - RNA, 17 nt, Mycobacterium tuberculosis H37Rv
cgaucccggcaacaacg

SEQ ID NO: 3332061 - RNA, 14 nt, Mycobacterium tuberculosis H37Rv
cgaucccggccagc

SEQ ID NO: 3332062 - RNA, 20 nt, Mycobacterium tuberculosis H37Rv
cgaucccggcgagcacccgc

SEQ ID NO: 3332063 - RNA, 12 nt, Mycobacterium tuberculosis H37Rv
cgauccgauaca

SEQ ID NO: 3332064 - RNA, 13 nt, Mycobacterium tuberculosis H37Rv
cgauccgcacagc

SEQ ID NO: 3332065 - RNA, 16 nt, Mycobacterium tuberculosis H37Rv
cgauccgcacagcaac

SEQ ID NO: 3332066 - RNA, 14 nt, Mycobacterium tuberculosis H37Rv
cgauccgcgcgcau

SEQ ID NO: 3332067 - RNA, 15 nt, Mycobacterium tuberculosis H37Rv
cgauccgcggcguuc

SEQ ID NO: 3332068 - RNA, 20 nt, Mycobacterium tuberculosis H37Rv
cgauccggaucccaccaccg

SEQ ID NO: 3332069 - RNA, 21 nt, Mycobacterium tuberculosis H37Rv
cgauccggaucccaccaccgc

SEQ ID NO: 3332070 - RNA, 20 nt, Mycobacterium tuberculosis H37Rv
cgauccucgcccgcaccagc

SEQ ID NO: 3332071 - RNA, 15 nt, Mycobacterium tuberculosis H37Rv
cgauccugaccagcc

SEQ ID NO: 3332072 - RNA, 20 nt, Mycobacterium tuberculosis H37Rv
cgaucgaauuaaagccacca

SEQ ID NO: 3332073 - RNA, 18 nt, Mycobacterium tuberculosis H37Rv
cgaucgacaccagggcgu

SEQ ID NO: 3332074 - RNA, 13 nt, Mycobacterium tuberculosis H37Rv
cgaucgacacccg

SEQ ID NO: 3332075 - RNA, 22 nt, Mycobacterium tuberculosis H37Rv
cgaucgacaccgugaccgccgc

SEQ ID NO: 3332076 - RNA, 22 nt, Mycobacterium tuberculosis H37Rv
cgaucgacgccgccacccggcg

SEQ ID NO: 3332077 - RNA, 23 nt, Mycobacterium tuberculosis H37Rv
cgaucgacggugucaugaacgac

SEQ ID NO: 3332078 - RNA, 17 nt, Mycobacterium tuberculosis H37Rv
cgaucgacucacacacc

SEQ ID NO: 3332079 - RNA, 16 nt, Mycobacterium tuberculosis H37Rv
cgaucgacugcagccc

SEQ ID NO: 3332080 - RNA, 17 nt, Mycobacterium tuberculosis H37Rv
cgaucgacugcagcccg

SEQ ID NO: 3332081 - RNA, 20 nt, Mycobacterium tuberculosis H37Rv
cgaucgagacuucuucgacg

SEQ ID NO: 3332082 - RNA, 13 nt, Mycobacterium tuberculosis H37Rv
cgaucgagcagga

SEQ ID NO: 3332083 - RNA, 21 nt, Mycobacterium tuberculosis H37Rv
cgaucgcauccgcgguuggca

SEQ ID NO: 3332084 - RNA, 16 nt, Mycobacterium tuberculosis H37Rv
cgaucgccaacgacuc

SEQ ID NO: 3332085 - RNA, 16 nt, Mycobacterium tuberculosis H37Rv
cgaucgccgacgccag

SEQ ID NO: 3332086 - RNA, 19 nt, Mycobacterium tuberculosis H37Rv
cgaucgccgaguccggcga

SEQ ID NO: 3332087 - RNA, 16 nt, Mycobacterium tuberculosis H37Rv
cgaucgccgcgaagcg

SEQ ID NO: 3332088 - RNA, 17 nt, Mycobacterium tuberculosis H37Rv
cgaucgccgcgccguag

SEQ ID NO: 3332089 - RNA, 17 nt, Mycobacterium tuberculosis H37Rv
cgaucgccgcgcugguc

SEQ ID NO: 3332090 - RNA, 18 nt, Mycobacterium tuberculosis H37Rv
cgaucgccgcgcuggucg

SEQ ID NO: 3332091 - RNA, 20 nt, Mycobacterium tuberculosis H37Rv
cgaucgccgcuaacgcaccu

SEQ ID NO: 3332092 - RNA, 14 nt, Mycobacterium tuberculosis H37Rv
cgaucgccggccgc

SEQ ID NO: 3332093 - RNA, 15 nt, Mycobacterium tuberculosis H37Rv
cgaucgccggccgcg

SEQ ID NO: 3332094 - RNA, 14 nt, Mycobacterium tuberculosis H37Rv
cgaucgcgagccca

SEQ ID NO: 3332095 - RNA, 14 nt, Mycobacterium tuberculosis H37Rv
cgaucgcgccaggc

SEQ ID NO: 3332096 - RNA, 17 nt, Mycobacterium tuberculosis H37Rv
cgaucgcgccaucgucg

SEQ ID NO: 3332097 - RNA, 15 nt, Mycobacterium tuberculosis H37Rv
cgaucgcgccgucgg

SEQ ID NO: 3332098 - RNA, 15 nt, Mycobacterium tuberculosis H37Rv
cgaucgcggcgccca

SEQ ID NO: 3332099 - RNA, 22 nt, Mycobacterium tuberculosis H37Rv
cgaucgcggcggccuccaccac

SEQ ID NO: 3332100 - RNA, 20 nt, Mycobacterium tuberculosis H37Rv
cgaucgcggucaaauccagc

SEQ ID NO: 3332101 - RNA, 16 nt, Mycobacterium tuberculosis H37Rv
cgaucgcguccuccuc

SEQ ID NO: 3332102 - RNA, 21 nt, Mycobacterium tuberculosis H37Rv
cgaucggcaacccgcaccagg

SEQ ID NO: 3332103 - RNA, 19 nt, Mycobacterium tuberculosis H37Rv
cgaucggcaaucgacucag

SEQ ID NO: 3332104 - RNA, 17 nt, Mycobacterium tuberculosis H37Rv
cgaucggcacuuagccc

SEQ ID NO: 3332105 - RNA, 22 nt, Mycobacterium tuberculosis H37Rv
cgaucggcagucccagcgccgc

SEQ ID NO: 3332106 - RNA, 22 nt, Mycobacterium tuberculosis H37Rv
cgaucggccaacagguccaccg

SEQ ID NO: 3332107 - RNA, 13 nt, Mycobacterium tuberculosis H37Rv
cgaucggccacca

SEQ ID NO: 3332108 - RNA, 18 nt, Mycobacterium tuberculosis H37Rv
cgaucggccagggugucc

SEQ ID NO: 3332109 - RNA, 13 nt, Mycobacterium tuberculosis H37Rv
cgaucggcccagc

SEQ ID NO: 3332110 - RNA, 16 nt, Mycobacterium tuberculosis H37Rv
cgaucggcgcgccgau

SEQ ID NO: 3332111 - RNA, 22 nt, Mycobacterium tuberculosis H37Rv
cgaucggcgcgccgaucggcac

SEQ ID NO: 3332112 - RNA, 18 nt, Mycobacterium tuberculosis H37Rv
cgaucggcucacgacugc

SEQ ID NO: 3332113 - RNA, 19 nt, Mycobacterium tuberculosis H37Rv
cgaucgggaguccgguagc

SEQ ID NO: 3332114 - RNA, 21 nt, Mycobacterium tuberculosis H37Rv
cgaucgggcccagcagcgcaa

SEQ ID NO: 3332115 - RNA, 18 nt, Mycobacterium tuberculosis H37Rv
cgaucgggcgggugaacg

SEQ ID NO: 3332116 - RNA, 14 nt, Mycobacterium tuberculosis H37Rv
cgaucgggcgucag

SEQ ID NO: 3332117 - RNA, 18 nt, Mycobacterium tuberculosis H37Rv
cgaucgggcuucggccag

SEQ ID NO: 3332118 - RNA, 15 nt, Mycobacterium tuberculosis H37Rv
cgaucggggcgacga

SEQ ID NO: 3332119 - RNA, 15 nt, Mycobacterium tuberculosis H37Rv
cgaucggggcgguga

SEQ ID NO: 3332120 - RNA, 16 nt, Mycobacterium tuberculosis H37Rv
cgaucggucguccgga

SEQ ID NO: 3332121 - RNA, 15 nt, Mycobacterium tuberculosis H37Rv
cgaucggugacgcgc

SEQ ID NO: 3332122 - RNA, 21 nt, Mycobacterium tuberculosis H37Rv
cgaucggugccgaagcugccc

SEQ ID NO: 3332123 - RNA, 22 nt, Mycobacterium tuberculosis H37Rv
cgaucggugccgaagcugccca

SEQ ID NO: 3332124 - RNA, 20 nt, Mycobacterium tuberculosis H37Rv
cgaucggugcgggcgccgcu

SEQ ID NO: 3332125 - RNA, 19 nt, Mycobacterium tuberculosis H37Rv
cgaucgucaagccgggcac

SEQ ID NO: 3332126 - RNA, 16 nt, Mycobacterium tuberculosis H37Rv
cgaucgucacgggguc

SEQ ID NO: 3332127 - RNA, 23 nt, Mycobacterium tuberculosis H37Rv
cgaucgucacgggguccgaugcg

SEQ ID NO: 3332128 - RNA, 19 nt, Mycobacterium tuberculosis H37Rv
cgaucgucagccagcguug

SEQ ID NO: 3332129 - RNA, 21 nt, Mycobacterium tuberculosis H37Rv
cgaucgucgcggccaaggcga

SEQ ID NO: 3332130 - RNA, 14 nt, Mycobacterium tuberculosis H37Rv
cgaucgugccggga

SEQ ID NO: 3332131 - RNA, 21 nt, Mycobacterium tuberculosis H37Rv
cgaucgugccgggaccggugu

SEQ ID NO: 3332132 - RNA, 19 nt, Mycobacterium tuberculosis H37Rv
cgaucguuucagcuagacc

SEQ ID NO: 3332133 - RNA, 21 nt, Mycobacterium tuberculosis H37Rv
cgaucuccaggcccggcggug

SEQ ID NO: 3332134 - RNA, 22 nt, Mycobacterium tuberculosis H37Rv
cgaucucccagugagcaugcga

SEQ ID NO: 3332135 - RNA, 14 nt, Mycobacterium tuberculosis H37Rv
cgaucucgaccagc

SEQ ID NO: 3332136 - RNA, 23 nt, Mycobacterium tuberculosis H37Rv
cgaucucgaccguauugaccagc

SEQ ID NO: 3332137 - RNA, 21 nt, Mycobacterium tuberculosis H37Rv
cgaucucgagcaggcgcacca

SEQ ID NO: 3332138 - RNA, 20 nt, Mycobacterium tuberculosis H37Rv
cgaucucgaucgacccgguc

SEQ ID NO: 3332139 - RNA, 22 nt, Mycobacterium tuberculosis H37Rv
cgaucucgccggcgaagaccgc

SEQ ID NO: 3332140 - RNA, 13 nt, Mycobacterium tuberculosis H37Rv
cgaucucggccag

SEQ ID NO: 3332141 - RNA, 17 nt, Mycobacterium tuberculosis H37Rv
cgaucucggcgagcacc

SEQ ID NO: 3332142 - RNA, 22 nt, Mycobacterium tuberculosis H37Rv
cgaucucggcgagcaccacccc

SEQ ID NO: 3332143 - RNA, 12 nt, Mycobacterium tuberculosis H37Rv
cgaucucggcgg

SEQ ID NO: 3332144 - RNA, 19 nt, Mycobacterium tuberculosis H37Rv
cgaucucggugaccucacc

SEQ ID NO: 3332145 - RNA, 22 nt, Mycobacterium tuberculosis H37Rv
cgaucucgucgcggucgaucac

SEQ ID NO: 3332146 - RNA, 19 nt, Mycobacterium tuberculosis H37Rv
cgaucucguggaucugccu

SEQ ID NO: 3332147 - RNA, 21 nt, Mycobacterium tuberculosis H37Rv
cgaucucguggaucugccucu

SEQ ID NO: 3332148 - RNA, 14 nt, Mycobacterium tuberculosis H37Rv
cgaucucuccugga

SEQ ID NO: 3332149 - RNA, 23 nt, Mycobacterium tuberculosis H37Rv
cgaucucuugguagugacugcga

SEQ ID NO: 3332150 - RNA, 21 nt, Mycobacterium tuberculosis H37Rv
cgaucugaagguguccgcugg

SEQ ID NO: 3332151 - RNA, 13 nt, Mycobacterium tuberculosis H37Rv
cgaucugcagcgc

SEQ ID NO: 3332152 - RNA, 14 nt, Mycobacterium tuberculosis H37Rv
cgaucugcagcgcg

SEQ ID NO: 3332153 - RNA, 15 nt, Mycobacterium tuberculosis H37Rv
cgaucugcaggccca

SEQ ID NO: 3332154 - RNA, 16 nt, Mycobacterium tuberculosis H37Rv
cgaucugcccccgccg

SEQ ID NO: 3332155 - RNA, 22 nt, Mycobacterium tuberculosis H37Rv
cgaucugcccggugauccacgc

SEQ ID NO: 3332156 - RNA, 14 nt, Mycobacterium tuberculosis H37Rv
cgaucugcgcguca

SEQ ID NO: 3332157 - RNA, 21 nt, Mycobacterium tuberculosis H37Rv
cgaucuggcguagugcucgcc

SEQ ID NO: 3332158 - RNA, 22 nt, Mycobacterium tuberculosis H37Rv
cgaucuucucgcggacggauuc

SEQ ID NO: 3332159 - RNA, 13 nt, Mycobacterium tuberculosis H37Rv
cgaucuuggccac

SEQ ID NO: 3332160 - RNA, 15 nt, Mycobacterium tuberculosis H37Rv
cgaucuuggccaccg

SEQ ID NO: 3332161 - RNA, 16 nt, Mycobacterium tuberculosis H37Rv
cgaucuuggccaccgc

SEQ ID NO: 3332162 - RNA, 13 nt, Mycobacterium tuberculosis H37Rv
cgaugaacagcga

SEQ ID NO: 3332163 - RNA, 20 nt, Mycobacterium tuberculosis H37Rv
cgaugaacaucuggcgacga

SEQ ID NO: 3332164 - RNA, 15 nt, Mycobacterium tuberculosis H37Rv
cgaugaaccgggcag

SEQ ID NO: 3332165 - RNA, 17 nt, Mycobacterium tuberculosis H37Rv
cgaugaaccgggcagca

SEQ ID NO: 3332166 - RNA, 19 nt, Mycobacterium tuberculosis H37Rv
cgaugacaaucaccuggua

SEQ ID NO: 3332167 - RNA, 22 nt, Mycobacterium tuberculosis H37Rv
cgaugacacaccgcgucggccg

SEQ ID NO: 3332168 - RNA, 18 nt, Mycobacterium tuberculosis H37Rv
cgaugacagacaucgcga

SEQ ID NO: 3332169 - RNA, 15 nt, Mycobacterium tuberculosis H37Rv
cgaugacaucgguca

SEQ ID NO: 3332170 - RNA, 23 nt, Mycobacterium tuberculosis H37Rv
cgaugaccagauguaccucaucg

SEQ ID NO: 3332171 - RNA, 19 nt, Mycobacterium tuberculosis H37Rv
cgaugaccagggucugcuc

SEQ ID NO: 3332172 - RNA, 14 nt, Mycobacterium tuberculosis H37Rv
cgaugaccgcaacc

SEQ ID NO: 3332173 - RNA, 12 nt, Mycobacterium tuberculosis H37Rv
cgaugaccgcac

SEQ ID NO: 3332174 - RNA, 15 nt, Mycobacterium tuberculosis H37Rv
cgaugaccgcaccga

SEQ ID NO: 3332175 - RNA, 23 nt, Mycobacterium tuberculosis H37Rv
cgaugaccgcaccgaccugaguc

SEQ ID NO: 3332176 - RNA, 15 nt, Mycobacterium tuberculosis H37Rv
cgaugaccgccugcu

SEQ ID NO: 3332177 - RNA, 14 nt, Mycobacterium tuberculosis H37Rv
cgaugaccgucgca

SEQ ID NO: 3332178 - RNA, 20 nt, Mycobacterium tuberculosis H37Rv
cgaugaccuugcccaccagu

SEQ ID NO: 3332179 - RNA, 19 nt, Mycobacterium tuberculosis H37Rv
cgaugacgaacggacccgg

SEQ ID NO: 3332180 - RNA, 16 nt, Mycobacterium tuberculosis H37Rv
cgaugacgaagugcag

SEQ ID NO: 3332181 - RNA, 18 nt, Mycobacterium tuberculosis H37Rv
cgaugacgacgccgucgg

SEQ ID NO: 3332182 - RNA, 21 nt, Mycobacterium tuberculosis H37Rv
cgaugacgaguucgcgcauca

SEQ ID NO: 3332183 - RNA, 13 nt, Mycobacterium tuberculosis H37Rv
cgaugacgaucgc

SEQ ID NO: 3332184 - RNA, 12 nt, Mycobacterium tuberculosis H37Rv
cgaugacgccgu

SEQ ID NO: 3332185 - RNA, 19 nt, Mycobacterium tuberculosis H37Rv
cgaugacggugccgaccgc

SEQ ID NO: 3332186 - RNA, 19 nt, Mycobacterium tuberculosis H37Rv
cgaugacguacggcugugc

SEQ ID NO: 3332187 - RNA, 16 nt, Mycobacterium tuberculosis H37Rv
cgaugagcaugcccag

SEQ ID NO: 3332188 - RNA, 17 nt, Mycobacterium tuberculosis H37Rv
cgaugagcaugcccagc

SEQ ID NO: 3332189 - RNA, 19 nt, Mycobacterium tuberculosis H37Rv
cgaugagccgacggcggcg

SEQ ID NO: 3332190 - RNA, 21 nt, Mycobacterium tuberculosis H37Rv
cgaugagcgguaccccccagc

SEQ ID NO: 3332191 - RNA, 17 nt, Mycobacterium tuberculosis H37Rv
cgaugaggcgcagcgcc

SEQ ID NO: 3332192 - RNA, 19 nt, Mycobacterium tuberculosis H37Rv
cgaugaucgccuucuuguu

SEQ ID NO: 3332193 - RNA, 21 nt, Mycobacterium tuberculosis H37Rv
cgaugaucucacccagcucgc

SEQ ID NO: 3332194 - RNA, 21 nt, Mycobacterium tuberculosis H37Rv
cgaugaucugcuugccaccgc

SEQ ID NO: 3332195 - RNA, 18 nt, Mycobacterium tuberculosis H37Rv
cgaugaucugugccgcua

SEQ ID NO: 3332196 - RNA, 17 nt, Mycobacterium tuberculosis H37Rv
cgaugaucuugccgcgg

SEQ ID NO: 3332197 - RNA, 24 nt, Mycobacterium tuberculosis H37Rv
cgaugaugacggcggcccgaucca

SEQ ID NO: 3332198 - RNA, 17 nt, Mycobacterium tuberculosis H37Rv
cgaugaugcggcgcagc

SEQ ID NO: 3332199 - RNA, 18 nt, Mycobacterium tuberculosis H37Rv
cgaugaugcggcgcagcg

SEQ ID NO: 3332200 - RNA, 18 nt, Mycobacterium tuberculosis H37Rv
cgaugauggacaccagcc

SEQ ID NO: 3332201 - RNA, 15 nt, Mycobacterium tuberculosis H37Rv
cgaugaugggcgguu

SEQ ID NO: 3332202 - RNA, 16 nt, Mycobacterium tuberculosis H37Rv
cgaugaugucggccgc

SEQ ID NO: 3332203 - RNA, 18 nt, Mycobacterium tuberculosis H37Rv
cgaugaugugcgaccaca

SEQ ID NO: 3332204 - RNA, 14 nt, Mycobacterium tuberculosis H37Rv
cgaugauguugagc

SEQ ID NO: 3332205 - RNA, 18 nt, Mycobacterium tuberculosis H37Rv
cgaugauguuggccggcg

SEQ ID NO: 3332206 - RNA, 21 nt, Mycobacterium tuberculosis H37Rv
cgaugauguuuuccccgcccu

SEQ ID NO: 3332207 - RNA, 20 nt, Mycobacterium tuberculosis H37Rv
cgaugauuucgucgaucggc

SEQ ID NO: 3332208 - RNA, 14 nt, Mycobacterium tuberculosis H37Rv
cgaugcacaaccgc

SEQ ID NO: 3332209 - RNA, 22 nt, Mycobacterium tuberculosis H37Rv
cgaugcacaaccgcugcugcug

SEQ ID NO: 3332210 - RNA, 22 nt, Mycobacterium tuberculosis H37Rv
cgaugcagccacauacaggccc

SEQ ID NO: 3332211 - RNA, 13 nt, Mycobacterium tuberculosis H37Rv
cgaugcaucggug

SEQ ID NO: 3332212 - RNA, 18 nt, Mycobacterium tuberculosis H37Rv
cgaugcaucggugcagcc

SEQ ID NO: 3332213 - RNA, 21 nt, Mycobacterium tuberculosis H37Rv
cgaugcauggcuugcucugcg

SEQ ID NO: 3332214 - RNA, 21 nt, Mycobacterium tuberculosis H37Rv
cgaugccacaucccacggugg

SEQ ID NO: 3332215 - RNA, 20 nt, Mycobacterium tuberculosis H37Rv
cgaugcccaagcccucgacg

SEQ ID NO: 3332216 - RNA, 20 nt, Mycobacterium tuberculosis H37Rv
cgaugcccuccucgaccgcg

SEQ ID NO: 3332217 - RNA, 22 nt, Mycobacterium tuberculosis H37Rv
cgaugcccuuggcgauguagcc

SEQ ID NO: 3332218 - RNA, 20 nt, Mycobacterium tuberculosis H37Rv
cgaugccgaacuccgcggaa

SEQ ID NO: 3332219 - RNA, 15 nt, Mycobacterium tuberculosis H37Rv
cgaugccgaagcccc

SEQ ID NO: 3332220 - RNA, 23 nt, Mycobacterium tuberculosis H37Rv
cgaugccgaagcccccgacguug

SEQ ID NO: 3332221 - RNA, 13 nt, Mycobacterium tuberculosis H37Rv
cgaugccgaccuu

SEQ ID NO: 3332222 - RNA, 19 nt, Mycobacterium tuberculosis H37Rv
cgaugccgccccgcagcug

SEQ ID NO: 3332223 - RNA, 17 nt, Mycobacterium tuberculosis H37Rv
cgaugccgccgaagagg

SEQ ID NO: 3332224 - RNA, 17 nt, Mycobacterium tuberculosis H37Rv
cgaugccgccggcaccg

SEQ ID NO: 3332225 - RNA, 21 nt, Mycobacterium tuberculosis H37Rv
cgaugccgccggcaccgccgg

SEQ ID NO: 3332226 - RNA, 16 nt, Mycobacterium tuberculosis H37Rv
cgaugccggguguguu

SEQ ID NO: 3332227 - RNA, 18 nt, Mycobacterium tuberculosis H37Rv
cgaugccggugugcgcca

SEQ ID NO: 3332228 - RNA, 20 nt, Mycobacterium tuberculosis H37Rv
cgaugccguaggcggccagu

SEQ ID NO: 3332229 - RNA, 18 nt, Mycobacterium tuberculosis H37Rv
cgaugccgugccgggcca

SEQ ID NO: 3332230 - RNA, 16 nt, Mycobacterium tuberculosis H37Rv
cgaugccgugcugggc

SEQ ID NO: 3332231 - RNA, 17 nt, Mycobacterium tuberculosis H37Rv
cgaugccgugcugggcc

SEQ ID NO: 3332232 - RNA, 13 nt, Mycobacterium tuberculosis H37Rv
cgaugcgacgaac

SEQ ID NO: 3332233 - RNA, 13 nt, Mycobacterium tuberculosis H37Rv
cgaugcgacgcag

SEQ ID NO: 3332234 - RNA, 16 nt, Mycobacterium tuberculosis H37Rv
cgaugcgacgcagacc

SEQ ID NO: 3332235 - RNA, 14 nt, Mycobacterium tuberculosis H37Rv
cgaugcgauuccgc

SEQ ID NO: 3332236 - RNA, 14 nt, Mycobacterium tuberculosis H37Rv
cgaugcgcaccagc

SEQ ID NO: 3332237 - RNA, 22 nt, Mycobacterium tuberculosis H37Rv
cgaugcgcaccagcaccugcac

SEQ ID NO: 3332238 - RNA, 18 nt, Mycobacterium tuberculosis H37Rv
cgaugcgcaccagcggcu

SEQ ID NO: 3332239 - RNA, 22 nt, Mycobacterium tuberculosis H37Rv
cgaugcgcacucccggcucggc

SEQ ID NO: 3332240 - RNA, 18 nt, Mycobacterium tuberculosis H37Rv
cgaugcgcagugcaccgc

SEQ ID NO: 3332241 - RNA, 13 nt, Mycobacterium tuberculosis H37Rv
cgaugcgcgccgg

SEQ ID NO: 3332242 - RNA, 19 nt, Mycobacterium tuberculosis H37Rv
cgaugcgcucacugcagcg

SEQ ID NO: 3332243 - RNA, 16 nt, Mycobacterium tuberculosis H37Rv
cgaugcgggccgccag

SEQ ID NO: 3332244 - RNA, 18 nt, Mycobacterium tuberculosis H37Rv
cgaugcgggccgccaggc

SEQ ID NO: 3332245 - RNA, 14 nt, Mycobacterium tuberculosis H37Rv
cgaugcgggcgacg

SEQ ID NO: 3332246 - RNA, 22 nt, Mycobacterium tuberculosis H37Rv
cgaugcgggcgccccaccggcc

SEQ ID NO: 3332247 - RNA, 14 nt, Mycobacterium tuberculosis H37Rv
cgaugcgguaucgg

SEQ ID NO: 3332248 - RNA, 22 nt, Mycobacterium tuberculosis H37Rv
cgaugcgguaucggucgacugg

SEQ ID NO: 3332249 - RNA, 16 nt, Mycobacterium tuberculosis H37Rv
cgaugcggucgacggg

SEQ ID NO: 3332250 - RNA, 17 nt, Mycobacterium tuberculosis H37Rv
cgaugcgucacaccacg

SEQ ID NO: 3332251 - RNA, 19 nt, Mycobacterium tuberculosis H37Rv
cgaugcgucacaccacgac

SEQ ID NO: 3332252 - RNA, 20 nt, Mycobacterium tuberculosis H37Rv
cgaugcgucacaccacgacg

SEQ ID NO: 3332253 - RNA, 22 nt, Mycobacterium tuberculosis H37Rv
cgaugcgucacaccacgacgcg

SEQ ID NO: 3332254 - RNA, 15 nt, Mycobacterium tuberculosis H37Rv
cgaugcguccgccca

SEQ ID NO: 3332255 - RNA, 22 nt, Mycobacterium tuberculosis H37Rv
cgaugcguccgcccagccgcag

SEQ ID NO: 3332256 - RNA, 14 nt, Mycobacterium tuberculosis H37Rv
cgaugcgugccgac

SEQ ID NO: 3332257 - RNA, 18 nt, Mycobacterium tuberculosis H37Rv
cgaugcgugccgacccgc

SEQ ID NO: 3332258 - RNA, 20 nt, Mycobacterium tuberculosis H37Rv
cgaugcgugccgacccgcuu

SEQ ID NO: 3332259 - RNA, 21 nt, Mycobacterium tuberculosis H37Rv
cgaugcgugccgacccgcuuc

SEQ ID NO: 3332260 - RNA, 20 nt, Mycobacterium tuberculosis H37Rv
cgaugcguucgggcuccagc

SEQ ID NO: 3332261 - RNA, 18 nt, Mycobacterium tuberculosis H37Rv
cgaugcucacuacccgca

SEQ ID NO: 3332262 - RNA, 16 nt, Mycobacterium tuberculosis H37Rv
cgaugcucagcugguc

SEQ ID NO: 3332263 - RNA, 14 nt, Mycobacterium tuberculosis H37Rv
cgaugcucgccguu

SEQ ID NO: 3332264 - RNA, 15 nt, Mycobacterium tuberculosis H37Rv
cgaugcucgccguug

SEQ ID NO: 3332265 - RNA, 17 nt, Mycobacterium tuberculosis H37Rv
cgaugcucgucccagaa

SEQ ID NO: 3332266 - RNA, 21 nt, Mycobacterium tuberculosis H37Rv
cgaugcucgucccagaaccgg

SEQ ID NO: 3332267 - RNA, 24 nt, Mycobacterium tuberculosis H37Rv
cgaugcugaucaccgucguacucg

SEQ ID NO: 3332268 - RNA, 21 nt, Mycobacterium tuberculosis H37Rv
cgaugcuggcaaaguaucgca

SEQ ID NO: 3332269 - RNA, 23 nt, Mycobacterium tuberculosis H37Rv
cgaugcugggcgagacggcguug

SEQ ID NO: 3332270 - RNA, 23 nt, Mycobacterium tuberculosis H37Rv
cgaugcuucccggaugccgaccu

SEQ ID NO: 3332271 - RNA, 22 nt, Mycobacterium tuberculosis H37Rv
cgaugcuuucguauucggccgc

SEQ ID NO: 3332272 - RNA, 23 nt, Mycobacterium tuberculosis H37Rv
cgaugcuuucguauucggccgcg

SEQ ID NO: 3332273 - RNA, 15 nt, Mycobacterium tuberculosis H37Rv
cgauggaccgccagg

SEQ ID NO: 3332274 - RNA, 19 nt, Mycobacterium tuberculosis H37Rv
cgauggaguucucaucgcc

SEQ ID NO: 3332275 - RNA, 22 nt, Mycobacterium tuberculosis H37Rv
cgauggaugggcugcgcgucga

SEQ ID NO: 3332276 - RNA, 22 nt, Mycobacterium tuberculosis H37Rv
cgauggauuggcgucagcagca

SEQ ID NO: 3332277 - RNA, 21 nt, Mycobacterium tuberculosis H37Rv
cgauggcaagggccgacgucg

SEQ ID NO: 3332278 - RNA, 21 nt, Mycobacterium tuberculosis H37Rv
cgauggcaccacuacaucgau

SEQ ID NO: 3332279 - RNA, 14 nt, Mycobacterium tuberculosis H37Rv
cgauggcaggggcg

SEQ ID NO: 3332280 - RNA, 13 nt, Mycobacterium tuberculosis H37Rv
cgauggcaucucg

SEQ ID NO: 3332281 - RNA, 15 nt, Mycobacterium tuberculosis H37Rv
cgauggcaucucgau

SEQ ID NO: 3332282 - RNA, 21 nt, Mycobacterium tuberculosis H37Rv
cgauggcaugggcuaccgaga

SEQ ID NO: 3332283 - RNA, 17 nt, Mycobacterium tuberculosis H37Rv
cgauggccaguucuuca

SEQ ID NO: 3332284 - RNA, 14 nt, Mycobacterium tuberculosis H37Rv
cgauggccgacgcu

SEQ ID NO: 3332285 - RNA, 15 nt, Mycobacterium tuberculosis H37Rv
cgauggcgcaccggc

SEQ ID NO: 3332286 - RNA, 19 nt, Mycobacterium tuberculosis H37Rv
cgauggcgcaccggcgucg

SEQ ID NO: 3332287 - RNA, 21 nt, Mycobacterium tuberculosis H37Rv
cgauggcgcgcaacguagcca

SEQ ID NO: 3332288 - RNA, 14 nt, Mycobacterium tuberculosis H37Rv
cgauggcgcgcuca

SEQ ID NO: 3332289 - RNA, 15 nt, Mycobacterium tuberculosis H37Rv
cgauggcggccacca

SEQ ID NO: 3332290 - RNA, 17 nt, Mycobacterium tuberculosis H37Rv
cgauggcggccaccagc

SEQ ID NO: 3332291 - RNA, 16 nt, Mycobacterium tuberculosis H37Rv
cgauggcggccaccgu

SEQ ID NO: 3332292 - RNA, 18 nt, Mycobacterium tuberculosis H37Rv
cgauggcgguggggcugu

SEQ ID NO: 3332293 - RNA, 18 nt, Mycobacterium tuberculosis H37Rv
cgauggcgucggccagga

SEQ ID NO: 3332294 - RNA, 16 nt, Mycobacterium tuberculosis H37Rv
cgauggcuaccccagg

SEQ ID NO: 3332295 - RNA, 17 nt, Mycobacterium tuberculosis H37Rv
cgauggcuaccccaggg

SEQ ID NO: 3332296 - RNA, 18 nt, Mycobacterium tuberculosis H37Rv
cgauggcuaccuuggacu

SEQ ID NO: 3332297 - RNA, 17 nt, Mycobacterium tuberculosis H37Rv
cgauggcucucacgagc

SEQ ID NO: 3332298 - RNA, 19 nt, Mycobacterium tuberculosis H37Rv
cgaugggaaucagugaaga

SEQ ID NO: 3332299 - RNA, 16 nt, Mycobacterium tuberculosis H37Rv
cgaugggauaccgcgu

SEQ ID NO: 3332300 - RNA, 20 nt, Mycobacterium tuberculosis H37Rv
cgaugggccgguccggggca

SEQ ID NO: 3332301 - RNA, 20 nt, Mycobacterium tuberculosis H37Rv
cgauggguguugcuggccgc

SEQ ID NO: 3332302 - RNA, 18 nt, Mycobacterium tuberculosis H37Rv
cgaugguacccgcgccgc

SEQ ID NO: 3332303 - RNA, 19 nt, Mycobacterium tuberculosis H37Rv
cgaugguacccgcgccgcg

SEQ ID NO: 3332304 - RNA, 20 nt, Mycobacterium tuberculosis H37Rv
cgaugguaugcccgccguag

SEQ ID NO: 3332305 - RNA, 19 nt, Mycobacterium tuberculosis H37Rv
cgauggucaaugcgcuggc

SEQ ID NO: 3332306 - RNA, 21 nt, Mycobacterium tuberculosis H37Rv
cgauggucuccucggucaccg

SEQ ID NO: 3332307 - RNA, 22 nt, Mycobacterium tuberculosis H37Rv
cgauggucuccucggucaccga

SEQ ID NO: 3332308 - RNA, 17 nt, Mycobacterium tuberculosis H37Rv
cgauggugccgacccgc

SEQ ID NO: 3332309 - RNA, 18 nt, Mycobacterium tuberculosis H37Rv
cgauggugccgacccgcc

SEQ ID NO: 3332310 - RNA, 20 nt, Mycobacterium tuberculosis H37Rv
cgauggugcggcccaaccgg

SEQ ID NO: 3332311 - RNA, 16 nt, Mycobacterium tuberculosis H37Rv
cgaugguggccgccac

SEQ ID NO: 3332312 - RNA, 18 nt, Mycobacterium tuberculosis H37Rv
cgaugguguacugcugcu

SEQ ID NO: 3332313 - RNA, 20 nt, Mycobacterium tuberculosis H37Rv
cgauggugugcacggcuucg

SEQ ID NO: 3332314 - RNA, 22 nt, Mycobacterium tuberculosis H37Rv
cgaugguuauccccuggccaac

SEQ ID NO: 3332315 - RNA, 23 nt, Mycobacterium tuberculosis H37Rv
cgaugguuauccccuggccaacc

SEQ ID NO: 3332316 - RNA, 21 nt, Mycobacterium tuberculosis H37Rv
cgaugguugaaccagucgacc

SEQ ID NO: 3332317 - RNA, 23 nt, Mycobacterium tuberculosis H37Rv
cgaugguugccuuguucgcccac

SEQ ID NO: 3332318 - RNA, 16 nt, Mycobacterium tuberculosis H37Rv
cgauguauccgaugcg

SEQ ID NO: 3332319 - RNA, 17 nt, Mycobacterium tuberculosis H37Rv
cgaugucacccucccgc

SEQ ID NO: 3332320 - RNA, 23 nt, Mycobacterium tuberculosis H37Rv
cgaugucagcggccgcgacguug

SEQ ID NO: 3332321 - RNA, 20 nt, Mycobacterium tuberculosis H37Rv
cgauguccaaugcaccguug

SEQ ID NO: 3332322 - RNA, 18 nt, Mycobacterium tuberculosis H37Rv
cgauguccgcagcaccgu

SEQ ID NO: 3332323 - RNA, 15 nt, Mycobacterium tuberculosis H37Rv
cgauguccgcgcgaa

SEQ ID NO: 3332324 - RNA, 13 nt, Mycobacterium tuberculosis H37Rv
cgauguccucgua

SEQ ID NO: 3332325 - RNA, 15 nt, Mycobacterium tuberculosis H37Rv
cgauguccuggaagc

SEQ ID NO: 3332326 - RNA, 14 nt, Mycobacterium tuberculosis H37Rv
cgaugucgacgucg

SEQ ID NO: 3332327 - RNA, 13 nt, Mycobacterium tuberculosis H37Rv
cgaugucgaugcc

SEQ ID NO: 3332328 - RNA, 22 nt, Mycobacterium tuberculosis H37Rv
cgaugucggcucggcccccgag

SEQ ID NO: 3332329 - RNA, 19 nt, Mycobacterium tuberculosis H37Rv
cgaugucgguaaucuccuc

SEQ ID NO: 3332330 - RNA, 15 nt, Mycobacterium tuberculosis H37Rv
cgaugucggucgggu

SEQ ID NO: 3332331 - RNA, 18 nt, Mycobacterium tuberculosis H37Rv
cgaugucguaccgggcga

SEQ ID NO: 3332332 - RNA, 18 nt, Mycobacterium tuberculosis H37Rv
cgaugucguuggccaccu

SEQ ID NO: 3332333 - RNA, 22 nt, Mycobacterium tuberculosis H37Rv
cgaugugcccaugaugcucgau

SEQ ID NO: 3332334 - RNA, 15 nt, Mycobacterium tuberculosis H37Rv
cgaugugcccgccag

SEQ ID NO: 3332335 - RNA, 21 nt, Mycobacterium tuberculosis H37Rv
cgaugugccgauuggccugcc

SEQ ID NO: 3332336 - RNA, 13 nt, Mycobacterium tuberculosis H37Rv
cgaugugcgccca

SEQ ID NO: 3332337 - RNA, 15 nt, Mycobacterium tuberculosis H37Rv
cgauguuggcagggc

SEQ ID NO: 3332338 - RNA, 19 nt, Mycobacterium tuberculosis H37Rv
cgauuagcaaaccgaccgu

SEQ ID NO: 3332339 - RNA, 13 nt, Mycobacterium tuberculosis H37Rv
cgauuccaggaug

SEQ ID NO: 3332340 - RNA, 19 nt, Mycobacterium tuberculosis H37Rv
cgauuccgcgucugcucgc

SEQ ID NO: 3332341 - RNA, 20 nt, Mycobacterium tuberculosis H37Rv
cgauuccgcgucugcucgcg

SEQ ID NO: 3332342 - RNA, 20 nt, Mycobacterium tuberculosis H37Rv
cgauuccgcgucugcucggc

SEQ ID NO: 3332343 - RNA, 22 nt, Mycobacterium tuberculosis H37Rv
cgauuccgcgucugcucggcgg

SEQ ID NO: 3332344 - RNA, 16 nt, Mycobacterium tuberculosis H37Rv
cgauuccgcucguucg

SEQ ID NO: 3332345 - RNA, 22 nt, Mycobacterium tuberculosis H37Rv
cgauuccggaguucuuguagcc

SEQ ID NO: 3332346 - RNA, 21 nt, Mycobacterium tuberculosis H37Rv
cgauucgccuagcgagcgcac

SEQ ID NO: 3332347 - RNA, 12 nt, Mycobacterium tuberculosis H37Rv
cgauucggccca

SEQ ID NO: 3332348 - RNA, 18 nt, Mycobacterium tuberculosis H37Rv
cgauucgucgcggaucag

SEQ ID NO: 3332349 - RNA, 17 nt, Mycobacterium tuberculosis H37Rv
cgauucgugucggugcg

SEQ ID NO: 3332350 - RNA, 15 nt, Mycobacterium tuberculosis H37Rv
cgauucucgaucugg

SEQ ID NO: 3332351 - RNA, 16 nt, Mycobacterium tuberculosis H37Rv
cgauucugcgucugcu

SEQ ID NO: 3332352 - RNA, 19 nt, Mycobacterium tuberculosis H37Rv
cgauucugcgucugcucgc

SEQ ID NO: 3332353 - RNA, 20 nt, Mycobacterium tuberculosis H37Rv
cgauucugcgucugcucgcc

SEQ ID NO: 3332354 - RNA, 16 nt, Mycobacterium tuberculosis H37Rv
cgauucugugucugcu

SEQ ID NO: 3332355 - RNA, 20 nt, Mycobacterium tuberculosis H37Rv
cgauucugugucugcucgcg

SEQ ID NO: 3332356 - RNA, 19 nt, Mycobacterium tuberculosis H37Rv
cgauucugugucugcucgg

SEQ ID NO: 3332357 - RNA, 20 nt, Mycobacterium tuberculosis H37Rv
cgauucugugucugcucggc

SEQ ID NO: 3332358 - RNA, 23 nt, Mycobacterium tuberculosis H37Rv
cgauucugugucugcucggcgag

SEQ ID NO: 3332359 - RNA, 17 nt, Mycobacterium tuberculosis H37Rv
cgauugaacucugguga

SEQ ID NO: 3332360 - RNA, 13 nt, Mycobacterium tuberculosis H37Rv
cgauugagcccca

SEQ ID NO: 3332361 - RNA, 14 nt, Mycobacterium tuberculosis H37Rv
cgauugcaccaugg

SEQ ID NO: 3332362 - RNA, 14 nt, Mycobacterium tuberculosis H37Rv
cgauugcagcuucg

SEQ ID NO: 3332363 - RNA, 19 nt, Mycobacterium tuberculosis H37Rv
cgauugcagcuucggccag

SEQ ID NO: 3332364 - RNA, 14 nt, Mycobacterium tuberculosis H37Rv
cgauugcccgcgcu

SEQ ID NO: 3332365 - RNA, 15 nt, Mycobacterium tuberculosis H37Rv
cgauugcugcggcuu

SEQ ID NO: 3332366 - RNA, 15 nt, Mycobacterium tuberculosis H37Rv
cgauuggaccgccaa

SEQ ID NO: 3332367 - RNA, 13 nt, Mycobacterium tuberculosis H37Rv
cgauuggcucgcc

SEQ ID NO: 3332368 - RNA, 17 nt, Mycobacterium tuberculosis H37Rv
cgauugucgccgcgcuc

SEQ ID NO: 3332369 - RNA, 18 nt, Mycobacterium tuberculosis H37Rv
cgauuuccaucgcgaccu

SEQ ID NO: 3332370 - RNA, 14 nt, Mycobacterium tuberculosis H37Rv
cgauuucgaucaca

SEQ ID NO: 3332371 - RNA, 16 nt, Mycobacterium tuberculosis H37Rv
cgauuucgaugacgaa

SEQ ID NO: 3332372 - RNA, 24 nt, Mycobacterium tuberculosis H37Rv
cgauuucgaugacgaacaagaaaa

SEQ ID NO: 3332373 - RNA, 12 nt, Mycobacterium tuberculosis H37Rv
cgauuucgccgg

SEQ ID NO: 3332374 - RNA, 15 nt, Mycobacterium tuberculosis H37Rv
cgauuucggcgcgug

SEQ ID NO: 3332375 - RNA, 20 nt, Mycobacterium tuberculosis H37Rv
cgauuuugcgucugcucgcc

SEQ ID NO: 3332376 - RNA, 19 nt, Mycobacterium tuberculosis H37Rv
cgauuuugcgucugcucgg

SEQ ID NO: 3332377 - RNA, 20 nt, Mycobacterium tuberculosis H37Rv
cgcaaaacgagcuuccacgc

SEQ ID NO: 3332378 - RNA, 17 nt, Mycobacterium tuberculosis H37Rv
cgcaaaaucgcacgguu

SEQ ID NO: 3332379 - RNA, 15 nt, Mycobacterium tuberculosis H37Rv
cgcaaacagauucgg

SEQ ID NO: 3332380 - RNA, 19 nt, Mycobacterium tuberculosis H37Rv
cgcaaaccacccgcaacac

SEQ ID NO: 3332381 - RNA, 18 nt, Mycobacterium tuberculosis H37Rv
cgcaaagacagcgcggga

SEQ ID NO: 3332382 - RNA, 13 nt, Mycobacterium tuberculosis H37Rv
cgcaaaggagaag

SEQ ID NO: 3332383 - RNA, 15 nt, Mycobacterium tuberculosis H37Rv
cgcaaaggccccggu

SEQ ID NO: 3332384 - RNA, 17 nt, Mycobacterium tuberculosis H37Rv
cgcaaaggccccgguga

SEQ ID NO: 3332385 - RNA, 19 nt, Mycobacterium tuberculosis H37Rv
cgcaaauugcaacagagcg

SEQ ID NO: 3332386 - RNA, 16 nt, Mycobacterium tuberculosis H37Rv
cgcaacaaccgguugg

SEQ ID NO: 3332387 - RNA, 14 nt, Mycobacterium tuberculosis H37Rv
cgcaacacauccag

SEQ ID NO: 3332388 - RNA, 19 nt, Mycobacterium tuberculosis H37Rv
cgcaacaccgccaacuccu

SEQ ID NO: 3332389 - RNA, 17 nt, Mycobacterium tuberculosis H37Rv
cgcaacacugaguucgg

SEQ ID NO: 3332390 - RNA, 22 nt, Mycobacterium tuberculosis H37Rv
cgcaaccaaagcgacgagcagc

SEQ ID NO: 3332391 - RNA, 21 nt, Mycobacterium tuberculosis H37Rv
cgcaaccacgccccgaucggu

SEQ ID NO: 3332392 - RNA, 19 nt, Mycobacterium tuberculosis H37Rv
cgcaaccagccuuuccggc

SEQ ID NO: 3332393 - RNA, 17 nt, Mycobacterium tuberculosis H37Rv
cgcaaccauguuaacgc

SEQ ID NO: 3332394 - RNA, 13 nt, Mycobacterium tuberculosis H37Rv
cgcaacccagccg

SEQ ID NO: 3332395 - RNA, 19 nt, Mycobacterium tuberculosis H37Rv
cgcaacccugccgcgauga

SEQ ID NO: 3332396 - RNA, 19 nt, Mycobacterium tuberculosis H37Rv
cgcaaccgagggcauuccg

SEQ ID NO: 3332397 - RNA, 20 nt, Mycobacterium tuberculosis H37Rv
cgcaaccgagggcauuccga

SEQ ID NO: 3332398 - RNA, 17 nt, Mycobacterium tuberculosis H37Rv
cgcaaccgccgcgucau

SEQ ID NO: 3332399 - RNA, 21 nt, Mycobacterium tuberculosis H37Rv
cgcaaccgcgcuuggagcggg

SEQ ID NO: 3332400 - RNA, 14 nt, Mycobacterium tuberculosis H37Rv
cgcaaccgcggccc

SEQ ID NO: 3332401 - RNA, 16 nt, Mycobacterium tuberculosis H37Rv
cgcaaccggcgaucgg

SEQ ID NO: 3332402 - RNA, 18 nt, Mycobacterium tuberculosis H37Rv
cgcaaccggcggacaccu

SEQ ID NO: 3332403 - RNA, 17 nt, Mycobacterium tuberculosis H37Rv
cgcaaccgguggaugaa

SEQ ID NO: 3332404 - RNA, 22 nt, Mycobacterium tuberculosis H37Rv
cgcaaccuaaauugccgggccc

SEQ ID NO: 3332405 - RNA, 17 nt, Mycobacterium tuberculosis H37Rv
cgcaaccucgccgucgu

SEQ ID NO: 3332406 - RNA, 15 nt, Mycobacterium tuberculosis H37Rv
cgcaacgcaucgaug

SEQ ID NO: 3332407 - RNA, 15 nt, Mycobacterium tuberculosis H37Rv
cgcaacgccgauggc

SEQ ID NO: 3332408 - RNA, 15 nt, Mycobacterium tuberculosis H37Rv
cgcaacgccgccagc

SEQ ID NO: 3332409 - RNA, 13 nt, Mycobacterium tuberculosis H37Rv
cgcaacgcgucgg

SEQ ID NO: 3332410 - RNA, 23 nt, Mycobacterium tuberculosis H37Rv
cgcaacgcgugcgcaucagcggu

SEQ ID NO: 3332411 - RNA, 13 nt, Mycobacterium tuberculosis H37Rv
cgcaacgcuucgg

SEQ ID NO: 3332412 - RNA, 21 nt, Mycobacterium tuberculosis H37Rv
cgcaacgcuucggcagcuccc

SEQ ID NO: 3332413 - RNA, 14 nt, Mycobacterium tuberculosis H37Rv
cgcaacggaugugg

SEQ ID NO: 3332414 - RNA, 20 nt, Mycobacterium tuberculosis H37Rv
cgcaacguacgcacgcagcc

SEQ ID NO: 3332415 - RNA, 22 nt, Mycobacterium tuberculosis H37Rv
cgcaacuacggcguccccgaca

SEQ ID NO: 3332416 - RNA, 16 nt, Mycobacterium tuberculosis H37Rv
cgcaacucccagcacg

SEQ ID NO: 3332417 - RNA, 23 nt, Mycobacterium tuberculosis H37Rv
cgcaacucccagcacgguggcuu

SEQ ID NO: 3332418 - RNA, 17 nt, Mycobacterium tuberculosis H37Rv
cgcaacucgaccacuuc

SEQ ID NO: 3332419 - RNA, 24 nt, Mycobacterium tuberculosis H37Rv
cgcaacucgacgcguagcucgcgg

SEQ ID NO: 3332420 - RNA, 23 nt, Mycobacterium tuberculosis H37Rv
cgcaacucgccgaaaucggccag

SEQ ID NO: 3332421 - RNA, 14 nt, Mycobacterium tuberculosis H37Rv
cgcaagaaugccgc

SEQ ID NO: 3332422 - RNA, 16 nt, Mycobacterium tuberculosis H37Rv
cgcaagaaugccgccg

SEQ ID NO: 3332423 - RNA, 18 nt, Mycobacterium tuberculosis H37Rv
cgcaagcagcccggguga

SEQ ID NO: 3332424 - RNA, 24 nt, Mycobacterium tuberculosis H37Rv
cgcaagccucguggugagaucaug

SEQ ID NO: 3332425 - RNA, 21 nt, Mycobacterium tuberculosis H37Rv
cgcaagcggacccgaccgucg

SEQ ID NO: 3332426 - RNA, 15 nt, Mycobacterium tuberculosis H37Rv
cgcaagucuccucga

SEQ ID NO: 3332427 - RNA, 17 nt, Mycobacterium tuberculosis H37Rv
cgcaagucuccucgaau

SEQ ID NO: 3332428 - RNA, 17 nt, Mycobacterium tuberculosis H37Rv
cgcaagugucuccggca

SEQ ID NO: 3332429 - RNA, 22 nt, Mycobacterium tuberculosis H37Rv
cgcaauacccgagcguccggug

SEQ ID NO: 3332430 - RNA, 21 nt, Mycobacterium tuberculosis H37Rv
cgcaauagaccgcagucgcug

SEQ ID NO: 3332431 - RNA, 19 nt, Mycobacterium tuberculosis H37Rv
cgcaauauccuccagcagg

SEQ ID NO: 3332432 - RNA, 16 nt, Mycobacterium tuberculosis H37Rv
cgcaauaugccacaga

SEQ ID NO: 3332433 - RNA, 21 nt, Mycobacterium tuberculosis H37Rv
cgcaauaugccacagaccgaa

SEQ ID NO: 3332434 - RNA, 23 nt, Mycobacterium tuberculosis H37Rv
cgcaaucaggaaccgcucgucac

SEQ ID NO: 3332435 - RNA, 21 nt, Mycobacterium tuberculosis H37Rv
cgcaaugaccugcagcgcauc

SEQ ID NO: 3332436 - RNA, 20 nt, Mycobacterium tuberculosis H37Rv
cgcaaugacgucgucggcca

SEQ ID NO: 3332437 - RNA, 20 nt, Mycobacterium tuberculosis H37Rv
cgcaaugccaaucgcacugg

SEQ ID NO: 3332438 - RNA, 12 nt, Mycobacterium tuberculosis H37Rv
cgcaaugcggcc

SEQ ID NO: 3332439 - RNA, 14 nt, Mycobacterium tuberculosis H37Rv
cgcaaugcguugac

SEQ ID NO: 3332440 - RNA, 17 nt, Mycobacterium tuberculosis H37Rv
cgcacaaaaucagcgau

SEQ ID NO: 3332441 - RNA, 15 nt, Mycobacterium tuberculosis H37Rv
cgcacaaaccgggcg

SEQ ID NO: 3332442 - RNA, 15 nt, Mycobacterium tuberculosis H37Rv
cgcacaaacgggcgu

SEQ ID NO: 3332443 - RNA, 18 nt, Mycobacterium tuberculosis H37Rv
cgcacaacccgucgagcc

SEQ ID NO: 3332444 - RNA, 21 nt, Mycobacterium tuberculosis H37Rv
cgcacaaguucuucgacagcg

SEQ ID NO: 3332445 - RNA, 17 nt, Mycobacterium tuberculosis H37Rv
cgcacaccaacaccgcg

SEQ ID NO: 3332446 - RNA, 15 nt, Mycobacterium tuberculosis H37Rv
cgcacacccgguugg

SEQ ID NO: 3332447 - RNA, 13 nt, Mycobacterium tuberculosis H37Rv
cgcacacccugca

SEQ ID NO: 3332448 - RNA, 13 nt, Mycobacterium tuberculosis H37Rv
cgcacaccgaccc

SEQ ID NO: 3332449 - RNA, 22 nt, Mycobacterium tuberculosis H37Rv
cgcacaccggcuuugcuugccg

SEQ ID NO: 3332450 - RNA, 13 nt, Mycobacterium tuberculosis H37Rv
cgcacacgaucgc

SEQ ID NO: 3332451 - RNA, 13 nt, Mycobacterium tuberculosis H37Rv
cgcacacuaccgc

SEQ ID NO: 3332452 - RNA, 20 nt, Mycobacterium tuberculosis H37Rv
cgcacagcaccacaucgaag

SEQ ID NO: 3332453 - RNA, 15 nt, Mycobacterium tuberculosis H37Rv
cgcacagcaccacgu

SEQ ID NO: 3332454 - RNA, 14 nt, Mycobacterium tuberculosis H37Rv
cgcacaggauuuuc

SEQ ID NO: 3332455 - RNA, 16 nt, Mycobacterium tuberculosis H37Rv
cgcacaguucgccgga

SEQ ID NO: 3332456 - RNA, 20 nt, Mycobacterium tuberculosis H37Rv
cgcacauggugggucgacga

SEQ ID NO: 3332457 - RNA, 19 nt, Mycobacterium tuberculosis H37Rv
cgcacauugguguccacca

SEQ ID NO: 3332458 - RNA, 22 nt, Mycobacterium tuberculosis H37Rv
cgcacauugguguccaccaccg

SEQ ID NO: 3332459 - RNA, 12 nt, Mycobacterium tuberculosis H37Rv
cgcaccaacacc

SEQ ID NO: 3332460 - RNA, 19 nt, Mycobacterium tuberculosis H37Rv
cgcaccaagacgccaccca

SEQ ID NO: 3332461 - RNA, 16 nt, Mycobacterium tuberculosis H37Rv
cgcaccaaggccguga

SEQ ID NO: 3332462 - RNA, 18 nt, Mycobacterium tuberculosis H37Rv
cgcaccacaauccacgca

SEQ ID NO: 3332463 - RNA, 16 nt, Mycobacterium tuberculosis H37Rv
cgcaccacaccacggu

SEQ ID NO: 3332464 - RNA, 18 nt, Mycobacterium tuberculosis H37Rv
cgcaccacaccacggugg

SEQ ID NO: 3332465 - RNA, 23 nt, Mycobacterium tuberculosis H37Rv
cgcaccacaccacgguggccgcu

SEQ ID NO: 3332466 - RNA, 16 nt, Mycobacterium tuberculosis H37Rv
cgcaccaccgagccga

SEQ ID NO: 3332467 - RNA, 15 nt, Mycobacterium tuberculosis H37Rv
cgcaccaccgccccg

SEQ ID NO: 3332468 - RNA, 16 nt, Mycobacterium tuberculosis H37Rv
cgcaccaccgccccgc

SEQ ID NO: 3332469 - RNA, 12 nt, Mycobacterium tuberculosis H37Rv
cgcaccaccgcg

SEQ ID NO: 3332470 - RNA, 19 nt, Mycobacterium tuberculosis H37Rv
cgcaccaccuccccgaucu

SEQ ID NO: 3332471 - RNA, 21 nt, Mycobacterium tuberculosis H37Rv
cgcaccacgaugaucuugccg

SEQ ID NO: 3332472 - RNA, 16 nt, Mycobacterium tuberculosis H37Rv
cgcaccacggcgguca

SEQ ID NO: 3332473 - RNA, 15 nt, Mycobacterium tuberculosis H37Rv
cgcaccagcaccugc

SEQ ID NO: 3332474 - RNA, 14 nt, Mycobacterium tuberculosis H37Rv
cgcaccagcggcug

SEQ ID NO: 3332475 - RNA, 22 nt, Mycobacterium tuberculosis H37Rv
cgcaccagcggcugaccgggca

SEQ ID NO: 3332476 - RNA, 15 nt, Mycobacterium tuberculosis H37Rv
cgcaccagcugucgg

SEQ ID NO: 3332477 - RNA, 20 nt, Mycobacterium tuberculosis H37Rv
cgcaccagcugucgggcagc

SEQ ID NO: 3332478 - RNA, 16 nt, Mycobacterium tuberculosis H37Rv
cgcaccaggcggccgu

SEQ ID NO: 3332479 - RNA, 14 nt, Mycobacterium tuberculosis H37Rv
cgcaccaguggcgc

SEQ ID NO: 3332480 - RNA, 16 nt, Mycobacterium tuberculosis H37Rv
cgcaccaugucgguga

SEQ ID NO: 3332481 - RNA, 17 nt, Mycobacterium tuberculosis H37Rv
cgcaccaugucggugag

SEQ ID NO: 3332482 - RNA, 16 nt, Mycobacterium tuberculosis H37Rv
cgcacccaccacacca

SEQ ID NO: 3332483 - RNA, 14 nt, Mycobacterium tuberculosis H37Rv
cgcacccagggcgu

SEQ ID NO: 3332484 - RNA, 20 nt, Mycobacterium tuberculosis H37Rv
cgcacccaugaucccgcuga

SEQ ID NO: 3332485 - RNA, 18 nt, Mycobacterium tuberculosis H37Rv
cgcacccccgacaccgcc

SEQ ID NO: 3332486 - RNA, 19 nt, Mycobacterium tuberculosis H37Rv
cgcacccccgacaccgccg

SEQ ID NO: 3332487 - RNA, 14 nt, Mycobacterium tuberculosis H37Rv
cgcacccccgucga

SEQ ID NO: 3332488 - RNA, 14 nt, Mycobacterium tuberculosis H37Rv
cgcaccccggcaua

SEQ ID NO: 3332489 - RNA, 15 nt, Mycobacterium tuberculosis H37Rv
cgcaccccggccgcg

SEQ ID NO: 3332490 - RNA, 20 nt, Mycobacterium tuberculosis H37Rv
cgcacccgaaacaccgucug

SEQ ID NO: 3332491 - RNA, 12 nt, Mycobacterium tuberculosis H37Rv
cgcacccgccgg

SEQ ID NO: 3332492 - RNA, 21 nt, Mycobacterium tuberculosis H37Rv
cgcacccgcgggucguccggc

SEQ ID NO: 3332493 - RNA, 12 nt, Mycobacterium tuberculosis H37Rv
cgcacccgcucg

SEQ ID NO: 3332494 - RNA, 13 nt, Mycobacterium tuberculosis H37Rv
cgcacccgcucgg

SEQ ID NO: 3332495 - RNA, 15 nt, Mycobacterium tuberculosis H37Rv
cgcacccgcucgucg

SEQ ID NO: 3332496 - RNA, 17 nt, Mycobacterium tuberculosis H37Rv
cgcacccggccgcgcac

SEQ ID NO: 3332497 - RNA, 16 nt, Mycobacterium tuberculosis H37Rv
cgcacccguccgccgc

SEQ ID NO: 3332498 - RNA, 14 nt, Mycobacterium tuberculosis H37Rv
cgcacccguccggc

SEQ ID NO: 3332499 - RNA, 19 nt, Mycobacterium tuberculosis H37Rv
cgcacccguugcgacaccu

SEQ ID NO: 3332500 - RNA, 21 nt, Mycobacterium tuberculosis H37Rv
cgcacccguugcgacaccucc

SEQ ID NO: 3332501 - RNA, 21 nt, Mycobacterium tuberculosis H37Rv
cgcacccguugcucccacggc

SEQ ID NO: 3332502 - RNA, 17 nt, Mycobacterium tuberculosis H37Rv
cgcacccugcgugcggc

SEQ ID NO: 3332503 - RNA, 18 nt, Mycobacterium tuberculosis H37Rv
cgcaccgaccgcaccgug

SEQ ID NO: 3332504 - RNA, 16 nt, Mycobacterium tuberculosis H37Rv
cgcaccgagcgagacc

SEQ ID NO: 3332505 - RNA, 18 nt, Mycobacterium tuberculosis H37Rv
cgcaccgagcgagaccac

SEQ ID NO: 3332506 - RNA, 17 nt, Mycobacterium tuberculosis H37Rv
cgcaccgccacccugac

SEQ ID NO: 3332507 - RNA, 19 nt, Mycobacterium tuberculosis H37Rv
cgcaccgccacccugacca

SEQ ID NO: 3332508 - RNA, 15 nt, Mycobacterium tuberculosis H37Rv
cgcaccgcccgccga

SEQ ID NO: 3332509 - RNA, 17 nt, Mycobacterium tuberculosis H37Rv
cgcaccgcggaccggcg

SEQ ID NO: 3332510 - RNA, 21 nt, Mycobacterium tuberculosis H37Rv
cgcaccgcggaccggcgucgg

SEQ ID NO: 3332511 - RNA, 17 nt, Mycobacterium tuberculosis H37Rv
cgcaccgcgguacgccg

SEQ ID NO: 3332512 - RNA, 22 nt, Mycobacterium tuberculosis H37Rv
cgcaccgcgguggggucgacgc

SEQ ID NO: 3332513 - RNA, 14 nt, Mycobacterium tuberculosis H37Rv
cgcaccgcguucug

SEQ ID NO: 3332514 - RNA, 13 nt, Mycobacterium tuberculosis H37Rv
cgcaccgcugacc

SEQ ID NO: 3332515 - RNA, 15 nt, Mycobacterium tuberculosis H37Rv
cgcaccgcugaccgc

SEQ ID NO: 3332516 - RNA, 21 nt, Mycobacterium tuberculosis H37Rv
cgcaccgcuguugcaucgccg

SEQ ID NO: 3332517 - RNA, 14 nt, Mycobacterium tuberculosis H37Rv
cgcaccggagucgc

SEQ ID NO: 3332518 - RNA, 18 nt, Mycobacterium tuberculosis H37Rv
cgcaccggaucaccgcgc

SEQ ID NO: 3332519 - RNA, 14 nt, Mycobacterium tuberculosis H37Rv
cgcaccggaucgcc

SEQ ID NO: 3332520 - RNA, 20 nt, Mycobacterium tuberculosis H37Rv
cgcaccggaucggcuaccua

SEQ ID NO: 3332521 - RNA, 14 nt, Mycobacterium tuberculosis H37Rv
cgcaccggugaugg

SEQ ID NO: 3332522 - RNA, 23 nt, Mycobacterium tuberculosis H37Rv
cgcaccggugauggugaccagca

SEQ ID NO: 3332523 - RNA, 22 nt, Mycobacterium tuberculosis H37Rv
cgcaccgugggcccuucacugu

SEQ ID NO: 3332524 - RNA, 23 nt, Mycobacterium tuberculosis H37Rv
cgcaccgugugggccccgccgau

SEQ ID NO: 3332525 - RNA, 15 nt, Mycobacterium tuberculosis H37Rv
cgcaccuacccugcg

SEQ ID NO: 3332526 - RNA, 18 nt, Mycobacterium tuberculosis H37Rv
cgcaccuauggucaaccg

SEQ ID NO: 3332527 - RNA, 18 nt, Mycobacterium tuberculosis H37Rv
cgcaccuccgccccggau

SEQ ID NO: 3332528 - RNA, 13 nt, Mycobacterium tuberculosis H37Rv
cgcaccuccugcg

SEQ ID NO: 3332529 - RNA, 17 nt, Mycobacterium tuberculosis H37Rv
cgcaccugcgcgcggcc

SEQ ID NO: 3332530 - RNA, 22 nt, Mycobacterium tuberculosis H37Rv
cgcaccugcgcgcggccgcgcu

SEQ ID NO: 3332531 - RNA, 19 nt, Mycobacterium tuberculosis H37Rv
cgcaccugggcugccggcc

SEQ ID NO: 3332532 - RNA, 13 nt, Mycobacterium tuberculosis H37Rv
cgcaccuugaccg

SEQ ID NO: 3332533 - RNA, 19 nt, Mycobacterium tuberculosis H37Rv
cgcaccuugaccgucgcgc

SEQ ID NO: 3332534 - RNA, 22 nt, Mycobacterium tuberculosis H37Rv
cgcaccuugaccgucgcgcauu

SEQ ID NO: 3332535 - RNA, 17 nt, Mycobacterium tuberculosis H37Rv
cgcacgaaaccgcagcg

SEQ ID NO: 3332536 - RNA, 20 nt, Mycobacterium tuberculosis H37Rv
cgcacgaaaccgcagcgcga

SEQ ID NO: 3332537 - RNA, 16 nt, Mycobacterium tuberculosis H37Rv
cgcacgaaaucagccc

SEQ ID NO: 3332538 - RNA, 15 nt, Mycobacterium tuberculosis H37Rv
cgcacgaaccggucg

SEQ ID NO: 3332539 - RNA, 18 nt, Mycobacterium tuberculosis H37Rv
cgcacgaacgaguccaac

SEQ ID NO: 3332540 - RNA, 19 nt, Mycobacterium tuberculosis H37Rv
cgcacgacaacuucgccgg

SEQ ID NO: 3332541 - RNA, 18 nt, Mycobacterium tuberculosis H37Rv
cgcacgacaggaucgggg

SEQ ID NO: 3332542 - RNA, 19 nt, Mycobacterium tuberculosis H37Rv
cgcacgacgaauccccgac

SEQ ID NO: 3332543 - RNA, 20 nt, Mycobacterium tuberculosis H37Rv
cgcacgacgcgacacgccgg

SEQ ID NO: 3332544 - RNA, 15 nt, Mycobacterium tuberculosis H37Rv
cgcacgaguuaccgg

SEQ ID NO: 3332545 - RNA, 18 nt, Mycobacterium tuberculosis H37Rv
cgcacgaucagggaagcc

SEQ ID NO: 3332546 - RNA, 22 nt, Mycobacterium tuberculosis H37Rv
cgcacgaucagggaagccugcg

SEQ ID NO: 3332547 - RNA, 16 nt, Mycobacterium tuberculosis H37Rv
cgcacgaucgcaccga

SEQ ID NO: 3332548 - RNA, 12 nt, Mycobacterium tuberculosis H37Rv
cgcacgaucugc

SEQ ID NO: 3332549 - RNA, 14 nt, Mycobacterium tuberculosis H37Rv
cgcacgaucugcag

SEQ ID NO: 3332550 - RNA, 17 nt, Mycobacterium tuberculosis H37Rv
cgcacgauggccgucga

SEQ ID NO: 3332551 - RNA, 19 nt, Mycobacterium tuberculosis H37Rv
cgcacgauggugugcagca

SEQ ID NO: 3332552 - RNA, 21 nt, Mycobacterium tuberculosis H37Rv
cgcacgauuucgagcgcugcu

SEQ ID NO: 3332553 - RNA, 13 nt, Mycobacterium tuberculosis H37Rv
cgcacgcacggcg

SEQ ID NO: 3332554 - RNA, 14 nt, Mycobacterium tuberculosis H37Rv
cgcacgcacggcgu

SEQ ID NO: 3332555 - RNA, 16 nt, Mycobacterium tuberculosis H37Rv
cgcacgcagccgauac

SEQ ID NO: 3332556 - RNA, 23 nt, Mycobacterium tuberculosis H37Rv
cgcacgcaguucggucagcgccu

SEQ ID NO: 3332557 - RNA, 13 nt, Mycobacterium tuberculosis H37Rv
cgcacgccaccgg

SEQ ID NO: 3332558 - RNA, 13 nt, Mycobacterium tuberculosis H37Rv
cgcacgcccgcac

SEQ ID NO: 3332559 - RNA, 16 nt, Mycobacterium tuberculosis H37Rv
cgcacgcccgcacucg

SEQ ID NO: 3332560 - RNA, 16 nt, Mycobacterium tuberculosis H37Rv
cgcacgccgaccagca

SEQ ID NO: 3332561 - RNA, 20 nt, Mycobacterium tuberculosis H37Rv
cgcacgccgaccagcacccg

SEQ ID NO: 3332562 - RNA, 18 nt, Mycobacterium tuberculosis H37Rv
cgcacgccggcaugccag

SEQ ID NO: 3332563 - RNA, 14 nt, Mycobacterium tuberculosis H37Rv
cgcacgccggccag

SEQ ID NO: 3332564 - RNA, 21 nt, Mycobacterium tuberculosis H37Rv
cgcacgcgaaaugccugcgcg

SEQ ID NO: 3332565 - RNA, 21 nt, Mycobacterium tuberculosis H37Rv
cgcacgcggaaaggcuuccgc

SEQ ID NO: 3332566 - RNA, 23 nt, Mycobacterium tuberculosis H37Rv
cgcacgcggaaaggcuuccgcgu

SEQ ID NO: 3332567 - RNA, 16 nt, Mycobacterium tuberculosis H37Rv
cgcacgcggcaauggu

SEQ ID NO: 3332568 - RNA, 18 nt, Mycobacterium tuberculosis H37Rv
cgcacgcgguucaccacg

SEQ ID NO: 3332569 - RNA, 15 nt, Mycobacterium tuberculosis H37Rv
cgcacgcuagccgac

SEQ ID NO: 3332570 - RNA, 19 nt, Mycobacterium tuberculosis H37Rv
cgcacgcucggcgugucgg

SEQ ID NO: 3332571 - RNA, 14 nt, Mycobacterium tuberculosis H37Rv
cgcacggaccaucg

SEQ ID NO: 3332572 - RNA, 19 nt, Mycobacterium tuberculosis H37Rv
cgcacggaccaucgccagg

SEQ ID NO: 3332573 - RNA, 19 nt, Mycobacterium tuberculosis H37Rv
cgcacggaggcggaccagg

SEQ ID NO: 3332574 - RNA, 20 nt, Mycobacterium tuberculosis H37Rv
cgcacggccaccgcgcaacc

SEQ ID NO: 3332575 - RNA, 23 nt, Mycobacterium tuberculosis H37Rv
cgcacggccgggucgaacaggcc

SEQ ID NO: 3332576 - RNA, 21 nt, Mycobacterium tuberculosis H37Rv
cgcacggcgccgacccgauca

SEQ ID NO: 3332577 - RNA, 14 nt, Mycobacterium tuberculosis H37Rv
cgcacggcgucggc

SEQ ID NO: 3332578 - RNA, 19 nt, Mycobacterium tuberculosis H37Rv
cgcacggcgucggccaccg

SEQ ID NO: 3332579 - RNA, 23 nt, Mycobacterium tuberculosis H37Rv
cgcacggcgucggccaccgccug

SEQ ID NO: 3332580 - RNA, 19 nt, Mycobacterium tuberculosis H37Rv
cgcacggcuagcgccguga

SEQ ID NO: 3332581 - RNA, 22 nt, Mycobacterium tuberculosis H37Rv
cgcacgggaucgaucugcggag

SEQ ID NO: 3332582 - RNA, 17 nt, Mycobacterium tuberculosis H37Rv
cgcacgggcgaccugcg

SEQ ID NO: 3332583 - RNA, 12 nt, Mycobacterium tuberculosis H37Rv
cgcacggucagc

SEQ ID NO: 3332584 - RNA, 16 nt, Mycobacterium tuberculosis H37Rv
cgcacgguccacggug

SEQ ID NO: 3332585 - RNA, 20 nt, Mycobacterium tuberculosis H37Rv
cgcacgguguauccgacugg

SEQ ID NO: 3332586 - RNA, 22 nt, Mycobacterium tuberculosis H37Rv
cgcacgguucuuggcgucuugg

SEQ ID NO: 3332587 - RNA, 17 nt, Mycobacterium tuberculosis H37Rv
cgcacgguugccgucag

SEQ ID NO: 3332588 - RNA, 21 nt, Mycobacterium tuberculosis H37Rv
cgcacgguugccgucaggguc

SEQ ID NO: 3332589 - RNA, 22 nt, Mycobacterium tuberculosis H37Rv
cgcacguauccacggucgacca

SEQ ID NO: 3332590 - RNA, 20 nt, Mycobacterium tuberculosis H37Rv
cgcacgugaugcccuggggg

SEQ ID NO: 3332591 - RNA, 16 nt, Mycobacterium tuberculosis H37Rv
cgcacguuggcggcca

SEQ ID NO: 3332592 - RNA, 17 nt, Mycobacterium tuberculosis H37Rv
cgcacguuggcggccag

SEQ ID NO: 3332593 - RNA, 20 nt, Mycobacterium tuberculosis H37Rv
cgcacuaccgccuuugcccg

SEQ ID NO: 3332594 - RNA, 21 nt, Mycobacterium tuberculosis H37Rv
cgcacucauagaacucgccgc

SEQ ID NO: 3332595 - RNA, 17 nt, Mycobacterium tuberculosis H37Rv
cgcacuccacgaucggc

SEQ ID NO: 3332596 - RNA, 19 nt, Mycobacterium tuberculosis H37Rv
cgcacucccggcucggcca

SEQ ID NO: 3332597 - RNA, 22 nt, Mycobacterium tuberculosis H37Rv
cgcacucgacggucaucgcugu

SEQ ID NO: 3332598 - RNA, 19 nt, Mycobacterium tuberculosis H37Rv
cgcacucggcgguuccggc

SEQ ID NO: 3332599 - RNA, 14 nt, Mycobacterium tuberculosis H37Rv
cgcacucguugccg

SEQ ID NO: 3332600 - RNA, 19 nt, Mycobacterium tuberculosis H37Rv
cgcacugaaauggcgugcu

SEQ ID NO: 3332601 - RNA, 17 nt, Mycobacterium tuberculosis H37Rv
cgcacugaggcucaggu

SEQ ID NO: 3332602 - RNA, 22 nt, Mycobacterium tuberculosis H37Rv
cgcacugaugucacccgcccga

SEQ ID NO: 3332603 - RNA, 12 nt, Mycobacterium tuberculosis H37Rv
cgcacugccggg

SEQ ID NO: 3332604 - RNA, 18 nt, Mycobacterium tuberculosis H37Rv
cgcacugcgccggccgca

SEQ ID NO: 3332605 - RNA, 19 nt, Mycobacterium tuberculosis H37Rv
cgcacugggugcgucgacc

SEQ ID NO: 3332606 - RNA, 16 nt, Mycobacterium tuberculosis H37Rv
cgcacuggucaacacg

SEQ ID NO: 3332607 - RNA, 19 nt, Mycobacterium tuberculosis H37Rv
cgcacuggucaacacgacu

SEQ ID NO: 3332608 - RNA, 20 nt, Mycobacterium tuberculosis H37Rv
cgcacugguugggcgagacc

SEQ ID NO: 3332609 - RNA, 22 nt, Mycobacterium tuberculosis H37Rv
cgcacugguugggcgagaccgc

SEQ ID NO: 3332610 - RNA, 17 nt, Mycobacterium tuberculosis H37Rv
cgcacuguugcguagcg

SEQ ID NO: 3332611 - RNA, 14 nt, Mycobacterium tuberculosis H37Rv
cgcacuuucuuccu

SEQ ID NO: 3332612 - RNA, 22 nt, Mycobacterium tuberculosis H37Rv
cgcacuuucuuccucggggcuc

SEQ ID NO: 3332613 - RNA, 15 nt, Mycobacterium tuberculosis H37Rv
cgcagaaagucgcgc

SEQ ID NO: 3332614 - RNA, 14 nt, Mycobacterium tuberculosis H37Rv
cgcagaacggcguu

SEQ ID NO: 3332615 - RNA, 18 nt, Mycobacterium tuberculosis H37Rv
cgcagaauccggcaacca

SEQ ID NO: 3332616 - RNA, 23 nt, Mycobacterium tuberculosis H37Rv
cgcagaauccggcaaccaccggc

SEQ ID NO: 3332617 - RNA, 14 nt, Mycobacterium tuberculosis H37Rv
cgcagaaucgcaca

SEQ ID NO: 3332618 - RNA, 13 nt, Mycobacterium tuberculosis H37Rv
cgcagaccgccac

SEQ ID NO: 3332619 - RNA, 14 nt, Mycobacterium tuberculosis H37Rv
cgcagaccguccag

SEQ ID NO: 3332620 - RNA, 18 nt, Mycobacterium tuberculosis H37Rv
cgcagaccguccagcaac

SEQ ID NO: 3332621 - RNA, 22 nt, Mycobacterium tuberculosis H37Rv
cgcagaccguccagcaacagcg

SEQ ID NO: 3332622 - RNA, 15 nt, Mycobacterium tuberculosis H37Rv
cgcagaccugcauca

SEQ ID NO: 3332623 - RNA, 18 nt, Mycobacterium tuberculosis H37Rv
cgcagaccugcaucacaa

SEQ ID NO: 3332624 - RNA, 15 nt, Mycobacterium tuberculosis H37Rv
cgcagacgccgacuc

SEQ ID NO: 3332625 - RNA, 13 nt, Mycobacterium tuberculosis H37Rv
cgcagacggcugc

SEQ ID NO: 3332626 - RNA, 22 nt, Mycobacterium tuberculosis H37Rv
cgcagacucgauaugcagcucg

SEQ ID NO: 3332627 - RNA, 22 nt, Mycobacterium tuberculosis H37Rv
cgcagacucgccaccgcggcga

SEQ ID NO: 3332628 - RNA, 11 nt, Mycobacterium tuberculosis H37Rv
cgcagagcgua

SEQ ID NO: 3332629 - RNA, 21 nt, Mycobacterium tuberculosis H37Rv
cgcagagcguacaggucggcc

SEQ ID NO: 3332630 - RNA, 16 nt, Mycobacterium tuberculosis H37Rv
cgcagauagcgcucga

SEQ ID NO: 3332631 - RNA, 21 nt, Mycobacterium tuberculosis H37Rv
cgcagauagcgcucgaacucg

SEQ ID NO: 3332632 - RNA, 15 nt, Mycobacterium tuberculosis H37Rv
cgcagaucaccgcca

SEQ ID NO: 3332633 - RNA, 16 nt, Mycobacterium tuberculosis H37Rv
cgcagaucaccgccag

SEQ ID NO: 3332634 - RNA, 22 nt, Mycobacterium tuberculosis H37Rv
cgcagaucaggguggcgcggua

SEQ ID NO: 3332635 - RNA, 19 nt, Mycobacterium tuberculosis H37Rv
cgcagauccccgccaccga

SEQ ID NO: 3332636 - RNA, 12 nt, Mycobacterium tuberculosis H37Rv
cgcagaucgugg

SEQ ID NO: 3332637 - RNA, 16 nt, Mycobacterium tuberculosis H37Rv
cgcagcaacggcggcg

SEQ ID NO: 3332638 - RNA, 22 nt, Mycobacterium tuberculosis H37Rv
cgcagcaacggcggcgucgcgg

SEQ ID NO: 3332639 - RNA, 18 nt, Mycobacterium tuberculosis H37Rv
cgcagcaacugggcggcc

SEQ ID NO: 3332640 - RNA, 19 nt, Mycobacterium tuberculosis H37Rv
cgcagcacauccugcagcu

SEQ ID NO: 3332641 - RNA, 20 nt, Mycobacterium tuberculosis H37Rv
cgcagcaccggcucgacugc

SEQ ID NO: 3332642 - RNA, 14 nt, Mycobacterium tuberculosis H37Rv
cgcagcaccgucgg

SEQ ID NO: 3332643 - RNA, 19 nt, Mycobacterium tuberculosis H37Rv
cgcagcaccgucggcacca

SEQ ID NO: 3332644 - RNA, 22 nt, Mycobacterium tuberculosis H37Rv
cgcagcaccucgucgaucgccg

SEQ ID NO: 3332645 - RNA, 14 nt, Mycobacterium tuberculosis H37Rv
cgcagcacggguga

SEQ ID NO: 3332646 - RNA, 20 nt, Mycobacterium tuberculosis H37Rv
cgcagcacucccugguucgg

SEQ ID NO: 3332647 - RNA, 16 nt, Mycobacterium tuberculosis H37Rv
cgcagcacucgcccaa

SEQ ID NO: 3332648 - RNA, 22 nt, Mycobacterium tuberculosis H37Rv
cgcagcacucgcccaagcgcag

SEQ ID NO: 3332649 - RNA, 20 nt, Mycobacterium tuberculosis H37Rv
cgcagcaggggacgaccaug

SEQ ID NO: 3332650 - RNA, 14 nt, Mycobacterium tuberculosis H37Rv
cgcagcaggugagc

SEQ ID NO: 3332651 - RNA, 18 nt, Mycobacterium tuberculosis H37Rv
cgcagcaggugcaucgcc

SEQ ID NO: 3332652 - RNA, 18 nt, Mycobacterium tuberculosis H37Rv
cgcagcauccccgcagcg

SEQ ID NO: 3332653 - RNA, 16 nt, Mycobacterium tuberculosis H37Rv
cgcagcaucuccgccg

SEQ ID NO: 3332654 - RNA, 17 nt, Mycobacterium tuberculosis H37Rv
cgcagcaucuccgccgg

SEQ ID NO: 3332655 - RNA, 21 nt, Mycobacterium tuberculosis H37Rv
cgcagcauguccgcagcggug

SEQ ID NO: 3332656 - RNA, 20 nt, Mycobacterium tuberculosis H37Rv
cgcagcauguggccgccguc

SEQ ID NO: 3332657 - RNA, 14 nt, Mycobacterium tuberculosis H37Rv
cgcagcauugacca

SEQ ID NO: 3332658 - RNA, 18 nt, Mycobacterium tuberculosis H37Rv
cgcagccaaguccgcccg

SEQ ID NO: 3332659 - RNA, 20 nt, Mycobacterium tuberculosis H37Rv
cgcagccaaguccgcccgcc

SEQ ID NO: 3332660 - RNA, 22 nt, Mycobacterium tuberculosis H37Rv
cgcagccaaguccgcccgccga

SEQ ID NO: 3332661 - RNA, 13 nt, Mycobacterium tuberculosis H37Rv
cgcagccacgcgg

SEQ ID NO: 3332662 - RNA, 14 nt, Mycobacterium tuberculosis H37Rv
cgcagccacgcggg

SEQ ID NO: 3332663 - RNA, 20 nt, Mycobacterium tuberculosis H37Rv
cgcagccacguuacgcucgc

SEQ ID NO: 3332664 - RNA, 21 nt, Mycobacterium tuberculosis H37Rv
cgcagccacguuacgcucgcg

SEQ ID NO: 3332665 - RNA, 13 nt, Mycobacterium tuberculosis H37Rv
cgcagccagaucu

SEQ ID NO: 3332666 - RNA, 12 nt, Mycobacterium tuberculosis H37Rv
cgcagccagcaa

SEQ ID NO: 3332667 - RNA, 22 nt, Mycobacterium tuberculosis H37Rv
cgcagccagcaagucugcccga

SEQ ID NO: 3332668 - RNA, 15 nt, Mycobacterium tuberculosis H37Rv
cgcagccccgacagu

SEQ ID NO: 3332669 - RNA, 15 nt, Mycobacterium tuberculosis H37Rv
cgcagccccucgucg

SEQ ID NO: 3332670 - RNA, 16 nt, Mycobacterium tuberculosis H37Rv
cgcagccgaucgagca

SEQ ID NO: 3332671 - RNA, 19 nt, Mycobacterium tuberculosis H37Rv
cgcagccgaucgagcagga

SEQ ID NO: 3332672 - RNA, 17 nt, Mycobacterium tuberculosis H37Rv
cgcagccgaucgucucg

SEQ ID NO: 3332673 - RNA, 20 nt, Mycobacterium tuberculosis H37Rv
cgcagccgaucgucucggcc

SEQ ID NO: 3332674 - RNA, 21 nt, Mycobacterium tuberculosis H37Rv
cgcagccgaucgucucggcca

SEQ ID NO: 3332675 - RNA, 16 nt, Mycobacterium tuberculosis H37Rv
cgcagccgcucgacgg

SEQ ID NO: 3332676 - RNA, 18 nt, Mycobacterium tuberculosis H37Rv
cgcagccgggcaccaccc

SEQ ID NO: 3332677 - RNA, 16 nt, Mycobacterium tuberculosis H37Rv
cgcagccgggcaccga

SEQ ID NO: 3332678 - RNA, 21 nt, Mycobacterium tuberculosis H37Rv
cgcagccgguuaauggaauga

SEQ ID NO: 3332679 - RNA, 14 nt, Mycobacterium tuberculosis H37Rv
cgcagccugcagcg

SEQ ID NO: 3332680 - RNA, 14 nt, Mycobacterium tuberculosis H37Rv
cgcagccuucucgc

SEQ ID NO: 3332681 - RNA, 20 nt, Mycobacterium tuberculosis H37Rv
cgcagcgaaaacccggucgg

SEQ ID NO: 3332682 - RNA, 16 nt, Mycobacterium tuberculosis H37Rv
cgcagcgaaucuccaa

SEQ ID NO: 3332683 - RNA, 16 nt, Mycobacterium tuberculosis H37Rv
cgcagcgacgcggugg

SEQ ID NO: 3332684 - RNA, 22 nt, Mycobacterium tuberculosis H37Rv
cgcagcgacgggaaagccaccu

SEQ ID NO: 3332685 - RNA, 13 nt, Mycobacterium tuberculosis H37Rv
cgcagcgccaccc

SEQ ID NO: 3332686 - RNA, 15 nt, Mycobacterium tuberculosis H37Rv
cgcagcgccacccga

SEQ ID NO: 3332687 - RNA, 22 nt, Mycobacterium tuberculosis H37Rv
cgcagcgccggcagcagcagag

SEQ ID NO: 3332688 - RNA, 22 nt, Mycobacterium tuberculosis H37Rv
cgcagcgccuccucgaucuccg

SEQ ID NO: 3332689 - RNA, 12 nt, Mycobacterium tuberculosis H37Rv
cgcagcgccugc

SEQ ID NO: 3332690 - RNA, 22 nt, Mycobacterium tuberculosis H37Rv
cgcagcgccugcggcagcaccc

SEQ ID NO: 3332691 - RNA, 19 nt, Mycobacterium tuberculosis H37Rv
cgcagcgcgaucgcgguca

SEQ ID NO: 3332692 - RNA, 12 nt, Mycobacterium tuberculosis H37Rv
cgcagcgcggcu

SEQ ID NO: 3332693 - RNA, 19 nt, Mycobacterium tuberculosis H37Rv
cgcagcggcaaggucaacg

SEQ ID NO: 3332694 - RNA, 12 nt, Mycobacterium tuberculosis H37Rv
cgcagcggcauc

SEQ ID NO: 3332695 - RNA, 20 nt, Mycobacterium tuberculosis H37Rv
cgcagcggcauccacaccga

SEQ ID NO: 3332696 - RNA, 18 nt, Mycobacterium tuberculosis H37Rv
cgcagcggccagcccagc

SEQ ID NO: 3332697 - RNA, 19 nt, Mycobacterium tuberculosis H37Rv
cgcagcggccagcccagcc

SEQ ID NO: 3332698 - RNA, 22 nt, Mycobacterium tuberculosis H37Rv
cgcagcggccugaccggcucgc

SEQ ID NO: 3332699 - RNA, 14 nt, Mycobacterium tuberculosis H37Rv
cgcagcggcggcaa

SEQ ID NO: 3332700 - RNA, 23 nt, Mycobacterium tuberculosis H37Rv
cgcagcgggcggugucgucaucg

SEQ ID NO: 3332701 - RNA, 16 nt, Mycobacterium tuberculosis H37Rv
cgcagcgguccgccgc

SEQ ID NO: 3332702 - RNA, 22 nt, Mycobacterium tuberculosis H37Rv
cgcagcggugaggugaccaacg

SEQ ID NO: 3332703 - RNA, 17 nt, Mycobacterium tuberculosis H37Rv
cgcagcgugagugcagc

SEQ ID NO: 3332704 - RNA, 18 nt, Mycobacterium tuberculosis H37Rv
cgcagcgugagugcagca

SEQ ID NO: 3332705 - RNA, 22 nt, Mycobacterium tuberculosis H37Rv
cgcagcgugagugcagcacgau

SEQ ID NO: 3332706 - RNA, 23 nt, Mycobacterium tuberculosis H37Rv
cgcagcguguugcguucggugau

SEQ ID NO: 3332707 - RNA, 18 nt, Mycobacterium tuberculosis H37Rv
cgcagcguuggccgcugu

SEQ ID NO: 3332708 - RNA, 15 nt, Mycobacterium tuberculosis H37Rv
cgcagcuaacccgcc

SEQ ID NO: 3332709 - RNA, 16 nt, Mycobacterium tuberculosis H37Rv
cgcagcucgcugauag

SEQ ID NO: 3332710 - RNA, 22 nt, Mycobacterium tuberculosis H37Rv
cgcagcucgcugauaguggcgc

SEQ ID NO: 3332711 - RNA, 15 nt, Mycobacterium tuberculosis H37Rv
cgcagcugagccgug

SEQ ID NO: 3332712 - RNA, 15 nt, Mycobacterium tuberculosis H37Rv
cgcagcugccgcacc

SEQ ID NO: 3332713 - RNA, 13 nt, Mycobacterium tuberculosis H37Rv
cgcagcuugcccg

SEQ ID NO: 3332714 - RNA, 22 nt, Mycobacterium tuberculosis H37Rv
cgcaggaaaaccccggccacca

SEQ ID NO: 3332715 - RNA, 15 nt, Mycobacterium tuberculosis H37Rv
cgcaggaagcccacg

SEQ ID NO: 3332716 - RNA, 19 nt, Mycobacterium tuberculosis H37Rv
cgcaggaauucgccauagc

SEQ ID NO: 3332717 - RNA, 23 nt, Mycobacterium tuberculosis H37Rv
cgcaggaauucgccauagcgggc

SEQ ID NO: 3332718 - RNA, 15 nt, Mycobacterium tuberculosis H37Rv
cgcaggacgcugccg

SEQ ID NO: 3332719 - RNA, 19 nt, Mycobacterium tuberculosis H37Rv
cgcaggaucgaguugcggu

SEQ ID NO: 3332720 - RNA, 14 nt, Mycobacterium tuberculosis H37Rv
cgcaggaucggcgg

SEQ ID NO: 3332721 - RNA, 18 nt, Mycobacterium tuberculosis H37Rv
cgcaggauucccagucca

SEQ ID NO: 3332722 - RNA, 21 nt, Mycobacterium tuberculosis H37Rv
cgcaggauucccaguccagga

SEQ ID NO: 3332723 - RNA, 19 nt, Mycobacterium tuberculosis H37Rv
cgcaggauucccagucgcg

SEQ ID NO: 3332724 - RNA, 23 nt, Mycobacterium tuberculosis H37Rv
cgcaggauucugcugaccaugac

SEQ ID NO: 3332725 - RNA, 15 nt, Mycobacterium tuberculosis H37Rv
cgcaggcacaucgcg

SEQ ID NO: 3332726 - RNA, 13 nt, Mycobacterium tuberculosis H37Rv
cgcaggcaccccg

SEQ ID NO: 3332727 - RNA, 16 nt, Mycobacterium tuberculosis H37Rv
cgcaggcgcagauucc

SEQ ID NO: 3332728 - RNA, 17 nt, Mycobacterium tuberculosis H37Rv
cgcaggcucaccgagcc

SEQ ID NO: 3332729 - RNA, 18 nt, Mycobacterium tuberculosis H37Rv
cgcaggcucaccgagccg

SEQ ID NO: 3332730 - RNA, 15 nt, Mycobacterium tuberculosis H37Rv
cgcaggcucagcugg

SEQ ID NO: 3332731 - RNA, 22 nt, Mycobacterium tuberculosis H37Rv
cgcaggcuuccagccacagccc

SEQ ID NO: 3332732 - RNA, 18 nt, Mycobacterium tuberculosis H37Rv
cgcagggacugugggggc

SEQ ID NO: 3332733 - RNA, 21 nt, Mycobacterium tuberculosis H37Rv
cgcagggaucaccccggccgg

SEQ ID NO: 3332734 - RNA, 14 nt, Mycobacterium tuberculosis H37Rv
cgcagggaucgcag

SEQ ID NO: 3332735 - RNA, 18 nt, Mycobacterium tuberculosis H37Rv
cgcagggccgcgcgcacu

SEQ ID NO: 3332736 - RNA, 16 nt, Mycobacterium tuberculosis H37Rv
cgcagggcgucggcga

SEQ ID NO: 3332737 - RNA, 14 nt, Mycobacterium tuberculosis H37Rv
cgcaggggguggug

SEQ ID NO: 3332738 - RNA, 23 nt, Mycobacterium tuberculosis H37Rv
cgcaggggguggugucgcggccg

SEQ ID NO: 3332739 - RNA, 18 nt, Mycobacterium tuberculosis H37Rv
cgcaggguucgucgggac

SEQ ID NO: 3332740 - RNA, 15 nt, Mycobacterium tuberculosis H37Rv
cgcaggucgaucugc

SEQ ID NO: 3332741 - RNA, 16 nt, Mycobacterium tuberculosis H37Rv
cgcaggucgaucugcg

SEQ ID NO: 3332742 - RNA, 16 nt, Mycobacterium tuberculosis H37Rv
cgcaggucgcaccaca

SEQ ID NO: 3332743 - RNA, 12 nt, Mycobacterium tuberculosis H37Rv
cgcaggucgcgc

SEQ ID NO: 3332744 - RNA, 18 nt, Mycobacterium tuberculosis H37Rv
cgcaggucggccaccugc

SEQ ID NO: 3332745 - RNA, 18 nt, Mycobacterium tuberculosis H37Rv
cgcaggugaacgccggug

SEQ ID NO: 3332746 - RNA, 17 nt, Mycobacterium tuberculosis H37Rv
cgcaggugccuuucggc

SEQ ID NO: 3332747 - RNA, 20 nt, Mycobacterium tuberculosis H37Rv
cgcaggugccuuucggcaga

SEQ ID NO: 3332748 - RNA, 16 nt, Mycobacterium tuberculosis H37Rv
cgcaggugcugggcga

SEQ ID NO: 3332749 - RNA, 22 nt, Mycobacterium tuberculosis H37Rv
cgcagguggucgaucagguacu

SEQ ID NO: 3332750 - RNA, 21 nt, Mycobacterium tuberculosis H37Rv
cgcagguuggcaagcacggcg

SEQ ID NO: 3332751 - RNA, 15 nt, Mycobacterium tuberculosis H37Rv
cgcaguacuugaccg

SEQ ID NO: 3332752 - RNA, 19 nt, Mycobacterium tuberculosis H37Rv
cgcaguagccgaccaggac

SEQ ID NO: 3332753 - RNA, 21 nt, Mycobacterium tuberculosis H37Rv
cgcaguauucacagucgcucg

SEQ ID NO: 3332754 - RNA, 18 nt, Mycobacterium tuberculosis H37Rv
cgcagucaacgcaaucga

SEQ ID NO: 3332755 - RNA, 19 nt, Mycobacterium tuberculosis H37Rv
cgcaguccgguuacgcucg

SEQ ID NO: 3332756 - RNA, 15 nt, Mycobacterium tuberculosis H37Rv
cgcagucgcggcaga

SEQ ID NO: 3332757 - RNA, 14 nt, Mycobacterium tuberculosis H37Rv
cgcagucgggcagc

SEQ ID NO: 3332758 - RNA, 13 nt, Mycobacterium tuberculosis H37Rv
cgcagucugacga

SEQ ID NO: 3332759 - RNA, 23 nt, Mycobacterium tuberculosis H37Rv
cgcagucuuguugcuuugcuggc

SEQ ID NO: 3332760 - RNA, 16 nt, Mycobacterium tuberculosis H37Rv
cgcagugacgggaccc

SEQ ID NO: 3332761 - RNA, 15 nt, Mycobacterium tuberculosis H37Rv
cgcagugacguuccg

SEQ ID NO: 3332762 - RNA, 20 nt, Mycobacterium tuberculosis H37Rv
cgcagugacguuccgcucgc

SEQ ID NO: 3332763 - RNA, 22 nt, Mycobacterium tuberculosis H37Rv
cgcagugacguuccgcucgccg

SEQ ID NO: 3332764 - RNA, 23 nt, Mycobacterium tuberculosis H37Rv
cgcagugacguuuguuggcuguc

SEQ ID NO: 3332765 - RNA, 14 nt, Mycobacterium tuberculosis H37Rv
cgcagugagcagcc

SEQ ID NO: 3332766 - RNA, 14 nt, Mycobacterium tuberculosis H37Rv
cgcagugcgacucu

SEQ ID NO: 3332767 - RNA, 19 nt, Mycobacterium tuberculosis H37Rv
cgcaguggcguuacgcucg

SEQ ID NO: 3332768 - RNA, 20 nt, Mycobacterium tuberculosis H37Rv
cgcaguggcguuacgcucgg

SEQ ID NO: 3332769 - RNA, 22 nt, Mycobacterium tuberculosis H37Rv
cgcaguggcguuacgcucggcg

SEQ ID NO: 3332770 - RNA, 22 nt, Mycobacterium tuberculosis H37Rv
cgcaguucaucgggcaccaacc

SEQ ID NO: 3332771 - RNA, 18 nt, Mycobacterium tuberculosis H37Rv
cgcaguuggcaccagccg

SEQ ID NO: 3332772 - RNA, 13 nt, Mycobacterium tuberculosis H37Rv
cgcauaaccggcg

SEQ ID NO: 3332773 - RNA, 18 nt, Mycobacterium tuberculosis H37Rv
cgcauaaccggcgcgccc

SEQ ID NO: 3332774 - RNA, 20 nt, Mycobacterium tuberculosis H37Rv
cgcauaauauuuucccgccu

SEQ ID NO: 3332775 - RNA, 19 nt, Mycobacterium tuberculosis H37Rv
cgcauaccaguaccgucau

SEQ ID NO: 3332776 - RNA, 17 nt, Mycobacterium tuberculosis H37Rv
cgcauaggccccgccag

SEQ ID NO: 3332777 - RNA, 18 nt, Mycobacterium tuberculosis H37Rv
cgcauaggccccgccagc

SEQ ID NO: 3332778 - RNA, 16 nt, Mycobacterium tuberculosis H37Rv
cgcauagggccaccgc

SEQ ID NO: 3332779 - RNA, 19 nt, Mycobacterium tuberculosis H37Rv
cgcauauugcggcgccgug

SEQ ID NO: 3332780 - RNA, 14 nt, Mycobacterium tuberculosis H37Rv
cgcaucaccacugg

SEQ ID NO: 3332781 - RNA, 23 nt, Mycobacterium tuberculosis H37Rv
cgcaucacccgggaugaccaccg

SEQ ID NO: 3332782 - RNA, 17 nt, Mycobacterium tuberculosis H37Rv
cgcaucagggugggcga

SEQ ID NO: 3332783 - RNA, 16 nt, Mycobacterium tuberculosis H37Rv
cgcaucaggucggugg

SEQ ID NO: 3332784 - RNA, 21 nt, Mycobacterium tuberculosis H37Rv
cgcaucauagacagggccgcu

SEQ ID NO: 3332785 - RNA, 22 nt, Mycobacterium tuberculosis H37Rv
cgcaucaugucgaagaaccggc

SEQ ID NO: 3332786 - RNA, 20 nt, Mycobacterium tuberculosis H37Rv
cgcauccagccgugcggcgg

SEQ ID NO: 3332787 - RNA, 21 nt, Mycobacterium tuberculosis H37Rv
cgcaucccgaaguagaagccc

SEQ ID NO: 3332788 - RNA, 15 nt, Mycobacterium tuberculosis H37Rv
cgcauccgacacccg

SEQ ID NO: 3332789 - RNA, 22 nt, Mycobacterium tuberculosis H37Rv
cgcauccgcgguuggcaguggc

SEQ ID NO: 3332790 - RNA, 23 nt, Mycobacterium tuberculosis H37Rv
cgcauccgguuuggucgccgcgu

SEQ ID NO: 3332791 - RNA, 15 nt, Mycobacterium tuberculosis H37Rv
cgcaucgagcaccuc

SEQ ID NO: 3332792 - RNA, 17 nt, Mycobacterium tuberculosis H37Rv
cgcaucgccucaccacg

SEQ ID NO: 3332793 - RNA, 15 nt, Mycobacterium tuberculosis H37Rv
cgcaucgccuccucg

SEQ ID NO: 3332794 - RNA, 16 nt, Mycobacterium tuberculosis H37Rv
cgcaucgccucgaggu

SEQ ID NO: 3332795 - RNA, 20 nt, Mycobacterium tuberculosis H37Rv
cgcaucgcgaagucguccag

SEQ ID NO: 3332796 - RNA, 18 nt, Mycobacterium tuberculosis H37Rv
cgcaucgcggcgacgucg

SEQ ID NO: 3332797 - RNA, 14 nt, Mycobacterium tuberculosis H37Rv
cgcaucggcaaggc

SEQ ID NO: 3332798 - RNA, 23 nt, Mycobacterium tuberculosis H37Rv
cgcaucggccagcagcgacucca

SEQ ID NO: 3332799 - RNA, 15 nt, Mycobacterium tuberculosis H37Rv
cgcaucggcccccaa

SEQ ID NO: 3332800 - RNA, 16 nt, Mycobacterium tuberculosis H37Rv
cgcaucggcgaacaac

SEQ ID NO: 3332801 - RNA, 14 nt, Mycobacterium tuberculosis H37Rv
cgcaucggcgguga

SEQ ID NO: 3332802 - RNA, 18 nt, Mycobacterium tuberculosis H37Rv
cgcaucguugccgaccgu

SEQ ID NO: 3332803 - RNA, 22 nt, Mycobacterium tuberculosis H37Rv
cgcaucucgagcaugcccagcg

SEQ ID NO: 3332804 - RNA, 12 nt, Mycobacterium tuberculosis H37Rv
cgcaugccccga

SEQ ID NO: 3332805 - RNA, 16 nt, Mycobacterium tuberculosis H37Rv
cgcaugccccgaccgc

SEQ ID NO: 3332806 - RNA, 15 nt, Mycobacterium tuberculosis H37Rv
cgcaugcccuggacc

SEQ ID NO: 3332807 - RNA, 19 nt, Mycobacterium tuberculosis H37Rv
cgcaugccggcgcaccaca

SEQ ID NO: 3332808 - RNA, 16 nt, Mycobacterium tuberculosis H37Rv
cgcaugcgcgcgccgg

SEQ ID NO: 3332809 - RNA, 17 nt, Mycobacterium tuberculosis H37Rv
cgcaugcgugacccgac

SEQ ID NO: 3332810 - RNA, 16 nt, Mycobacterium tuberculosis H37Rv
cgcaugcucacgaucu

SEQ ID NO: 3332811 - RNA, 22 nt, Mycobacterium tuberculosis H37Rv
cgcaugcucacgaucugcgcgu

SEQ ID NO: 3332812 - RNA, 14 nt, Mycobacterium tuberculosis H37Rv
cgcaugcucgaucg

SEQ ID NO: 3332813 - RNA, 20 nt, Mycobacterium tuberculosis H37Rv
cgcaugggccaggucagccg

SEQ ID NO: 3332814 - RNA, 19 nt, Mycobacterium tuberculosis H37Rv
cgcauguucuccacgccga

SEQ ID NO: 3332815 - RNA, 21 nt, Mycobacterium tuberculosis H37Rv
cgcauguuggugaucaaaccg

SEQ ID NO: 3332816 - RNA, 14 nt, Mycobacterium tuberculosis H37Rv
cgcauuagccugcg

SEQ ID NO: 3332817 - RNA, 15 nt, Mycobacterium tuberculosis H37Rv
cgcauuccggcgcca

SEQ ID NO: 3332818 - RNA, 18 nt, Mycobacterium tuberculosis H37Rv
cgcauucggcgagccgcg

SEQ ID NO: 3332819 - RNA, 20 nt, Mycobacterium tuberculosis H37Rv
cgcauucguggagccggccg

SEQ ID NO: 3332820 - RNA, 14 nt, Mycobacterium tuberculosis H37Rv
cgcauugaacagcg

SEQ ID NO: 3332821 - RNA, 14 nt, Mycobacterium tuberculosis H37Rv
cgcauugcagcguc

SEQ ID NO: 3332822 - RNA, 20 nt, Mycobacterium tuberculosis H37Rv
cgcauugcagcguccccaug

SEQ ID NO: 3332823 - RNA, 19 nt, Mycobacterium tuberculosis H37Rv
cgcauugccaacgcccacg

SEQ ID NO: 3332824 - RNA, 19 nt, Mycobacterium tuberculosis H37Rv
cgcauuucguggcgcgccg

SEQ ID NO: 3332825 - RNA, 19 nt, Mycobacterium tuberculosis H37Rv
cgcauuuguugcugcugcc

SEQ ID NO: 3332826 - RNA, 18 nt, Mycobacterium tuberculosis H37Rv
cgcauuuuucgccagcug

SEQ ID NO: 3332827 - RNA, 15 nt, Mycobacterium tuberculosis H37Rv
cgccaaaacggucga

SEQ ID NO: 3332828 - RNA, 23 nt, Mycobacterium tuberculosis H37Rv
cgccaaacccaugucggcgcgcc

SEQ ID NO: 3332829 - RNA, 20 nt, Mycobacterium tuberculosis H37Rv
cgccaaacgcugcgcccgga

SEQ ID NO: 3332830 - RNA, 20 nt, Mycobacterium tuberculosis H37Rv
cgccaaagccgggauugccg

SEQ ID NO: 3332831 - RNA, 22 nt, Mycobacterium tuberculosis H37Rv
cgccaaagccgggauugccgcc

SEQ ID NO: 3332832 - RNA, 14 nt, Mycobacterium tuberculosis H37Rv
cgccaacaccaacc

SEQ ID NO: 3332833 - RNA, 22 nt, Mycobacterium tuberculosis H37Rv
cgccaaccacuuuccggccgau

SEQ ID NO: 3332834 - RNA, 15 nt, Mycobacterium tuberculosis H37Rv
cgccaaccccaacau

SEQ ID NO: 3332835 - RNA, 15 nt, Mycobacterium tuberculosis H37Rv
cgccaacccggccaa

SEQ ID NO: 3332836 - RNA, 13 nt, Mycobacterium tuberculosis H37Rv
cgccaacccggcg

SEQ ID NO: 3332837 - RNA, 15 nt, Mycobacterium tuberculosis H37Rv
cgccaacccgguuga

SEQ ID NO: 3332838 - RNA, 20 nt, Mycobacterium tuberculosis H37Rv
cgccaaccguucccggcaga

SEQ ID NO: 3332839 - RNA, 19 nt, Mycobacterium tuberculosis H37Rv
cgccaaccuuugcguugcu

SEQ ID NO: 3332840 - RNA, 22 nt, Mycobacterium tuberculosis H37Rv
cgccaacgacucacccacccgc

SEQ ID NO: 3332841 - RNA, 21 nt, Mycobacterium tuberculosis H37Rv
cgccaacgccaaaacggucga

SEQ ID NO: 3332842 - RNA, 16 nt, Mycobacterium tuberculosis H37Rv
cgccaacgccacggca

SEQ ID NO: 3332843 - RNA, 15 nt, Mycobacterium tuberculosis H37Rv
cgccaacgccagcac

SEQ ID NO: 3332844 - RNA, 14 nt, Mycobacterium tuberculosis H37Rv
cgccaacggcaccu

SEQ ID NO: 3332845 - RNA, 19 nt, Mycobacterium tuberculosis H37Rv
cgccaacgggcugccccuc

SEQ ID NO: 3332846 - RNA, 13 nt, Mycobacterium tuberculosis H37Rv
cgccaacguugcg

SEQ ID NO: 3332847 - RNA, 21 nt, Mycobacterium tuberculosis H37Rv
cgccaacuccucagccgccug

SEQ ID NO: 3332848 - RNA, 13 nt, Mycobacterium tuberculosis H37Rv
cgccaacugcggc

SEQ ID NO: 3332849 - RNA, 15 nt, Mycobacterium tuberculosis H37Rv
cgccaacuucaccac

SEQ ID NO: 3332850 - RNA, 18 nt, Mycobacterium tuberculosis H37Rv
cgccaacuucaccacccu

SEQ ID NO: 3332851 - RNA, 17 nt, Mycobacterium tuberculosis H37Rv
cgccaagacgucggcgu

SEQ ID NO: 3332852 - RNA, 22 nt, Mycobacterium tuberculosis H37Rv
cgccaagaucggguggcggguc

SEQ ID NO: 3332853 - RNA, 15 nt, Mycobacterium tuberculosis H37Rv
cgccaagcucggcca

SEQ ID NO: 3332854 - RNA, 18 nt, Mycobacterium tuberculosis H37Rv
cgccaagcucggccacca

SEQ ID NO: 3332855 - RNA, 13 nt, Mycobacterium tuberculosis H37Rv
cgccaaggaggcc

SEQ ID NO: 3332856 - RNA, 13 nt, Mycobacterium tuberculosis H37Rv
cgccaaggcgaug

SEQ ID NO: 3332857 - RNA, 19 nt, Mycobacterium tuberculosis H37Rv
cgccaagugcagggcugcu

SEQ ID NO: 3332858 - RNA, 17 nt, Mycobacterium tuberculosis H37Rv
cgccaauagcaacucga

SEQ ID NO: 3332859 - RNA, 20 nt, Mycobacterium tuberculosis H37Rv
cgccaaucauggugcguagc

SEQ ID NO: 3332860 - RNA, 23 nt, Mycobacterium tuberculosis H37Rv
cgccaaucgaguagcugaccgag

SEQ ID NO: 3332861 - RNA, 20 nt, Mycobacterium tuberculosis H37Rv
cgccaaugccaccauugccg

SEQ ID NO: 3332862 - RNA, 16 nt, Mycobacterium tuberculosis H37Rv
cgccaaugcccaggug

SEQ ID NO: 3332863 - RNA, 12 nt, Mycobacterium tuberculosis H37Rv
cgccacaaagaa

SEQ ID NO: 3332864 - RNA, 14 nt, Mycobacterium tuberculosis H37Rv
cgccacaccaacgu

SEQ ID NO: 3332865 - RNA, 22 nt, Mycobacterium tuberculosis H37Rv
cgccacacccaaaccggcccgc

SEQ ID NO: 3332866 - RNA, 14 nt, Mycobacterium tuberculosis H37Rv
cgccacaccgccgc

SEQ ID NO: 3332867 - RNA, 22 nt, Mycobacterium tuberculosis H37Rv
cgccacaccggggcggccgacc

SEQ ID NO: 3332868 - RNA, 16 nt, Mycobacterium tuberculosis H37Rv
cgccacagcacccacg

SEQ ID NO: 3332869 - RNA, 16 nt, Mycobacterium tuberculosis H37Rv
cgccacagccccaggg

SEQ ID NO: 3332870 - RNA, 15 nt, Mycobacterium tuberculosis H37Rv
cgccacagucgucga

SEQ ID NO: 3332871 - RNA, 22 nt, Mycobacterium tuberculosis H37Rv
cgccacauacaccggccggucc

SEQ ID NO: 3332872 - RNA, 13 nt, Mycobacterium tuberculosis H37Rv
cgccacaucgugg

SEQ ID NO: 3332873 - RNA, 14 nt, Mycobacterium tuberculosis H37Rv
cgccaccaccaggg

SEQ ID NO: 3332874 - RNA, 16 nt, Mycobacterium tuberculosis H37Rv
cgccaccaccagggca

SEQ ID NO: 3332875 - RNA, 18 nt, Mycobacterium tuberculosis H37Rv
cgccaccacccaggccau

SEQ ID NO: 3332876 - RNA, 13 nt, Mycobacterium tuberculosis H37Rv
cgccaccacccgg

SEQ ID NO: 3332877 - RNA, 11 nt, Mycobacterium tuberculosis H37Rv
cgccaccaccg

SEQ ID NO: 3332878 - RNA, 12 nt, Mycobacterium tuberculosis H37Rv
cgccaccaccuc

SEQ ID NO: 3332879 - RNA, 18 nt, Mycobacterium tuberculosis H37Rv
cgccaccacgccgucgac

SEQ ID NO: 3332880 - RNA, 16 nt, Mycobacterium tuberculosis H37Rv
cgccaccagaccagga

SEQ ID NO: 3332881 - RNA, 21 nt, Mycobacterium tuberculosis H37Rv
cgccaccagagucaacaucag

SEQ ID NO: 3332882 - RNA, 19 nt, Mycobacterium tuberculosis H37Rv
cgccaccagcaccgccgcu

SEQ ID NO: 3332883 - RNA, 18 nt, Mycobacterium tuberculosis H37Rv
cgccaccaucaccgccuu

SEQ ID NO: 3332884 - RNA, 23 nt, Mycobacterium tuberculosis H37Rv
cgccaccaucaccgccuuugccg

SEQ ID NO: 3332885 - RNA, 19 nt, Mycobacterium tuberculosis H37Rv
cgccaccauccccggcaac

SEQ ID NO: 3332886 - RNA, 23 nt, Mycobacterium tuberculosis H37Rv
cgccaccauccccggcaacaaag

SEQ ID NO: 3332887 - RNA, 13 nt, Mycobacterium tuberculosis H37Rv
cgccaccaucggg

SEQ ID NO: 3332888 - RNA, 17 nt, Mycobacterium tuberculosis H37Rv
cgccaccaucguugccg

SEQ ID NO: 3332889 - RNA, 17 nt, Mycobacterium tuberculosis H37Rv
cgccacccagcaccagg

SEQ ID NO: 3332890 - RNA, 22 nt, Mycobacterium tuberculosis H37Rv
cgccaccccgcguaugccagga

SEQ ID NO: 3332891 - RNA, 21 nt, Mycobacterium tuberculosis H37Rv
cgccacccgaaugccuucgau

SEQ ID NO: 3332892 - RNA, 18 nt, Mycobacterium tuberculosis H37Rv
cgccacccgaucgggcgu

SEQ ID NO: 3332893 - RNA, 12 nt, Mycobacterium tuberculosis H37Rv
cgccacccgcga

SEQ ID NO: 3332894 - RNA, 14 nt, Mycobacterium tuberculosis H37Rv
cgccacccgcgccg

SEQ ID NO: 3332895 - RNA, 19 nt, Mycobacterium tuberculosis H37Rv
cgccacccgcgccgcccgc

SEQ ID NO: 3332896 - RNA, 21 nt, Mycobacterium tuberculosis H37Rv
cgccacccgcgccgcccgcuc

SEQ ID NO: 3332897 - RNA, 22 nt, Mycobacterium tuberculosis H37Rv
cgccacccuuggcccggugcag

SEQ ID NO: 3332898 - RNA, 16 nt, Mycobacterium tuberculosis H37Rv
cgccaccgaacgcacc

SEQ ID NO: 3332899 - RNA, 21 nt, Mycobacterium tuberculosis H37Rv
cgccaccgaacgcaccgaaac

SEQ ID NO: 3332900 - RNA, 13 nt, Mycobacterium tuberculosis H37Rv
cgccaccgaccga

SEQ ID NO: 3332901 - RNA, 18 nt, Mycobacterium tuberculosis H37Rv
cgccaccgagaucggaca

SEQ ID NO: 3332902 - RNA, 19 nt, Mycobacterium tuberculosis H37Rv
cgccaccgagaucggacag

SEQ ID NO: 3332903 - RNA, 15 nt, Mycobacterium tuberculosis H37Rv
cgccaccgaggccgc

SEQ ID NO: 3332904 - RNA, 21 nt, Mycobacterium tuberculosis H37Rv
cgccaccgcaagaaucagcag

SEQ ID NO: 3332905 - RNA, 14 nt, Mycobacterium tuberculosis H37Rv
cgccaccgccagcg

SEQ ID NO: 3332906 - RNA, 17 nt, Mycobacterium tuberculosis H37Rv
cgccaccgccagcgucg

SEQ ID NO: 3332907 - RNA, 12 nt, Mycobacterium tuberculosis H37Rv
cgccaccgccgg

SEQ ID NO: 3332908 - RNA, 19 nt, Mycobacterium tuberculosis H37Rv
cgccaccgcgacaccccgg

SEQ ID NO: 3332909 - RNA, 15 nt, Mycobacterium tuberculosis H37Rv
cgccaccgcgagcag

SEQ ID NO: 3332910 - RNA, 14 nt, Mycobacterium tuberculosis H37Rv
cgccaccgcggcga

SEQ ID NO: 3332911 - RNA, 23 nt, Mycobacterium tuberculosis H37Rv
cgccaccggcaccgccugcgccg

SEQ ID NO: 3332912 - RNA, 13 nt, Mycobacterium tuberculosis H37Rv
cgccaccggcgac

SEQ ID NO: 3332913 - RNA, 19 nt, Mycobacterium tuberculosis H37Rv
cgccaccggcgccaccggc

SEQ ID NO: 3332914 - RNA, 24 nt, Mycobacterium tuberculosis H37Rv
cgccaccggcgccaccggcgccgc

SEQ ID NO: 3332915 - RNA, 17 nt, Mycobacterium tuberculosis H37Rv
cgccaccggcgccgccc

SEQ ID NO: 3332916 - RNA, 19 nt, Mycobacterium tuberculosis H37Rv
cgccaccggcgccgcccgc

SEQ ID NO: 3332917 - RNA, 22 nt, Mycobacterium tuberculosis H37Rv
cgccaccggcgccgccgucgcc

SEQ ID NO: 3332918 - RNA, 23 nt, Mycobacterium tuberculosis H37Rv
cgccaccggcgcgaccgcggcga

SEQ ID NO: 3332919 - RNA, 19 nt, Mycobacterium tuberculosis H37Rv
cgccaccggguucaccgag

SEQ ID NO: 3332920 - RNA, 17 nt, Mycobacterium tuberculosis H37Rv
cgccaccgguaccggcg

SEQ ID NO: 3332921 - RNA, 19 nt, Mycobacterium tuberculosis H37Rv
cgccaccgucgcugcccgc

SEQ ID NO: 3332922 - RNA, 18 nt, Mycobacterium tuberculosis H37Rv
cgccaccgugguggacga

SEQ ID NO: 3332923 - RNA, 20 nt, Mycobacterium tuberculosis H37Rv
cgccaccgugguggacgacc

SEQ ID NO: 3332924 - RNA, 19 nt, Mycobacterium tuberculosis H37Rv
cgccaccguuugcgcaccg

SEQ ID NO: 3332925 - RNA, 17 nt, Mycobacterium tuberculosis H37Rv
cgccaccucccacgccg

SEQ ID NO: 3332926 - RNA, 18 nt, Mycobacterium tuberculosis H37Rv
cgccaccucccagggcuc

SEQ ID NO: 3332927 - RNA, 14 nt, Mycobacterium tuberculosis H37Rv
cgccaccucgccgg

SEQ ID NO: 3332928 - RNA, 22 nt, Mycobacterium tuberculosis H37Rv
cgccaccucgccggccgucagc

SEQ ID NO: 3332929 - RNA, 21 nt, Mycobacterium tuberculosis H37Rv
cgccaccucggaggugccggu

SEQ ID NO: 3332930 - RNA, 15 nt, Mycobacterium tuberculosis H37Rv
cgccaccuucgacga

SEQ ID NO: 3332931 - RNA, 16 nt, Mycobacterium tuberculosis H37Rv
cgccaccuuggcuggg

SEQ ID NO: 3332932 - RNA, 21 nt, Mycobacterium tuberculosis H37Rv
cgccaccuuggcugggcccgc

SEQ ID NO: 3332933 - RNA, 13 nt, Mycobacterium tuberculosis H37Rv
cgccacgacaggu

SEQ ID NO: 3332934 - RNA, 17 nt, Mycobacterium tuberculosis H37Rv
cgccacgaccgcggcgg

SEQ ID NO: 3332935 - RNA, 20 nt, Mycobacterium tuberculosis H37Rv
cgccacgacgcccaccguug

SEQ ID NO: 3332936 - RNA, 15 nt, Mycobacterium tuberculosis H37Rv
cgccacgcccgacgc

SEQ ID NO: 3332937 - RNA, 19 nt, Mycobacterium tuberculosis H37Rv
cgccacgccgaggcguucg

SEQ ID NO: 3332938 - RNA, 17 nt, Mycobacterium tuberculosis H37Rv
cgccacgccgaugaugg

SEQ ID NO: 3332939 - RNA, 21 nt, Mycobacterium tuberculosis H37Rv
cgccacgcucggcggccagcu

SEQ ID NO: 3332940 - RNA, 18 nt, Mycobacterium tuberculosis H37Rv
cgccacggaucgcggcgg

SEQ ID NO: 3332941 - RNA, 19 nt, Mycobacterium tuberculosis H37Rv
cgccacggaucgcggcggc

SEQ ID NO: 3332942 - RNA, 16 nt, Mycobacterium tuberculosis H37Rv
cgccacggcagcgccc

SEQ ID NO: 3332943 - RNA, 19 nt, Mycobacterium tuberculosis H37Rv
cgccacggcggcuuccggc

SEQ ID NO: 3332944 - RNA, 15 nt, Mycobacterium tuberculosis H37Rv
cgccacgggcggcca

SEQ ID NO: 3332945 - RNA, 23 nt, Mycobacterium tuberculosis H37Rv
cgccacgggcggccaccgcacgc

SEQ ID NO: 3332946 - RNA, 20 nt, Mycobacterium tuberculosis H37Rv
cgccacggucgccgaccacu

SEQ ID NO: 3332947 - RNA, 12 nt, Mycobacterium tuberculosis H37Rv
cgccacggugua

SEQ ID NO: 3332948 - RNA, 23 nt, Mycobacterium tuberculosis H37Rv
cgccacggugucgucgaccaccu

SEQ ID NO: 3332949 - RNA, 17 nt, Mycobacterium tuberculosis H37Rv
cgccacgguucgggcag

SEQ ID NO: 3332950 - RNA, 24 nt, Mycobacterium tuberculosis H37Rv
cgccacgguucgggcagcacccgc

SEQ ID NO: 3332951 - RNA, 15 nt, Mycobacterium tuberculosis H37Rv
cgccacgguuggucc

SEQ ID NO: 3332952 - RNA, 19 nt, Mycobacterium tuberculosis H37Rv
cgccacguaauuccccagg

SEQ ID NO: 3332953 - RNA, 20 nt, Mycobacterium tuberculosis H37Rv
cgccacguaauuccccaggg

SEQ ID NO: 3332954 - RNA, 23 nt, Mycobacterium tuberculosis H37Rv
cgccacguacuccaccgcgccgu

SEQ ID NO: 3332955 - RNA, 20 nt, Mycobacterium tuberculosis H37Rv
cgccacguacuuggacgacc

SEQ ID NO: 3332956 - RNA, 14 nt, Mycobacterium tuberculosis H37Rv
cgccacgucgacgg

SEQ ID NO: 3332957 - RNA, 15 nt, Mycobacterium tuberculosis H37Rv
cgccacgucgacggu

SEQ ID NO: 3332958 - RNA, 14 nt, Mycobacterium tuberculosis H37Rv
cgccacugaccgcg

SEQ ID NO: 3332959 - RNA, 20 nt, Mycobacterium tuberculosis H37Rv
cgccacugccggcagcgccc

SEQ ID NO: 3332960 - RNA, 22 nt, Mycobacterium tuberculosis H37Rv
cgccacugcguuggaauguccg

SEQ ID NO: 3332961 - RNA, 19 nt, Mycobacterium tuberculosis H37Rv
cgccacuggaagccaagcu

SEQ ID NO: 3332962 - RNA, 13 nt, Mycobacterium tuberculosis H37Rv
cgccacuggcgcu

SEQ ID NO: 3332963 - RNA, 23 nt, Mycobacterium tuberculosis H37Rv
cgccacuugaugccgcacccgau

SEQ ID NO: 3332964 - RNA, 21 nt, Mycobacterium tuberculosis H37Rv
cgccagaacguggccauccuc

SEQ ID NO: 3332965 - RNA, 12 nt, Mycobacterium tuberculosis H37Rv
cgccagaccgcc

SEQ ID NO: 3332966 - RNA, 15 nt, Mycobacterium tuberculosis H37Rv
cgccagaccgccgau

SEQ ID NO: 3332967 - RNA, 14 nt, Mycobacterium tuberculosis H37Rv
cgccagaccgcggc

SEQ ID NO: 3332968 - RNA, 16 nt, Mycobacterium tuberculosis H37Rv
cgccagagucggagac

SEQ ID NO: 3332969 - RNA, 20 nt, Mycobacterium tuberculosis H37Rv
cgccagagucggagacccgu

SEQ ID NO: 3332970 - RNA, 21 nt, Mycobacterium tuberculosis H37Rv
cgccagagucggagacccguc

SEQ ID NO: 3332971 - RNA, 14 nt, Mycobacterium tuberculosis H37Rv
cgccagaucaccgu

SEQ ID NO: 3332972 - RNA, 13 nt, Mycobacterium tuberculosis H37Rv
cgccagaucucgc

SEQ ID NO: 3332973 - RNA, 17 nt, Mycobacterium tuberculosis H37Rv
cgccagcaacagcgcgg

SEQ ID NO: 3332974 - RNA, 23 nt, Mycobacterium tuberculosis H37Rv
cgccagcaccaccggcucccggg

SEQ ID NO: 3332975 - RNA, 14 nt, Mycobacterium tuberculosis H37Rv
cgccagcaccagcg

SEQ ID NO: 3332976 - RNA, 16 nt, Mycobacterium tuberculosis H37Rv
cgccagcaccagcguc

SEQ ID NO: 3332977 - RNA, 17 nt, Mycobacterium tuberculosis H37Rv
cgccagcaccagcgucg

SEQ ID NO: 3332978 - RNA, 20 nt, Mycobacterium tuberculosis H37Rv
cgccagcaccagcgucgcgg

SEQ ID NO: 3332979 - RNA, 21 nt, Mycobacterium tuberculosis H37Rv
cgccagcagaucuccggggcu

SEQ ID NO: 3332980 - RNA, 18 nt, Mycobacterium tuberculosis H37Rv
cgccagcagggccagacc

SEQ ID NO: 3332981 - RNA, 13 nt, Mycobacterium tuberculosis H37Rv
cgccagcagugcg

SEQ ID NO: 3332982 - RNA, 14 nt, Mycobacterium tuberculosis H37Rv
cgccagcaugacac

SEQ ID NO: 3332983 - RNA, 22 nt, Mycobacterium tuberculosis H37Rv
cgccagcaugacaccggccacc

SEQ ID NO: 3332984 - RNA, 23 nt, Mycobacterium tuberculosis H37Rv
cgccagcauugaagaagcccgaa

SEQ ID NO: 3332985 - RNA, 14 nt, Mycobacterium tuberculosis H37Rv
cgccagccaccaca

SEQ ID NO: 3332986 - RNA, 20 nt, Mycobacterium tuberculosis H37Rv
cgccagccaccacaucgcgg

SEQ ID NO: 3332987 - RNA, 14 nt, Mycobacterium tuberculosis H37Rv
cgccagccaggcga

SEQ ID NO: 3332988 - RNA, 17 nt, Mycobacterium tuberculosis H37Rv
cgccagccaggcgaagu

SEQ ID NO: 3332989 - RNA, 14 nt, Mycobacterium tuberculosis H37Rv
cgccagcccagcac

SEQ ID NO: 3332990 - RNA, 19 nt, Mycobacterium tuberculosis H37Rv
cgccagcccagcacgcugg

SEQ ID NO: 3332991 - RNA, 13 nt, Mycobacterium tuberculosis H37Rv
cgccagccccagc

SEQ ID NO: 3332992 - RNA, 21 nt, Mycobacterium tuberculosis H37Rv
cgccagccccgccggggccgc

SEQ ID NO: 3332993 - RNA, 14 nt, Mycobacterium tuberculosis H37Rv
cgccagcccgguga

SEQ ID NO: 3332994 - RNA, 15 nt, Mycobacterium tuberculosis H37Rv
cgccagcccggugau

SEQ ID NO: 3332995 - RNA, 17 nt, Mycobacterium tuberculosis H37Rv
cgccagcccggugaugg

SEQ ID NO: 3332996 - RNA, 14 nt, Mycobacterium tuberculosis H37Rv
cgccagcccgucau

SEQ ID NO: 3332997 - RNA, 22 nt, Mycobacterium tuberculosis H37Rv
cgccagcccguccggcccccga

SEQ ID NO: 3332998 - RNA, 13 nt, Mycobacterium tuberculosis H37Rv
cgccagccgcgag

SEQ ID NO: 3332999 - RNA, 14 nt, Mycobacterium tuberculosis H37Rv
cgccagccggagcg

SEQ ID NO: 3333000 - RNA, 15 nt, Mycobacterium tuberculosis H37Rv
cgccagccggccgcg

SEQ ID NO: 3333001 - RNA, 17 nt, Mycobacterium tuberculosis H37Rv
cgccagccgguccagca

SEQ ID NO: 3333002 - RNA, 14 nt, Mycobacterium tuberculosis H37Rv
cgccagccgguugg

SEQ ID NO: 3333003 - RNA, 13 nt, Mycobacterium tuberculosis H37Rv
cgccagccgugcc

SEQ ID NO: 3333004 - RNA, 16 nt, Mycobacterium tuberculosis H37Rv
cgccagccugaaccgc

SEQ ID NO: 3333005 - RNA, 17 nt, Mycobacterium tuberculosis H37Rv
cgccagccugaaccgcc

SEQ ID NO: 3333006 - RNA, 17 nt, Mycobacterium tuberculosis H37Rv
cgccagccugugcugcc

SEQ ID NO: 3333007 - RNA, 20 nt, Mycobacterium tuberculosis H37Rv
cgccagccugugcugccaac

SEQ ID NO: 3333008 - RNA, 23 nt, Mycobacterium tuberculosis H37Rv
cgccagcgauccaccaagcucgc

SEQ ID NO: 3333009 - RNA, 20 nt, Mycobacterium tuberculosis H37Rv
cgccagcgccaccguuaccg

SEQ ID NO: 3333010 - RNA, 15 nt, Mycobacterium tuberculosis H37Rv
cgccagcgccacugg

SEQ ID NO: 3333011 - RNA, 17 nt, Mycobacterium tuberculosis H37Rv
cgccagcgccgccgcga

SEQ ID NO: 3333012 - RNA, 18 nt, Mycobacterium tuberculosis H37Rv
cgccagcgccgccggcac

SEQ ID NO: 3333013 - RNA, 13 nt, Mycobacterium tuberculosis H37Rv
cgccagcgccgga

SEQ ID NO: 3333014 - RNA, 14 nt, Mycobacterium tuberculosis H37Rv
cgccagcgccggcc

SEQ ID NO: 3333015 - RNA, 20 nt, Mycobacterium tuberculosis H37Rv
cgccagcgccggucagggcu

SEQ ID NO: 3333016 - RNA, 19 nt, Mycobacterium tuberculosis H37Rv
cgccagcgccugcgcgcau

SEQ ID NO: 3333017 - RNA, 11 nt, Mycobacterium tuberculosis H37Rv
cgccagcgcga

SEQ ID NO: 3333018 - RNA, 13 nt, Mycobacterium tuberculosis H37Rv
cgccagcggcagc

SEQ ID NO: 3333019 - RNA, 18 nt, Mycobacterium tuberculosis H37Rv
cgccagcggcagcggcgu

SEQ ID NO: 3333020 - RNA, 13 nt, Mycobacterium tuberculosis H37Rv
cgccagcggcccu

SEQ ID NO: 3333021 - RNA, 14 nt, Mycobacterium tuberculosis H37Rv
cgccagcggccgcu

SEQ ID NO: 3333022 - RNA, 23 nt, Mycobacterium tuberculosis H37Rv
cgccagcggccgcuccaccucgg

SEQ ID NO: 3333023 - RNA, 12 nt, Mycobacterium tuberculosis H37Rv
cgccagcggcgc

SEQ ID NO: 3333024 - RNA, 16 nt, Mycobacterium tuberculosis H37Rv
cgccagcggcgcgacc

SEQ ID NO: 3333025 - RNA, 20 nt, Mycobacterium tuberculosis H37Rv
cgccagcggggcuagucggg

SEQ ID NO: 3333026 - RNA, 17 nt, Mycobacterium tuberculosis H37Rv
cgccagcggguccccgg

SEQ ID NO: 3333027 - RNA, 19 nt, Mycobacterium tuberculosis H37Rv
cgccagcgguggaccaccg

SEQ ID NO: 3333028 - RNA, 14 nt, Mycobacterium tuberculosis H37Rv
cgccagcgucgaca

SEQ ID NO: 3333029 - RNA, 15 nt, Mycobacterium tuberculosis H37Rv
cgccagcgucgacca

SEQ ID NO: 3333030 - RNA, 19 nt, Mycobacterium tuberculosis H37Rv
cgccagcguuaggucgccg

SEQ ID NO: 3333031 - RNA, 13 nt, Mycobacterium tuberculosis H37Rv
cgccagcucgccg

SEQ ID NO: 3333032 - RNA, 20 nt, Mycobacterium tuberculosis H37Rv
cgccagcugacacccgcagc

SEQ ID NO: 3333033 - RNA, 14 nt, Mycobacterium tuberculosis H37Rv
cgccagcugcccga

SEQ ID NO: 3333034 - RNA, 23 nt, Mycobacterium tuberculosis H37Rv
cgccagcugcgcagcgcaacauc

SEQ ID NO: 3333035 - RNA, 16 nt, Mycobacterium tuberculosis H37Rv
cgccagcugcuuucgg

SEQ ID NO: 3333036 - RNA, 17 nt, Mycobacterium tuberculosis H37Rv
cgccagcuuggcaaccu

SEQ ID NO: 3333037 - RNA, 16 nt, Mycobacterium tuberculosis H37Rv
cgccagcuugucgggc

SEQ ID NO: 3333038 - RNA, 21 nt, Mycobacterium tuberculosis H37Rv
cgccagcuugucgggcaccgg

SEQ ID NO: 3333039 - RNA, 14 nt, Mycobacterium tuberculosis H37Rv
cgccaggaacccgu

SEQ ID NO: 3333040 - RNA, 18 nt, Mycobacterium tuberculosis H37Rv
cgccaggaacucggccca

SEQ ID NO: 3333041 - RNA, 13 nt, Mycobacterium tuberculosis H37Rv
cgccaggaucugg

SEQ ID NO: 3333042 - RNA, 23 nt, Mycobacterium tuberculosis H37Rv
cgccaggaucugguugaaccggu

SEQ ID NO: 3333043 - RNA, 14 nt, Mycobacterium tuberculosis H37Rv
cgccaggcaccacg

SEQ ID NO: 3333044 - RNA, 15 nt, Mycobacterium tuberculosis H37Rv
cgccaggcaugccgc

SEQ ID NO: 3333045 - RNA, 13 nt, Mycobacterium tuberculosis H37Rv
cgccaggccacgu

SEQ ID NO: 3333046 - RNA, 15 nt, Mycobacterium tuberculosis H37Rv
cgccaggccgaccgc

SEQ ID NO: 3333047 - RNA, 15 nt, Mycobacterium tuberculosis H37Rv
cgccaggccgcgcga

SEQ ID NO: 3333048 - RNA, 20 nt, Mycobacterium tuberculosis H37Rv
cgccaggccguugccccguc

SEQ ID NO: 3333049 - RNA, 23 nt, Mycobacterium tuberculosis H37Rv
cgccaggcgcgaucgcgcccgcu

SEQ ID NO: 3333050 - RNA, 16 nt, Mycobacterium tuberculosis H37Rv
cgccaggcgcuuggcc

SEQ ID NO: 3333051 - RNA, 19 nt, Mycobacterium tuberculosis H37Rv
cgccaggcgcuuggccgga

SEQ ID NO: 3333052 - RNA, 17 nt, Mycobacterium tuberculosis H37Rv
cgccaggcggcaauucg

SEQ ID NO: 3333053 - RNA, 23 nt, Mycobacterium tuberculosis H37Rv
cgccagggagcgcagcgccggca

SEQ ID NO: 3333054 - RNA, 21 nt, Mycobacterium tuberculosis H37Rv
cgccagggcacguggcgguac

SEQ ID NO: 3333055 - RNA, 15 nt, Mycobacterium tuberculosis H37Rv
cgccagggccgccga

SEQ ID NO: 3333056 - RNA, 18 nt, Mycobacterium tuberculosis H37Rv
cgccagggccgccgaagc

SEQ ID NO: 3333057 - RNA, 11 nt, Mycobacterium tuberculosis H37Rv
cgccagggcgg

SEQ ID NO: 3333058 - RNA, 12 nt, Mycobacterium tuberculosis H37Rv
cgccagggcggc

SEQ ID NO: 3333059 - RNA, 14 nt, Mycobacterium tuberculosis H37Rv
cgccaggggaacgc

SEQ ID NO: 3333060 - RNA, 15 nt, Mycobacterium tuberculosis H37Rv
cgccagggucgcgag

SEQ ID NO: 3333061 - RNA, 22 nt, Mycobacterium tuberculosis H37Rv
cgccagggucgcgagcccgcca

SEQ ID NO: 3333062 - RNA, 21 nt, Mycobacterium tuberculosis H37Rv
cgccagguacucggugcacag

SEQ ID NO: 3333063 - RNA, 12 nt, Mycobacterium tuberculosis H37Rv
cgccaggucauc

SEQ ID NO: 3333064 - RNA, 15 nt, Mycobacterium tuberculosis H37Rv
cgccaggucggcgga

SEQ ID NO: 3333065 - RNA, 19 nt, Mycobacterium tuberculosis H37Rv
cgccaggugcagcaccagc

SEQ ID NO: 3333066 - RNA, 15 nt, Mycobacterium tuberculosis H37Rv
cgccagguggccgcu

SEQ ID NO: 3333067 - RNA, 14 nt, Mycobacterium tuberculosis H37Rv
cgccaguagcacgu

SEQ ID NO: 3333068 - RNA, 14 nt, Mycobacterium tuberculosis H37Rv
cgccaguauggccg

SEQ ID NO: 3333069 - RNA, 16 nt, Mycobacterium tuberculosis H37Rv
cgccaguauggccgcc

SEQ ID NO: 3333070 - RNA, 17 nt, Mycobacterium tuberculosis H37Rv
cgccaguauggccgcca

SEQ ID NO: 3333071 - RNA, 15 nt, Mycobacterium tuberculosis H37Rv
cgccagucccacugg

SEQ ID NO: 3333072 - RNA, 22 nt, Mycobacterium tuberculosis H37Rv
cgccagucccggcgcacaaaca

SEQ ID NO: 3333073 - RNA, 13 nt, Mycobacterium tuberculosis H37Rv
cgccagucgagca

SEQ ID NO: 3333074 - RNA, 20 nt, Mycobacterium tuberculosis H37Rv
cgccagucgcaggaucggcg

SEQ ID NO: 3333075 - RNA, 22 nt, Mycobacterium tuberculosis H37Rv
cgccagucgcaggaucggcgga

SEQ ID NO: 3333076 - RNA, 18 nt, Mycobacterium tuberculosis H37Rv
cgccagugcccgcacugc

SEQ ID NO: 3333077 - RNA, 21 nt, Mycobacterium tuberculosis H37Rv
cgccagugccucgcggggucu

SEQ ID NO: 3333078 - RNA, 22 nt, Mycobacterium tuberculosis H37Rv
cgccagugccucgcggggucug

SEQ ID NO: 3333079 - RNA, 12 nt, Mycobacterium tuberculosis H37Rv
cgccaguggcca

SEQ ID NO: 3333080 - RNA, 16 nt, Mycobacterium tuberculosis H37Rv
cgccaguggugcaccg

SEQ ID NO: 3333081 - RNA, 20 nt, Mycobacterium tuberculosis H37Rv
cgccaguguugcgcugcggc

SEQ ID NO: 3333082 - RNA, 16 nt, Mycobacterium tuberculosis H37Rv
cgccaguuccggugac

SEQ ID NO: 3333083 - RNA, 22 nt, Mycobacterium tuberculosis H37Rv
cgccaguucgcgccacgcaccc

SEQ ID NO: 3333084 - RNA, 14 nt, Mycobacterium tuberculosis H37Rv
cgccaguucgcggc

SEQ ID NO: 3333085 - RNA, 17 nt, Mycobacterium tuberculosis H37Rv
cgccaguucgcggcugc

SEQ ID NO: 3333086 - RNA, 14 nt, Mycobacterium tuberculosis H37Rv
cgccaguucggcgg

SEQ ID NO: 3333087 - RNA, 15 nt, Mycobacterium tuberculosis H37Rv
cgccaguucggcggg

SEQ ID NO: 3333088 - RNA, 16 nt, Mycobacterium tuberculosis H37Rv
cgccaguucggcggga

SEQ ID NO: 3333089 - RNA, 18 nt, Mycobacterium tuberculosis H37Rv
cgccaguucggcgggagc

SEQ ID NO: 3333090 - RNA, 21 nt, Mycobacterium tuberculosis H37Rv
cgccaguucggcgggagcugc

SEQ ID NO: 3333091 - RNA, 20 nt, Mycobacterium tuberculosis H37Rv
cgccaguugcguuguccacc

SEQ ID NO: 3333092 - RNA, 21 nt, Mycobacterium tuberculosis H37Rv
cgccauaaagagauggguagc

SEQ ID NO: 3333093 - RNA, 20 nt, Mycobacterium tuberculosis H37Rv
cgccauaauauugccgccuc

SEQ ID NO: 3333094 - RNA, 16 nt, Mycobacterium tuberculosis H37Rv
cgccauaccggccgcc

SEQ ID NO: 3333095 - RNA, 18 nt, Mycobacterium tuberculosis H37Rv
cgccauaccggccgccau

SEQ ID NO: 3333096 - RNA, 19 nt, Mycobacterium tuberculosis H37Rv
cgccauaccggccgccauc

SEQ ID NO: 3333097 - RNA, 22 nt, Mycobacterium tuberculosis H37Rv
cgccauaccggcuggccaggug

SEQ ID NO: 3333098 - RNA, 18 nt, Mycobacterium tuberculosis H37Rv
cgccauacgucgccucga

SEQ ID NO: 3333099 - RNA, 23 nt, Mycobacterium tuberculosis H37Rv
cgccauacgucgccucgagaugg

SEQ ID NO: 3333100 - RNA, 16 nt, Mycobacterium tuberculosis H37Rv
cgccauagcagagccg

SEQ ID NO: 3333101 - RNA, 21 nt, Mycobacterium tuberculosis H37Rv
cgccauagccgcgacccgcgc

SEQ ID NO: 3333102 - RNA, 15 nt, Mycobacterium tuberculosis H37Rv
cgccaucaccgccgu

SEQ ID NO: 3333103 - RNA, 22 nt, Mycobacterium tuberculosis H37Rv
cgccaucagaccaaugaccgcc

SEQ ID NO: 3333104 - RNA, 18 nt, Mycobacterium tuberculosis H37Rv
cgccaucagcccuucagc

SEQ ID NO: 3333105 - RNA, 12 nt, Mycobacterium tuberculosis H37Rv
cgccaucagccg

SEQ ID NO: 3333106 - RNA, 17 nt, Mycobacterium tuberculosis H37Rv
cgccaucagccgcugcg

SEQ ID NO: 3333107 - RNA, 13 nt, Mycobacterium tuberculosis H37Rv
cgccauccgccga

SEQ ID NO: 3333108 - RNA, 14 nt, Mycobacterium tuberculosis H37Rv
cgccaucgagcagc

SEQ ID NO: 3333109 - RNA, 19 nt, Mycobacterium tuberculosis H37Rv
cgccaucgccgccaaccac

SEQ ID NO: 3333110 - RNA, 22 nt, Mycobacterium tuberculosis H37Rv
cgccaucgccgccggugccgcc

SEQ ID NO: 3333111 - RNA, 18 nt, Mycobacterium tuberculosis H37Rv
cgccaucgguugacccgg

SEQ ID NO: 3333112 - RNA, 22 nt, Mycobacterium tuberculosis H37Rv
cgccaucgguugacccggcagc

SEQ ID NO: 3333113 - RNA, 16 nt, Mycobacterium tuberculosis H37Rv
cgccaucgucgcgccg

SEQ ID NO: 3333114 - RNA, 18 nt, Mycobacterium tuberculosis H37Rv
cgccaucucgacggugac

SEQ ID NO: 3333115 - RNA, 17 nt, Mycobacterium tuberculosis H37Rv
cgccaucucguaggggu

SEQ ID NO: 3333116 - RNA, 16 nt, Mycobacterium tuberculosis H37Rv
cgccaugccgggaacc

SEQ ID NO: 3333117 - RNA, 12 nt, Mycobacterium tuberculosis H37Rv
cgccaugcgcac

SEQ ID NO: 3333118 - RNA, 14 nt, Mycobacterium tuberculosis H37Rv
cgccaugcgcacca

SEQ ID NO: 3333119 - RNA, 13 nt, Mycobacterium tuberculosis H37Rv
cgccaugcggcgc

SEQ ID NO: 3333120 - RNA, 17 nt, Mycobacterium tuberculosis H37Rv
cgccauggccgccguug

SEQ ID NO: 3333121 - RNA, 14 nt, Mycobacterium tuberculosis H37Rv
cgccauggcguucu

SEQ ID NO: 3333122 - RNA, 15 nt, Mycobacterium tuberculosis H37Rv
cgccauggcguucug

SEQ ID NO: 3333123 - RNA, 12 nt, Mycobacterium tuberculosis H37Rv
cgccauggugaa

SEQ ID NO: 3333124 - RNA, 14 nt, Mycobacterium tuberculosis H37Rv
cgccaugucggcca

SEQ ID NO: 3333125 - RNA, 15 nt, Mycobacterium tuberculosis H37Rv
cgccaugucggccag

SEQ ID NO: 3333126 - RNA, 16 nt, Mycobacterium tuberculosis H37Rv
cgccauucaucggcau

SEQ ID NO: 3333127 - RNA, 17 nt, Mycobacterium tuberculosis H37Rv
cgccauugagcucccgc

SEQ ID NO: 3333128 - RNA, 21 nt, Mycobacterium tuberculosis H37Rv
cgccauugaggaagccguugg

SEQ ID NO: 3333129 - RNA, 14 nt, Mycobacterium tuberculosis H37Rv
cgccauugccacca

SEQ ID NO: 3333130 - RNA, 13 nt, Mycobacterium tuberculosis H37Rv
cgccauugccgcc

SEQ ID NO: 3333131 - RNA, 15 nt, Mycobacterium tuberculosis H37Rv
cgccauugccgccgu

SEQ ID NO: 3333132 - RNA, 19 nt, Mycobacterium tuberculosis H37Rv
cgccauugccgccgucgcc

SEQ ID NO: 3333133 - RNA, 13 nt, Mycobacterium tuberculosis H37Rv
cgccauugcggga

SEQ ID NO: 3333134 - RNA, 18 nt, Mycobacterium tuberculosis H37Rv
cgccauuggcgccgccga

SEQ ID NO: 3333135 - RNA, 19 nt, Mycobacterium tuberculosis H37Rv
cgccauuggcgccgccgau

SEQ ID NO: 3333136 - RNA, 13 nt, Mycobacterium tuberculosis H37Rv
cgccauuggcggu

SEQ ID NO: 3333137 - RNA, 23 nt, Mycobacterium tuberculosis H37Rv
cgccauuuccuggcgcagcgccu

SEQ ID NO: 3333138 - RNA, 22 nt, Mycobacterium tuberculosis H37Rv
cgccauuucgagggcaacggca

SEQ ID NO: 3333139 - RNA, 22 nt, Mycobacterium tuberculosis H37Rv
cgccauuucgcccgaggcaacg

SEQ ID NO: 3333140 - RNA, 19 nt, Mycobacterium tuberculosis H37Rv
cgcccaaaacgucaccgcc

SEQ ID NO: 3333141 - RNA, 13 nt, Mycobacterium tuberculosis H37Rv
cgcccaacaccgc

SEQ ID NO: 3333142 - RNA, 14 nt, Mycobacterium tuberculosis H37Rv
cgcccaacgcgggu

SEQ ID NO: 3333143 - RNA, 14 nt, Mycobacterium tuberculosis H37Rv
cgcccaagcgcagc

SEQ ID NO: 3333144 - RNA, 17 nt, Mycobacterium tuberculosis H37Rv
cgcccaagcgcagccug

SEQ ID NO: 3333145 - RNA, 16 nt, Mycobacterium tuberculosis H37Rv
cgcccaagguggcggc

SEQ ID NO: 3333146 - RNA, 22 nt, Mycobacterium tuberculosis H37Rv
cgcccaauguccaggcgcgcac

SEQ ID NO: 3333147 - RNA, 23 nt, Mycobacterium tuberculosis H37Rv
cgcccaauguccaggcgcgcacc

SEQ ID NO: 3333148 - RNA, 21 nt, Mycobacterium tuberculosis H37Rv
cgcccaauuucgucucgaaau

SEQ ID NO: 3333149 - RNA, 14 nt, Mycobacterium tuberculosis H37Rv
cgcccacagcugac

SEQ ID NO: 3333150 - RNA, 19 nt, Mycobacterium tuberculosis H37Rv
cgcccacagcugacgagcc

SEQ ID NO: 3333151 - RNA, 21 nt, Mycobacterium tuberculosis H37Rv
cgcccacagcugacgagccgg

SEQ ID NO: 3333152 - RNA, 21 nt, Mycobacterium tuberculosis H37Rv
cgcccacaugccgguugcggc

SEQ ID NO: 3333153 - RNA, 18 nt, Mycobacterium tuberculosis H37Rv
cgcccacaugcgcucgcg

SEQ ID NO: 3333154 - RNA, 18 nt, Mycobacterium tuberculosis H37Rv
cgcccaccacgaacacgu

SEQ ID NO: 3333155 - RNA, 22 nt, Mycobacterium tuberculosis H37Rv
cgcccaccacgaacacguucgg

SEQ ID NO: 3333156 - RNA, 14 nt, Mycobacterium tuberculosis H37Rv
cgcccaccacugug

SEQ ID NO: 3333157 - RNA, 13 nt, Mycobacterium tuberculosis H37Rv
cgcccaccgcaac

SEQ ID NO: 3333158 - RNA, 14 nt, Mycobacterium tuberculosis H37Rv
cgcccaccgggcgg

SEQ ID NO: 3333159 - RNA, 13 nt, Mycobacterium tuberculosis H37Rv
cgcccaccggucg

SEQ ID NO: 3333160 - RNA, 16 nt, Mycobacterium tuberculosis H37Rv
cgcccaccucgaucgc

SEQ ID NO: 3333161 - RNA, 20 nt, Mycobacterium tuberculosis H37Rv
cgcccaccucgaucgcgccg

SEQ ID NO: 3333162 - RNA, 13 nt, Mycobacterium tuberculosis H37Rv
cgcccacgcugcc

SEQ ID NO: 3333163 - RNA, 18 nt, Mycobacterium tuberculosis H37Rv
cgcccacggcaccaccaa

SEQ ID NO: 3333164 - RNA, 23 nt, Mycobacterium tuberculosis H37Rv
cgcccacggcaccaccaagcucg

SEQ ID NO: 3333165 - RNA, 13 nt, Mycobacterium tuberculosis H37Rv
cgcccagaccgcc

SEQ ID NO: 3333166 - RNA, 15 nt, Mycobacterium tuberculosis H37Rv
cgcccagaccgccga

SEQ ID NO: 3333167 - RNA, 13 nt, Mycobacterium tuberculosis H37Rv
cgcccagagccgc

SEQ ID NO: 3333168 - RNA, 19 nt, Mycobacterium tuberculosis H37Rv
cgcccagagccgcugcggc

SEQ ID NO: 3333169 - RNA, 22 nt, Mycobacterium tuberculosis H37Rv
cgcccagagugaauccggcaua

SEQ ID NO: 3333170 - RNA, 23 nt, Mycobacterium tuberculosis H37Rv
cgcccagagugaauccggcauac

SEQ ID NO: 3333171 - RNA, 21 nt, Mycobacterium tuberculosis H37Rv
cgcccagauguuuagcguccg

SEQ ID NO: 3333172 - RNA, 13 nt, Mycobacterium tuberculosis H37Rv
cgcccagcaaggc

SEQ ID NO: 3333173 - RNA, 14 nt, Mycobacterium tuberculosis H37Rv
cgcccagccgagcg

SEQ ID NO: 3333174 - RNA, 14 nt, Mycobacterium tuberculosis H37Rv
cgcccagccgcagc

SEQ ID NO: 3333175 - RNA, 20 nt, Mycobacterium tuberculosis H37Rv
cgcccagcgacccggccagc

SEQ ID NO: 3333176 - RNA, 17 nt, Mycobacterium tuberculosis H37Rv
cgcccagcgaccgcugc

SEQ ID NO: 3333177 - RNA, 15 nt, Mycobacterium tuberculosis H37Rv
cgcccagcgaggugg

SEQ ID NO: 3333178 - RNA, 14 nt, Mycobacterium tuberculosis H37Rv
cgcccagcgcccgc

SEQ ID NO: 3333179 - RNA, 21 nt, Mycobacterium tuberculosis H37Rv
cgcccagcgugaacugagggc

SEQ ID NO: 3333180 - RNA, 16 nt, Mycobacterium tuberculosis H37Rv
cgcccagcucgauacc

SEQ ID NO: 3333181 - RNA, 19 nt, Mycobacterium tuberculosis H37Rv
cgcccaggcauggccuggg

SEQ ID NO: 3333182 - RNA, 15 nt, Mycobacterium tuberculosis H37Rv
cgcccagggugucug

SEQ ID NO: 3333183 - RNA, 18 nt, Mycobacterium tuberculosis H37Rv
cgcccaggugaucgcgag

SEQ ID NO: 3333184 - RNA, 18 nt, Mycobacterium tuberculosis H37Rv
cgcccagugaaucggacc

SEQ ID NO: 3333185 - RNA, 21 nt, Mycobacterium tuberculosis H37Rv
cgcccagugcgcaacccagcc

SEQ ID NO: 3333186 - RNA, 18 nt, Mycobacterium tuberculosis H37Rv
cgcccagugugcgccgug

SEQ ID NO: 3333187 - RNA, 15 nt, Mycobacterium tuberculosis H37Rv
cgcccaucucaugca

SEQ ID NO: 3333188 - RNA, 13 nt, Mycobacterium tuberculosis H37Rv
cgcccaugccggg

SEQ ID NO: 3333189 - RNA, 20 nt, Mycobacterium tuberculosis H37Rv
cgcccaugcugacacgacau

SEQ ID NO: 3333190 - RNA, 15 nt, Mycobacterium tuberculosis H37Rv
cgcccauggccacca

SEQ ID NO: 3333191 - RNA, 21 nt, Mycobacterium tuberculosis H37Rv
cgcccauggcgucgaaccagu

SEQ ID NO: 3333192 - RNA, 22 nt, Mycobacterium tuberculosis H37Rv
cgcccauuggguaaccagcgcc

SEQ ID NO: 3333193 - RNA, 16 nt, Mycobacterium tuberculosis H37Rv
cgccccaagcgccuga

SEQ ID NO: 3333194 - RNA, 15 nt, Mycobacterium tuberculosis H37Rv
cgccccaccgcgccg

SEQ ID NO: 3333195 - RNA, 16 nt, Mycobacterium tuberculosis H37Rv
cgccccaccgcgccga

SEQ ID NO: 3333196 - RNA, 14 nt, Mycobacterium tuberculosis H37Rv
cgccccaccggccc

SEQ ID NO: 3333197 - RNA, 15 nt, Mycobacterium tuberculosis H37Rv
cgccccaccggccga

SEQ ID NO: 3333198 - RNA, 18 nt, Mycobacterium tuberculosis H37Rv
cgccccagccaugcugcu

SEQ ID NO: 3333199 - RNA, 20 nt, Mycobacterium tuberculosis H37Rv
cgccccagggggcgugccgc

SEQ ID NO: 3333200 - RNA, 23 nt, Mycobacterium tuberculosis H37Rv
cgccccagggggcgugccgccgc

SEQ ID NO: 3333201 - RNA, 16 nt, Mycobacterium tuberculosis H37Rv
cgccccaguucgacgg

SEQ ID NO: 3333202 - RNA, 21 nt, Mycobacterium tuberculosis H37Rv
cgccccaugaugaacagcuca

SEQ ID NO: 3333203 - RNA, 22 nt, Mycobacterium tuberculosis H37Rv
cgccccaugaugaacagcucac

SEQ ID NO: 3333204 - RNA, 20 nt, Mycobacterium tuberculosis H37Rv
cgcccccagcagcugcgaua

SEQ ID NO: 3333205 - RNA, 20 nt, Mycobacterium tuberculosis H37Rv
cgcccccauaacugcggccc

SEQ ID NO: 3333206 - RNA, 15 nt, Mycobacterium tuberculosis H37Rv
cgccccccacggccc

SEQ ID NO: 3333207 - RNA, 19 nt, Mycobacterium tuberculosis H37Rv
cgccccccacggcccguug

SEQ ID NO: 3333208 - RNA, 17 nt, Mycobacterium tuberculosis H37Rv
cgcccccgccauugccg

SEQ ID NO: 3333209 - RNA, 14 nt, Mycobacterium tuberculosis H37Rv
cgcccccgccggcc

SEQ ID NO: 3333210 - RNA, 14 nt, Mycobacterium tuberculosis H37Rv
cgcccccgucggcc

SEQ ID NO: 3333211 - RNA, 13 nt, Mycobacterium tuberculosis H37Rv
cgcccccgugggg

SEQ ID NO: 3333212 - RNA, 20 nt, Mycobacterium tuberculosis H37Rv
cgcccccguuaccgccgucg

SEQ ID NO: 3333213 - RNA, 22 nt, Mycobacterium tuberculosis H37Rv
cgcccccguuaccgccgucgcc

SEQ ID NO: 3333214 - RNA, 14 nt, Mycobacterium tuberculosis H37Rv
cgccccgaucggug

SEQ ID NO: 3333215 - RNA, 16 nt, Mycobacterium tuberculosis H37Rv
cgccccgaucggugac

SEQ ID NO: 3333216 - RNA, 18 nt, Mycobacterium tuberculosis H37Rv
cgccccgaucggugacgc

SEQ ID NO: 3333217 - RNA, 16 nt, Mycobacterium tuberculosis H37Rv
cgccccgaugaccgcc

SEQ ID NO: 3333218 - RNA, 12 nt, Mycobacterium tuberculosis H37Rv
cgccccgcccgc

SEQ ID NO: 3333219 - RNA, 12 nt, Mycobacterium tuberculosis H37Rv
cgccccgcgccc

SEQ ID NO: 3333220 - RNA, 19 nt, Mycobacterium tuberculosis H37Rv
cgccccgcgccuuggcacc

SEQ ID NO: 3333221 - RNA, 17 nt, Mycobacterium tuberculosis H37Rv
cgccccgcguuggacaa

SEQ ID NO: 3333222 - RNA, 16 nt, Mycobacterium tuberculosis H37Rv
cgccccggcgcggcca

SEQ ID NO: 3333223 - RNA, 13 nt, Mycobacterium tuberculosis H37Rv
cgccccggcggcg

SEQ ID NO: 3333224 - RNA, 20 nt, Mycobacterium tuberculosis H37Rv
cgccccggcggcggcggccc

SEQ ID NO: 3333225 - RNA, 15 nt, Mycobacterium tuberculosis H37Rv
cgccccgggccacca

SEQ ID NO: 3333226 - RNA, 18 nt, Mycobacterium tuberculosis H37Rv
cgccccggugaguccgga

SEQ ID NO: 3333227 - RNA, 12 nt, Mycobacterium tuberculosis H37Rv
cgccccgguugg

SEQ ID NO: 3333228 - RNA, 14 nt, Mycobacterium tuberculosis H37Rv
cgccccgugggccu

SEQ ID NO: 3333229 - RNA, 20 nt, Mycobacterium tuberculosis H37Rv
cgccccucacguggacugac

SEQ ID NO: 3333230 - RNA, 16 nt, Mycobacterium tuberculosis H37Rv
cgccccugcacagcag

SEQ ID NO: 3333231 - RNA, 17 nt, Mycobacterium tuberculosis H37Rv
cgcccgaaaaacgaccc

SEQ ID NO: 3333232 - RNA, 20 nt, Mycobacterium tuberculosis H37Rv
cgcccgaaccccgggcggcg

SEQ ID NO: 3333233 - RNA, 16 nt, Mycobacterium tuberculosis H37Rv
cgcccgaagccgggcc

SEQ ID NO: 3333234 - RNA, 18 nt, Mycobacterium tuberculosis H37Rv
cgcccgaaucgccggcgg

SEQ ID NO: 3333235 - RNA, 14 nt, Mycobacterium tuberculosis H37Rv
cgcccgacacccgu

SEQ ID NO: 3333236 - RNA, 23 nt, Mycobacterium tuberculosis H37Rv
cgcccgacgaggaugucgaugac

SEQ ID NO: 3333237 - RNA, 20 nt, Mycobacterium tuberculosis H37Rv
cgcccgacggaguucgacgu

SEQ ID NO: 3333238 - RNA, 19 nt, Mycobacterium tuberculosis H37Rv
cgcccgacgugaagccaag

SEQ ID NO: 3333239 - RNA, 18 nt, Mycobacterium tuberculosis H37Rv
cgcccgagaccggcaccg

SEQ ID NO: 3333240 - RNA, 20 nt, Mycobacterium tuberculosis H37Rv
cgcccgagaccggcaccggc

SEQ ID NO: 3333241 - RNA, 21 nt, Mycobacterium tuberculosis H37Rv
cgcccgagccggugccacugc

SEQ ID NO: 3333242 - RNA, 17 nt, Mycobacterium tuberculosis H37Rv
cgcccgaggcacccgug

SEQ ID NO: 3333243 - RNA, 18 nt, Mycobacterium tuberculosis H37Rv
cgcccgaggcacccgugc

SEQ ID NO: 3333244 - RNA, 22 nt, Mycobacterium tuberculosis H37Rv
cgcccgaggcacccgugccgcc

SEQ ID NO: 3333245 - RNA, 17 nt, Mycobacterium tuberculosis H37Rv
cgcccgagucucgucgg

SEQ ID NO: 3333246 - RNA, 19 nt, Mycobacterium tuberculosis H37Rv
cgcccgagucucgucgggu

SEQ ID NO: 3333247 - RNA, 18 nt, Mycobacterium tuberculosis H37Rv
cgcccgagugaccagggu

SEQ ID NO: 3333248 - RNA, 13 nt, Mycobacterium tuberculosis H37Rv
cgcccgaguugaa

SEQ ID NO: 3333249 - RNA, 20 nt, Mycobacterium tuberculosis H37Rv
cgcccgaguugaagaagccg

SEQ ID NO: 3333250 - RNA, 19 nt, Mycobacterium tuberculosis H37Rv
cgcccgaguuguggacgcc

SEQ ID NO: 3333251 - RNA, 15 nt, Mycobacterium tuberculosis H37Rv
cgcccgauacgccac

SEQ ID NO: 3333252 - RNA, 13 nt, Mycobacterium tuberculosis H37Rv
cgcccgaucggcg

SEQ ID NO: 3333253 - RNA, 16 nt, Mycobacterium tuberculosis H37Rv
cgcccgaugcgccagc

SEQ ID NO: 3333254 - RNA, 20 nt, Mycobacterium tuberculosis H37Rv
cgcccgcaagucggacgggu

SEQ ID NO: 3333255 - RNA, 18 nt, Mycobacterium tuberculosis H37Rv
cgcccgcaccaccggccc

SEQ ID NO: 3333256 - RNA, 19 nt, Mycobacterium tuberculosis H37Rv
cgcccgcaccaccggcccc

SEQ ID NO: 3333257 - RNA, 15 nt, Mycobacterium tuberculosis H37Rv
uuguugcugcugccg

SEQ ID NO: 3333258 - RNA, 16 nt, Mycobacterium tuberculosis H37Rv
uuguuuuugcacugaa

SEQ ID NO: 3333259 - RNA, 19 nt, Mycobacterium tuberculosis H37Rv
uuuagcaacuacucaucca

SEQ ID NO: 3333260 - RNA, 13 nt, Mycobacterium tuberculosis H37Rv
uuuaggcguggcc

SEQ ID NO: 3333261 - RNA, 16 nt, Mycobacterium tuberculosis H37Rv
uuucaccaccguggcc

SEQ ID NO: 3333262 - RNA, 19 nt, Mycobacterium tuberculosis H37Rv
uuuccacaccagcuuguag

SEQ ID NO: 3333263 - RNA, 17 nt, Mycobacterium tuberculosis H37Rv
uuuccaccguuagccag

SEQ ID NO: 3333264 - RNA, 19 nt, Mycobacterium tuberculosis H37Rv
uuuccgccggccaggugac

SEQ ID NO: 3333265 - RNA, 21 nt, Mycobacterium tuberculosis H37Rv
uuuccuugcgcgccauuggcg

SEQ ID NO: 3333266 - RNA, 19 nt, Mycobacterium tuberculosis H37Rv
uuucgaagaacguucacgc

SEQ ID NO: 3333267 - RNA, 22 nt, Mycobacterium tuberculosis H37Rv
uuucgauauagccgccggugcc

SEQ ID NO: 3333268 - RNA, 24 nt, Mycobacterium tuberculosis H37Rv
uuucgaugaugggcgguuccacgc

SEQ ID NO: 3333269 - RNA, 19 nt, Mycobacterium tuberculosis H37Rv
uuucgcgugcggcugccag

SEQ ID NO: 3333270 - RNA, 21 nt, Mycobacterium tuberculosis H37Rv
uuucggaugcaacccggugau

SEQ ID NO: 3333271 - RNA, 17 nt, Mycobacterium tuberculosis H37Rv
uuucggcgccgucgccc

SEQ ID NO: 3333272 - RNA, 20 nt, Mycobacterium tuberculosis H37Rv
uuucgggguggcggcaggug

SEQ ID NO: 3333273 - RNA, 17 nt, Mycobacterium tuberculosis H37Rv
uuucguguaacgccgac

SEQ ID NO: 3333274 - RNA, 23 nt, Mycobacterium tuberculosis H37Rv
uuucguugggagaguguugaucu

SEQ ID NO: 3333275 - RNA, 15 nt, Mycobacterium tuberculosis H37Rv
uuucuccgccgccca

SEQ ID NO: 3333276 - RNA, 22 nt, Mycobacterium tuberculosis H37Rv
uuugacgacaaacggcgaccca

SEQ ID NO: 3333277 - RNA, 17 nt, Mycobacterium tuberculosis H37Rv
uuugacgcccucggcga

SEQ ID NO: 3333278 - RNA, 18 nt, Mycobacterium tuberculosis H37Rv
uuugacgcccucggcgac

SEQ ID NO: 3333279 - RNA, 15 nt, Mycobacterium tuberculosis H37Rv
uuugacgggauagcc

SEQ ID NO: 3333280 - RNA, 14 nt, Mycobacterium tuberculosis H37Rv
uuugaucaccgugg

SEQ ID NO: 3333281 - RNA, 17 nt, Mycobacterium tuberculosis H37Rv
uuugauccuggcucagg

SEQ ID NO: 3333282 - RNA, 14 nt, Mycobacterium tuberculosis H37Rv
uuugcagccuucga

SEQ ID NO: 3333283 - RNA, 16 nt, Mycobacterium tuberculosis H37Rv
uuugccaucgggaccg

SEQ ID NO: 3333284 - RNA, 17 nt, Mycobacterium tuberculosis H37Rv
uuugccgguucggcgau

SEQ ID NO: 3333285 - RNA, 13 nt, Mycobacterium tuberculosis H37Rv
uuugcgaagccca

SEQ ID NO: 3333286 - RNA, 12 nt, Mycobacterium tuberculosis H37Rv
uuuggccgccgu

SEQ ID NO: 3333287 - RNA, 20 nt, Mycobacterium tuberculosis H37Rv
uuuggcgaguucguguugcu

SEQ ID NO: 3333288 - RNA, 14 nt, Mycobacterium tuberculosis H37Rv
uuugggucggcgau

SEQ ID NO: 3333289 - RNA, 23 nt, Mycobacterium tuberculosis H37Rv
uuuggugcagccgcggucguugg

SEQ ID NO: 3333290 - RNA, 12 nt, Mycobacterium tuberculosis H37Rv
uuugguggcugg

SEQ ID NO: 3333291 - RNA, 23 nt, Mycobacterium tuberculosis H37Rv
uuuggugguuucacauuuuuguu

SEQ ID NO: 3333292 - RNA, 15 nt, Mycobacterium tuberculosis H37Rv
uuugucgccuucuug

SEQ ID NO: 3333293 - RNA, 16 nt, Mycobacterium tuberculosis H37Rv
uuugucgccuucuugg

SEQ ID NO: 3333294 - RNA, 22 nt, Mycobacterium tuberculosis H37Rv
uuuucgagguacaacgggcacg

SEQ ID NO: 3333295 - RNA, 20 nt, Mycobacterium tuberculosis H37Rv
uuuucgaucgcuugccccgc

SEQ ID NO: 3333296 - RNA, 19 nt, Mycobacterium tuberculosis H37Rv
uuuucgcaagucuccucga

SEQ ID NO: 3333297 - RNA, 13 nt, Mycobacterium tuberculosis H37Rv
uuuugcugcaugc

SEQ ID NO: 3333298 - RNA, 14 nt, Mycobacterium tuberculosis H37Rv
uuuugucaggauau

SEQ ID NO: 3333299 - RNA, 16 nt, Mycobacterium tuberculosis H37Rv
uguccaaugcaccguu

SEQ ID NO: 3333300 - RNA, 13 nt, Mycobacterium tuberculosis H37Rv
uguccaccaccgg

SEQ ID NO: 3333301 - RNA, 12 nt, Mycobacterium tuberculosis H37Rv
uguccaccauca

SEQ ID NO: 3333302 - RNA, 14 nt, Mycobacterium tuberculosis H37Rv
uguccaccgcggcg

SEQ ID NO: 3333303 - RNA, 18 nt, Mycobacterium tuberculosis H37Rv
uguccacgaugacgucga

SEQ ID NO: 3333304 - RNA, 19 nt, Mycobacterium tuberculosis H37Rv
uguccacgaugacgucgac

SEQ ID NO: 3333305 - RNA, 13 nt, Mycobacterium tuberculosis H37Rv
uguccacugccac

SEQ ID NO: 3333306 - RNA, 23 nt, Mycobacterium tuberculosis H37Rv
uguccagaacggcgaucaccgag

SEQ ID NO: 3333307 - RNA, 13 nt, Mycobacterium tuberculosis H37Rv
uguccagaacggu

SEQ ID NO: 3333308 - RNA, 21 nt, Mycobacterium tuberculosis H37Rv
uguccagcggcauggugacgu

SEQ ID NO: 3333309 - RNA, 16 nt, Mycobacterium tuberculosis H37Rv
uguccagcguccuggc

SEQ ID NO: 3333310 - RNA, 23 nt, Mycobacterium tuberculosis H37Rv
uguccaggaauuccccaccgucg

SEQ ID NO: 3333311 - RNA, 22 nt, Mycobacterium tuberculosis H37Rv
uguccaggagugcgggcaugcc

SEQ ID NO: 3333312 - RNA, 19 nt, Mycobacterium tuberculosis H37Rv
uguccaggcgcgcaccacc

SEQ ID NO: 3333313 - RNA, 20 nt, Mycobacterium tuberculosis H37Rv
uguccaggcgcgcaccaccg

SEQ ID NO: 3333314 - RNA, 16 nt, Mycobacterium tuberculosis H37Rv
uguccagguggcgcgg

SEQ ID NO: 3333315 - RNA, 13 nt, Mycobacterium tuberculosis H37Rv
uguccauguucuc

SEQ ID NO: 3333316 - RNA, 19 nt, Mycobacterium tuberculosis H37Rv
uguccccccgcgcagauac

SEQ ID NO: 3333317 - RNA, 13 nt, Mycobacterium tuberculosis H37Rv
uguccccgacgga

SEQ ID NO: 3333318 - RNA, 17 nt, Mycobacterium tuberculosis H37Rv
ugucccgcacccggccc

SEQ ID NO: 3333319 - RNA, 16 nt, Mycobacterium tuberculosis H37Rv
uguccgaccucgccgc

SEQ ID NO: 3333320 - RNA, 12 nt, Mycobacterium tuberculosis H37Rv
uguccgacgcga

SEQ ID NO: 3333321 - RNA, 17 nt, Mycobacterium tuberculosis H37Rv
uguccgcagcaccgucg

SEQ ID NO: 3333322 - RNA, 22 nt, Mycobacterium tuberculosis H37Rv
uguccgcgacguaguggaagcc

SEQ ID NO: 3333323 - RNA, 22 nt, Mycobacterium tuberculosis H37Rv
uguccgcugguggaguucgcgc

SEQ ID NO: 3333324 - RNA, 21 nt, Mycobacterium tuberculosis H37Rv
uguccggauagacgugcacca

SEQ ID NO: 3333325 - RNA, 22 nt, Mycobacterium tuberculosis H37Rv
uguccggcccuacgcagcgcgg

SEQ ID NO: 3333326 - RNA, 15 nt, Mycobacterium tuberculosis H37Rv
uguccggccgguccg

SEQ ID NO: 3333327 - RNA, 19 nt, Mycobacterium tuberculosis H37Rv
uguccgggcugcaugcggu

SEQ ID NO: 3333328 - RNA, 20 nt, Mycobacterium tuberculosis H37Rv
uguccggggaccucggcgau

SEQ ID NO: 3333329 - RNA, 17 nt, Mycobacterium tuberculosis H37Rv
uguccggucgccaagug

SEQ ID NO: 3333330 - RNA, 16 nt, Mycobacterium tuberculosis H37Rv
uguccuacuuuuccac

SEQ ID NO: 3333331 - RNA, 19 nt, Mycobacterium tuberculosis H37Rv
uguccuauuugcagccuuc

SEQ ID NO: 3333332 - RNA, 13 nt, Mycobacterium tuberculosis H37Rv
uguccucacaugc

SEQ ID NO: 3333333 - RNA, 19 nt, Mycobacterium tuberculosis H37Rv
uguccuugaaccagcgcgu

SEQ ID NO: 3333334 - RNA, 16 nt, Mycobacterium tuberculosis H37Rv
uguccuuugccaccuc

SEQ ID NO: 3333335 - RNA, 17 nt, Mycobacterium tuberculosis H37Rv
uguccuuugccaccucg

SEQ ID NO: 3333336 - RNA, 18 nt, Mycobacterium tuberculosis H37Rv
ugucgaagaauaugccga

SEQ ID NO: 3333337 - RNA, 20 nt, Mycobacterium tuberculosis H37Rv
ugucgaagccccucaccucg

SEQ ID NO: 3333338 - RNA, 21 nt, Mycobacterium tuberculosis H37Rv
ugucgaagccccucaccucgg

SEQ ID NO: 3333339 - RNA, 23 nt, Mycobacterium tuberculosis H37Rv
ugucgaccgccacguaauucccc

SEQ ID NO: 3333340 - RNA, 21 nt, Mycobacterium tuberculosis H37Rv
ugucgacgacaacgaugucac

SEQ ID NO: 3333341 - RNA, 16 nt, Mycobacterium tuberculosis H37Rv
ugucgacggccacccc

SEQ ID NO: 3333342 - RNA, 16 nt, Mycobacterium tuberculosis H37Rv
ugucgagccggugccg

SEQ ID NO: 3333343 - RNA, 22 nt, Mycobacterium tuberculosis H37Rv
ugucgaucagaaucugccucuc

SEQ ID NO: 3333344 - RNA, 22 nt, Mycobacterium tuberculosis H37Rv
ugucgccacaccggggcggccg

SEQ ID NO: 3333345 - RNA, 20 nt, Mycobacterium tuberculosis H37Rv
ugucgccgaacgccaccacc

SEQ ID NO: 3333346 - RNA, 21 nt, Mycobacterium tuberculosis H37Rv
ugucgccgaguaccggccagc

SEQ ID NO: 3333347 - RNA, 21 nt, Mycobacterium tuberculosis H37Rv
ugucgccgauaucggugaccg

SEQ ID NO: 3333348 - RNA, 14 nt, Mycobacterium tuberculosis H37Rv
ugucgccgcucggu

SEQ ID NO: 3333349 - RNA, 20 nt, Mycobacterium tuberculosis H37Rv
ugucgcgaucgcggcaucga

SEQ ID NO: 3333350 - RNA, 19 nt, Mycobacterium tuberculosis H37Rv
ugucgcgccgguggucagg

SEQ ID NO: 3333351 - RNA, 14 nt, Mycobacterium tuberculosis H37Rv
ugucgcgcugcugu

SEQ ID NO: 3333352 - RNA, 13 nt, Mycobacterium tuberculosis H37Rv
ugucgcugccgcc

SEQ ID NO: 3333353 - RNA, 15 nt, Mycobacterium tuberculosis H37Rv
ugucgcugcggcgcu

SEQ ID NO: 3333354 - RNA, 22 nt, Mycobacterium tuberculosis H37Rv
ugucgcugcggcgcuggccagc

SEQ ID NO: 3333355 - RNA, 21 nt, Mycobacterium tuberculosis H37Rv
ugucggcagguaccaccgcgg

SEQ ID NO: 3333356 - RNA, 16 nt, Mycobacterium tuberculosis H37Rv
ugucggccacccggac

SEQ ID NO: 3333357 - RNA, 21 nt, Mycobacterium tuberculosis H37Rv
ugucggcgaaccacggcagcc

SEQ ID NO: 3333358 - RNA, 22 nt, Mycobacterium tuberculosis H37Rv
ugucggcgaccgagacggcguc

SEQ ID NO: 3333359 - RNA, 15 nt, Mycobacterium tuberculosis H37Rv
ugucggcgaucaacg

SEQ ID NO: 3333360 - RNA, 20 nt, Mycobacterium tuberculosis H37Rv
ugucggcgaugucgaagccc

SEQ ID NO: 3333361 - RNA, 21 nt, Mycobacterium tuberculosis H37Rv
ugucgggaacgaguacgggca

SEQ ID NO: 3333362 - RNA, 24 nt, Mycobacterium tuberculosis H37Rv
ugucgggcaccgguuugacgucca

SEQ ID NO: 3333363 - RNA, 12 nt, Mycobacterium tuberculosis H37Rv
ugucgggcugga

SEQ ID NO: 3333364 - RNA, 20 nt, Mycobacterium tuberculosis H37Rv
ugucgggcuggguggccaac

SEQ ID NO: 3333365 - RNA, 22 nt, Mycobacterium tuberculosis H37Rv
ugucggggccgcaggccagggu

SEQ ID NO: 3333366 - RNA, 16 nt, Mycobacterium tuberculosis H37Rv
ugucggggccgucguc

SEQ ID NO: 3333367 - RNA, 20 nt, Mycobacterium tuberculosis H37Rv
ugucgggggcuuuugcgucu

SEQ ID NO: 3333368 - RNA, 12 nt, Mycobacterium tuberculosis H37Rv
ugucgguacuga

SEQ ID NO: 3333369 - RNA, 15 nt, Mycobacterium tuberculosis H37Rv
ugucgguacugacag

SEQ ID NO: 3333370 - RNA, 18 nt, Mycobacterium tuberculosis H37Rv
ugucggucggaucggcgc

SEQ ID NO: 3333371 - RNA, 18 nt, Mycobacterium tuberculosis H37Rv
ugucggugaaccaacgcg

SEQ ID NO: 3333372 - RNA, 17 nt, Mycobacterium tuberculosis H37Rv
ugucggugguaccggcg

SEQ ID NO: 3333373 - RNA, 22 nt, Mycobacterium tuberculosis H37Rv
ugucgguguacagucgcgcgcu

SEQ ID NO: 3333374 - RNA, 16 nt, Mycobacterium tuberculosis H37Rv
ugucggugucggugac

SEQ ID NO: 3333375 - RNA, 13 nt, Mycobacterium tuberculosis H37Rv
ugucgguucgucg

SEQ ID NO: 3333376 - RNA, 21 nt, Mycobacterium tuberculosis H37Rv
ugucgguuuccucgagccagc

SEQ ID NO: 3333377 - RNA, 16 nt, Mycobacterium tuberculosis H37Rv
ugucguaccagccaug

SEQ ID NO: 3333378 - RNA, 23 nt, Mycobacterium tuberculosis H37Rv
ugucgucgccggcggcggugcgc

SEQ ID NO: 3333379 - RNA, 14 nt, Mycobacterium tuberculosis H37Rv
ugucgucgcggccg

SEQ ID NO: 3333380 - RNA, 17 nt, Mycobacterium tuberculosis H37Rv
ugucgucuuggcgaucg

SEQ ID NO: 3333381 - RNA, 19 nt, Mycobacterium tuberculosis H37Rv
ugucgugauacagcucggu

SEQ ID NO: 3333382 - RNA, 18 nt, Mycobacterium tuberculosis H37Rv
ugucgugcaaugcuucca

SEQ ID NO: 3333383 - RNA, 19 nt, Mycobacterium tuberculosis H37Rv
ugucguggcgggugaugca

SEQ ID NO: 3333384 - RNA, 18 nt, Mycobacterium tuberculosis H37Rv
ugucgugguuccgcccag

SEQ ID NO: 3333385 - RNA, 22 nt, Mycobacterium tuberculosis H37Rv
ugucguucgcgucacaccagcg

SEQ ID NO: 3333386 - RNA, 16 nt, Mycobacterium tuberculosis H37Rv
ugucuagcugguggug

SEQ ID NO: 3333387 - RNA, 15 nt, Mycobacterium tuberculosis H37Rv
ugucucccuugccgc

SEQ ID NO: 3333388 - RNA, 14 nt, Mycobacterium tuberculosis H37Rv
ugucuccggcaaca

SEQ ID NO: 3333389 - RNA, 22 nt, Mycobacterium tuberculosis H37Rv
ugucuccuccggaaagcucucg

SEQ ID NO: 3333390 - RNA, 16 nt, Mycobacterium tuberculosis H37Rv
ugucucgcccaccacc

SEQ ID NO: 3333391 - RNA, 21 nt, Mycobacterium tuberculosis H37Rv
ugucucggcaccacagugaaa

SEQ ID NO: 3333392 - RNA, 11 nt, Mycobacterium tuberculosis H37Rv
ugucugaaccg

SEQ ID NO: 3333393 - RNA, 19 nt, Mycobacterium tuberculosis H37Rv
ugucugcccgauacccggu

SEQ ID NO: 3333394 - RNA, 17 nt, Mycobacterium tuberculosis H37Rv
ugucuggucauggccga

SEQ ID NO: 3333395 - RNA, 22 nt, Mycobacterium tuberculosis H37Rv
uguugaaauugaugaucugcag

SEQ ID NO: 3333396 - RNA, 21 nt, Mycobacterium tuberculosis H37Rv
uguugaagaggcgcaccuccu

SEQ ID NO: 3333397 - RNA, 16 nt, Mycobacterium tuberculosis H37Rv
uguugaccgggucguc

SEQ ID NO: 3333398 - RNA, 20 nt, Mycobacterium tuberculosis H37Rv
uguugacucugcguccaccg

SEQ ID NO: 3333399 - RNA, 21 nt, Mycobacterium tuberculosis H37Rv
uguugagcggcagccaagcga

SEQ ID NO: 3333400 - RNA, 18 nt, Mycobacterium tuberculosis H37Rv
uguugagcuggaccuccg

SEQ ID NO: 3333401 - RNA, 15 nt, Mycobacterium tuberculosis H37Rv
uguugaugggcagcc

SEQ ID NO: 3333402 - RNA, 22 nt, Mycobacterium tuberculosis H37Rv
uguugcacgcgggugccgacgu

SEQ ID NO: 3333403 - RNA, 19 nt, Mycobacterium tuberculosis H37Rv
uguugccccggucggcgac

SEQ ID NO: 3333404 - RNA, 19 nt, Mycobacterium tuberculosis H37Rv
uguugccccuccaggggcu

SEQ ID NO: 3333405 - RNA, 14 nt, Mycobacterium tuberculosis H37Rv
uguugccgaagccc

SEQ ID NO: 3333406 - RNA, 16 nt, Mycobacterium tuberculosis H37Rv
uguugcgcacccgcgg

SEQ ID NO: 3333407 - RNA, 19 nt, Mycobacterium tuberculosis H37Rv
uguugcugucgaaguuggu

SEQ ID NO: 3333408 - RNA, 20 nt, Mycobacterium tuberculosis H37Rv
uguuggccagaccgcgcgca

SEQ ID NO: 3333409 - RNA, 17 nt, Mycobacterium tuberculosis H37Rv
uguuggccggcgccacc

SEQ ID NO: 3333410 - RNA, 17 nt, Mycobacterium tuberculosis H37Rv
uguuggcgcccgggccc

SEQ ID NO: 3333411 - RNA, 14 nt, Mycobacterium tuberculosis H37Rv
uguugggagccacc

SEQ ID NO: 3333412 - RNA, 20 nt, Mycobacterium tuberculosis H37Rv
uguugggcgcgaaacgccgc

SEQ ID NO: 3333413 - RNA, 16 nt, Mycobacterium tuberculosis H37Rv
uguuggugccagccgg

SEQ ID NO: 3333414 - RNA, 23 nt, Mycobacterium tuberculosis H37Rv
uguugguuugccggcgguggccg

SEQ ID NO: 3333415 - RNA, 13 nt, Mycobacterium tuberculosis H37Rv
uguuguacuggcu

SEQ ID NO: 3333416 - RNA, 15 nt, Mycobacterium tuberculosis H37Rv
uguugucugaccccc

SEQ ID NO: 3333417 - RNA, 17 nt, Mycobacterium tuberculosis H37Rv
uguugugcucggugacg

SEQ ID NO: 3333418 - RNA, 10 nt, Mycobacterium tuberculosis H37Rv
uguuguugaa

SEQ ID NO: 3333419 - RNA, 15 nt, Mycobacterium tuberculosis H37Rv
uguuguugaagcccg

SEQ ID NO: 3333420 - RNA, 13 nt, Mycobacterium tuberculosis H37Rv
uguuguugacgcc

SEQ ID NO: 3333421 - RNA, 12 nt, Mycobacterium tuberculosis H37Rv
uguuugacugcg

SEQ ID NO: 3333422 - RNA, 14 nt, Mycobacterium tuberculosis H37Rv
uguuuggguuuugu

SEQ ID NO: 3333423 - RNA, 22 nt, Mycobacterium tuberculosis H37Rv
uguuuugucaggauauuucuaa

SEQ ID NO: 3333424 - RNA, 14 nt, Mycobacterium tuberculosis H37Rv
uguuuuugcacuga

SEQ ID NO: 3333425 - RNA, 19 nt, Mycobacterium tuberculosis H37Rv
uguuuuuguauguucggcg

SEQ ID NO: 3333426 - RNA, 15 nt, Mycobacterium tuberculosis H37Rv
uuaagucuggaguga

SEQ ID NO: 3333427 - RNA, 17 nt, Mycobacterium tuberculosis H37Rv
uuacauagaccaccggc

SEQ ID NO: 3333428 - RNA, 14 nt, Mycobacterium tuberculosis H37Rv
uuacaugucacacc

SEQ ID NO: 3333429 - RNA, 17 nt, Mycobacterium tuberculosis H37Rv
uuaccaccgucaccgcc

SEQ ID NO: 3333430 - RNA, 15 nt, Mycobacterium tuberculosis H37Rv
uuaccauauccggac

SEQ ID NO: 3333431 - RNA, 14 nt, Mycobacterium tuberculosis H37Rv
uuaccgaagcccga

SEQ ID NO: 3333432 - RNA, 19 nt, Mycobacterium tuberculosis H37Rv
uuaccgguauagccaagug

SEQ ID NO: 3333433 - RNA, 21 nt, Mycobacterium tuberculosis H37Rv
uuacgaugcucagcuggucgg

SEQ ID NO: 3333434 - RNA, 21 nt, Mycobacterium tuberculosis H37Rv
uuacgcaccgaugccuugacc

SEQ ID NO: 3333435 - RNA, 14 nt, Mycobacterium tuberculosis H37Rv
uuacgccgagcaca

SEQ ID NO: 3333436 - RNA, 21 nt, Mycobacterium tuberculosis H37Rv
uuacgcucgcgggccaaagcc

SEQ ID NO: 3333437 - RNA, 13 nt, Mycobacterium tuberculosis H37Rv
uuacgucugcucg

SEQ ID NO: 3333438 - RNA, 15 nt, Mycobacterium tuberculosis H37Rv
uuagcagcacccggg

SEQ ID NO: 3333439 - RNA, 11 nt, Mycobacterium tuberculosis H37Rv
uuagccagguc

SEQ ID NO: 3333440 - RNA, 18 nt, Mycobacterium tuberculosis H37Rv
uuagcccacccauggccu

SEQ ID NO: 3333441 - RNA, 13 nt, Mycobacterium tuberculosis H37Rv
uuagcccgauggu

SEQ ID NO: 3333442 - RNA, 20 nt, Mycobacterium tuberculosis H37Rv
uuagcgcaugggccuuguug

SEQ ID NO: 3333443 - RNA, 21 nt, Mycobacterium tuberculosis H37Rv
uuagcgcuugccgcugagccc

SEQ ID NO: 3333444 - RNA, 23 nt, Mycobacterium tuberculosis H37Rv
uuagcggcugagggcccuuggcc

SEQ ID NO: 3333445 - RNA, 18 nt, Mycobacterium tuberculosis H37Rv
uuagcggcuugaacagcu

SEQ ID NO: 3333446 - RNA, 14 nt, Mycobacterium tuberculosis H37Rv
uuagcgguguggga

SEQ ID NO: 3333447 - RNA, 20 nt, Mycobacterium tuberculosis H37Rv
uuaggcgauucugcgucugc

SEQ ID NO: 3333448 - RNA, 14 nt, Mycobacterium tuberculosis H37Rv
uuaggcgcaguuaa

SEQ ID NO: 3333449 - RNA, 22 nt, Mycobacterium tuberculosis H37Rv
uuaggcguggcccaguccgcug

SEQ ID NO: 3333450 - RNA, 15 nt, Mycobacterium tuberculosis H37Rv
uuagggcgcccgccc

SEQ ID NO: 3333451 - RNA, 14 nt, Mycobacterium tuberculosis H37Rv
uuaucagcaagagc

SEQ ID NO: 3333452 - RNA, 20 nt, Mycobacterium tuberculosis H37Rv
uuaucggcagcaggacaccu

SEQ ID NO: 3333453 - RNA, 18 nt, Mycobacterium tuberculosis H37Rv
uuauucacccgguaggug

SEQ ID NO: 3333454 - RNA, 22 nt, Mycobacterium tuberculosis H37Rv
uuauucggugcgcgguugcugg

SEQ ID NO: 3333455 - RNA, 15 nt, Mycobacterium tuberculosis H37Rv
uuauugagucggcug

SEQ ID NO: 3333456 - RNA, 20 nt, Mycobacterium tuberculosis H37Rv
uucaacuuacgcgacgccgu

SEQ ID NO: 3333457 - RNA, 16 nt, Mycobacterium tuberculosis H37Rv
uucaccacgucgucgg

SEQ ID NO: 3333458 - RNA, 18 nt, Mycobacterium tuberculosis H37Rv
uucaccgcgauuagcaaa

SEQ ID NO: 3333459 - RNA, 19 nt, Mycobacterium tuberculosis H37Rv
uucaccgcgcugaaccaga

SEQ ID NO: 3333460 - RNA, 22 nt, Mycobacterium tuberculosis H37Rv
uucacgugcgacgaaguucucu

SEQ ID NO: 3333461 - RNA, 15 nt, Mycobacterium tuberculosis H37Rv
uucacguucggcgac

SEQ ID NO: 3333462 - RNA, 21 nt, Mycobacterium tuberculosis H37Rv
uucacguucggcgacgcgccg

SEQ ID NO: 3333463 - RNA, 18 nt, Mycobacterium tuberculosis H37Rv
uucacugugccgcugcau

SEQ ID NO: 3333464 - RNA, 20 nt, Mycobacterium tuberculosis H37Rv
uucagaggucuccacgugcu

SEQ ID NO: 3333465 - RNA, 22 nt, Mycobacterium tuberculosis H37Rv
uucagcaggcccuucaguucga

SEQ ID NO: 3333466 - RNA, 10 nt, Mycobacterium tuberculosis H37Rv
uucagcgcca

SEQ ID NO: 3333467 - RNA, 14 nt, Mycobacterium tuberculosis H37Rv
uucagcgccagcgc

SEQ ID NO: 3333468 - RNA, 15 nt, Mycobacterium tuberculosis H37Rv
uucaggaucggcgau

SEQ ID NO: 3333469 - RNA, 20 nt, Mycobacterium tuberculosis H37Rv
uucaggccgaggaaggagcc

SEQ ID NO: 3333470 - RNA, 13 nt, Mycobacterium tuberculosis H37Rv
uucagggcgucga

SEQ ID NO: 3333471 - RNA, 17 nt, Mycobacterium tuberculosis H37Rv
uucagguccaccgcugc

SEQ ID NO: 3333472 - RNA, 23 nt, Mycobacterium tuberculosis H37Rv
uucagguccaccgcugccggcag

SEQ ID NO: 3333473 - RNA, 22 nt, Mycobacterium tuberculosis H37Rv
uucaguucggccgucauggccc

SEQ ID NO: 3333474 - RNA, 14 nt, Mycobacterium tuberculosis H37Rv
uucaugaugacaau

SEQ ID NO: 3333475 - RNA, 19 nt, Mycobacterium tuberculosis H37Rv
uucauguagcagcgcggcu

SEQ ID NO: 3333476 - RNA, 19 nt, Mycobacterium tuberculosis H37Rv
uuccaaaaucaucugcaca

SEQ ID NO: 3333477 - RNA, 21 nt, Mycobacterium tuberculosis H37Rv
uuccaaagggaguguuugggu

SEQ ID NO: 3333478 - RNA, 13 nt, Mycobacterium tuberculosis H37Rv
uuccaacaccaac

SEQ ID NO: 3333479 - RNA, 14 nt, Mycobacterium tuberculosis H37Rv
uuccaacuccugca

SEQ ID NO: 3333480 - RNA, 15 nt, Mycobacterium tuberculosis H37Rv
uuccaagccgaccug

SEQ ID NO: 3333481 - RNA, 20 nt, Mycobacterium tuberculosis H37Rv
uuccaagucagaacggcggc

SEQ ID NO: 3333482 - RNA, 15 nt, Mycobacterium tuberculosis H37Rv
uuccacaccaggccg

SEQ ID NO: 3333483 - RNA, 11 nt, Mycobacterium tuberculosis H37Rv
uuccaccgccg

SEQ ID NO: 3333484 - RNA, 21 nt, Mycobacterium tuberculosis H37Rv
uuccacgaucggcucacgacu

SEQ ID NO: 3333485 - RNA, 20 nt, Mycobacterium tuberculosis H37Rv
uuccacggguggugccaggu

SEQ ID NO: 3333486 - RNA, 20 nt, Mycobacterium tuberculosis H37Rv
uuccacugggccugccaguc

SEQ ID NO: 3333487 - RNA, 15 nt, Mycobacterium tuberculosis H37Rv
uuccagcaguacacc

SEQ ID NO: 3333488 - RNA, 15 nt, Mycobacterium tuberculosis H37Rv
uuccagccacagccc

SEQ ID NO: 3333489 - RNA, 13 nt, Mycobacterium tuberculosis H37Rv
uuccagcgucugc

SEQ ID NO: 3333490 - RNA, 15 nt, Mycobacterium tuberculosis H37Rv
uuccagggcggccau

SEQ ID NO: 3333491 - RNA, 20 nt, Mycobacterium tuberculosis H37Rv
uucggcggcauguucaucgc

SEQ ID NO: 3333492 - RNA, 17 nt, Mycobacterium tuberculosis H37Rv
uucggcggccgugucgg

SEQ ID NO: 3333493 - RNA, 14 nt, Mycobacterium tuberculosis H37Rv
uucggcggcgauga

SEQ ID NO: 3333494 - RNA, 15 nt, Mycobacterium tuberculosis H37Rv
uucggcggucagcgg

SEQ ID NO: 3333495 - RNA, 15 nt, Mycobacterium tuberculosis H37Rv
uucggcggucgccgc

SEQ ID NO: 3333496 - RNA, 14 nt, Mycobacterium tuberculosis H37Rv
uucggcgucaccgu

SEQ ID NO: 3333497 - RNA, 14 nt, Mycobacterium tuberculosis H37Rv
uucggcgucguccg

SEQ ID NO: 3333498 - RNA, 13 nt, Mycobacterium tuberculosis H37Rv
uucggcgucgucg

SEQ ID NO: 3333499 - RNA, 13 nt, Mycobacterium tuberculosis H37Rv
uucggcgugucgg

SEQ ID NO: 3333500 - RNA, 23 nt, Mycobacterium tuberculosis H37Rv
uucgggacgaaaaaaucgugcgg

SEQ ID NO: 3333501 - RNA, 18 nt, Mycobacterium tuberculosis H37Rv
uucgggacgcgagugcgu

SEQ ID NO: 3333502 - RNA, 18 nt, Mycobacterium tuberculosis H37Rv
uucgggcauggucgccgg

SEQ ID NO: 3333503 - RNA, 15 nt, Mycobacterium tuberculosis H37Rv
uucggggugcgccca

SEQ ID NO: 3333504 - RNA, 14 nt, Mycobacterium tuberculosis H37Rv
uucggguccagcgg

SEQ ID NO: 3333505 - RNA, 14 nt, Mycobacterium tuberculosis H37Rv
uucgggugcagcca

SEQ ID NO: 3333506 - RNA, 12 nt, Mycobacterium tuberculosis H37Rv
uucggucggccu

SEQ ID NO: 3333507 - RNA, 20 nt, Mycobacterium tuberculosis H37Rv
uucggucgggggcagcgccu

SEQ ID NO: 3333508 - RNA, 22 nt, Mycobacterium tuberculosis H37Rv
uucggucugguugggccagcuc

SEQ ID NO: 3333509 - RNA, 23 nt, Mycobacterium tuberculosis H37Rv
uucggugagguauucguggucgg

SEQ ID NO: 3333510 - RNA, 20 nt, Mycobacterium tuberculosis H37Rv
uucggugccgugaucggcgc

SEQ ID NO: 3333511 - RNA, 13 nt, Mycobacterium tuberculosis H37Rv
uucggugcgcggu

SEQ ID NO: 3333512 - RNA, 16 nt, Mycobacterium tuberculosis H37Rv
uucggugcuguugucg

SEQ ID NO: 3333513 - RNA, 16 nt, Mycobacterium tuberculosis H37Rv
uucgguggagggcgag

SEQ ID NO: 3333514 - RNA, 21 nt, Mycobacterium tuberculosis H37Rv
uucguauggacgaggagcuca

SEQ ID NO: 3333515 - RNA, 12 nt, Mycobacterium tuberculosis H37Rv
uucguccccaga

SEQ ID NO: 3333516 - RNA, 15 nt, Mycobacterium tuberculosis H37Rv
uucgucgaaccuguc

SEQ ID NO: 3333517 - RNA, 18 nt, Mycobacterium tuberculosis H37Rv
uucgucgaccgcgccaua

SEQ ID NO: 3333518 - RNA, 22 nt, Mycobacterium tuberculosis H37Rv
uucgucggagucuucgucgucg

SEQ ID NO: 3333519 - RNA, 17 nt, Mycobacterium tuberculosis H37Rv
uucgucgguguccucgg

SEQ ID NO: 3333520 - RNA, 18 nt, Mycobacterium tuberculosis H37Rv
uucgucguaguccaggcc

SEQ ID NO: 3333521 - RNA, 11 nt, Mycobacterium tuberculosis H37Rv
uucgucgucgu

SEQ ID NO: 3333522 - RNA, 14 nt, Mycobacterium tuberculosis H37Rv
uucgucgucgucgg

SEQ ID NO: 3333523 - RNA, 14 nt, Mycobacterium tuberculosis H37Rv
uucgugcacggcga

SEQ ID NO: 3333524 - RNA, 15 nt, Mycobacterium tuberculosis H37Rv
uucgugcguugucgg

SEQ ID NO: 3333525 - RNA, 20 nt, Mycobacterium tuberculosis H37Rv
uucguuaggucacuccauga

SEQ ID NO: 3333526 - RNA, 12 nt, Mycobacterium tuberculosis H37Rv
uucuagcccguu

SEQ ID NO: 3333527 - RNA, 15 nt, Mycobacterium tuberculosis H37Rv
uucuccaccagcgug

SEQ ID NO: 3333528 - RNA, 12 nt, Mycobacterium tuberculosis H37Rv
uucuccaggcug

SEQ ID NO: 3333529 - RNA, 20 nt, Mycobacterium tuberculosis H37Rv
uucucgagccgccggaucgc

SEQ ID NO: 3333530 - RNA, 12 nt, Mycobacterium tuberculosis H37Rv
uucucgcuguug

SEQ ID NO: 3333531 - RNA, 17 nt, Mycobacterium tuberculosis H37Rv
uucucgguaccaccggc

SEQ ID NO: 3333532 - RNA, 17 nt, Mycobacterium tuberculosis H37Rv
uucucgguccacgggcc

SEQ ID NO: 3333533 - RNA, 18 nt, Mycobacterium tuberculosis H37Rv
uucucguagucaaccaag

SEQ ID NO: 3333534 - RNA, 14 nt, Mycobacterium tuberculosis H37Rv
uucucuagcucgaa

SEQ ID NO: 3333535 - RNA, 19 nt, Mycobacterium tuberculosis H37Rv
uucucuagcucgaacaggu

SEQ ID NO: 3333536 - RNA, 13 nt, Mycobacterium tuberculosis H37Rv
uucugaagcccga

SEQ ID NO: 3333537 - RNA, 21 nt, Mycobacterium tuberculosis H37Rv
uucuggaaccccgagcugcca

SEQ ID NO: 3333538 - RNA, 14 nt, Mycobacterium tuberculosis H37Rv
uucugguccagcac

SEQ ID NO: 3333539 - RNA, 22 nt, Mycobacterium tuberculosis H37Rv
uucuggucgaaauugggugccg

SEQ ID NO: 3333540 - RNA, 22 nt, Mycobacterium tuberculosis H37Rv
uucuguaccggcugguugaccg

SEQ ID NO: 3333541 - RNA, 19 nt, Mycobacterium tuberculosis H37Rv
uucugugucugcucggcga

SEQ ID NO: 3333542 - RNA, 18 nt, Mycobacterium tuberculosis H37Rv
uucuucaccgccuugguc

SEQ ID NO: 3333543 - RNA, 14 nt, Mycobacterium tuberculosis H37Rv
uucuucacuggcga

SEQ ID NO: 3333544 - RNA, 24 nt, Mycobacterium tuberculosis H37Rv
uucuucgcgaagaacgacgccacc

SEQ ID NO: 3333545 - RNA, 14 nt, Mycobacterium tuberculosis H37Rv
uucuucggacagca

SEQ ID NO: 3333546 - RNA, 17 nt, Mycobacterium tuberculosis H37Rv
uucuucggccagcuccc

SEQ ID NO: 3333547 - RNA, 23 nt, Mycobacterium tuberculosis H37Rv
uucuucggugaagaacaugcuca

SEQ ID NO: 3333548 - RNA, 22 nt, Mycobacterium tuberculosis H37Rv
uucuugaccagcagcucguuga

SEQ ID NO: 3333549 - RNA, 21 nt, Mycobacterium tuberculosis H37Rv
uucuuggcaggugccuucuuc

SEQ ID NO: 3333550 - RNA, 22 nt, Mycobacterium tuberculosis H37Rv
uucuuggcaggugccuucuucg

SEQ ID NO: 3333551 - RNA, 12 nt, Mycobacterium tuberculosis H37Rv
uucuuggcugca

SEQ ID NO: 3333552 - RNA, 16 nt, Mycobacterium tuberculosis H37Rv
uucuuguagccgccga

SEQ ID NO: 3333553 - RNA, 21 nt, Mycobacterium tuberculosis H37Rv
uucuuugccggcgccuugguc

SEQ ID NO: 3333554 - RNA, 16 nt, Mycobacterium tuberculosis H37Rv
uugaaauugaugaucu

SEQ ID NO: 3333555 - RNA, 20 nt, Mycobacterium tuberculosis H37Rv
uugaaauugaugaucugcag

SEQ ID NO: 3333556 - RNA, 20 nt, Mycobacterium tuberculosis H37Rv
uugaaccgguacaaccccca

SEQ ID NO: 3333557 - RNA, 14 nt, Mycobacterium tuberculosis H37Rv
uugaacgccgccag

SEQ ID NO: 3333558 - RNA, 15 nt, Mycobacterium tuberculosis H37Rv
uugaacucuggugac

SEQ ID NO: 3333559 - RNA, 14 nt, Mycobacterium tuberculosis H37Rv
uugaagaggcgcac

SEQ ID NO: 3333560 - RNA, 17 nt, Mycobacterium tuberculosis H37Rv
uugacaacccuguuguu

SEQ ID NO: 3333561 - RNA, 15 nt, Mycobacterium tuberculosis H37Rv
uugacagcuuucuug

SEQ ID NO: 3333562 - RNA, 19 nt, Mycobacterium tuberculosis H37Rv
uugaccccgcgugaccgac

SEQ ID NO: 3333563 - RNA, 15 nt, Mycobacterium tuberculosis H37Rv
uugaccgauacgcgg

SEQ ID NO: 3333564 - RNA, 21 nt, Mycobacterium tuberculosis H37Rv
uugaccgccgacaccacggcg

SEQ ID NO: 3333565 - RNA, 11 nt, Mycobacterium tuberculosis H37Rv
uugaccucuuc

SEQ ID NO: 3333566 - RNA, 15 nt, Mycobacterium tuberculosis H37Rv
uugacgagccgacca

SEQ ID NO: 3333567 - RNA, 17 nt, Mycobacterium tuberculosis H37Rv
uugacggucagccgcgg

SEQ ID NO: 3333568 - RNA, 13 nt, Mycobacterium tuberculosis H37Rv
uugacguccaaca

SEQ ID NO: 3333569 - RNA, 20 nt, Mycobacterium tuberculosis H37Rv
uugacgucgagcagcgccac

SEQ ID NO: 3333570 - RNA, 18 nt, Mycobacterium tuberculosis H37Rv
uugacucugcguccacca

SEQ ID NO: 3333571 - RNA, 11 nt, Mycobacterium tuberculosis H37Rv
uugacugaacu

SEQ ID NO: 3333572 - RNA, 21 nt, Mycobacterium tuberculosis H37Rv
uugagacgccggggaaccuug

SEQ ID NO: 3333573 - RNA, 23 nt, Mycobacterium tuberculosis H37Rv
uugagcagcuugguggcguggcc

SEQ ID NO: 3333574 - RNA, 14 nt, Mycobacterium tuberculosis H37Rv
uugagcauaugacg

SEQ ID NO: 3333575 - RNA, 9 nt, Mycobacterium tuberculosis H37Rv
uugagcccg

SEQ ID NO: 3333576 - RNA, 12 nt, Mycobacterium tuberculosis H37Rv
uugagccgccgc

SEQ ID NO: 3333577 - RNA, 16 nt, Mycobacterium tuberculosis H37Rv
uugagcucgcugauca

SEQ ID NO: 3333578 - RNA, 21 nt, Mycobacterium tuberculosis H37Rv
uugaggauccgcaccacgccc

SEQ ID NO: 3333579 - RNA, 16 nt, Mycobacterium tuberculosis H37Rv
uugagucguuggacgg

SEQ ID NO: 3333580 - RNA, 16 nt, Mycobacterium tuberculosis H37Rv
uugaucaccguggugg

SEQ ID NO: 3333581 - RNA, 14 nt, Mycobacterium tuberculosis H37Rv
uugauccccagcuc

SEQ ID NO: 3333582 - RNA, 14 nt, Mycobacterium tuberculosis H37Rv
uugauccuggcuca

SEQ ID NO: 3333583 - RNA, 19 nt, Mycobacterium tuberculosis H37Rv
uugaugaucugcagcucca

SEQ ID NO: 3333584 - RNA, 14 nt, Mycobacterium tuberculosis H37Rv
uugaugcucgaugc

SEQ ID NO: 3333585 - RNA, 21 nt, Mycobacterium tuberculosis H37Rv
uugauguugccggaguugaag

SEQ ID NO: 3333586 - RNA, 14 nt, Mycobacterium tuberculosis H37Rv
uugauugaccugcu

SEQ ID NO: 3333587 - RNA, 19 nt, Mycobacterium tuberculosis H37Rv
uugcacaccggcacugccc

SEQ ID NO: 3333588 - RNA, 11 nt, Mycobacterium tuberculosis H37Rv
uuggccaggug

SEQ ID NO: 3333589 - RNA, 22 nt, Mycobacterium tuberculosis H37Rv
uuggccaugcuggucagcggcg

SEQ ID NO: 3333590 - RNA, 14 nt, Mycobacterium tuberculosis H37Rv
uuggcccaccgccg

SEQ ID NO: 3333591 - RNA, 14 nt, Mycobacterium tuberculosis H37Rv
uuggcccagcgugu

SEQ ID NO: 3333592 - RNA, 18 nt, Mycobacterium tuberculosis H37Rv
uuggccccgcggagcgca

SEQ ID NO: 3333593 - RNA, 19 nt, Mycobacterium tuberculosis H37Rv
uuggcccgggucuccggcg

SEQ ID NO: 3333594 - RNA, 11 nt, Mycobacterium tuberculosis H37Rv
uuggccgccac

SEQ ID NO: 3333595 - RNA, 18 nt, Mycobacterium tuberculosis H37Rv
uuggccgccacaccgccg

SEQ ID NO: 3333596 - RNA, 21 nt, Mycobacterium tuberculosis H37Rv
uuggccgcgcucaucgcggcg

SEQ ID NO: 3333597 - RNA, 16 nt, Mycobacterium tuberculosis H37Rv
uuggccggcgcugccc

SEQ ID NO: 3333598 - RNA, 15 nt, Mycobacterium tuberculosis H37Rv
uuggccggcuugucg

SEQ ID NO: 3333599 - RNA, 15 nt, Mycobacterium tuberculosis H37Rv
uuggccgggcacgcg

SEQ ID NO: 3333600 - RNA, 17 nt, Mycobacterium tuberculosis H37Rv
uuggccguaccggugau

SEQ ID NO: 3333601 - RNA, 16 nt, Mycobacterium tuberculosis H37Rv
uuggccgucaucuccg

SEQ ID NO: 3333602 - RNA, 15 nt, Mycobacterium tuberculosis H37Rv
uuggcgaaccgcaga

SEQ ID NO: 3333603 - RNA, 13 nt, Mycobacterium tuberculosis H37Rv
uuggcgaagcccg

SEQ ID NO: 3333604 - RNA, 14 nt, Mycobacterium tuberculosis H37Rv
uuggcgaagcccga

SEQ ID NO: 3333605 - RNA, 20 nt, Mycobacterium tuberculosis H37Rv
uuggcgacgucggcggugac

SEQ ID NO: 3333606 - RNA, 16 nt, Mycobacterium tuberculosis H37Rv
uuggcgaucagcagcc

SEQ ID NO: 3333607 - RNA, 13 nt, Mycobacterium tuberculosis H37Rv
uuggcgaucucga

SEQ ID NO: 3333608 - RNA, 20 nt, Mycobacterium tuberculosis H37Rv
uuggcgaugacaaucaccug

SEQ ID NO: 3333609 - RNA, 17 nt, Mycobacterium tuberculosis H37Rv
uuggcgccaaaaaggau

SEQ ID NO: 3333610 - RNA, 13 nt, Mycobacterium tuberculosis H37Rv
uuggcgccgauga

SEQ ID NO: 3333611 - RNA, 21 nt, Mycobacterium tuberculosis H37Rv
uuggcgccggccaguucggcc

SEQ ID NO: 3333612 - RNA, 15 nt, Mycobacterium tuberculosis H37Rv
uuggcgcgcagguag

SEQ ID NO: 3333613 - RNA, 15 nt, Mycobacterium tuberculosis H37Rv
uuggcggccagcgca

SEQ ID NO: 3333614 - RNA, 20 nt, Mycobacterium tuberculosis H37Rv
uuggcggccagcgcaccgcc

SEQ ID NO: 3333615 - RNA, 14 nt, Mycobacterium tuberculosis H37Rv
uuggcggccagcgu

SEQ ID NO: 3333616 - RNA, 16 nt, Mycobacterium tuberculosis H37Rv
uuggcggccuuugucg

SEQ ID NO: 3333617 - RNA, 23 nt, Mycobacterium tuberculosis H37Rv
uuggcggcggcauagugcgacug

SEQ ID NO: 3333618 - RNA, 16 nt, Mycobacterium tuberculosis H37Rv
uuggcgggaccgugac

SEQ ID NO: 3333619 - RNA, 18 nt, Mycobacterium tuberculosis H37Rv
uuggcgggagcaccgacc

SEQ ID NO: 3333620 - RNA, 23 nt, Mycobacterium tuberculosis H37Rv
uuggcgggcgccuuggucgccgc

SEQ ID NO: 3333621 - RNA, 18 nt, Mycobacterium tuberculosis H37Rv
uuggcggucugcgccaaa

SEQ ID NO: 3333622 - RNA, 18 nt, Mycobacterium tuberculosis H37Rv
uuggcggugaacaccgcc

SEQ ID NO: 3333623 - RNA, 19 nt, Mycobacterium tuberculosis H37Rv
uuggcguaguuccgcaccg

SEQ ID NO: 3333624 - RNA, 23 nt, Mycobacterium tuberculosis H37Rv
uuggcgucacguaauuccccagg

SEQ ID NO: 3333625 - RNA, 15 nt, Mycobacterium tuberculosis H37Rv
uuggcgucagcagca

SEQ ID NO: 3333626 - RNA, 16 nt, Mycobacterium tuberculosis H37Rv
uuggcguugaccagca

SEQ ID NO: 3333627 - RNA, 15 nt, Mycobacterium tuberculosis H37Rv
uuggcucgcugggac

SEQ ID NO: 3333628 - RNA, 15 nt, Mycobacterium tuberculosis H37Rv
uuggcucggcgcagc

SEQ ID NO: 3333629 - RNA, 15 nt, Mycobacterium tuberculosis H37Rv
uuggcucgggccaga

SEQ ID NO: 3333630 - RNA, 22 nt, Mycobacterium tuberculosis H37Rv
uuggcugccgaacaguucggcg

SEQ ID NO: 3333631 - RNA, 14 nt, Mycobacterium tuberculosis H37Rv
uuggcuugcgccga

SEQ ID NO: 3333632 - RNA, 16 nt, Mycobacterium tuberculosis H37Rv
uugggccagcuccuga

SEQ ID NO: 3333633 - RNA, 19 nt, Mycobacterium tuberculosis H37Rv
uugggcgauuuugcgucug

SEQ ID NO: 3333634 - RNA, 21 nt, Mycobacterium tuberculosis H37Rv
uugggcgcgggugcgccggcg

SEQ ID NO: 3333635 - RNA, 16 nt, Mycobacterium tuberculosis H37Rv
cggaacaccaccaggc

SEQ ID NO: 3333636 - RNA, 12 nt, Mycobacterium tuberculosis H37Rv
cggaacaccagc

SEQ ID NO: 3333637 - RNA, 16 nt, Mycobacterium tuberculosis H37Rv
cggaacaccgacgaca

SEQ ID NO: 3333638 - RNA, 21 nt, Mycobacterium tuberculosis H37Rv
cggaacaccgacgucaggcuc

SEQ ID NO: 3333639 - RNA, 13 nt, Mycobacterium tuberculosis H37Rv
cggaacacgaugc

SEQ ID NO: 3333640 - RNA, 23 nt, Mycobacterium tuberculosis H37Rv
cggaaccaaccucggaucgccag

SEQ ID NO: 3333641 - RNA, 14 nt, Mycobacterium tuberculosis H37Rv
cggaacccagcacu

SEQ ID NO: 3333642 - RNA, 19 nt, Mycobacterium tuberculosis H37Rv
cggaacccccagcugcagg

SEQ ID NO: 3333643 - RNA, 18 nt, Mycobacterium tuberculosis H37Rv
cggaaccggcgugcagca

SEQ ID NO: 3333644 - RNA, 18 nt, Mycobacterium tuberculosis H37Rv
cggaaccgguaucgccaa

SEQ ID NO: 3333645 - RNA, 17 nt, Mycobacterium tuberculosis H37Rv
cggaaccguacgccaga

SEQ ID NO: 3333646 - RNA, 23 nt, Mycobacterium tuberculosis H37Rv
cggaaccguuugacgcgcucgcg

SEQ ID NO: 3333647 - RNA, 21 nt, Mycobacterium tuberculosis H37Rv
cggaacgaaagucuccggaac

SEQ ID NO: 3333648 - RNA, 17 nt, Mycobacterium tuberculosis H37Rv
cggaacgccggcaccga

SEQ ID NO: 3333649 - RNA, 23 nt, Mycobacterium tuberculosis H37Rv
cggaacggguuggcgaucaucag

SEQ ID NO: 3333650 - RNA, 22 nt, Mycobacterium tuberculosis H37Rv
cggaacguuccugcacagacag

SEQ ID NO: 3333651 - RNA, 15 nt, Mycobacterium tuberculosis H37Rv
cggaacugaccacgu

SEQ ID NO: 3333652 - RNA, 18 nt, Mycobacterium tuberculosis H37Rv
cggaagaagugcucacau

SEQ ID NO: 3333653 - RNA, 18 nt, Mycobacterium tuberculosis H37Rv
cggaagacgugguagagg

SEQ ID NO: 3333654 - RNA, 19 nt, Mycobacterium tuberculosis H37Rv
cggaagcccuuguagcaca

SEQ ID NO: 3333655 - RNA, 17 nt, Mycobacterium tuberculosis H37Rv
cggaagccgccuaggac

SEQ ID NO: 3333656 - RNA, 20 nt, Mycobacterium tuberculosis H37Rv
cggaaggacggcagccacca

SEQ ID NO: 3333657 - RNA, 23 nt, Mycobacterium tuberculosis H37Rv
cggaaggacggcagccaccagcg

SEQ ID NO: 3333658 - RNA, 16 nt, Mycobacterium tuberculosis H37Rv
cggaaggcccggcgcg

SEQ ID NO: 3333659 - RNA, 18 nt, Mycobacterium tuberculosis H37Rv
cggaaguacuccauggca

SEQ ID NO: 3333660 - RNA, 22 nt, Mycobacterium tuberculosis H37Rv
cggaaguucuccucgugcagca

SEQ ID NO: 3333661 - RNA, 19 nt, Mycobacterium tuberculosis H37Rv
cggaauacaccagcgacgc

SEQ ID NO: 3333662 - RNA, 16 nt, Mycobacterium tuberculosis H37Rv
cggaauacccgcuggc

SEQ ID NO: 3333663 - RNA, 16 nt, Mycobacterium tuberculosis H37Rv
cggaauacccggccca

SEQ ID NO: 3333664 - RNA, 14 nt, Mycobacterium tuberculosis H37Rv
cggaauauggcggc

SEQ ID NO: 3333665 - RNA, 16 nt, Mycobacterium tuberculosis H37Rv
cggaauauggcggccg

SEQ ID NO: 3333666 - RNA, 18 nt, Mycobacterium tuberculosis H37Rv
cggaauauggcggccggg

SEQ ID NO: 3333667 - RNA, 14 nt, Mycobacterium tuberculosis H37Rv
cggaaucagcaccc

SEQ ID NO: 3333668 - RNA, 18 nt, Mycobacterium tuberculosis H37Rv
cggaauccccccugucgc

SEQ ID NO: 3333669 - RNA, 14 nt, Mycobacterium tuberculosis H37Rv
cggaaucgcccggg

SEQ ID NO: 3333670 - RNA, 15 nt, Mycobacterium tuberculosis H37Rv
cggaaucgcgaaaca

SEQ ID NO: 3333671 - RNA, 12 nt, Mycobacterium tuberculosis H37Rv
cggaaucgcgac

SEQ ID NO: 3333672 - RNA, 21 nt, Mycobacterium tuberculosis H37Rv
cggaaucgguuucgaccugcg

SEQ ID NO: 3333673 - RNA, 15 nt, Mycobacterium tuberculosis H37Rv
cggaaucgucggcgc

SEQ ID NO: 3333674 - RNA, 20 nt, Mycobacterium tuberculosis H37Rv
cggaaucucuucggcggugc

SEQ ID NO: 3333675 - RNA, 17 nt, Mycobacterium tuberculosis H37Rv
cggaaugaaggcaccga

SEQ ID NO: 3333676 - RNA, 20 nt, Mycobacterium tuberculosis H37Rv
cggaaugcccgagcaggacg

SEQ ID NO: 3333677 - RNA, 17 nt, Mycobacterium tuberculosis H37Rv
cggaaugccgucgccgg

SEQ ID NO: 3333678 - RNA, 22 nt, Mycobacterium tuberculosis H37Rv
cggaaugggcgccacagccgua

SEQ ID NO: 3333679 - RNA, 23 nt, Mycobacterium tuberculosis H37Rv
cggaauggucccggguccaagaa

SEQ ID NO: 3333680 - RNA, 15 nt, Mycobacterium tuberculosis H37Rv
cggaauucgguuggc

SEQ ID NO: 3333681 - RNA, 20 nt, Mycobacterium tuberculosis H37Rv
cggaauucgguuggcucggg

SEQ ID NO: 3333682 - RNA, 20 nt, Mycobacterium tuberculosis H37Rv
cggacaacacggcgaaccgg

SEQ ID NO: 3333683 - RNA, 12 nt, Mycobacterium tuberculosis H37Rv
cggacaaccugg

SEQ ID NO: 3333684 - RNA, 14 nt, Mycobacterium tuberculosis H37Rv
cggacaaccugggg

SEQ ID NO: 3333685 - RNA, 17 nt, Mycobacterium tuberculosis H37Rv
cggacacacaggcggcg

SEQ ID NO: 3333686 - RNA, 15 nt, Mycobacterium tuberculosis H37Rv
cggacaccgcggcga

SEQ ID NO: 3333687 - RNA, 20 nt, Mycobacterium tuberculosis H37Rv
cggacaccgcggcgaucugc

SEQ ID NO: 3333688 - RNA, 14 nt, Mycobacterium tuberculosis H37Rv
cggacaccucgggc

SEQ ID NO: 3333689 - RNA, 18 nt, Mycobacterium tuberculosis H37Rv
cggacacgaucgcgucgg

SEQ ID NO: 3333690 - RNA, 20 nt, Mycobacterium tuberculosis H37Rv
cggacagcgcauccacaauc

SEQ ID NO: 3333691 - RNA, 18 nt, Mycobacterium tuberculosis H37Rv
cggacagcgccuggccgg

SEQ ID NO: 3333692 - RNA, 15 nt, Mycobacterium tuberculosis H37Rv
cggacagcgucucgg

SEQ ID NO: 3333693 - RNA, 14 nt, Mycobacterium tuberculosis H37Rv
cggacagggcggcg

SEQ ID NO: 3333694 - RNA, 15 nt, Mycobacterium tuberculosis H37Rv
cggacagggcggcga

SEQ ID NO: 3333695 - RNA, 16 nt, Mycobacterium tuberculosis H37Rv
cggacaguuccccggg

SEQ ID NO: 3333696 - RNA, 15 nt, Mycobacterium tuberculosis H37Rv
cggacaguucccggc

SEQ ID NO: 3333697 - RNA, 23 nt, Mycobacterium tuberculosis H37Rv
cggacauccgaugcgucacacca

SEQ ID NO: 3333698 - RNA, 16 nt, Mycobacterium tuberculosis H37Rv
cggacaugcgggcagc

SEQ ID NO: 3333699 - RNA, 21 nt, Mycobacterium tuberculosis H37Rv
cggaccacuguuggugccgcc

SEQ ID NO: 3333700 - RNA, 23 nt, Mycobacterium tuberculosis H37Rv
cggaccacuguuggugccgccac

SEQ ID NO: 3333701 - RNA, 19 nt, Mycobacterium tuberculosis H37Rv
cggaccagagugguggcga

SEQ ID NO: 3333702 - RNA, 16 nt, Mycobacterium tuberculosis H37Rv
cggaccaucgacaacg

SEQ ID NO: 3333703 - RNA, 14 nt, Mycobacterium tuberculosis H37Rv
cggaccaucgccag

SEQ ID NO: 3333704 - RNA, 19 nt, Mycobacterium tuberculosis H37Rv
cggacccacccgcaccgcc

SEQ ID NO: 3333705 - RNA, 17 nt, Mycobacterium tuberculosis H37Rv
cggaccccacgaguagc

SEQ ID NO: 3333706 - RNA, 14 nt, Mycobacterium tuberculosis H37Rv
cggaccccgagacc

SEQ ID NO: 3333707 - RNA, 19 nt, Mycobacterium tuberculosis H37Rv
cggacccgaccgucgucgu

SEQ ID NO: 3333708 - RNA, 15 nt, Mycobacterium tuberculosis H37Rv
cggacccgcagcugc

SEQ ID NO: 3333709 - RNA, 16 nt, Mycobacterium tuberculosis H37Rv
cggacccgcagcugcg

SEQ ID NO: 3333710 - RNA, 13 nt, Mycobacterium tuberculosis H37Rv
cggacccgcccuu

SEQ ID NO: 3333711 - RNA, 17 nt, Mycobacterium tuberculosis H37Rv
cggacccgcccuugccg

SEQ ID NO: 3333712 - RNA, 13 nt, Mycobacterium tuberculosis H37Rv
cggacccgccgug

SEQ ID NO: 3333713 - RNA, 13 nt, Mycobacterium tuberculosis H37Rv
cggacccgcgcgu

SEQ ID NO: 3333714 - RNA, 11 nt, Mycobacterium tuberculosis H37Rv
cggacccgcgg

SEQ ID NO: 3333715 - RNA, 14 nt, Mycobacterium tuberculosis H37Rv
cggacccgcucgcg

SEQ ID NO: 3333716 - RNA, 18 nt, Mycobacterium tuberculosis H37Rv
cggacccggcgcgauggc

SEQ ID NO: 3333717 - RNA, 21 nt, Mycobacterium tuberculosis H37Rv
cggacccggugacccgcuggg

SEQ ID NO: 3333718 - RNA, 20 nt, Mycobacterium tuberculosis H37Rv
cggaccgaagaccuccucgg

SEQ ID NO: 3333719 - RNA, 14 nt, Mycobacterium tuberculosis H37Rv
cggaccgaccaccg

SEQ ID NO: 3333720 - RNA, 12 nt, Mycobacterium tuberculosis H37Rv
cggaccgauggu

SEQ ID NO: 3333721 - RNA, 16 nt, Mycobacterium tuberculosis H37Rv
cggaccgaugguugag

SEQ ID NO: 3333722 - RNA, 22 nt, Mycobacterium tuberculosis H37Rv
cggaccgauugucggcaacgac

SEQ ID NO: 3333723 - RNA, 23 nt, Mycobacterium tuberculosis H37Rv
cggaccgauugucggcaacgacc

SEQ ID NO: 3333724 - RNA, 20 nt, Mycobacterium tuberculosis H37Rv
cggaccgcacuugaucgacg

SEQ ID NO: 3333725 - RNA, 11 nt, Mycobacterium tuberculosis H37Rv
cggaccgcgaa

SEQ ID NO: 3333726 - RNA, 15 nt, Mycobacterium tuberculosis H37Rv
cggaccgcgacggcg

SEQ ID NO: 3333727 - RNA, 13 nt, Mycobacterium tuberculosis H37Rv
cggaccgcggauu

SEQ ID NO: 3333728 - RNA, 21 nt, Mycobacterium tuberculosis H37Rv
cggaccgcggccaccgccugu

SEQ ID NO: 3333729 - RNA, 16 nt, Mycobacterium tuberculosis H37Rv
cggaccgcugccugcc

SEQ ID NO: 3333730 - RNA, 21 nt, Mycobacterium tuberculosis H37Rv
cggaccgcuucgacgucguug

SEQ ID NO: 3333731 - RNA, 22 nt, Mycobacterium tuberculosis H37Rv
cggaccgggccaagacggcggg

SEQ ID NO: 3333732 - RNA, 23 nt, Mycobacterium tuberculosis H37Rv
cgccguaucggggcaccacgcca

SEQ ID NO: 3333733 - RNA, 13 nt, Mycobacterium tuberculosis H37Rv
cgccguaugccgc

SEQ ID NO: 3333734 - RNA, 19 nt, Mycobacterium tuberculosis H37Rv
cgccgucaccgaucgaaca

SEQ ID NO: 3333735 - RNA, 13 nt, Mycobacterium tuberculosis H37Rv
cgccgucaccgcc

SEQ ID NO: 3333736 - RNA, 16 nt, Mycobacterium tuberculosis H37Rv
cgccgucaccgccgac

SEQ ID NO: 3333737 - RNA, 15 nt, Mycobacterium tuberculosis H37Rv
cgccgucaccgccgu

SEQ ID NO: 3333738 - RNA, 16 nt, Mycobacterium tuberculosis H37Rv
cgccgucaccgccguu

SEQ ID NO: 3333739 - RNA, 17 nt, Mycobacterium tuberculosis H37Rv
cgccgucaccgcgcggc

SEQ ID NO: 3333740 - RNA, 19 nt, Mycobacterium tuberculosis H37Rv
cgccgucaccgcgcggcuc

SEQ ID NO: 3333741 - RNA, 18 nt, Mycobacterium tuberculosis H37Rv
cgccgucacgcacgccgc

SEQ ID NO: 3333742 - RNA, 15 nt, Mycobacterium tuberculosis H37Rv
cgccgucagcccagg

SEQ ID NO: 3333743 - RNA, 17 nt, Mycobacterium tuberculosis H37Rv
cgccgucagcccaggug

SEQ ID NO: 3333744 - RNA, 18 nt, Mycobacterium tuberculosis H37Rv
cgccgucagcggccaagu

SEQ ID NO: 3333745 - RNA, 15 nt, Mycobacterium tuberculosis H37Rv
cgccguccagcaaua

SEQ ID NO: 3333746 - RNA, 21 nt, Mycobacterium tuberculosis H37Rv
cgccguccagcgccgcggccc

SEQ ID NO: 3333747 - RNA, 15 nt, Mycobacterium tuberculosis H37Rv
cgccguccccaccga

SEQ ID NO: 3333748 - RNA, 18 nt, Mycobacterium tuberculosis H37Rv
cgccguccccgccgccgu

SEQ ID NO: 3333749 - RNA, 15 nt, Mycobacterium tuberculosis H37Rv
cgccguccccgccgu

SEQ ID NO: 3333750 - RNA, 17 nt, Mycobacterium tuberculosis H37Rv
cgccguccccgccgucg

SEQ ID NO: 3333751 - RNA, 20 nt, Mycobacterium tuberculosis H37Rv
cgccgucccgaaacgccggg

SEQ ID NO: 3333752 - RNA, 18 nt, Mycobacterium tuberculosis H37Rv
cgccgucgaagacguugg

SEQ ID NO: 3333753 - RNA, 12 nt, Mycobacterium tuberculosis H37Rv
cgccgucgacca

SEQ ID NO: 3333754 - RNA, 17 nt, Mycobacterium tuberculosis H37Rv
cgccgucgaccggcggg

SEQ ID NO: 3333755 - RNA, 18 nt, Mycobacterium tuberculosis H37Rv
cgccgucgaccggcggga

SEQ ID NO: 3333756 - RNA, 17 nt, Mycobacterium tuberculosis H37Rv
cgccgucgacgcggccg

SEQ ID NO: 3333757 - RNA, 16 nt, Mycobacterium tuberculosis H37Rv
cgccgucgcagccagc

SEQ ID NO: 3333758 - RNA, 13 nt, Mycobacterium tuberculosis H37Rv
cgccgucgccacc

SEQ ID NO: 3333759 - RNA, 14 nt, Mycobacterium tuberculosis H37Rv
cgccgucgccacca

SEQ ID NO: 3333760 - RNA, 14 nt, Mycobacterium tuberculosis H37Rv
cgccgucgccaccg

SEQ ID NO: 3333761 - RNA, 15 nt, Mycobacterium tuberculosis H37Rv
cgccgucgccaccgg

SEQ ID NO: 3333762 - RNA, 14 nt, Mycobacterium tuberculosis H37Rv
cgccgucgccgaac

SEQ ID NO: 3333763 - RNA, 15 nt, Mycobacterium tuberculosis H37Rv
cgccgucgccgccgc

SEQ ID NO: 3333764 - RNA, 16 nt, Mycobacterium tuberculosis H37Rv
cgccgucgccgccggc

SEQ ID NO: 3333765 - RNA, 18 nt, Mycobacterium tuberculosis H37Rv
cgccgucggagccggcca

SEQ ID NO: 3333766 - RNA, 18 nt, Mycobacterium tuberculosis H37Rv
cgccgucggccgagucga

SEQ ID NO: 3333767 - RNA, 12 nt, Mycobacterium tuberculosis H37Rv
cgccgucggcgc

SEQ ID NO: 3333768 - RNA, 13 nt, Mycobacterium tuberculosis H37Rv
cgccgucggcgcg

SEQ ID NO: 3333769 - RNA, 20 nt, Mycobacterium tuberculosis H37Rv
cgccgucggguccgcggccc

SEQ ID NO: 3333770 - RNA, 21 nt, Mycobacterium tuberculosis H37Rv
cgccgucggguccgcggcccu

SEQ ID NO: 3333771 - RNA, 19 nt, Mycobacterium tuberculosis H37Rv
cgccgucggguuccuccuc

SEQ ID NO: 3333772 - RNA, 16 nt, Mycobacterium tuberculosis H37Rv
cgccgucggugccgcc

SEQ ID NO: 3333773 - RNA, 18 nt, Mycobacterium tuberculosis H37Rv
cgccgucggugccgccgc

SEQ ID NO: 3333774 - RNA, 16 nt, Mycobacterium tuberculosis H37Rv
cgccgucgucgcgcag

SEQ ID NO: 3333775 - RNA, 21 nt, Mycobacterium tuberculosis H37Rv
cgccgucguugugccggucga

SEQ ID NO: 3333776 - RNA, 16 nt, Mycobacterium tuberculosis H37Rv
cgccgucucgcggugc

SEQ ID NO: 3333777 - RNA, 22 nt, Mycobacterium tuberculosis H37Rv
cgccgucucgcggugcggcaac

SEQ ID NO: 3333778 - RNA, 16 nt, Mycobacterium tuberculosis H37Rv
cgccgucucugccacg

SEQ ID NO: 3333779 - RNA, 20 nt, Mycobacterium tuberculosis H37Rv
cgccgugacccauucucggc

SEQ ID NO: 3333780 - RNA, 22 nt, Mycobacterium tuberculosis H37Rv
cgccgugaguagguccacguuc

SEQ ID NO: 3333781 - RNA, 18 nt, Mycobacterium tuberculosis H37Rv
cgccgugaucagcucgcg

SEQ ID NO: 3333782 - RNA, 13 nt, Mycobacterium tuberculosis H37Rv
cgccgugcgccgu

SEQ ID NO: 3333783 - RNA, 13 nt, Mycobacterium tuberculosis H37Rv
cgccgugcggguu

SEQ ID NO: 3333784 - RNA, 15 nt, Mycobacterium tuberculosis H37Rv
cgccgugcugcggcg

SEQ ID NO: 3333785 - RNA, 17 nt, Mycobacterium tuberculosis H37Rv
cgccguggauacgcacg

SEQ ID NO: 3333786 - RNA, 14 nt, Mycobacterium tuberculosis H37Rv
cgccguggccugaa

SEQ ID NO: 3333787 - RNA, 23 nt, Mycobacterium tuberculosis H37Rv
cgccguggccugaaacggcugca

SEQ ID NO: 3333788 - RNA, 21 nt, Mycobacterium tuberculosis H37Rv
cgccguggcgcggucggaguc

SEQ ID NO: 3333789 - RNA, 17 nt, Mycobacterium tuberculosis H37Rv
cgccguggugcgcaugg

SEQ ID NO: 3333790 - RNA, 20 nt, Mycobacterium tuberculosis H37Rv
cgccgugguggaugagccgg

SEQ ID NO: 3333791 - RNA, 21 nt, Mycobacterium tuberculosis H37Rv
cgccgugguugcacguucggc

SEQ ID NO: 3333792 - RNA, 15 nt, Mycobacterium tuberculosis H37Rv
cgccguuaccgccgu

SEQ ID NO: 3333793 - RNA, 22 nt, Mycobacterium tuberculosis H37Rv
cgccguuacggagggcacgggu

SEQ ID NO: 3333794 - RNA, 15 nt, Mycobacterium tuberculosis H37Rv
cgccguucacccugg

SEQ ID NO: 3333795 - RNA, 15 nt, Mycobacterium tuberculosis H37Rv
cgccguuccacgucg

SEQ ID NO: 3333796 - RNA, 20 nt, Mycobacterium tuberculosis H37Rv
cgccguucccaccaccaccg

SEQ ID NO: 3333797 - RNA, 16 nt, Mycobacterium tuberculosis H37Rv
cgccguucccacccac

SEQ ID NO: 3333798 - RNA, 18 nt, Mycobacterium tuberculosis H37Rv
cgccguucccacccacgc

SEQ ID NO: 3333799 - RNA, 20 nt, Mycobacterium tuberculosis H37Rv
cgccguucccacccacgccg

SEQ ID NO: 3333800 - RNA, 21 nt, Mycobacterium tuberculosis H37Rv
cgccguucccacccacgccga

SEQ ID NO: 3333801 - RNA, 21 nt, Mycobacterium tuberculosis H37Rv
cgccguucgcucccccgcuac

SEQ ID NO: 3333802 - RNA, 18 nt, Mycobacterium tuberculosis H37Rv
cgccguucgggaugcaag

SEQ ID NO: 3333803 - RNA, 19 nt, Mycobacterium tuberculosis H37Rv
cgccguucgggaugcaagg

SEQ ID NO: 3333804 - RNA, 18 nt, Mycobacterium tuberculosis H37Rv
cgccguugaacggcacca

SEQ ID NO: 3333805 - RNA, 23 nt, Mycobacterium tuberculosis H37Rv
cgccguugaacggcaccagcggg

SEQ ID NO: 3333806 - RNA, 18 nt, Mycobacterium tuberculosis H37Rv
cgccguugaugucggcag

SEQ ID NO: 3333807 - RNA, 22 nt, Mycobacterium tuberculosis H37Rv
cgccguugaugucggcagguac

SEQ ID NO: 3333808 - RNA, 16 nt, Mycobacterium tuberculosis H37Rv
cgccguugccaagcag

SEQ ID NO: 3333809 - RNA, 13 nt, Mycobacterium tuberculosis H37Rv
cgccguugccacc

SEQ ID NO: 3333810 - RNA, 17 nt, Mycobacterium tuberculosis H37Rv
cgccguugccaccggug

SEQ ID NO: 3333811 - RNA, 20 nt, Mycobacterium tuberculosis H37Rv
cgccguugccaccggugccg

SEQ ID NO: 3333812 - RNA, 21 nt, Mycobacterium tuberculosis H37Rv
cgccguugccauugccucccg

SEQ ID NO: 3333813 - RNA, 21 nt, Mycobacterium tuberculosis H37Rv
cgccguugccgaucagcccgg

SEQ ID NO: 3333814 - RNA, 22 nt, Mycobacterium tuberculosis H37Rv
cgccguugccgaucagcccggc

SEQ ID NO: 3333815 - RNA, 20 nt, Mycobacterium tuberculosis H37Rv
cgccguugccgauccccagg

SEQ ID NO: 3333816 - RNA, 21 nt, Mycobacterium tuberculosis H37Rv
cgccguugccgauccccaggc

SEQ ID NO: 3333817 - RNA, 17 nt, Mycobacterium tuberculosis H37Rv
cgccguugccgccagcg

SEQ ID NO: 3333818 - RNA, 18 nt, Mycobacterium tuberculosis H37Rv
cgccguugccgccagcgc

SEQ ID NO: 3333819 - RNA, 15 nt, Mycobacterium tuberculosis H37Rv
cgccguugccgccga

SEQ ID NO: 3333820 - RNA, 17 nt, Mycobacterium tuberculosis H37Rv
cgccguugccgccgaag

SEQ ID NO: 3333821 - RNA, 23 nt, Mycobacterium tuberculosis H37Rv
cgccguugccgccgaagccgacg

SEQ ID NO: 3333822 - RNA, 16 nt, Mycobacterium tuberculosis H37Rv
cgccguugccgccgac

SEQ ID NO: 3333823 - RNA, 17 nt, Mycobacterium tuberculosis H37Rv
cgccguugccgccgccu

SEQ ID NO: 3333824 - RNA, 16 nt, Mycobacterium tuberculosis H37Rv
cgccguugccgccggc

SEQ ID NO: 3333825 - RNA, 15 nt, Mycobacterium tuberculosis H37Rv
cgccguugccgccgu

SEQ ID NO: 3333826 - RNA, 20 nt, Mycobacterium tuberculosis H37Rv
cgccguugccgccguuaccg

SEQ ID NO: 3333827 - RNA, 22 nt, Mycobacterium tuberculosis H37Rv
cgccguugccgccguugccacc

SEQ ID NO: 3333828 - RNA, 14 nt, Mycobacterium tuberculosis H37Rv
cgccguugccgccu

SEQ ID NO: 3333829 - RNA, 17 nt, Mycobacterium tuberculosis H37Rv
ugcaggugaugagugcg

SEQ ID NO: 3333830 - RNA, 19 nt, Mycobacterium tuberculosis H37Rv
ugcaggugaugagugcgga

SEQ ID NO: 3333831 - RNA, 16 nt, Mycobacterium tuberculosis H37Rv
ugcaggugaugcaugc

SEQ ID NO: 3333832 - RNA, 21 nt, Mycobacterium tuberculosis H37Rv
ugcaggugcccggccaaaaug

SEQ ID NO: 3333833 - RNA, 13 nt, Mycobacterium tuberculosis H37Rv
ugcagguggccgu

SEQ ID NO: 3333834 - RNA, 18 nt, Mycobacterium tuberculosis H37Rv
ugcagguuaggguccagg

SEQ ID NO: 3333835 - RNA, 19 nt, Mycobacterium tuberculosis H37Rv
ugcaguaacuucaccggcu

SEQ ID NO: 3333836 - RNA, 20 nt, Mycobacterium tuberculosis H37Rv
ugcaguaacuucaccggcuc

SEQ ID NO: 3333837 - RNA, 15 nt, Mycobacterium tuberculosis H37Rv
ugcagucgauuucgg

SEQ ID NO: 3333838 - RNA, 22 nt, Mycobacterium tuberculosis H37Rv
ugcagucuuucccggggcuggg

SEQ ID NO: 3333839 - RNA, 23 nt, Mycobacterium tuberculosis H37Rv
ugcagugccguguccagcaugcc

SEQ ID NO: 3333840 - RNA, 13 nt, Mycobacterium tuberculosis H37Rv
ugcagugcgaccc

SEQ ID NO: 3333841 - RNA, 14 nt, Mycobacterium tuberculosis H37Rv
ugcagugcgccagc

SEQ ID NO: 3333842 - RNA, 22 nt, Mycobacterium tuberculosis H37Rv
ugcaguggauccggcagcagcc

SEQ ID NO: 3333843 - RNA, 22 nt, Mycobacterium tuberculosis H37Rv
ugcaguguuuuugcagacucgg

SEQ ID NO: 3333844 - RNA, 21 nt, Mycobacterium tuberculosis H37Rv
ugcaguuccuugagacgccgg

SEQ ID NO: 3333845 - RNA, 13 nt, Mycobacterium tuberculosis H37Rv
ugcaguuccuugc

SEQ ID NO: 3333846 - RNA, 19 nt, Mycobacterium tuberculosis H37Rv
ugcauagcaauccgcacag

SEQ ID NO: 3333847 - RNA, 21 nt, Mycobacterium tuberculosis H37Rv
ugcauagcaauccgcacagcg

SEQ ID NO: 3333848 - RNA, 14 nt, Mycobacterium tuberculosis H37Rv
ugcauaggcgcggu

SEQ ID NO: 3333849 - RNA, 20 nt, Mycobacterium tuberculosis H37Rv
ugcaucacaagggugcccgg

SEQ ID NO: 3333850 - RNA, 18 nt, Mycobacterium tuberculosis H37Rv
ugcaucaugccgcccauc

SEQ ID NO: 3333851 - RNA, 20 nt, Mycobacterium tuberculosis H37Rv
ugcaucaugccgcccaucac

SEQ ID NO: 3333852 - RNA, 16 nt, Mycobacterium tuberculosis H37Rv
ugcaucauggccguga

SEQ ID NO: 3333853 - RNA, 20 nt, Mycobacterium tuberculosis H37Rv
ugcaucauggccgugaacug

SEQ ID NO: 3333854 - RNA, 21 nt, Mycobacterium tuberculosis H37Rv
ugcauccacugcggcgcuggg

SEQ ID NO: 3333855 - RNA, 16 nt, Mycobacterium tuberculosis H37Rv
ugcauccagcugcugc

SEQ ID NO: 3333856 - RNA, 18 nt, Mycobacterium tuberculosis H37Rv
ugcauccauccugccuua

SEQ ID NO: 3333857 - RNA, 15 nt, Mycobacterium tuberculosis H37Rv
ugcaucgaucaccgc

SEQ ID NO: 3333858 - RNA, 16 nt, Mycobacterium tuberculosis H37Rv
ugcaucgccugcgccu

SEQ ID NO: 3333859 - RNA, 19 nt, Mycobacterium tuberculosis H37Rv
ugcaucgcgauuccggcgg

SEQ ID NO: 3333860 - RNA, 20 nt, Mycobacterium tuberculosis H37Rv
ugcaucgcggcggcgcucuu

SEQ ID NO: 3333861 - RNA, 19 nt, Mycobacterium tuberculosis H37Rv
ugcaucugaucaggccaca

SEQ ID NO: 3333862 - RNA, 15 nt, Mycobacterium tuberculosis H37Rv
ugcaugaacugcucg

SEQ ID NO: 3333863 - RNA, 19 nt, Mycobacterium tuberculosis H37Rv
ugcaugagcguucagcacg

SEQ ID NO: 3333864 - RNA, 22 nt, Mycobacterium tuberculosis H37Rv
ugcaugcccagaaaaccgccgc

SEQ ID NO: 3333865 - RNA, 12 nt, Mycobacterium tuberculosis H37Rv
ugcauuggcggu

SEQ ID NO: 3333866 - RNA, 22 nt, Mycobacterium tuberculosis H37Rv
ugccaaaagggcggcagcgagg

SEQ ID NO: 3333867 - RNA, 21 nt, Mycobacterium tuberculosis H37Rv
ugccaaaggacgacaccgcga

SEQ ID NO: 3333868 - RNA, 22 nt, Mycobacterium tuberculosis H37Rv
ugccaacaaaggccggguggcc

SEQ ID NO: 3333869 - RNA, 21 nt, Mycobacterium tuberculosis H37Rv
ugccaacaccggcgaucaccg

SEQ ID NO: 3333870 - RNA, 21 nt, Mycobacterium tuberculosis H37Rv
ugccaacgacaggcgcccaca

SEQ ID NO: 3333871 - RNA, 18 nt, Mycobacterium tuberculosis H37Rv
ugccaacgcccguguuga

SEQ ID NO: 3333872 - RNA, 14 nt, Mycobacterium tuberculosis H37Rv
ugccaacgggcagg

SEQ ID NO: 3333873 - RNA, 23 nt, Mycobacterium tuberculosis H37Rv
ugccaagcagcugggcaucaccg

SEQ ID NO: 3333874 - RNA, 15 nt, Mycobacterium tuberculosis H37Rv
ugccaaucgccguca

SEQ ID NO: 3333875 - RNA, 16 nt, Mycobacterium tuberculosis H37Rv
ugccaaugcugcaggu

SEQ ID NO: 3333876 - RNA, 14 nt, Mycobacterium tuberculosis H37Rv
ugccaauuccagcc

SEQ ID NO: 3333877 - RNA, 16 nt, Mycobacterium tuberculosis H37Rv
ugccacaacgccucga

SEQ ID NO: 3333878 - RNA, 14 nt, Mycobacterium tuberculosis H37Rv
ugccacacaggcgu

SEQ ID NO: 3333879 - RNA, 23 nt, Mycobacterium tuberculosis H37Rv
ugccacacaggcguccaucgcca

SEQ ID NO: 3333880 - RNA, 12 nt, Mycobacterium tuberculosis H37Rv
ugccacagaccg

SEQ ID NO: 3333881 - RNA, 22 nt, Mycobacterium tuberculosis H37Rv
ugccacagaccgaacagcaccg

SEQ ID NO: 3333882 - RNA, 18 nt, Mycobacterium tuberculosis H37Rv
ugccacagcgacagcgug

SEQ ID NO: 3333883 - RNA, 23 nt, Mycobacterium tuberculosis H37Rv
ugccacagcucgccgugaccagg

SEQ ID NO: 3333884 - RNA, 12 nt, Mycobacterium tuberculosis H37Rv
ugccacaggcgu

SEQ ID NO: 3333885 - RNA, 14 nt, Mycobacterium tuberculosis H37Rv
ugccacaggugacc

SEQ ID NO: 3333886 - RNA, 15 nt, Mycobacterium tuberculosis H37Rv
ugccaccagaaacac

SEQ ID NO: 3333887 - RNA, 23 nt, Mycobacterium tuberculosis H37Rv
ugccaccagacaacgccgucgau

SEQ ID NO: 3333888 - RNA, 20 nt, Mycobacterium tuberculosis H37Rv
ugccacccagaugcagcggu

SEQ ID NO: 3333889 - RNA, 14 nt, Mycobacterium tuberculosis H37Rv
ugccacccagcacg

SEQ ID NO: 3333890 - RNA, 22 nt, Mycobacterium tuberculosis H37Rv
ugccacccagcacgcgcgcgac

SEQ ID NO: 3333891 - RNA, 15 nt, Mycobacterium tuberculosis H37Rv
ugccacccaucgcac

SEQ ID NO: 3333892 - RNA, 15 nt, Mycobacterium tuberculosis H37Rv
ugccacccuugccgc

SEQ ID NO: 3333893 - RNA, 16 nt, Mycobacterium tuberculosis H37Rv
ugccacccuugccgcc

SEQ ID NO: 3333894 - RNA, 23 nt, Mycobacterium tuberculosis H37Rv
ugccaccgcggccgcggucgaug

SEQ ID NO: 3333895 - RNA, 18 nt, Mycobacterium tuberculosis H37Rv
ugccaccggugccggcga

SEQ ID NO: 3333896 - RNA, 20 nt, Mycobacterium tuberculosis H37Rv
ugccaccggugccggcgacg

SEQ ID NO: 3333897 - RNA, 20 nt, Mycobacterium tuberculosis H37Rv
ugccaccgguuaaccuccag

SEQ ID NO: 3333898 - RNA, 15 nt, Mycobacterium tuberculosis H37Rv
ugcccgacgagucgc

SEQ ID NO: 3333899 - RNA, 13 nt, Mycobacterium tuberculosis H37Rv
ugcccgacugaac

SEQ ID NO: 3333900 - RNA, 20 nt, Mycobacterium tuberculosis H37Rv
ugcccgacugaacgucaccg

SEQ ID NO: 3333901 - RNA, 18 nt, Mycobacterium tuberculosis H37Rv
ugcccgagcccagcgccu

SEQ ID NO: 3333902 - RNA, 15 nt, Mycobacterium tuberculosis H37Rv
ugcccgaucagccgu

SEQ ID NO: 3333903 - RNA, 21 nt, Mycobacterium tuberculosis H37Rv
ugcccgaugguacccgcgccg

SEQ ID NO: 3333904 - RNA, 15 nt, Mycobacterium tuberculosis H37Rv
ugcccgcaacgccaa

SEQ ID NO: 3333905 - RNA, 16 nt, Mycobacterium tuberculosis H37Rv
ugcccgcaccacaccg

SEQ ID NO: 3333906 - RNA, 14 nt, Mycobacterium tuberculosis H37Rv
ugcccgcaccgcgu

SEQ ID NO: 3333907 - RNA, 16 nt, Mycobacterium tuberculosis H37Rv
ugcccgcacugccgcc

SEQ ID NO: 3333908 - RNA, 18 nt, Mycobacterium tuberculosis H37Rv
ugcccgcauugccaacgc

SEQ ID NO: 3333909 - RNA, 19 nt, Mycobacterium tuberculosis H37Rv
ugcccgcauugccaacgcc

SEQ ID NO: 3333910 - RNA, 15 nt, Mycobacterium tuberculosis H37Rv
ugcccgccagcgccg

SEQ ID NO: 3333911 - RNA, 17 nt, Mycobacterium tuberculosis H37Rv
ugcccgcccagcccggc

SEQ ID NO: 3333912 - RNA, 15 nt, Mycobacterium tuberculosis H37Rv
ugcccgccguagacc

SEQ ID NO: 3333913 - RNA, 18 nt, Mycobacterium tuberculosis H37Rv
ugcccgccguagaccagc

SEQ ID NO: 3333914 - RNA, 21 nt, Mycobacterium tuberculosis H37Rv
ugcccgccguagaccagccgu

SEQ ID NO: 3333915 - RNA, 20 nt, Mycobacterium tuberculosis H37Rv
ugcccgccucgcagcgacac

SEQ ID NO: 3333916 - RNA, 24 nt, Mycobacterium tuberculosis H37Rv
ugcccgcggugacgagcacaugcu

SEQ ID NO: 3333917 - RNA, 14 nt, Mycobacterium tuberculosis H37Rv
ugcccgcguugcca

SEQ ID NO: 3333918 - RNA, 20 nt, Mycobacterium tuberculosis H37Rv
ugcccgcguuugcgaagccc

SEQ ID NO: 3333919 - RNA, 19 nt, Mycobacterium tuberculosis H37Rv
ugcccgcugaucagauccu

SEQ ID NO: 3333920 - RNA, 22 nt, Mycobacterium tuberculosis H37Rv
ugcccgcugaucagauccucga

SEQ ID NO: 3333921 - RNA, 16 nt, Mycobacterium tuberculosis H37Rv
ugcccggcaaccugga

SEQ ID NO: 3333922 - RNA, 23 nt, Mycobacterium tuberculosis H37Rv
ugcccggcaaccuggacuggguc

SEQ ID NO: 3333923 - RNA, 19 nt, Mycobacterium tuberculosis H37Rv
ugcccggcccgcucagccg

SEQ ID NO: 3333924 - RNA, 14 nt, Mycobacterium tuberculosis H37Rv
ugcccggcgcgaag

SEQ ID NO: 3333925 - RNA, 22 nt, Mycobacterium tuberculosis H37Rv
ugcccggcuccuccccggcccg

SEQ ID NO: 3333926 - RNA, 22 nt, Mycobacterium tuberculosis H37Rv
ugcccggcucucagcgacagcu

SEQ ID NO: 3333927 - RNA, 20 nt, Mycobacterium tuberculosis H37Rv
ugcccgggacaaguucggua

SEQ ID NO: 3333928 - RNA, 17 nt, Mycobacterium tuberculosis H37Rv
ugcccgggcccgucguc

SEQ ID NO: 3333929 - RNA, 21 nt, Mycobacterium tuberculosis H37Rv
ugcccgggcgggagucgucga

SEQ ID NO: 3333930 - RNA, 17 nt, Mycobacterium tuberculosis H37Rv
ugcccgggcggucgaag

SEQ ID NO: 3333931 - RNA, 19 nt, Mycobacterium tuberculosis H37Rv
ugcccgggcggucgaagac

SEQ ID NO: 3333932 - RNA, 20 nt, Mycobacterium tuberculosis H37Rv
ugcccgggcggucgaagacc

SEQ ID NO: 3333933 - RNA, 20 nt, Mycobacterium tuberculosis H37Rv
ugcccgggguccaucggggc

SEQ ID NO: 3333934 - RNA, 16 nt, Mycobacterium tuberculosis H37Rv
ugcccgggugacccgu

SEQ ID NO: 3333935 - RNA, 20 nt, Mycobacterium tuberculosis H37Rv
ugcccgggugacccgugcgg

SEQ ID NO: 3333936 - RNA, 19 nt, Mycobacterium tuberculosis H37Rv
ugcccguauaaccggccau

SEQ ID NO: 3333937 - RNA, 22 nt, Mycobacterium tuberculosis H37Rv
ugcccguguuaaagaagccuga

SEQ ID NO: 3333938 - RNA, 22 nt, Mycobacterium tuberculosis H37Rv
ugcccguucaugcggcggcgcu

SEQ ID NO: 3333939 - RNA, 19 nt, Mycobacterium tuberculosis H37Rv
ugcccucaacgucccagcc

SEQ ID NO: 3333940 - RNA, 21 nt, Mycobacterium tuberculosis H37Rv
ugcccuccggguauggcggcg

SEQ ID NO: 3333941 - RNA, 18 nt, Mycobacterium tuberculosis H37Rv
ugcccugacgccccgcca

SEQ ID NO: 3333942 - RNA, 20 nt, Mycobacterium tuberculosis H37Rv
ugcccugcgcucgggcugcc

SEQ ID NO: 3333943 - RNA, 16 nt, Mycobacterium tuberculosis H37Rv
ugcccugcgugcagau

SEQ ID NO: 3333944 - RNA, 17 nt, Mycobacterium tuberculosis H37Rv
ugcccuggaccagcggg

SEQ ID NO: 3333945 - RNA, 15 nt, Mycobacterium tuberculosis H37Rv
ugcccuggcccaucu

SEQ ID NO: 3333946 - RNA, 16 nt, Mycobacterium tuberculosis H37Rv
ugcccugggugauggc

SEQ ID NO: 3333947 - RNA, 16 nt, Mycobacterium tuberculosis H37Rv
ugcccuugcggaagaa

SEQ ID NO: 3333948 - RNA, 20 nt, Mycobacterium tuberculosis H37Rv
ugcccuuguaggccaucguc

SEQ ID NO: 3333949 - RNA, 17 nt, Mycobacterium tuberculosis H37Rv
ugccgaaaaucgcagcc

SEQ ID NO: 3333950 - RNA, 13 nt, Mycobacterium tuberculosis H37Rv
ugccgaaacccga

SEQ ID NO: 3333951 - RNA, 22 nt, Mycobacterium tuberculosis H37Rv
ugccgaaacgccgaccgcgccg

SEQ ID NO: 3333952 - RNA, 23 nt, Mycobacterium tuberculosis H37Rv
ugccgaacagcgaaccgccggca

SEQ ID NO: 3333953 - RNA, 21 nt, Mycobacterium tuberculosis H37Rv
ugccgaacagggaggucgccg

SEQ ID NO: 3333954 - RNA, 18 nt, Mycobacterium tuberculosis H37Rv
ugccgaaccacgcgcccg

SEQ ID NO: 3333955 - RNA, 15 nt, Mycobacterium tuberculosis H37Rv
ugccgaaccgcgcgu

SEQ ID NO: 3333956 - RNA, 17 nt, Mycobacterium tuberculosis H37Rv
ugccgaaccgcugcggg

SEQ ID NO: 3333957 - RNA, 16 nt, Mycobacterium tuberculosis H37Rv
ugccgaacgccagacc

SEQ ID NO: 3333958 - RNA, 17 nt, Mycobacterium tuberculosis H37Rv
ugccgaacgccagaccg

SEQ ID NO: 3333959 - RNA, 18 nt, Mycobacterium tuberculosis H37Rv
ugccgaacuccgcggaac

SEQ ID NO: 3333960 - RNA, 17 nt, Mycobacterium tuberculosis H37Rv
ugccgaagaugaccgcu

SEQ ID NO: 3333961 - RNA, 22 nt, Mycobacterium tuberculosis H37Rv
ugccgaagcccccgacguugcu

SEQ ID NO: 3333962 - RNA, 20 nt, Mycobacterium tuberculosis H37Rv
ugccgaagcugcccaaccgg

SEQ ID NO: 3333963 - RNA, 22 nt, Mycobacterium tuberculosis H37Rv
ugccgaagcugcccaaccgguc

SEQ ID NO: 3333964 - RNA, 13 nt, Mycobacterium tuberculosis H37Rv
ugccgaaguugaa

SEQ ID NO: 3333965 - RNA, 17 nt, Mycobacterium tuberculosis H37Rv
ugccgaaguugaagaag

SEQ ID NO: 3333966 - RNA, 20 nt, Mycobacterium tuberculosis H37Rv
ugccgaaguuuuggaagccc

SEQ ID NO: 3333967 - RNA, 18 nt, Mycobacterium tuberculosis H37Rv
ugccgaauaccgguggca

SEQ ID NO: 3333968 - RNA, 15 nt, Mycobacterium tuberculosis H37Rv
ugccgaauugggcga

SEQ ID NO: 3333969 - RNA, 21 nt, Mycobacterium tuberculosis H37Rv
ugccgacaguuuaccgugccg

SEQ ID NO: 3333970 - RNA, 13 nt, Mycobacterium tuberculosis H37Rv
ugccgaccagcau

SEQ ID NO: 3333971 - RNA, 18 nt, Mycobacterium tuberculosis H37Rv
ugccgaccagcaucucgg

SEQ ID NO: 3333972 - RNA, 21 nt, Mycobacterium tuberculosis H37Rv
ugccgacccgccgcgcccggc

SEQ ID NO: 3333973 - RNA, 21 nt, Mycobacterium tuberculosis H37Rv
ugccgacccgcuucgcccggc

SEQ ID NO: 3333974 - RNA, 22 nt, Mycobacterium tuberculosis H37Rv
ugccgacccgcuucgcccggcu

SEQ ID NO: 3333975 - RNA, 23 nt, Mycobacterium tuberculosis H37Rv
ugccgacccgcuucgcccggcug

SEQ ID NO: 3333976 - RNA, 21 nt, Mycobacterium tuberculosis H37Rv
ugccgaccggcacccgcggcg

SEQ ID NO: 3333977 - RNA, 12 nt, Mycobacterium tuberculosis H37Rv
ugccgaccgguc

SEQ ID NO: 3333978 - RNA, 13 nt, Mycobacterium tuberculosis H37Rv
ugccgaccguggu

SEQ ID NO: 3333979 - RNA, 23 nt, Mycobacterium tuberculosis H37Rv
ugccgacgccccgaucggccacc

SEQ ID NO: 3333980 - RNA, 18 nt, Mycobacterium tuberculosis H37Rv
ugccgacgcgcggccagc

SEQ ID NO: 3333981 - RNA, 19 nt, Mycobacterium tuberculosis H37Rv
ugccgacgcgcggccagcc

SEQ ID NO: 3333982 - RNA, 23 nt, Mycobacterium tuberculosis H37Rv
ugccgacgcuccaggguccggac

SEQ ID NO: 3333983 - RNA, 17 nt, Mycobacterium tuberculosis H37Rv
ugccgacggcaucaacg

SEQ ID NO: 3333984 - RNA, 16 nt, Mycobacterium tuberculosis H37Rv
ugccgacggugauggg

SEQ ID NO: 3333985 - RNA, 14 nt, Mycobacterium tuberculosis H37Rv
ugccgacucaucgg

SEQ ID NO: 3333986 - RNA, 23 nt, Mycobacterium tuberculosis H37Rv
ugccgacucaucggccgcggucg

SEQ ID NO: 3333987 - RNA, 16 nt, Mycobacterium tuberculosis H37Rv
ugccgacucggccaca

SEQ ID NO: 3333988 - RNA, 16 nt, Mycobacterium tuberculosis H37Rv
ugccgagaucccagcg

SEQ ID NO: 3333989 - RNA, 14 nt, Mycobacterium tuberculosis H37Rv
ugccgagcccaggu

SEQ ID NO: 3333990 - RNA, 20 nt, Mycobacterium tuberculosis H37Rv
ugccgagcgcaaggucgacg

SEQ ID NO: 3333991 - RNA, 21 nt, Mycobacterium tuberculosis H37Rv
ugccgagcgugcgcugguggc

SEQ ID NO: 3333992 - RNA, 19 nt, Mycobacterium tuberculosis H37Rv
ugccgagcuucagcgcgcu

SEQ ID NO: 3333993 - RNA, 21 nt, Mycobacterium tuberculosis H37Rv
ugccgccgguuccgccggccc

SEQ ID NO: 3333994 - RNA, 12 nt, Mycobacterium tuberculosis H37Rv
ugccgccgucac

SEQ ID NO: 3333995 - RNA, 20 nt, Mycobacterium tuberculosis H37Rv
ugccgccgucaccgccguug

SEQ ID NO: 3333996 - RNA, 20 nt, Mycobacterium tuberculosis H37Rv
ugccgccguccccaccgacg

SEQ ID NO: 3333997 - RNA, 17 nt, Mycobacterium tuberculosis H37Rv
ugccgccgucgccgccg

SEQ ID NO: 3333998 - RNA, 19 nt, Mycobacterium tuberculosis H37Rv
ugccgccgucgccgccgcu

SEQ ID NO: 3333999 - RNA, 23 nt, Mycobacterium tuberculosis H37Rv
ugccgccgucgucgucggcagcg

SEQ ID NO: 3334000 - RNA, 15 nt, Mycobacterium tuberculosis H37Rv
ugccgccgugguugc

SEQ ID NO: 3334001 - RNA, 23 nt, Mycobacterium tuberculosis H37Rv
ugccgccguucccaccaccaccg

SEQ ID NO: 3334002 - RNA, 14 nt, Mycobacterium tuberculosis H37Rv
ugccgccguugcca

SEQ ID NO: 3334003 - RNA, 16 nt, Mycobacterium tuberculosis H37Rv
ugccgccguugccacc

SEQ ID NO: 3334004 - RNA, 23 nt, Mycobacterium tuberculosis H37Rv
ugccgccguugccgccggcgccg

SEQ ID NO: 3334005 - RNA, 15 nt, Mycobacterium tuberculosis H37Rv
ugccgccguugccgu

SEQ ID NO: 3334006 - RNA, 21 nt, Mycobacterium tuberculosis H37Rv
ugccgccuccgccugccccac

SEQ ID NO: 3334007 - RNA, 20 nt, Mycobacterium tuberculosis H37Rv
ugccgccuccggugcauauu

SEQ ID NO: 3334008 - RNA, 16 nt, Mycobacterium tuberculosis H37Rv
ugccgccuugcuugcg

SEQ ID NO: 3334009 - RNA, 14 nt, Mycobacterium tuberculosis H37Rv
ugccgcgaucgggc

SEQ ID NO: 3334010 - RNA, 20 nt, Mycobacterium tuberculosis H37Rv
ugccgcgaucgggcccagca

SEQ ID NO: 3334011 - RNA, 15 nt, Mycobacterium tuberculosis H37Rv
ugccgcgaucgugca

SEQ ID NO: 3334012 - RNA, 20 nt, Mycobacterium tuberculosis H37Rv
ugccgcgcaccaacaccagc

SEQ ID NO: 3334013 - RNA, 21 nt, Mycobacterium tuberculosis H37Rv
ugccgcgcaccaacaccagcg

SEQ ID NO: 3334014 - RNA, 14 nt, Mycobacterium tuberculosis H37Rv
ugccgcgcagcugc

SEQ ID NO: 3334015 - RNA, 15 nt, Mycobacterium tuberculosis H37Rv
ugccgcgcagcugcc

SEQ ID NO: 3334016 - RNA, 16 nt, Mycobacterium tuberculosis H37Rv
ugccgcgcagcugccg

SEQ ID NO: 3334017 - RNA, 19 nt, Mycobacterium tuberculosis H37Rv
ugccgcgcagcugccgcac

SEQ ID NO: 3334018 - RNA, 14 nt, Mycobacterium tuberculosis H37Rv
ugccgcgccacugu

SEQ ID NO: 3334019 - RNA, 19 nt, Mycobacterium tuberculosis H37Rv
ugccgcgccguagagccgc

SEQ ID NO: 3334020 - RNA, 18 nt, Mycobacterium tuberculosis H37Rv
ugccgcgcucgcgcaccg

SEQ ID NO: 3334021 - RNA, 13 nt, Mycobacterium tuberculosis H37Rv
ugccgcggccacc

SEQ ID NO: 3334022 - RNA, 15 nt, Mycobacterium tuberculosis H37Rv
ugccgcggccaccgc

SEQ ID NO: 3334023 - RNA, 17 nt, Mycobacterium tuberculosis H37Rv
ugccgcggccaccgccg

SEQ ID NO: 3334024 - RNA, 19 nt, Mycobacterium tuberculosis H37Rv
ugccgcggcugccaucccg

SEQ ID NO: 3334025 - RNA, 17 nt, Mycobacterium tuberculosis H37Rv
ugccgcggucggcgacg

SEQ ID NO: 3334026 - RNA, 19 nt, Mycobacterium tuberculosis H37Rv
ugccgcgguugugcugggu

SEQ ID NO: 3334027 - RNA, 20 nt, Mycobacterium tuberculosis H37Rv
ugccgcguagaacccaggcc

SEQ ID NO: 3334028 - RNA, 23 nt, Mycobacterium tuberculosis H37Rv
ugccgcguagguggccagcgcgg

SEQ ID NO: 3334029 - RNA, 15 nt, Mycobacterium tuberculosis H37Rv
ugccgcgucggccgc

SEQ ID NO: 3334030 - RNA, 18 nt, Mycobacterium tuberculosis H37Rv
ugccgcgucggccgcgcu

SEQ ID NO: 3334031 - RNA, 19 nt, Mycobacterium tuberculosis H37Rv
ugccgcucggcaaccugcg

SEQ ID NO: 3334032 - RNA, 23 nt, Mycobacterium tuberculosis H37Rv
ugccgcugaagccaaaugcgcug

SEQ ID NO: 3334033 - RNA, 16 nt, Mycobacterium tuberculosis H37Rv
ugccgcugagcccugc

SEQ ID NO: 3334034 - RNA, 18 nt, Mycobacterium tuberculosis H37Rv
ugccgcugagcccugcgc

SEQ ID NO: 3334035 - RNA, 15 nt, Mycobacterium tuberculosis H37Rv
ugccgcuggucgucg

SEQ ID NO: 3334036 - RNA, 15 nt, Mycobacterium tuberculosis H37Rv
ugccggaaacgccag

SEQ ID NO: 3334037 - RNA, 16 nt, Mycobacterium tuberculosis H37Rv
ugccggacaaccuggg

SEQ ID NO: 3334038 - RNA, 18 nt, Mycobacterium tuberculosis H37Rv
ugccggacagcucgcgcu

SEQ ID NO: 3334039 - RNA, 18 nt, Mycobacterium tuberculosis H37Rv
ugccggaccaccgggccg

SEQ ID NO: 3334040 - RNA, 19 nt, Mycobacterium tuberculosis H37Rv
ugccggaccaccgggccga

SEQ ID NO: 3334041 - RNA, 18 nt, Mycobacterium tuberculosis H37Rv
ugccggacgccaugcccg

SEQ ID NO: 3334042 - RNA, 19 nt, Mycobacterium tuberculosis H37Rv
ugccggagacacccgccag

SEQ ID NO: 3334043 - RNA, 13 nt, Mycobacterium tuberculosis H37Rv
ugccggagacguc

SEQ ID NO: 3334044 - RNA, 18 nt, Mycobacterium tuberculosis H37Rv
ugccggagacgucgccgc

SEQ ID NO: 3334045 - RNA, 19 nt, Mycobacterium tuberculosis H37Rv
ugccggaggaucgcugguu

SEQ ID NO: 3334046 - RNA, 23 nt, Mycobacterium tuberculosis H37Rv
ugccggaguugucgacggccacc

SEQ ID NO: 3334047 - RNA, 17 nt, Mycobacterium tuberculosis H37Rv
ugccggauugacgccga

SEQ ID NO: 3334048 - RNA, 14 nt, Mycobacterium tuberculosis H37Rv
ugccggcaacagcu

SEQ ID NO: 3334049 - RNA, 23 nt, Mycobacterium tuberculosis H37Rv
ugccggcacccgucgggugcuga

SEQ ID NO: 3334050 - RNA, 17 nt, Mycobacterium tuberculosis H37Rv
ugccggcacgcaugccg

SEQ ID NO: 3334051 - RNA, 13 nt, Mycobacterium tuberculosis H37Rv
ugccggcagcgcc

SEQ ID NO: 3334052 - RNA, 12 nt, Mycobacterium tuberculosis H37Rv
ugccggcagcgg

SEQ ID NO: 3334053 - RNA, 13 nt, Mycobacterium tuberculosis H37Rv
ugccggcagcggu

SEQ ID NO: 3334054 - RNA, 17 nt, Mycobacterium tuberculosis H37Rv
ugccggcagcgguggca

SEQ ID NO: 3334055 - RNA, 22 nt, Mycobacterium tuberculosis H37Rv
ugccggccaaguugacccccuc

SEQ ID NO: 3334056 - RNA, 19 nt, Mycobacterium tuberculosis H37Rv
ugccggccaggauuucgca

SEQ ID NO: 3334057 - RNA, 12 nt, Mycobacterium tuberculosis H37Rv
ugccggcccugc

SEQ ID NO: 3334058 - RNA, 22 nt, Mycobacterium tuberculosis H37Rv
ugccggcgaaccccagcgcauc

SEQ ID NO: 3334059 - RNA, 14 nt, Mycobacterium tuberculosis H37Rv
ugccggcgaacucg

SEQ ID NO: 3334060 - RNA, 15 nt, Mycobacterium tuberculosis H37Rv
ugccggcgaacucgc

SEQ ID NO: 3334061 - RNA, 14 nt, Mycobacterium tuberculosis H37Rv
ugccggcgacgcua

SEQ ID NO: 3334062 - RNA, 19 nt, Mycobacterium tuberculosis H37Rv
ugccggcgagggccacggc

SEQ ID NO: 3334063 - RNA, 15 nt, Mycobacterium tuberculosis H37Rv
ugccggcgccuuggu

SEQ ID NO: 3334064 - RNA, 23 nt, Mycobacterium tuberculosis H37Rv
ugccggcgccuuggucgccgccu

SEQ ID NO: 3334065 - RNA, 22 nt, Mycobacterium tuberculosis H37Rv
ugccggcggaucugaucggcgc

SEQ ID NO: 3334066 - RNA, 18 nt, Mycobacterium tuberculosis H37Rv
ugccggcgguggccgaca

SEQ ID NO: 3334067 - RNA, 22 nt, Mycobacterium tuberculosis H37Rv
ugccggcguaggcaggaucgcc

SEQ ID NO: 3334068 - RNA, 18 nt, Mycobacterium tuberculosis H37Rv
ugccggcgugcgcgagau

SEQ ID NO: 3334069 - RNA, 22 nt, Mycobacterium tuberculosis H37Rv
ugccggcgugcggcgaggacgc

SEQ ID NO: 3334070 - RNA, 18 nt, Mycobacterium tuberculosis H37Rv
ugccggcguuagcguagc

SEQ ID NO: 3334071 - RNA, 16 nt, Mycobacterium tuberculosis H37Rv
ugccggcguugccgcc

SEQ ID NO: 3334072 - RNA, 13 nt, Mycobacterium tuberculosis H37Rv
ugccggcuuggcc

SEQ ID NO: 3334073 - RNA, 22 nt, Mycobacterium tuberculosis H37Rv
ugccgggaaccaacaccagguc

SEQ ID NO: 3334074 - RNA, 16 nt, Mycobacterium tuberculosis H37Rv
ugccgggaacgaggua

SEQ ID NO: 3334075 - RNA, 19 nt, Mycobacterium tuberculosis H37Rv
ugccgggacauucccaggu

SEQ ID NO: 3334076 - RNA, 13 nt, Mycobacterium tuberculosis H37Rv
ugccgggaccggu

SEQ ID NO: 3334077 - RNA, 21 nt, Mycobacterium tuberculosis H37Rv
ugccgggaucgccguccagca

SEQ ID NO: 3334078 - RNA, 13 nt, Mycobacterium tuberculosis H37Rv
ugccgggcaccac

SEQ ID NO: 3334079 - RNA, 18 nt, Mycobacterium tuberculosis H37Rv
ugccgggcaccaccacac

SEQ ID NO: 3334080 - RNA, 14 nt, Mycobacterium tuberculosis H37Rv
ugccgggcccagca

SEQ ID NO: 3334081 - RNA, 20 nt, Mycobacterium tuberculosis H37Rv
ugccgggcccagcaggucgu

SEQ ID NO: 3334082 - RNA, 22 nt, Mycobacterium tuberculosis H37Rv
ugccgggcccagcaggucgucg

SEQ ID NO: 3334083 - RNA, 14 nt, Mycobacterium tuberculosis H37Rv
ugccgggccgccga

SEQ ID NO: 3334084 - RNA, 18 nt, Mycobacterium tuberculosis H37Rv
ugccgggccgccgagcgg

SEQ ID NO: 3334085 - RNA, 13 nt, Mycobacterium tuberculosis H37Rv
ugccgggccgcgc

SEQ ID NO: 3334086 - RNA, 23 nt, Mycobacterium tuberculosis H37Rv
ugccgggccgcgcgggccgccgc

SEQ ID NO: 3334087 - RNA, 21 nt, Mycobacterium tuberculosis H37Rv
ugccgggcgcacgcccgcacu

SEQ ID NO: 3334088 - RNA, 18 nt, Mycobacterium tuberculosis H37Rv
ugccggggccccaugccg

SEQ ID NO: 3334089 - RNA, 14 nt, Mycobacterium tuberculosis H37Rv
ugcgaugcacaacc

SEQ ID NO: 3334090 - RNA, 20 nt, Mycobacterium tuberculosis H37Rv
ugcgaugcacaaccgcugcu

SEQ ID NO: 3334091 - RNA, 12 nt, Mycobacterium tuberculosis H37Rv
ugcgaugcccac

SEQ ID NO: 3334092 - RNA, 12 nt, Mycobacterium tuberculosis H37Rv
ugcgauggccga

SEQ ID NO: 3334093 - RNA, 22 nt, Mycobacterium tuberculosis H37Rv
ugcgauucacacucgggcggcu

SEQ ID NO: 3334094 - RNA, 19 nt, Mycobacterium tuberculosis H37Rv
ugcgauuccgcgucugcuc

SEQ ID NO: 3334095 - RNA, 16 nt, Mycobacterium tuberculosis H37Rv
ugcgauucugcgucug

SEQ ID NO: 3334096 - RNA, 18 nt, Mycobacterium tuberculosis H37Rv
ugcgauucugcgucugcu

SEQ ID NO: 3334097 - RNA, 19 nt, Mycobacterium tuberculosis H37Rv
ugcgauucugcgucugcuc

SEQ ID NO: 3334098 - RNA, 20 nt, Mycobacterium tuberculosis H37Rv
ugcgauucugcgucugcucg

SEQ ID NO: 3334099 - RNA, 19 nt, Mycobacterium tuberculosis H37Rv
ugcgauucugcgucugcuu

SEQ ID NO: 3334100 - RNA, 20 nt, Mycobacterium tuberculosis H37Rv
ugcgauucugcgucugcuug

SEQ ID NO: 3334101 - RNA, 19 nt, Mycobacterium tuberculosis H37Rv
ugcgauucugugucugcuc

SEQ ID NO: 3334102 - RNA, 20 nt, Mycobacterium tuberculosis H37Rv
ugcgauucugugucugcucg

SEQ ID NO: 3334103 - RNA, 18 nt, Mycobacterium tuberculosis H37Rv
ugcgauuuugugucugcu

SEQ ID NO: 3334104 - RNA, 20 nt, Mycobacterium tuberculosis H37Rv
ugcgauuuugugucugcucg

SEQ ID NO: 3334105 - RNA, 21 nt, Mycobacterium tuberculosis H37Rv
ugcgauuuugugucugcucgc

SEQ ID NO: 3334106 - RNA, 19 nt, Mycobacterium tuberculosis H37Rv
ugcgcaaacacgcguucca

SEQ ID NO: 3334107 - RNA, 14 nt, Mycobacterium tuberculosis H37Rv
ugcgcaaauuugaa

SEQ ID NO: 3334108 - RNA, 13 nt, Mycobacterium tuberculosis H37Rv
ugcgcaaccgcgg

SEQ ID NO: 3334109 - RNA, 16 nt, Mycobacterium tuberculosis H37Rv
ugcgcaacgcgucguc

SEQ ID NO: 3334110 - RNA, 20 nt, Mycobacterium tuberculosis H37Rv
ugcgcaacuucuucagcagc

SEQ ID NO: 3334111 - RNA, 21 nt, Mycobacterium tuberculosis H37Rv
ugcgcaacuucuucagcagcg

SEQ ID NO: 3334112 - RNA, 19 nt, Mycobacterium tuberculosis H37Rv
ugcgcaaggccgcguugcc

SEQ ID NO: 3334113 - RNA, 19 nt, Mycobacterium tuberculosis H37Rv
ugcgcaauagcgacagcag

SEQ ID NO: 3334114 - RNA, 15 nt, Mycobacterium tuberculosis H37Rv
ugcgcacaccgaccc

SEQ ID NO: 3334115 - RNA, 13 nt, Mycobacterium tuberculosis H37Rv
ugcgcaccaaggc

SEQ ID NO: 3334116 - RNA, 17 nt, Mycobacterium tuberculosis H37Rv
ugcgcaccaccgagccg

SEQ ID NO: 3334117 - RNA, 20 nt, Mycobacterium tuberculosis H37Rv
ugcgcaccagcggcugaccg

SEQ ID NO: 3334118 - RNA, 19 nt, Mycobacterium tuberculosis H37Rv
ugcgcaccaguccagcggg

SEQ ID NO: 3334119 - RNA, 23 nt, Mycobacterium tuberculosis H37Rv
ugcgcaccaugggucuggcaggc

SEQ ID NO: 3334120 - RNA, 20 nt, Mycobacterium tuberculosis H37Rv
ugcgcacccgcgggucgucc

SEQ ID NO: 3334121 - RNA, 19 nt, Mycobacterium tuberculosis H37Rv
ugcgcaccggucaacgugg

SEQ ID NO: 3334122 - RNA, 18 nt, Mycobacterium tuberculosis H37Rv
ugcgcacggcgccgaccc

SEQ ID NO: 3334123 - RNA, 16 nt, Mycobacterium tuberculosis H37Rv
ugcgcacuaccgccuu

SEQ ID NO: 3334124 - RNA, 14 nt, Mycobacterium tuberculosis H37Rv
ugcgcacucccggc

SEQ ID NO: 3334125 - RNA, 17 nt, Mycobacterium tuberculosis H37Rv
ugcgcagaacaccaccg

SEQ ID NO: 3334126 - RNA, 18 nt, Mycobacterium tuberculosis H37Rv
ugcgcagaacaccaccgc

SEQ ID NO: 3334127 - RNA, 16 nt, Mycobacterium tuberculosis H37Rv
ugcgcagauuugcucc

SEQ ID NO: 3334128 - RNA, 20 nt, Mycobacterium tuberculosis H37Rv
ugcgcagauuugcuccagcg

SEQ ID NO: 3334129 - RNA, 21 nt, Mycobacterium tuberculosis H37Rv
ugcgcagcagcgugcacaccc

SEQ ID NO: 3334130 - RNA, 16 nt, Mycobacterium tuberculosis H37Rv
ugcgcagccgcagccg

SEQ ID NO: 3334131 - RNA, 12 nt, Mycobacterium tuberculosis H37Rv
ugcgcagcgcaa

SEQ ID NO: 3334132 - RNA, 17 nt, Mycobacterium tuberculosis H37Rv
ugcgcagcgcaacaucg

SEQ ID NO: 3334133 - RNA, 16 nt, Mycobacterium tuberculosis H37Rv
ugcgcagcgccugcgg

SEQ ID NO: 3334134 - RNA, 21 nt, Mycobacterium tuberculosis H37Rv
ugcgcagcggcauccacaccg

SEQ ID NO: 3334135 - RNA, 18 nt, Mycobacterium tuberculosis H37Rv
ugcgcagcgugaaaugca

SEQ ID NO: 3334136 - RNA, 23 nt, Mycobacterium tuberculosis H37Rv
ugcgcagcgugaaaugcacgauc

SEQ ID NO: 3334137 - RNA, 17 nt, Mycobacterium tuberculosis H37Rv
ugcgcagguacgccucg

SEQ ID NO: 3334138 - RNA, 14 nt, Mycobacterium tuberculosis H37Rv
ugcgcauccgucgu

SEQ ID NO: 3334139 - RNA, 15 nt, Mycobacterium tuberculosis H37Rv
ugcgcaucgccacca

SEQ ID NO: 3334140 - RNA, 18 nt, Mycobacterium tuberculosis H37Rv
ugcgcaucgccgacagcg

SEQ ID NO: 3334141 - RNA, 13 nt, Mycobacterium tuberculosis H37Rv
ugcgcaucgucga

SEQ ID NO: 3334142 - RNA, 21 nt, Mycobacterium tuberculosis H37Rv
ugcgcauggacaacagcuugg

SEQ ID NO: 3334143 - RNA, 21 nt, Mycobacterium tuberculosis H37Rv
ugcgccaaggucugccgggcg

SEQ ID NO: 3334144 - RNA, 15 nt, Mycobacterium tuberculosis H37Rv
ugcgccacagcagcg

SEQ ID NO: 3334145 - RNA, 12 nt, Mycobacterium tuberculosis H37Rv
ugcgccaccgug

SEQ ID NO: 3334146 - RNA, 18 nt, Mycobacterium tuberculosis H37Rv
ugcgccacgccacuucuu

SEQ ID NO: 3334147 - RNA, 15 nt, Mycobacterium tuberculosis H37Rv
ugcgccacgucgacg

SEQ ID NO: 3334148 - RNA, 16 nt, Mycobacterium tuberculosis H37Rv
ugcgccacgucgacgg

SEQ ID NO: 3334149 - RNA, 20 nt, Mycobacterium tuberculosis H37Rv
ugcgccagaucaccgucgac

SEQ ID NO: 3334150 - RNA, 19 nt, Mycobacterium tuberculosis H37Rv
ugcgccagcaacagcgcgg

SEQ ID NO: 3334151 - RNA, 21 nt, Mycobacterium tuberculosis H37Rv
ugcgccagcgguggaccaccg

SEQ ID NO: 3334152 - RNA, 13 nt, Mycobacterium tuberculosis H37Rv
ugcgccaggaacc

SEQ ID NO: 3334153 - RNA, 23 nt, Mycobacterium tuberculosis H37Rv
ugcgccaucacaucggccucuga

SEQ ID NO: 3334154 - RNA, 19 nt, Mycobacterium tuberculosis H37Rv
ugcgccauucgcccggccg

SEQ ID NO: 3334155 - RNA, 16 nt, Mycobacterium tuberculosis H37Rv
ugcgcccaauccaccg

SEQ ID NO: 3334156 - RNA, 19 nt, Mycobacterium tuberculosis H37Rv
ugcgcccaauccaccgauu

SEQ ID NO: 3334157 - RNA, 11 nt, Mycobacterium tuberculosis H37Rv
ugcgcccagca

SEQ ID NO: 3334158 - RNA, 13 nt, Mycobacterium tuberculosis H37Rv
ugcgcccagcacg

SEQ ID NO: 3334159 - RNA, 15 nt, Mycobacterium tuberculosis H37Rv
ugcgcccagcgaccc

SEQ ID NO: 3334160 - RNA, 22 nt, Mycobacterium tuberculosis H37Rv
ugcgcccagcgacccggccagc

SEQ ID NO: 3334161 - RNA, 16 nt, Mycobacterium tuberculosis H37Rv
ugcgcccaggugaucg

SEQ ID NO: 3334162 - RNA, 16 nt, Mycobacterium tuberculosis H37Rv
ugcgcccauagcugcc

SEQ ID NO: 3334163 - RNA, 21 nt, Mycobacterium tuberculosis H37Rv
ugcgcccauagcugccggccc

SEQ ID NO: 3334164 - RNA, 12 nt, Mycobacterium tuberculosis H37Rv
ugcgccccauga

SEQ ID NO: 3334165 - RNA, 23 nt, Mycobacterium tuberculosis H37Rv
ugcgcccgacggaguucgacguc

SEQ ID NO: 3334166 - RNA, 21 nt, Mycobacterium tuberculosis H37Rv
ugcgcccggccaagccggcga

SEQ ID NO: 3334167 - RNA, 23 nt, Mycobacterium tuberculosis H37Rv
ugcgcccguccgcgcgccgacca

SEQ ID NO: 3334168 - RNA, 19 nt, Mycobacterium tuberculosis H37Rv
ugcgccgaacaccacaccg

SEQ ID NO: 3334169 - RNA, 19 nt, Mycobacterium tuberculosis H37Rv
ugcgccgaaugccaccucg

SEQ ID NO: 3334170 - RNA, 22 nt, Mycobacterium tuberculosis H37Rv
ugcgccgaaugccaccucgacg

SEQ ID NO: 3334171 - RNA, 23 nt, Mycobacterium tuberculosis H37Rv
ugcgccgaaugccaccucgacgc

SEQ ID NO: 3334172 - RNA, 22 nt, Mycobacterium tuberculosis H37Rv
ugcgccgacaccgggcccuugc

SEQ ID NO: 3334173 - RNA, 23 nt, Mycobacterium tuberculosis H37Rv
ugcgccgaccggccacgaccucg

SEQ ID NO: 3334174 - RNA, 22 nt, Mycobacterium tuberculosis H37Rv
ugcgccgagauccacgccagag

SEQ ID NO: 3334175 - RNA, 19 nt, Mycobacterium tuberculosis H37Rv
ugcgccgagaucgacaucg

SEQ ID NO: 3334176 - RNA, 21 nt, Mycobacterium tuberculosis H37Rv
ugcgccgagcuggcaacgccg

SEQ ID NO: 3334177 - RNA, 15 nt, Mycobacterium tuberculosis H37Rv
ugcgccgcacgccga

SEQ ID NO: 3334178 - RNA, 19 nt, Mycobacterium tuberculosis H37Rv
ugcgccgcacgccgaccgg

SEQ ID NO: 3334179 - RNA, 22 nt, Mycobacterium tuberculosis H37Rv
ugcgccgcacgccgaccggccc

SEQ ID NO: 3334180 - RNA, 23 nt, Mycobacterium tuberculosis H37Rv
ugcgccgcacgccgaccggcccg

SEQ ID NO: 3334181 - RNA, 12 nt, Mycobacterium tuberculosis H37Rv
ugcgccgcagcg

SEQ ID NO: 3334182 - RNA, 19 nt, Mycobacterium tuberculosis H37Rv
ugcgccgcccaugccucca

SEQ ID NO: 3334183 - RNA, 16 nt, Mycobacterium tuberculosis H37Rv
ugcgccgccggcgcgu

SEQ ID NO: 3334184 - RNA, 14 nt, Mycobacterium tuberculosis H37Rv
ugcggcaagcgcac

SEQ ID NO: 3334185 - RNA, 17 nt, Mycobacterium tuberculosis H37Rv
ugcggcaagcgcacgcu

SEQ ID NO: 3334186 - RNA, 12 nt, Mycobacterium tuberculosis H37Rv
ugcggcaccgcc

SEQ ID NO: 3334187 - RNA, 18 nt, Mycobacterium tuberculosis H37Rv
ugcggcaccucauugccg

SEQ ID NO: 3334188 - RNA, 15 nt, Mycobacterium tuberculosis H37Rv
ugcggcacgaucgcc

SEQ ID NO: 3334189 - RNA, 22 nt, Mycobacterium tuberculosis H37Rv
ugcggcagaccaagcccgucgu

SEQ ID NO: 3334190 - RNA, 19 nt, Mycobacterium tuberculosis H37Rv
ugcggcagauacucggcga

SEQ ID NO: 3334191 - RNA, 16 nt, Mycobacterium tuberculosis H37Rv
ugcggcagcgcggcca

SEQ ID NO: 3334192 - RNA, 18 nt, Mycobacterium tuberculosis H37Rv
ugcggcagcuggcgcagc

SEQ ID NO: 3334193 - RNA, 19 nt, Mycobacterium tuberculosis H37Rv
ugcggcagcuggcgcagcc

SEQ ID NO: 3334194 - RNA, 17 nt, Mycobacterium tuberculosis H37Rv
ugcggcaguaccccucg

SEQ ID NO: 3334195 - RNA, 18 nt, Mycobacterium tuberculosis H37Rv
ugcggccacucgcccgau

SEQ ID NO: 3334196 - RNA, 12 nt, Mycobacterium tuberculosis H37Rv
ugcggccaggga

SEQ ID NO: 3334197 - RNA, 21 nt, Mycobacterium tuberculosis H37Rv
ugcggcccacaccagcgcagc

SEQ ID NO: 3334198 - RNA, 18 nt, Mycobacterium tuberculosis H37Rv
ugcggccccaugcgccag

SEQ ID NO: 3334199 - RNA, 14 nt, Mycobacterium tuberculosis H37Rv
ugcggccccgacau

SEQ ID NO: 3334200 - RNA, 15 nt, Mycobacterium tuberculosis H37Rv
ugcggcccgggcucg

SEQ ID NO: 3334201 - RNA, 19 nt, Mycobacterium tuberculosis H37Rv
ugcggcccggguggcccgg

SEQ ID NO: 3334202 - RNA, 13 nt, Mycobacterium tuberculosis H37Rv
ugcggccgcgccg

SEQ ID NO: 3334203 - RNA, 18 nt, Mycobacterium tuberculosis H37Rv
ugcggccgcugaucaaca

SEQ ID NO: 3334204 - RNA, 14 nt, Mycobacterium tuberculosis H37Rv
ugcggccuagggcg

SEQ ID NO: 3334205 - RNA, 23 nt, Mycobacterium tuberculosis H37Rv
ugcggcgaccgucaaccugcugc

SEQ ID NO: 3334206 - RNA, 19 nt, Mycobacterium tuberculosis H37Rv
ugcggcgaggacgcgcccg

SEQ ID NO: 3334207 - RNA, 16 nt, Mycobacterium tuberculosis H37Rv
ugcggcgcucccgccg

SEQ ID NO: 3334208 - RNA, 16 nt, Mycobacterium tuberculosis H37Rv
ugcggcgcuggccagc

SEQ ID NO: 3334209 - RNA, 14 nt, Mycobacterium tuberculosis H37Rv
ugcggcgggcucgc

SEQ ID NO: 3334210 - RNA, 13 nt, Mycobacterium tuberculosis H37Rv
ugcggcgguaugc

SEQ ID NO: 3334211 - RNA, 19 nt, Mycobacterium tuberculosis H37Rv
ugcggcguauugcggccug

SEQ ID NO: 3334212 - RNA, 20 nt, Mycobacterium tuberculosis H37Rv
ugcggcgucgaacugccgga

SEQ ID NO: 3334213 - RNA, 14 nt, Mycobacterium tuberculosis H37Rv
ugcggcguggauca

SEQ ID NO: 3334214 - RNA, 23 nt, Mycobacterium tuberculosis H37Rv
ugcggcugaauucggcgagcgcc

SEQ ID NO: 3334215 - RNA, 21 nt, Mycobacterium tuberculosis H37Rv
ugcggcugguguccagccagg

SEQ ID NO: 3334216 - RNA, 17 nt, Mycobacterium tuberculosis H37Rv
ugcggcuuggccaucac

SEQ ID NO: 3334217 - RNA, 14 nt, Mycobacterium tuberculosis H37Rv
ugcgggaaccccag

SEQ ID NO: 3334218 - RNA, 18 nt, Mycobacterium tuberculosis H37Rv
ugcgggaaguugcccagg

SEQ ID NO: 3334219 - RNA, 20 nt, Mycobacterium tuberculosis H37Rv
ugcgggaaguugcccaggug

SEQ ID NO: 3334220 - RNA, 15 nt, Mycobacterium tuberculosis H37Rv
ugcgggacgccgaau

SEQ ID NO: 3334221 - RNA, 16 nt, Mycobacterium tuberculosis H37Rv
ugcgggacgucgucgu

SEQ ID NO: 3334222 - RNA, 19 nt, Mycobacterium tuberculosis H37Rv
ugcgggacuugucggggug

SEQ ID NO: 3334223 - RNA, 13 nt, Mycobacterium tuberculosis H37Rv
ugcgggaggcagc

SEQ ID NO: 3334224 - RNA, 20 nt, Mycobacterium tuberculosis H37Rv
ugcgggcaaccacaucaccg

SEQ ID NO: 3334225 - RNA, 12 nt, Mycobacterium tuberculosis H37Rv
ugcgggcagcac

SEQ ID NO: 3334226 - RNA, 18 nt, Mycobacterium tuberculosis H37Rv
ugcgggcagccgcccgcc

SEQ ID NO: 3334227 - RNA, 15 nt, Mycobacterium tuberculosis H37Rv
ugcgggcaugccggc

SEQ ID NO: 3334228 - RNA, 15 nt, Mycobacterium tuberculosis H37Rv
ugcgggcccacgccc

SEQ ID NO: 3334229 - RNA, 15 nt, Mycobacterium tuberculosis H37Rv
ugcgggccgccaggc

SEQ ID NO: 3334230 - RNA, 15 nt, Mycobacterium tuberculosis H37Rv
ugcgggccgcucggu

SEQ ID NO: 3334231 - RNA, 23 nt, Mycobacterium tuberculosis H37Rv
ugcgggccgcucgguaggacagg

SEQ ID NO: 3334232 - RNA, 16 nt, Mycobacterium tuberculosis H37Rv
ugcgggccgugacccu

SEQ ID NO: 3334233 - RNA, 23 nt, Mycobacterium tuberculosis H37Rv
ugcgggccuccugcuggcccugc

SEQ ID NO: 3334234 - RNA, 15 nt, Mycobacterium tuberculosis H37Rv
ugcgggcgaucucga

SEQ ID NO: 3334235 - RNA, 19 nt, Mycobacterium tuberculosis H37Rv
ugcgggcggugcacaccgu

SEQ ID NO: 3334236 - RNA, 18 nt, Mycobacterium tuberculosis H37Rv
ugcgggcuguccgggcug

SEQ ID NO: 3334237 - RNA, 19 nt, Mycobacterium tuberculosis H37Rv
ugcgggcuuugagcgcccg

SEQ ID NO: 3334238 - RNA, 13 nt, Mycobacterium tuberculosis H37Rv
ugcggggccgggc

SEQ ID NO: 3334239 - RNA, 14 nt, Mycobacterium tuberculosis H37Rv
ugcggggccgggcg

SEQ ID NO: 3334240 - RNA, 20 nt, Mycobacterium tuberculosis H37Rv
ugcgggggcuuaugcgacug

SEQ ID NO: 3334241 - RNA, 20 nt, Mycobacterium tuberculosis H37Rv
ugcgggggcuuaugcgucug

SEQ ID NO: 3334242 - RNA, 21 nt, Mycobacterium tuberculosis H37Rv
ugcggggggccuuaucccacc

SEQ ID NO: 3334243 - RNA, 22 nt, Mycobacterium tuberculosis H37Rv
ugcgggguugaccguggucgga

SEQ ID NO: 3334244 - RNA, 16 nt, Mycobacterium tuberculosis H37Rv
ugcggguaaaccaggu

SEQ ID NO: 3334245 - RNA, 17 nt, Mycobacterium tuberculosis H37Rv
ugcggguaaaccaggug

SEQ ID NO: 3334246 - RNA, 23 nt, Mycobacterium tuberculosis H37Rv
ugcggguagccgucgaucccggu

SEQ ID NO: 3334247 - RNA, 14 nt, Mycobacterium tuberculosis H37Rv
ugcgggucagcgcc

SEQ ID NO: 3334248 - RNA, 14 nt, Mycobacterium tuberculosis H37Rv
ugcgggucucgccg

SEQ ID NO: 3334249 - RNA, 12 nt, Mycobacterium tuberculosis H37Rv
ugcggguggagu

SEQ ID NO: 3334250 - RNA, 17 nt, Mycobacterium tuberculosis H37Rv
ugcggguggauuggugc

SEQ ID NO: 3334251 - RNA, 13 nt, Mycobacterium tuberculosis H37Rv
ugcgggugggaaa

SEQ ID NO: 3334252 - RNA, 19 nt, Mycobacterium tuberculosis H37Rv
ugcgggugggacaccaucu

SEQ ID NO: 3334253 - RNA, 16 nt, Mycobacterium tuberculosis H37Rv
ugcgggugggcacacc

SEQ ID NO: 3334254 - RNA, 19 nt, Mycobacterium tuberculosis H37Rv
ugcgggugggcacaccggu

SEQ ID NO: 3334255 - RNA, 17 nt, Mycobacterium tuberculosis H37Rv
ugcgggugucgggcagc

SEQ ID NO: 3334256 - RNA, 19 nt, Mycobacterium tuberculosis H37Rv
ugcgggugucgggcagcaa

SEQ ID NO: 3334257 - RNA, 16 nt, Mycobacterium tuberculosis H37Rv
ugcgguaaucgccacc

SEQ ID NO: 3334258 - RNA, 18 nt, Mycobacterium tuberculosis H37Rv
ugcgguauugcccgggcg

SEQ ID NO: 3334259 - RNA, 17 nt, Mycobacterium tuberculosis H37Rv
ugcgguauuugaacgcc

SEQ ID NO: 3334260 - RNA, 19 nt, Mycobacterium tuberculosis H37Rv
ugcggucagacgccggccg

SEQ ID NO: 3334261 - RNA, 23 nt, Mycobacterium tuberculosis H37Rv
ugcggucagacgccggccgccga

SEQ ID NO: 3334262 - RNA, 14 nt, Mycobacterium tuberculosis H37Rv
ugcggucagauucg

SEQ ID NO: 3334263 - RNA, 16 nt, Mycobacterium tuberculosis H37Rv
ugcgguccaggccggc

SEQ ID NO: 3334264 - RNA, 19 nt, Mycobacterium tuberculosis H37Rv
ugcggucgacguuggcaaa

SEQ ID NO: 3334265 - RNA, 23 nt, Mycobacterium tuberculosis H37Rv
ugcggucucacucaucggugugc

SEQ ID NO: 3334266 - RNA, 15 nt, Mycobacterium tuberculosis H37Rv
ugcggucucgaccgu

SEQ ID NO: 3334267 - RNA, 14 nt, Mycobacterium tuberculosis H37Rv
ugcggugaguccgc

SEQ ID NO: 3334268 - RNA, 23 nt, Mycobacterium tuberculosis H37Rv
ugcggugcuaugcaacaccgcac

SEQ ID NO: 3334269 - RNA, 12 nt, Mycobacterium tuberculosis H37Rv
ugcgguggcagg

SEQ ID NO: 3334270 - RNA, 22 nt, Mycobacterium tuberculosis H37Rv
ugcgguggcaggugaucccgau

SEQ ID NO: 3334271 - RNA, 20 nt, Mycobacterium tuberculosis H37Rv
ugcgguggcuuuugcgucug

SEQ ID NO: 3334272 - RNA, 15 nt, Mycobacterium tuberculosis H37Rv
ugcggugggccaggu

SEQ ID NO: 3334273 - RNA, 22 nt, Mycobacterium tuberculosis H37Rv
ugcggugguaggacgccagcaa

SEQ ID NO: 3334274 - RNA, 17 nt, Mycobacterium tuberculosis H37Rv
ugcggugucgggcuggg

SEQ ID NO: 3334275 - RNA, 16 nt, Mycobacterium tuberculosis H37Rv
ugcgguuccgauagcc

SEQ ID NO: 3334276 - RNA, 23 nt, Mycobacterium tuberculosis H37Rv
ugcgguugcauaccgccgggccc

SEQ ID NO: 3334277 - RNA, 14 nt, Mycobacterium tuberculosis H37Rv
ugcgguugcgcgga

SEQ ID NO: 3334278 - RNA, 20 nt, Mycobacterium tuberculosis H37Rv
ugcgguuucaccgacgacgc

SEQ ID NO: 3334279 - RNA, 17 nt, Mycobacterium tuberculosis H37Rv
ugcguacaacgccgguu

SEQ ID NO: 3334280 - RNA, 12 nt, Mycobacterium tuberculosis H37Rv
ugcucggugacg

SEQ ID NO: 3334281 - RNA, 16 nt, Mycobacterium tuberculosis H37Rv
ugcucgguggugacca

SEQ ID NO: 3334282 - RNA, 21 nt, Mycobacterium tuberculosis H37Rv
ugcucguagacuugcugcucc

SEQ ID NO: 3334283 - RNA, 22 nt, Mycobacterium tuberculosis H37Rv
ugcucguaggugccgaagauga

SEQ ID NO: 3334284 - RNA, 17 nt, Mycobacterium tuberculosis H37Rv
ugcucgucgagccgacc

SEQ ID NO: 3334285 - RNA, 19 nt, Mycobacterium tuberculosis H37Rv
ugcucgucuuggcggcggu

SEQ ID NO: 3334286 - RNA, 15 nt, Mycobacterium tuberculosis H37Rv
ugcucguggguaccg

SEQ ID NO: 3334287 - RNA, 14 nt, Mycobacterium tuberculosis H37Rv
ugcucguguuguug

SEQ ID NO: 3334288 - RNA, 19 nt, Mycobacterium tuberculosis H37Rv
ugcucguucaccgcagcgg

SEQ ID NO: 3334289 - RNA, 14 nt, Mycobacterium tuberculosis H37Rv
ugcucucgcagcau

SEQ ID NO: 3334290 - RNA, 16 nt, Mycobacterium tuberculosis H37Rv
ugcugacauuuccacc

SEQ ID NO: 3334291 - RNA, 18 nt, Mycobacterium tuberculosis H37Rv
ugcugaccaugaccgggc

SEQ ID NO: 3334292 - RNA, 22 nt, Mycobacterium tuberculosis H37Rv
ugcugacgacgagggccagcag

SEQ ID NO: 3334293 - RNA, 12 nt, Mycobacterium tuberculosis H37Rv
ugcugacggugc

SEQ ID NO: 3334294 - RNA, 20 nt, Mycobacterium tuberculosis H37Rv
ugcugacggugcaggaccag

SEQ ID NO: 3334295 - RNA, 23 nt, Mycobacterium tuberculosis H37Rv
ugcugagcaaguccugcagcugg

SEQ ID NO: 3334296 - RNA, 18 nt, Mycobacterium tuberculosis H37Rv
ugcugagcgccaggccgc

SEQ ID NO: 3334297 - RNA, 15 nt, Mycobacterium tuberculosis H37Rv
ugcugagucgguuca

SEQ ID NO: 3334298 - RNA, 13 nt, Mycobacterium tuberculosis H37Rv
ugcugaucuugcc

SEQ ID NO: 3334299 - RNA, 15 nt, Mycobacterium tuberculosis H37Rv
ugcugaugcccuugc

SEQ ID NO: 3334300 - RNA, 13 nt, Mycobacterium tuberculosis H37Rv
ugcugauggauca

SEQ ID NO: 3334301 - RNA, 16 nt, Mycobacterium tuberculosis H37Rv
ugcugaugggucaggc

SEQ ID NO: 3334302 - RNA, 19 nt, Mycobacterium tuberculosis H37Rv
ugcugcaaggaauuccggc

SEQ ID NO: 3334303 - RNA, 15 nt, Mycobacterium tuberculosis H37Rv
ugcugcacccggaga

SEQ ID NO: 3334304 - RNA, 21 nt, Mycobacterium tuberculosis H37Rv
ugcugcagacccguucgccgu

SEQ ID NO: 3334305 - RNA, 20 nt, Mycobacterium tuberculosis H37Rv
ugcugcagcgaugcggcguu

SEQ ID NO: 3334306 - RNA, 16 nt, Mycobacterium tuberculosis H37Rv
ugcugcaugccgaccc

SEQ ID NO: 3334307 - RNA, 20 nt, Mycobacterium tuberculosis H37Rv
ugcugccaacgggccauggg

SEQ ID NO: 3334308 - RNA, 15 nt, Mycobacterium tuberculosis H37Rv
ugcugccauugccgc

SEQ ID NO: 3334309 - RNA, 21 nt, Mycobacterium tuberculosis H37Rv
ugcugccccauaaacucugug

SEQ ID NO: 3334310 - RNA, 21 nt, Mycobacterium tuberculosis H37Rv
ugcugccccccagacaauccg

SEQ ID NO: 3334311 - RNA, 20 nt, Mycobacterium tuberculosis H37Rv
ugcugccgcacacgcgugca

SEQ ID NO: 3334312 - RNA, 21 nt, Mycobacterium tuberculosis H37Rv
ugcugccggagacacccgcca

SEQ ID NO: 3334313 - RNA, 22 nt, Mycobacterium tuberculosis H37Rv
ugcugccggagacacccgccag

SEQ ID NO: 3334314 - RNA, 20 nt, Mycobacterium tuberculosis H37Rv
ugcugccgggggcccgaccu

SEQ ID NO: 3334315 - RNA, 13 nt, Mycobacterium tuberculosis H37Rv
ugcugccuuugcg

SEQ ID NO: 3334316 - RNA, 21 nt, Mycobacterium tuberculosis H37Rv
ugcugcgcaccaaggccguga

SEQ ID NO: 3334317 - RNA, 14 nt, Mycobacterium tuberculosis H37Rv
ugcugcgcgcggcg

SEQ ID NO: 3334318 - RNA, 12 nt, Mycobacterium tuberculosis H37Rv
ugcugcgcggug

SEQ ID NO: 3334319 - RNA, 15 nt, Mycobacterium tuberculosis H37Rv
ugcugcgcggugccg

SEQ ID NO: 3334320 - RNA, 15 nt, Mycobacterium tuberculosis H37Rv
ugcugcggccaggga

SEQ ID NO: 3334321 - RNA, 14 nt, Mycobacterium tuberculosis H37Rv
ugcugcucgugagc

SEQ ID NO: 3334322 - RNA, 13 nt, Mycobacterium tuberculosis H37Rv
ugcugcugcagca

SEQ ID NO: 3334323 - RNA, 19 nt, Mycobacterium tuberculosis H37Rv
ugcugcuucaacgcguccg

SEQ ID NO: 3334324 - RNA, 17 nt, Mycobacterium tuberculosis H37Rv
ugcuggaacagguugaa

SEQ ID NO: 3334325 - RNA, 14 nt, Mycobacterium tuberculosis H37Rv
ugcuggaucucggu

SEQ ID NO: 3334326 - RNA, 19 nt, Mycobacterium tuberculosis H37Rv
ugcuggcaaaguaucgcag

SEQ ID NO: 3334327 - RNA, 13 nt, Mycobacterium tuberculosis H37Rv
ugcuggccgaacc

SEQ ID NO: 3334328 - RNA, 12 nt, Mycobacterium tuberculosis H37Rv
ugcuggccgcgg

SEQ ID NO: 3334329 - RNA, 14 nt, Mycobacterium tuberculosis H37Rv
ugcuggccuuguug

SEQ ID NO: 3334330 - RNA, 13 nt, Mycobacterium tuberculosis H37Rv
ugcuggcgaucgc

SEQ ID NO: 3334331 - RNA, 16 nt, Mycobacterium tuberculosis H37Rv
ugcuggcgcaaccaau

SEQ ID NO: 3334332 - RNA, 18 nt, Mycobacterium tuberculosis H37Rv
ugcuggcggccagcaucg

SEQ ID NO: 3334333 - RNA, 15 nt, Mycobacterium tuberculosis H37Rv
ugcuggggguaccuc

SEQ ID NO: 3334334 - RNA, 17 nt, Mycobacterium tuberculosis H37Rv
ugcuggggguaccuccc

SEQ ID NO: 3334335 - RNA, 12 nt, Mycobacterium tuberculosis H37Rv
ugcugggugccg

SEQ ID NO: 3334336 - RNA, 17 nt, Mycobacterium tuberculosis H37Rv
ugcugggugccgcagcu

SEQ ID NO: 3334337 - RNA, 19 nt, Mycobacterium tuberculosis H37Rv
ugcugguaccgggcuccaa

SEQ ID NO: 3334338 - RNA, 20 nt, Mycobacterium tuberculosis H37Rv
ugcuggucaagaucagcggu

SEQ ID NO: 3334339 - RNA, 13 nt, Mycobacterium tuberculosis H37Rv
ugcugguccaggc

SEQ ID NO: 3334340 - RNA, 14 nt, Mycobacterium tuberculosis H37Rv
ugcuggucggcgau

SEQ ID NO: 3334341 - RNA, 22 nt, Mycobacterium tuberculosis H37Rv
ugcuguuccaucaaggucauca

SEQ ID NO: 3334342 - RNA, 14 nt, Mycobacterium tuberculosis H37Rv
ugcuuagcgcgaaa

SEQ ID NO: 3334343 - RNA, 19 nt, Mycobacterium tuberculosis H37Rv
ugcuucaacgcguccgcca

SEQ ID NO: 3334344 - RNA, 16 nt, Mycobacterium tuberculosis H37Rv
ugcuucaguggcaaca

SEQ ID NO: 3334345 - RNA, 22 nt, Mycobacterium tuberculosis H37Rv
ugcuucaguggcaacagcaacg

SEQ ID NO: 3334346 - RNA, 17 nt, Mycobacterium tuberculosis H37Rv
ugcuucguugucggcgg

SEQ ID NO: 3334347 - RNA, 13 nt, Mycobacterium tuberculosis H37Rv
ugcuugcagggcc

SEQ ID NO: 3334348 - RNA, 22 nt, Mycobacterium tuberculosis H37Rv
ugcuugcgaaacgaauccgcca

SEQ ID NO: 3334349 - RNA, 15 nt, Mycobacterium tuberculosis H37Rv
ugcuugcgcagcacc

SEQ ID NO: 3334350 - RNA, 17 nt, Mycobacterium tuberculosis H37Rv
ugcuuggccacuugcuc

SEQ ID NO: 3334351 - RNA, 13 nt, Mycobacterium tuberculosis H37Rv
ugcuuggccgcgc

SEQ ID NO: 3334352 - RNA, 19 nt, Mycobacterium tuberculosis H37Rv
ugcuugggcagcucgucca

SEQ ID NO: 3334353 - RNA, 22 nt, Mycobacterium tuberculosis H37Rv
ugcuugggcagcucguccagcg

SEQ ID NO: 3334354 - RNA, 17 nt, Mycobacterium tuberculosis H37Rv
ugcuuggucgcccagcc

SEQ ID NO: 3334355 - RNA, 18 nt, Mycobacterium tuberculosis H37Rv
ugcuuggucgcccagcca

SEQ ID NO: 3334356 - RNA, 18 nt, Mycobacterium tuberculosis H37Rv
ugcuuguguucgugguug

SEQ ID NO: 3334357 - RNA, 21 nt, Mycobacterium tuberculosis H37Rv
ugcuuuccagaguucccgaaa

SEQ ID NO: 3334358 - RNA, 23 nt, Mycobacterium tuberculosis H37Rv
ugcuuucgggauuccggaugcag

SEQ ID NO: 3334359 - RNA, 22 nt, Mycobacterium tuberculosis H37Rv
uggaaaagccacggcugcccau

SEQ ID NO: 3334360 - RNA, 20 nt, Mycobacterium tuberculosis H37Rv
uggaaaaucgggucacacuc

SEQ ID NO: 3334361 - RNA, 13 nt, Mycobacterium tuberculosis H37Rv
uggaacaccgcgg

SEQ ID NO: 3334362 - RNA, 13 nt, Mycobacterium tuberculosis H37Rv
uggaacagaucuu

SEQ ID NO: 3334363 - RNA, 15 nt, Mycobacterium tuberculosis H37Rv
uggaacucacccuau

SEQ ID NO: 3334364 - RNA, 17 nt, Mycobacterium tuberculosis H37Rv
uggaacuggacaccgug

SEQ ID NO: 3334365 - RNA, 13 nt, Mycobacterium tuberculosis H37Rv
uggaagacgccgg

SEQ ID NO: 3334366 - RNA, 16 nt, Mycobacterium tuberculosis H37Rv
uggaagacgccggcga

SEQ ID NO: 3334367 - RNA, 19 nt, Mycobacterium tuberculosis H37Rv
uggaagacgucgagguuga

SEQ ID NO: 3334368 - RNA, 15 nt, Mycobacterium tuberculosis H37Rv
uggaagaucacgcgu

SEQ ID NO: 3334369 - RNA, 22 nt, Mycobacterium tuberculosis H37Rv
uggaagauguugccgccgguca

SEQ ID NO: 3334370 - RNA, 18 nt, Mycobacterium tuberculosis H37Rv
uggaagccgacgaccagc

SEQ ID NO: 3334371 - RNA, 21 nt, Mycobacterium tuberculosis H37Rv
uggaagccgacgaccagcaga

SEQ ID NO: 3334372 - RNA, 13 nt, Mycobacterium tuberculosis H37Rv
uggaagccgcacc

SEQ ID NO: 3334373 - RNA, 15 nt, Mycobacterium tuberculosis H37Rv
uggaagcggcgacua

SEQ ID NO: 3334374 - RNA, 18 nt, Mycobacterium tuberculosis H37Rv
uggaaucgcggagccagg

SEQ ID NO: 3334375 - RNA, 19 nt, Mycobacterium tuberculosis H37Rv
uggaaucgcggagccagga

SEQ ID NO: 3334376 - RNA, 20 nt, Mycobacterium tuberculosis H37Rv
uggaaugccgccacaaagaa

SEQ ID NO: 3334377 - RNA, 20 nt, Mycobacterium tuberculosis H37Rv
uggcagcugcucuccgucgc

SEQ ID NO: 3334378 - RNA, 20 nt, Mycobacterium tuberculosis H37Rv
uggcagcuuugagucccggu

SEQ ID NO: 3334379 - RNA, 12 nt, Mycobacterium tuberculosis H37Rv
uggcaggccagc

SEQ ID NO: 3334380 - RNA, 13 nt, Mycobacterium tuberculosis H37Rv
uggcagggaacca

SEQ ID NO: 3334381 - RNA, 22 nt, Mycobacterium tuberculosis H37Rv
uggcagggccagcggcagccug

SEQ ID NO: 3334382 - RNA, 18 nt, Mycobacterium tuberculosis H37Rv
uggcaggugccuucuucg

SEQ ID NO: 3334383 - RNA, 13 nt, Mycobacterium tuberculosis H37Rv
uggcaguccagcc

SEQ ID NO: 3334384 - RNA, 17 nt, Mycobacterium tuberculosis H37Rv
uggcaguccagccgggu

SEQ ID NO: 3334385 - RNA, 14 nt, Mycobacterium tuberculosis H37Rv
uggcaguggcgcgg

SEQ ID NO: 3334386 - RNA, 16 nt, Mycobacterium tuberculosis H37Rv
uggcauccaaaaucgc

SEQ ID NO: 3334387 - RNA, 19 nt, Mycobacterium tuberculosis H37Rv
uggcauccaaaaucgccug

SEQ ID NO: 3334388 - RNA, 21 nt, Mycobacterium tuberculosis H37Rv
uggcauccaaaaucgccugau

SEQ ID NO: 3334389 - RNA, 22 nt, Mycobacterium tuberculosis H37Rv
uggcaucccgggcaguccaggc

SEQ ID NO: 3334390 - RNA, 23 nt, Mycobacterium tuberculosis H37Rv
uggcaucccgggcaguccaggca

SEQ ID NO: 3334391 - RNA, 17 nt, Mycobacterium tuberculosis H37Rv
uggcaucgaacgcccug

SEQ ID NO: 3334392 - RNA, 14 nt, Mycobacterium tuberculosis H37Rv
uggcaucgccucca

SEQ ID NO: 3334393 - RNA, 19 nt, Mycobacterium tuberculosis H37Rv
uggcaugccggcgugcggc

SEQ ID NO: 3334394 - RNA, 22 nt, Mycobacterium tuberculosis H37Rv
uggcauucgauaccgcaccaaa

SEQ ID NO: 3334395 - RNA, 16 nt, Mycobacterium tuberculosis H37Rv
uggcauugcgcccacc

SEQ ID NO: 3334396 - RNA, 14 nt, Mycobacterium tuberculosis H37Rv
uggccaaccccaug

SEQ ID NO: 3334397 - RNA, 17 nt, Mycobacterium tuberculosis H37Rv
uggccaaccccauggcc

SEQ ID NO: 3334398 - RNA, 15 nt, Mycobacterium tuberculosis H37Rv
uggccaaccgggucg

SEQ ID NO: 3334399 - RNA, 20 nt, Mycobacterium tuberculosis H37Rv
uggccaacucgacauccucg

SEQ ID NO: 3334400 - RNA, 21 nt, Mycobacterium tuberculosis H37Rv
uggccaauagaagcacgucgu

SEQ ID NO: 3334401 - RNA, 22 nt, Mycobacterium tuberculosis H37Rv
uggccaauagaagcacgucguc

SEQ ID NO: 3334402 - RNA, 14 nt, Mycobacterium tuberculosis H37Rv
uggccaauccggcg

SEQ ID NO: 3334403 - RNA, 22 nt, Mycobacterium tuberculosis H37Rv
uggccaccaaacgcugcuggca

SEQ ID NO: 3334404 - RNA, 12 nt, Mycobacterium tuberculosis H37Rv
uggccaccaucg

SEQ ID NO: 3334405 - RNA, 18 nt, Mycobacterium tuberculosis H37Rv
uggccaccaucgccgccg

SEQ ID NO: 3334406 - RNA, 13 nt, Mycobacterium tuberculosis H37Rv
uggccacccccgu

SEQ ID NO: 3334407 - RNA, 12 nt, Mycobacterium tuberculosis H37Rv
uggccacccggc

SEQ ID NO: 3334408 - RNA, 19 nt, Mycobacterium tuberculosis H37Rv
uggccacccggccgcgcgg

SEQ ID NO: 3334409 - RNA, 19 nt, Mycobacterium tuberculosis H37Rv
uggccaccgaacgcggcca

SEQ ID NO: 3334410 - RNA, 14 nt, Mycobacterium tuberculosis H37Rv
uggccaccgcccag

SEQ ID NO: 3334411 - RNA, 21 nt, Mycobacterium tuberculosis H37Rv
uggccaccgccgaaaaccucg

SEQ ID NO: 3334412 - RNA, 22 nt, Mycobacterium tuberculosis H37Rv
uggccaccucggguguggucac

SEQ ID NO: 3334413 - RNA, 15 nt, Mycobacterium tuberculosis H37Rv
uggccacgcccaggc

SEQ ID NO: 3334414 - RNA, 19 nt, Mycobacterium tuberculosis H37Rv
uggccacggaaguaucgcc

SEQ ID NO: 3334415 - RNA, 24 nt, Mycobacterium tuberculosis H37Rv
uggccacggaaguaucgccggccg

SEQ ID NO: 3334416 - RNA, 15 nt, Mycobacterium tuberculosis H37Rv
uggccacggggcugc

SEQ ID NO: 3334417 - RNA, 19 nt, Mycobacterium tuberculosis H37Rv
uggccacggggcugccggu

SEQ ID NO: 3334418 - RNA, 16 nt, Mycobacterium tuberculosis H37Rv
uggccacuugcucggc

SEQ ID NO: 3334419 - RNA, 13 nt, Mycobacterium tuberculosis H37Rv
uggccagacccac

SEQ ID NO: 3334420 - RNA, 18 nt, Mycobacterium tuberculosis H37Rv
uggccagacccaccaccg

SEQ ID NO: 3334421 - RNA, 22 nt, Mycobacterium tuberculosis H37Rv
uggccagacccaccaccgcaac

SEQ ID NO: 3334422 - RNA, 23 nt, Mycobacterium tuberculosis H37Rv
uggccagaucgaacgcagccagc

SEQ ID NO: 3334423 - RNA, 20 nt, Mycobacterium tuberculosis H37Rv
uggccagcaacugccgcacc

SEQ ID NO: 3334424 - RNA, 21 nt, Mycobacterium tuberculosis H37Rv
uggccagcaacugccgcaccc

SEQ ID NO: 3334425 - RNA, 16 nt, Mycobacterium tuberculosis H37Rv
uggccagcaccacggc

SEQ ID NO: 3334426 - RNA, 19 nt, Mycobacterium tuberculosis H37Rv
uggccagcaccacggccag

SEQ ID NO: 3334427 - RNA, 13 nt, Mycobacterium tuberculosis H37Rv
uggccagcacggu

SEQ ID NO: 3334428 - RNA, 15 nt, Mycobacterium tuberculosis H37Rv
uggccagcagcagcg

SEQ ID NO: 3334429 - RNA, 16 nt, Mycobacterium tuberculosis H37Rv
uggccagcagccgcga

SEQ ID NO: 3334430 - RNA, 17 nt, Mycobacterium tuberculosis H37Rv
uggccagcagccgcgac

SEQ ID NO: 3334431 - RNA, 15 nt, Mycobacterium tuberculosis H37Rv
uggccagcagcgcgg

SEQ ID NO: 3334432 - RNA, 13 nt, Mycobacterium tuberculosis H37Rv
uggccagcaggcg

SEQ ID NO: 3334433 - RNA, 13 nt, Mycobacterium tuberculosis H37Rv
uggccagcagguu

SEQ ID NO: 3334434 - RNA, 13 nt, Mycobacterium tuberculosis H37Rv
uggccagcgcggc

SEQ ID NO: 3334435 - RNA, 19 nt, Mycobacterium tuberculosis H37Rv
uggccagcgcggcgucgcc

SEQ ID NO: 3334436 - RNA, 21 nt, Mycobacterium tuberculosis H37Rv
uggccagcgcggcgucgccuu

SEQ ID NO: 3334437 - RNA, 18 nt, Mycobacterium tuberculosis H37Rv
uggccagcgucgcgauug

SEQ ID NO: 3334438 - RNA, 23 nt, Mycobacterium tuberculosis H37Rv
uggccaggcccaagccguggccg

SEQ ID NO: 3334439 - RNA, 17 nt, Mycobacterium tuberculosis H37Rv
uggccaggucggccacc

SEQ ID NO: 3334440 - RNA, 19 nt, Mycobacterium tuberculosis H37Rv
uggccaggucggccaccgu

SEQ ID NO: 3334441 - RNA, 20 nt, Mycobacterium tuberculosis H37Rv
uggccaggucggccaccgug

SEQ ID NO: 3334442 - RNA, 20 nt, Mycobacterium tuberculosis H37Rv
uggccagguggccgcaucgc

SEQ ID NO: 3334443 - RNA, 13 nt, Mycobacterium tuberculosis H37Rv
uggccagguugcc

SEQ ID NO: 3334444 - RNA, 19 nt, Mycobacterium tuberculosis H37Rv
uggccaguucggugagccg

SEQ ID NO: 3334445 - RNA, 14 nt, Mycobacterium tuberculosis H37Rv
uggccaucagcucg

SEQ ID NO: 3334446 - RNA, 23 nt, Mycobacterium tuberculosis H37Rv
uggccaucagcucgccagggucg

SEQ ID NO: 3334447 - RNA, 16 nt, Mycobacterium tuberculosis H37Rv
uggccaucgcgcggac

SEQ ID NO: 3334448 - RNA, 16 nt, Mycobacterium tuberculosis H37Rv
uggccaugcaccgaug

SEQ ID NO: 3334449 - RNA, 23 nt, Mycobacterium tuberculosis H37Rv
uggccaugccacaacgccucgau

SEQ ID NO: 3334450 - RNA, 18 nt, Mycobacterium tuberculosis H37Rv
uggccaugcuggucagcg

SEQ ID NO: 3334451 - RNA, 16 nt, Mycobacterium tuberculosis H37Rv
uggccauguccaccag

SEQ ID NO: 3334452 - RNA, 18 nt, Mycobacterium tuberculosis H37Rv
uggccauguccaccagcg

SEQ ID NO: 3334453 - RNA, 21 nt, Mycobacterium tuberculosis H37Rv
uggccauguccaccagcgugu

SEQ ID NO: 3334454 - RNA, 22 nt, Mycobacterium tuberculosis H37Rv
uggcccacauguccagcguccu

SEQ ID NO: 3334455 - RNA, 21 nt, Mycobacterium tuberculosis H37Rv
uggcccaccuccucgccggau

SEQ ID NO: 3334456 - RNA, 13 nt, Mycobacterium tuberculosis H37Rv
uggcccagcgugu

SEQ ID NO: 3334457 - RNA, 15 nt, Mycobacterium tuberculosis H37Rv
uggcccagcgugucu

SEQ ID NO: 3334458 - RNA, 15 nt, Mycobacterium tuberculosis H37Rv
uggcccaguccgcug

SEQ ID NO: 3334459 - RNA, 20 nt, Mycobacterium tuberculosis H37Rv
uggcccaguccgcuggccau

SEQ ID NO: 3334460 - RNA, 17 nt, Mycobacterium tuberculosis H37Rv
uggcccaucuugaccaa

SEQ ID NO: 3334461 - RNA, 22 nt, Mycobacterium tuberculosis H37Rv
uggccccgggcggugaggcagc

SEQ ID NO: 3334462 - RNA, 20 nt, Mycobacterium tuberculosis H37Rv
uggccccgguggugcugccg

SEQ ID NO: 3334463 - RNA, 14 nt, Mycobacterium tuberculosis H37Rv
uggcccgaccggga

SEQ ID NO: 3334464 - RNA, 17 nt, Mycobacterium tuberculosis H37Rv
uggcccgaccgggaacc

SEQ ID NO: 3334465 - RNA, 14 nt, Mycobacterium tuberculosis H37Rv
uggcccgaguuggc

SEQ ID NO: 3334466 - RNA, 23 nt, Mycobacterium tuberculosis H37Rv
uggcccgaguuggcgaagcccga

SEQ ID NO: 3334467 - RNA, 16 nt, Mycobacterium tuberculosis H37Rv
uggcccgaucgaccgc

SEQ ID NO: 3334468 - RNA, 19 nt, Mycobacterium tuberculosis H37Rv
uggcccgccacgaugucgu

SEQ ID NO: 3334469 - RNA, 15 nt, Mycobacterium tuberculosis H37Rv
uggcccgcggugacg

SEQ ID NO: 3334470 - RNA, 22 nt, Mycobacterium tuberculosis H37Rv
uggcccgcggugacgcaacauc

SEQ ID NO: 3334471 - RNA, 22 nt, Mycobacterium tuberculosis H37Rv
uggcccgcucccugcacccagc

SEQ ID NO: 3334472 - RNA, 15 nt, Mycobacterium tuberculosis H37Rv
uggcccggacaugcg

SEQ ID NO: 3334473 - RNA, 17 nt, Mycobacterium tuberculosis H37Rv
uggcgaggucggugagg

SEQ ID NO: 3334474 - RNA, 21 nt, Mycobacterium tuberculosis H37Rv
uggcgaguggcugacacugcc

SEQ ID NO: 3334475 - RNA, 19 nt, Mycobacterium tuberculosis H37Rv
uggcgauaaccgacgauca

SEQ ID NO: 3334476 - RNA, 16 nt, Mycobacterium tuberculosis H37Rv
uggcgauagcggcgcu

SEQ ID NO: 3334477 - RNA, 14 nt, Mycobacterium tuberculosis H37Rv
uggcgaucaaccgc

SEQ ID NO: 3334478 - RNA, 21 nt, Mycobacterium tuberculosis H37Rv
uggcgaucaaccgcugucacc

SEQ ID NO: 3334479 - RNA, 17 nt, Mycobacterium tuberculosis H37Rv
uggcgaucaugagcagc

SEQ ID NO: 3334480 - RNA, 16 nt, Mycobacterium tuberculosis H37Rv
uggcgauccaggccag

SEQ ID NO: 3334481 - RNA, 13 nt, Mycobacterium tuberculosis H37Rv
uggcgaucucacc

SEQ ID NO: 3334482 - RNA, 14 nt, Mycobacterium tuberculosis H37Rv
uggcgcaccaccgc

SEQ ID NO: 3334483 - RNA, 15 nt, Mycobacterium tuberculosis H37Rv
uggcgcaccggcguc

SEQ ID NO: 3334484 - RNA, 13 nt, Mycobacterium tuberculosis H37Rv
uggcgcagcgccu

SEQ ID NO: 3334485 - RNA, 20 nt, Mycobacterium tuberculosis H37Rv
uggcgcagcucaccgacgga

SEQ ID NO: 3334486 - RNA, 16 nt, Mycobacterium tuberculosis H37Rv
uggcgccaaaaaggau

SEQ ID NO: 3334487 - RNA, 14 nt, Mycobacterium tuberculosis H37Rv
uggcgccaccaguc

SEQ ID NO: 3334488 - RNA, 15 nt, Mycobacterium tuberculosis H37Rv
uggcgccaccggccg

SEQ ID NO: 3334489 - RNA, 18 nt, Mycobacterium tuberculosis H37Rv
uggcgccacggcagcgcc

SEQ ID NO: 3334490 - RNA, 14 nt, Mycobacterium tuberculosis H37Rv
uggcgccagggccu

SEQ ID NO: 3334491 - RNA, 17 nt, Mycobacterium tuberculosis H37Rv
uggcgcccauggccacc

SEQ ID NO: 3334492 - RNA, 15 nt, Mycobacterium tuberculosis H37Rv
uggcgccccaggugg

SEQ ID NO: 3334493 - RNA, 18 nt, Mycobacterium tuberculosis H37Rv
uggcgcccgaagccgggc

SEQ ID NO: 3334494 - RNA, 13 nt, Mycobacterium tuberculosis H37Rv
uggcgcccgccgg

SEQ ID NO: 3334495 - RNA, 22 nt, Mycobacterium tuberculosis H37Rv
uggcgcccgccggcaaccggga

SEQ ID NO: 3334496 - RNA, 14 nt, Mycobacterium tuberculosis H37Rv
uggcgcccgggccc

SEQ ID NO: 3334497 - RNA, 18 nt, Mycobacterium tuberculosis H37Rv
uggcgcccgucuccagca

SEQ ID NO: 3334498 - RNA, 21 nt, Mycobacterium tuberculosis H37Rv
uggcgcccgucuccagcacca

SEQ ID NO: 3334499 - RNA, 17 nt, Mycobacterium tuberculosis H37Rv
uggcgcccugcgccaca

SEQ ID NO: 3334500 - RNA, 23 nt, Mycobacterium tuberculosis H37Rv
uggcgcccuugccggcgagagcg

SEQ ID NO: 3334501 - RNA, 21 nt, Mycobacterium tuberculosis H37Rv
uggcgccgaacgccagcagcu

SEQ ID NO: 3334502 - RNA, 19 nt, Mycobacterium tuberculosis H37Rv
uggcgccgaaguagccgac

SEQ ID NO: 3334503 - RNA, 13 nt, Mycobacterium tuberculosis H37Rv
uggcgccgccgac

SEQ ID NO: 3334504 - RNA, 20 nt, Mycobacterium tuberculosis H37Rv
uggcgccgccggcaccgccg

SEQ ID NO: 3334505 - RNA, 14 nt, Mycobacterium tuberculosis H37Rv
uggcgccgcggcug

SEQ ID NO: 3334506 - RNA, 21 nt, Mycobacterium tuberculosis H37Rv
uggcgccggccaguucggccu

SEQ ID NO: 3334507 - RNA, 14 nt, Mycobacterium tuberculosis H37Rv
uggcgccggggccg

SEQ ID NO: 3334508 - RNA, 15 nt, Mycobacterium tuberculosis H37Rv
uggcgccggucgccg

SEQ ID NO: 3334509 - RNA, 14 nt, Mycobacterium tuberculosis H37Rv
uggcgccggugccg

SEQ ID NO: 3334510 - RNA, 15 nt, Mycobacterium tuberculosis H37Rv
uggcgccgucggccg

SEQ ID NO: 3334511 - RNA, 20 nt, Mycobacterium tuberculosis H37Rv
uggcgccguuaccgccguug

SEQ ID NO: 3334512 - RNA, 19 nt, Mycobacterium tuberculosis H37Rv
uggcgccguugccggcguu

SEQ ID NO: 3334513 - RNA, 14 nt, Mycobacterium tuberculosis H37Rv
uggcgcgaccgaug

SEQ ID NO: 3334514 - RNA, 21 nt, Mycobacterium tuberculosis H37Rv
uggcgcgcagguagucgacga

SEQ ID NO: 3334515 - RNA, 20 nt, Mycobacterium tuberculosis H37Rv
uggcgcgcccacagcccggg

SEQ ID NO: 3334516 - RNA, 22 nt, Mycobacterium tuberculosis H37Rv
uggcgcgcccacagcccgggcg

SEQ ID NO: 3334517 - RNA, 19 nt, Mycobacterium tuberculosis H37Rv
uggcgcggagcugauugug

SEQ ID NO: 3334518 - RNA, 11 nt, Mycobacterium tuberculosis H37Rv
uggcgcggccg

SEQ ID NO: 3334519 - RNA, 22 nt, Mycobacterium tuberculosis H37Rv
uggcgcggccgaaagagccagc

SEQ ID NO: 3334520 - RNA, 21 nt, Mycobacterium tuberculosis H37Rv
uggcgcgggccggcgacuguc

SEQ ID NO: 3334521 - RNA, 13 nt, Mycobacterium tuberculosis H37Rv
uggcgcggggccg

SEQ ID NO: 3334522 - RNA, 18 nt, Mycobacterium tuberculosis H37Rv
uggcgcggguccagccac

SEQ ID NO: 3334523 - RNA, 16 nt, Mycobacterium tuberculosis H37Rv
uggcgcgguccuccag

SEQ ID NO: 3334524 - RNA, 16 nt, Mycobacterium tuberculosis H37Rv
uggcgcguaucgcguc

SEQ ID NO: 3334525 - RNA, 19 nt, Mycobacterium tuberculosis H37Rv
uggcgcguggucgggaacc

SEQ ID NO: 3334526 - RNA, 14 nt, Mycobacterium tuberculosis H37Rv
uggcgcucggcgag

SEQ ID NO: 3334527 - RNA, 16 nt, Mycobacterium tuberculosis H37Rv
uggcgcugaagccgac

SEQ ID NO: 3334528 - RNA, 18 nt, Mycobacterium tuberculosis H37Rv
uggcgcugaagccgacga

SEQ ID NO: 3334529 - RNA, 12 nt, Mycobacterium tuberculosis H37Rv
uggcgcugaucg

SEQ ID NO: 3334530 - RNA, 13 nt, Mycobacterium tuberculosis H37Rv
uggcgcugaucgg

SEQ ID NO: 3334531 - RNA, 15 nt, Mycobacterium tuberculosis H37Rv
uggcgcugcucugag

SEQ ID NO: 3334532 - RNA, 16 nt, Mycobacterium tuberculosis H37Rv
uggcgcuucggccacu

SEQ ID NO: 3334533 - RNA, 15 nt, Mycobacterium tuberculosis H37Rv
uggcggaccgggcca

SEQ ID NO: 3334534 - RNA, 23 nt, Mycobacterium tuberculosis H37Rv
uggcggauggccgccuuggcuuc

SEQ ID NO: 3334535 - RNA, 19 nt, Mycobacterium tuberculosis H37Rv
uggcggcagcaacgacguc

SEQ ID NO: 3334536 - RNA, 23 nt, Mycobacterium tuberculosis H37Rv
uggcggcagcgguuuuaggcagc

SEQ ID NO: 3334537 - RNA, 20 nt, Mycobacterium tuberculosis H37Rv
uggcggcaggugcggcggca

SEQ ID NO: 3334538 - RNA, 19 nt, Mycobacterium tuberculosis H37Rv
uggcggcagguguuggugc

SEQ ID NO: 3334539 - RNA, 21 nt, Mycobacterium tuberculosis H37Rv
uggcggccacaacagggugac

SEQ ID NO: 3334540 - RNA, 17 nt, Mycobacterium tuberculosis H37Rv
uggcggccaccgucagc

SEQ ID NO: 3334541 - RNA, 20 nt, Mycobacterium tuberculosis H37Rv
uggcggccaccgucagcgcg

SEQ ID NO: 3334542 - RNA, 20 nt, Mycobacterium tuberculosis H37Rv
uggcggccagcgcaccgccg

SEQ ID NO: 3334543 - RNA, 14 nt, Mycobacterium tuberculosis H37Rv
uggcggcccggugg

SEQ ID NO: 3334544 - RNA, 19 nt, Mycobacterium tuberculosis H37Rv
uggcggccgcaaucauguc

SEQ ID NO: 3334545 - RNA, 14 nt, Mycobacterium tuberculosis H37Rv
uggcggccgggucg

SEQ ID NO: 3334546 - RNA, 23 nt, Mycobacterium tuberculosis H37Rv
uggcggccucgggcucaaacgga

SEQ ID NO: 3334547 - RNA, 17 nt, Mycobacterium tuberculosis H37Rv
uggcggcgacacgccag

SEQ ID NO: 3334548 - RNA, 19 nt, Mycobacterium tuberculosis H37Rv
uggcggcgacacgccaggu

SEQ ID NO: 3334549 - RNA, 20 nt, Mycobacterium tuberculosis H37Rv
uggcggcgacacgccaggug

SEQ ID NO: 3334550 - RNA, 19 nt, Mycobacterium tuberculosis H37Rv
uggcggcgaucaacucggg

SEQ ID NO: 3334551 - RNA, 20 nt, Mycobacterium tuberculosis H37Rv
uggcggcgaugguaucgccg

SEQ ID NO: 3334552 - RNA, 21 nt, Mycobacterium tuberculosis H37Rv
uggcggcgaugguaucgccgc

SEQ ID NO: 3334553 - RNA, 16 nt, Mycobacterium tuberculosis H37Rv
uggcggcgccgcagau

SEQ ID NO: 3334554 - RNA, 22 nt, Mycobacterium tuberculosis H37Rv
uggcggcgccgcagaucaccgc

SEQ ID NO: 3334555 - RNA, 14 nt, Mycobacterium tuberculosis H37Rv
uggcggcgcgcgcu

SEQ ID NO: 3334556 - RNA, 20 nt, Mycobacterium tuberculosis H37Rv
uggcggcgcgcgcugcgcag

SEQ ID NO: 3334557 - RNA, 13 nt, Mycobacterium tuberculosis H37Rv
uggcggcgcugcg

SEQ ID NO: 3334558 - RNA, 23 nt, Mycobacterium tuberculosis H37Rv
uggcggcggcauagugcgacugc

SEQ ID NO: 3334559 - RNA, 20 nt, Mycobacterium tuberculosis H37Rv
uggcggcgggccucggcgac

SEQ ID NO: 3334560 - RNA, 13 nt, Mycobacterium tuberculosis H37Rv
uggcggcgggggc

SEQ ID NO: 3334561 - RNA, 17 nt, Mycobacterium tuberculosis H37Rv
uggcggcgguggccagc

SEQ ID NO: 3334562 - RNA, 15 nt, Mycobacterium tuberculosis H37Rv
uggcggcugcacgcu

SEQ ID NO: 3334563 - RNA, 17 nt, Mycobacterium tuberculosis H37Rv
uggcggcugcagccgac

SEQ ID NO: 3334564 - RNA, 20 nt, Mycobacterium tuberculosis H37Rv
uggcggcugcagccgaccga

SEQ ID NO: 3334565 - RNA, 16 nt, Mycobacterium tuberculosis H37Rv
uggcggcuucgacguc

SEQ ID NO: 3334566 - RNA, 21 nt, Mycobacterium tuberculosis H37Rv
uggcggcuucgccccgaggau

SEQ ID NO: 3334567 - RNA, 23 nt, Mycobacterium tuberculosis H37Rv
uggcgggaccgugacguaucgcc

SEQ ID NO: 3334568 - RNA, 18 nt, Mycobacterium tuberculosis H37Rv
uggcgggagaucgucgcc

SEQ ID NO: 3334569 - RNA, 20 nt, Mycobacterium tuberculosis H37Rv
ugggccgacugggcgcgacc

SEQ ID NO: 3334570 - RNA, 21 nt, Mycobacterium tuberculosis H37Rv
ugggccgacugggcgcgaccc

SEQ ID NO: 3334571 - RNA, 19 nt, Mycobacterium tuberculosis H37Rv
ugggccgagagcagccagc

SEQ ID NO: 3334572 - RNA, 21 nt, Mycobacterium tuberculosis H37Rv
ugggccgggaugaagccaccc

SEQ ID NO: 3334573 - RNA, 22 nt, Mycobacterium tuberculosis H37Rv
ugggccggugcagcacgugugc

SEQ ID NO: 3334574 - RNA, 16 nt, Mycobacterium tuberculosis H37Rv
ugggccgguuccucag

SEQ ID NO: 3334575 - RNA, 18 nt, Mycobacterium tuberculosis H37Rv
ugggccgguuccucagcg

SEQ ID NO: 3334576 - RNA, 20 nt, Mycobacterium tuberculosis H37Rv
ugggccguacaacagcgcgc

SEQ ID NO: 3334577 - RNA, 22 nt, Mycobacterium tuberculosis H37Rv
ugggccucaaguugguucaccg

SEQ ID NO: 3334578 - RNA, 19 nt, Mycobacterium tuberculosis H37Rv
ugggccuccaccgcgucca

SEQ ID NO: 3334579 - RNA, 22 nt, Mycobacterium tuberculosis H37Rv
ugggcgaagcccagaucuugca

SEQ ID NO: 3334580 - RNA, 22 nt, Mycobacterium tuberculosis H37Rv
ugggcgacgcggcgccgccauc

SEQ ID NO: 3334581 - RNA, 16 nt, Mycobacterium tuberculosis H37Rv
ugggcgacgucaucgc

SEQ ID NO: 3334582 - RNA, 19 nt, Mycobacterium tuberculosis H37Rv
ugggcgacgucaucgccga

SEQ ID NO: 3334583 - RNA, 20 nt, Mycobacterium tuberculosis H37Rv
ugggcgagaaguccgggccc

SEQ ID NO: 3334584 - RNA, 20 nt, Mycobacterium tuberculosis H37Rv
ugggcgagaccgcgagcagc

SEQ ID NO: 3334585 - RNA, 14 nt, Mycobacterium tuberculosis H37Rv
ugggcgagcugcug

SEQ ID NO: 3334586 - RNA, 19 nt, Mycobacterium tuberculosis H37Rv
ugggcgauauuggacgcgc

SEQ ID NO: 3334587 - RNA, 22 nt, Mycobacterium tuberculosis H37Rv
ugggcgaucgacaccgugaccg

SEQ ID NO: 3334588 - RNA, 21 nt, Mycobacterium tuberculosis H37Rv
ugggcgcagagucaacgucgu

SEQ ID NO: 3334589 - RNA, 15 nt, Mycobacterium tuberculosis H37Rv
ugggcgccaccaucg

SEQ ID NO: 3334590 - RNA, 21 nt, Mycobacterium tuberculosis H37Rv
ugggcgccaugcgccaacccg

SEQ ID NO: 3334591 - RNA, 21 nt, Mycobacterium tuberculosis H37Rv
ugggcgcccgcgguccggcga

SEQ ID NO: 3334592 - RNA, 16 nt, Mycobacterium tuberculosis H37Rv
ugggcgccgacaccgg

SEQ ID NO: 3334593 - RNA, 18 nt, Mycobacterium tuberculosis H37Rv
ugggcgccgacaccggcu

SEQ ID NO: 3334594 - RNA, 22 nt, Mycobacterium tuberculosis H37Rv
ugggcgccgcaaccgccgcguc

SEQ ID NO: 3334595 - RNA, 11 nt, Mycobacterium tuberculosis H37Rv
ugggcgccggu

SEQ ID NO: 3334596 - RNA, 16 nt, Mycobacterium tuberculosis H37Rv
ugggcgcgcucaucga

SEQ ID NO: 3334597 - RNA, 19 nt, Mycobacterium tuberculosis H37Rv
ugggcgcgcucaucgaccg

SEQ ID NO: 3334598 - RNA, 20 nt, Mycobacterium tuberculosis H37Rv
ugggcgcgcucaucgaccgc

SEQ ID NO: 3334599 - RNA, 15 nt, Mycobacterium tuberculosis H37Rv
ugggcgcgcuggcgg

SEQ ID NO: 3334600 - RNA, 13 nt, Mycobacterium tuberculosis H37Rv
ugggcgcggcgcc

SEQ ID NO: 3334601 - RNA, 19 nt, Mycobacterium tuberculosis H37Rv
ugggcgcuuaugcgucugc

SEQ ID NO: 3334602 - RNA, 17 nt, Mycobacterium tuberculosis H37Rv
ugggcggcauuaccaac

SEQ ID NO: 3334603 - RNA, 16 nt, Mycobacterium tuberculosis H37Rv
ugggcggcccaccggc

SEQ ID NO: 3334604 - RNA, 23 nt, Mycobacterium tuberculosis H37Rv
ugggcggccuggucggccagguc

SEQ ID NO: 3334605 - RNA, 19 nt, Mycobacterium tuberculosis H37Rv
ugggcgggauggccgccga

SEQ ID NO: 3334606 - RNA, 20 nt, Mycobacterium tuberculosis H37Rv
ugggcgggcaaucaccgccg

SEQ ID NO: 3334607 - RNA, 15 nt, Mycobacterium tuberculosis H37Rv
ugggcgggcuuggcg

SEQ ID NO: 3334608 - RNA, 16 nt, Mycobacterium tuberculosis H37Rv
ugggcggguucggacg

SEQ ID NO: 3334609 - RNA, 15 nt, Mycobacterium tuberculosis H37Rv
ugggcggugucgucg

SEQ ID NO: 3334610 - RNA, 15 nt, Mycobacterium tuberculosis H37Rv
ugggcgguugaucgc

SEQ ID NO: 3334611 - RNA, 22 nt, Mycobacterium tuberculosis H37Rv
ugggcgucaagcaaguccaccg

SEQ ID NO: 3334612 - RNA, 19 nt, Mycobacterium tuberculosis H37Rv
ugggcgucgaccacgcaag

SEQ ID NO: 3334613 - RNA, 18 nt, Mycobacterium tuberculosis H37Rv
ugggcgugacgggcagga

SEQ ID NO: 3334614 - RNA, 15 nt, Mycobacterium tuberculosis H37Rv
ugggcgugagcgcgc

SEQ ID NO: 3334615 - RNA, 22 nt, Mycobacterium tuberculosis H37Rv
ugggcguucccccggcaccgcc

SEQ ID NO: 3334616 - RNA, 23 nt, Mycobacterium tuberculosis H37Rv
ugggcguucccccggcaccgccg

SEQ ID NO: 3334617 - RNA, 24 nt, Mycobacterium tuberculosis H37Rv
ugggcuaccgagauugggcuggga

SEQ ID NO: 3334618 - RNA, 16 nt, Mycobacterium tuberculosis H37Rv
ugggcugaggguggac

SEQ ID NO: 3334619 - RNA, 23 nt, Mycobacterium tuberculosis H37Rv
ugggcugcgcgucgagcagcacc

SEQ ID NO: 3334620 - RNA, 19 nt, Mycobacterium tuberculosis H37Rv
ugggcugggauagcgcggu

SEQ ID NO: 3334621 - RNA, 21 nt, Mycobacterium tuberculosis H37Rv
ugggcuucgaguuuggcgacg

SEQ ID NO: 3334622 - RNA, 14 nt, Mycobacterium tuberculosis H37Rv
ugggcuuucagcac

SEQ ID NO: 3334623 - RNA, 16 nt, Mycobacterium tuberculosis H37Rv
ugggcuuuugcgucug

SEQ ID NO: 3334624 - RNA, 17 nt, Mycobacterium tuberculosis H37Rv
ugggcuuuugcgucugc

SEQ ID NO: 3334625 - RNA, 18 nt, Mycobacterium tuberculosis H37Rv
uggggaacagcagcgcac

SEQ ID NO: 3334626 - RNA, 18 nt, Mycobacterium tuberculosis H37Rv
uggggacccgcuccaagc

SEQ ID NO: 3334627 - RNA, 14 nt, Mycobacterium tuberculosis H37Rv
uggggacuggcagg

SEQ ID NO: 3334628 - RNA, 21 nt, Mycobacterium tuberculosis H37Rv
uggggaggaaggucgaaucgc

SEQ ID NO: 3334629 - RNA, 18 nt, Mycobacterium tuberculosis H37Rv
uggggauaaacugccgcg

SEQ ID NO: 3334630 - RNA, 13 nt, Mycobacterium tuberculosis H37Rv
uggggcacgacgc

SEQ ID NO: 3334631 - RNA, 14 nt, Mycobacterium tuberculosis H37Rv
uggggcacgacgcc

SEQ ID NO: 3334632 - RNA, 22 nt, Mycobacterium tuberculosis H37Rv
uggggcacuuccagcccggcaa

SEQ ID NO: 3334633 - RNA, 18 nt, Mycobacterium tuberculosis H37Rv
uggggccggaugucgacg

SEQ ID NO: 3334634 - RNA, 19 nt, Mycobacterium tuberculosis H37Rv
uggggccggaugucgacga

SEQ ID NO: 3334635 - RNA, 21 nt, Mycobacterium tuberculosis H37Rv
uggggccgggcuccucugguu

SEQ ID NO: 3334636 - RNA, 17 nt, Mycobacterium tuberculosis H37Rv
uggggccguguucuacc

SEQ ID NO: 3334637 - RNA, 19 nt, Mycobacterium tuberculosis H37Rv
uggggcgcgugggcgugca

SEQ ID NO: 3334638 - RNA, 17 nt, Mycobacterium tuberculosis H37Rv
uggggcuauggcgcagc

SEQ ID NO: 3334639 - RNA, 19 nt, Mycobacterium tuberculosis H37Rv
uggggcugugcaggcggga

SEQ ID NO: 3334640 - RNA, 16 nt, Mycobacterium tuberculosis H37Rv
ugggggcaucaggguc

SEQ ID NO: 3334641 - RNA, 20 nt, Mycobacterium tuberculosis H37Rv
ugggggcuucugcgucugcu

SEQ ID NO: 3334642 - RNA, 21 nt, Mycobacterium tuberculosis H37Rv
ugggggucaaucggguuuguc

SEQ ID NO: 3334643 - RNA, 14 nt, Mycobacterium tuberculosis H37Rv
ugggguccggugac

SEQ ID NO: 3334644 - RNA, 14 nt, Mycobacterium tuberculosis H37Rv
uggggucguucgcc

SEQ ID NO: 3334645 - RNA, 21 nt, Mycobacterium tuberculosis H37Rv
uggggugcuuucgcgucugcu

SEQ ID NO: 3334646 - RNA, 12 nt, Mycobacterium tuberculosis H37Rv
ugggguggcagc

SEQ ID NO: 3334647 - RNA, 13 nt, Mycobacterium tuberculosis H37Rv
uggguacccgauc

SEQ ID NO: 3334648 - RNA, 20 nt, Mycobacterium tuberculosis H37Rv
uggguaccucucugucgcgu

SEQ ID NO: 3334649 - RNA, 15 nt, Mycobacterium tuberculosis H37Rv
uggguagccgcccag

SEQ ID NO: 3334650 - RNA, 13 nt, Mycobacterium tuberculosis H37Rv
uggguauccaccg

SEQ ID NO: 3334651 - RNA, 14 nt, Mycobacterium tuberculosis H37Rv
ugggucagguuguc

SEQ ID NO: 3334652 - RNA, 20 nt, Mycobacterium tuberculosis H37Rv
ugggucaugccguagguugc

SEQ ID NO: 3334653 - RNA, 20 nt, Mycobacterium tuberculosis H37Rv
uggguccucgagcggcagau

SEQ ID NO: 3334654 - RNA, 14 nt, Mycobacterium tuberculosis H37Rv
ugggucgcaauauc

SEQ ID NO: 3334655 - RNA, 12 nt, Mycobacterium tuberculosis H37Rv
ugggucggcgau

SEQ ID NO: 3334656 - RNA, 19 nt, Mycobacterium tuberculosis H37Rv
ugggucugcucagcgcggc

SEQ ID NO: 3334657 - RNA, 17 nt, Mycobacterium tuberculosis H37Rv
ugggucuggcaggccag

SEQ ID NO: 3334658 - RNA, 15 nt, Mycobacterium tuberculosis H37Rv
ugggugaacgccugc

SEQ ID NO: 3334659 - RNA, 21 nt, Mycobacterium tuberculosis H37Rv
ugggugaaguguucgacaccc

SEQ ID NO: 3334660 - RNA, 19 nt, Mycobacterium tuberculosis H37Rv
ugggugacguaggcgcuga

SEQ ID NO: 3334661 - RNA, 13 nt, Mycobacterium tuberculosis H37Rv
ugggugaggccaa

SEQ ID NO: 3334662 - RNA, 15 nt, Mycobacterium tuberculosis H37Rv
ugggugaucugcccu

SEQ ID NO: 3334663 - RNA, 18 nt, Mycobacterium tuberculosis H37Rv
ugggugcagcacguccgc

SEQ ID NO: 3334664 - RNA, 23 nt, Mycobacterium tuberculosis H37Rv
uggugcagaauucggcgcgacag

SEQ ID NO: 3334665 - RNA, 17 nt, Mycobacterium tuberculosis H37Rv
uggugcagccgcggucg

SEQ ID NO: 3334666 - RNA, 14 nt, Mycobacterium tuberculosis H37Rv
uggugcagcgcagg

SEQ ID NO: 3334667 - RNA, 16 nt, Mycobacterium tuberculosis H37Rv
uggugcagcgugcagc

SEQ ID NO: 3334668 - RNA, 23 nt, Mycobacterium tuberculosis H37Rv
uggugccaaccugggccaucacg

SEQ ID NO: 3334669 - RNA, 12 nt, Mycobacterium tuberculosis H37Rv
uggugccagguc

SEQ ID NO: 3334670 - RNA, 17 nt, Mycobacterium tuberculosis H37Rv
uggugcccgugugcagc

SEQ ID NO: 3334671 - RNA, 21 nt, Mycobacterium tuberculosis H37Rv
uggugcccgugugcagccagc

SEQ ID NO: 3334672 - RNA, 17 nt, Mycobacterium tuberculosis H37Rv
uggugcccuugaagaaa

SEQ ID NO: 3334673 - RNA, 14 nt, Mycobacterium tuberculosis H37Rv
uggugccgacccgc

SEQ ID NO: 3334674 - RNA, 14 nt, Mycobacterium tuberculosis H37Rv
uggugccgagcagc

SEQ ID NO: 3334675 - RNA, 15 nt, Mycobacterium tuberculosis H37Rv
uggugccgccugugc

SEQ ID NO: 3334676 - RNA, 14 nt, Mycobacterium tuberculosis H37Rv
uggugccgcggcca

SEQ ID NO: 3334677 - RNA, 15 nt, Mycobacterium tuberculosis H37Rv
uggugccgcggccac

SEQ ID NO: 3334678 - RNA, 17 nt, Mycobacterium tuberculosis H37Rv
uggugccgucagguucu

SEQ ID NO: 3334679 - RNA, 18 nt, Mycobacterium tuberculosis H37Rv
uggugccugcggguggau

SEQ ID NO: 3334680 - RNA, 15 nt, Mycobacterium tuberculosis H37Rv
uggugccuucaccgc

SEQ ID NO: 3334681 - RNA, 14 nt, Mycobacterium tuberculosis H37Rv
uggugcggcccugc

SEQ ID NO: 3334682 - RNA, 13 nt, Mycobacterium tuberculosis H37Rv
uggugcgggguug

SEQ ID NO: 3334683 - RNA, 14 nt, Mycobacterium tuberculosis H37Rv
ugguggaccuccgg

SEQ ID NO: 3334684 - RNA, 16 nt, Mycobacterium tuberculosis H37Rv
ugguggcagcgcaccc

SEQ ID NO: 3334685 - RNA, 12 nt, Mycobacterium tuberculosis H37Rv
ugguggccacca

SEQ ID NO: 3334686 - RNA, 21 nt, Mycobacterium tuberculosis H37Rv
ugguggccaugacggcuccga

SEQ ID NO: 3334687 - RNA, 16 nt, Mycobacterium tuberculosis H37Rv
ugguggcccgggccac

SEQ ID NO: 3334688 - RNA, 18 nt, Mycobacterium tuberculosis H37Rv
ugguggcccgggccaccg

SEQ ID NO: 3334689 - RNA, 22 nt, Mycobacterium tuberculosis H37Rv
ugguggccgaacgggucggcga

SEQ ID NO: 3334690 - RNA, 17 nt, Mycobacterium tuberculosis H37Rv
ugguggccggggugccg

SEQ ID NO: 3334691 - RNA, 18 nt, Mycobacterium tuberculosis H37Rv
ugguggcgguguugcucc

SEQ ID NO: 3334692 - RNA, 18 nt, Mycobacterium tuberculosis H37Rv
ugguggcguaucgggccc

SEQ ID NO: 3334693 - RNA, 15 nt, Mycobacterium tuberculosis H37Rv
uggugggaucgcagc

SEQ ID NO: 3334694 - RNA, 16 nt, Mycobacterium tuberculosis H37Rv
uggugggccagcagca

SEQ ID NO: 3334695 - RNA, 14 nt, Mycobacterium tuberculosis H37Rv
ugguggucaccacc

SEQ ID NO: 3334696 - RNA, 14 nt, Mycobacterium tuberculosis H37Rv
ugguggucgggcgc

SEQ ID NO: 3334697 - RNA, 15 nt, Mycobacterium tuberculosis H37Rv
ugguggugccgaccu

SEQ ID NO: 3334698 - RNA, 22 nt, Mycobacterium tuberculosis H37Rv
ugguguacccgccucgggccgg

SEQ ID NO: 3334699 - RNA, 16 nt, Mycobacterium tuberculosis H37Rv
ugguguacugcugcuu

SEQ ID NO: 3334700 - RNA, 17 nt, Mycobacterium tuberculosis H37Rv
ugguguauucgcggaug

SEQ ID NO: 3334701 - RNA, 22 nt, Mycobacterium tuberculosis H37Rv
uggugucagcugauuaccgaca

SEQ ID NO: 3334702 - RNA, 14 nt, Mycobacterium tuberculosis H37Rv
ugguguccaccacc

SEQ ID NO: 3334703 - RNA, 16 nt, Mycobacterium tuberculosis H37Rv
ugguguccaccaccgg

SEQ ID NO: 3334704 - RNA, 20 nt, Mycobacterium tuberculosis H37Rv
cgcugcacggaaucgcaucu

SEQ ID NO: 3334705 - RNA, 20 nt, Mycobacterium tuberculosis H37Rv
cgcugcagacgccccuuccc

SEQ ID NO: 3334706 - RNA, 23 nt, Mycobacterium tuberculosis H37Rv
cgcugcauacaaccccgcgcugu

SEQ ID NO: 3334707 - RNA, 22 nt, Mycobacterium tuberculosis H37Rv
cgcugcauccgcagcaccaagg

SEQ ID NO: 3334708 - RNA, 19 nt, Mycobacterium tuberculosis H37Rv
cgcugccacuagcauuguc

SEQ ID NO: 3334709 - RNA, 17 nt, Mycobacterium tuberculosis H37Rv
cgcugccagccguuccc

SEQ ID NO: 3334710 - RNA, 16 nt, Mycobacterium tuberculosis H37Rv
cgcugccagcggccgg

SEQ ID NO: 3334711 - RNA, 19 nt, Mycobacterium tuberculosis H37Rv
cgcugccagggugcgccgg

SEQ ID NO: 3334712 - RNA, 14 nt, Mycobacterium tuberculosis H37Rv
cgcugccaguucuu

SEQ ID NO: 3334713 - RNA, 18 nt, Mycobacterium tuberculosis H37Rv
cgcugccaguucuuggcg

SEQ ID NO: 3334714 - RNA, 15 nt, Mycobacterium tuberculosis H37Rv
cgcugcccaaaagcg

SEQ ID NO: 3334715 - RNA, 14 nt, Mycobacterium tuberculosis H37Rv
cgcugcccaugcgg

SEQ ID NO: 3334716 - RNA, 14 nt, Mycobacterium tuberculosis H37Rv
cgcugccccgccgc

SEQ ID NO: 3334717 - RNA, 17 nt, Mycobacterium tuberculosis H37Rv
cgcugccccgccgccau

SEQ ID NO: 3334718 - RNA, 17 nt, Mycobacterium tuberculosis H37Rv
cgcugcccgccagccca

SEQ ID NO: 3334719 - RNA, 16 nt, Mycobacterium tuberculosis H37Rv
cgcugcccgcgcggcc

SEQ ID NO: 3334720 - RNA, 15 nt, Mycobacterium tuberculosis H37Rv
cgcugcccgcggugu

SEQ ID NO: 3334721 - RNA, 15 nt, Mycobacterium tuberculosis H37Rv
cgcugcccgggcugc

SEQ ID NO: 3334722 - RNA, 21 nt, Mycobacterium tuberculosis H37Rv
cgcugccgaagcggccaccgc

SEQ ID NO: 3334723 - RNA, 22 nt, Mycobacterium tuberculosis H37Rv
cgcugccgaagcggccaccgcc

SEQ ID NO: 3334724 - RNA, 20 nt, Mycobacterium tuberculosis H37Rv
cgcugccgcaguucaucgag

SEQ ID NO: 3334725 - RNA, 19 nt, Mycobacterium tuberculosis H37Rv
cgcugccgcaucggcaagg

SEQ ID NO: 3334726 - RNA, 13 nt, Mycobacterium tuberculosis H37Rv
cgcugccgcccuu

SEQ ID NO: 3334727 - RNA, 22 nt, Mycobacterium tuberculosis H37Rv
cgcugccgcccuugccgcccgc

SEQ ID NO: 3334728 - RNA, 15 nt, Mycobacterium tuberculosis H37Rv
cgcugccgccgagcu

SEQ ID NO: 3334729 - RNA, 22 nt, Mycobacterium tuberculosis H37Rv
cgcugccgccgaucgacacccg

SEQ ID NO: 3334730 - RNA, 14 nt, Mycobacterium tuberculosis H37Rv
cgcugccgcgcggc

SEQ ID NO: 3334731 - RNA, 18 nt, Mycobacterium tuberculosis H37Rv
cgcugccggcgccgccac

SEQ ID NO: 3334732 - RNA, 14 nt, Mycobacterium tuberculosis H37Rv
cgcugccgguguug

SEQ ID NO: 3334733 - RNA, 19 nt, Mycobacterium tuberculosis H37Rv
cgcugccucuugcucggcg

SEQ ID NO: 3334734 - RNA, 21 nt, Mycobacterium tuberculosis H37Rv
cgcugccucuugcucggcgug

SEQ ID NO: 3334735 - RNA, 18 nt, Mycobacterium tuberculosis H37Rv
cgcugccuggccgggacc

SEQ ID NO: 3334736 - RNA, 14 nt, Mycobacterium tuberculosis H37Rv
cgcugccuucuuug

SEQ ID NO: 3334737 - RNA, 16 nt, Mycobacterium tuberculosis H37Rv
cgcugccuuggcgcgg

SEQ ID NO: 3334738 - RNA, 13 nt, Mycobacterium tuberculosis H37Rv
cgcugcgaucacc

SEQ ID NO: 3334739 - RNA, 17 nt, Mycobacterium tuberculosis H37Rv
cgcugcgaucacccccu

SEQ ID NO: 3334740 - RNA, 22 nt, Mycobacterium tuberculosis H37Rv
cgcugcgaucacccccuggacu

SEQ ID NO: 3334741 - RNA, 20 nt, Mycobacterium tuberculosis H37Rv
cgcugcgaugcugaucaccg

SEQ ID NO: 3334742 - RNA, 20 nt, Mycobacterium tuberculosis H37Rv
cgcugcgccgucgcagccag

SEQ ID NO: 3334743 - RNA, 13 nt, Mycobacterium tuberculosis H37Rv
cgcugcgcgacga

SEQ ID NO: 3334744 - RNA, 15 nt, Mycobacterium tuberculosis H37Rv
cgcugcgcgacugau

SEQ ID NO: 3334745 - RNA, 18 nt, Mycobacterium tuberculosis H37Rv
cgcugcgcgacugauccu

SEQ ID NO: 3334746 - RNA, 17 nt, Mycobacterium tuberculosis H37Rv
cgcugcgcgccagacac

SEQ ID NO: 3334747 - RNA, 19 nt, Mycobacterium tuberculosis H37Rv
cgcugcgcggcccgcaucg

SEQ ID NO: 3334748 - RNA, 17 nt, Mycobacterium tuberculosis H37Rv
cgcugcggcaccacccg

SEQ ID NO: 3334749 - RNA, 21 nt, Mycobacterium tuberculosis H37Rv
cgcugcggcaccacccggcga

SEQ ID NO: 3334750 - RNA, 18 nt, Mycobacterium tuberculosis H37Rv
cgcugcggcccacaccag

SEQ ID NO: 3334751 - RNA, 12 nt, Mycobacterium tuberculosis H37Rv
cgcugcggcggu

SEQ ID NO: 3334752 - RNA, 20 nt, Mycobacterium tuberculosis H37Rv
cgcugcggcgugccgggugg

SEQ ID NO: 3334753 - RNA, 16 nt, Mycobacterium tuberculosis H37Rv
cgcugcggugccggcc

SEQ ID NO: 3334754 - RNA, 16 nt, Mycobacterium tuberculosis H37Rv
cgcugcggugggccag

SEQ ID NO: 3334755 - RNA, 20 nt, Mycobacterium tuberculosis H37Rv
cgcugcguugggaucccagc

SEQ ID NO: 3334756 - RNA, 13 nt, Mycobacterium tuberculosis H37Rv
cgcugcucacgca

SEQ ID NO: 3334757 - RNA, 15 nt, Mycobacterium tuberculosis H37Rv
cgcugcucacgcagc

SEQ ID NO: 3334758 - RNA, 16 nt, Mycobacterium tuberculosis H37Rv
cgcugcucacgcagca

SEQ ID NO: 3334759 - RNA, 17 nt, Mycobacterium tuberculosis H37Rv
cgcugcucagcaacggc

SEQ ID NO: 3334760 - RNA, 17 nt, Mycobacterium tuberculosis H37Rv
cgcugcuccgcgccgcu

SEQ ID NO: 3334761 - RNA, 16 nt, Mycobacterium tuberculosis H37Rv
cgcugcucuggacggu

SEQ ID NO: 3334762 - RNA, 22 nt, Mycobacterium tuberculosis H37Rv
cgcugcucuuuuagccacaauc

SEQ ID NO: 3334763 - RNA, 23 nt, Mycobacterium tuberculosis H37Rv
cgcugcucuuuuagccacaaucg

SEQ ID NO: 3334764 - RNA, 17 nt, Mycobacterium tuberculosis H37Rv
cgcugcugaacaaccag

SEQ ID NO: 3334765 - RNA, 15 nt, Mycobacterium tuberculosis H37Rv
cgcugcugccgcacc

SEQ ID NO: 3334766 - RNA, 21 nt, Mycobacterium tuberculosis H37Rv
cgcugcuggucuugccgugca

SEQ ID NO: 3334767 - RNA, 14 nt, Mycobacterium tuberculosis H37Rv
cgcugcugucgauu

SEQ ID NO: 3334768 - RNA, 21 nt, Mycobacterium tuberculosis H37Rv
cgcugcuugaggucccgugcg

SEQ ID NO: 3334769 - RNA, 21 nt, Mycobacterium tuberculosis H37Rv
cgcuggacaguuacgcuggca

SEQ ID NO: 3334770 - RNA, 14 nt, Mycobacterium tuberculosis H37Rv
cgcuggaccugaug

SEQ ID NO: 3334771 - RNA, 23 nt, Mycobacterium tuberculosis H37Rv
cgcuggaccugaugagcucaccg

SEQ ID NO: 3334772 - RNA, 14 nt, Mycobacterium tuberculosis H37Rv
cgcuggacggaucu

SEQ ID NO: 3334773 - RNA, 13 nt, Mycobacterium tuberculosis H37Rv
cgcuggacggcgg

SEQ ID NO: 3334774 - RNA, 18 nt, Mycobacterium tuberculosis H37Rv
cgcuggacggcgggccgc

SEQ ID NO: 3334775 - RNA, 14 nt, Mycobacterium tuberculosis H37Rv
cgcuggaggccacc

SEQ ID NO: 3334776 - RNA, 19 nt, Mycobacterium tuberculosis H37Rv
cgcuggcaaguucggccga

SEQ ID NO: 3334777 - RNA, 16 nt, Mycobacterium tuberculosis H37Rv
cgcuggcaaucccgcg

SEQ ID NO: 3334778 - RNA, 14 nt, Mycobacterium tuberculosis H37Rv
cgcuggcaggccgg

SEQ ID NO: 3334779 - RNA, 20 nt, Mycobacterium tuberculosis H37Rv
cgcuggcaggccgggcacca

SEQ ID NO: 3334780 - RNA, 15 nt, Mycobacterium tuberculosis H37Rv
cgcuggcauaucccu

SEQ ID NO: 3334781 - RNA, 11 nt, Mycobacterium tuberculosis H37Rv
cgcuggccacg

SEQ ID NO: 3334782 - RNA, 13 nt, Mycobacterium tuberculosis H37Rv
cgcuggccacgau

SEQ ID NO: 3334783 - RNA, 19 nt, Mycobacterium tuberculosis H37Rv
cgcuggccacgauccgcgg

SEQ ID NO: 3334784 - RNA, 12 nt, Mycobacterium tuberculosis H37Rv
cgcuggccagca

SEQ ID NO: 3334785 - RNA, 15 nt, Mycobacterium tuberculosis H37Rv
cgcuggccagcccgg

SEQ ID NO: 3334786 - RNA, 20 nt, Mycobacterium tuberculosis H37Rv
cgcuggcccgccagaacggc

SEQ ID NO: 3334787 - RNA, 15 nt, Mycobacterium tuberculosis H37Rv
cgcuggccguccggu

SEQ ID NO: 3334788 - RNA, 14 nt, Mycobacterium tuberculosis H37Rv
cgcuggccuccagc

SEQ ID NO: 3334789 - RNA, 13 nt, Mycobacterium tuberculosis H37Rv
cgcuggccuccug

SEQ ID NO: 3334790 - RNA, 15 nt, Mycobacterium tuberculosis H37Rv
cgcuggccuccugga

SEQ ID NO: 3334791 - RNA, 17 nt, Mycobacterium tuberculosis H37Rv
cgcuggccuccuggaag

SEQ ID NO: 3334792 - RNA, 22 nt, Mycobacterium tuberculosis H37Rv
cgcuggccucgucgcugcccau

SEQ ID NO: 3334793 - RNA, 15 nt, Mycobacterium tuberculosis H37Rv
cgcuggcgcccccga

SEQ ID NO: 3334794 - RNA, 23 nt, Mycobacterium tuberculosis H37Rv
cgcuggcgcccccgacgacggca

SEQ ID NO: 3334795 - RNA, 13 nt, Mycobacterium tuberculosis H37Rv
cgcuggcgccgcc

SEQ ID NO: 3334796 - RNA, 14 nt, Mycobacterium tuberculosis H37Rv
cgcuggcgccgccg

SEQ ID NO: 3334797 - RNA, 17 nt, Mycobacterium tuberculosis H37Rv
cgcuggcgccgccggug

SEQ ID NO: 3334798 - RNA, 13 nt, Mycobacterium tuberculosis H37Rv
cgcuggcggcgca

SEQ ID NO: 3334799 - RNA, 16 nt, Mycobacterium tuberculosis H37Rv
cgcuggcggcgcagcg

SEQ ID NO: 3334800 - RNA, 20 nt, Mycobacterium tuberculosis H37Rv
cgcuggcgggcacucagcag

SEQ ID NO: 3334801 - RNA, 21 nt, Mycobacterium tuberculosis H37Rv
cgcuggcgggcgaucucggcg

SEQ ID NO: 3334802 - RNA, 19 nt, Mycobacterium tuberculosis H37Rv
cgcuggcgucgucuucggu

SEQ ID NO: 3334803 - RNA, 23 nt, Mycobacterium tuberculosis H37Rv
cgcuggcguuguugacgaucacc

SEQ ID NO: 3334804 - RNA, 19 nt, Mycobacterium tuberculosis H37Rv
cgcuggcuacccaccggcc

SEQ ID NO: 3334805 - RNA, 21 nt, Mycobacterium tuberculosis H37Rv
cgcuggcuacccaccggccgg

SEQ ID NO: 3334806 - RNA, 14 nt, Mycobacterium tuberculosis H37Rv
cgcuggcucaucga

SEQ ID NO: 3334807 - RNA, 16 nt, Mycobacterium tuberculosis H37Rv
cgcuggcugacaccga

SEQ ID NO: 3334808 - RNA, 17 nt, Mycobacterium tuberculosis H37Rv
cgcuggcugacaccgau

SEQ ID NO: 3334809 - RNA, 18 nt, Mycobacterium tuberculosis H37Rv
cgcugggaaaucccgacc

SEQ ID NO: 3334810 - RNA, 18 nt, Mycobacterium tuberculosis H37Rv
cgcugggacgggcgcguc

SEQ ID NO: 3334811 - RNA, 14 nt, Mycobacterium tuberculosis H37Rv
cgcugggacggucg

SEQ ID NO: 3334812 - RNA, 15 nt, Mycobacterium tuberculosis H37Rv
cgcugggaggcgcgg

SEQ ID NO: 3334813 - RNA, 15 nt, Mycobacterium tuberculosis H37Rv
cgcugggccgaccgc

SEQ ID NO: 3334814 - RNA, 16 nt, Mycobacterium tuberculosis H37Rv
cgcugggccgaccgcc

SEQ ID NO: 3334815 - RNA, 13 nt, Mycobacterium tuberculosis H37Rv
cgcugggcgcaac

SEQ ID NO: 3334816 - RNA, 22 nt, Mycobacterium tuberculosis H37Rv
cgcugggcgccgucgggccugc

SEQ ID NO: 3334817 - RNA, 19 nt, Mycobacterium tuberculosis H37Rv
cgcugggcgcgcucaucga

SEQ ID NO: 3334818 - RNA, 21 nt, Mycobacterium tuberculosis H37Rv
cgcugggcgcgcucaucgacc

SEQ ID NO: 3334819 - RNA, 17 nt, Mycobacterium tuberculosis H37Rv
cgcuggguccccuccca

SEQ ID NO: 3334820 - RNA, 21 nt, Mycobacterium tuberculosis H37Rv
cgcuggguccccucccaccag

SEQ ID NO: 3334821 - RNA, 18 nt, Mycobacterium tuberculosis H37Rv
cgcugggugaccaggaag

SEQ ID NO: 3334822 - RNA, 21 nt, Mycobacterium tuberculosis H37Rv
cgcuggguggcgggccggaug

SEQ ID NO: 3334823 - RNA, 21 nt, Mycobacterium tuberculosis H37Rv
cgcugguauagcucacggugg

SEQ ID NO: 3334824 - RNA, 17 nt, Mycobacterium tuberculosis H37Rv
cgcuggucagccgugcc

SEQ ID NO: 3334825 - RNA, 13 nt, Mycobacterium tuberculosis H37Rv
cgcuggucgagca

SEQ ID NO: 3334826 - RNA, 13 nt, Mycobacterium tuberculosis H37Rv
cgcuggucgcggu

SEQ ID NO: 3334827 - RNA, 19 nt, Mycobacterium tuberculosis H37Rv
cgcuggucgcgguggcggc

SEQ ID NO: 3334828 - RNA, 20 nt, Mycobacterium tuberculosis H37Rv
cgcuggucgcgguggcggcg

SEQ ID NO: 3334829 - RNA, 19 nt, Mycobacterium tuberculosis H37Rv
cgcuggucggagaccagcg

SEQ ID NO: 3334830 - RNA, 15 nt, Mycobacterium tuberculosis H37Rv
cgcuggucggcggcu

SEQ ID NO: 3334831 - RNA, 20 nt, Mycobacterium tuberculosis H37Rv
cgcuggucuuucacguagcg

SEQ ID NO: 3334832 - RNA, 22 nt, Mycobacterium tuberculosis H37Rv
cgcuggugaaccacucggugau

SEQ ID NO: 3334833 - RNA, 14 nt, Mycobacterium tuberculosis H37Rv
cgcuggugcacggc

SEQ ID NO: 3334834 - RNA, 15 nt, Mycobacterium tuberculosis H37Rv
cgcuggugcgccacg

SEQ ID NO: 3334835 - RNA, 20 nt, Mycobacterium tuberculosis H37Rv
cgcuggugcgccacgccacc

SEQ ID NO: 3334836 - RNA, 22 nt, Mycobacterium tuberculosis H37Rv
cgcuggugcgccacgccaccgc

SEQ ID NO: 3334837 - RNA, 14 nt, Mycobacterium tuberculosis H37Rv
cgcuggugcgccca

SEQ ID NO: 3334838 - RNA, 14 nt, Mycobacterium tuberculosis H37Rv
cgcugguggucagc

SEQ ID NO: 3334839 - RNA, 18 nt, Mycobacterium tuberculosis H37Rv
cgcugguggucagcaccc

SEQ ID NO: 3334840 - RNA, 14 nt, Mycobacterium tuberculosis H37Rv
cgcugguggugauu

SEQ ID NO: 3334841 - RNA, 15 nt, Mycobacterium tuberculosis H37Rv
cgcuguaggccagcc

SEQ ID NO: 3334842 - RNA, 18 nt, Mycobacterium tuberculosis H37Rv
cgcuguaggccagcccgg

SEQ ID NO: 3334843 - RNA, 14 nt, Mycobacterium tuberculosis H37Rv
cgcuguagucgcgc

SEQ ID NO: 3334844 - RNA, 15 nt, Mycobacterium tuberculosis H37Rv
cgcugucccagcccg

SEQ ID NO: 3334845 - RNA, 15 nt, Mycobacterium tuberculosis H37Rv
cgcuguccgacuugu

SEQ ID NO: 3334846 - RNA, 18 nt, Mycobacterium tuberculosis H37Rv
cgcugucgcccucgaucg

SEQ ID NO: 3334847 - RNA, 17 nt, Mycobacterium tuberculosis H37Rv
cgcugucguaccgcucg

SEQ ID NO: 3334848 - RNA, 19 nt, Mycobacterium tuberculosis H37Rv
cgcugucguaccgcucggc

SEQ ID NO: 3334849 - RNA, 18 nt, Mycobacterium tuberculosis H37Rv
cgcugucgugcucucggc

SEQ ID NO: 3334850 - RNA, 19 nt, Mycobacterium tuberculosis H37Rv
cgcugugagcuuggucgcc

SEQ ID NO: 3334851 - RNA, 14 nt, Mycobacterium tuberculosis H37Rv
cgcuguggcucgac

SEQ ID NO: 3334852 - RNA, 15 nt, Mycobacterium tuberculosis H37Rv
cgcuguggcucgacg

SEQ ID NO: 3334853 - RNA, 20 nt, Mycobacterium tuberculosis H37Rv
cgcuguggucuucaucgccg

SEQ ID NO: 3334854 - RNA, 13 nt, Mycobacterium tuberculosis H37Rv
cgcuguuccucga

SEQ ID NO: 3334855 - RNA, 19 nt, Mycobacterium tuberculosis H37Rv
cgcuguuccucgaguucgg

SEQ ID NO: 3334856 - RNA, 17 nt, Mycobacterium tuberculosis H37Rv
cgcuguugccaucgacg

SEQ ID NO: 3334857 - RNA, 19 nt, Mycobacterium tuberculosis H37Rv
cgcuguugcuggcgccccc

SEQ ID NO: 3334858 - RNA, 13 nt, Mycobacterium tuberculosis H37Rv
cgcuguuggccgg

SEQ ID NO: 3334859 - RNA, 16 nt, Mycobacterium tuberculosis H37Rv
cgcuguuggccggucc

SEQ ID NO: 3334860 - RNA, 22 nt, Mycobacterium tuberculosis H37Rv
cgcuuaacagcggguccuucug

SEQ ID NO: 3334861 - RNA, 18 nt, Mycobacterium tuberculosis H37Rv
cgcuucacagccaccagc

SEQ ID NO: 3334862 - RNA, 21 nt, Mycobacterium tuberculosis H37Rv
cgcuucaggcgccacugcuuc

SEQ ID NO: 3334863 - RNA, 18 nt, Mycobacterium tuberculosis H37Rv
cgcuucgcaagucaucca

SEQ ID NO: 3334864 - RNA, 20 nt, Mycobacterium tuberculosis H37Rv
cgcuucgcaagucauccagg

SEQ ID NO: 3334865 - RNA, 20 nt, Mycobacterium tuberculosis H37Rv
cgcuucggcagcucccgcca

SEQ ID NO: 3334866 - RNA, 16 nt, Mycobacterium tuberculosis H37Rv
cgcuucggccugugcg

SEQ ID NO: 3334867 - RNA, 22 nt, Mycobacterium tuberculosis H37Rv
cgcuucgggcgucauccgcggc

SEQ ID NO: 3334868 - RNA, 20 nt, Mycobacterium tuberculosis H37Rv
cgcuucgucggccggcaccc

SEQ ID NO: 3334869 - RNA, 17 nt, Mycobacterium tuberculosis H37Rv
cgcuugaccccuggccg

SEQ ID NO: 3334870 - RNA, 18 nt, Mycobacterium tuberculosis H37Rv
cgcuugaccccuggccgc

SEQ ID NO: 3334871 - RNA, 21 nt, Mycobacterium tuberculosis H37Rv
cgcuugaccccuggccgccgg

SEQ ID NO: 3334872 - RNA, 12 nt, Mycobacterium tuberculosis H37Rv
cgcuugcauuga

SEQ ID NO: 3334873 - RNA, 12 nt, Mycobacterium tuberculosis H37Rv
cgcuugccccgc

SEQ ID NO: 3334874 - RNA, 17 nt, Mycobacterium tuberculosis H37Rv
cgcuugccccgccgagc

SEQ ID NO: 3334875 - RNA, 14 nt, Mycobacterium tuberculosis H37Rv
cgcuugccgcugag

SEQ ID NO: 3334876 - RNA, 17 nt, Mycobacterium tuberculosis H37Rv
cgcuugccgcugagccc

SEQ ID NO: 3334877 - RNA, 13 nt, Mycobacterium tuberculosis H37Rv
cgcuugcggccgc

SEQ ID NO: 3334878 - RNA, 13 nt, Mycobacterium tuberculosis H37Rv
cgcuugcggcugc

SEQ ID NO: 3334879 - RNA, 19 nt, Mycobacterium tuberculosis H37Rv
cgcuugcggggccgggcga

SEQ ID NO: 3334880 - RNA, 18 nt, Mycobacterium tuberculosis H37Rv
cgcuuggcaaucaucucc

SEQ ID NO: 3334881 - RNA, 21 nt, Mycobacterium tuberculosis H37Rv
cgcuuggcaaucaucucccga

SEQ ID NO: 3334882 - RNA, 18 nt, Mycobacterium tuberculosis H37Rv
cgcuuggccgcugccuuc

SEQ ID NO: 3334883 - RNA, 18 nt, Mycobacterium tuberculosis H37Rv
cgcuuggcgagccacggc

SEQ ID NO: 3334884 - RNA, 15 nt, Mycobacterium tuberculosis H37Rv
cgcuuggcgcggccc

SEQ ID NO: 3334885 - RNA, 23 nt, Mycobacterium tuberculosis H37Rv
cgcuuggcguauccuugcgacgu

SEQ ID NO: 3334886 - RNA, 21 nt, Mycobacterium tuberculosis H37Rv
cgcuugguguggcccaaccgc

SEQ ID NO: 3334887 - RNA, 18 nt, Mycobacterium tuberculosis H37Rv
cgcuuugaauugcgcgcc

SEQ ID NO: 3334888 - RNA, 16 nt, Mycobacterium tuberculosis H37Rv
cgcuuugcacugugga

SEQ ID NO: 3334889 - RNA, 22 nt, Mycobacterium tuberculosis H37Rv
cgcuuuggaggugcaguacgcg

SEQ ID NO: 3334890 - RNA, 14 nt, Mycobacterium tuberculosis H37Rv
cgcuuuggcguucg

SEQ ID NO: 3334891 - RNA, 14 nt, Mycobacterium tuberculosis H37Rv
cggaaaaccgcacc

SEQ ID NO: 3334892 - RNA, 15 nt, Mycobacterium tuberculosis H37Rv
cggaaacaagcaagc

SEQ ID NO: 3334893 - RNA, 13 nt, Mycobacterium tuberculosis H37Rv
cggaaacagcaug

SEQ ID NO: 3334894 - RNA, 14 nt, Mycobacterium tuberculosis H37Rv
cggaaacagcgauc

SEQ ID NO: 3334895 - RNA, 17 nt, Mycobacterium tuberculosis H37Rv
cggaaaccaucgccagc

SEQ ID NO: 3334896 - RNA, 17 nt, Mycobacterium tuberculosis H37Rv
cggaaaggccgcgguga

SEQ ID NO: 3334897 - RNA, 13 nt, Mycobacterium tuberculosis H37Rv
cggaaaggcuucc

SEQ ID NO: 3334898 - RNA, 18 nt, Mycobacterium tuberculosis H37Rv
cgcggaccggcgucggcu

SEQ ID NO: 3334899 - RNA, 12 nt, Mycobacterium tuberculosis H37Rv
cgcggaccucga

SEQ ID NO: 3334900 - RNA, 17 nt, Mycobacterium tuberculosis H37Rv
cgcggaccucgaagccc

SEQ ID NO: 3334901 - RNA, 23 nt, Mycobacterium tuberculosis H37Rv
cgcggaccucgaagcccagcacc

SEQ ID NO: 3334902 - RNA, 16 nt, Mycobacterium tuberculosis H37Rv
cgcggaccucggcgac

SEQ ID NO: 3334903 - RNA, 23 nt, Mycobacterium tuberculosis H37Rv
cgcggacgauuacgccggaggca

SEQ ID NO: 3334904 - RNA, 19 nt, Mycobacterium tuberculosis H37Rv
cgcggacgugccggucccc

SEQ ID NO: 3334905 - RNA, 14 nt, Mycobacterium tuberculosis H37Rv
cgcggacucgggca

SEQ ID NO: 3334906 - RNA, 14 nt, Mycobacterium tuberculosis H37Rv
cgcggagaacgcgu

SEQ ID NO: 3334907 - RNA, 17 nt, Mycobacterium tuberculosis H37Rv
cgcggagaacgcgucgc

SEQ ID NO: 3334908 - RNA, 15 nt, Mycobacterium tuberculosis H37Rv
cgcggagccaggacg

SEQ ID NO: 3334909 - RNA, 16 nt, Mycobacterium tuberculosis H37Rv
cgcggagcgugagcca

SEQ ID NO: 3334910 - RNA, 12 nt, Mycobacterium tuberculosis H37Rv
cgcggagggcgc

SEQ ID NO: 3334911 - RNA, 14 nt, Mycobacterium tuberculosis H37Rv
cgcggaguagccgc

SEQ ID NO: 3334912 - RNA, 18 nt, Mycobacterium tuberculosis H37Rv
cgcggaguagccgcagcu

SEQ ID NO: 3334913 - RNA, 15 nt, Mycobacterium tuberculosis H37Rv
cgcggagucaagcag

SEQ ID NO: 3334914 - RNA, 18 nt, Mycobacterium tuberculosis H37Rv
cgcggagucaagcagcag

SEQ ID NO: 3334915 - RNA, 21 nt, Mycobacterium tuberculosis H37Rv
cgcggaguucgcugacggcca

SEQ ID NO: 3334916 - RNA, 15 nt, Mycobacterium tuberculosis H37Rv
cgcggauaggccgcg

SEQ ID NO: 3334917 - RNA, 23 nt, Mycobacterium tuberculosis H37Rv
cgcggauaggccgcgcggcggcg

SEQ ID NO: 3334918 - RNA, 15 nt, Mycobacterium tuberculosis H37Rv
cgcggaucaccaucg

SEQ ID NO: 3334919 - RNA, 16 nt, Mycobacterium tuberculosis H37Rv
cgcggaucaccaucgc

SEQ ID NO: 3334920 - RNA, 17 nt, Mycobacterium tuberculosis H37Rv
cgcggaucaccaucgcc

SEQ ID NO: 3334921 - RNA, 19 nt, Mycobacterium tuberculosis H37Rv
cgcggaucaccaucgccgc

SEQ ID NO: 3334922 - RNA, 24 nt, Mycobacterium tuberculosis H37Rv
cgcggaucacgaaaucgcccugac

SEQ ID NO: 3334923 - RNA, 18 nt, Mycobacterium tuberculosis H37Rv
cgcggauccgggcguggu

SEQ ID NO: 3334924 - RNA, 17 nt, Mycobacterium tuberculosis H37Rv
cgcggaucgaccgccag

SEQ ID NO: 3334925 - RNA, 17 nt, Mycobacterium tuberculosis H37Rv
cgcggaucggcggccgc

SEQ ID NO: 3334926 - RNA, 15 nt, Mycobacterium tuberculosis H37Rv
cgcggaucugggcgg

SEQ ID NO: 3334927 - RNA, 17 nt, Mycobacterium tuberculosis H37Rv
cgcggaugagcucggcc

SEQ ID NO: 3334928 - RNA, 17 nt, Mycobacterium tuberculosis H37Rv
cgcggaugcucagguca

SEQ ID NO: 3334929 - RNA, 21 nt, Mycobacterium tuberculosis H37Rv
cgcggauggguacgacaccgc

SEQ ID NO: 3334930 - RNA, 21 nt, Mycobacterium tuberculosis H37Rv
cgcggauguccaggagugcgg

SEQ ID NO: 3334931 - RNA, 19 nt, Mycobacterium tuberculosis H37Rv
cgcggauuggcacugucga

SEQ ID NO: 3334932 - RNA, 16 nt, Mycobacterium tuberculosis H37Rv
cgcggauuucucgccc

SEQ ID NO: 3334933 - RNA, 19 nt, Mycobacterium tuberculosis H37Rv
cgcggcaaaguuggccgcc

SEQ ID NO: 3334934 - RNA, 22 nt, Mycobacterium tuberculosis H37Rv
cgcggcaaaguuggccgcccga

SEQ ID NO: 3334935 - RNA, 12 nt, Mycobacterium tuberculosis H37Rv
cgcggcaagagu

SEQ ID NO: 3334936 - RNA, 19 nt, Mycobacterium tuberculosis H37Rv
cgcggcaagaguugccgga

SEQ ID NO: 3334937 - RNA, 20 nt, Mycobacterium tuberculosis H37Rv
cgcggcaauggugcgggcca

SEQ ID NO: 3334938 - RNA, 16 nt, Mycobacterium tuberculosis H37Rv
cgcggcacaccccggu

SEQ ID NO: 3334939 - RNA, 16 nt, Mycobacterium tuberculosis H37Rv
cgcggcaccacgucga

SEQ ID NO: 3334940 - RNA, 19 nt, Mycobacterium tuberculosis H37Rv
cgcggcaccacgucgacca

SEQ ID NO: 3334941 - RNA, 15 nt, Mycobacterium tuberculosis H37Rv
cgcggcacccggcuu

SEQ ID NO: 3334942 - RNA, 19 nt, Mycobacterium tuberculosis H37Rv
cgcggcacccggucggcca

SEQ ID NO: 3334943 - RNA, 18 nt, Mycobacterium tuberculosis H37Rv
cgcggcaccgauggcgca

SEQ ID NO: 3334944 - RNA, 20 nt, Mycobacterium tuberculosis H37Rv
cgcggcaccgauggcgcacc

SEQ ID NO: 3334945 - RNA, 20 nt, Mycobacterium tuberculosis H37Rv
cgcggcacgaucaaccgggu

SEQ ID NO: 3334946 - RNA, 17 nt, Mycobacterium tuberculosis H37Rv
cgcggcacgcccacagc

SEQ ID NO: 3334947 - RNA, 21 nt, Mycobacterium tuberculosis H37Rv
cgcggcacgcccacagcugac

SEQ ID NO: 3334948 - RNA, 19 nt, Mycobacterium tuberculosis H37Rv
cgcggcacggugugcggca

SEQ ID NO: 3334949 - RNA, 21 nt, Mycobacterium tuberculosis H37Rv
cgcggcacggugugcggcauu

SEQ ID NO: 3334950 - RNA, 21 nt, Mycobacterium tuberculosis H37Rv
cgcggcacuuuguagcccgcg

SEQ ID NO: 3334951 - RNA, 16 nt, Mycobacterium tuberculosis H37Rv
cgcggcagccggcgga

SEQ ID NO: 3334952 - RNA, 18 nt, Mycobacterium tuberculosis H37Rv
cgcggcagccggcggaga

SEQ ID NO: 3334953 - RNA, 12 nt, Mycobacterium tuberculosis H37Rv
cgcggcagcgga

SEQ ID NO: 3334954 - RNA, 13 nt, Mycobacterium tuberculosis H37Rv
cgcggcagcggau

SEQ ID NO: 3334955 - RNA, 15 nt, Mycobacterium tuberculosis H37Rv
cgcggcagcggauac

SEQ ID NO: 3334956 - RNA, 13 nt, Mycobacterium tuberculosis H37Rv
cgcggcagcguug

SEQ ID NO: 3334957 - RNA, 12 nt, Mycobacterium tuberculosis H37Rv
cgcggcagggcg

SEQ ID NO: 3334958 - RNA, 14 nt, Mycobacterium tuberculosis H37Rv
cgcggcaucccgcc

SEQ ID NO: 3334959 - RNA, 22 nt, Mycobacterium tuberculosis H37Rv
cgcggcaucgaauuccagccag

SEQ ID NO: 3334960 - RNA, 13 nt, Mycobacterium tuberculosis H37Rv
cgcggcaucgacg

SEQ ID NO: 3334961 - RNA, 16 nt, Mycobacterium tuberculosis H37Rv
cgcggcaucgacgcgg

SEQ ID NO: 3334962 - RNA, 23 nt, Mycobacterium tuberculosis H37Rv
cgcggcaugcaaugcuggcggcg

SEQ ID NO: 3334963 - RNA, 17 nt, Mycobacterium tuberculosis H37Rv
cgcggcauucucgagca

SEQ ID NO: 3334964 - RNA, 19 nt, Mycobacterium tuberculosis H37Rv
cgcggccaaucagcccgcc

SEQ ID NO: 3334965 - RNA, 21 nt, Mycobacterium tuberculosis H37Rv
cgcggccaaucagcccgccgg

SEQ ID NO: 3334966 - RNA, 18 nt, Mycobacterium tuberculosis H37Rv
cgcggccacaucgccagc

SEQ ID NO: 3334967 - RNA, 19 nt, Mycobacterium tuberculosis H37Rv
cgcggccacaucgccagca

SEQ ID NO: 3334968 - RNA, 20 nt, Mycobacterium tuberculosis H37Rv
cgcggccaccacaacgccag

SEQ ID NO: 3334969 - RNA, 23 nt, Mycobacterium tuberculosis H37Rv
cgcggccaccaccaggcugacgu

SEQ ID NO: 3334970 - RNA, 15 nt, Mycobacterium tuberculosis H37Rv
cgcggccaccaccgc

SEQ ID NO: 3334971 - RNA, 17 nt, Mycobacterium tuberculosis H37Rv
cgcggccaccaccgccg

SEQ ID NO: 3334972 - RNA, 20 nt, Mycobacterium tuberculosis H37Rv
cgcggccaccaccgccgccg

SEQ ID NO: 3334973 - RNA, 16 nt, Mycobacterium tuberculosis H37Rv
cgcggccacccgcgac

SEQ ID NO: 3334974 - RNA, 21 nt, Mycobacterium tuberculosis H37Rv
cgcggccacccgcgacgaugu

SEQ ID NO: 3334975 - RNA, 12 nt, Mycobacterium tuberculosis H37Rv
cgcggccaccgc

SEQ ID NO: 3334976 - RNA, 18 nt, Mycobacterium tuberculosis H37Rv
cgcggccaccgccgccgc

SEQ ID NO: 3334977 - RNA, 16 nt, Mycobacterium tuberculosis H37Rv
cgcggccaccgccugu

SEQ ID NO: 3334978 - RNA, 18 nt, Mycobacterium tuberculosis H37Rv
cgcggccaccgccuguac

SEQ ID NO: 3334979 - RNA, 19 nt, Mycobacterium tuberculosis H37Rv
cgcggccacggucagccag

SEQ ID NO: 3334980 - RNA, 16 nt, Mycobacterium tuberculosis H37Rv
cgcggccagcaccagc

SEQ ID NO: 3334981 - RNA, 18 nt, Mycobacterium tuberculosis H37Rv
cgcggccagcaccagcuc

SEQ ID NO: 3334982 - RNA, 12 nt, Mycobacterium tuberculosis H37Rv
cgcggccagcgg

SEQ ID NO: 3334983 - RNA, 14 nt, Mycobacterium tuberculosis H37Rv
cgcggccagcggga

SEQ ID NO: 3334984 - RNA, 16 nt, Mycobacterium tuberculosis H37Rv
cgcggccaguacgucg

SEQ ID NO: 3334985 - RNA, 20 nt, Mycobacterium tuberculosis H37Rv
cgcggccaguacgucgauca

SEQ ID NO: 3334986 - RNA, 18 nt, Mycobacterium tuberculosis H37Rv
cgcggccaucgccgacac

SEQ ID NO: 3334987 - RNA, 22 nt, Mycobacterium tuberculosis H37Rv
cgcggccauuagcagcacccgg

SEQ ID NO: 3334988 - RNA, 14 nt, Mycobacterium tuberculosis H37Rv
cgcggcccaccuca

SEQ ID NO: 3334989 - RNA, 21 nt, Mycobacterium tuberculosis H37Rv
cgcggcccagguccgcgugcu

SEQ ID NO: 3334990 - RNA, 13 nt, Mycobacterium tuberculosis H37Rv
cgcggccccgaau

SEQ ID NO: 3334991 - RNA, 14 nt, Mycobacterium tuberculosis H37Rv
cgcggccccgccgu

SEQ ID NO: 3334992 - RNA, 12 nt, Mycobacterium tuberculosis H37Rv
cgcggcccgaga

SEQ ID NO: 3334993 - RNA, 15 nt, Mycobacterium tuberculosis H37Rv
cgcggcccgaucggc

SEQ ID NO: 3334994 - RNA, 12 nt, Mycobacterium tuberculosis H37Rv
cgcggcccgcau

SEQ ID NO: 3334995 - RNA, 15 nt, Mycobacterium tuberculosis H37Rv
cgcggcccgccgagu

SEQ ID NO: 3334996 - RNA, 15 nt, Mycobacterium tuberculosis H37Rv
cgcggcccgcucgau

SEQ ID NO: 3334997 - RNA, 20 nt, Mycobacterium tuberculosis H37Rv
cgcggcccgcucgaucggca

SEQ ID NO: 3334998 - RNA, 21 nt, Mycobacterium tuberculosis H37Rv
cgcggcccgcucgaucggcag

SEQ ID NO: 3334999 - RNA, 23 nt, Mycobacterium tuberculosis H37Rv
cgcggcccgcucgaucggcagcc

SEQ ID NO: 3335000 - RNA, 22 nt, Mycobacterium tuberculosis H37Rv
cgcggcccggacgucggcggcc

SEQ ID NO: 3335001 - RNA, 24 nt, Mycobacterium tuberculosis H37Rv
cgcggcccucgaugccgcguagcu

SEQ ID NO: 3335002 - RNA, 20 nt, Mycobacterium tuberculosis H37Rv
cgcggcccucgccuucgccg

SEQ ID NO: 3335003 - RNA, 19 nt, Mycobacterium tuberculosis H37Rv
cgcggccgagacggcguug

SEQ ID NO: 3335004 - RNA, 20 nt, Mycobacterium tuberculosis H37Rv
cgcggccgaggucacccggu

SEQ ID NO: 3335005 - RNA, 17 nt, Mycobacterium tuberculosis H37Rv
cgcggccgaggucgcgg

SEQ ID NO: 3335006 - RNA, 20 nt, Mycobacterium tuberculosis H37Rv
cgcggccgcaagccgcgagu

SEQ ID NO: 3335007 - RNA, 24 nt, Mycobacterium tuberculosis H37Rv
cgcggccgcaagccgcgagucgcc

SEQ ID NO: 3335008 - RNA, 14 nt, Mycobacterium tuberculosis H37Rv
cgcggccgcagcca

SEQ ID NO: 3335009 - RNA, 18 nt, Mycobacterium tuberculosis H37Rv
cgcggccgcagccagcaa

SEQ ID NO: 3335010 - RNA, 12 nt, Mycobacterium tuberculosis H37Rv
cgcggccgcccc

SEQ ID NO: 3335011 - RNA, 13 nt, Mycobacterium tuberculosis H37Rv
cgcggccgcccgu

SEQ ID NO: 3335012 - RNA, 14 nt, Mycobacterium tuberculosis H37Rv
cgcggccgcccgua

SEQ ID NO: 3335013 - RNA, 15 nt, Mycobacterium tuberculosis H37Rv
cgcggccgccguccc

SEQ ID NO: 3335014 - RNA, 19 nt, Mycobacterium tuberculosis H37Rv
cgcggccgccguccccgcc

SEQ ID NO: 3335015 - RNA, 18 nt, Mycobacterium tuberculosis H37Rv
cgcggccgcggacuugcg

SEQ ID NO: 3335016 - RNA, 16 nt, Mycobacterium tuberculosis H37Rv
cgcggccgcggugacg

SEQ ID NO: 3335017 - RNA, 21 nt, Mycobacterium tuberculosis H37Rv
cgcggccggaauacccggccc

SEQ ID NO: 3335018 - RNA, 18 nt, Mycobacterium tuberculosis H37Rv
cgcggccggcgcucgcgg

SEQ ID NO: 3335019 - RNA, 14 nt, Mycobacterium tuberculosis H37Rv
cgcggccggcgucg

SEQ ID NO: 3335020 - RNA, 12 nt, Mycobacterium tuberculosis H37Rv
cgcggccgggcc

SEQ ID NO: 3335021 - RNA, 22 nt, Mycobacterium tuberculosis H37Rv
cgcggccggguggcccggcgaa

SEQ ID NO: 3335022 - RNA, 16 nt, Mycobacterium tuberculosis H37Rv
cgcggccgucgcggga

SEQ ID NO: 3335023 - RNA, 12 nt, Mycobacterium tuberculosis H37Rv
cgcggccgugaa

SEQ ID NO: 3335024 - RNA, 17 nt, Mycobacterium tuberculosis H37Rv
cgcggccguggaugucg

SEQ ID NO: 3335025 - RNA, 20 nt, Mycobacterium tuberculosis H37Rv
cgcggccguggaugucgcgg

SEQ ID NO: 3335026 - RNA, 14 nt, Mycobacterium tuberculosis H37Rv
cgcggccucccgca

SEQ ID NO: 3335027 - RNA, 20 nt, Mycobacterium tuberculosis H37Rv
cgcggccucguuguagccga

SEQ ID NO: 3335028 - RNA, 22 nt, Mycobacterium tuberculosis H37Rv
cgcggccucguuguagccgaau

SEQ ID NO: 3335029 - RNA, 16 nt, Mycobacterium tuberculosis H37Rv
cgcggccugacgcugc

SEQ ID NO: 3335030 - RNA, 12 nt, Mycobacterium tuberculosis H37Rv
cgcggccugcac

SEQ ID NO: 3335031 - RNA, 18 nt, Mycobacterium tuberculosis H37Rv
cgcggcgaacaucaccgu

SEQ ID NO: 3335032 - RNA, 20 nt, Mycobacterium tuberculosis H37Rv
cgcggcgaaccgucucgccc

SEQ ID NO: 3335033 - RNA, 20 nt, Mycobacterium tuberculosis H37Rv
cgcggcgacaagccgagccc

SEQ ID NO: 3335034 - RNA, 24 nt, Mycobacterium tuberculosis H37Rv
cgcggcgacaagccgagcccgucg

SEQ ID NO: 3335035 - RNA, 13 nt, Mycobacterium tuberculosis H37Rv
cgcggcgaccugu

SEQ ID NO: 3335036 - RNA, 17 nt, Mycobacterium tuberculosis H37Rv
cgcggcgacggcgguca

SEQ ID NO: 3335037 - RNA, 12 nt, Mycobacterium tuberculosis H37Rv
cgcggcgaucac

SEQ ID NO: 3335038 - RNA, 13 nt, Mycobacterium tuberculosis H37Rv
cgcggcgaucacc

SEQ ID NO: 3335039 - RNA, 12 nt, Mycobacterium tuberculosis H37Rv
cgcggcgaucgc

SEQ ID NO: 3335040 - RNA, 19 nt, Mycobacterium tuberculosis H37Rv
cgcggcgaugauggcgcga

SEQ ID NO: 3335041 - RNA, 18 nt, Mycobacterium tuberculosis H37Rv
cgcggcgauuacggccag

SEQ ID NO: 3335042 - RNA, 19 nt, Mycobacterium tuberculosis H37Rv
cgcggcgauuacggccagu

SEQ ID NO: 3335043 - RNA, 17 nt, Mycobacterium tuberculosis H37Rv
cgcggcgcaagcccacc

SEQ ID NO: 3335044 - RNA, 23 nt, Mycobacterium tuberculosis H37Rv
cgcggcgcacaacccgucgagcc

SEQ ID NO: 3335045 - RNA, 13 nt, Mycobacterium tuberculosis H37Rv
cgcggcgcagcac

SEQ ID NO: 3335046 - RNA, 17 nt, Mycobacterium tuberculosis H37Rv
cgcggcgcaggucgcgc

SEQ ID NO: 3335047 - RNA, 18 nt, Mycobacterium tuberculosis H37Rv
cgcggcgcaggucgcgca

SEQ ID NO: 3335048 - RNA, 19 nt, Mycobacterium tuberculosis H37Rv
cgcggcgcaggucgcgcag

SEQ ID NO: 3335049 - RNA, 20 nt, Mycobacterium tuberculosis H37Rv
cgcggcgcauuccggcgcca

SEQ ID NO: 3335050 - RNA, 12 nt, Mycobacterium tuberculosis H37Rv
cgcggcgccacc

SEQ ID NO: 3335051 - RNA, 13 nt, Mycobacterium tuberculosis H37Rv
cgcggcgccaccc

SEQ ID NO: 3335052 - RNA, 16 nt, Mycobacterium tuberculosis H37Rv
cgcggcgccacccgcg

SEQ ID NO: 3335053 - RNA, 21 nt, Mycobacterium tuberculosis H37Rv
cgcggcgccauagccgcgacc

SEQ ID NO: 3335054 - RNA, 14 nt, Mycobacterium tuberculosis H37Rv
cgcggcgcccagga

SEQ ID NO: 3335055 - RNA, 18 nt, Mycobacterium tuberculosis H37Rv
cgcggcgcccggcggauc

SEQ ID NO: 3335056 - RNA, 17 nt, Mycobacterium tuberculosis H37Rv
cgcggcgcccuggccgc

SEQ ID NO: 3335057 - RNA, 18 nt, Mycobacterium tuberculosis H37Rv
cgcggcgcccuggccgcc

SEQ ID NO: 3335058 - RNA, 14 nt, Mycobacterium tuberculosis H37Rv
cgcggcgccgcaau

SEQ ID NO: 3335059 - RNA, 13 nt, Mycobacterium tuberculosis H37Rv
cgcggcgccgcca

SEQ ID NO: 3335060 - RNA, 19 nt, Mycobacterium tuberculosis H37Rv
cgcggcgccgccacgguac

SEQ ID NO: 3335061 - RNA, 14 nt, Mycobacterium tuberculosis H37Rv
cgcggcgccgccau

SEQ ID NO: 3335062 - RNA, 12 nt, Mycobacterium tuberculosis H37Rv
cgcggcgcgaau

SEQ ID NO: 3335063 - RNA, 13 nt, Mycobacterium tuberculosis H37Rv
cgcggcgcgcuga

SEQ ID NO: 3335064 - RNA, 13 nt, Mycobacterium tuberculosis H37Rv
cgcggcgcggccg

SEQ ID NO: 3335065 - RNA, 14 nt, Mycobacterium tuberculosis H37Rv
cgcggcgcggccgc

SEQ ID NO: 3335066 - RNA, 22 nt, Mycobacterium tuberculosis H37Rv
cgcggcgcguccgggcucgcgc

SEQ ID NO: 3335067 - RNA, 21 nt, Mycobacterium tuberculosis H37Rv
cgcggcggaacaccgacgaca

SEQ ID NO: 3335068 - RNA, 22 nt, Mycobacterium tuberculosis H37Rv
cgcggcggaacaccgacgacac

SEQ ID NO: 3335069 - RNA, 22 nt, Mycobacterium tuberculosis H37Rv
cgcggcggcacuacgcagccgu

SEQ ID NO: 3335070 - RNA, 19 nt, Mycobacterium tuberculosis H37Rv
cgcggcggcagcggcgauc

SEQ ID NO: 3335071 - RNA, 14 nt, Mycobacterium tuberculosis H37Rv
cgcggcggccagcg

SEQ ID NO: 3335072 - RNA, 15 nt, Mycobacterium tuberculosis H37Rv
cgcggcggccagcgc

SEQ ID NO: 3335073 - RNA, 12 nt, Mycobacterium tuberculosis H37Rv
cgcggcggcgcu

SEQ ID NO: 3335074 - RNA, 19 nt, Mycobacterium tuberculosis H37Rv
cgcggcggcgcucuucgau

SEQ ID NO: 3335075 - RNA, 20 nt, Mycobacterium tuberculosis H37Rv
cgcggcggcgcuggcgggca

SEQ ID NO: 3335076 - RNA, 19 nt, Mycobacterium tuberculosis H37Rv
cgcggcggcguccaccugc

SEQ ID NO: 3335077 - RNA, 14 nt, Mycobacterium tuberculosis H37Rv
cgcggcggcgugcu

SEQ ID NO: 3335078 - RNA, 12 nt, Mycobacterium tuberculosis H37Rv
cgcggcgggccc

SEQ ID NO: 3335079 - RNA, 17 nt, Mycobacterium tuberculosis H37Rv
cgcggcgggcccgauga

SEQ ID NO: 3335080 - RNA, 20 nt, Mycobacterium tuberculosis H37Rv
cgcggcggguccucgcggag

SEQ ID NO: 3335081 - RNA, 17 nt, Mycobacterium tuberculosis H37Rv
cgcggcggucuggguga

SEQ ID NO: 3335082 - RNA, 15 nt, Mycobacterium tuberculosis H37Rv
cgcggcguaggcguu

SEQ ID NO: 3335083 - RNA, 16 nt, Mycobacterium tuberculosis H37Rv
cgcggcguguacgucg

SEQ ID NO: 3335084 - RNA, 20 nt, Mycobacterium tuberculosis H37Rv
cgcggcguguacgucgauca

SEQ ID NO: 3335085 - RNA, 21 nt, Mycobacterium tuberculosis H37Rv
cgcggcguuaagguacccggu

SEQ ID NO: 3335086 - RNA, 17 nt, Mycobacterium tuberculosis H37Rv
cgcggcguucgccggug

SEQ ID NO: 3335087 - RNA, 21 nt, Mycobacterium tuberculosis H37Rv
cgcggcguucgccggugguga

SEQ ID NO: 3335088 - RNA, 19 nt, Mycobacterium tuberculosis H37Rv
cgcggcguuguugcggauc

SEQ ID NO: 3335089 - RNA, 24 nt, Mycobacterium tuberculosis H37Rv
cgcggcguuguugcggaucgagca

SEQ ID NO: 3335090 - RNA, 18 nt, Mycobacterium tuberculosis H37Rv
cgcggcuaggccaagccg

SEQ ID NO: 3335091 - RNA, 21 nt, Mycobacterium tuberculosis H37Rv
cgcggcuaggccaagccgcgg

SEQ ID NO: 3335092 - RNA, 16 nt, Mycobacterium tuberculosis H37Rv
cgcggcuaggccagca

SEQ ID NO: 3335093 - RNA, 17 nt, Mycobacterium tuberculosis H37Rv
cgcggcuauggcgccgc

SEQ ID NO: 3335094 - RNA, 11 nt, Mycobacterium tuberculosis H37Rv
cgcggcugacg

SEQ ID NO: 3335095 - RNA, 22 nt, Mycobacterium tuberculosis H37Rv
cgcggcugacgguuugcggagc

SEQ ID NO: 3335096 - RNA, 19 nt, Mycobacterium tuberculosis H37Rv
cgcggcuggugucgggcgu

SEQ ID NO: 3335097 - RNA, 21 nt, Mycobacterium tuberculosis H37Rv
cgcggcugucacgccugccac

SEQ ID NO: 3335098 - RNA, 18 nt, Mycobacterium tuberculosis H37Rv
cgcggcuucaguccggcc

SEQ ID NO: 3335099 - RNA, 23 nt, Mycobacterium tuberculosis H37Rv
cgcggcuucaguccggccccccg

SEQ ID NO: 3335100 - RNA, 18 nt, Mycobacterium tuberculosis H37Rv
cgcggcuuggccaaaacc

SEQ ID NO: 3335101 - RNA, 20 nt, Mycobacterium tuberculosis H37Rv
cgcggcuuggccuagccgcg

SEQ ID NO: 3335102 - RNA, 22 nt, Mycobacterium tuberculosis H37Rv
cgcggcuugggcuugcgccgga

SEQ ID NO: 3335103 - RNA, 15 nt, Mycobacterium tuberculosis H37Rv
cgcggcuugucgccc

SEQ ID NO: 3335104 - RNA, 16 nt, Mycobacterium tuberculosis H37Rv
cgcggcuugucgcccc

SEQ ID NO: 3335105 - RNA, 15 nt, Mycobacterium tuberculosis H37Rv
cgcggcuugucgcgg

SEQ ID NO: 3335106 - RNA, 19 nt, Mycobacterium tuberculosis H37Rv
cgcggcuugucgcggugcg

SEQ ID NO: 3335107 - RNA, 23 nt, Mycobacterium tuberculosis H37Rv
cgcgggaaguccgucggucgccg

SEQ ID NO: 3335108 - RNA, 20 nt, Mycobacterium tuberculosis H37Rv
cgcgggacacgucgcgccag

SEQ ID NO: 3335109 - RNA, 17 nt, Mycobacterium tuberculosis H37Rv
cgcgggacagauggcgg

SEQ ID NO: 3335110 - RNA, 15 nt, Mycobacterium tuberculosis H37Rv
cgcgggagguacccc

SEQ ID NO: 3335111 - RNA, 22 nt, Mycobacterium tuberculosis H37Rv
cgcgggagguacccccagcacc

SEQ ID NO: 3335112 - RNA, 24 nt, Mycobacterium tuberculosis H37Rv
cgcgggauaccaauggacacaggu

SEQ ID NO: 3335113 - RNA, 13 nt, Mycobacterium tuberculosis H37Rv
cgcgggaucggug

SEQ ID NO: 3335114 - RNA, 19 nt, Mycobacterium tuberculosis H37Rv
cgcgggaucgguggcggca

SEQ ID NO: 3335115 - RNA, 20 nt, Mycobacterium tuberculosis H37Rv
cgcgggauguaccccggccc

SEQ ID NO: 3335116 - RNA, 15 nt, Mycobacterium tuberculosis H37Rv
cgcgggauugcgcgc

SEQ ID NO: 3335117 - RNA, 18 nt, Mycobacterium tuberculosis H37Rv
cgcgggcacugguggcga

SEQ ID NO: 3335118 - RNA, 15 nt, Mycobacterium tuberculosis H37Rv
cgcgggcaggucguu

SEQ ID NO: 3335119 - RNA, 18 nt, Mycobacterium tuberculosis H37Rv
cgcgggcaguggcagccc

SEQ ID NO: 3335120 - RNA, 21 nt, Mycobacterium tuberculosis H37Rv
cgcgggcaguggcagcccguc

SEQ ID NO: 3335121 - RNA, 12 nt, Mycobacterium tuberculosis H37Rv
cgcgggccacca

SEQ ID NO: 3335122 - RNA, 13 nt, Mycobacterium tuberculosis H37Rv
cgcgggccaccac

SEQ ID NO: 3335123 - RNA, 17 nt, Mycobacterium tuberculosis H37Rv
cgcgggccaccaccgag

SEQ ID NO: 3335124 - RNA, 22 nt, Mycobacterium tuberculosis H37Rv
cgcgggccaccacgcgccgcac

SEQ ID NO: 3335125 - RNA, 18 nt, Mycobacterium tuberculosis H37Rv
cgcgggccagcaccucga

SEQ ID NO: 3335126 - RNA, 17 nt, Mycobacterium tuberculosis H37Rv
cgcgggccggcgacugu

SEQ ID NO: 3335127 - RNA, 23 nt, Mycobacterium tuberculosis H37Rv
cgcgggcgaccaccgcggcaugu

SEQ ID NO: 3335128 - RNA, 24 nt, Mycobacterium tuberculosis H37Rv
cgcgggcgagaacccacgcaugca

SEQ ID NO: 3335129 - RNA, 15 nt, Mycobacterium tuberculosis H37Rv
cgcgggcgccgggaa

SEQ ID NO: 3335130 - RNA, 20 nt, Mycobacterium tuberculosis H37Rv
cgcgggcgccgggaagcccc

SEQ ID NO: 3335131 - RNA, 15 nt, Mycobacterium tuberculosis H37Rv
cgcgggcgcgguucg

SEQ ID NO: 3335132 - RNA, 16 nt, Mycobacterium tuberculosis H37Rv
cgcgggcggaucgccg

SEQ ID NO: 3335133 - RNA, 19 nt, Mycobacterium tuberculosis H37Rv
cgcgggcgguaaucgcgag

SEQ ID NO: 3335134 - RNA, 22 nt, Mycobacterium tuberculosis H37Rv
cgcgggcgguaaucgcgagacc

SEQ ID NO: 3335135 - RNA, 15 nt, Mycobacterium tuberculosis H37Rv
cgcgggcgucccgca

SEQ ID NO: 3335136 - RNA, 18 nt, Mycobacterium tuberculosis H37Rv
cgcgggcgucccgcauac

SEQ ID NO: 3335137 - RNA, 16 nt, Mycobacterium tuberculosis H37Rv
cgcgggcgugccgacc

SEQ ID NO: 3335138 - RNA, 17 nt, Mycobacterium tuberculosis H37Rv
cgcgggcgugcuacacc

SEQ ID NO: 3335139 - RNA, 17 nt, Mycobacterium tuberculosis H37Rv
cgcgggcguuggccagc

SEQ ID NO: 3335140 - RNA, 13 nt, Mycobacterium tuberculosis H37Rv
cgcgggcucacau

SEQ ID NO: 3335141 - RNA, 12 nt, Mycobacterium tuberculosis H37Rv
cgcgggcucccc

SEQ ID NO: 3335142 - RNA, 12 nt, Mycobacterium tuberculosis H37Rv
cgcgggcugacc

SEQ ID NO: 3335143 - RNA, 19 nt, Mycobacterium tuberculosis H37Rv
cgcggggaugucgaccgcg

SEQ ID NO: 3335144 - RNA, 14 nt, Mycobacterium tuberculosis H37Rv
cgcggggcccacac

SEQ ID NO: 3335145 - RNA, 12 nt, Mycobacterium tuberculosis H37Rv
cgcggggccgcc

SEQ ID NO: 3335146 - RNA, 13 nt, Mycobacterium tuberculosis H37Rv
cgcggggccgccg

SEQ ID NO: 3335147 - RNA, 13 nt, Mycobacterium tuberculosis H37Rv
cgcggggccggcc

SEQ ID NO: 3335148 - RNA, 17 nt, Mycobacterium tuberculosis H37Rv
cgcggggccggccggca

SEQ ID NO: 3335149 - RNA, 19 nt, Mycobacterium tuberculosis H37Rv
cgcggggcgcaccgcggac

SEQ ID NO: 3335150 - RNA, 18 nt, Mycobacterium tuberculosis H37Rv
cgcggggcggcugcgggc

SEQ ID NO: 3335151 - RNA, 14 nt, Mycobacterium tuberculosis H37Rv
cgcggggcucaacc

SEQ ID NO: 3335152 - RNA, 21 nt, Mycobacterium tuberculosis H37Rv
cgcggggucugucgaacuggu

SEQ ID NO: 3335153 - RNA, 20 nt, Mycobacterium tuberculosis H37Rv
cgcgggguugauugacccgu

SEQ ID NO: 3335154 - RNA, 15 nt, Mycobacterium tuberculosis H37Rv
cgcggguccagccac

SEQ ID NO: 3335155 - RNA, 13 nt, Mycobacterium tuberculosis H37Rv
cgcgggucccggc

SEQ ID NO: 3335156 - RNA, 19 nt, Mycobacterium tuberculosis H37Rv
cgcgggucgugccagcagc

SEQ ID NO: 3335157 - RNA, 21 nt, Mycobacterium tuberculosis H37Rv
cgcgggugccagaucggcggg

SEQ ID NO: 3335158 - RNA, 20 nt, Mycobacterium tuberculosis H37Rv
cgcgggugccgacgucggca

SEQ ID NO: 3335159 - RNA, 14 nt, Mycobacterium tuberculosis H37Rv
cgcgggugccgggc

SEQ ID NO: 3335160 - RNA, 19 nt, Mycobacterium tuberculosis H37Rv
cgcgggugccgggcaugau

SEQ ID NO: 3335161 - RNA, 22 nt, Mycobacterium tuberculosis H37Rv
cgcgggugccgggcaugaucac

SEQ ID NO: 3335162 - RNA, 21 nt, Mycobacterium tuberculosis H37Rv
cgcgggugcgcugcagcgaga

SEQ ID NO: 3335163 - RNA, 14 nt, Mycobacterium tuberculosis H37Rv
cgcggguggcagcg

SEQ ID NO: 3335164 - RNA, 23 nt, Mycobacterium tuberculosis H37Rv
cgcgggugguucaccucggcgac

SEQ ID NO: 3335165 - RNA, 17 nt, Mycobacterium tuberculosis H37Rv
cgcggguguuccacacc

SEQ ID NO: 3335166 - RNA, 15 nt, Mycobacterium tuberculosis H37Rv
cgcggguucggcugc

SEQ ID NO: 3335167 - RNA, 14 nt, Mycobacterium tuberculosis H37Rv
cgcgguaaagcccc

SEQ ID NO: 3335168 - RNA, 15 nt, Mycobacterium tuberculosis H37Rv
cgcgguaaagccccg

SEQ ID NO: 3335169 - RNA, 17 nt, Mycobacterium tuberculosis H37Rv
cgcgguaccgcucgggc

SEQ ID NO: 3335170 - RNA, 20 nt, Mycobacterium tuberculosis H37Rv
cgcgguaccgcucgggcgcg

SEQ ID NO: 3335171 - RNA, 14 nt, Mycobacterium tuberculosis H37Rv
cgcgguaccggugu

SEQ ID NO: 3335172 - RNA, 15 nt, Mycobacterium tuberculosis H37Rv
cgcgguacugcgcag

SEQ ID NO: 3335173 - RNA, 15 nt, Mycobacterium tuberculosis H37Rv
cgcgguagacgccgc

SEQ ID NO: 3335174 - RNA, 15 nt, Mycobacterium tuberculosis H37Rv
cgcgguagccgagcu

SEQ ID NO: 3335175 - RNA, 17 nt, Mycobacterium tuberculosis H37Rv
cgcgguagccgcggcca

SEQ ID NO: 3335176 - RNA, 19 nt, Mycobacterium tuberculosis H37Rv
cgcgguagccgcggccaca

SEQ ID NO: 3335177 - RNA, 13 nt, Mycobacterium tuberculosis H37Rv
cgcgguagcucgu

SEQ ID NO: 3335178 - RNA, 16 nt, Mycobacterium tuberculosis H37Rv
cgcgguagcucgucga

SEQ ID NO: 3335179 - RNA, 19 nt, Mycobacterium tuberculosis H37Rv
cgcgguaggugcaugucga

SEQ ID NO: 3335180 - RNA, 21 nt, Mycobacterium tuberculosis H37Rv
cgcggucaaauccagcagcca

SEQ ID NO: 3335181 - RNA, 16 nt, Mycobacterium tuberculosis H37Rv
cgcggucaccgcguca

SEQ ID NO: 3335182 - RNA, 12 nt, Mycobacterium tuberculosis H37Rv
cgcggucagcgg

SEQ ID NO: 3335183 - RNA, 17 nt, Mycobacterium tuberculosis H37Rv
cgcggucagcgggucga

SEQ ID NO: 3335184 - RNA, 19 nt, Mycobacterium tuberculosis H37Rv
cgcggucagcucggcagca

SEQ ID NO: 3335185 - RNA, 14 nt, Mycobacterium tuberculosis H37Rv
cgcggucauggcga

SEQ ID NO: 3335186 - RNA, 21 nt, Mycobacterium tuberculosis H37Rv
cgcggucauggcgacggucgu

SEQ ID NO: 3335187 - RNA, 14 nt, Mycobacterium tuberculosis H37Rv
cgcgguccuccaga

SEQ ID NO: 3335188 - RNA, 18 nt, Mycobacterium tuberculosis H37Rv
cgcgguccucgagccgau

SEQ ID NO: 3335189 - RNA, 16 nt, Mycobacterium tuberculosis H37Rv
cgcggucgacgacgcc

SEQ ID NO: 3335190 - RNA, 20 nt, Mycobacterium tuberculosis H37Rv
cgcggucgagguccuugagg

SEQ ID NO: 3335191 - RNA, 18 nt, Mycobacterium tuberculosis H37Rv
cgcggucgaucaggccgu

SEQ ID NO: 3335192 - RNA, 17 nt, Mycobacterium tuberculosis H37Rv
cgcggucgcagcagacc

SEQ ID NO: 3335193 - RNA, 22 nt, Mycobacterium tuberculosis H37Rv
cgcggucgccaagaucgggugg

SEQ ID NO: 3335194 - RNA, 16 nt, Mycobacterium tuberculosis H37Rv
cgcggucgcugcgaug

SEQ ID NO: 3335195 - RNA, 12 nt, Mycobacterium tuberculosis H37Rv
cgcggucggacc

SEQ ID NO: 3335196 - RNA, 18 nt, Mycobacterium tuberculosis H37Rv
cgcggucggagucgagca

SEQ ID NO: 3335197 - RNA, 22 nt, Mycobacterium tuberculosis H37Rv
cgcggucggagucgagcacacc

SEQ ID NO: 3335198 - RNA, 12 nt, Mycobacterium tuberculosis H37Rv
cgcggucggcag

SEQ ID NO: 3335199 - RNA, 14 nt, Mycobacterium tuberculosis H37Rv
cgcggucggcagcg

SEQ ID NO: 3335200 - RNA, 16 nt, Mycobacterium tuberculosis H37Rv
cgcggucggcagcgac

SEQ ID NO: 3335201 - RNA, 14 nt, Mycobacterium tuberculosis H37Rv
cgcggucggccacc

SEQ ID NO: 3335202 - RNA, 17 nt, Mycobacterium tuberculosis H37Rv
cgcggucggccaccaac

SEQ ID NO: 3335203 - RNA, 15 nt, Mycobacterium tuberculosis H37Rv
cgcggucggcgugca

SEQ ID NO: 3335204 - RNA, 19 nt, Mycobacterium tuberculosis H37Rv
cgcggucgugaucagcagg

SEQ ID NO: 3335205 - RNA, 22 nt, Mycobacterium tuberculosis H37Rv
cgcggucgugaucagcaggacg

SEQ ID NO: 3335206 - RNA, 20 nt, Mycobacterium tuberculosis H37Rv
cgcggucucggugccgagca

SEQ ID NO: 3335207 - RNA, 19 nt, Mycobacterium tuberculosis H37Rv
cgcggucugaccgcgucgg

SEQ ID NO: 3335208 - RNA, 23 nt, Mycobacterium tuberculosis H37Rv
cgcggucugcuccaggcgcgccg

SEQ ID NO: 3335209 - RNA, 21 nt, Mycobacterium tuberculosis H37Rv
cgcggucuugacaccgccggg

SEQ ID NO: 3335210 - RNA, 13 nt, Mycobacterium tuberculosis H37Rv
cgcggugaccggg

SEQ ID NO: 3335211 - RNA, 23 nt, Mycobacterium tuberculosis H37Rv
cgcggugacgauugccaccaaug

SEQ ID NO: 3335212 - RNA, 13 nt, Mycobacterium tuberculosis H37Rv
cgcggugacggcg

SEQ ID NO: 3335213 - RNA, 16 nt, Mycobacterium tuberculosis H37Rv
cgcggugacggcggcu

SEQ ID NO: 3335214 - RNA, 16 nt, Mycobacterium tuberculosis H37Rv
cgcggugauggucacc

SEQ ID NO: 3335215 - RNA, 13 nt, Mycobacterium tuberculosis H37Rv
cgcggugcccgcg

SEQ ID NO: 3335216 - RNA, 18 nt, Mycobacterium tuberculosis H37Rv
cgcggugcccugccggca

SEQ ID NO: 3335217 - RNA, 16 nt, Mycobacterium tuberculosis H37Rv
cgcggugccgccaccg

SEQ ID NO: 3335218 - RNA, 15 nt, Mycobacterium tuberculosis H37Rv
cgcggugccggccgu

SEQ ID NO: 3335219 - RNA, 15 nt, Mycobacterium tuberculosis H37Rv
cgcggugccggcgga

SEQ ID NO: 3335220 - RNA, 14 nt, Mycobacterium tuberculosis H37Rv
cgcggugcgcguga

SEQ ID NO: 3335221 - RNA, 17 nt, Mycobacterium tuberculosis H37Rv
cgcggugcgcgugacga

SEQ ID NO: 3335222 - RNA, 20 nt, Mycobacterium tuberculosis H37Rv
cgcggugcgcgugacgacca

SEQ ID NO: 3335223 - RNA, 20 nt, Mycobacterium tuberculosis H37Rv
cgcggugcggccacucgccc

SEQ ID NO: 3335224 - RNA, 14 nt, Mycobacterium tuberculosis H37Rv
cgcgguggaugcga

SEQ ID NO: 3335225 - RNA, 17 nt, Mycobacterium tuberculosis H37Rv
cgcgguggccccgaugg

SEQ ID NO: 3335226 - RNA, 14 nt, Mycobacterium tuberculosis H37Rv
cgcgguggcggcga

SEQ ID NO: 3335227 - RNA, 17 nt, Mycobacterium tuberculosis H37Rv
cgcgguggcggcgagca

SEQ ID NO: 3335228 - RNA, 14 nt, Mycobacterium tuberculosis H37Rv
cgcgguggcggugu

SEQ ID NO: 3335229 - RNA, 15 nt, Mycobacterium tuberculosis H37Rv
cgcgguggcgguguc

SEQ ID NO: 3335230 - RNA, 22 nt, Mycobacterium tuberculosis H37Rv
cgcgguggcggugucggcgccg

SEQ ID NO: 3335231 - RNA, 18 nt, Mycobacterium tuberculosis H37Rv
cgcgguggggucgacgca

SEQ ID NO: 3335232 - RNA, 19 nt, Mycobacterium tuberculosis H37Rv
cgcgguggugauugacggu

SEQ ID NO: 3335233 - RNA, 20 nt, Mycobacterium tuberculosis H37Rv
cgcgguguagaagcgggcgu

SEQ ID NO: 3335234 - RNA, 16 nt, Mycobacterium tuberculosis H37Rv
cgcggugugcggcagc

SEQ ID NO: 3335235 - RNA, 18 nt, Mycobacterium tuberculosis H37Rv
cgcggugugcggcagccc

SEQ ID NO: 3335236 - RNA, 16 nt, Mycobacterium tuberculosis H37Rv
cgcgguguucgcggca

SEQ ID NO: 3335237 - RNA, 18 nt, Mycobacterium tuberculosis H37Rv
cgcgguguucgcggcauc

SEQ ID NO: 3335238 - RNA, 21 nt, Mycobacterium tuberculosis H37Rv
cgcgguguugcggugaucggg

SEQ ID NO: 3335239 - RNA, 17 nt, Mycobacterium tuberculosis H37Rv
cgcgguguuggacgcgg

SEQ ID NO: 3335240 - RNA, 15 nt, Mycobacterium tuberculosis H37Rv
cgcgguucgaugaca

SEQ ID NO: 3335241 - RNA, 16 nt, Mycobacterium tuberculosis H37Rv
cgcgguucgucggcga

SEQ ID NO: 3335242 - RNA, 22 nt, Mycobacterium tuberculosis H37Rv
cgcgguucgucggcgagcgcgg

SEQ ID NO: 3335243 - RNA, 22 nt, Mycobacterium tuberculosis H37Rv
cgcgguuguccuccgacggggg

SEQ ID NO: 3335244 - RNA, 17 nt, Mycobacterium tuberculosis H37Rv
cgcgguugugacgguga

SEQ ID NO: 3335245 - RNA, 18 nt, Mycobacterium tuberculosis H37Rv
cgcgguugugacggugaa

SEQ ID NO: 3335246 - RNA, 14 nt, Mycobacterium tuberculosis H37Rv
cgcgguuucggcga

SEQ ID NO: 3335247 - RNA, 16 nt, Mycobacterium tuberculosis H37Rv
cgcgguuucggcguca

SEQ ID NO: 3335248 - RNA, 13 nt, Mycobacterium tuberculosis H37Rv
cgcgguuuucggc

SEQ ID NO: 3335249 - RNA, 18 nt, Mycobacterium tuberculosis H37Rv
cgcguaaaccggcugacc

SEQ ID NO: 3335250 - RNA, 18 nt, Mycobacterium tuberculosis H37Rv
cgcguagaccccaaucga

SEQ ID NO: 3335251 - RNA, 17 nt, Mycobacterium tuberculosis H37Rv
cgcguagagcagcagcg

SEQ ID NO: 3335252 - RNA, 22 nt, Mycobacterium tuberculosis H37Rv
cgcguagaguguccccggcugc

SEQ ID NO: 3335253 - RNA, 12 nt, Mycobacterium tuberculosis H37Rv
cgcguagccgug

SEQ ID NO: 3335254 - RNA, 21 nt, Mycobacterium tuberculosis H37Rv
cgcguagccguggagcacagc

SEQ ID NO: 3335255 - RNA, 22 nt, Mycobacterium tuberculosis H37Rv
cgcguaggccgcuaugcagguc

SEQ ID NO: 3335256 - RNA, 18 nt, Mycobacterium tuberculosis H37Rv
cgcguagguggccagcgc

SEQ ID NO: 3335257 - RNA, 19 nt, Mycobacterium tuberculosis H37Rv
cgcguagugcuccguccga

SEQ ID NO: 3335258 - RNA, 13 nt, Mycobacterium tuberculosis H37Rv
cgcguaguggugg

SEQ ID NO: 3335259 - RNA, 14 nt, Mycobacterium tuberculosis H37Rv
cgcguaucccagau

SEQ ID NO: 3335260 - RNA, 17 nt, Mycobacterium tuberculosis H37Rv
cgcguauucggcaucgc

SEQ ID NO: 3335261 - RNA, 19 nt, Mycobacterium tuberculosis H37Rv
cgcguauucggcaucgccg

SEQ ID NO: 3335262 - RNA, 15 nt, Mycobacterium tuberculosis H37Rv
cgcgucaaacaccuc

SEQ ID NO: 3335263 - RNA, 13 nt, Mycobacterium tuberculosis H37Rv
cgcgucaagucug

SEQ ID NO: 3335264 - RNA, 14 nt, Mycobacterium tuberculosis H37Rv
cgcgucacaccagc

SEQ ID NO: 3335265 - RNA, 20 nt, Mycobacterium tuberculosis H37Rv
cgcgucacaccagcgggcau

SEQ ID NO: 3335266 - RNA, 23 nt, Mycobacterium tuberculosis H37Rv
cgcgucacaccagcgggcaucgc

SEQ ID NO: 3335267 - RNA, 16 nt, Mycobacterium tuberculosis H37Rv
cgcgucagcggcgagc

SEQ ID NO: 3335268 - RNA, 15 nt, Mycobacterium tuberculosis H37Rv
cgcgucaggccagcg

SEQ ID NO: 3335269 - RNA, 13 nt, Mycobacterium tuberculosis H37Rv
cgcgucaucaccg

SEQ ID NO: 3335270 - RNA, 16 nt, Mycobacterium tuberculosis H37Rv
cgcguccagcgcggcc

SEQ ID NO: 3335271 - RNA, 17 nt, Mycobacterium tuberculosis H37Rv
cgcguccagcgcggccu

SEQ ID NO: 3335272 - RNA, 16 nt, Mycobacterium tuberculosis H37Rv
cgcguccaggugcgcc

SEQ ID NO: 3335273 - RNA, 21 nt, Mycobacterium tuberculosis H37Rv
cgcguccccagcgccaccguu

SEQ ID NO: 3335274 - RNA, 18 nt, Mycobacterium tuberculosis H37Rv
cgcguccgggcagccgcg

SEQ ID NO: 3335275 - RNA, 21 nt, Mycobacterium tuberculosis H37Rv
cgcguccgggcagccgcgccg

SEQ ID NO: 3335276 - RNA, 16 nt, Mycobacterium tuberculosis H37Rv
cgcguccggugcacca

SEQ ID NO: 3335277 - RNA, 18 nt, Mycobacterium tuberculosis H37Rv
cgcguccggugcaccagg

SEQ ID NO: 3335278 - RNA, 17 nt, Mycobacterium tuberculosis H37Rv
cgcguccuuuuccgccg

SEQ ID NO: 3335279 - RNA, 15 nt, Mycobacterium tuberculosis H37Rv
cgcgucgaagccggg

SEQ ID NO: 3335280 - RNA, 15 nt, Mycobacterium tuberculosis H37Rv
cgcgucgaccggaca

SEQ ID NO: 3335281 - RNA, 14 nt, Mycobacterium tuberculosis H37Rv
cgcgucgacgagcg

SEQ ID NO: 3335282 - RNA, 15 nt, Mycobacterium tuberculosis H37Rv
cgcgucgagcagcac

SEQ ID NO: 3335283 - RNA, 20 nt, Mycobacterium tuberculosis H37Rv
cgcgucgagcgacccccagc

SEQ ID NO: 3335284 - RNA, 15 nt, Mycobacterium tuberculosis H37Rv
cgcgucgagugccgc

SEQ ID NO: 3335285 - RNA, 14 nt, Mycobacterium tuberculosis H37Rv
cgcgucgccagaua

SEQ ID NO: 3335286 - RNA, 14 nt, Mycobacterium tuberculosis H37Rv
cgcgucgccgauga

SEQ ID NO: 3335287 - RNA, 14 nt, Mycobacterium tuberculosis H37Rv
cgcgucgccggccu

SEQ ID NO: 3335288 - RNA, 22 nt, Mycobacterium tuberculosis H37Rv
cgcgucgcgaaauagcugcgga

SEQ ID NO: 3335289 - RNA, 13 nt, Mycobacterium tuberculosis H37Rv
cgcgucgcgcgcc

SEQ ID NO: 3335290 - RNA, 23 nt, Mycobacterium tuberculosis H37Rv
cgcgucgcgcgccuuggccagcg

SEQ ID NO: 3335291 - RNA, 15 nt, Mycobacterium tuberculosis H37Rv
cgcgucgcgcgcggc

SEQ ID NO: 3335292 - RNA, 12 nt, Mycobacterium tuberculosis H37Rv
cgcgucgcggga

SEQ ID NO: 3335293 - RNA, 23 nt, Mycobacterium tuberculosis H37Rv
cgcgucgcgugggaugucgagcg

SEQ ID NO: 3335294 - RNA, 12 nt, Mycobacterium tuberculosis H37Rv
cgcgucggaccg

SEQ ID NO: 3335295 - RNA, 15 nt, Mycobacterium tuberculosis H37Rv
cgcgucggagccggg

SEQ ID NO: 3335296 - RNA, 15 nt, Mycobacterium tuberculosis H37Rv
cgcgucggcggccag

SEQ ID NO: 3335297 - RNA, 13 nt, Mycobacterium tuberculosis H37Rv
cgcgucggcguug

SEQ ID NO: 3335298 - RNA, 14 nt, Mycobacterium tuberculosis H37Rv
cgcgucggcguugg

SEQ ID NO: 3335299 - RNA, 21 nt, Mycobacterium tuberculosis H37Rv
cgcgucggcguuggggcucgu

SEQ ID NO: 3335300 - RNA, 13 nt, Mycobacterium tuberculosis H37Rv
cgcgucgggccgc

SEQ ID NO: 3335301 - RNA, 14 nt, Mycobacterium tuberculosis H37Rv
cgcgucggucaccg

SEQ ID NO: 3335302 - RNA, 15 nt, Mycobacterium tuberculosis H37Rv
cgcgucggucaccga

SEQ ID NO: 3335303 - RNA, 16 nt, Mycobacterium tuberculosis H37Rv
cgcgucguagcgcucg

SEQ ID NO: 3335304 - RNA, 20 nt, Mycobacterium tuberculosis H37Rv
cgcgucguagcgcucgugac

SEQ ID NO: 3335305 - RNA, 13 nt, Mycobacterium tuberculosis H37Rv
cgcgucgucgaga

SEQ ID NO: 3335306 - RNA, 13 nt, Mycobacterium tuberculosis H37Rv
cgcgucgucgagu

SEQ ID NO: 3335307 - RNA, 16 nt, Mycobacterium tuberculosis H37Rv
cgcgucgucgagucga

SEQ ID NO: 3335308 - RNA, 19 nt, Mycobacterium tuberculosis H37Rv
cgcgucgucggucaaaccg

SEQ ID NO: 3335309 - RNA, 22 nt, Mycobacterium tuberculosis H37Rv
cgcgucuacgucguccagcacc

SEQ ID NO: 3335310 - RNA, 13 nt, Mycobacterium tuberculosis H37Rv
cgcgucugcucgc

SEQ ID NO: 3335311 - RNA, 17 nt, Mycobacterium tuberculosis H37Rv
cgcgucugcucgccagc

SEQ ID NO: 3335312 - RNA, 14 nt, Mycobacterium tuberculosis H37Rv
cgcgucugcucggc

SEQ ID NO: 3335313 - RNA, 21 nt, Mycobacterium tuberculosis H37Rv
cgcgucuuggugcgcgucagc

SEQ ID NO: 3335314 - RNA, 19 nt, Mycobacterium tuberculosis H37Rv
cgcgugaccgacugcgggu

SEQ ID NO: 3335315 - RNA, 16 nt, Mycobacterium tuberculosis H37Rv
cgcgugacgaccagcc

SEQ ID NO: 3335316 - RNA, 16 nt, Mycobacterium tuberculosis H37Rv
cgcgugacguaccacg

SEQ ID NO: 3335317 - RNA, 14 nt, Mycobacterium tuberculosis H37Rv
cgcgugcaccgagc

SEQ ID NO: 3335318 - RNA, 19 nt, Mycobacterium tuberculosis H37Rv
cgcgugcaccgagccgucg

SEQ ID NO: 3335319 - RNA, 22 nt, Mycobacterium tuberculosis H37Rv
cgcgugcagccauugacggucc

SEQ ID NO: 3335320 - RNA, 20 nt, Mycobacterium tuberculosis H37Rv
cgcgugcagcggcgccgcca

SEQ ID NO: 3335321 - RNA, 19 nt, Mycobacterium tuberculosis H37Rv
cgcgugcaggcugucaauc

SEQ ID NO: 3335322 - RNA, 17 nt, Mycobacterium tuberculosis H37Rv
cgcgugcaucgccugcg

SEQ ID NO: 3335323 - RNA, 14 nt, Mycobacterium tuberculosis H37Rv
cgcgugccacucga

SEQ ID NO: 3335324 - RNA, 18 nt, Mycobacterium tuberculosis H37Rv
cgcgugccacucgaugcu

SEQ ID NO: 3335325 - RNA, 19 nt, Mycobacterium tuberculosis H37Rv
cgcgugcccguggugaugg

SEQ ID NO: 3335326 - RNA, 22 nt, Mycobacterium tuberculosis H37Rv
cgcgugccgcaaccggcgaucg

SEQ ID NO: 3335327 - RNA, 17 nt, Mycobacterium tuberculosis H37Rv
cgcgugccgcccgccuc

SEQ ID NO: 3335328 - RNA, 18 nt, Mycobacterium tuberculosis H37Rv
cgcgugccgcccgccucu

SEQ ID NO: 3335329 - RNA, 17 nt, Mycobacterium tuberculosis H37Rv
cgcgugcgcaucccgaa

SEQ ID NO: 3335330 - RNA, 13 nt, Mycobacterium tuberculosis H37Rv
cgcgugcggcugc

SEQ ID NO: 3335331 - RNA, 16 nt, Mycobacterium tuberculosis H37Rv
cgcgugcggcugccag

SEQ ID NO: 3335332 - RNA, 18 nt, Mycobacterium tuberculosis H37Rv
cgcgugcgggggacgggu

SEQ ID NO: 3335333 - RNA, 23 nt, Mycobacterium tuberculosis H37Rv
cgcgugcucguaguaguccagca

SEQ ID NO: 3335334 - RNA, 12 nt, Mycobacterium tuberculosis H37Rv
cgcgugcugagu

SEQ ID NO: 3335335 - RNA, 21 nt, Mycobacterium tuberculosis H37Rv
cgcgugcugcagaucggccgg

SEQ ID NO: 3335336 - RNA, 21 nt, Mycobacterium tuberculosis H37Rv
cgcgugcugccguauccaggc

SEQ ID NO: 3335337 - RNA, 22 nt, Mycobacterium tuberculosis H37Rv
cgcgugcugccguauccaggcg

SEQ ID NO: 3335338 - RNA, 14 nt, Mycobacterium tuberculosis H37Rv
cgcgugcugcggac

SEQ ID NO: 3335339 - RNA, 20 nt, Mycobacterium tuberculosis H37Rv
cgcguggaacuugcgcaggu

SEQ ID NO: 3335340 - RNA, 20 nt, Mycobacterium tuberculosis H37Rv
cgcguggcauccagcagcgc

SEQ ID NO: 3335341 - RNA, 20 nt, Mycobacterium tuberculosis H37Rv
cgcguggccgccggcgcugg

SEQ ID NO: 3335342 - RNA, 21 nt, Mycobacterium tuberculosis H37Rv
cgcguggcgcaccaccgcccc

SEQ ID NO: 3335343 - RNA, 20 nt, Mycobacterium tuberculosis H37Rv
cgcguggcuggcggcgaccg

SEQ ID NO: 3335344 - RNA, 17 nt, Mycobacterium tuberculosis H37Rv
cgcgugguaccgcuugu

SEQ ID NO: 3335345 - RNA, 18 nt, Mycobacterium tuberculosis H37Rv
cgcguggugcugaccgcg

SEQ ID NO: 3335346 - RNA, 14 nt, Mycobacterium tuberculosis H37Rv
cgcgugguucgguc

SEQ ID NO: 3335347 - RNA, 19 nt, Mycobacterium tuberculosis H37Rv
cgcguguaccgcgacguag

SEQ ID NO: 3335348 - RNA, 16 nt, Mycobacterium tuberculosis H37Rv
cgcguguacggcggcu

SEQ ID NO: 3335349 - RNA, 21 nt, Mycobacterium tuberculosis H37Rv
cgcguucaacaccgccgaccu

SEQ ID NO: 3335350 - RNA, 17 nt, Mycobacterium tuberculosis H37Rv
cgcguuccuccagcagc

SEQ ID NO: 3335351 - RNA, 14 nt, Mycobacterium tuberculosis H37Rv
cgcguucgaccucg

SEQ ID NO: 3335352 - RNA, 22 nt, Mycobacterium tuberculosis H37Rv
cgcguucgcgcaaaugccugcu

SEQ ID NO: 3335353 - RNA, 14 nt, Mycobacterium tuberculosis H37Rv
cgcguucggcaccu

SEQ ID NO: 3335354 - RNA, 16 nt, Mycobacterium tuberculosis H37Rv
cgcguucugcaccagc

SEQ ID NO: 3335355 - RNA, 19 nt, Mycobacterium tuberculosis H37Rv
cgcguugaaggcgccggug

SEQ ID NO: 3335356 - RNA, 19 nt, Mycobacterium tuberculosis H37Rv
cgcguugaccaucacgccc

SEQ ID NO: 3335357 - RNA, 22 nt, Mycobacterium tuberculosis H37Rv
cgcguugagcucaauggcuucg

SEQ ID NO: 3335358 - RNA, 20 nt, Mycobacterium tuberculosis H37Rv
cgcguugaugaccgccgccg

SEQ ID NO: 3335359 - RNA, 19 nt, Mycobacterium tuberculosis H37Rv
cgcguugcagaccaccagu

SEQ ID NO: 3335360 - RNA, 19 nt, Mycobacterium tuberculosis H37Rv
cgcguugccggucgcaugg

SEQ ID NO: 3335361 - RNA, 18 nt, Mycobacterium tuberculosis H37Rv
cgcguugcguaucgaccc

SEQ ID NO: 3335362 - RNA, 17 nt, Mycobacterium tuberculosis H37Rv
cgcguuggacaauucga

SEQ ID NO: 3335363 - RNA, 12 nt, Mycobacterium tuberculosis H37Rv
cgcguuggccac

SEQ ID NO: 3335364 - RNA, 16 nt, Mycobacterium tuberculosis H37Rv
cgcguuggcccgccug

SEQ ID NO: 3335365 - RNA, 14 nt, Mycobacterium tuberculosis H37Rv
cgcguuggguugaa

SEQ ID NO: 3335366 - RNA, 15 nt, Mycobacterium tuberculosis H37Rv
cgcguugucggcgcu

SEQ ID NO: 3335367 - RNA, 21 nt, Mycobacterium tuberculosis H37Rv
cgcguuuauaccucgccgccc

SEQ ID NO: 3335368 - RNA, 22 nt, Mycobacterium tuberculosis H37Rv
cgcguuucacgaaacccagucg

SEQ ID NO: 3335369 - RNA, 17 nt, Mycobacterium tuberculosis H37Rv
cgcguuucgccggaugc

SEQ ID NO: 3335370 - RNA, 17 nt, Mycobacterium tuberculosis H37Rv
cgcguuugcgaagccca

SEQ ID NO: 3335371 - RNA, 23 nt, Mycobacterium tuberculosis H37Rv
cgcuaaaacgccagucgagcacc

SEQ ID NO: 3335372 - RNA, 15 nt, Mycobacterium tuberculosis H37Rv
cgcuaaaccgucgcu

SEQ ID NO: 3335373 - RNA, 22 nt, Mycobacterium tuberculosis H37Rv
cgcuaacagauuguccggccgg

SEQ ID NO: 3335374 - RNA, 20 nt, Mycobacterium tuberculosis H37Rv
cgcuaaggugggcacagcga

SEQ ID NO: 3335375 - RNA, 17 nt, Mycobacterium tuberculosis H37Rv
cgcuacaucagaaucag

SEQ ID NO: 3335376 - RNA, 19 nt, Mycobacterium tuberculosis H37Rv
cgcuaccccagccggcagc

SEQ ID NO: 3335377 - RNA, 16 nt, Mycobacterium tuberculosis H37Rv
cgcuacccgcgcgacc

SEQ ID NO: 3335378 - RNA, 13 nt, Mycobacterium tuberculosis H37Rv
cgcuaccgcccgc

SEQ ID NO: 3335379 - RNA, 21 nt, Mycobacterium tuberculosis H37Rv
cgcuaccgcccgcgccaccgg

SEQ ID NO: 3335380 - RNA, 23 nt, Mycobacterium tuberculosis H37Rv
cgcuaccuguguugagcggcagc

SEQ ID NO: 3335381 - RNA, 15 nt, Mycobacterium tuberculosis H37Rv
cgcuaccuucuuggc

SEQ ID NO: 3335382 - RNA, 16 nt, Mycobacterium tuberculosis H37Rv
cgcuaccuucuuggcu

SEQ ID NO: 3335383 - RNA, 11 nt, Mycobacterium tuberculosis H37Rv
cgcuacgcgcg

SEQ ID NO: 3335384 - RNA, 14 nt, Mycobacterium tuberculosis H37Rv
cgcuacgcgcgcuc

SEQ ID NO: 3335385 - RNA, 15 nt, Mycobacterium tuberculosis H37Rv
cgcuacgcgcgcucg

SEQ ID NO: 3335386 - RNA, 17 nt, Mycobacterium tuberculosis H37Rv
cgcuacguaaucagccc

SEQ ID NO: 3335387 - RNA, 14 nt, Mycobacterium tuberculosis H37Rv
cgcuacugcgacca

SEQ ID NO: 3335388 - RNA, 19 nt, Mycobacterium tuberculosis H37Rv
cgcuagaucccaguccgau

SEQ ID NO: 3335389 - RNA, 12 nt, Mycobacterium tuberculosis H37Rv
cgcuagccgaca

SEQ ID NO: 3335390 - RNA, 14 nt, Mycobacterium tuberculosis H37Rv
cgcuagccgacagc

SEQ ID NO: 3335391 - RNA, 19 nt, Mycobacterium tuberculosis H37Rv
cgcuagccggcucaucgca

SEQ ID NO: 3335392 - RNA, 22 nt, Mycobacterium tuberculosis H37Rv
cgcuagccggcucaucgcagcc

SEQ ID NO: 3335393 - RNA, 18 nt, Mycobacterium tuberculosis H37Rv
cgcuagccgggcgcgccg

SEQ ID NO: 3335394 - RNA, 21 nt, Mycobacterium tuberculosis H37Rv
cgcuaggacggcgcgagccgc

SEQ ID NO: 3335395 - RNA, 20 nt, Mycobacterium tuberculosis H37Rv
cgcuaggacggcugccguca

SEQ ID NO: 3335396 - RNA, 24 nt, Mycobacterium tuberculosis H37Rv
cgcuaggacggcugccgucagccg

SEQ ID NO: 3335397 - RNA, 22 nt, Mycobacterium tuberculosis H37Rv
cgcuaggucaggugauucgcgc

SEQ ID NO: 3335398 - RNA, 20 nt, Mycobacterium tuberculosis H37Rv
cgcuaggugacgccgccagc

SEQ ID NO: 3335399 - RNA, 23 nt, Mycobacterium tuberculosis H37Rv
cgcuaggugacgccgccagcacc

SEQ ID NO: 3335400 - RNA, 15 nt, Mycobacterium tuberculosis H37Rv
cgcuaugaagucgau

SEQ ID NO: 3335401 - RNA, 17 nt, Mycobacterium tuberculosis H37Rv
cgcuaugaagucgaucu

SEQ ID NO: 3335402 - RNA, 14 nt, Mycobacterium tuberculosis H37Rv
cgcuaugccccgga

SEQ ID NO: 3335403 - RNA, 22 nt, Mycobacterium tuberculosis H37Rv
cgcuauggcauuaccacuucgg

SEQ ID NO: 3335404 - RNA, 14 nt, Mycobacterium tuberculosis H37Rv
cgcuauggcccggg

SEQ ID NO: 3335405 - RNA, 18 nt, Mycobacterium tuberculosis H37Rv
cgcuauggcggcuucgac

SEQ ID NO: 3335406 - RNA, 19 nt, Mycobacterium tuberculosis H37Rv
cgcucaaugaucgcggcgg

SEQ ID NO: 3335407 - RNA, 18 nt, Mycobacterium tuberculosis H37Rv
cgcucacauacagcaggc

SEQ ID NO: 3335408 - RNA, 20 nt, Mycobacterium tuberculosis H37Rv
cgcucacccggcgucucgca

SEQ ID NO: 3335409 - RNA, 23 nt, Mycobacterium tuberculosis H37Rv
cgcucacccggucgcacuuggcc

SEQ ID NO: 3335410 - RNA, 22 nt, Mycobacterium tuberculosis H37Rv
cgcucacgaagaccgcgucggc

SEQ ID NO: 3335411 - RNA, 14 nt, Mycobacterium tuberculosis H37Rv
cgcucacgcucacc

SEQ ID NO: 3335412 - RNA, 14 nt, Mycobacterium tuberculosis H37Rv
cgcucacggggcgu

SEQ ID NO: 3335413 - RNA, 16 nt, Mycobacterium tuberculosis H37Rv
cgcucacggggcguga

SEQ ID NO: 3335414 - RNA, 16 nt, Mycobacterium tuberculosis H37Rv
cgcucacugcagcgcc

SEQ ID NO: 3335415 - RNA, 11 nt, Mycobacterium tuberculosis H37Rv
cgcucagggug

SEQ ID NO: 3335416 - RNA, 18 nt, Mycobacterium tuberculosis H37Rv
cgcucagggugcgccgca

SEQ ID NO: 3335417 - RNA, 20 nt, Mycobacterium tuberculosis H37Rv
cgcucagggugcgccgcagc

SEQ ID NO: 3335418 - RNA, 16 nt, Mycobacterium tuberculosis H37Rv
cgcucaggucaucggc

SEQ ID NO: 3335419 - RNA, 18 nt, Mycobacterium tuberculosis H37Rv
cgcucaggucaucggcgg

SEQ ID NO: 3335420 - RNA, 17 nt, Mycobacterium tuberculosis H37Rv
cgcucaguuuggcgggu

SEQ ID NO: 3335421 - RNA, 17 nt, Mycobacterium tuberculosis H37Rv
cgcucaucacccagcgc

SEQ ID NO: 3335422 - RNA, 13 nt, Mycobacterium tuberculosis H37Rv
cgcucaucgaccg

SEQ ID NO: 3335423 - RNA, 11 nt, Mycobacterium tuberculosis H37Rv
cgcucaucgau

SEQ ID NO: 3335424 - RNA, 15 nt, Mycobacterium tuberculosis H37Rv
cgcucaucgcggcga

SEQ ID NO: 3335425 - RNA, 21 nt, Mycobacterium tuberculosis H37Rv
cgcucaucugcgcgcggaagc

SEQ ID NO: 3335426 - RNA, 22 nt, Mycobacterium tuberculosis H37Rv
cgcucaucuguaaccuccucga

SEQ ID NO: 3335427 - RNA, 18 nt, Mycobacterium tuberculosis H37Rv
cgcucauucgugcccggg

SEQ ID NO: 3335428 - RNA, 18 nt, Mycobacterium tuberculosis H37Rv
cgcucauugcaucugcca

SEQ ID NO: 3335429 - RNA, 15 nt, Mycobacterium tuberculosis H37Rv
cgcuccaaaagccuc

SEQ ID NO: 3335430 - RNA, 19 nt, Mycobacterium tuberculosis H37Rv
cgcuccaaaagccucagcc

SEQ ID NO: 3335431 - RNA, 20 nt, Mycobacterium tuberculosis H37Rv
cgcuccaaaagccucagccg

SEQ ID NO: 3335432 - RNA, 23 nt, Mycobacterium tuberculosis H37Rv
cgcuccaaaagccucagccgcuc

SEQ ID NO: 3335433 - RNA, 24 nt, Mycobacterium tuberculosis H37Rv
cgcuccaaaagccucagccgcucg

SEQ ID NO: 3335434 - RNA, 15 nt, Mycobacterium tuberculosis H37Rv
cgcuccaacaacucc

SEQ ID NO: 3335435 - RNA, 17 nt, Mycobacterium tuberculosis H37Rv
cgcuccaacaacuccag

SEQ ID NO: 3335436 - RNA, 20 nt, Mycobacterium tuberculosis H37Rv
cgcuccaacgcacacaccgu

SEQ ID NO: 3335437 - RNA, 14 nt, Mycobacterium tuberculosis H37Rv
cgcuccaagcgcgg

SEQ ID NO: 3335438 - RNA, 15 nt, Mycobacterium tuberculosis H37Rv
cgcuccacugaccag

SEQ ID NO: 3335439 - RNA, 17 nt, Mycobacterium tuberculosis H37Rv
cgcuccagauggggcuc

SEQ ID NO: 3335440 - RNA, 15 nt, Mycobacterium tuberculosis H37Rv
cgcuccaggucgaca

SEQ ID NO: 3335441 - RNA, 14 nt, Mycobacterium tuberculosis H37Rv
cgcuccaguggcgc

SEQ ID NO: 3335442 - RNA, 18 nt, Mycobacterium tuberculosis H37Rv
cgcuccaguggcgccagg

SEQ ID NO: 3335443 - RNA, 20 nt, Mycobacterium tuberculosis H37Rv
cgcuccaguggcgccagggc

SEQ ID NO: 3335444 - RNA, 23 nt, Mycobacterium tuberculosis H37Rv
cgcuccaguggcgccagggccuu

SEQ ID NO: 3335445 - RNA, 20 nt, Mycobacterium tuberculosis H37Rv
cgcuccauaucgucgggcgu

SEQ ID NO: 3335446 - RNA, 20 nt, Mycobacterium tuberculosis H37Rv
cgcucccaugaucgccgacc

SEQ ID NO: 3335447 - RNA, 22 nt, Mycobacterium tuberculosis H37Rv
cgcuccccagcgaaucacccgc

SEQ ID NO: 3335448 - RNA, 15 nt, Mycobacterium tuberculosis H37Rv
cgcucccccgccaac

SEQ ID NO: 3335449 - RNA, 17 nt, Mycobacterium tuberculosis H37Rv
cgcucccgccggcagcg

SEQ ID NO: 3335450 - RNA, 17 nt, Mycobacterium tuberculosis H37Rv
cgcucccucuacacccg

SEQ ID NO: 3335451 - RNA, 17 nt, Mycobacterium tuberculosis H37Rv
cgcucccugcacccagc

SEQ ID NO: 3335452 - RNA, 21 nt, Mycobacterium tuberculosis H37Rv
cgcucccugcacccagccgug

SEQ ID NO: 3335453 - RNA, 13 nt, Mycobacterium tuberculosis H37Rv
cgcuccgaccggu

SEQ ID NO: 3335454 - RNA, 23 nt, Mycobacterium tuberculosis H37Rv
cgcuccgccgucgccgccggcgc

SEQ ID NO: 3335455 - RNA, 15 nt, Mycobacterium tuberculosis H37Rv
cgcuccgcgccgccc

SEQ ID NO: 3335456 - RNA, 13 nt, Mycobacterium tuberculosis H37Rv
cgcuccgcggcgc

SEQ ID NO: 3335457 - RNA, 23 nt, Mycobacterium tuberculosis H37Rv
cgcuccgcggcucaaucuccucc

SEQ ID NO: 3335458 - RNA, 18 nt, Mycobacterium tuberculosis H37Rv
cgcuccggcccugccgcc

SEQ ID NO: 3335459 - RNA, 23 nt, Mycobacterium tuberculosis H37Rv
cgcuccggcccugccgccggccc

SEQ ID NO: 3335460 - RNA, 12 nt, Mycobacterium tuberculosis H37Rv
cgcuccuccggc

SEQ ID NO: 3335461 - RNA, 19 nt, Mycobacterium tuberculosis H37Rv
cgcuccuucagggcgucga

SEQ ID NO: 3335462 - RNA, 20 nt, Mycobacterium tuberculosis H37Rv
cgcucgaaauccugguggca

SEQ ID NO: 3335463 - RNA, 21 nt, Mycobacterium tuberculosis H37Rv
cgcucgaacucggcggccagc

SEQ ID NO: 3335464 - RNA, 15 nt, Mycobacterium tuberculosis H37Rv
cgcucgaccagacgc

SEQ ID NO: 3335465 - RNA, 18 nt, Mycobacterium tuberculosis H37Rv
cgcucgaccagacgcugc

SEQ ID NO: 3335466 - RNA, 13 nt, Mycobacterium tuberculosis H37Rv
cgcucgaccccgc

SEQ ID NO: 3335467 - RNA, 18 nt, Mycobacterium tuberculosis H37Rv
cgcucgacgaccacggug

SEQ ID NO: 3335468 - RNA, 21 nt, Mycobacterium tuberculosis H37Rv
cgcucgacgacgggcgccaac

SEQ ID NO: 3335469 - RNA, 16 nt, Mycobacterium tuberculosis H37Rv
cgcucgagguggucuc

SEQ ID NO: 3335470 - RNA, 21 nt, Mycobacterium tuberculosis H37Rv
cgcucgaucacuagcgccccu

SEQ ID NO: 3335471 - RNA, 18 nt, Mycobacterium tuberculosis H37Rv
cgcucgauggauccaacc

SEQ ID NO: 3335472 - RNA, 16 nt, Mycobacterium tuberculosis H37Rv
cgcucgaugucccgag

SEQ ID NO: 3335473 - RNA, 18 nt, Mycobacterium tuberculosis H37Rv
cgcucgaugucccgagcc

SEQ ID NO: 3335474 - RNA, 16 nt, Mycobacterium tuberculosis H37Rv
cgcucgcacagccgcu

SEQ ID NO: 3335475 - RNA, 13 nt, Mycobacterium tuberculosis H37Rv
cgcucgcacccgc

SEQ ID NO: 3335476 - RNA, 16 nt, Mycobacterium tuberculosis H37Rv
cgcucgcaccgcccgc

SEQ ID NO: 3335477 - RNA, 14 nt, Mycobacterium tuberculosis H37Rv
cgcucgcaggccgg

SEQ ID NO: 3335478 - RNA, 14 nt, Mycobacterium tuberculosis H37Rv
cgcucgcccgccgc

SEQ ID NO: 3335479 - RNA, 19 nt, Mycobacterium tuberculosis H37Rv
cgcucgcccgccgccacca

SEQ ID NO: 3335480 - RNA, 21 nt, Mycobacterium tuberculosis H37Rv
cgcucgcccgccgccaccagc

SEQ ID NO: 3335481 - RNA, 15 nt, Mycobacterium tuberculosis H37Rv
cgcucgccgagcugu

SEQ ID NO: 3335482 - RNA, 23 nt, Mycobacterium tuberculosis H37Rv
cgcucgccgguaggcggccagcg

SEQ ID NO: 3335483 - RNA, 15 nt, Mycobacterium tuberculosis H37Rv
cgcucgcgccagguc

SEQ ID NO: 3335484 - RNA, 12 nt, Mycobacterium tuberculosis H37Rv
cgcucgcgcgcu

SEQ ID NO: 3335485 - RNA, 17 nt, Mycobacterium tuberculosis H37Rv
cgcucgcgcgcugggcg

SEQ ID NO: 3335486 - RNA, 16 nt, Mycobacterium tuberculosis H37Rv
cgcucgcggcggcgcu

SEQ ID NO: 3335487 - RNA, 23 nt, Mycobacterium tuberculosis H37Rv
cgcucgcggcuucaguccggccc

SEQ ID NO: 3335488 - RNA, 21 nt, Mycobacterium tuberculosis H37Rv
cgcucgcggguucggcugccu

SEQ ID NO: 3335489 - RNA, 15 nt, Mycobacterium tuberculosis H37Rv
cgcucgcucaccggc

SEQ ID NO: 3335490 - RNA, 14 nt, Mycobacterium tuberculosis H37Rv
cgcucgcugcagca

SEQ ID NO: 3335491 - RNA, 15 nt, Mycobacterium tuberculosis H37Rv
cgcucgcugcagcag

SEQ ID NO: 3335492 - RNA, 17 nt, Mycobacterium tuberculosis H37Rv
cgcucgcugcagcaggg

SEQ ID NO: 3335493 - RNA, 20 nt, Mycobacterium tuberculosis H37Rv
cgcucggagaucgccacuac

SEQ ID NO: 3335494 - RNA, 17 nt, Mycobacterium tuberculosis H37Rv
cgcucggaucguacggg

SEQ ID NO: 3335495 - RNA, 18 nt, Mycobacterium tuberculosis H37Rv
cgcucggaucguacgggu

SEQ ID NO: 3335496 - RNA, 20 nt, Mycobacterium tuberculosis H37Rv
cgcucggcaaccugcgacca

SEQ ID NO: 3335497 - RNA, 12 nt, Mycobacterium tuberculosis H37Rv
cgcucggcagcc

SEQ ID NO: 3335498 - RNA, 15 nt, Mycobacterium tuberculosis H37Rv
cgcucggcagccggc

SEQ ID NO: 3335499 - RNA, 14 nt, Mycobacterium tuberculosis H37Rv
cgcucggccgcagc

SEQ ID NO: 3335500 - RNA, 19 nt, Mycobacterium tuberculosis H37Rv
cgcucggccugcugcugca

SEQ ID NO: 3335501 - RNA, 20 nt, Mycobacterium tuberculosis H37Rv
cgcucggcgaucugcguuug

SEQ ID NO: 3335502 - RNA, 22 nt, Mycobacterium tuberculosis H37Rv
cgcucggcgccacggugucgcg

SEQ ID NO: 3335503 - RNA, 14 nt, Mycobacterium tuberculosis H37Rv
cgcucggcggucgg

SEQ ID NO: 3335504 - RNA, 13 nt, Mycobacterium tuberculosis H37Rv
cgcucggcguagc

SEQ ID NO: 3335505 - RNA, 21 nt, Mycobacterium tuberculosis H37Rv
cgcucggcguagcgagcgggu

SEQ ID NO: 3335506 - RNA, 18 nt, Mycobacterium tuberculosis H37Rv
cgcucgggguggucggcu

SEQ ID NO: 3335507 - RNA, 22 nt, Mycobacterium tuberculosis H37Rv
cgcucgggguugcucgcgaucg

SEQ ID NO: 3335508 - RNA, 15 nt, Mycobacterium tuberculosis H37Rv
cgcucgguccagccg

SEQ ID NO: 3335509 - RNA, 22 nt, Mycobacterium tuberculosis H37Rv
cgcucgguccccgcagcucgac

SEQ ID NO: 3335510 - RNA, 13 nt, Mycobacterium tuberculosis H37Rv
cgcucggucgcca

SEQ ID NO: 3335511 - RNA, 14 nt, Mycobacterium tuberculosis H37Rv
cgcucggucgccac

SEQ ID NO: 3335512 - RNA, 18 nt, Mycobacterium tuberculosis H37Rv
cgcucggucgccuccucg

SEQ ID NO: 3335513 - RNA, 19 nt, Mycobacterium tuberculosis H37Rv
cgcucggugaaggucaccg

SEQ ID NO: 3335514 - RNA, 22 nt, Mycobacterium tuberculosis H37Rv
cgcucggugaaggucaccgucg

SEQ ID NO: 3335515 - RNA, 14 nt, Mycobacterium tuberculosis H37Rv
cgcucggugccgcc

SEQ ID NO: 3335516 - RNA, 19 nt, Mycobacterium tuberculosis H37Rv
cgcucggugcugcgccgau

SEQ ID NO: 3335517 - RNA, 14 nt, Mycobacterium tuberculosis H37Rv
cgcucgucgaucuc

SEQ ID NO: 3335518 - RNA, 18 nt, Mycobacterium tuberculosis H37Rv
cgcucgucgcggcccgcg

SEQ ID NO: 3335519 - RNA, 16 nt, Mycobacterium tuberculosis H37Rv
cgcucgucgucaccga

SEQ ID NO: 3335520 - RNA, 17 nt, Mycobacterium tuberculosis H37Rv
cgcucgucguccggcca

SEQ ID NO: 3335521 - RNA, 24 nt, Mycobacterium tuberculosis H37Rv
cgcucgugcacgcugagccggucg

SEQ ID NO: 3335522 - RNA, 14 nt, Mycobacterium tuberculosis H37Rv
cgcucguggucgac

SEQ ID NO: 3335523 - RNA, 23 nt, Mycobacterium tuberculosis H37Rv
cgcucguggucgacgugaucgcg

SEQ ID NO: 3335524 - RNA, 19 nt, Mycobacterium tuberculosis H37Rv
cgcucguuagcggcgggca

SEQ ID NO: 3335525 - RNA, 22 nt, Mycobacterium tuberculosis H37Rv
cgcucguuagcggcgggcacgc

SEQ ID NO: 3335526 - RNA, 16 nt, Mycobacterium tuberculosis H37Rv
cgcucguuccggcggu

SEQ ID NO: 3335527 - RNA, 17 nt, Mycobacterium tuberculosis H37Rv
cgcucucggucaguucc

SEQ ID NO: 3335528 - RNA, 19 nt, Mycobacterium tuberculosis H37Rv
cgcucugcgccacagcagc

SEQ ID NO: 3335529 - RNA, 14 nt, Mycobacterium tuberculosis H37Rv
cgcucugcgcggcu

SEQ ID NO: 3335530 - RNA, 14 nt, Mycobacterium tuberculosis H37Rv
cgcucugcugaaau

SEQ ID NO: 3335531 - RNA, 14 nt, Mycobacterium tuberculosis H37Rv
cgcucugugucgcc

SEQ ID NO: 3335532 - RNA, 21 nt, Mycobacterium tuberculosis H37Rv
cgcucugugucgccgaucacc

SEQ ID NO: 3335533 - RNA, 15 nt, Mycobacterium tuberculosis H37Rv
cgcucuugaauagga

SEQ ID NO: 3335534 - RNA, 14 nt, Mycobacterium tuberculosis H37Rv
cgcucuugcucacc

SEQ ID NO: 3335535 - RNA, 15 nt, Mycobacterium tuberculosis H37Rv
cgcucuugcucacca

SEQ ID NO: 3335536 - RNA, 21 nt, Mycobacterium tuberculosis H37Rv
cgcugaaggccgguagcgcgg

SEQ ID NO: 3335537 - RNA, 23 nt, Mycobacterium tuberculosis H37Rv
cgcugaagguggcgaacccgguc

SEQ ID NO: 3335538 - RNA, 20 nt, Mycobacterium tuberculosis H37Rv
cgcugaaguggcacaagcug

SEQ ID NO: 3335539 - RNA, 23 nt, Mycobacterium tuberculosis H37Rv
cgcugaaucaccccggcggccau

SEQ ID NO: 3335540 - RNA, 21 nt, Mycobacterium tuberculosis H37Rv
cgcugaaugcuugcgcagcac

SEQ ID NO: 3335541 - RNA, 18 nt, Mycobacterium tuberculosis H37Rv
cgcugaauuggcgccgau

SEQ ID NO: 3335542 - RNA, 22 nt, Mycobacterium tuberculosis H37Rv
cgcugaccacaaccgugagcac

SEQ ID NO: 3335543 - RNA, 14 nt, Mycobacterium tuberculosis H37Rv
cgcugacccgccac

SEQ ID NO: 3335544 - RNA, 14 nt, Mycobacterium tuberculosis H37Rv
cgcugaccgcguag

SEQ ID NO: 3335545 - RNA, 18 nt, Mycobacterium tuberculosis H37Rv
cgcugaccuuuucccgca

SEQ ID NO: 3335546 - RNA, 14 nt, Mycobacterium tuberculosis H37Rv
cgcugacgcccucc

SEQ ID NO: 3335547 - RNA, 13 nt, Mycobacterium tuberculosis H37Rv
cgcugagcacggc

SEQ ID NO: 3335548 - RNA, 18 nt, Mycobacterium tuberculosis H37Rv
cgcugagcacucaugaug

SEQ ID NO: 3335549 - RNA, 13 nt, Mycobacterium tuberculosis H37Rv
cgcugagcagcgc

SEQ ID NO: 3335550 - RNA, 14 nt, Mycobacterium tuberculosis H37Rv
cgcugagcagcgcc

SEQ ID NO: 3335551 - RNA, 17 nt, Mycobacterium tuberculosis H37Rv
cgcugagcagcgccgcg

SEQ ID NO: 3335552 - RNA, 12 nt, Mycobacterium tuberculosis H37Rv
cgcugagccccc

SEQ ID NO: 3335553 - RNA, 15 nt, Mycobacterium tuberculosis H37Rv
cgcugagccccccga

SEQ ID NO: 3335554 - RNA, 19 nt, Mycobacterium tuberculosis H37Rv
cgcugagccccccgagccc

SEQ ID NO: 3335555 - RNA, 23 nt, Mycobacterium tuberculosis H37Rv
cgcugagccccccgagcccgcca

SEQ ID NO: 3335556 - RNA, 15 nt, Mycobacterium tuberculosis H37Rv
cgcugagcccugcgc

SEQ ID NO: 3335557 - RNA, 15 nt, Mycobacterium tuberculosis H37Rv
cgcugagccgcucau

SEQ ID NO: 3335558 - RNA, 13 nt, Mycobacterium tuberculosis H37Rv
cgcugagcgacug

SEQ ID NO: 3335559 - RNA, 12 nt, Mycobacterium tuberculosis H37Rv
cgcugagcucga

SEQ ID NO: 3335560 - RNA, 18 nt, Mycobacterium tuberculosis H37Rv
cgcugaggaacccuccgg

SEQ ID NO: 3335561 - RNA, 19 nt, Mycobacterium tuberculosis H37Rv
cgcugaggaacccuccgga

SEQ ID NO: 3335562 - RNA, 19 nt, Mycobacterium tuberculosis H37Rv
cgcugaggaagcggcggca

SEQ ID NO: 3335563 - RNA, 15 nt, Mycobacterium tuberculosis H37Rv
cgcugaguccccagg

SEQ ID NO: 3335564 - RNA, 20 nt, Mycobacterium tuberculosis H37Rv
cgcugauagcggucggucac

SEQ ID NO: 3335565 - RNA, 16 nt, Mycobacterium tuberculosis H37Rv
cgcugauaguggcgcg

SEQ ID NO: 3335566 - RNA, 22 nt, Mycobacterium tuberculosis H37Rv
cgcugauaguggcgcgcggcgc

SEQ ID NO: 3335567 - RNA, 21 nt, Mycobacterium tuberculosis H37Rv
cgcugauauccggaaccgguc

SEQ ID NO: 3335568 - RNA, 18 nt, Mycobacterium tuberculosis H37Rv
cgcugaucagauccucga

SEQ ID NO: 3335569 - RNA, 13 nt, Mycobacterium tuberculosis H37Rv
cgcugaucggcag

SEQ ID NO: 3335570 - RNA, 20 nt, Mycobacterium tuberculosis H37Rv
cgcugaucuggggcaccacg

SEQ ID NO: 3335571 - RNA, 22 nt, Mycobacterium tuberculosis H37Rv
cgcugaucuuccccucggccgc

SEQ ID NO: 3335572 - RNA, 20 nt, Mycobacterium tuberculosis H37Rv
cgcugauggugcugcggcgu

SEQ ID NO: 3335573 - RNA, 15 nt, Mycobacterium tuberculosis H37Rv
cgcugcaaccgccgg

SEQ ID NO: 3335574 - RNA, 16 nt, Mycobacterium tuberculosis H37Rv
cgcugcacaacguggu

SEQ ID NO: 3335575 - RNA, 14 nt, Mycobacterium tuberculosis H37Rv
cgcugcaccagcug

SEQ ID NO: 3335576 - RNA, 15 nt, Mycobacterium tuberculosis H37Rv
cgcugcacgacaucg

SEQ ID NO: 3335577 - RNA, 21 nt, Mycobacterium tuberculosis H37Rv
cggaccgggggaagcgguagc

SEQ ID NO: 3335578 - RNA, 17 nt, Mycobacterium tuberculosis H37Rv
cggaccguccgacggcg

SEQ ID NO: 3335579 - RNA, 23 nt, Mycobacterium tuberculosis H37Rv
cggaccgucuuuggugccgagca

SEQ ID NO: 3335580 - RNA, 23 nt, Mycobacterium tuberculosis H37Rv
cggaccguggcagcugcucuccg

SEQ ID NO: 3335581 - RNA, 14 nt, Mycobacterium tuberculosis H37Rv
cggaccuccucgcc

SEQ ID NO: 3335582 - RNA, 16 nt, Mycobacterium tuberculosis H37Rv
cggaccucgaagccca

SEQ ID NO: 3335583 - RNA, 14 nt, Mycobacterium tuberculosis H37Rv
cggaccucgcccau

SEQ ID NO: 3335584 - RNA, 19 nt, Mycobacterium tuberculosis H37Rv
cggaccugaccgguggcca

SEQ ID NO: 3335585 - RNA, 23 nt, Mycobacterium tuberculosis H37Rv
cggaccugaccgguggccaucgc

SEQ ID NO: 3335586 - RNA, 20 nt, Mycobacterium tuberculosis H37Rv
cggacgauggcgucggccag

SEQ ID NO: 3335587 - RNA, 18 nt, Mycobacterium tuberculosis H37Rv
cggacgauuacgccggag

SEQ ID NO: 3335588 - RNA, 20 nt, Mycobacterium tuberculosis H37Rv
cggacgcaacacccgggcga

SEQ ID NO: 3335589 - RNA, 19 nt, Mycobacterium tuberculosis H37Rv
cggacgcacgauccgcacc

SEQ ID NO: 3335590 - RNA, 23 nt, Mycobacterium tuberculosis H37Rv
cggacgccgcgccggcgggcgag

SEQ ID NO: 3335591 - RNA, 15 nt, Mycobacterium tuberculosis H37Rv
cggacgcgcggaugg

SEQ ID NO: 3335592 - RNA, 21 nt, Mycobacterium tuberculosis H37Rv
cggacgcugauugcgaccgcg

SEQ ID NO: 3335593 - RNA, 20 nt, Mycobacterium tuberculosis H37Rv
cggacggauucgaaggucgg

SEQ ID NO: 3335594 - RNA, 14 nt, Mycobacterium tuberculosis H37Rv
cggacggcaggcug

SEQ ID NO: 3335595 - RNA, 14 nt, Mycobacterium tuberculosis H37Rv
cggacgggaucgcc

SEQ ID NO: 3335596 - RNA, 18 nt, Mycobacterium tuberculosis H37Rv
cggacgggaucgcccagg

SEQ ID NO: 3335597 - RNA, 23 nt, Mycobacterium tuberculosis H37Rv
cggacgggaucgcccaggcgcga

SEQ ID NO: 3335598 - RNA, 13 nt, Mycobacterium tuberculosis H37Rv
cggacggucgggc

SEQ ID NO: 3335599 - RNA, 17 nt, Mycobacterium tuberculosis H37Rv
cggacggucgggcggau

SEQ ID NO: 3335600 - RNA, 20 nt, Mycobacterium tuberculosis H37Rv
cggacgucgacuuguugggc

SEQ ID NO: 3335601 - RNA, 14 nt, Mycobacterium tuberculosis H37Rv
cggacgugccgguc

SEQ ID NO: 3335602 - RNA, 17 nt, Mycobacterium tuberculosis H37Rv
cggacguucuggaucgu

SEQ ID NO: 3335603 - RNA, 18 nt, Mycobacterium tuberculosis H37Rv
cggacucacgaggcacaa

SEQ ID NO: 3335604 - RNA, 16 nt, Mycobacterium tuberculosis H37Rv
cggacucccucgauca

SEQ ID NO: 3335605 - RNA, 22 nt, Mycobacterium tuberculosis H37Rv
cggacugaagccgcgagcgcgc

SEQ ID NO: 3335606 - RNA, 21 nt, Mycobacterium tuberculosis H37Rv
cggacugagagauggucgggc

SEQ ID NO: 3335607 - RNA, 17 nt, Mycobacterium tuberculosis H37Rv
cggacugcagcgcggcc

SEQ ID NO: 3335608 - RNA, 14 nt, Mycobacterium tuberculosis H37Rv
cggacugcggaaca

SEQ ID NO: 3335609 - RNA, 19 nt, Mycobacterium tuberculosis H37Rv
cggacugcggaacaccagc

SEQ ID NO: 3335610 - RNA, 20 nt, Mycobacterium tuberculosis H37Rv
cggacuggcauccgccccgc

SEQ ID NO: 3335611 - RNA, 18 nt, Mycobacterium tuberculosis H37Rv
cggacuggccucggggau

SEQ ID NO: 3335612 - RNA, 21 nt, Mycobacterium tuberculosis H37Rv
cggacuggccucggggaucgc

SEQ ID NO: 3335613 - RNA, 19 nt, Mycobacterium tuberculosis H37Rv
cggacuucaugaucggacc

SEQ ID NO: 3335614 - RNA, 23 nt, Mycobacterium tuberculosis H37Rv
cggacuucguuccgugccgagcu

SEQ ID NO: 3335615 - RNA, 20 nt, Mycobacterium tuberculosis H37Rv
cggagaacgcgucgcgcgcc

SEQ ID NO: 3335616 - RNA, 18 nt, Mycobacterium tuberculosis H37Rv
cggagaacgggucgacgu

SEQ ID NO: 3335617 - RNA, 17 nt, Mycobacterium tuberculosis H37Rv
cggagaaguucgugagc

SEQ ID NO: 3335618 - RNA, 23 nt, Mycobacterium tuberculosis H37Rv
cggagaauuccgcuaggucaggu

SEQ ID NO: 3335619 - RNA, 20 nt, Mycobacterium tuberculosis H37Rv
cggagacaccgcaacgcgug

SEQ ID NO: 3335620 - RNA, 18 nt, Mycobacterium tuberculosis H37Rv
cggagaccggccggguga

SEQ ID NO: 3335621 - RNA, 22 nt, Mycobacterium tuberculosis H37Rv
cggagaccggccgggugaacca

SEQ ID NO: 3335622 - RNA, 13 nt, Mycobacterium tuberculosis H37Rv
cggagacgucgcc

SEQ ID NO: 3335623 - RNA, 18 nt, Mycobacterium tuberculosis H37Rv
cggagacgucgccgcagu

SEQ ID NO: 3335624 - RNA, 16 nt, Mycobacterium tuberculosis H37Rv
cggagacucucugauc

SEQ ID NO: 3335625 - RNA, 19 nt, Mycobacterium tuberculosis H37Rv
cggagauacgggccaccgu

SEQ ID NO: 3335626 - RNA, 13 nt, Mycobacterium tuberculosis H37Rv
cggagaucgccac

SEQ ID NO: 3335627 - RNA, 15 nt, Mycobacterium tuberculosis H37Rv
cggagaucgucgcgu

SEQ ID NO: 3335628 - RNA, 23 nt, Mycobacterium tuberculosis H37Rv
cggagaucuugcgcaaugccgac

SEQ ID NO: 3335629 - RNA, 15 nt, Mycobacterium tuberculosis H37Rv
cggagaugaacucgg

SEQ ID NO: 3335630 - RNA, 20 nt, Mycobacterium tuberculosis H37Rv
cggagaugaacucggcgauc

SEQ ID NO: 3335631 - RNA, 15 nt, Mycobacterium tuberculosis H37Rv
cggagaugagcagcu

SEQ ID NO: 3335632 - RNA, 23 nt, Mycobacterium tuberculosis H37Rv
cggagaugccauuucgucgucgc

SEQ ID NO: 3335633 - RNA, 18 nt, Mycobacterium tuberculosis H37Rv
cggagauuucgucgcuga

SEQ ID NO: 3335634 - RNA, 23 nt, Mycobacterium tuberculosis H37Rv
cggagcaauuccacgaucggcuc

SEQ ID NO: 3335635 - RNA, 14 nt, Mycobacterium tuberculosis H37Rv
cggagcacccgggg

SEQ ID NO: 3335636 - RNA, 21 nt, Mycobacterium tuberculosis H37Rv
cggagcacuucgucgaaccug

SEQ ID NO: 3335637 - RNA, 15 nt, Mycobacterium tuberculosis H37Rv
cggagccaggacgac

SEQ ID NO: 3335638 - RNA, 17 nt, Mycobacterium tuberculosis H37Rv
cggagccaggacgacgc

SEQ ID NO: 3335639 - RNA, 21 nt, Mycobacterium tuberculosis H37Rv
cggagcccacacgcucacggg

SEQ ID NO: 3335640 - RNA, 14 nt, Mycobacterium tuberculosis H37Rv
cggagccgacaacg

SEQ ID NO: 3335641 - RNA, 15 nt, Mycobacterium tuberculosis H37Rv
cggagccgacaacga

SEQ ID NO: 3335642 - RNA, 12 nt, Mycobacterium tuberculosis H37Rv
cggagccgagcc

SEQ ID NO: 3335643 - RNA, 17 nt, Mycobacterium tuberculosis H37Rv
cggagccgagccgauau

SEQ ID NO: 3335644 - RNA, 13 nt, Mycobacterium tuberculosis H37Rv
cggagccgccagg

SEQ ID NO: 3335645 - RNA, 15 nt, Mycobacterium tuberculosis H37Rv
cggagccgcccaagc

SEQ ID NO: 3335646 - RNA, 17 nt, Mycobacterium tuberculosis H37Rv
cggagccgccggccccg

SEQ ID NO: 3335647 - RNA, 19 nt, Mycobacterium tuberculosis H37Rv
cggagccgccggccccgcc

SEQ ID NO: 3335648 - RNA, 14 nt, Mycobacterium tuberculosis H37Rv
cggagccggccacc

SEQ ID NO: 3335649 - RNA, 17 nt, Mycobacterium tuberculosis H37Rv
cggagccggccaccucg

SEQ ID NO: 3335650 - RNA, 16 nt, Mycobacterium tuberculosis H37Rv
cggagccggugccgac

SEQ ID NO: 3335651 - RNA, 21 nt, Mycobacterium tuberculosis H37Rv
cggagccgucgcaucaggucg

SEQ ID NO: 3335652 - RNA, 21 nt, Mycobacterium tuberculosis H37Rv
cggagcgcauuuguugcugcu

SEQ ID NO: 3335653 - RNA, 14 nt, Mycobacterium tuberculosis H37Rv
cggagcgccgagcu

SEQ ID NO: 3335654 - RNA, 18 nt, Mycobacterium tuberculosis H37Rv
cggagcgggccagcaccc

SEQ ID NO: 3335655 - RNA, 20 nt, Mycobacterium tuberculosis H37Rv
cggagcgggccagcacccgc

SEQ ID NO: 3335656 - RNA, 23 nt, Mycobacterium tuberculosis H37Rv
cggagcggggaaguuggcugagc

SEQ ID NO: 3335657 - RNA, 17 nt, Mycobacterium tuberculosis H37Rv
cggagcggucagcggau

SEQ ID NO: 3335658 - RNA, 20 nt, Mycobacterium tuberculosis H37Rv
cggagcgguguggucgcagg

SEQ ID NO: 3335659 - RNA, 16 nt, Mycobacterium tuberculosis H37Rv
cggagcucaaccaccu

SEQ ID NO: 3335660 - RNA, 21 nt, Mycobacterium tuberculosis H37Rv
cggagcucuugcgggcagccg

SEQ ID NO: 3335661 - RNA, 17 nt, Mycobacterium tuberculosis H37Rv
cggagcuuguugcagcg

SEQ ID NO: 3335662 - RNA, 18 nt, Mycobacterium tuberculosis H37Rv
cggaggaucgcugguugg

SEQ ID NO: 3335663 - RNA, 12 nt, Mycobacterium tuberculosis H37Rv
cggaggcaagca

SEQ ID NO: 3335664 - RNA, 13 nt, Mycobacterium tuberculosis H37Rv
cggaggcaagcaa

SEQ ID NO: 3335665 - RNA, 17 nt, Mycobacterium tuberculosis H37Rv
cggaggcauuagcacgc

SEQ ID NO: 3335666 - RNA, 20 nt, Mycobacterium tuberculosis H37Rv
cggaggcauuagcacgcugu

SEQ ID NO: 3335667 - RNA, 14 nt, Mycobacterium tuberculosis H37Rv
cggaggcgaccacg

SEQ ID NO: 3335668 - RNA, 19 nt, Mycobacterium tuberculosis H37Rv
cggaggcgaccacgucggc

SEQ ID NO: 3335669 - RNA, 21 nt, Mycobacterium tuberculosis H37Rv
cggaggcgaccacgucggcga

SEQ ID NO: 3335670 - RNA, 16 nt, Mycobacterium tuberculosis H37Rv
cggaggcggaccaggc

SEQ ID NO: 3335671 - RNA, 20 nt, Mycobacterium tuberculosis H37Rv
cggaggcggaccaggccgcg

SEQ ID NO: 3335672 - RNA, 17 nt, Mycobacterium tuberculosis H37Rv
cggaggcgggugcggca

SEQ ID NO: 3335673 - RNA, 21 nt, Mycobacterium tuberculosis H37Rv
cggaggcugggcugagggugg

SEQ ID NO: 3335674 - RNA, 13 nt, Mycobacterium tuberculosis H37Rv
cggaggguucgga

SEQ ID NO: 3335675 - RNA, 22 nt, Mycobacterium tuberculosis H37Rv
cggagguccuacgugcugcggg

SEQ ID NO: 3335676 - RNA, 13 nt, Mycobacterium tuberculosis H37Rv
cggaggucggagc

SEQ ID NO: 3335677 - RNA, 16 nt, Mycobacterium tuberculosis H37Rv
cggaggucgggcggcg

SEQ ID NO: 3335678 - RNA, 16 nt, Mycobacterium tuberculosis H37Rv
cggagguggggugggg

SEQ ID NO: 3335679 - RNA, 16 nt, Mycobacterium tuberculosis H37Rv
cggaguaggccgcgcc

SEQ ID NO: 3335680 - RNA, 14 nt, Mycobacterium tuberculosis H37Rv
cggagucaagcagc

SEQ ID NO: 3335681 - RNA, 14 nt, Mycobacterium tuberculosis H37Rv
cggagucacgcagc

SEQ ID NO: 3335682 - RNA, 15 nt, Mycobacterium tuberculosis H37Rv
cggaguccgucgggg

SEQ ID NO: 3335683 - RNA, 21 nt, Mycobacterium tuberculosis H37Rv
cggagucgaacaucaccggag

SEQ ID NO: 3335684 - RNA, 15 nt, Mycobacterium tuberculosis H37Rv
cggagucgacgacgu

SEQ ID NO: 3335685 - RNA, 23 nt, Mycobacterium tuberculosis H37Rv
cggagucgcccgguccgccgcag

SEQ ID NO: 3335686 - RNA, 21 nt, Mycobacterium tuberculosis H37Rv
cggagucgguggucucggcau

SEQ ID NO: 3335687 - RNA, 18 nt, Mycobacterium tuberculosis H37Rv
cggagugcauguccgacc

SEQ ID NO: 3335688 - RNA, 14 nt, Mycobacterium tuberculosis H37Rv
cggaguggccaguu

SEQ ID NO: 3335689 - RNA, 16 nt, Mycobacterium tuberculosis H37Rv
cggagugguauccagg

SEQ ID NO: 3335690 - RNA, 19 nt, Mycobacterium tuberculosis H37Rv
cggagugguauccaggccc

SEQ ID NO: 3335691 - RNA, 19 nt, Mycobacterium tuberculosis H37Rv
cggagugucgaugcgcgcc

SEQ ID NO: 3335692 - RNA, 22 nt, Mycobacterium tuberculosis H37Rv
cggagugucgaugcgcgccggc

SEQ ID NO: 3335693 - RNA, 19 nt, Mycobacterium tuberculosis H37Rv
cggaguucuguaccggcug

SEQ ID NO: 3335694 - RNA, 18 nt, Mycobacterium tuberculosis H37Rv
cggaguucuucgaaggcg

SEQ ID NO: 3335695 - RNA, 22 nt, Mycobacterium tuberculosis H37Rv
cggaguucuucgaaggcguggg

SEQ ID NO: 3335696 - RNA, 18 nt, Mycobacterium tuberculosis H37Rv
cggaguugaagaagcccg

SEQ ID NO: 3335697 - RNA, 17 nt, Mycobacterium tuberculosis H37Rv
cggaguuggcccgacgc

SEQ ID NO: 3335698 - RNA, 19 nt, Mycobacterium tuberculosis H37Rv
cggaguugucgacggccac

SEQ ID NO: 3335699 - RNA, 17 nt, Mycobacterium tuberculosis H37Rv
cggaguuuccccuacca

SEQ ID NO: 3335700 - RNA, 22 nt, Mycobacterium tuberculosis H37Rv
cggaguuuuucgggguggcggc

SEQ ID NO: 3335701 - RNA, 16 nt, Mycobacterium tuberculosis H37Rv
cggauaaccggcaugc

SEQ ID NO: 3335702 - RNA, 19 nt, Mycobacterium tuberculosis H37Rv
cggauaacgucacaccgau

SEQ ID NO: 3335703 - RNA, 20 nt, Mycobacterium tuberculosis H37Rv
cggauaauucaacagcaccg

SEQ ID NO: 3335704 - RNA, 15 nt, Mycobacterium tuberculosis H37Rv
cggauacaccggcac

SEQ ID NO: 3335705 - RNA, 16 nt, Mycobacterium tuberculosis H37Rv
cggauacagccacgca

SEQ ID NO: 3335706 - RNA, 22 nt, Mycobacterium tuberculosis H37Rv
cggauacagccgccgccggcaa

SEQ ID NO: 3335707 - RNA, 14 nt, Mycobacterium tuberculosis H37Rv
cggauacggcgaca

SEQ ID NO: 3335708 - RNA, 15 nt, Mycobacterium tuberculosis H37Rv
cggauagcaccggca

SEQ ID NO: 3335709 - RNA, 18 nt, Mycobacterium tuberculosis H37Rv
cggauagcaccggcaccc

SEQ ID NO: 3335710 - RNA, 20 nt, Mycobacterium tuberculosis H37Rv
cggauagcgucuggcgacau

SEQ ID NO: 3335711 - RNA, 20 nt, Mycobacterium tuberculosis H37Rv
cggauaggacgaacaacgcg

SEQ ID NO: 3335712 - RNA, 19 nt, Mycobacterium tuberculosis H37Rv
cggauaggccgcgcggcgg

SEQ ID NO: 3335713 - RNA, 16 nt, Mycobacterium tuberculosis H37Rv
cggauaguucaccaca

SEQ ID NO: 3335714 - RNA, 14 nt, Mycobacterium tuberculosis H37Rv
cggaucaaaaacca

SEQ ID NO: 3335715 - RNA, 18 nt, Mycobacterium tuberculosis H37Rv
cggaucaacaggccggcu

SEQ ID NO: 3335716 - RNA, 22 nt, Mycobacterium tuberculosis H37Rv
cggaucagcccgcgcagcagug

SEQ ID NO: 3335717 - RNA, 23 nt, Mycobacterium tuberculosis H37Rv
cggaucauccuucgccggcgcca

SEQ ID NO: 3335718 - RNA, 19 nt, Mycobacterium tuberculosis H37Rv
cggauccaccacgcuggcc

SEQ ID NO: 3335719 - RNA, 19 nt, Mycobacterium tuberculosis H37Rv
cggauccauuagcacaucg

SEQ ID NO: 3335720 - RNA, 20 nt, Mycobacterium tuberculosis H37Rv
cggaucccugugccagcagc

SEQ ID NO: 3335721 - RNA, 19 nt, Mycobacterium tuberculosis H37Rv
cggauccgauccgcacagc

SEQ ID NO: 3335722 - RNA, 19 nt, Mycobacterium tuberculosis H37Rv
cggauccucggccgccauc

SEQ ID NO: 3335723 - RNA, 20 nt, Mycobacterium tuberculosis H37Rv
cggaucgauuccgccgcacu

SEQ ID NO: 3335724 - RNA, 16 nt, Mycobacterium tuberculosis H37Rv
cggaucgccacggugg

SEQ ID NO: 3335725 - RNA, 13 nt, Mycobacterium tuberculosis H37Rv
cggaucgccaggc

SEQ ID NO: 3335726 - RNA, 19 nt, Mycobacterium tuberculosis H37Rv
cggaucgccaggccgucgg

SEQ ID NO: 3335727 - RNA, 20 nt, Mycobacterium tuberculosis H37Rv
cggaucgccgucgcgaccga

SEQ ID NO: 3335728 - RNA, 19 nt, Mycobacterium tuberculosis H37Rv
cggaucgcgagcgccgcua

SEQ ID NO: 3335729 - RNA, 15 nt, Mycobacterium tuberculosis H37Rv
cggaucgcucccguc

SEQ ID NO: 3335730 - RNA, 13 nt, Mycobacterium tuberculosis H37Rv
cggaucggcaccc

SEQ ID NO: 3335731 - RNA, 18 nt, Mycobacterium tuberculosis H37Rv
cggaucggcaccccacgc

SEQ ID NO: 3335732 - RNA, 18 nt, Mycobacterium tuberculosis H37Rv
cggaucggcucgccaccu

SEQ ID NO: 3335733 - RNA, 21 nt, Mycobacterium tuberculosis H37Rv
cggaucguucgcgugccagcg

SEQ ID NO: 3335734 - RNA, 23 nt, Mycobacterium tuberculosis H37Rv
cggaucugagcuagccguucggc

SEQ ID NO: 3335735 - RNA, 18 nt, Mycobacterium tuberculosis H37Rv
cggaucuggccuuggcag

SEQ ID NO: 3335736 - RNA, 21 nt, Mycobacterium tuberculosis H37Rv
cggaucuggcuccggccaggg

SEQ ID NO: 3335737 - RNA, 12 nt, Mycobacterium tuberculosis H37Rv
cggaugacaccg

SEQ ID NO: 3335738 - RNA, 22 nt, Mycobacterium tuberculosis H37Rv
cggaugacgcccagggcgucgg

SEQ ID NO: 3335739 - RNA, 17 nt, Mycobacterium tuberculosis H37Rv
cggaugagcucggccau

SEQ ID NO: 3335740 - RNA, 20 nt, Mycobacterium tuberculosis H37Rv
cggaugagcucggccaucag

SEQ ID NO: 3335741 - RNA, 17 nt, Mycobacterium tuberculosis H37Rv
cggaugcaacccgguga

SEQ ID NO: 3335742 - RNA, 15 nt, Mycobacterium tuberculosis H37Rv
cggaugcgauggccg

SEQ ID NO: 3335743 - RNA, 20 nt, Mycobacterium tuberculosis H37Rv
cggaugcgauggccgacgcu

SEQ ID NO: 3335744 - RNA, 16 nt, Mycobacterium tuberculosis H37Rv
cggaugcggccgguga

SEQ ID NO: 3335745 - RNA, 20 nt, Mycobacterium tuberculosis H37Rv
cggaugcguuggccccagga

SEQ ID NO: 3335746 - RNA, 23 nt, Mycobacterium tuberculosis H37Rv
cggaugcguuggccccaggaucg

SEQ ID NO: 3335747 - RNA, 23 nt, Mycobacterium tuberculosis H37Rv
cggaugcucaggucaccggccgc

SEQ ID NO: 3335748 - RNA, 14 nt, Mycobacterium tuberculosis H37Rv
cggauggccucgaa

SEQ ID NO: 3335749 - RNA, 13 nt, Mycobacterium tuberculosis H37Rv
cggauggccucgg

SEQ ID NO: 3335750 - RNA, 13 nt, Mycobacterium tuberculosis H37Rv
cggauggcggcca

SEQ ID NO: 3335751 - RNA, 14 nt, Mycobacterium tuberculosis H37Rv
cggauguccgccga

SEQ ID NO: 3335752 - RNA, 16 nt, Mycobacterium tuberculosis H37Rv
cggaugucgacgagca

SEQ ID NO: 3335753 - RNA, 21 nt, Mycobacterium tuberculosis H37Rv
cggaugucgacgagcaccgcg

SEQ ID NO: 3335754 - RNA, 17 nt, Mycobacterium tuberculosis H37Rv
cggaugucucggcacca

SEQ ID NO: 3335755 - RNA, 19 nt, Mycobacterium tuberculosis H37Rv
cggaugucucggcaccaca

SEQ ID NO: 3335756 - RNA, 14 nt, Mycobacterium tuberculosis H37Rv
cggauguugaccgg

SEQ ID NO: 3335757 - RNA, 19 nt, Mycobacterium tuberculosis H37Rv
cggauguugaccggcucga

SEQ ID NO: 3335758 - RNA, 16 nt, Mycobacterium tuberculosis H37Rv
cggauuaagucggcgg

SEQ ID NO: 3335759 - RNA, 22 nt, Mycobacterium tuberculosis H37Rv
cggauucaucacgggacgacgg

SEQ ID NO: 3335760 - RNA, 17 nt, Mycobacterium tuberculosis H37Rv
cggauucccgcccagca

SEQ ID NO: 3335761 - RNA, 20 nt, Mycobacterium tuberculosis H37Rv
cggauuccggcucgucaggu

SEQ ID NO: 3335762 - RNA, 23 nt, Mycobacterium tuberculosis H37Rv
cggauugacgccgaaucuggggu

SEQ ID NO: 3335763 - RNA, 15 nt, Mycobacterium tuberculosis H37Rv
cggauugcagcgcga

SEQ ID NO: 3335764 - RNA, 24 nt, Mycobacterium tuberculosis H37Rv
cggauugcagcgcgauggccuggc

SEQ ID NO: 3335765 - RNA, 21 nt, Mycobacterium tuberculosis H37Rv
cggauuggugggccagcagca

SEQ ID NO: 3335766 - RNA, 21 nt, Mycobacterium tuberculosis H37Rv
cggauuucgucgggcaccgcc

SEQ ID NO: 3335767 - RNA, 14 nt, Mycobacterium tuberculosis H37Rv
cggcaaacacugcg

SEQ ID NO: 3335768 - RNA, 18 nt, Mycobacterium tuberculosis H37Rv
cggcaaaccaguuggcga

SEQ ID NO: 3335769 - RNA, 16 nt, Mycobacterium tuberculosis H37Rv
cggcaaaccugagucc

SEQ ID NO: 3335770 - RNA, 18 nt, Mycobacterium tuberculosis H37Rv
cggcaaaccugaguccgg

SEQ ID NO: 3335771 - RNA, 20 nt, Mycobacterium tuberculosis H37Rv
cggcaaacuccagcuugccg

SEQ ID NO: 3335772 - RNA, 21 nt, Mycobacterium tuberculosis H37Rv
cggcaaaggauucgcgcgaau

SEQ ID NO: 3335773 - RNA, 18 nt, Mycobacterium tuberculosis H37Rv
cggcaaaguuggccgccc

SEQ ID NO: 3335774 - RNA, 14 nt, Mycobacterium tuberculosis H37Rv
cggcaacagcacca

SEQ ID NO: 3335775 - RNA, 15 nt, Mycobacterium tuberculosis H37Rv
cggcaacagcaccag

SEQ ID NO: 3335776 - RNA, 16 nt, Mycobacterium tuberculosis H37Rv
cggcaacagcaccagu

SEQ ID NO: 3335777 - RNA, 23 nt, Mycobacterium tuberculosis H37Rv
cggcaacagcgccaagacgucgg

SEQ ID NO: 3335778 - RNA, 16 nt, Mycobacterium tuberculosis H37Rv
cggcaacagcucgccu

SEQ ID NO: 3335779 - RNA, 21 nt, Mycobacterium tuberculosis H37Rv
cggcaacaucgagcgccagcc

SEQ ID NO: 3335780 - RNA, 17 nt, Mycobacterium tuberculosis H37Rv
cggcaacaugagcgucg

SEQ ID NO: 3335781 - RNA, 17 nt, Mycobacterium tuberculosis H37Rv
cggcaaccaccucgugg

SEQ ID NO: 3335782 - RNA, 14 nt, Mycobacterium tuberculosis H37Rv
cggcaaccacggag

SEQ ID NO: 3335783 - RNA, 14 nt, Mycobacterium tuberculosis H37Rv
cggcaaccccgagc

SEQ ID NO: 3335784 - RNA, 14 nt, Mycobacterium tuberculosis H37Rv
cggcaaccgccgug

SEQ ID NO: 3335785 - RNA, 16 nt, Mycobacterium tuberculosis H37Rv
cggcaaccugcgacca

SEQ ID NO: 3335786 - RNA, 14 nt, Mycobacterium tuberculosis H37Rv
cggcaacgcggucu

SEQ ID NO: 3335787 - RNA, 16 nt, Mycobacterium tuberculosis H37Rv
cggcaacgcggucugc

SEQ ID NO: 3335788 - RNA, 19 nt, Mycobacterium tuberculosis H37Rv
cggcaacggcgcgccgacc

SEQ ID NO: 3335789 - RNA, 20 nt, Mycobacterium tuberculosis H37Rv
cggcaacggcgcgccgacca

SEQ ID NO: 3335790 - RNA, 18 nt, Mycobacterium tuberculosis H37Rv
cggcaagaaacagguaag

SEQ ID NO: 3335791 - RNA, 13 nt, Mycobacterium tuberculosis H37Rv
cggcaagaccgaa

SEQ ID NO: 3335792 - RNA, 18 nt, Mycobacterium tuberculosis H37Rv
cggcaagcacaccgccag

SEQ ID NO: 3335793 - RNA, 19 nt, Mycobacterium tuberculosis H37Rv
cggcaagcacaccgccagc

SEQ ID NO: 3335794 - RNA, 22 nt, Mycobacterium tuberculosis H37Rv
cggcaagccacgccggucgcgg

SEQ ID NO: 3335795 - RNA, 14 nt, Mycobacterium tuberculosis H37Rv
cggcaagccgggga

SEQ ID NO: 3335796 - RNA, 18 nt, Mycobacterium tuberculosis H37Rv
cggcaagcgcacgcugag

SEQ ID NO: 3335797 - RNA, 14 nt, Mycobacterium tuberculosis H37Rv
cggcaagcgcagac

SEQ ID NO: 3335798 - RNA, 17 nt, Mycobacterium tuberculosis H37Rv
cggcaaggacggagccc

SEQ ID NO: 3335799 - RNA, 14 nt, Mycobacterium tuberculosis H37Rv
cggcaaggcggauc

SEQ ID NO: 3335800 - RNA, 16 nt, Mycobacterium tuberculosis H37Rv
cggcaaggucaacggg

SEQ ID NO: 3335801 - RNA, 12 nt, Mycobacterium tuberculosis H37Rv
cggcaagucgac

SEQ ID NO: 3335802 - RNA, 18 nt, Mycobacterium tuberculosis H37Rv
cggcaagucgacgccgca

SEQ ID NO: 3335803 - RNA, 17 nt, Mycobacterium tuberculosis H37Rv
cggcaaguuccacgggu

SEQ ID NO: 3335804 - RNA, 15 nt, Mycobacterium tuberculosis H37Rv
cggcaauaccgccag

SEQ ID NO: 3335805 - RNA, 18 nt, Mycobacterium tuberculosis H37Rv
cggcaaucggcggcaccc

SEQ ID NO: 3335806 - RNA, 19 nt, Mycobacterium tuberculosis H37Rv
cggcaaucucaugcccggg

SEQ ID NO: 3335807 - RNA, 12 nt, Mycobacterium tuberculosis H37Rv
cggcaaucucga

SEQ ID NO: 3335808 - RNA, 18 nt, Mycobacterium tuberculosis H37Rv
cggcaaucucgaucuugg

SEQ ID NO: 3335809 - RNA, 20 nt, Mycobacterium tuberculosis H37Rv
cggcaaugacguacgggguc

SEQ ID NO: 3335810 - RNA, 19 nt, Mycobacterium tuberculosis H37Rv
cggcaaugcggggcaaucc

SEQ ID NO: 3335811 - RNA, 18 nt, Mycobacterium tuberculosis H37Rv
cggcaauggccagcacca

SEQ ID NO: 3335812 - RNA, 21 nt, Mycobacterium tuberculosis H37Rv
cggcaauggugcgggccacga

SEQ ID NO: 3335813 - RNA, 20 nt, Mycobacterium tuberculosis H37Rv
cggcaauuacccgacuucaa

SEQ ID NO: 3335814 - RNA, 22 nt, Mycobacterium tuberculosis H37Rv
cggcaauucgggauaggacacc

SEQ ID NO: 3335815 - RNA, 19 nt, Mycobacterium tuberculosis H37Rv
cggcaauugcgguucgaac

SEQ ID NO: 3335816 - RNA, 21 nt, Mycobacterium tuberculosis H37Rv
cggcacaaucggauagccgug

SEQ ID NO: 3335817 - RNA, 16 nt, Mycobacterium tuberculosis H37Rv
cggcacaaucggcgcc

SEQ ID NO: 3335818 - RNA, 20 nt, Mycobacterium tuberculosis H37Rv
cggcacacccaucaccgcca

SEQ ID NO: 3335819 - RNA, 22 nt, Mycobacterium tuberculosis H37Rv
cggcacacccaucaccgccagc

SEQ ID NO: 3335820 - RNA, 16 nt, Mycobacterium tuberculosis H37Rv
cggcacacccaucagc

SEQ ID NO: 3335821 - RNA, 18 nt, Mycobacterium tuberculosis H37Rv
cggcacaccccgguucga

SEQ ID NO: 3335822 - RNA, 16 nt, Mycobacterium tuberculosis H37Rv
cggcacacggccuugc

SEQ ID NO: 3335823 - RNA, 20 nt, Mycobacterium tuberculosis H37Rv
cggcacaggcggccagcauc

SEQ ID NO: 3335824 - RNA, 17 nt, Mycobacterium tuberculosis H37Rv
cggcacauugaucgacg

SEQ ID NO: 3335825 - RNA, 18 nt, Mycobacterium tuberculosis H37Rv
cggcaccaacgccaccgu

SEQ ID NO: 3335826 - RNA, 22 nt, Mycobacterium tuberculosis H37Rv
cggcaccaccaagcucggccag

SEQ ID NO: 3335827 - RNA, 19 nt, Mycobacterium tuberculosis H37Rv
cggcaccaccacgccgacc

SEQ ID NO: 3335828 - RNA, 12 nt, Mycobacterium tuberculosis H37Rv
cggcaccaccgc

SEQ ID NO: 3335829 - RNA, 14 nt, Mycobacterium tuberculosis H37Rv
cggcaccaccgcga

SEQ ID NO: 3335830 - RNA, 21 nt, Mycobacterium tuberculosis H37Rv
cggcaccaccguugccgccgu

SEQ ID NO: 3335831 - RNA, 22 nt, Mycobacterium tuberculosis H37Rv
cggcaccaccguugccgccguc

SEQ ID NO: 3335832 - RNA, 12 nt, Mycobacterium tuberculosis H37Rv
cggcaccacgau

SEQ ID NO: 3335833 - RNA, 21 nt, Mycobacterium tuberculosis H37Rv
cggcaccagaucaacaucauc

SEQ ID NO: 3335834 - RNA, 17 nt, Mycobacterium tuberculosis H37Rv
cggcaccagaucuucga

SEQ ID NO: 3335835 - RNA, 15 nt, Mycobacterium tuberculosis H37Rv
cggcaccagcggcac

SEQ ID NO: 3335836 - RNA, 15 nt, Mycobacterium tuberculosis H37Rv
cggcaccagguugcc

SEQ ID NO: 3335837 - RNA, 19 nt, Mycobacterium tuberculosis H37Rv
cggcaccagguugccgagg

SEQ ID NO: 3335838 - RNA, 20 nt, Mycobacterium tuberculosis H37Rv
cggcaccagguugccgaggu

SEQ ID NO: 3335839 - RNA, 17 nt, Mycobacterium tuberculosis H37Rv
cggcacccagucggcgc

SEQ ID NO: 3335840 - RNA, 15 nt, Mycobacterium tuberculosis H37Rv
cggcacccaguucca

SEQ ID NO: 3335841 - RNA, 21 nt, Mycobacterium tuberculosis H37Rv
cggcacccaguuccacccggu

SEQ ID NO: 3335842 - RNA, 17 nt, Mycobacterium tuberculosis H37Rv
cggcaccccacgccugc

SEQ ID NO: 3335843 - RNA, 15 nt, Mycobacterium tuberculosis H37Rv
cggcacccccgacga

SEQ ID NO: 3335844 - RNA, 17 nt, Mycobacterium tuberculosis H37Rv
cggcaccccggccacuu

SEQ ID NO: 3335845 - RNA, 23 nt, Mycobacterium tuberculosis H37Rv
cggcacccgaaaacugacccccu

SEQ ID NO: 3335846 - RNA, 20 nt, Mycobacterium tuberculosis H37Rv
cggcacccgacucgucggcc

SEQ ID NO: 3335847 - RNA, 23 nt, Mycobacterium tuberculosis H37Rv
cggcacccgaguuauagaagccg

SEQ ID NO: 3335848 - RNA, 16 nt, Mycobacterium tuberculosis H37Rv
cggcacccgcacggcc

SEQ ID NO: 3335849 - RNA, 17 nt, Mycobacterium tuberculosis H37Rv
cggcacccgcacggccu

SEQ ID NO: 3335850 - RNA, 22 nt, Mycobacterium tuberculosis H37Rv
cggcacccgcacggccuccgga

SEQ ID NO: 3335851 - RNA, 16 nt, Mycobacterium tuberculosis H37Rv
cggcacccggcagagc

SEQ ID NO: 3335852 - RNA, 18 nt, Mycobacterium tuberculosis H37Rv
cggcacccggucggccau

SEQ ID NO: 3335853 - RNA, 21 nt, Mycobacterium tuberculosis H37Rv
cggcacccggugagaagaagc

SEQ ID NO: 3335854 - RNA, 22 nt, Mycobacterium tuberculosis H37Rv
cggcacccggugagaagaagcc

SEQ ID NO: 3335855 - RNA, 18 nt, Mycobacterium tuberculosis H37Rv
cggcacccgucgggugcu

SEQ ID NO: 3335856 - RNA, 23 nt, Mycobacterium tuberculosis H37Rv
cggcacccgucgggugcugaugg

SEQ ID NO: 3335857 - RNA, 13 nt, Mycobacterium tuberculosis H37Rv
cggcaccgacggu

SEQ ID NO: 3335858 - RNA, 22 nt, Mycobacterium tuberculosis H37Rv
cggcaccgacugcugucaccgc

SEQ ID NO: 3335859 - RNA, 18 nt, Mycobacterium tuberculosis H37Rv
cggcaccgaucaacggaa

SEQ ID NO: 3335860 - RNA, 22 nt, Mycobacterium tuberculosis H37Rv
cggcaccgaugcacuccaugaa

SEQ ID NO: 3335861 - RNA, 19 nt, Mycobacterium tuberculosis H37Rv
cggcaccgauggcgcaccg

SEQ ID NO: 3335862 - RNA, 23 nt, Mycobacterium tuberculosis H37Rv
cggcaccgauggcgcaccggcgu

SEQ ID NO: 3335863 - RNA, 13 nt, Mycobacterium tuberculosis H37Rv
cggcaccgcagcg

SEQ ID NO: 3335864 - RNA, 11 nt, Mycobacterium tuberculosis H37Rv
cggcaccgcca

SEQ ID NO: 3335865 - RNA, 13 nt, Mycobacterium tuberculosis H37Rv
cggcaccgccccg

SEQ ID NO: 3335866 - RNA, 17 nt, Mycobacterium tuberculosis H37Rv
cggcaccgcccuugccg

SEQ ID NO: 3335867 - RNA, 23 nt, Mycobacterium tuberculosis H37Rv
cggcaccgcccuugccgccguug

SEQ ID NO: 3335868 - RNA, 11 nt, Mycobacterium tuberculosis H37Rv
cggcaccgccg

SEQ ID NO: 3335869 - RNA, 12 nt, Mycobacterium tuberculosis H37Rv
cggcaccgccgc

SEQ ID NO: 3335870 - RNA, 14 nt, Mycobacterium tuberculosis H37Rv
cggcaccgccgccc

SEQ ID NO: 3335871 - RNA, 16 nt, Mycobacterium tuberculosis H37Rv
cggcaccgccgccccc

SEQ ID NO: 3335872 - RNA, 18 nt, Mycobacterium tuberculosis H37Rv
cggcaccgccgcccccgc

SEQ ID NO: 3335873 - RNA, 19 nt, Mycobacterium tuberculosis H37Rv
cggcaccgccgcccccgcc

SEQ ID NO: 3335874 - RNA, 19 nt, Mycobacterium tuberculosis H37Rv
cggcaccgccggcaccgcc

SEQ ID NO: 3335875 - RNA, 20 nt, Mycobacterium tuberculosis H37Rv
cggcaccgccggcaccgccg

SEQ ID NO: 3335876 - RNA, 21 nt, Mycobacterium tuberculosis H37Rv
cggcaccgccggcaccgccgg

SEQ ID NO: 3335877 - RNA, 17 nt, Mycobacterium tuberculosis H37Rv
cggcaccgccggcgccc

SEQ ID NO: 3335878 - RNA, 21 nt, Mycobacterium tuberculosis H37Rv
cggcaccgccggcgcccaggc

SEQ ID NO: 3335879 - RNA, 15 nt, Mycobacterium tuberculosis H37Rv
cggcaccgccggcuc

SEQ ID NO: 3335880 - RNA, 19 nt, Mycobacterium tuberculosis H37Rv
cggcaccgccggcuccgcc

SEQ ID NO: 3335881 - RNA, 20 nt, Mycobacterium tuberculosis H37Rv
cggcaccgccggcuccgccg

SEQ ID NO: 3335882 - RNA, 22 nt, Mycobacterium tuberculosis H37Rv
cggcaccgccgguggcgccggg

SEQ ID NO: 3335883 - RNA, 19 nt, Mycobacterium tuberculosis H37Rv
cggcaccgccugcgccgcc

SEQ ID NO: 3335884 - RNA, 20 nt, Mycobacterium tuberculosis H37Rv
cggcaccgccugcgccgccc

SEQ ID NO: 3335885 - RNA, 16 nt, Mycobacterium tuberculosis H37Rv
cggcaccgcggccagc

SEQ ID NO: 3335886 - RNA, 15 nt, Mycobacterium tuberculosis H37Rv
cggcaccgcggccgc

SEQ ID NO: 3335887 - RNA, 23 nt, Mycobacterium tuberculosis H37Rv
cggcaccgcguaauucgacuucg

SEQ ID NO: 3335888 - RNA, 13 nt, Mycobacterium tuberculosis H37Rv
cggcaccggggcu

SEQ ID NO: 3335889 - RNA, 16 nt, Mycobacterium tuberculosis H37Rv
cggcaccggggcugcc

SEQ ID NO: 3335890 - RNA, 21 nt, Mycobacterium tuberculosis H37Rv
cggcaccggggcugcccgcgg

SEQ ID NO: 3335891 - RNA, 19 nt, Mycobacterium tuberculosis H37Rv
cggcaccgguuuucgccgg

SEQ ID NO: 3335892 - RNA, 22 nt, Mycobacterium tuberculosis H37Rv
cggcaccgguuuucgccggcuc

SEQ ID NO: 3335893 - RNA, 20 nt, Mycobacterium tuberculosis H37Rv
cggcaccguagagcaugccg

SEQ ID NO: 3335894 - RNA, 21 nt, Mycobacterium tuberculosis H37Rv
cggcaccgucucgcaccgcgu

SEQ ID NO: 3335895 - RNA, 18 nt, Mycobacterium tuberculosis H37Rv
cggcaccgugcggggggc

SEQ ID NO: 3335896 - RNA, 16 nt, Mycobacterium tuberculosis H37Rv
cggcaccgugucgacg

SEQ ID NO: 3335897 - RNA, 20 nt, Mycobacterium tuberculosis H37Rv
cggcaccuccagcaccaccg

SEQ ID NO: 3335898 - RNA, 13 nt, Mycobacterium tuberculosis H37Rv
cggcaccuccgcc

SEQ ID NO: 3335899 - RNA, 20 nt, Mycobacterium tuberculosis H37Rv
cggcaccuccgccggcaccu

SEQ ID NO: 3335900 - RNA, 22 nt, Mycobacterium tuberculosis H37Rv
cggcaccuccgccggcaccucc

SEQ ID NO: 3335901 - RNA, 15 nt, Mycobacterium tuberculosis H37Rv
cggcaccuccggcac

SEQ ID NO: 3335902 - RNA, 19 nt, Mycobacterium tuberculosis H37Rv
cggcaccuccggcaccgcc

SEQ ID NO: 3335903 - RNA, 17 nt, Mycobacterium tuberculosis H37Rv
cggcaccucgacgucga

SEQ ID NO: 3335904 - RNA, 18 nt, Mycobacterium tuberculosis H37Rv
cggcaccugguccaaucg

SEQ ID NO: 3335905 - RNA, 19 nt, Mycobacterium tuberculosis H37Rv
cggcacgaaauugggcgau

SEQ ID NO: 3335906 - RNA, 16 nt, Mycobacterium tuberculosis H37Rv
cggcacgacccgggaa

SEQ ID NO: 3335907 - RNA, 18 nt, Mycobacterium tuberculosis H37Rv
cggcacgaccgcucccgg

SEQ ID NO: 3335908 - RNA, 18 nt, Mycobacterium tuberculosis H37Rv
cggcacgaucaaccgggu

SEQ ID NO: 3335909 - RNA, 15 nt, Mycobacterium tuberculosis H37Rv
cggcacgaucgccaa

SEQ ID NO: 3335910 - RNA, 17 nt, Mycobacterium tuberculosis H37Rv
cggcacgaucgccaacg

SEQ ID NO: 3335911 - RNA, 14 nt, Mycobacterium tuberculosis H37Rv
cggcacgcaauguc

SEQ ID NO: 3335912 - RNA, 23 nt, Mycobacterium tuberculosis H37Rv
cggcacgcacgcgguucaccacg

SEQ ID NO: 3335913 - RNA, 19 nt, Mycobacterium tuberculosis H37Rv
cggcacgcagccaaugccg

SEQ ID NO: 3335914 - RNA, 20 nt, Mycobacterium tuberculosis H37Rv
cggcacgcccacagcugacg

SEQ ID NO: 3335915 - RNA, 14 nt, Mycobacterium tuberculosis H37Rv
cggcacgccggcgg

SEQ ID NO: 3335916 - RNA, 16 nt, Mycobacterium tuberculosis H37Rv
cggcacgccggcggcg

SEQ ID NO: 3335917 - RNA, 18 nt, Mycobacterium tuberculosis H37Rv
cggcacgcgucuggaacg

SEQ ID NO: 3335918 - RNA, 16 nt, Mycobacterium tuberculosis H37Rv
cggcacgcuccagcuc

SEQ ID NO: 3335919 - RNA, 22 nt, Mycobacterium tuberculosis H37Rv
cggcacgcuccagcucggccag

SEQ ID NO: 3335920 - RNA, 22 nt, Mycobacterium tuberculosis H37Rv
cggcacgcugaccggaucugac

SEQ ID NO: 3335921 - RNA, 18 nt, Mycobacterium tuberculosis H37Rv
cggcacggaugcgauggc

SEQ ID NO: 3335922 - RNA, 22 nt, Mycobacterium tuberculosis H37Rv
cggcacggaugcgauggccgac

SEQ ID NO: 3335923 - RNA, 23 nt, Mycobacterium tuberculosis H37Rv
cggcacggugaacaauccgagga

SEQ ID NO: 3335924 - RNA, 17 nt, Mycobacterium tuberculosis H37Rv
cggcacgucggcgccga

SEQ ID NO: 3335925 - RNA, 19 nt, Mycobacterium tuberculosis H37Rv
cggcacgucggcgccgacc

SEQ ID NO: 3335926 - RNA, 18 nt, Mycobacterium tuberculosis H37Rv
cggcacgucgucguccca

SEQ ID NO: 3335927 - RNA, 20 nt, Mycobacterium tuberculosis H37Rv
cggcacuaacggcgugucgg

SEQ ID NO: 3335928 - RNA, 15 nt, Mycobacterium tuberculosis H37Rv
cggcacuacgcagcc

SEQ ID NO: 3335929 - RNA, 14 nt, Mycobacterium tuberculosis H37Rv
cggcacucccuggg

SEQ ID NO: 3335930 - RNA, 13 nt, Mycobacterium tuberculosis H37Rv
cggcacugaccgc

SEQ ID NO: 3335931 - RNA, 15 nt, Mycobacterium tuberculosis H37Rv
cggcacugaccgcga

SEQ ID NO: 3335932 - RNA, 14 nt, Mycobacterium tuberculosis H37Rv
cggcacugaucugc

SEQ ID NO: 3335933 - RNA, 14 nt, Mycobacterium tuberculosis H37Rv
cggcacugcccagc

SEQ ID NO: 3335934 - RNA, 19 nt, Mycobacterium tuberculosis H37Rv
cggcacugcccagcagacc

SEQ ID NO: 3335935 - RNA, 13 nt, Mycobacterium tuberculosis H37Rv
cggcacuggcccc

SEQ ID NO: 3335936 - RNA, 17 nt, Mycobacterium tuberculosis H37Rv
cggcacuggccccggug

SEQ ID NO: 3335937 - RNA, 15 nt, Mycobacterium tuberculosis H37Rv
cggcacuuagcccga

SEQ ID NO: 3335938 - RNA, 19 nt, Mycobacterium tuberculosis H37Rv
cggcacuuagcccgauggu

SEQ ID NO: 3335939 - RNA, 23 nt, Mycobacterium tuberculosis H37Rv
cggcacuuagcccgauggugccg

SEQ ID NO: 3335940 - RNA, 20 nt, Mycobacterium tuberculosis H37Rv
cggcacuugggaaggauggu

SEQ ID NO: 3335941 - RNA, 22 nt, Mycobacterium tuberculosis H37Rv
cggcacuugggaaggauggucg

SEQ ID NO: 3335942 - RNA, 21 nt, Mycobacterium tuberculosis H37Rv
cggcacuuuguagcccgcgau

SEQ ID NO: 3335943 - RNA, 21 nt, Mycobacterium tuberculosis H37Rv
cggcagaauccggucgaugac

SEQ ID NO: 3335944 - RNA, 18 nt, Mycobacterium tuberculosis H37Rv
cggcagacccgggccagu

SEQ ID NO: 3335945 - RNA, 12 nt, Mycobacterium tuberculosis H37Rv
cggcagaccgac

SEQ ID NO: 3335946 - RNA, 17 nt, Mycobacterium tuberculosis H37Rv
cggcagaccgaccucgg

SEQ ID NO: 3335947 - RNA, 19 nt, Mycobacterium tuberculosis H37Rv
cggcagaccgaccucggcg

SEQ ID NO: 3335948 - RNA, 21 nt, Mycobacterium tuberculosis H37Rv
cggcagaccgaccucggcgac

SEQ ID NO: 3335949 - RNA, 23 nt, Mycobacterium tuberculosis H37Rv
cggcagaccggugcugucgacgu

SEQ ID NO: 3335950 - RNA, 13 nt, Mycobacterium tuberculosis H37Rv
cggcagacgcguu

SEQ ID NO: 3335951 - RNA, 20 nt, Mycobacterium tuberculosis H37Rv
cggcagacgcguuucgucga

SEQ ID NO: 3335952 - RNA, 16 nt, Mycobacterium tuberculosis H37Rv
cggcagauacucggcg

SEQ ID NO: 3335953 - RNA, 18 nt, Mycobacterium tuberculosis H37Rv
cggcagauacucggcgac

SEQ ID NO: 3335954 - RNA, 18 nt, Mycobacterium tuberculosis H37Rv
cggcagaucccacgccag

SEQ ID NO: 3335955 - RNA, 22 nt, Mycobacterium tuberculosis H37Rv
cggcagaucccacgccaggauc

SEQ ID NO: 3335956 - RNA, 22 nt, Mycobacterium tuberculosis H37Rv
cggcagaugcagcgggucgccg

SEQ ID NO: 3335957 - RNA, 11 nt, Mycobacterium tuberculosis H37Rv
cggcagauggu

SEQ ID NO: 3335958 - RNA, 16 nt, Mycobacterium tuberculosis H37Rv
cggcagcacccacauc

SEQ ID NO: 3335959 - RNA, 15 nt, Mycobacterium tuberculosis H37Rv
cggcagcaccgguga

SEQ ID NO: 3335960 - RNA, 21 nt, Mycobacterium tuberculosis H37Rv
cggcagcaccggugaccucgg

SEQ ID NO: 3335961 - RNA, 14 nt, Mycobacterium tuberculosis H37Rv
cggcagcacggucu

SEQ ID NO: 3335962 - RNA, 22 nt, Mycobacterium tuberculosis H37Rv
cggcagcagaguucccugaugg

SEQ ID NO: 3335963 - RNA, 14 nt, Mycobacterium tuberculosis H37Rv
cggcagcagcagag

SEQ ID NO: 3335964 - RNA, 14 nt, Mycobacterium tuberculosis H37Rv
cggcagcagcgccg

SEQ ID NO: 3335965 - RNA, 14 nt, Mycobacterium tuberculosis H37Rv
cggcagcaggacac

SEQ ID NO: 3335966 - RNA, 21 nt, Mycobacterium tuberculosis H37Rv
cggcagcaggacacucuuuug

SEQ ID NO: 3335967 - RNA, 16 nt, Mycobacterium tuberculosis H37Rv
cggcagcauauccgcc

SEQ ID NO: 3335968 - RNA, 14 nt, Mycobacterium tuberculosis H37Rv
cggcagcaucggca

SEQ ID NO: 3335969 - RNA, 23 nt, Mycobacterium tuberculosis H37Rv
cggcagcaucggcaccccggcca

SEQ ID NO: 3335970 - RNA, 18 nt, Mycobacterium tuberculosis H37Rv
cggcagccaaccggcgca

SEQ ID NO: 3335971 - RNA, 13 nt, Mycobacterium tuberculosis H37Rv
cggcagccaagcg

SEQ ID NO: 3335972 - RNA, 14 nt, Mycobacterium tuberculosis H37Rv
cggcagccaccagc

SEQ ID NO: 3335973 - RNA, 19 nt, Mycobacterium tuberculosis H37Rv
cggcagccaccagcgacga

SEQ ID NO: 3335974 - RNA, 14 nt, Mycobacterium tuberculosis H37Rv
cggcagccagggcg

SEQ ID NO: 3335975 - RNA, 16 nt, Mycobacterium tuberculosis H37Rv
cggcagccagggcgcc

SEQ ID NO: 3335976 - RNA, 18 nt, Mycobacterium tuberculosis H37Rv
cggcagccaugcggcugc

SEQ ID NO: 3335977 - RNA, 23 nt, Mycobacterium tuberculosis H37Rv
cggcagcccaaagcgccagcagc

SEQ ID NO: 3335978 - RNA, 17 nt, Mycobacterium tuberculosis H37Rv
cggcagccccugccgau

SEQ ID NO: 3335979 - RNA, 14 nt, Mycobacterium tuberculosis H37Rv
cggcagcccggcgg

SEQ ID NO: 3335980 - RNA, 13 nt, Mycobacterium tuberculosis H37Rv
cggcagccgcaua

SEQ ID NO: 3335981 - RNA, 15 nt, Mycobacterium tuberculosis H37Rv
cggcagccgcauagg

SEQ ID NO: 3335982 - RNA, 20 nt, Mycobacterium tuberculosis H37Rv
cggcagccggcuugggcggu

SEQ ID NO: 3335983 - RNA, 23 nt, Mycobacterium tuberculosis H37Rv
cggcagccggcuugggcgguagc

SEQ ID NO: 3335984 - RNA, 14 nt, Mycobacterium tuberculosis H37Rv
cggcagccuggccu

SEQ ID NO: 3335985 - RNA, 22 nt, Mycobacterium tuberculosis H37Rv
cggcagccuugaucucguccca

SEQ ID NO: 3335986 - RNA, 21 nt, Mycobacterium tuberculosis H37Rv
cggcagcgaaaggagcuccau

SEQ ID NO: 3335987 - RNA, 20 nt, Mycobacterium tuberculosis H37Rv
cggcagcgacgccggcccga

SEQ ID NO: 3335988 - RNA, 17 nt, Mycobacterium tuberculosis H37Rv
cggcagcgaggcucgca

SEQ ID NO: 3335989 - RNA, 15 nt, Mycobacterium tuberculosis H37Rv
cggcagcgagucgac

SEQ ID NO: 3335990 - RNA, 16 nt, Mycobacterium tuberculosis H37Rv
cggcagcgagucgacg

SEQ ID NO: 3335991 - RNA, 14 nt, Mycobacterium tuberculosis H37Rv
cggcagcgaucggg

SEQ ID NO: 3335992 - RNA, 14 nt, Mycobacterium tuberculosis H37Rv
cggcagcgaugcgg

SEQ ID NO: 3335993 - RNA, 22 nt, Mycobacterium tuberculosis H37Rv
cggcagcgaugcggugucgggc

SEQ ID NO: 3335994 - RNA, 15 nt, Mycobacterium tuberculosis H37Rv
cggcagcgccaccga

SEQ ID NO: 3335995 - RNA, 19 nt, Mycobacterium tuberculosis H37Rv
cggcagcgccaccgaccga

SEQ ID NO: 3335996 - RNA, 21 nt, Mycobacterium tuberculosis H37Rv
cggcagcgcccagaucgccga

SEQ ID NO: 3335997 - RNA, 16 nt, Mycobacterium tuberculosis H37Rv
cggcagcgccggucgg

SEQ ID NO: 3335998 - RNA, 19 nt, Mycobacterium tuberculosis H37Rv
cggcagcgccggucggauc

SEQ ID NO: 3335999 - RNA, 21 nt, Mycobacterium tuberculosis H37Rv
cggcagcgcgaucgauuccgc

SEQ ID NO: 3336000 - RNA, 18 nt, Mycobacterium tuberculosis H37Rv
cggcagcggaccgcugcc

SEQ ID NO: 3336001 - RNA, 21 nt, Mycobacterium tuberculosis H37Rv
cggcagcggcgaguuggccgu

SEQ ID NO: 3336002 - RNA, 15 nt, Mycobacterium tuberculosis H37Rv
cggcagcggcgauca

SEQ ID NO: 3336003 - RNA, 16 nt, Mycobacterium tuberculosis H37Rv
cggcagcggcgccgcc

SEQ ID NO: 3336004 - RNA, 20 nt, Mycobacterium tuberculosis H37Rv
cggcagcggcgccgccugga

SEQ ID NO: 3336005 - RNA, 13 nt, Mycobacterium tuberculosis H37Rv
cggcagcggcgcg

SEQ ID NO: 3336006 - RNA, 13 nt, Mycobacterium tuberculosis H37Rv
cggcagcggcgcu

SEQ ID NO: 3336007 - RNA, 18 nt, Mycobacterium tuberculosis H37Rv
cggcagcggcgcucggcg

SEQ ID NO: 3336008 - RNA, 14 nt, Mycobacterium tuberculosis H37Rv
cggcagcggcuggg

SEQ ID NO: 3336009 - RNA, 23 nt, Mycobacterium tuberculosis H37Rv
cggcagcggguuugccgggcgcu

SEQ ID NO: 3336010 - RNA, 18 nt, Mycobacterium tuberculosis H37Rv
cggcagcggugcuggugg

SEQ ID NO: 3336011 - RNA, 22 nt, Mycobacterium tuberculosis H37Rv
cggcagcgguggcuugccccgc

SEQ ID NO: 3336012 - RNA, 22 nt, Mycobacterium tuberculosis H37Rv
cggcagcgguuuuaggcagccc

SEQ ID NO: 3336013 - RNA, 16 nt, Mycobacterium tuberculosis H37Rv
cggcagcguccacaug

SEQ ID NO: 3336014 - RNA, 16 nt, Mycobacterium tuberculosis H37Rv
cggcagcgugcggggc

SEQ ID NO: 3336015 - RNA, 21 nt, Mycobacterium tuberculosis H37Rv
cggcagcgugcggggcgccug

SEQ ID NO: 3336016 - RNA, 15 nt, Mycobacterium tuberculosis H37Rv
cggcagcgugggcga

SEQ ID NO: 3336017 - RNA, 13 nt, Mycobacterium tuberculosis H37Rv
cggcagcguugac

SEQ ID NO: 3336018 - RNA, 24 nt, Mycobacterium tuberculosis H37Rv
cggcagcuacuaugccaacgacag

SEQ ID NO: 3336019 - RNA, 20 nt, Mycobacterium tuberculosis H37Rv
cggcagcuggcgcagccugc

SEQ ID NO: 3336020 - RNA, 22 nt, Mycobacterium tuberculosis H37Rv
cggcagcuggggcccggccgcc

SEQ ID NO: 3336021 - RNA, 19 nt, Mycobacterium tuberculosis H37Rv
cggcagcuggucggugggc

SEQ ID NO: 3336022 - RNA, 18 nt, Mycobacterium tuberculosis H37Rv
cggcagcuugcagugccg

SEQ ID NO: 3336023 - RNA, 20 nt, Mycobacterium tuberculosis H37Rv
cggcagcuuugacgcccucg

SEQ ID NO: 3336024 - RNA, 20 nt, Mycobacterium tuberculosis H37Rv
cggcaggaaugccgcgggga

SEQ ID NO: 3336025 - RNA, 15 nt, Mycobacterium tuberculosis H37Rv
cggcaggauucccuc

SEQ ID NO: 3336026 - RNA, 17 nt, Mycobacterium tuberculosis H37Rv
cggcaggauucccucga

SEQ ID NO: 3336027 - RNA, 20 nt, Mycobacterium tuberculosis H37Rv
cggcaggcccgacggcgccc

SEQ ID NO: 3336028 - RNA, 16 nt, Mycobacterium tuberculosis H37Rv
cggcaggcccggaggg

SEQ ID NO: 3336029 - RNA, 23 nt, Mycobacterium tuberculosis H37Rv
cggcaggcccggaggguucggac

SEQ ID NO: 3336030 - RNA, 14 nt, Mycobacterium tuberculosis H37Rv
cggcaggcggccgc

SEQ ID NO: 3336031 - RNA, 23 nt, Mycobacterium tuberculosis H37Rv
cggcaggcuggcgagggcugacg

SEQ ID NO: 3336032 - RNA, 18 nt, Mycobacterium tuberculosis H37Rv
cggcaggucuucgcuguc

SEQ ID NO: 3336033 - RNA, 19 nt, Mycobacterium tuberculosis H37Rv
cggcaggucuucgcugucg

SEQ ID NO: 3336034 - RNA, 19 nt, Mycobacterium tuberculosis H37Rv
cggcaggugcggcggcauc

SEQ ID NO: 3336035 - RNA, 12 nt, Mycobacterium tuberculosis H37Rv
cggcaguacccc

SEQ ID NO: 3336036 - RNA, 20 nt, Mycobacterium tuberculosis H37Rv
cggcagucauuauucgcgca

SEQ ID NO: 3336037 - RNA, 16 nt, Mycobacterium tuberculosis H37Rv
cggcagugcugcagac

SEQ ID NO: 3336038 - RNA, 16 nt, Mycobacterium tuberculosis H37Rv
cggcaguuccugacgc

SEQ ID NO: 3336039 - RNA, 16 nt, Mycobacterium tuberculosis H37Rv
cggcauaaacaucggu

SEQ ID NO: 3336040 - RNA, 17 nt, Mycobacterium tuberculosis H37Rv
cggcauaacccuggccg

SEQ ID NO: 3336041 - RNA, 22 nt, Mycobacterium tuberculosis H37Rv
cggcauaacccuggccggugcg

SEQ ID NO: 3336042 - RNA, 18 nt, Mycobacterium tuberculosis H37Rv
cggcauaacgaucccgug

SEQ ID NO: 3336043 - RNA, 16 nt, Mycobacterium tuberculosis H37Rv
cggcauacaacuggug

SEQ ID NO: 3336044 - RNA, 19 nt, Mycobacterium tuberculosis H37Rv
cggcauagcggcccaucgg

SEQ ID NO: 3336045 - RNA, 16 nt, Mycobacterium tuberculosis H37Rv
cggcaucaacgcgggc

SEQ ID NO: 3336046 - RNA, 19 nt, Mycobacterium tuberculosis H37Rv
cggcaucaacgcgggcgcu

SEQ ID NO: 3336047 - RNA, 22 nt, Mycobacterium tuberculosis H37Rv
cggcauccaggcugucgcgggc

SEQ ID NO: 3336048 - RNA, 22 nt, Mycobacterium tuberculosis H37Rv
cggcauccccaguugugcggcc

SEQ ID NO: 3336049 - RNA, 19 nt, Mycobacterium tuberculosis H37Rv
cggcaucccggccgcucag

SEQ ID NO: 3336050 - RNA, 15 nt, Mycobacterium tuberculosis H37Rv
cggcauccgcgggga

SEQ ID NO: 3336051 - RNA, 21 nt, Mycobacterium tuberculosis H37Rv
cggcauccucaacaacgguag

SEQ ID NO: 3336052 - RNA, 15 nt, Mycobacterium tuberculosis H37Rv
cggcauccugcacga

SEQ ID NO: 3336053 - RNA, 18 nt, Mycobacterium tuberculosis H37Rv
cggcauccugcacgaccc

SEQ ID NO: 3336054 - RNA, 14 nt, Mycobacterium tuberculosis H37Rv
cggcaucgacugcc

SEQ ID NO: 3336055 - RNA, 15 nt, Mycobacterium tuberculosis H37Rv
cggcaucgacugcca

SEQ ID NO: 3336056 - RNA, 19 nt, Mycobacterium tuberculosis H37Rv
cggcaucgagacgcacggc

SEQ ID NO: 3336057 - RNA, 13 nt, Mycobacterium tuberculosis H37Rv
cggcaucgagcag

SEQ ID NO: 3336058 - RNA, 20 nt, Mycobacterium tuberculosis H37Rv
cggcaucgaguucggcccgc

SEQ ID NO: 3336059 - RNA, 17 nt, Mycobacterium tuberculosis H37Rv
cggcaucgccgagcucg

SEQ ID NO: 3336060 - RNA, 14 nt, Mycobacterium tuberculosis H37Rv
cggcaucgccgcgg

SEQ ID NO: 3336061 - RNA, 17 nt, Mycobacterium tuberculosis H37Rv
cggcaucgccgcgggug

SEQ ID NO: 3336062 - RNA, 22 nt, Mycobacterium tuberculosis H37Rv
cggcaucgcgggcggcgcuggc

SEQ ID NO: 3336063 - RNA, 15 nt, Mycobacterium tuberculosis H37Rv
cggcaucggccagcc

SEQ ID NO: 3336064 - RNA, 17 nt, Mycobacterium tuberculosis H37Rv
cggcaucggugguaaca

SEQ ID NO: 3336065 - RNA, 20 nt, Mycobacterium tuberculosis H37Rv
cggcaucgucgacgcccgau

SEQ ID NO: 3336066 - RNA, 14 nt, Mycobacterium tuberculosis H37Rv
cggcaucgucgcca

SEQ ID NO: 3336067 - RNA, 13 nt, Mycobacterium tuberculosis H37Rv
cggcaucuccacc

SEQ ID NO: 3336068 - RNA, 15 nt, Mycobacterium tuberculosis H37Rv
cggcaucuccaccgu

SEQ ID NO: 3336069 - RNA, 17 nt, Mycobacterium tuberculosis H37Rv
cggcaucuccaccgucg

SEQ ID NO: 3336070 - RNA, 22 nt, Mycobacterium tuberculosis H37Rv
cggcaucugaaaauugaccccc

SEQ ID NO: 3336071 - RNA, 18 nt, Mycobacterium tuberculosis H37Rv
cggcaucugguauggguc

SEQ ID NO: 3336072 - RNA, 17 nt, Mycobacterium tuberculosis H37Rv
cggcaugcaaugcuggc

SEQ ID NO: 3336073 - RNA, 18 nt, Mycobacterium tuberculosis H37Rv
cggcaugcaaugcuggcg

SEQ ID NO: 3336074 - RNA, 17 nt, Mycobacterium tuberculosis H37Rv
cggcaugcagccccacu

SEQ ID NO: 3336075 - RNA, 17 nt, Mycobacterium tuberculosis H37Rv
cggcaugccagccacga

SEQ ID NO: 3336076 - RNA, 22 nt, Mycobacterium tuberculosis H37Rv
cggcaugccagccacgaacuga

SEQ ID NO: 3336077 - RNA, 21 nt, Mycobacterium tuberculosis H37Rv
cggcaugcccgcggugaccac

SEQ ID NO: 3336078 - RNA, 20 nt, Mycobacterium tuberculosis H37Rv
cggcaugcgugccggcagcg

SEQ ID NO: 3336079 - RNA, 18 nt, Mycobacterium tuberculosis H37Rv
cggcaugcucaccgaaac

SEQ ID NO: 3336080 - RNA, 15 nt, Mycobacterium tuberculosis H37Rv
cggcaugggcccugc

SEQ ID NO: 3336081 - RNA, 21 nt, Mycobacterium tuberculosis H37Rv
cggcaugggucgugcaggcga

SEQ ID NO: 3336082 - RNA, 13 nt, Mycobacterium tuberculosis H37Rv
cggcauggugacg

SEQ ID NO: 3336083 - RNA, 15 nt, Mycobacterium tuberculosis H37Rv
cggcauguaccgacc

SEQ ID NO: 3336084 - RNA, 18 nt, Mycobacterium tuberculosis H37Rv
cggcauguaccgaccgcg

SEQ ID NO: 3336085 - RNA, 20 nt, Mycobacterium tuberculosis H37Rv
cggcauguaccgaccgcguu

SEQ ID NO: 3336086 - RNA, 22 nt, Mycobacterium tuberculosis H37Rv
cggcauguucagcccgaacucg

SEQ ID NO: 3336087 - RNA, 22 nt, Mycobacterium tuberculosis H37Rv
cggcauguuccuugcggccgcu

SEQ ID NO: 3336088 - RNA, 20 nt, Mycobacterium tuberculosis H37Rv
cggcauucucgagcacccgc

SEQ ID NO: 3336089 - RNA, 20 nt, Mycobacterium tuberculosis H37Rv
cggcauugcccgagcccagc

SEQ ID NO: 3336090 - RNA, 17 nt, Mycobacterium tuberculosis H37Rv
cggcauuucagcgcgcc

SEQ ID NO: 3336091 - RNA, 13 nt, Mycobacterium tuberculosis H37Rv
cggccaaaauggc

SEQ ID NO: 3336092 - RNA, 21 nt, Mycobacterium tuberculosis H37Rv
cggccaaaauggcgcgaacgu

SEQ ID NO: 3336093 - RNA, 23 nt, Mycobacterium tuberculosis H37Rv
cggccaaaauuuugucggccgcc

SEQ ID NO: 3336094 - RNA, 20 nt, Mycobacterium tuberculosis H37Rv
cggccaaagacccggcaccc

SEQ ID NO: 3336095 - RNA, 23 nt, Mycobacterium tuberculosis H37Rv
cggccaaagacccggcacccagu

SEQ ID NO: 3336096 - RNA, 22 nt, Mycobacterium tuberculosis H37Rv
cggccaacaccacuagcggcuc

SEQ ID NO: 3336097 - RNA, 21 nt, Mycobacterium tuberculosis H37Rv
cggccaacagguccaccggcc

SEQ ID NO: 3336098 - RNA, 19 nt, Mycobacterium tuberculosis H37Rv
cggccaacagucgcagcac

SEQ ID NO: 3336099 - RNA, 14 nt, Mycobacterium tuberculosis H37Rv
cggccaaccaccaa

SEQ ID NO: 3336100 - RNA, 14 nt, Mycobacterium tuberculosis H37Rv
cggccaaccaugcu

SEQ ID NO: 3336101 - RNA, 17 nt, Mycobacterium tuberculosis H37Rv
cggccaacccaucccga

SEQ ID NO: 3336102 - RNA, 22 nt, Mycobacterium tuberculosis H37Rv
cggccaacccgggccgccaggg

SEQ ID NO: 3336103 - RNA, 23 nt, Mycobacterium tuberculosis H37Rv
cggccaacgaacgugccccggcg

SEQ ID NO: 3336104 - RNA, 18 nt, Mycobacterium tuberculosis H37Rv
cggccaacgacgacccgu

SEQ ID NO: 3336105 - RNA, 20 nt, Mycobacterium tuberculosis H37Rv
cggccaacgacgacccguug

SEQ ID NO: 3336106 - RNA, 20 nt, Mycobacterium tuberculosis H37Rv
cggccaacgacggccgacaa

SEQ ID NO: 3336107 - RNA, 18 nt, Mycobacterium tuberculosis H37Rv
cggccaacggaccguuac

SEQ ID NO: 3336108 - RNA, 21 nt, Mycobacterium tuberculosis H37Rv
cggccaacggcuccgggcgcu

SEQ ID NO: 3336109 - RNA, 13 nt, Mycobacterium tuberculosis H37Rv
cggccaacugggc

SEQ ID NO: 3336110 - RNA, 22 nt, Mycobacterium tuberculosis H37Rv
cggccaacugggccgagcgcgc

SEQ ID NO: 3336111 - RNA, 21 nt, Mycobacterium tuberculosis H37Rv
cggccaacuucugcacgaacg

SEQ ID NO: 3336112 - RNA, 17 nt, Mycobacterium tuberculosis H37Rv
cggccaaguugaccccc

SEQ ID NO: 3336113 - RNA, 16 nt, Mycobacterium tuberculosis H37Rv
cggccaaucagcccgc

SEQ ID NO: 3336114 - RNA, 15 nt, Mycobacterium tuberculosis H37Rv
cggccaauccggggc

SEQ ID NO: 3336115 - RNA, 20 nt, Mycobacterium tuberculosis H37Rv
cggccaauugcgccgccaac

SEQ ID NO: 3336116 - RNA, 22 nt, Mycobacterium tuberculosis H37Rv
cggccaauugcgccgccaacuc

SEQ ID NO: 3336117 - RNA, 13 nt, Mycobacterium tuberculosis H37Rv
cggccacaaccuc

SEQ ID NO: 3336118 - RNA, 12 nt, Mycobacterium tuberculosis H37Rv
cggccacaccgu

SEQ ID NO: 3336119 - RNA, 23 nt, Mycobacterium tuberculosis H37Rv
cggccacaccgucacgccaccgc

SEQ ID NO: 3336120 - RNA, 22 nt, Mycobacterium tuberculosis H37Rv
cggccacaccuuggccgccggc

SEQ ID NO: 3336121 - RNA, 13 nt, Mycobacterium tuberculosis H37Rv
cggccacagugca

SEQ ID NO: 3336122 - RNA, 22 nt, Mycobacterium tuberculosis H37Rv
cggccacagugcauacgguuga

SEQ ID NO: 3336123 - RNA, 18 nt, Mycobacterium tuberculosis H37Rv
cggccacauaccaccacg

SEQ ID NO: 3336124 - RNA, 18 nt, Mycobacterium tuberculosis H37Rv
cggccacauccagcgcuu

SEQ ID NO: 3336125 - RNA, 19 nt, Mycobacterium tuberculosis H37Rv
cggccacauccagcgcuuc

SEQ ID NO: 3336126 - RNA, 15 nt, Mycobacterium tuberculosis H37Rv
cggccacaucgccag

SEQ ID NO: 3336127 - RNA, 16 nt, Mycobacterium tuberculosis H37Rv
cggccacaucgccagc

SEQ ID NO: 3336128 - RNA, 23 nt, Mycobacterium tuberculosis H37Rv
cggccacaucgccagcagcaaac

SEQ ID NO: 3336129 - RNA, 12 nt, Mycobacterium tuberculosis H37Rv
cggccaccaacc

SEQ ID NO: 3336130 - RNA, 13 nt, Mycobacterium tuberculosis H37Rv
cggccaccaaccu

SEQ ID NO: 3336131 - RNA, 19 nt, Mycobacterium tuberculosis H37Rv
cggccaccaaccucaucgc

SEQ ID NO: 3336132 - RNA, 13 nt, Mycobacterium tuberculosis H37Rv
cggccaccaacuc

SEQ ID NO: 3336133 - RNA, 14 nt, Mycobacterium tuberculosis H37Rv
cggccaccaccgag

SEQ ID NO: 3336134 - RNA, 21 nt, Mycobacterium tuberculosis H37Rv
cggccaccaccgagcgcaacc

SEQ ID NO: 3336135 - RNA, 23 nt, Mycobacterium tuberculosis H37Rv
cggccaccaccgagcgcaacccg

SEQ ID NO: 3336136 - RNA, 13 nt, Mycobacterium tuberculosis H37Rv
cggccaccaccgc

SEQ ID NO: 3336137 - RNA, 14 nt, Mycobacterium tuberculosis H37Rv
cggccaccaccgcc

SEQ ID NO: 3336138 - RNA, 15 nt, Mycobacterium tuberculosis H37Rv
cggccaccaccgccg

SEQ ID NO: 3336139 - RNA, 18 nt, Mycobacterium tuberculosis H37Rv
cggccaccaccgccgccg

SEQ ID NO: 3336140 - RNA, 20 nt, Mycobacterium tuberculosis H37Rv
cggccaccaccgccgccggc

SEQ ID NO: 3336141 - RNA, 22 nt, Mycobacterium tuberculosis H37Rv
cggccaccaccgccgccggcac

SEQ ID NO: 3336142 - RNA, 18 nt, Mycobacterium tuberculosis H37Rv
cggccaccaccgcgccgu

SEQ ID NO: 3336143 - RNA, 20 nt, Mycobacterium tuberculosis H37Rv
cggccaccaccgcgccgucg

SEQ ID NO: 3336144 - RNA, 14 nt, Mycobacterium tuberculosis H37Rv
cggccaccagcccg

SEQ ID NO: 3336145 - RNA, 15 nt, Mycobacterium tuberculosis H37Rv
cggccaccagcgccc

SEQ ID NO: 3336146 - RNA, 18 nt, Mycobacterium tuberculosis H37Rv
cggccaccagcgcccggc

SEQ ID NO: 3336147 - RNA, 15 nt, Mycobacterium tuberculosis H37Rv
cggccaccagcgccu

SEQ ID NO: 3336148 - RNA, 15 nt, Mycobacterium tuberculosis H37Rv
cggccaccagggcca

SEQ ID NO: 3336149 - RNA, 16 nt, Mycobacterium tuberculosis H37Rv
cggccaccagggccac

SEQ ID NO: 3336150 - RNA, 20 nt, Mycobacterium tuberculosis H37Rv
cggccaccagggccaccgcg

SEQ ID NO: 3336151 - RNA, 13 nt, Mycobacterium tuberculosis H37Rv
cggccaccaggug

SEQ ID NO: 3336152 - RNA, 16 nt, Mycobacterium tuberculosis H37Rv
cggccaccaggugccg

SEQ ID NO: 3336153 - RNA, 17 nt, Mycobacterium tuberculosis H37Rv
cggccaccccacagucg

SEQ ID NO: 3336154 - RNA, 22 nt, Mycobacterium tuberculosis H37Rv
cggccacccggacauagccgcg

SEQ ID NO: 3336155 - RNA, 15 nt, Mycobacterium tuberculosis H37Rv
cggccaccgcacgcu

SEQ ID NO: 3336156 - RNA, 19 nt, Mycobacterium tuberculosis H37Rv
cggccaccgcacgcuggcg

SEQ ID NO: 3336157 - RNA, 21 nt, Mycobacterium tuberculosis H37Rv
cggccaccgcacgcuggcggg

SEQ ID NO: 3336158 - RNA, 16 nt, Mycobacterium tuberculosis H37Rv
cggccaccgccgccgc

SEQ ID NO: 3336159 - RNA, 17 nt, Mycobacterium tuberculosis H37Rv
cggccaccgccgccgcc

SEQ ID NO: 3336160 - RNA, 18 nt, Mycobacterium tuberculosis H37Rv
cggccaccgccgccgcca

SEQ ID NO: 3336161 - RNA, 23 nt, Mycobacterium tuberculosis H37Rv
cggccaccgccgccgccaccggc

SEQ ID NO: 3336162 - RNA, 17 nt, Mycobacterium tuberculosis H37Rv
cggccaccgccugagcg

SEQ ID NO: 3336163 - RNA, 15 nt, Mycobacterium tuberculosis H37Rv
cggccaccgccugua

SEQ ID NO: 3336164 - RNA, 21 nt, Mycobacterium tuberculosis H37Rv
cggccaccggcgucugcccgc

SEQ ID NO: 3336165 - RNA, 12 nt, Mycobacterium tuberculosis H37Rv
cggccaccgggg

SEQ ID NO: 3336166 - RNA, 17 nt, Mycobacterium tuberculosis H37Rv
cggccaccgucagcgcg

SEQ ID NO: 3336167 - RNA, 19 nt, Mycobacterium tuberculosis H37Rv
cggccaccgucagcgcgac

SEQ ID NO: 3336168 - RNA, 14 nt, Mycobacterium tuberculosis H37Rv
cggccaccucggug

SEQ ID NO: 3336169 - RNA, 15 nt, Mycobacterium tuberculosis H37Rv
cggccaccucggugc

SEQ ID NO: 3336170 - RNA, 16 nt, Mycobacterium tuberculosis H37Rv
cggccaccucuucucg

SEQ ID NO: 3336171 - RNA, 12 nt, Mycobacterium tuberculosis H37Rv
cggccaccugcu

SEQ ID NO: 3336172 - RNA, 15 nt, Mycobacterium tuberculosis H37Rv
cggccaccugcucgu

SEQ ID NO: 3336173 - RNA, 20 nt, Mycobacterium tuberculosis H37Rv
cggccaccugcucgucgguc

SEQ ID NO: 3336174 - RNA, 13 nt, Mycobacterium tuberculosis H37Rv
cggccacggccau

SEQ ID NO: 3336175 - RNA, 21 nt, Mycobacterium tuberculosis H37Rv
cggccacggcgucggccaccc

SEQ ID NO: 3336176 - RNA, 22 nt, Mycobacterium tuberculosis H37Rv
cggccacggcgucggccacccg

SEQ ID NO: 3336177 - RNA, 22 nt, Mycobacterium tuberculosis H37Rv
cggccacgguucuuccuggucg

SEQ ID NO: 3336178 - RNA, 17 nt, Mycobacterium tuberculosis H37Rv
cggccacgucaaacccg

SEQ ID NO: 3336179 - RNA, 19 nt, Mycobacterium tuberculosis H37Rv
cggccacgucgaugugcgc

SEQ ID NO: 3336180 - RNA, 21 nt, Mycobacterium tuberculosis H37Rv
cggccacgucgaugugcgccc

SEQ ID NO: 3336181 - RNA, 16 nt, Mycobacterium tuberculosis H37Rv
cggccacguuguccgc

SEQ ID NO: 3336182 - RNA, 22 nt, Mycobacterium tuberculosis H37Rv
cggccacuacggccuggccacc

SEQ ID NO: 3336183 - RNA, 23 nt, Mycobacterium tuberculosis H37Rv
cggccacuacggccuggccaccu

SEQ ID NO: 3336184 - RNA, 21 nt, Mycobacterium tuberculosis H37Rv
cggccacucgcccgauccgga

SEQ ID NO: 3336185 - RNA, 13 nt, Mycobacterium tuberculosis H37Rv
cggccacucggga

SEQ ID NO: 3336186 - RNA, 21 nt, Mycobacterium tuberculosis H37Rv
cggccacugauucgcaggcuc

SEQ ID NO: 3336187 - RNA, 16 nt, Mycobacterium tuberculosis H37Rv
cggccagaaacccggc

SEQ ID NO: 3336188 - RNA, 17 nt, Mycobacterium tuberculosis H37Rv
cggccagaaacccggcg

SEQ ID NO: 3336189 - RNA, 19 nt, Mycobacterium tuberculosis H37Rv
cggccagacggugcagcuc

SEQ ID NO: 3336190 - RNA, 14 nt, Mycobacterium tuberculosis H37Rv
cggccagagccgcg

SEQ ID NO: 3336191 - RNA, 16 nt, Mycobacterium tuberculosis H37Rv
cggccagaugguggca

SEQ ID NO: 3336192 - RNA, 20 nt, Mycobacterium tuberculosis H37Rv
cggccagaugguggcaugcu

SEQ ID NO: 3336193 - RNA, 23 nt, Mycobacterium tuberculosis H37Rv
cggccagcaagacgaugacagac

SEQ ID NO: 3336194 - RNA, 19 nt, Mycobacterium tuberculosis H37Rv
cggccagcaccagcucacg

SEQ ID NO: 3336195 - RNA, 12 nt, Mycobacterium tuberculosis H37Rv
cggccagcagca

SEQ ID NO: 3336196 - RNA, 14 nt, Mycobacterium tuberculosis H37Rv
cggccagcagcaga

SEQ ID NO: 3336197 - RNA, 15 nt, Mycobacterium tuberculosis H37Rv
cggccagcagcagau

SEQ ID NO: 3336198 - RNA, 16 nt, Mycobacterium tuberculosis H37Rv
cggccagcagcagaug

SEQ ID NO: 3336199 - RNA, 12 nt, Mycobacterium tuberculosis H37Rv
cggccagcagcg

SEQ ID NO: 3336200 - RNA, 12 nt, Mycobacterium tuberculosis H37Rv
cggccagcaggu

SEQ ID NO: 3336201 - RNA, 21 nt, Mycobacterium tuberculosis H37Rv
cggccagcagguauuugccgu

SEQ ID NO: 3336202 - RNA, 14 nt, Mycobacterium tuberculosis H37Rv
cggccagcagugcg

SEQ ID NO: 3336203 - RNA, 18 nt, Mycobacterium tuberculosis H37Rv
cggccagcaucagcucga

SEQ ID NO: 3336204 - RNA, 12 nt, Mycobacterium tuberculosis H37Rv
cggccagcaucg

SEQ ID NO: 3336205 - RNA, 13 nt, Mycobacterium tuberculosis H37Rv
cggccagcccagc

SEQ ID NO: 3336206 - RNA, 18 nt, Mycobacterium tuberculosis H37Rv
cggccagcccagccggga

SEQ ID NO: 3336207 - RNA, 12 nt, Mycobacterium tuberculosis H37Rv
cggccagccgac

SEQ ID NO: 3336208 - RNA, 13 nt, Mycobacterium tuberculosis H37Rv
cggccagccgacg

SEQ ID NO: 3336209 - RNA, 13 nt, Mycobacterium tuberculosis H37Rv
cggccagccgcac

SEQ ID NO: 3336210 - RNA, 14 nt, Mycobacterium tuberculosis H37Rv
cggccagccgcggc

SEQ ID NO: 3336211 - RNA, 19 nt, Mycobacterium tuberculosis H37Rv
cggccagccuaccggcuac

SEQ ID NO: 3336212 - RNA, 13 nt, Mycobacterium tuberculosis H37Rv
cggccagcgcacc

SEQ ID NO: 3336213 - RNA, 14 nt, Mycobacterium tuberculosis H37Rv
cggccagcgcaccg

SEQ ID NO: 3336214 - RNA, 16 nt, Mycobacterium tuberculosis H37Rv
cggccagcgcaccgcc

SEQ ID NO: 3336215 - RNA, 13 nt, Mycobacterium tuberculosis H37Rv
cggccagcgccuc

SEQ ID NO: 3336216 - RNA, 17 nt, Mycobacterium tuberculosis H37Rv
cggccagcgcgucggga

SEQ ID NO: 3336217 - RNA, 21 nt, Mycobacterium tuberculosis H37Rv
cggccagcggccauccggcgg

SEQ ID NO: 3336218 - RNA, 21 nt, Mycobacterium tuberculosis H37Rv
cggccagcgucagcuguuugc

SEQ ID NO: 3336219 - RNA, 21 nt, Mycobacterium tuberculosis H37Rv
cggccagcguguccgccaagu

SEQ ID NO: 3336220 - RNA, 15 nt, Mycobacterium tuberculosis H37Rv
cggccagcuccagcg

SEQ ID NO: 3336221 - RNA, 13 nt, Mycobacterium tuberculosis H37Rv
cggccagcucccg

SEQ ID NO: 3336222 - RNA, 14 nt, Mycobacterium tuberculosis H37Rv
cggccagcucccgc

SEQ ID NO: 3336223 - RNA, 15 nt, Mycobacterium tuberculosis H37Rv
cggccagcucccggg

SEQ ID NO: 3336224 - RNA, 16 nt, Mycobacterium tuberculosis H37Rv
cggccagcuccgccug

SEQ ID NO: 3336225 - RNA, 20 nt, Mycobacterium tuberculosis H37Rv
cggccagcuccucagccacc

SEQ ID NO: 3336226 - RNA, 17 nt, Mycobacterium tuberculosis H37Rv
cggccagcucgcgggcc

SEQ ID NO: 3336227 - RNA, 15 nt, Mycobacterium tuberculosis H37Rv
cggccagcucggcca

SEQ ID NO: 3336228 - RNA, 21 nt, Mycobacterium tuberculosis H37Rv
cggccagcucgggcgcgcggc

SEQ ID NO: 3336229 - RNA, 13 nt, Mycobacterium tuberculosis H37Rv
cggccagcuuccc

SEQ ID NO: 3336230 - RNA, 17 nt, Mycobacterium tuberculosis H37Rv
cggccagcuugcggagc

SEQ ID NO: 3336231 - RNA, 12 nt, Mycobacterium tuberculosis H37Rv
cggccaggacaa

SEQ ID NO: 3336232 - RNA, 18 nt, Mycobacterium tuberculosis H37Rv
cggccaggauuucgcagu

SEQ ID NO: 3336233 - RNA, 14 nt, Mycobacterium tuberculosis H37Rv
cggccaggccgaca

SEQ ID NO: 3336234 - RNA, 12 nt, Mycobacterium tuberculosis H37Rv
cggccaggccgg

SEQ ID NO: 3336235 - RNA, 15 nt, Mycobacterium tuberculosis H37Rv
cggccaggccggcgg

SEQ ID NO: 3336236 - RNA, 14 nt, Mycobacterium tuberculosis H37Rv
cggccaggccgucg

SEQ ID NO: 3336237 - RNA, 19 nt, Mycobacterium tuberculosis H37Rv
cggccaggggaucaccggc

SEQ ID NO: 3336238 - RNA, 22 nt, Mycobacterium tuberculosis H37Rv
cggccaggggaucaccggcugc

SEQ ID NO: 3336239 - RNA, 21 nt, Mycobacterium tuberculosis H37Rv
cggccagggugcccucggccg

SEQ ID NO: 3336240 - RNA, 18 nt, Mycobacterium tuberculosis H37Rv
cggccagguauguccgcc

SEQ ID NO: 3336241 - RNA, 22 nt, Mycobacterium tuberculosis H37Rv
cggccagguauguccgccauug

SEQ ID NO: 3336242 - RNA, 19 nt, Mycobacterium tuberculosis H37Rv
cggccaggucgacaccgcg

SEQ ID NO: 3336243 - RNA, 24 nt, Mycobacterium tuberculosis H37Rv
cggccaggucgacaccgcggugcc

SEQ ID NO: 3336244 - RNA, 17 nt, Mycobacterium tuberculosis H37Rv
cggccaggucgagcacc

SEQ ID NO: 3336245 - RNA, 20 nt, Mycobacterium tuberculosis H37Rv
cggccaggucgagcaccggc

SEQ ID NO: 3336246 - RNA, 21 nt, Mycobacterium tuberculosis H37Rv
cggccaggucgagcaccggcu

SEQ ID NO: 3336247 - RNA, 24 nt, Mycobacterium tuberculosis H37Rv
cggccaggucgcgauagccgccgc

SEQ ID NO: 3336248 - RNA, 13 nt, Mycobacterium tuberculosis H37Rv
cggccaggucggc

SEQ ID NO: 3336249 - RNA, 18 nt, Mycobacterium tuberculosis H37Rv
cggccaggugacguucga

SEQ ID NO: 3336250 - RNA, 18 nt, Mycobacterium tuberculosis H37Rv
cggccaguacgucgauca

SEQ ID NO: 3336251 - RNA, 16 nt, Mycobacterium tuberculosis H37Rv
cggccaguccgcgcgc

SEQ ID NO: 3336252 - RNA, 16 nt, Mycobacterium tuberculosis H37Rv
cggccagugccaucgc

SEQ ID NO: 3336253 - RNA, 14 nt, Mycobacterium tuberculosis H37Rv
cggccagugccggu

SEQ ID NO: 3336254 - RNA, 12 nt, Mycobacterium tuberculosis H37Rv
cggccagugcgc

SEQ ID NO: 3336255 - RNA, 20 nt, Mycobacterium tuberculosis H37Rv
cggccagugucagcacgacg

SEQ ID NO: 3336256 - RNA, 13 nt, Mycobacterium tuberculosis H37Rv
cggccaguucggc

SEQ ID NO: 3336257 - RNA, 19 nt, Mycobacterium tuberculosis H37Rv
cggccaguucggcggccgc

SEQ ID NO: 3336258 - RNA, 22 nt, Mycobacterium tuberculosis H37Rv
cggccaguucggcggccgccgc

SEQ ID NO: 3336259 - RNA, 17 nt, Mycobacterium tuberculosis H37Rv
cggccaguugcacaucg

SEQ ID NO: 3336260 - RNA, 20 nt, Mycobacterium tuberculosis H37Rv
cggccaguugguagccgccc

SEQ ID NO: 3336261 - RNA, 21 nt, Mycobacterium tuberculosis H37Rv
cggccaguugguagccgcccu

SEQ ID NO: 3336262 - RNA, 15 nt, Mycobacterium tuberculosis H37Rv
cggccaguuuccaga

SEQ ID NO: 3336263 - RNA, 18 nt, Mycobacterium tuberculosis H37Rv
cggccauaccgcucgccg

SEQ ID NO: 3336264 - RNA, 21 nt, Mycobacterium tuberculosis H37Rv
cggccauaccgcucgccguua

SEQ ID NO: 3336265 - RNA, 15 nt, Mycobacterium tuberculosis H37Rv
cggccauacgcgcgc

SEQ ID NO: 3336266 - RNA, 18 nt, Mycobacterium tuberculosis H37Rv
cggccauacgcgcgcggu

SEQ ID NO: 3336267 - RNA, 19 nt, Mycobacterium tuberculosis H37Rv
cggccauagcgccgcgccc

SEQ ID NO: 3336268 - RNA, 22 nt, Mycobacterium tuberculosis H37Rv
cggccauagcgccgcgcccacc

SEQ ID NO: 3336269 - RNA, 22 nt, Mycobacterium tuberculosis H37Rv
cggccauaucgcccaccacgaa

SEQ ID NO: 3336270 - RNA, 23 nt, Mycobacterium tuberculosis H37Rv
cggccauauugggaguccggccg

SEQ ID NO: 3336271 - RNA, 19 nt, Mycobacterium tuberculosis H37Rv
cggccaucagaaccuccuc

SEQ ID NO: 3336272 - RNA, 20 nt, Mycobacterium tuberculosis H37Rv
cggccaucagaaccuccucg

SEQ ID NO: 3336273 - RNA, 21 nt, Mycobacterium tuberculosis H37Rv
cggccaucagaaccuccucgg

SEQ ID NO: 3336274 - RNA, 12 nt, Mycobacterium tuberculosis H37Rv
cggccauccacc

SEQ ID NO: 3336275 - RNA, 19 nt, Mycobacterium tuberculosis H37Rv
cggccauccaccgcagauc

SEQ ID NO: 3336276 - RNA, 18 nt, Mycobacterium tuberculosis H37Rv
cggccauccggcggcggc

SEQ ID NO: 3336277 - RNA, 19 nt, Mycobacterium tuberculosis H37Rv
cggccauccggucgcucga

SEQ ID NO: 3336278 - RNA, 12 nt, Mycobacterium tuberculosis H37Rv
cggccaucgacg

SEQ ID NO: 3336279 - RNA, 21 nt, Mycobacterium tuberculosis H37Rv
cggccaucgaguccaccaccu

SEQ ID NO: 3336280 - RNA, 23 nt, Mycobacterium tuberculosis H37Rv
cggccaucgaguccaccaccugg

SEQ ID NO: 3336281 - RNA, 14 nt, Mycobacterium tuberculosis H37Rv
cggccaucgccagc

SEQ ID NO: 3336282 - RNA, 22 nt, Mycobacterium tuberculosis H37Rv
cggccaucgccagccugugcug

SEQ ID NO: 3336283 - RNA, 13 nt, Mycobacterium tuberculosis H37Rv
cggccaucgcccg

SEQ ID NO: 3336284 - RNA, 15 nt, Mycobacterium tuberculosis H37Rv
cggccaucgcccgau

SEQ ID NO: 3336285 - RNA, 18 nt, Mycobacterium tuberculosis H37Rv
cggccaucgggauggaca

SEQ ID NO: 3336286 - RNA, 14 nt, Mycobacterium tuberculosis H37Rv
cggccaucguccag

SEQ ID NO: 3336287 - RNA, 16 nt, Mycobacterium tuberculosis H37Rv
cggccaucguccagca

SEQ ID NO: 3336288 - RNA, 15 nt, Mycobacterium tuberculosis H37Rv
cggccaucucgucga

SEQ ID NO: 3336289 - RNA, 20 nt, Mycobacterium tuberculosis H37Rv
cggccaucugcucgugggua

SEQ ID NO: 3336290 - RNA, 20 nt, Mycobacterium tuberculosis H37Rv
cggccaugaaaaucggcaag

SEQ ID NO: 3336291 - RNA, 23 nt, Mycobacterium tuberculosis H37Rv
cggccaugaaaaucggcaagacg

SEQ ID NO: 3336292 - RNA, 14 nt, Mycobacterium tuberculosis H37Rv
cggccaugaucaca

SEQ ID NO: 3336293 - RNA, 19 nt, Mycobacterium tuberculosis H37Rv
cggccaugaucacaccgcu

SEQ ID NO: 3336294 - RNA, 17 nt, Mycobacterium tuberculosis H37Rv
cggccaugaugaugaca

SEQ ID NO: 3336295 - RNA, 15 nt, Mycobacterium tuberculosis H37Rv
cggccaugccuucgg

SEQ ID NO: 3336296 - RNA, 14 nt, Mycobacterium tuberculosis H37Rv
cggccauggacgcc

SEQ ID NO: 3336297 - RNA, 18 nt, Mycobacterium tuberculosis H37Rv
cggccauggacgccaugg

SEQ ID NO: 3336298 - RNA, 16 nt, Mycobacterium tuberculosis H37Rv
cggccaugguguucgg

SEQ ID NO: 3336299 - RNA, 20 nt, Mycobacterium tuberculosis H37Rv
cggccaugguguucggcagc

SEQ ID NO: 3336300 - RNA, 17 nt, Mycobacterium tuberculosis H37Rv
cggccauguagccguug

SEQ ID NO: 3336301 - RNA, 18 nt, Mycobacterium tuberculosis H37Rv
cggccauuagcagcaccc

SEQ ID NO: 3336302 - RNA, 23 nt, Mycobacterium tuberculosis H37Rv
cggccauuagcagcacccgggcc

SEQ ID NO: 3336303 - RNA, 20 nt, Mycobacterium tuberculosis H37Rv
cggcccaaacggcgugucgg

SEQ ID NO: 3336304 - RNA, 21 nt, Mycobacterium tuberculosis H37Rv
cggcccacacggucgucgcga

SEQ ID NO: 3336305 - RNA, 12 nt, Mycobacterium tuberculosis H37Rv
cggcccaccagg

SEQ ID NO: 3336306 - RNA, 15 nt, Mycobacterium tuberculosis H37Rv
cggcccaccaggccc

SEQ ID NO: 3336307 - RNA, 14 nt, Mycobacterium tuberculosis H37Rv
cggcccaccgccga

SEQ ID NO: 3336308 - RNA, 16 nt, Mycobacterium tuberculosis H37Rv
cggcccaccgccgaua

SEQ ID NO: 3336309 - RNA, 14 nt, Mycobacterium tuberculosis H37Rv
cggcccaccggcca

SEQ ID NO: 3336310 - RNA, 17 nt, Mycobacterium tuberculosis H37Rv
cggcccaccggucgcgc

SEQ ID NO: 3336311 - RNA, 14 nt, Mycobacterium tuberculosis H37Rv
cggcccacgcgcac

SEQ ID NO: 3336312 - RNA, 15 nt, Mycobacterium tuberculosis H37Rv
cggcccagcgccccc

SEQ ID NO: 3336313 - RNA, 18 nt, Mycobacterium tuberculosis H37Rv
cggcccagcgcccccagc

SEQ ID NO: 3336314 - RNA, 15 nt, Mycobacterium tuberculosis H37Rv
cggcccagcgcgcca

SEQ ID NO: 3336315 - RNA, 17 nt, Mycobacterium tuberculosis H37Rv
cggcccagcgcgccagc

SEQ ID NO: 3336316 - RNA, 14 nt, Mycobacterium tuberculosis H37Rv
cggcccagguugcc

SEQ ID NO: 3336317 - RNA, 21 nt, Mycobacterium tuberculosis H37Rv
cggcccagguugccuuggcgg

SEQ ID NO: 3336318 - RNA, 20 nt, Mycobacterium tuberculosis H37Rv
cggcccagugggacaggucg

SEQ ID NO: 3336319 - RNA, 18 nt, Mycobacterium tuberculosis H37Rv
cggcccaguucugcagga

SEQ ID NO: 3336320 - RNA, 20 nt, Mycobacterium tuberculosis H37Rv
cggcccaugaaggagauccc

SEQ ID NO: 3336321 - RNA, 18 nt, Mycobacterium tuberculosis H37Rv
cggccccacaagucgcgc

SEQ ID NO: 3336322 - RNA, 17 nt, Mycobacterium tuberculosis H37Rv
cggccccaccgacagcc

SEQ ID NO: 3336323 - RNA, 13 nt, Mycobacterium tuberculosis H37Rv
cggccccaccggu

SEQ ID NO: 3336324 - RNA, 15 nt, Mycobacterium tuberculosis H37Rv
cggccccaccgguac

SEQ ID NO: 3336325 - RNA, 14 nt, Mycobacterium tuberculosis H37Rv
cggccccaccggug

SEQ ID NO: 3336326 - RNA, 20 nt, Mycobacterium tuberculosis H37Rv
cggccccaccggugccgccg

SEQ ID NO: 3336327 - RNA, 23 nt, Mycobacterium tuberculosis H37Rv
cggccccaccggugccgccguug

SEQ ID NO: 3336328 - RNA, 12 nt, Mycobacterium tuberculosis H37Rv
cggccccagggg

SEQ ID NO: 3336329 - RNA, 17 nt, Mycobacterium tuberculosis H37Rv
cggccccaugcgccagc

SEQ ID NO: 3336330 - RNA, 16 nt, Mycobacterium tuberculosis H37Rv
cggcccccgaggcugg

SEQ ID NO: 3336331 - RNA, 18 nt, Mycobacterium tuberculosis H37Rv
cggcccccgaggcuggca

SEQ ID NO: 3336332 - RNA, 16 nt, Mycobacterium tuberculosis H37Rv
cggcccccggucgagc

SEQ ID NO: 3336333 - RNA, 17 nt, Mycobacterium tuberculosis H37Rv
cggcccccggucgagcu

SEQ ID NO: 3336334 - RNA, 21 nt, Mycobacterium tuberculosis H37Rv
cggccccgaaacgauggccgg

SEQ ID NO: 3336335 - RNA, 22 nt, Mycobacterium tuberculosis H37Rv
cggccccgacauacgucggggc

SEQ ID NO: 3336336 - RNA, 18 nt, Mycobacterium tuberculosis H37Rv
cggccccgccgaugccgc

SEQ ID NO: 3336337 - RNA, 20 nt, Mycobacterium tuberculosis H37Rv
cggccccgccgaugccgccg

SEQ ID NO: 3336338 - RNA, 22 nt, Mycobacterium tuberculosis H37Rv
cggccccgccgaugccgccggc

SEQ ID NO: 3336339 - RNA, 15 nt, Mycobacterium tuberculosis H37Rv
cggccccgccgaugg

SEQ ID NO: 3336340 - RNA, 17 nt, Mycobacterium tuberculosis H37Rv
cggccccgccggccccg

SEQ ID NO: 3336341 - RNA, 18 nt, Mycobacterium tuberculosis H37Rv
cggccccgccggccccgc

SEQ ID NO: 3336342 - RNA, 23 nt, Mycobacterium tuberculosis H37Rv
cggccccgccgucaccgccguug

SEQ ID NO: 3336343 - RNA, 14 nt, Mycobacterium tuberculosis H37Rv
cggccccgcgcagc

SEQ ID NO: 3336344 - RNA, 16 nt, Mycobacterium tuberculosis H37Rv
cggccccggccgcguc

SEQ ID NO: 3336345 - RNA, 21 nt, Mycobacterium tuberculosis H37Rv
cggcccgaagaucuccuccug

SEQ ID NO: 3336346 - RNA, 20 nt, Mycobacterium tuberculosis H37Rv
cggcccgacccggccgaugg

SEQ ID NO: 3336347 - RNA, 20 nt, Mycobacterium tuberculosis H37Rv
cggcccgagccgcuaggacg

SEQ ID NO: 3336348 - RNA, 16 nt, Mycobacterium tuberculosis H37Rv
cggcccgaggcucggg

SEQ ID NO: 3336349 - RNA, 22 nt, Mycobacterium tuberculosis H37Rv
cggcccgaggugccggggcccc

SEQ ID NO: 3336350 - RNA, 18 nt, Mycobacterium tuberculosis H37Rv
cggcccgaucaccagccc

SEQ ID NO: 3336351 - RNA, 16 nt, Mycobacterium tuberculosis H37Rv
cggcccgauccagugg

SEQ ID NO: 3336352 - RNA, 21 nt, Mycobacterium tuberculosis H37Rv
cggcccgaucccgaucgauca

SEQ ID NO: 3336353 - RNA, 16 nt, Mycobacterium tuberculosis H37Rv
cggcccgaucggcaac

SEQ ID NO: 3336354 - RNA, 15 nt, Mycobacterium tuberculosis H37Rv
cggcccgaucugagc

SEQ ID NO: 3336355 - RNA, 16 nt, Mycobacterium tuberculosis H37Rv
cggcccgcacggccgc

SEQ ID NO: 3336356 - RNA, 19 nt, Mycobacterium tuberculosis H37Rv
cggcccgcagcccgccggg

SEQ ID NO: 3336357 - RNA, 20 nt, Mycobacterium tuberculosis H37Rv
cggcccgcagcccgccgggc

SEQ ID NO: 3336358 - RNA, 14 nt, Mycobacterium tuberculosis H37Rv
cggcccgcagcgug

SEQ ID NO: 3336359 - RNA, 20 nt, Mycobacterium tuberculosis H37Rv
cggcccgcauccgcaccgaa

SEQ ID NO: 3336360 - RNA, 19 nt, Mycobacterium tuberculosis H37Rv
cggcccgcaucguugccga

SEQ ID NO: 3336361 - RNA, 23 nt, Mycobacterium tuberculosis H37Rv
cggcccgccaaaaacgccccggc

SEQ ID NO: 3336362 - RNA, 20 nt, Mycobacterium tuberculosis H37Rv
cggcccgccguccggcgccc

SEQ ID NO: 3336363 - RNA, 16 nt, Mycobacterium tuberculosis H37Rv
cggcccgcgaucgggc

SEQ ID NO: 3336364 - RNA, 14 nt, Mycobacterium tuberculosis H37Rv
cggcccgcucaacg

SEQ ID NO: 3336365 - RNA, 21 nt, Mycobacterium tuberculosis H37Rv
cggcccgcucaacgggccgca

SEQ ID NO: 3336366 - RNA, 15 nt, Mycobacterium tuberculosis H37Rv
cggcccgcucagccg

SEQ ID NO: 3336367 - RNA, 23 nt, Mycobacterium tuberculosis H37Rv
cggcccgcucauuggcauugccc

SEQ ID NO: 3336368 - RNA, 13 nt, Mycobacterium tuberculosis H37Rv
cggcccgcuccac

SEQ ID NO: 3336369 - RNA, 14 nt, Mycobacterium tuberculosis H37Rv
cggcccgcuccacg

SEQ ID NO: 3336370 - RNA, 15 nt, Mycobacterium tuberculosis H37Rv
cggcccgcuccacgg

SEQ ID NO: 3336371 - RNA, 17 nt, Mycobacterium tuberculosis H37Rv
cggcccgcugcgcggcc

SEQ ID NO: 3336372 - RNA, 18 nt, Mycobacterium tuberculosis H37Rv
cggcccgcugcgcggccc

SEQ ID NO: 3336373 - RNA, 13 nt, Mycobacterium tuberculosis H37Rv
cggcccgcugugg

SEQ ID NO: 3336374 - RNA, 15 nt, Mycobacterium tuberculosis H37Rv
cggcccggacgucgg

SEQ ID NO: 3336375 - RNA, 20 nt, Mycobacterium tuberculosis H37Rv
cggcccggcacccggugaga

SEQ ID NO: 3336376 - RNA, 15 nt, Mycobacterium tuberculosis H37Rv
cggcccggcucggug

SEQ ID NO: 3336377 - RNA, 15 nt, Mycobacterium tuberculosis H37Rv
cggcccgggcucggc

SEQ ID NO: 3336378 - RNA, 16 nt, Mycobacterium tuberculosis H37Rv
cggcccgggcucggcg

SEQ ID NO: 3336379 - RNA, 17 nt, Mycobacterium tuberculosis H37Rv
cggcccgggcucggcga

SEQ ID NO: 3336380 - RNA, 13 nt, Mycobacterium tuberculosis H37Rv
cggcccggggacg

SEQ ID NO: 3336381 - RNA, 18 nt, Mycobacterium tuberculosis H37Rv
cggcccggguaucgccag

SEQ ID NO: 3336382 - RNA, 18 nt, Mycobacterium tuberculosis H37Rv
cggcccgggucagcgacc

SEQ ID NO: 3336383 - RNA, 19 nt, Mycobacterium tuberculosis H37Rv
cggcccgggucagcgaccu

SEQ ID NO: 3336384 - RNA, 18 nt, Mycobacterium tuberculosis H37Rv
cggcccggguuggccgaa

SEQ ID NO: 3336385 - RNA, 13 nt, Mycobacterium tuberculosis H37Rv
cggcccggugagc

SEQ ID NO: 3336386 - RNA, 23 nt, Mycobacterium tuberculosis H37Rv
cggcccgguugggugugcccggg

SEQ ID NO: 3336387 - RNA, 16 nt, Mycobacterium tuberculosis H37Rv
cggcccguagcugcgc

SEQ ID NO: 3336388 - RNA, 17 nt, Mycobacterium tuberculosis H37Rv
cggcccguagcugcgca

SEQ ID NO: 3336389 - RNA, 18 nt, Mycobacterium tuberculosis H37Rv
cggcccguagcugcgcag

SEQ ID NO: 3336390 - RNA, 20 nt, Mycobacterium tuberculosis H37Rv
cggcccguagcugcgcagcg

SEQ ID NO: 3336391 - RNA, 14 nt, Mycobacterium tuberculosis H37Rv
cggcccgucaccgc

SEQ ID NO: 3336392 - RNA, 18 nt, Mycobacterium tuberculosis H37Rv
cggcccgucaccgcgggc

SEQ ID NO: 3336393 - RNA, 18 nt, Mycobacterium tuberculosis H37Rv
cggcccgucgcgucgacc

SEQ ID NO: 3336394 - RNA, 16 nt, Mycobacterium tuberculosis H37Rv
cggcccgugugggcgu

SEQ ID NO: 3336395 - RNA, 16 nt, Mycobacterium tuberculosis H37Rv
cggcccuaaacaccgc

SEQ ID NO: 3336396 - RNA, 12 nt, Mycobacterium tuberculosis H37Rv
cggcccuccacc

SEQ ID NO: 3336397 - RNA, 15 nt, Mycobacterium tuberculosis H37Rv
cggcccuccaccggu

SEQ ID NO: 3336398 - RNA, 21 nt, Mycobacterium tuberculosis H37Rv
cggcccucgaauucggccggc

SEQ ID NO: 3336399 - RNA, 17 nt, Mycobacterium tuberculosis H37Rv
cggcccucgaugccgcg

SEQ ID NO: 3336400 - RNA, 21 nt, Mycobacterium tuberculosis H37Rv
cggcccucgaugccgcguagc

SEQ ID NO: 3336401 - RNA, 20 nt, Mycobacterium tuberculosis H37Rv
cggcccugagcugccgagcg

SEQ ID NO: 3336402 - RNA, 15 nt, Mycobacterium tuberculosis H37Rv
cggcccugcucgccg

SEQ ID NO: 3336403 - RNA, 22 nt, Mycobacterium tuberculosis H37Rv
cggcccugcucggccaacguag

SEQ ID NO: 3336404 - RNA, 22 nt, Mycobacterium tuberculosis H37Rv
cggcccuuguggaguacggcga

SEQ ID NO: 3336405 - RNA, 21 nt, Mycobacterium tuberculosis H37Rv
cggccgaaacuucgcccgggc

SEQ ID NO: 3336406 - RNA, 23 nt, Mycobacterium tuberculosis H37Rv
cggccgaaagagccagcggcacu

SEQ ID NO: 3336407 - RNA, 20 nt, Mycobacterium tuberculosis H37Rv
cggccgaacaaccuucgggc

SEQ ID NO: 3336408 - RNA, 13 nt, Mycobacterium tuberculosis H37Rv
cggccgaaugcgc

SEQ ID NO: 3336409 - RNA, 16 nt, Mycobacterium tuberculosis H37Rv
cggccgacaacccggc

SEQ ID NO: 3336410 - RNA, 13 nt, Mycobacterium tuberculosis H37Rv
cggccgacaccgc

SEQ ID NO: 3336411 - RNA, 20 nt, Mycobacterium tuberculosis H37Rv
cggccgacaccgccaccacg

SEQ ID NO: 3336412 - RNA, 15 nt, Mycobacterium tuberculosis H37Rv
cggccgacacgccga

SEQ ID NO: 3336413 - RNA, 16 nt, Mycobacterium tuberculosis H37Rv
cggccgacacgccgau

SEQ ID NO: 3336414 - RNA, 17 nt, Mycobacterium tuberculosis H37Rv
cggccgacacgccgaug

SEQ ID NO: 3336415 - RNA, 19 nt, Mycobacterium tuberculosis H37Rv
cggccgacacgccgaugcc

SEQ ID NO: 3336416 - RNA, 15 nt, Mycobacterium tuberculosis H37Rv
cggccgaccgcgacc

SEQ ID NO: 3336417 - RNA, 23 nt, Mycobacterium tuberculosis H37Rv
cggccgacucggucucauagugc

SEQ ID NO: 3336418 - RNA, 16 nt, Mycobacterium tuberculosis H37Rv
cggccgacuuggugac

SEQ ID NO: 3336419 - RNA, 17 nt, Mycobacterium tuberculosis H37Rv
cggccgagacggcguug

SEQ ID NO: 3336420 - RNA, 14 nt, Mycobacterium tuberculosis H37Rv
cggccgagccguug

SEQ ID NO: 3336421 - RNA, 15 nt, Mycobacterium tuberculosis H37Rv
cggccgagcgcaccg

SEQ ID NO: 3336422 - RNA, 17 nt, Mycobacterium tuberculosis H37Rv
cggccgagcugguuggc

SEQ ID NO: 3336423 - RNA, 20 nt, Mycobacterium tuberculosis H37Rv
cggccgaggaccagaggcgc

SEQ ID NO: 3336424 - RNA, 21 nt, Mycobacterium tuberculosis H37Rv
cggccgagggauugccgugcu

SEQ ID NO: 3336425 - RNA, 22 nt, Mycobacterium tuberculosis H37Rv
cggccgagggauugccgugcuc

SEQ ID NO: 3336426 - RNA, 15 nt, Mycobacterium tuberculosis H37Rv
cggccgaggucaccc

SEQ ID NO: 3336427 - RNA, 18 nt, Mycobacterium tuberculosis H37Rv
cggccgaggucacccggu

SEQ ID NO: 3336428 - RNA, 23 nt, Mycobacterium tuberculosis H37Rv
cggccgagucgauugccaccgag

SEQ ID NO: 3336429 - RNA, 15 nt, Mycobacterium tuberculosis H37Rv
cggccgagugcacgc

SEQ ID NO: 3336430 - RNA, 18 nt, Mycobacterium tuberculosis H37Rv
cggccgauacagaucugg

SEQ ID NO: 3336431 - RNA, 23 nt, Mycobacterium tuberculosis H37Rv
cggccgauacagaucuggguucc

SEQ ID NO: 3336432 - RNA, 17 nt, Mycobacterium tuberculosis H37Rv
cggccgauacgaagccg

SEQ ID NO: 3336433 - RNA, 16 nt, Mycobacterium tuberculosis H37Rv
cggccgaucagcagcu

SEQ ID NO: 3336434 - RNA, 14 nt, Mycobacterium tuberculosis H37Rv
cggccgaugcgacc

SEQ ID NO: 3336435 - RNA, 17 nt, Mycobacterium tuberculosis H37Rv
cggccgaugcgacccgc

SEQ ID NO: 3336436 - RNA, 21 nt, Mycobacterium tuberculosis H37Rv
cggccgaugcgacccgcagac

SEQ ID NO: 3336437 - RNA, 14 nt, Mycobacterium tuberculosis H37Rv
cggccgaugcgcag

SEQ ID NO: 3336438 - RNA, 23 nt, Mycobacterium tuberculosis H37Rv
cggccgauggugugcacggcuuc

SEQ ID NO: 3336439 - RNA, 18 nt, Mycobacterium tuberculosis H37Rv
cggccgcaaggcgccgau

SEQ ID NO: 3336440 - RNA, 24 nt, Mycobacterium tuberculosis H37Rv
cggccgcaaucaugucagcgcuga

SEQ ID NO: 3336441 - RNA, 13 nt, Mycobacterium tuberculosis H37Rv
cggccgcacauga

SEQ ID NO: 3336442 - RNA, 15 nt, Mycobacterium tuberculosis H37Rv
cggccgcacgccgac

SEQ ID NO: 3336443 - RNA, 18 nt, Mycobacterium tuberculosis H37Rv
cggccgcacgccuacgau

SEQ ID NO: 3336444 - RNA, 12 nt, Mycobacterium tuberculosis H37Rv
cggccgcacugg

SEQ ID NO: 3336445 - RNA, 14 nt, Mycobacterium tuberculosis H37Rv
cggccgcagccagc

SEQ ID NO: 3336446 - RNA, 15 nt, Mycobacterium tuberculosis H37Rv
cggccgcagcggcca

SEQ ID NO: 3336447 - RNA, 12 nt, Mycobacterium tuberculosis H37Rv
cggccgcaggcg

SEQ ID NO: 3336448 - RNA, 14 nt, Mycobacterium tuberculosis H37Rv
cggccgcagugcga

SEQ ID NO: 3336449 - RNA, 24 nt, Mycobacterium tuberculosis H37Rv
cggccgcagugcgacucugcgucu

SEQ ID NO: 3336450 - RNA, 16 nt, Mycobacterium tuberculosis H37Rv
cggccgcaucgcccaa

SEQ ID NO: 3336451 - RNA, 21 nt, Mycobacterium tuberculosis H37Rv
cggccgcaucgcccaacaacg

SEQ ID NO: 3336452 - RNA, 23 nt, Mycobacterium tuberculosis H37Rv
cggccgcaucggucaaugccacu

SEQ ID NO: 3336453 - RNA, 21 nt, Mycobacterium tuberculosis H37Rv
cggccgccaacuucaccaccc

SEQ ID NO: 3336454 - RNA, 20 nt, Mycobacterium tuberculosis H37Rv
cggccgccacuugcgcacag

SEQ ID NO: 3336455 - RNA, 13 nt, Mycobacterium tuberculosis H37Rv
cggccgccagccc

SEQ ID NO: 3336456 - RNA, 19 nt, Mycobacterium tuberculosis H37Rv
cggccgccagcgcgccgau

SEQ ID NO: 3336457 - RNA, 22 nt, Mycobacterium tuberculosis H37Rv
cggccgccaguucggcgucguc

SEQ ID NO: 3336458 - RNA, 15 nt, Mycobacterium tuberculosis H37Rv
cggccgccaucaucg

SEQ ID NO: 3336459 - RNA, 14 nt, Mycobacterium tuberculosis H37Rv
cggccgccccaggc

SEQ ID NO: 3336460 - RNA, 17 nt, Mycobacterium tuberculosis H37Rv
cggccgccccaggcugg

SEQ ID NO: 3336461 - RNA, 15 nt, Mycobacterium tuberculosis H37Rv
cggccgcccgcucga

SEQ ID NO: 3336462 - RNA, 16 nt, Mycobacterium tuberculosis H37Rv
cggccgcccgcucgau

SEQ ID NO: 3336463 - RNA, 11 nt, Mycobacterium tuberculosis H37Rv
cggccgcccgu

SEQ ID NO: 3336464 - RNA, 19 nt, Mycobacterium tuberculosis H37Rv
cggccgcccguaaaccgau

SEQ ID NO: 3336465 - RNA, 9 nt, Mycobacterium tuberculosis H37Rv
cggccgccg

SEQ ID NO: 3336466 - RNA, 18 nt, Mycobacterium tuberculosis H37Rv
cggccgccgacagggacc

SEQ ID NO: 3336467 - RNA, 19 nt, Mycobacterium tuberculosis H37Rv
cggccgccgacagggaccc

SEQ ID NO: 3336468 - RNA, 20 nt, Mycobacterium tuberculosis H37Rv
cggccgccgaccggagccgc

SEQ ID NO: 3336469 - RNA, 22 nt, Mycobacterium tuberculosis H37Rv
cggccgccgacuccccgccggg

SEQ ID NO: 3336470 - RNA, 13 nt, Mycobacterium tuberculosis H37Rv
cggccgccgcagc

SEQ ID NO: 3336471 - RNA, 16 nt, Mycobacterium tuberculosis H37Rv
cggccgccgcggcuug

SEQ ID NO: 3336472 - RNA, 13 nt, Mycobacterium tuberculosis H37Rv
cggccgccgcggg

SEQ ID NO: 3336473 - RNA, 18 nt, Mycobacterium tuberculosis H37Rv
cggccgccgcgucgacua

SEQ ID NO: 3336474 - RNA, 13 nt, Mycobacterium tuberculosis H37Rv
cggccgccgcguu

SEQ ID NO: 3336475 - RNA, 15 nt, Mycobacterium tuberculosis H37Rv
cggccgccguccccg

SEQ ID NO: 3336476 - RNA, 19 nt, Mycobacterium tuberculosis H37Rv
cggccgccguccccgccgu

SEQ ID NO: 3336477 - RNA, 21 nt, Mycobacterium tuberculosis H37Rv
cggccgccuacccguucuucg

SEQ ID NO: 3336478 - RNA, 19 nt, Mycobacterium tuberculosis H37Rv
cggccgccucguacggacc

SEQ ID NO: 3336479 - RNA, 24 nt, Mycobacterium tuberculosis H37Rv
cggccgccucguacggaccgucgc

SEQ ID NO: 3336480 - RNA, 17 nt, Mycobacterium tuberculosis H37Rv
cggccgccuucuccggc

SEQ ID NO: 3336481 - RNA, 16 nt, Mycobacterium tuberculosis H37Rv
cggccgcgaccagcgc

SEQ ID NO: 3336482 - RNA, 22 nt, Mycobacterium tuberculosis H37Rv
cggccgcgaccagcgccgcacc

SEQ ID NO: 3336483 - RNA, 17 nt, Mycobacterium tuberculosis H37Rv
cggccgcgaccgcgacc

SEQ ID NO: 3336484 - RNA, 16 nt, Mycobacterium tuberculosis H37Rv
cggccgcgacgacacg

SEQ ID NO: 3336485 - RNA, 14 nt, Mycobacterium tuberculosis H37Rv
cggccgcgacggau

SEQ ID NO: 3336486 - RNA, 20 nt, Mycobacterium tuberculosis H37Rv
cggccgcgauccagcgcuga

SEQ ID NO: 3336487 - RNA, 17 nt, Mycobacterium tuberculosis H37Rv
cggccgcgccggccccg

SEQ ID NO: 3336488 - RNA, 15 nt, Mycobacterium tuberculosis H37Rv
cggccgcgccgucgg

SEQ ID NO: 3336489 - RNA, 13 nt, Mycobacterium tuberculosis H37Rv
cggccgcgcugaa

SEQ ID NO: 3336490 - RNA, 23 nt, Mycobacterium tuberculosis H37Rv
cggccgcggaugcucaggucacc

SEQ ID NO: 3336491 - RNA, 14 nt, Mycobacterium tuberculosis H37Rv
cggccgcggccucc

SEQ ID NO: 3336492 - RNA, 16 nt, Mycobacterium tuberculosis H37Rv
cggccgcggccucccg

SEQ ID NO: 3336493 - RNA, 18 nt, Mycobacterium tuberculosis H37Rv
cggccgcggcgcggcggg

SEQ ID NO: 3336494 - RNA, 20 nt, Mycobacterium tuberculosis H37Rv
cggccgcggcgcggcgggca

SEQ ID NO: 3336495 - RNA, 16 nt, Mycobacterium tuberculosis H37Rv
cggccgcggcggcccc

SEQ ID NO: 3336496 - RNA, 18 nt, Mycobacterium tuberculosis H37Rv
cggccgcggcggccccgc

SEQ ID NO: 3336497 - RNA, 17 nt, Mycobacterium tuberculosis H37Rv
cggccgcgggcgcgcag

SEQ ID NO: 3336498 - RNA, 22 nt, Mycobacterium tuberculosis H37Rv
cggccgcgggcguugcugaugg

SEQ ID NO: 3336499 - RNA, 12 nt, Mycobacterium tuberculosis H37Rv
cggccgcgguga

SEQ ID NO: 3336500 - RNA, 19 nt, Mycobacterium tuberculosis H37Rv
cggccgcggugcccgucgg

SEQ ID NO: 3336501 - RNA, 22 nt, Mycobacterium tuberculosis H37Rv
cggccgcguaaaccggcugacc

SEQ ID NO: 3336502 - RNA, 13 nt, Mycobacterium tuberculosis H37Rv
cggccgcgugcuc

SEQ ID NO: 3336503 - RNA, 16 nt, Mycobacterium tuberculosis H37Rv
cggccgcgugcucgcc

SEQ ID NO: 3336504 - RNA, 17 nt, Mycobacterium tuberculosis H37Rv
cggccgcgugcucgccg

SEQ ID NO: 3336505 - RNA, 19 nt, Mycobacterium tuberculosis H37Rv
cggccgcgugcucgccgua

SEQ ID NO: 3336506 - RNA, 18 nt, Mycobacterium tuberculosis H37Rv
cggccgcucacauacagc

SEQ ID NO: 3336507 - RNA, 16 nt, Mycobacterium tuberculosis H37Rv
cggccgcucaccccgc

SEQ ID NO: 3336508 - RNA, 19 nt, Mycobacterium tuberculosis H37Rv
cggccgcucaccccgcgcu

SEQ ID NO: 3336509 - RNA, 19 nt, Mycobacterium tuberculosis H37Rv
cggccgcucguuacgccga

SEQ ID NO: 3336510 - RNA, 17 nt, Mycobacterium tuberculosis H37Rv
cggccgcugccuuggcg

SEQ ID NO: 3336511 - RNA, 12 nt, Mycobacterium tuberculosis H37Rv
cggccgcuggcg

SEQ ID NO: 3336512 - RNA, 19 nt, Mycobacterium tuberculosis H37Rv
cggccgcugggcccaucgc

SEQ ID NO: 3336513 - RNA, 13 nt, Mycobacterium tuberculosis H37Rv
cggccggacgggu

SEQ ID NO: 3336514 - RNA, 13 nt, Mycobacterium tuberculosis H37Rv
cggccggagccgc

SEQ ID NO: 3336515 - RNA, 13 nt, Mycobacterium tuberculosis H37Rv
cggccggaggggu

SEQ ID NO: 3336516 - RNA, 19 nt, Mycobacterium tuberculosis H37Rv
cggccggauacgggcugac

SEQ ID NO: 3336517 - RNA, 20 nt, Mycobacterium tuberculosis H37Rv
cggccggauacgggcugacg

SEQ ID NO: 3336518 - RNA, 20 nt, Mycobacterium tuberculosis H37Rv
cggccggaugagcgaacgcc

SEQ ID NO: 3336519 - RNA, 22 nt, Mycobacterium tuberculosis H37Rv
cggccggaugagcgaacgccag

SEQ ID NO: 3336520 - RNA, 23 nt, Mycobacterium tuberculosis H37Rv
cggccggaugagcgaacgccagu

SEQ ID NO: 3336521 - RNA, 16 nt, Mycobacterium tuberculosis H37Rv
cggccggcaaugccgc

SEQ ID NO: 3336522 - RNA, 12 nt, Mycobacterium tuberculosis H37Rv
cggccggcaccc

SEQ ID NO: 3336523 - RNA, 18 nt, Mycobacterium tuberculosis H37Rv
cggccggcaccccacggc

SEQ ID NO: 3336524 - RNA, 22 nt, Mycobacterium tuberculosis H37Rv
cggccggcaccccacggccagu

SEQ ID NO: 3336525 - RNA, 19 nt, Mycobacterium tuberculosis H37Rv
cggccggcacgaccgcucc

SEQ ID NO: 3336526 - RNA, 13 nt, Mycobacterium tuberculosis H37Rv
cggccggcaugcu

SEQ ID NO: 3336527 - RNA, 14 nt, Mycobacterium tuberculosis H37Rv
cggccggcaugcug

SEQ ID NO: 3336528 - RNA, 13 nt, Mycobacterium tuberculosis H37Rv
cggccggcccggg

SEQ ID NO: 3336529 - RNA, 23 nt, Mycobacterium tuberculosis H37Rv
cggccggcccggguaucgccagu

SEQ ID NO: 3336530 - RNA, 11 nt, Mycobacterium tuberculosis H37Rv
cggccggccgc

SEQ ID NO: 3336531 - RNA, 13 nt, Mycobacterium tuberculosis H37Rv
cggccggccgcuc

SEQ ID NO: 3336532 - RNA, 21 nt, Mycobacterium tuberculosis H37Rv
cggccggcgacgcgucgagcc

SEQ ID NO: 3336533 - RNA, 17 nt, Mycobacterium tuberculosis H37Rv
cggccggcgccggcgcg

SEQ ID NO: 3336534 - RNA, 15 nt, Mycobacterium tuberculosis H37Rv
cggccggcgcggcgu

SEQ ID NO: 3336535 - RNA, 21 nt, Mycobacterium tuberculosis H37Rv
cggccggcgcucgcggcggcg

SEQ ID NO: 3336536 - RNA, 21 nt, Mycobacterium tuberculosis H37Rv
cggccggcggcgcccaucgcg

SEQ ID NO: 3336537 - RNA, 14 nt, Mycobacterium tuberculosis H37Rv
cggccggcgucagc

SEQ ID NO: 3336538 - RNA, 15 nt, Mycobacterium tuberculosis H37Rv
cggccggcgucagcc

SEQ ID NO: 3336539 - RNA, 13 nt, Mycobacterium tuberculosis H37Rv
cggccggcgucgg

SEQ ID NO: 3336540 - RNA, 21 nt, Mycobacterium tuberculosis H37Rv
cggccggcgucggcgucgaau

SEQ ID NO: 3336541 - RNA, 13 nt, Mycobacterium tuberculosis H37Rv
cggccggcuccgg

SEQ ID NO: 3336542 - RNA, 19 nt, Mycobacterium tuberculosis H37Rv
cggccggcuccggauugcu

SEQ ID NO: 3336543 - RNA, 15 nt, Mycobacterium tuberculosis H37Rv
cggccggcucguccg

SEQ ID NO: 3336544 - RNA, 15 nt, Mycobacterium tuberculosis H37Rv
cggccgggccugcac

SEQ ID NO: 3336545 - RNA, 20 nt, Mycobacterium tuberculosis H37Rv
cggccgggcgggcggccgau

SEQ ID NO: 3336546 - RNA, 16 nt, Mycobacterium tuberculosis H37Rv
cggccggggccacccg

SEQ ID NO: 3336547 - RNA, 17 nt, Mycobacterium tuberculosis H37Rv
cggccggggccacccgc

SEQ ID NO: 3336548 - RNA, 15 nt, Mycobacterium tuberculosis H37Rv
cggccgggucauccg

SEQ ID NO: 3336549 - RNA, 23 nt, Mycobacterium tuberculosis H37Rv
cggccgggucuuccggugcgccg

SEQ ID NO: 3336550 - RNA, 22 nt, Mycobacterium tuberculosis H37Rv
cggccggguguagcucggaccc

SEQ ID NO: 3336551 - RNA, 18 nt, Mycobacterium tuberculosis H37Rv
cggccggguuaucggcag

SEQ ID NO: 3336552 - RNA, 20 nt, Mycobacterium tuberculosis H37Rv
cggccggguuaucggcagca

SEQ ID NO: 3336553 - RNA, 21 nt, Mycobacterium tuberculosis H37Rv
cggccggguuaucggcagcag

SEQ ID NO: 3336554 - RNA, 17 nt, Mycobacterium tuberculosis H37Rv
cggccggguucgcgucu

SEQ ID NO: 3336555 - RNA, 23 nt, Mycobacterium tuberculosis H37Rv
cggccgguagaucuucggccgca

SEQ ID NO: 3336556 - RNA, 19 nt, Mycobacterium tuberculosis H37Rv
cggccgguaguagcugacc

SEQ ID NO: 3336557 - RNA, 18 nt, Mycobacterium tuberculosis H37Rv
cggccgguauuucggcga

SEQ ID NO: 3336558 - RNA, 15 nt, Mycobacterium tuberculosis H37Rv
cggccggugaugauc

SEQ ID NO: 3336559 - RNA, 22 nt, Mycobacterium tuberculosis H37Rv
cggccggugaugaucgcgccgg

SEQ ID NO: 3336560 - RNA, 15 nt, Mycobacterium tuberculosis H37Rv
cggccggugcccggg

SEQ ID NO: 3336561 - RNA, 20 nt, Mycobacterium tuberculosis H37Rv
cggccgguggaaaccgggcg

SEQ ID NO: 3336562 - RNA, 21 nt, Mycobacterium tuberculosis H37Rv
cggccgguuggccagccacag

SEQ ID NO: 3336563 - RNA, 15 nt, Mycobacterium tuberculosis H37Rv
cggccguagugcacg

SEQ ID NO: 3336564 - RNA, 23 nt, Mycobacterium tuberculosis H37Rv
cggccguagugcacgucggcggg

SEQ ID NO: 3336565 - RNA, 21 nt, Mycobacterium tuberculosis H37Rv
cggccgucauggcccgaucga

SEQ ID NO: 3336566 - RNA, 16 nt, Mycobacterium tuberculosis H37Rv
cggccgucccgcgagc

SEQ ID NO: 3336567 - RNA, 14 nt, Mycobacterium tuberculosis H37Rv
cggccgucgauugc

SEQ ID NO: 3336568 - RNA, 14 nt, Mycobacterium tuberculosis H37Rv
cggccgucgcgcga

SEQ ID NO: 3336569 - RNA, 14 nt, Mycobacterium tuberculosis H37Rv
cggccgucggcggg

SEQ ID NO: 3336570 - RNA, 15 nt, Mycobacterium tuberculosis H37Rv
cggccgucgucggcc

SEQ ID NO: 3336571 - RNA, 20 nt, Mycobacterium tuberculosis H37Rv
cggccgugaacggcgcgggc

SEQ ID NO: 3336572 - RNA, 20 nt, Mycobacterium tuberculosis H37Rv
cggccgugaauucgccgaac

SEQ ID NO: 3336573 - RNA, 14 nt, Mycobacterium tuberculosis H37Rv
cggccgugaccgag

SEQ ID NO: 3336574 - RNA, 19 nt, Mycobacterium tuberculosis H37Rv
cggccgugaccgagccgcg

SEQ ID NO: 3336575 - RNA, 13 nt, Mycobacterium tuberculosis H37Rv
cggccgugccgcc

SEQ ID NO: 3336576 - RNA, 16 nt, Mycobacterium tuberculosis H37Rv
cggccgugccgccgac

SEQ ID NO: 3336577 - RNA, 22 nt, Mycobacterium tuberculosis H37Rv
cggccguggaugucgcggucga

SEQ ID NO: 3336578 - RNA, 20 nt, Mycobacterium tuberculosis H37Rv
cggccguggcauguugcgga

SEQ ID NO: 3336579 - RNA, 22 nt, Mycobacterium tuberculosis H37Rv
cggccguggcauguugcggacc

SEQ ID NO: 3336580 - RNA, 18 nt, Mycobacterium tuberculosis H37Rv
cggccgugucgggcgcga

SEQ ID NO: 3336581 - RNA, 16 nt, Mycobacterium tuberculosis H37Rv
cggccguucgugggca

SEQ ID NO: 3336582 - RNA, 15 nt, Mycobacterium tuberculosis H37Rv
cggccuccaccacgu

SEQ ID NO: 3336583 - RNA, 13 nt, Mycobacterium tuberculosis H37Rv
cggccuccaucgc

SEQ ID NO: 3336584 - RNA, 15 nt, Mycobacterium tuberculosis H37Rv
cggccuccaucgcga

SEQ ID NO: 3336585 - RNA, 16 nt, Mycobacterium tuberculosis H37Rv
cggccuccaucgcgac

SEQ ID NO: 3336586 - RNA, 17 nt, Mycobacterium tuberculosis H37Rv
cggccucccgggccgcc

SEQ ID NO: 3336587 - RNA, 18 nt, Mycobacterium tuberculosis H37Rv
cggccuccgggccaugug

SEQ ID NO: 3336588 - RNA, 15 nt, Mycobacterium tuberculosis H37Rv
cggccuccuccccga

SEQ ID NO: 3336589 - RNA, 21 nt, Mycobacterium tuberculosis H37Rv
cggccucgagacggucgauca

SEQ ID NO: 3336590 - RNA, 21 nt, Mycobacterium tuberculosis H37Rv
cggccucgaguaucucggcuc

SEQ ID NO: 3336591 - RNA, 21 nt, Mycobacterium tuberculosis H37Rv
cggccucgcugcucagcaacg

SEQ ID NO: 3336592 - RNA, 12 nt, Mycobacterium tuberculosis H37Rv
cggccucgucga

SEQ ID NO: 3336593 - RNA, 20 nt, Mycobacterium tuberculosis H37Rv
cggccucgucgauguucgcc

SEQ ID NO: 3336594 - RNA, 16 nt, Mycobacterium tuberculosis H37Rv
cggccucguugaccgg

SEQ ID NO: 3336595 - RNA, 18 nt, Mycobacterium tuberculosis H37Rv
cggccucuagcuugacaa

SEQ ID NO: 3336596 - RNA, 15 nt, Mycobacterium tuberculosis H37Rv
cggccucugaccagc

SEQ ID NO: 3336597 - RNA, 16 nt, Mycobacterium tuberculosis H37Rv
cggccucugaccagcc

SEQ ID NO: 3336598 - RNA, 12 nt, Mycobacterium tuberculosis H37Rv
cggccugaccgg

SEQ ID NO: 3336599 - RNA, 13 nt, Mycobacterium tuberculosis H37Rv
cggccugaccggc

SEQ ID NO: 3336600 - RNA, 20 nt, Mycobacterium tuberculosis H37Rv
cggccugaccggcucgccgg

SEQ ID NO: 3336601 - RNA, 23 nt, Mycobacterium tuberculosis H37Rv
cggccugaccggcucgccggcgc

SEQ ID NO: 3336602 - RNA, 13 nt, Mycobacterium tuberculosis H37Rv
cggccugaccggu

SEQ ID NO: 3336603 - RNA, 17 nt, Mycobacterium tuberculosis H37Rv
cggccugaccggucacc

SEQ ID NO: 3336604 - RNA, 22 nt, Mycobacterium tuberculosis H37Rv
cggccugaccggucacccgugc

SEQ ID NO: 3336605 - RNA, 13 nt, Mycobacterium tuberculosis H37Rv
cggccugagcggc

SEQ ID NO: 3336606 - RNA, 21 nt, Mycobacterium tuberculosis H37Rv
cggccugagcgucgucgccgg

SEQ ID NO: 3336607 - RNA, 15 nt, Mycobacterium tuberculosis H37Rv
cggccugcacggcgc

SEQ ID NO: 3336608 - RNA, 12 nt, Mycobacterium tuberculosis H37Rv
cggccugccgcu

SEQ ID NO: 3336609 - RNA, 13 nt, Mycobacterium tuberculosis H37Rv
cggccugccggca

SEQ ID NO: 3336610 - RNA, 21 nt, Mycobacterium tuberculosis H37Rv
cggccugcgaacacgcgauga

SEQ ID NO: 3336611 - RNA, 19 nt, Mycobacterium tuberculosis H37Rv
cggccugcgacgagcccac

SEQ ID NO: 3336612 - RNA, 22 nt, Mycobacterium tuberculosis H37Rv
cggccugcgacgagcccaccgu

SEQ ID NO: 3336613 - RNA, 16 nt, Mycobacterium tuberculosis H37Rv
cggccugcgccggcgc

SEQ ID NO: 3336614 - RNA, 14 nt, Mycobacterium tuberculosis H37Rv
cggccugcgcgacc

SEQ ID NO: 3336615 - RNA, 17 nt, Mycobacterium tuberculosis H37Rv
cggccugcgcgaccgac

SEQ ID NO: 3336616 - RNA, 19 nt, Mycobacterium tuberculosis H37Rv
cggccugcgcgaccgacca

SEQ ID NO: 3336617 - RNA, 14 nt, Mycobacterium tuberculosis H37Rv
cggccugcggcaac

SEQ ID NO: 3336618 - RNA, 13 nt, Mycobacterium tuberculosis H37Rv
cggccugcggcac

SEQ ID NO: 3336619 - RNA, 17 nt, Mycobacterium tuberculosis H37Rv
cggccugcucgcagauc

SEQ ID NO: 3336620 - RNA, 15 nt, Mycobacterium tuberculosis H37Rv
cggccugcucggcga

SEQ ID NO: 3336621 - RNA, 16 nt, Mycobacterium tuberculosis H37Rv
cggccugcucgggggc

SEQ ID NO: 3336622 - RNA, 17 nt, Mycobacterium tuberculosis H37Rv
cggccugcugcugcagc

SEQ ID NO: 3336623 - RNA, 18 nt, Mycobacterium tuberculosis H37Rv
cggccuggaucgugccga

SEQ ID NO: 3336624 - RNA, 14 nt, Mycobacterium tuberculosis H37Rv
cggccuggcacccg

SEQ ID NO: 3336625 - RNA, 16 nt, Mycobacterium tuberculosis H37Rv
cggccuggcacccggg

SEQ ID NO: 3336626 - RNA, 14 nt, Mycobacterium tuberculosis H37Rv
cggccuggccaccu

SEQ ID NO: 3336627 - RNA, 15 nt, Mycobacterium tuberculosis H37Rv
cggccugggccagcc

SEQ ID NO: 3336628 - RNA, 19 nt, Mycobacterium tuberculosis H37Rv
cggccuggggcagccgggc

SEQ ID NO: 3336629 - RNA, 14 nt, Mycobacterium tuberculosis H37Rv
cggccugguacucc

SEQ ID NO: 3336630 - RNA, 20 nt, Mycobacterium tuberculosis H37Rv
cggccuggucggccaggucg

SEQ ID NO: 3336631 - RNA, 21 nt, Mycobacterium tuberculosis H37Rv
cggccuggucggccaggucga

SEQ ID NO: 3336632 - RNA, 15 nt, Mycobacterium tuberculosis H37Rv
cggccuguccaccga

SEQ ID NO: 3336633 - RNA, 17 nt, Mycobacterium tuberculosis H37Rv
cggccuguucgccgucg

SEQ ID NO: 3336634 - RNA, 13 nt, Mycobacterium tuberculosis H37Rv
cggccuguucggc

SEQ ID NO: 3336635 - RNA, 21 nt, Mycobacterium tuberculosis H37Rv
cggccuguucggcggcugcca

SEQ ID NO: 3336636 - RNA, 17 nt, Mycobacterium tuberculosis H37Rv
cggccuuauucacccgg

SEQ ID NO: 3336637 - RNA, 18 nt, Mycobacterium tuberculosis H37Rv
cggccuucagcggucgca

SEQ ID NO: 3336638 - RNA, 21 nt, Mycobacterium tuberculosis H37Rv
cggccuucgggugugacgcgc

SEQ ID NO: 3336639 - RNA, 23 nt, Mycobacterium tuberculosis H37Rv
cggccuucgggugugacgcgcgc

SEQ ID NO: 3336640 - RNA, 15 nt, Mycobacterium tuberculosis H37Rv
cggccuucucgccgu

SEQ ID NO: 3336641 - RNA, 18 nt, Mycobacterium tuberculosis H37Rv
cggccuugacgcacgacu

SEQ ID NO: 3336642 - RNA, 15 nt, Mycobacterium tuberculosis H37Rv
cggccuugaucaccg

SEQ ID NO: 3336643 - RNA, 16 nt, Mycobacterium tuberculosis H37Rv
cggccuugaucaccgu

SEQ ID NO: 3336644 - RNA, 22 nt, Mycobacterium tuberculosis H37Rv
cggccuugaucaccgugcgguc

SEQ ID NO: 3336645 - RNA, 13 nt, Mycobacterium tuberculosis H37Rv
cggccuugccacc

SEQ ID NO: 3336646 - RNA, 15 nt, Mycobacterium tuberculosis H37Rv
cggccuugccaccgg

SEQ ID NO: 3336647 - RNA, 16 nt, Mycobacterium tuberculosis H37Rv
cggccuugccaccggu

SEQ ID NO: 3336648 - RNA, 15 nt, Mycobacterium tuberculosis H37Rv
cggccuugccgccgg

SEQ ID NO: 3336649 - RNA, 17 nt, Mycobacterium tuberculosis H37Rv
cggccuugccgccggcu

SEQ ID NO: 3336650 - RNA, 18 nt, Mycobacterium tuberculosis H37Rv
cggccuugccgccggcuc

SEQ ID NO: 3336651 - RNA, 21 nt, Mycobacterium tuberculosis H37Rv
cggccuugcgcacaggcgcga

SEQ ID NO: 3336652 - RNA, 20 nt, Mycobacterium tuberculosis H37Rv
cggccuugcgggcucucggc

SEQ ID NO: 3336653 - RNA, 20 nt, Mycobacterium tuberculosis H37Rv
cggccuugcucagcacgccg

SEQ ID NO: 3336654 - RNA, 17 nt, Mycobacterium tuberculosis H37Rv
cggccuugugcucgaug

SEQ ID NO: 3336655 - RNA, 14 nt, Mycobacterium tuberculosis H37Rv
cggccuuugucgcc

SEQ ID NO: 3336656 - RNA, 22 nt, Mycobacterium tuberculosis H37Rv
cggccuuugucgccuucuuggc

SEQ ID NO: 3336657 - RNA, 16 nt, Mycobacterium tuberculosis H37Rv
cggcgaaacucgucga

SEQ ID NO: 3336658 - RNA, 15 nt, Mycobacterium tuberculosis H37Rv
cggcgaaaggccagu

SEQ ID NO: 3336659 - RNA, 23 nt, Mycobacterium tuberculosis H37Rv
cggcgaaaucgacagcagcgcga

SEQ ID NO: 3336660 - RNA, 16 nt, Mycobacterium tuberculosis H37Rv
cggcgaacaaccacgc

SEQ ID NO: 3336661 - RNA, 17 nt, Mycobacterium tuberculosis H37Rv
cggcgaacaaccgccgc

SEQ ID NO: 3336662 - RNA, 14 nt, Mycobacterium tuberculosis H37Rv
cggcgaacagcccc

SEQ ID NO: 3336663 - RNA, 15 nt, Mycobacterium tuberculosis H37Rv
cggcgaacagcccca

SEQ ID NO: 3336664 - RNA, 17 nt, Mycobacterium tuberculosis H37Rv
cggcgaacaucaccguc

SEQ ID NO: 3336665 - RNA, 20 nt, Mycobacterium tuberculosis H37Rv
cggcgaacaucaccgucgcc

SEQ ID NO: 3336666 - RNA, 17 nt, Mycobacterium tuberculosis H37Rv
cggcgaaccacggcagc

SEQ ID NO: 3336667 - RNA, 18 nt, Mycobacterium tuberculosis H37Rv
cggcgaaccacggcagcc

SEQ ID NO: 3336668 - RNA, 17 nt, Mycobacterium tuberculosis H37Rv
cggcgaaccagcgcguc

SEQ ID NO: 3336669 - RNA, 19 nt, Mycobacterium tuberculosis H37Rv
cggcgaaccagcgcgucuc

SEQ ID NO: 3336670 - RNA, 14 nt, Mycobacterium tuberculosis H37Rv
cggcgaacccaccg

SEQ ID NO: 3336671 - RNA, 15 nt, Mycobacterium tuberculosis H37Rv
cggcgaacccaccgc

SEQ ID NO: 3336672 - RNA, 18 nt, Mycobacterium tuberculosis H37Rv
cggcgaacccaccgcauu

SEQ ID NO: 3336673 - RNA, 21 nt, Mycobacterium tuberculosis H37Rv
cggcgaacccgccgaugccgc

SEQ ID NO: 3336674 - RNA, 18 nt, Mycobacterium tuberculosis H37Rv
cggcgaaccggcccaccg

SEQ ID NO: 3336675 - RNA, 19 nt, Mycobacterium tuberculosis H37Rv
cggcgaaccggcccaccga

SEQ ID NO: 3336676 - RNA, 21 nt, Mycobacterium tuberculosis H37Rv
cggcgaacgcgaaugucgcgc

SEQ ID NO: 3336677 - RNA, 19 nt, Mycobacterium tuberculosis H37Rv
cggcgaacgcguccagcgc

SEQ ID NO: 3336678 - RNA, 23 nt, Mycobacterium tuberculosis H37Rv
cggcgaacgcguccagcgcggcc

SEQ ID NO: 3336679 - RNA, 20 nt, Mycobacterium tuberculosis H37Rv
cggcgaacucgcgccgagcc

SEQ ID NO: 3336680 - RNA, 16 nt, Mycobacterium tuberculosis H37Rv
cggcgaacucgggcga

SEQ ID NO: 3336681 - RNA, 17 nt, Mycobacterium tuberculosis H37Rv
cggcgaacucgggcgac

SEQ ID NO: 3336682 - RNA, 18 nt, Mycobacterium tuberculosis H37Rv
cggcgaacucuacggugg

SEQ ID NO: 3336683 - RNA, 14 nt, Mycobacterium tuberculosis H37Rv
cggcgaacugggug

SEQ ID NO: 3336684 - RNA, 19 nt, Mycobacterium tuberculosis H37Rv
cggcgaacugggugcgguc

SEQ ID NO: 3336685 - RNA, 15 nt, Mycobacterium tuberculosis H37Rv
cggcgaacuuggccg

SEQ ID NO: 3336686 - RNA, 18 nt, Mycobacterium tuberculosis H37Rv
cggcgaagaccgccggga

SEQ ID NO: 3336687 - RNA, 14 nt, Mycobacterium tuberculosis H37Rv
cggcgaagccgggu

SEQ ID NO: 3336688 - RNA, 14 nt, Mycobacterium tuberculosis H37Rv
cggcgaagcgggcg

SEQ ID NO: 3336689 - RNA, 15 nt, Mycobacterium tuberculosis H37Rv
cggcgaagcgggcgu

SEQ ID NO: 3336690 - RNA, 20 nt, Mycobacterium tuberculosis H37Rv
cggcgaaggccgcgcgcagg

SEQ ID NO: 3336691 - RNA, 13 nt, Mycobacterium tuberculosis H37Rv
cggcgaagguagu

SEQ ID NO: 3336692 - RNA, 17 nt, Mycobacterium tuberculosis H37Rv
cggcgaagucacgcacc

SEQ ID NO: 3336693 - RNA, 15 nt, Mycobacterium tuberculosis H37Rv
cggcgaagugcaccc

SEQ ID NO: 3336694 - RNA, 19 nt, Mycobacterium tuberculosis H37Rv
cggcgaagugcuccaccuc

SEQ ID NO: 3336695 - RNA, 14 nt, Mycobacterium tuberculosis H37Rv
cggcgaauacgacc

SEQ ID NO: 3336696 - RNA, 21 nt, Mycobacterium tuberculosis H37Rv
cggcgaauacgaccgucgcgc

SEQ ID NO: 3336697 - RNA, 17 nt, Mycobacterium tuberculosis H37Rv
cggcgacaacagcacgu

SEQ ID NO: 3336698 - RNA, 17 nt, Mycobacterium tuberculosis H37Rv
cggcgacaagccgagcc

SEQ ID NO: 3336699 - RNA, 22 nt, Mycobacterium tuberculosis H37Rv
cggcgacaagccgagcccgucg

SEQ ID NO: 3336700 - RNA, 14 nt, Mycobacterium tuberculosis H37Rv
cggcgacacccugg

SEQ ID NO: 3336701 - RNA, 12 nt, Mycobacterium tuberculosis H37Rv
cggcgacaccgc

SEQ ID NO: 3336702 - RNA, 17 nt, Mycobacterium tuberculosis H37Rv
cggcgacaccgcaccga

SEQ ID NO: 3336703 - RNA, 14 nt, Mycobacterium tuberculosis H37Rv
cggcgacacgccag

SEQ ID NO: 3336704 - RNA, 18 nt, Mycobacterium tuberculosis H37Rv
cggcgacagcuuggccgg

SEQ ID NO: 3336705 - RNA, 20 nt, Mycobacterium tuberculosis H37Rv
cggcgacagcuuggccgguu

SEQ ID NO: 3336706 - RNA, 22 nt, Mycobacterium tuberculosis H37Rv
cggcgacaggagacgguacgcc

SEQ ID NO: 3336707 - RNA, 19 nt, Mycobacterium tuberculosis H37Rv
cggcgaccaaggccgaccu

SEQ ID NO: 3336708 - RNA, 15 nt, Mycobacterium tuberculosis H37Rv
cggcgaccaccagcg

SEQ ID NO: 3336709 - RNA, 17 nt, Mycobacterium tuberculosis H37Rv
cggcgaccaccguuuga

SEQ ID NO: 3336710 - RNA, 16 nt, Mycobacterium tuberculosis H37Rv
cggcgaccacgccgcc

SEQ ID NO: 3336711 - RNA, 21 nt, Mycobacterium tuberculosis H37Rv
cggcgaccacgccgccggcgc

SEQ ID NO: 3336712 - RNA, 13 nt, Mycobacterium tuberculosis H37Rv
cggcgaccacggc

SEQ ID NO: 3336713 - RNA, 18 nt, Mycobacterium tuberculosis H37Rv
cggcgaccacggcaccga

SEQ ID NO: 3336714 - RNA, 19 nt, Mycobacterium tuberculosis H37Rv
cggcgaccacggcaccgau

SEQ ID NO: 3336715 - RNA, 20 nt, Mycobacterium tuberculosis H37Rv
cggcgaccacggcaccgauc

SEQ ID NO: 3336716 - RNA, 22 nt, Mycobacterium tuberculosis H37Rv
cggcgaccagcucagcugcgga

SEQ ID NO: 3336717 - RNA, 17 nt, Mycobacterium tuberculosis H37Rv
cggcgaccaggucggcu

SEQ ID NO: 3336718 - RNA, 12 nt, Mycobacterium tuberculosis H37Rv
cggcgaccaucu

SEQ ID NO: 3336719 - RNA, 19 nt, Mycobacterium tuberculosis H37Rv
cggcgaccaucugaucggg

SEQ ID NO: 3336720 - RNA, 23 nt, Mycobacterium tuberculosis H37Rv
cggcgaccccgaacauccgccgc

SEQ ID NO: 3336721 - RNA, 21 nt, Mycobacterium tuberculosis H37Rv
cggcgacccgccuguaccggc

SEQ ID NO: 3336722 - RNA, 20 nt, Mycobacterium tuberculosis H37Rv
cggcgacccggguagacacc

SEQ ID NO: 3336723 - RNA, 17 nt, Mycobacterium tuberculosis H37Rv
cggcgacccggucgcgg

SEQ ID NO: 3336724 - RNA, 23 nt, Mycobacterium tuberculosis H37Rv
cggcgaccgacgccggugucggc

SEQ ID NO: 3336725 - RNA, 13 nt, Mycobacterium tuberculosis H37Rv
cggcgaccgcgcu

SEQ ID NO: 3336726 - RNA, 15 nt, Mycobacterium tuberculosis H37Rv
cggcgaccgcggucg

SEQ ID NO: 3336727 - RNA, 18 nt, Mycobacterium tuberculosis H37Rv
cggcgaccggguccggcg

SEQ ID NO: 3336728 - RNA, 13 nt, Mycobacterium tuberculosis H37Rv
cggcgaccggugc

SEQ ID NO: 3336729 - RNA, 13 nt, Mycobacterium tuberculosis H37Rv
cggcgaccgucga

SEQ ID NO: 3336730 - RNA, 21 nt, Mycobacterium tuberculosis H37Rv
cggcgaccuccgggaugucga

SEQ ID NO: 3336731 - RNA, 17 nt, Mycobacterium tuberculosis H37Rv
cggcgaccucggcggcg

SEQ ID NO: 3336732 - RNA, 22 nt, Mycobacterium tuberculosis H37Rv
cggcgaccugccggaccgcgga

SEQ ID NO: 3336733 - RNA, 15 nt, Mycobacterium tuberculosis H37Rv
cggcgaccugcucgc

SEQ ID NO: 3336734 - RNA, 20 nt, Mycobacterium tuberculosis H37Rv
cggcgaccuggcucaucgau

SEQ ID NO: 3336735 - RNA, 17 nt, Mycobacterium tuberculosis H37Rv
cggcgacgaaccgccag

SEQ ID NO: 3336736 - RNA, 20 nt, Mycobacterium tuberculosis H37Rv
cggcgacgaacucacgcagg

SEQ ID NO: 3336737 - RNA, 17 nt, Mycobacterium tuberculosis H37Rv
cggcgacgaaugcagca

SEQ ID NO: 3336738 - RNA, 16 nt, Mycobacterium tuberculosis H37Rv
cggcgacgaccgucgg

SEQ ID NO: 3336739 - RNA, 15 nt, Mycobacterium tuberculosis H37Rv
cggcgacgagcgcag

SEQ ID NO: 3336740 - RNA, 13 nt, Mycobacterium tuberculosis H37Rv
cggcgacgaucuc

SEQ ID NO: 3336741 - RNA, 15 nt, Mycobacterium tuberculosis H37Rv
cggcgacgaucucgg

SEQ ID NO: 3336742 - RNA, 15 nt, Mycobacterium tuberculosis H37Rv
cggcgacgaugucga

SEQ ID NO: 3336743 - RNA, 22 nt, Mycobacterium tuberculosis H37Rv
cggcgacgaugucgacucgugg

SEQ ID NO: 3336744 - RNA, 19 nt, Mycobacterium tuberculosis H37Rv
cggcgacgaugucgagcgc

SEQ ID NO: 3336745 - RNA, 21 nt, Mycobacterium tuberculosis H37Rv
cggcgacgaugucgagcgcga

SEQ ID NO: 3336746 - RNA, 13 nt, Mycobacterium tuberculosis H37Rv
cggcgacgccagu

SEQ ID NO: 3336747 - RNA, 12 nt, Mycobacterium tuberculosis H37Rv
cggcgacgcgga

SEQ ID NO: 3336748 - RNA, 16 nt, Mycobacterium tuberculosis H37Rv
cggcgacgcuaccgcc

SEQ ID NO: 3336749 - RNA, 17 nt, Mycobacterium tuberculosis H37Rv
cggcgacgcuaccgccg

SEQ ID NO: 3336750 - RNA, 20 nt, Mycobacterium tuberculosis H37Rv
cggcgacgcuaccgccggag

SEQ ID NO: 3336751 - RNA, 17 nt, Mycobacterium tuberculosis H37Rv
cggcgacggccagcgcg

SEQ ID NO: 3336752 - RNA, 13 nt, Mycobacterium tuberculosis H37Rv
cggcgacggccgc

SEQ ID NO: 3336753 - RNA, 22 nt, Mycobacterium tuberculosis H37Rv
cggcgacggccgcucgggccag

SEQ ID NO: 3336754 - RNA, 14 nt, Mycobacterium tuberculosis H37Rv
cggcgacggcgguc

SEQ ID NO: 3336755 - RNA, 13 nt, Mycobacterium tuberculosis H37Rv
cggcgacggcguc

SEQ ID NO: 3336756 - RNA, 24 nt, Mycobacterium tuberculosis H37Rv
cggcgacggugagggcgucgucga

SEQ ID NO: 3336757 - RNA, 18 nt, Mycobacterium tuberculosis H37Rv
cggcgacgucgcgcaggu

SEQ ID NO: 3336758 - RNA, 22 nt, Mycobacterium tuberculosis H37Rv
cggcgacgucguuggccugccg

SEQ ID NO: 3336759 - RNA, 22 nt, Mycobacterium tuberculosis H37Rv
cggcgacgugaauggugguguc

SEQ ID NO: 3336760 - RNA, 17 nt, Mycobacterium tuberculosis H37Rv
cggcgacguggcgccga

SEQ ID NO: 3336761 - RNA, 21 nt, Mycobacterium tuberculosis H37Rv
cggcgacguggcgccgacagg

SEQ ID NO: 3336762 - RNA, 18 nt, Mycobacterium tuberculosis H37Rv
cggcgacguuccgcucga

SEQ ID NO: 3336763 - RNA, 19 nt, Mycobacterium tuberculosis H37Rv
cggcgacguuccgcucgag

SEQ ID NO: 3336764 - RNA, 17 nt, Mycobacterium tuberculosis H37Rv
cggcgacuacccagcca

SEQ ID NO: 3336765 - RNA, 24 nt, Mycobacterium tuberculosis H37Rv
cggcgacuacccagccagccgcga

SEQ ID NO: 3336766 - RNA, 17 nt, Mycobacterium tuberculosis H37Rv
cggcgacucgaggaccu

SEQ ID NO: 3336767 - RNA, 15 nt, Mycobacterium tuberculosis H37Rv
cggcgacucugugac

SEQ ID NO: 3336768 - RNA, 14 nt, Mycobacterium tuberculosis H37Rv
cggcgacugcagcg

SEQ ID NO: 3336769 - RNA, 16 nt, Mycobacterium tuberculosis H37Rv
cggcgacugcgcaccu

SEQ ID NO: 3336770 - RNA, 14 nt, Mycobacterium tuberculosis H37Rv
cggcgagagccucg

SEQ ID NO: 3336771 - RNA, 17 nt, Mycobacterium tuberculosis H37Rv
cggcgagagccucggcc

SEQ ID NO: 3336772 - RNA, 18 nt, Mycobacterium tuberculosis H37Rv
cggcgagagccucggcca

SEQ ID NO: 3336773 - RNA, 19 nt, Mycobacterium tuberculosis H37Rv
cggcgagagccucggccau

SEQ ID NO: 3336774 - RNA, 23 nt, Mycobacterium tuberculosis H37Rv
cggcgagagggcggggcagaagu

SEQ ID NO: 3336775 - RNA, 21 nt, Mycobacterium tuberculosis H37Rv
cggcgagcaauuccucagccg

SEQ ID NO: 3336776 - RNA, 20 nt, Mycobacterium tuberculosis H37Rv
cggcgagcacaugcugccgc

SEQ ID NO: 3336777 - RNA, 11 nt, Mycobacterium tuberculosis H37Rv
cggcgagcacc

SEQ ID NO: 3336778 - RNA, 14 nt, Mycobacterium tuberculosis H37Rv
cggcgagcacccgc

SEQ ID NO: 3336779 - RNA, 17 nt, Mycobacterium tuberculosis H37Rv
cggcgagcacccgcugg

SEQ ID NO: 3336780 - RNA, 21 nt, Mycobacterium tuberculosis H37Rv
cggcgagcacccgcuggucga

SEQ ID NO: 3336781 - RNA, 17 nt, Mycobacterium tuberculosis H37Rv
cggcgagcacgcgggca

SEQ ID NO: 3336782 - RNA, 18 nt, Mycobacterium tuberculosis H37Rv
cggcgagcacgcgggcac

SEQ ID NO: 3336783 - RNA, 22 nt, Mycobacterium tuberculosis H37Rv
cggcgagcacgucacgcgcggc

SEQ ID NO: 3336784 - RNA, 20 nt, Mycobacterium tuberculosis H37Rv
cggcgagcagacgcaaaagc

SEQ ID NO: 3336785 - RNA, 14 nt, Mycobacterium tuberculosis H37Rv
cggcgagcagagaa

SEQ ID NO: 3336786 - RNA, 15 nt, Mycobacterium tuberculosis H37Rv
cggcgagcagcaggu

SEQ ID NO: 3336787 - RNA, 14 nt, Mycobacterium tuberculosis H37Rv
cggcgagcagggcg

SEQ ID NO: 3336788 - RNA, 23 nt, Mycobacterium tuberculosis H37Rv
cggcgagccaaacuacccgccca

SEQ ID NO: 3336789 - RNA, 17 nt, Mycobacterium tuberculosis H37Rv
cggcgagccgcgcccaa

SEQ ID NO: 3336790 - RNA, 15 nt, Mycobacterium tuberculosis H37Rv
cggcgagccgcucgc

SEQ ID NO: 3336791 - RNA, 18 nt, Mycobacterium tuberculosis H37Rv
cggcgagccucgcgcgcc

SEQ ID NO: 3336792 - RNA, 23 nt, Mycobacterium tuberculosis H37Rv
cggcgagcgcaucggccaacacc

SEQ ID NO: 3336793 - RNA, 15 nt, Mycobacterium tuberculosis H37Rv
cggcgagcgcccugg

SEQ ID NO: 3336794 - RNA, 23 nt, Mycobacterium tuberculosis H37Rv
cggcgagcgcgaugcagugcgac

SEQ ID NO: 3336795 - RNA, 15 nt, Mycobacterium tuberculosis H37Rv
cggcgagcgucgggc

SEQ ID NO: 3336796 - RNA, 16 nt, Mycobacterium tuberculosis H37Rv
cggcgaggacgcgccc

SEQ ID NO: 3336797 - RNA, 19 nt, Mycobacterium tuberculosis H37Rv
cggcgaggacggcggccag

SEQ ID NO: 3336798 - RNA, 14 nt, Mycobacterium tuberculosis H37Rv
cggcgagggccagu

SEQ ID NO: 3336799 - RNA, 14 nt, Mycobacterium tuberculosis H37Rv
cggcgagggcgguc

SEQ ID NO: 3336800 - RNA, 22 nt, Mycobacterium tuberculosis H37Rv
cggcgagguauaaacgcggcgc

SEQ ID NO: 3336801 - RNA, 13 nt, Mycobacterium tuberculosis H37Rv
cggcgaggucccg

SEQ ID NO: 3336802 - RNA, 18 nt, Mycobacterium tuberculosis H37Rv
cggcgaggucccggccga

SEQ ID NO: 3336803 - RNA, 21 nt, Mycobacterium tuberculosis H37Rv
cggcgaggucccggccgagcg

SEQ ID NO: 3336804 - RNA, 23 nt, Mycobacterium tuberculosis H37Rv
cggcgaggugcccaaggccagga

SEQ ID NO: 3336805 - RNA, 14 nt, Mycobacterium tuberculosis H37Rv
cggcgagucgguug

SEQ ID NO: 3336806 - RNA, 13 nt, Mycobacterium tuberculosis H37Rv
cggcgaguggcuc

SEQ ID NO: 3336807 - RNA, 20 nt, Mycobacterium tuberculosis H37Rv
cggcgagugguccagccaga

SEQ ID NO: 3336808 - RNA, 17 nt, Mycobacterium tuberculosis H37Rv
cggcgauaacuccgcgg

SEQ ID NO: 3336809 - RNA, 21 nt, Mycobacterium tuberculosis H37Rv
cggcgauaccgaggaucucgc

SEQ ID NO: 3336810 - RNA, 16 nt, Mycobacterium tuberculosis H37Rv
cggcgauaccgguugc

SEQ ID NO: 3336811 - RNA, 17 nt, Mycobacterium tuberculosis H37Rv
cggcgauauaggacgcc

SEQ ID NO: 3336812 - RNA, 18 nt, Mycobacterium tuberculosis H37Rv
cggcgaucaacucgggca

SEQ ID NO: 3336813 - RNA, 20 nt, Mycobacterium tuberculosis H37Rv
cggcgaucaacucgggcagc

SEQ ID NO: 3336814 - RNA, 22 nt, Mycobacterium tuberculosis H37Rv
cggcgaucaacucgggcagcgc

SEQ ID NO: 3336815 - RNA, 15 nt, Mycobacterium tuberculosis H37Rv
cggcgaucaagccuc

SEQ ID NO: 3336816 - RNA, 11 nt, Mycobacterium tuberculosis H37Rv
cggcgaucacg

SEQ ID NO: 3336817 - RNA, 13 nt, Mycobacterium tuberculosis H37Rv
cggcgaucacgcg

SEQ ID NO: 3336818 - RNA, 14 nt, Mycobacterium tuberculosis H37Rv
cggcgaucacgcga

SEQ ID NO: 3336819 - RNA, 16 nt, Mycobacterium tuberculosis H37Rv
cggcgauccccgacgu

SEQ ID NO: 3336820 - RNA, 19 nt, Mycobacterium tuberculosis H37Rv
cggcgauccggucggccag

SEQ ID NO: 3336821 - RNA, 21 nt, Mycobacterium tuberculosis H37Rv
cggcgauccggucggccaggc

SEQ ID NO: 3336822 - RNA, 15 nt, Mycobacterium tuberculosis H37Rv
cggcgaucgcauggu

SEQ ID NO: 3336823 - RNA, 21 nt, Mycobacterium tuberculosis H37Rv
cggcgaucgcuccgcggcgca

SEQ ID NO: 3336824 - RNA, 18 nt, Mycobacterium tuberculosis H37Rv
cggcgaucggaggcccgc

SEQ ID NO: 3336825 - RNA, 19 nt, Mycobacterium tuberculosis H37Rv
cggcgaucguguccaccgg

SEQ ID NO: 3336826 - RNA, 22 nt, Mycobacterium tuberculosis H37Rv
cggcgaucguguccaccggacc

SEQ ID NO: 3336827 - RNA, 16 nt, Mycobacterium tuberculosis H37Rv
cggcgaucucgaccgu

SEQ ID NO: 3336828 - RNA, 17 nt, Mycobacterium tuberculosis H37Rv
cggcgaucucgucgcgg

SEQ ID NO: 3336829 - RNA, 15 nt, Mycobacterium tuberculosis H37Rv
cggcgaucugcugug

SEQ ID NO: 3336830 - RNA, 17 nt, Mycobacterium tuberculosis H37Rv
cggcgaucugcuguguc

SEQ ID NO: 3336831 - RNA, 20 nt, Mycobacterium tuberculosis H37Rv
cggcgaucugcugugucgua

SEQ ID NO: 3336832 - RNA, 14 nt, Mycobacterium tuberculosis H37Rv
cggcgaugaacggg

SEQ ID NO: 3336833 - RNA, 21 nt, Mycobacterium tuberculosis H37Rv
cggcgaugaacgggaucgacc

SEQ ID NO: 3336834 - RNA, 16 nt, Mycobacterium tuberculosis H37Rv
cggcgaugaauagguc

SEQ ID NO: 3336835 - RNA, 18 nt, Mycobacterium tuberculosis H37Rv
cggcgaugaccgggcgau

SEQ ID NO: 3336836 - RNA, 18 nt, Mycobacterium tuberculosis H37Rv
cggcgaugaugacggcgg

SEQ ID NO: 3336837 - RNA, 19 nt, Mycobacterium tuberculosis H37Rv
cggcgaugaugacggcggc

SEQ ID NO: 3336838 - RNA, 17 nt, Mycobacterium tuberculosis H37Rv
cggcgaugauggcgcga

SEQ ID NO: 3336839 - RNA, 19 nt, Mycobacterium tuberculosis H37Rv
cggcgaugauggcgcgauc

SEQ ID NO: 3336840 - RNA, 13 nt, Mycobacterium tuberculosis H37Rv
cggcgaugcagcc

SEQ ID NO: 3336841 - RNA, 14 nt, Mycobacterium tuberculosis H37Rv
cggcgaugcagcca

SEQ ID NO: 3336842 - RNA, 16 nt, Mycobacterium tuberculosis H37Rv
cggcgaugcagccggg

SEQ ID NO: 3336843 - RNA, 17 nt, Mycobacterium tuberculosis H37Rv
cggcgaugcagccggga

SEQ ID NO: 3336844 - RNA, 11 nt, Mycobacterium tuberculosis H37Rv
cggcgaugcgg

SEQ ID NO: 3336845 - RNA, 13 nt, Mycobacterium tuberculosis H37Rv
cggcgaugcgguc

SEQ ID NO: 3336846 - RNA, 15 nt, Mycobacterium tuberculosis H37Rv
cggcgaugcggucgg

SEQ ID NO: 3336847 - RNA, 18 nt, Mycobacterium tuberculosis H37Rv
cggcgaugcggucggcca

SEQ ID NO: 3336848 - RNA, 20 nt, Mycobacterium tuberculosis H37Rv
cggcgaugcguccgcccagc

SEQ ID NO: 3336849 - RNA, 15 nt, Mycobacterium tuberculosis H37Rv
cggcgaugcugagcc

SEQ ID NO: 3336850 - RNA, 16 nt, Mycobacterium tuberculosis H37Rv
cggcgaugcugagccg

SEQ ID NO: 3336851 - RNA, 12 nt, Mycobacterium tuberculosis H37Rv
cggcgauggccc

SEQ ID NO: 3336852 - RNA, 15 nt, Mycobacterium tuberculosis H37Rv
cggcgauggcgcgca

SEQ ID NO: 3336853 - RNA, 23 nt, Mycobacterium tuberculosis H37Rv
cggcgauggcgcgcaacguagcc

SEQ ID NO: 3336854 - RNA, 14 nt, Mycobacterium tuberculosis H37Rv
cggcgaugggccgg

SEQ ID NO: 3336855 - RNA, 22 nt, Mycobacterium tuberculosis H37Rv
cggcgaugggccgguccggggc

SEQ ID NO: 3336856 - RNA, 17 nt, Mycobacterium tuberculosis H37Rv
cggcgaugguaucgccg

SEQ ID NO: 3336857 - RNA, 21 nt, Mycobacterium tuberculosis H37Rv
cggcgaugguaucgccgcuag

SEQ ID NO: 3336858 - RNA, 18 nt, Mycobacterium tuberculosis H37Rv
cggcgaugguugaaccag

SEQ ID NO: 3336859 - RNA, 17 nt, Mycobacterium tuberculosis H37Rv
cggcgauuacggccagu

SEQ ID NO: 3336860 - RNA, 15 nt, Mycobacterium tuberculosis H37Rv
cggcgauucccgcga

SEQ ID NO: 3336861 - RNA, 16 nt, Mycobacterium tuberculosis H37Rv
cggcgauuggaccgcc

SEQ ID NO: 3336862 - RNA, 18 nt, Mycobacterium tuberculosis H37Rv
cggcgauuggcugugauc

SEQ ID NO: 3336863 - RNA, 19 nt, Mycobacterium tuberculosis H37Rv
cggcgauuuugcgucgcgc

SEQ ID NO: 3336864 - RNA, 19 nt, Mycobacterium tuberculosis H37Rv
cggcgcaagcgccgcgcuu

SEQ ID NO: 3336865 - RNA, 21 nt, Mycobacterium tuberculosis H37Rv
cggcgcacaaacauacgccac

SEQ ID NO: 3336866 - RNA, 15 nt, Mycobacterium tuberculosis H37Rv
cggcgcacaacccgu

SEQ ID NO: 3336867 - RNA, 17 nt, Mycobacterium tuberculosis H37Rv
cggcgcacaacccgucg

SEQ ID NO: 3336868 - RNA, 19 nt, Mycobacterium tuberculosis H37Rv
cggcgcaccacaccacggu

SEQ ID NO: 3336869 - RNA, 21 nt, Mycobacterium tuberculosis H37Rv
cggcgcaccaucgcggccgcu

SEQ ID NO: 3336870 - RNA, 14 nt, Mycobacterium tuberculosis H37Rv
cggcgcaccgucgc

SEQ ID NO: 3336871 - RNA, 15 nt, Mycobacterium tuberculosis H37Rv
cggcgcaccugggcu

SEQ ID NO: 3336872 - RNA, 18 nt, Mycobacterium tuberculosis H37Rv
cggcgcaccuugaccguc

SEQ ID NO: 3336873 - RNA, 20 nt, Mycobacterium tuberculosis H37Rv
cggcgcaccuugaccgucgc

SEQ ID NO: 3336874 - RNA, 22 nt, Mycobacterium tuberculosis H37Rv
cggcgcaccuugaccgucgcgc

SEQ ID NO: 3336875 - RNA, 19 nt, Mycobacterium tuberculosis H37Rv
cggcgcacgaaaccgcagc

SEQ ID NO: 3336876 - RNA, 23 nt, Mycobacterium tuberculosis H37Rv
cggcgcacgaaaccgcagcgcga

SEQ ID NO: 3336877 - RNA, 18 nt, Mycobacterium tuberculosis H37Rv
cggcgcagauagcgcucg

SEQ ID NO: 3336878 - RNA, 20 nt, Mycobacterium tuberculosis H37Rv
cggcgcagauagcgcucgaa

SEQ ID NO: 3336879 - RNA, 23 nt, Mycobacterium tuberculosis H37Rv
cggcgcagcaacgcaaucgucgc

SEQ ID NO: 3336880 - RNA, 21 nt, Mycobacterium tuberculosis H37Rv
cggcgcagcacauccugcagc

SEQ ID NO: 3336881 - RNA, 13 nt, Mycobacterium tuberculosis H37Rv
cggcgcagcgacc

SEQ ID NO: 3336882 - RNA, 14 nt, Mycobacterium tuberculosis H37Rv
cggcgcagcgaccg

SEQ ID NO: 3336883 - RNA, 16 nt, Mycobacterium tuberculosis H37Rv
cggcgcagcgaccggu

SEQ ID NO: 3336884 - RNA, 21 nt, Mycobacterium tuberculosis H37Rv
cggcgcagcgacgcgauuucg

SEQ ID NO: 3336885 - RNA, 17 nt, Mycobacterium tuberculosis H37Rv
cggcgcaggucgcgcag

SEQ ID NO: 3336886 - RNA, 20 nt, Mycobacterium tuberculosis H37Rv
cggcgcaggucgcgcaguug

SEQ ID NO: 3336887 - RNA, 16 nt, Mycobacterium tuberculosis H37Rv
cggcgcaguagccgac

SEQ ID NO: 3336888 - RNA, 17 nt, Mycobacterium tuberculosis H37Rv
cggcgcaguagccgacc

SEQ ID NO: 3336889 - RNA, 14 nt, Mycobacterium tuberculosis H37Rv
cggcgcagugcagg

SEQ ID NO: 3336890 - RNA, 21 nt, Mycobacterium tuberculosis H37Rv
cggcgccaauggcggaccggg

SEQ ID NO: 3336891 - RNA, 23 nt, Mycobacterium tuberculosis H37Rv
cggcgccaauggcggaccgggcc

SEQ ID NO: 3336892 - RNA, 18 nt, Mycobacterium tuberculosis H37Rv
cggcgccacccgcgccgc

SEQ ID NO: 3336893 - RNA, 19 nt, Mycobacterium tuberculosis H37Rv
cggcgccacccgcgccgcc

SEQ ID NO: 3336894 - RNA, 22 nt, Mycobacterium tuberculosis H37Rv
cggcgccacccgcgccgccagc

SEQ ID NO: 3336895 - RNA, 20 nt, Mycobacterium tuberculosis H37Rv
cggcgccacccgcgccgccc

SEQ ID NO: 3336896 - RNA, 12 nt, Mycobacterium tuberculosis H37Rv
cggcgccaccgu

SEQ ID NO: 3336897 - RNA, 18 nt, Mycobacterium tuberculosis H37Rv
cggcgccaccguggugga

SEQ ID NO: 3336898 - RNA, 16 nt, Mycobacterium tuberculosis H37Rv
cggcgccagaucgacg

SEQ ID NO: 3336899 - RNA, 14 nt, Mycobacterium tuberculosis H37Rv
cggcgccagaugcc

SEQ ID NO: 3336900 - RNA, 14 nt, Mycobacterium tuberculosis H37Rv
cggcgccagcagug

SEQ ID NO: 3336901 - RNA, 17 nt, Mycobacterium tuberculosis H37Rv
cggcgccagcgccgcca

SEQ ID NO: 3336902 - RNA, 18 nt, Mycobacterium tuberculosis H37Rv
cggcgccagcgccgccac

SEQ ID NO: 3336903 - RNA, 17 nt, Mycobacterium tuberculosis H37Rv
cggcgccaguauggccg

SEQ ID NO: 3336904 - RNA, 19 nt, Mycobacterium tuberculosis H37Rv
cggcgccaguauggccgcc

SEQ ID NO: 3336905 - RNA, 21 nt, Mycobacterium tuberculosis H37Rv
cggcgccaguauggccgccac

SEQ ID NO: 3336906 - RNA, 13 nt, Mycobacterium tuberculosis H37Rv
cggcgccagugcg

SEQ ID NO: 3336907 - RNA, 21 nt, Mycobacterium tuberculosis H37Rv
cggcgccauagccgcgacccg

SEQ ID NO: 3336908 - RNA, 23 nt, Mycobacterium tuberculosis H37Rv
cggcgccauagccgcgacccgcg

SEQ ID NO: 3336909 - RNA, 18 nt, Mycobacterium tuberculosis H37Rv
cggcgcccacaucgucgg

SEQ ID NO: 3336910 - RNA, 19 nt, Mycobacterium tuberculosis H37Rv
cggcgcccagcgccucgau

SEQ ID NO: 3336911 - RNA, 15 nt, Mycobacterium tuberculosis H37Rv
cggcgcccagcgcua

SEQ ID NO: 3336912 - RNA, 14 nt, Mycobacterium tuberculosis H37Rv
cggcgcccagcucg

SEQ ID NO: 3336913 - RNA, 15 nt, Mycobacterium tuberculosis H37Rv
cggcgcccagcucga

SEQ ID NO: 3336914 - RNA, 17 nt, Mycobacterium tuberculosis H37Rv
cggcgcccagcucgucg

SEQ ID NO: 3336915 - RNA, 16 nt, Mycobacterium tuberculosis H37Rv
cggcgcccaggccgau

SEQ ID NO: 3336916 - RNA, 20 nt, Mycobacterium tuberculosis H37Rv
cggcgcccaggccgaucagc

SEQ ID NO: 3336917 - RNA, 14 nt, Mycobacterium tuberculosis H37Rv
cggcgcccaucgcg

SEQ ID NO: 3336918 - RNA, 12 nt, Mycobacterium tuberculosis H37Rv
cggcgccccggu

SEQ ID NO: 3336919 - RNA, 14 nt, Mycobacterium tuberculosis H37Rv
cggcgcccgcccga

SEQ ID NO: 3336920 - RNA, 14 nt, Mycobacterium tuberculosis H37Rv
cggcgcccgcucgg

SEQ ID NO: 3336921 - RNA, 17 nt, Mycobacterium tuberculosis H37Rv
cggcgcccgcucggccg

SEQ ID NO: 3336922 - RNA, 13 nt, Mycobacterium tuberculosis H37Rv
cggcgcccggcgg

SEQ ID NO: 3336923 - RNA, 13 nt, Mycobacterium tuberculosis H37Rv
cggcgcccggcuu

SEQ ID NO: 3336924 - RNA, 14 nt, Mycobacterium tuberculosis H37Rv
cggcgcccggucga

SEQ ID NO: 3336925 - RNA, 14 nt, Mycobacterium tuberculosis H37Rv
cggcgccgaacccg

SEQ ID NO: 3336926 - RNA, 14 nt, Mycobacterium tuberculosis H37Rv
cggcgccgagcagc

SEQ ID NO: 3336927 - RNA, 13 nt, Mycobacterium tuberculosis H37Rv
cggcgccgagguc

SEQ ID NO: 3336928 - RNA, 15 nt, Mycobacterium tuberculosis H37Rv
cggcgccgaggucga

SEQ ID NO: 3336929 - RNA, 16 nt, Mycobacterium tuberculosis H37Rv
cggcgccgcaccaagc

SEQ ID NO: 3336930 - RNA, 19 nt, Mycobacterium tuberculosis H37Rv
cggcgccgcagaucaccgc

SEQ ID NO: 3336931 - RNA, 23 nt, Mycobacterium tuberculosis H37Rv
cggcgccgcagaucaccgccagc

SEQ ID NO: 3336932 - RNA, 14 nt, Mycobacterium tuberculosis H37Rv
cggcgccgcauacc

SEQ ID NO: 3336933 - RNA, 16 nt, Mycobacterium tuberculosis H37Rv
cggcgccgccacugcc

SEQ ID NO: 3336934 - RNA, 22 nt, Mycobacterium tuberculosis H37Rv
cggcgccgccacugccggcagc

SEQ ID NO: 3336935 - RNA, 23 nt, Mycobacterium tuberculosis H37Rv
cggcgccgccacugccggcagcg

SEQ ID NO: 3336936 - RNA, 13 nt, Mycobacterium tuberculosis H37Rv
cggcgccgccagc

SEQ ID NO: 3336937 - RNA, 20 nt, Mycobacterium tuberculosis H37Rv
cggcgccgccagcaccaccg

SEQ ID NO: 3336938 - RNA, 18 nt, Mycobacterium tuberculosis H37Rv
cggcgccgccaucaacaa

SEQ ID NO: 3336939 - RNA, 17 nt, Mycobacterium tuberculosis H37Rv
cggcgccgccauugcca

SEQ ID NO: 3336940 - RNA, 22 nt, Mycobacterium tuberculosis H37Rv
cggcgccgcccaacgcgagcuu

SEQ ID NO: 3336941 - RNA, 13 nt, Mycobacterium tuberculosis H37Rv
cggcgccgcccga

SEQ ID NO: 3336942 - RNA, 13 nt, Mycobacterium tuberculosis H37Rv
cggcgccgcccgc

SEQ ID NO: 3336943 - RNA, 20 nt, Mycobacterium tuberculosis H37Rv
cggcgccgcccgcgccacca

SEQ ID NO: 3336944 - RNA, 22 nt, Mycobacterium tuberculosis H37Rv
cggcgccgcccgcgccaccagc

SEQ ID NO: 3336945 - RNA, 13 nt, Mycobacterium tuberculosis H37Rv
cggcgccgcccuu

SEQ ID NO: 3336946 - RNA, 17 nt, Mycobacterium tuberculosis H37Rv
cggcgccgcccuugccg

SEQ ID NO: 3336947 - RNA, 22 nt, Mycobacterium tuberculosis H37Rv
cggcgccgcccuugccgccggc

SEQ ID NO: 3336948 - RNA, 17 nt, Mycobacterium tuberculosis H37Rv
cggcgccgccggcacca

SEQ ID NO: 3336949 - RNA, 19 nt, Mycobacterium tuberculosis H37Rv
cggcgccgccggcgccgcc

SEQ ID NO: 3336950 - RNA, 20 nt, Mycobacterium tuberculosis H37Rv
cggcgccgccguccagcgcc

SEQ ID NO: 3336951 - RNA, 15 nt, Mycobacterium tuberculosis H37Rv
cggcgccgccgucgc

SEQ ID NO: 3336952 - RNA, 23 nt, Mycobacterium tuberculosis H37Rv
cggcgccgccgucgccgccguua

SEQ ID NO: 3336953 - RNA, 15 nt, Mycobacterium tuberculosis H37Rv
cggcgccgccgugcg

SEQ ID NO: 3336954 - RNA, 20 nt, Mycobacterium tuberculosis H37Rv
cggcgccgccguuaccgccg

SEQ ID NO: 3336955 - RNA, 14 nt, Mycobacterium tuberculosis H37Rv
cggcgccgccguug

SEQ ID NO: 3336956 - RNA, 17 nt, Mycobacterium tuberculosis H37Rv
cggcgccgccguugccg

SEQ ID NO: 3336957 - RNA, 11 nt, Mycobacterium tuberculosis H37Rv
cggcgccgcgc

SEQ ID NO: 3336958 - RNA, 19 nt, Mycobacterium tuberculosis H37Rv
cggcgccgcgccgucccga

SEQ ID NO: 3336959 - RNA, 14 nt, Mycobacterium tuberculosis H37Rv
cggcgccgcgggug

SEQ ID NO: 3336960 - RNA, 14 nt, Mycobacterium tuberculosis H37Rv
cggcgccgcucacg

SEQ ID NO: 3336961 - RNA, 17 nt, Mycobacterium tuberculosis H37Rv
cggcgccggagccgccc

SEQ ID NO: 3336962 - RNA, 23 nt, Mycobacterium tuberculosis H37Rv
cggcgccggaguugaagaagccc

SEQ ID NO: 3336963 - RNA, 10 nt, Mycobacterium tuberculosis H37Rv
cggcgccggc

SEQ ID NO: 3336964 - RNA, 13 nt, Mycobacterium tuberculosis H37Rv
cggcgccggcauc

SEQ ID NO: 3336965 - RNA, 21 nt, Mycobacterium tuberculosis H37Rv
cggcgccggcaucuccaccgu

SEQ ID NO: 3336966 - RNA, 13 nt, Mycobacterium tuberculosis H37Rv
cggcgccggcgca

SEQ ID NO: 3336967 - RNA, 14 nt, Mycobacterium tuberculosis H37Rv
cggcgccggcgcug

SEQ ID NO: 3336968 - RNA, 16 nt, Mycobacterium tuberculosis H37Rv
cggcgccggcggccgc

SEQ ID NO: 3336969 - RNA, 14 nt, Mycobacterium tuberculosis H37Rv
cggcgccggcgucg

SEQ ID NO: 3336970 - RNA, 23 nt, Mycobacterium tuberculosis H37Rv
cggcgccggcgucggcgcccagc

SEQ ID NO: 3336971 - RNA, 13 nt, Mycobacterium tuberculosis H37Rv
cggcgccggcuug

SEQ ID NO: 3336972 - RNA, 22 nt, Mycobacterium tuberculosis H37Rv
cggcgccggggggcugcugcuc

SEQ ID NO: 3336973 - RNA, 16 nt, Mycobacterium tuberculosis H37Rv
cggcgccggugccgcc

SEQ ID NO: 3336974 - RNA, 18 nt, Mycobacterium tuberculosis H37Rv
cggcgccggugccgccuc

SEQ ID NO: 3336975 - RNA, 17 nt, Mycobacterium tuberculosis H37Rv
cggcgccgucgcccagc

SEQ ID NO: 3336976 - RNA, 23 nt, Mycobacterium tuberculosis H37Rv
cggcgccgucggagccggccacc

SEQ ID NO: 3336977 - RNA, 12 nt, Mycobacterium tuberculosis H37Rv
cggcgccgucgu

SEQ ID NO: 3336978 - RNA, 14 nt, Mycobacterium tuberculosis H37Rv
cggcgccgucguug

SEQ ID NO: 3336979 - RNA, 22 nt, Mycobacterium tuberculosis H37Rv
cggcgccgucguugugccgguc

SEQ ID NO: 3336980 - RNA, 21 nt, Mycobacterium tuberculosis H37Rv
cggcgccgugaucagcucgcg

SEQ ID NO: 3336981 - RNA, 13 nt, Mycobacterium tuberculosis H37Rv
cggcgccguugcc

SEQ ID NO: 3336982 - RNA, 14 nt, Mycobacterium tuberculosis H37Rv
cggcgccguugccg

SEQ ID NO: 3336983 - RNA, 18 nt, Mycobacterium tuberculosis H37Rv
cggcgccguugccgccgu

SEQ ID NO: 3336984 - RNA, 18 nt, Mycobacterium tuberculosis H37Rv
cggcgccuaaagacucga

SEQ ID NO: 3336985 - RNA, 19 nt, Mycobacterium tuberculosis H37Rv
cggcgccuccggcaccucc

SEQ ID NO: 3336986 - RNA, 14 nt, Mycobacterium tuberculosis H37Rv
cggcgccucggacc

SEQ ID NO: 3336987 - RNA, 13 nt, Mycobacterium tuberculosis H37Rv
cggcgccucguug

SEQ ID NO: 3336988 - RNA, 15 nt, Mycobacterium tuberculosis H37Rv
cggcgccucguugcc

SEQ ID NO: 3336989 - RNA, 16 nt, Mycobacterium tuberculosis H37Rv
cggcgccucguugccg

SEQ ID NO: 3336990 - RNA, 17 nt, Mycobacterium tuberculosis H37Rv
cggcgccucguugccgu

SEQ ID NO: 3336991 - RNA, 21 nt, Mycobacterium tuberculosis H37Rv
cggcgccucguugccguagcu

SEQ ID NO: 3336992 - RNA, 20 nt, Mycobacterium tuberculosis H37Rv
cggcgccugaggugcugcca

SEQ ID NO: 3336993 - RNA, 21 nt, Mycobacterium tuberculosis H37Rv
cggcgccugaggugcugccaa

SEQ ID NO: 3336994 - RNA, 20 nt, Mycobacterium tuberculosis H37Rv
cggcgccuggcggcgccgca

SEQ ID NO: 3336995 - RNA, 17 nt, Mycobacterium tuberculosis H37Rv
cggcgccuuggucgccg

SEQ ID NO: 3336996 - RNA, 18 nt, Mycobacterium tuberculosis H37Rv
cggcgcgaagucuugacc

SEQ ID NO: 3336997 - RNA, 16 nt, Mycobacterium tuberculosis H37Rv
cggcgcgacagccgug

SEQ ID NO: 3336998 - RNA, 13 nt, Mycobacterium tuberculosis H37Rv
cggcgcgacaggu

SEQ ID NO: 3336999 - RNA, 21 nt, Mycobacterium tuberculosis H37Rv
cggcgcgacaggugcuaggag

SEQ ID NO: 3337000 - RNA, 15 nt, Mycobacterium tuberculosis H37Rv
cggcgcgacgcccga

SEQ ID NO: 3337001 - RNA, 15 nt, Mycobacterium tuberculosis H37Rv
cggcgcgagccugau

SEQ ID NO: 3337002 - RNA, 19 nt, Mycobacterium tuberculosis H37Rv
cggcgcgagccugcucuuc

SEQ ID NO: 3337003 - RNA, 15 nt, Mycobacterium tuberculosis H37Rv
cggcgcgaggaacgc

SEQ ID NO: 3337004 - RNA, 21 nt, Mycobacterium tuberculosis H37Rv
cggcgcgaggaacgccggggc

SEQ ID NO: 3337005 - RNA, 18 nt, Mycobacterium tuberculosis H37Rv
cggcgcgauagauacccg

SEQ ID NO: 3337006 - RNA, 18 nt, Mycobacterium tuberculosis H37Rv
cggcgcgauccccgcgcu

SEQ ID NO: 3337007 - RNA, 18 nt, Mycobacterium tuberculosis H37Rv
cggcgcgaucgacgcucg

SEQ ID NO: 3337008 - RNA, 19 nt, Mycobacterium tuberculosis H37Rv
cggcgcgauggcgauagcg

SEQ ID NO: 3337009 - RNA, 12 nt, Mycobacterium tuberculosis H37Rv
cggcgcgcaccc

SEQ ID NO: 3337010 - RNA, 16 nt, Mycobacterium tuberculosis H37Rv
cggcgcgcaccccggc

SEQ ID NO: 3337011 - RNA, 16 nt, Mycobacterium tuberculosis H37Rv
cggcgcgccccaccgc

SEQ ID NO: 3337012 - RNA, 19 nt, Mycobacterium tuberculosis H37Rv
cggcgcgccccgccgcacg

SEQ ID NO: 3337013 - RNA, 12 nt, Mycobacterium tuberculosis H37Rv
cggcgcgccgac

SEQ ID NO: 3337014 - RNA, 18 nt, Mycobacterium tuberculosis H37Rv
cggcgcgccgaccaccgc

SEQ ID NO: 3337015 - RNA, 21 nt, Mycobacterium tuberculosis H37Rv
cggcgcgccgaguugcccggg

SEQ ID NO: 3337016 - RNA, 14 nt, Mycobacterium tuberculosis H37Rv
cggcgcgcgcgccg

SEQ ID NO: 3337017 - RNA, 16 nt, Mycobacterium tuberculosis H37Rv
cggcgcgcgcgccggc

SEQ ID NO: 3337018 - RNA, 17 nt, Mycobacterium tuberculosis H37Rv
cggcgcgcgcgccggcu

SEQ ID NO: 3337019 - RNA, 14 nt, Mycobacterium tuberculosis H37Rv
cggcgcgcggguug

SEQ ID NO: 3337020 - RNA, 12 nt, Mycobacterium tuberculosis H37Rv
cggcgcgcugaa

SEQ ID NO: 3337021 - RNA, 18 nt, Mycobacterium tuberculosis H37Rv
cggcgcgcugcacggaau

SEQ ID NO: 3337022 - RNA, 14 nt, Mycobacterium tuberculosis H37Rv
cggcgcggaacgcg

SEQ ID NO: 3337023 - RNA, 18 nt, Mycobacterium tuberculosis H37Rv
cggcgcggaacgcgucgc

SEQ ID NO: 3337024 - RNA, 14 nt, Mycobacterium tuberculosis H37Rv
cggcgcggagugcc

SEQ ID NO: 3337025 - RNA, 15 nt, Mycobacterium tuberculosis H37Rv
cggcgcggccagcuc

SEQ ID NO: 3337026 - RNA, 13 nt, Mycobacterium tuberculosis H37Rv
cggcgcggccgca

SEQ ID NO: 3337027 - RNA, 15 nt, Mycobacterium tuberculosis H37Rv
cggcgcggccgcagc

SEQ ID NO: 3337028 - RNA, 17 nt, Mycobacterium tuberculosis H37Rv
cggcgcggccgcagcca

SEQ ID NO: 3337029 - RNA, 20 nt, Mycobacterium tuberculosis H37Rv
cggcgcggccgcagccagca

SEQ ID NO: 3337030 - RNA, 15 nt, Mycobacterium tuberculosis H37Rv
cggcgcggccggccg

SEQ ID NO: 3337031 - RNA, 16 nt, Mycobacterium tuberculosis H37Rv
cggcgcggccggccgc

SEQ ID NO: 3337032 - RNA, 17 nt, Mycobacterium tuberculosis H37Rv
cggcgcggccggccgcu

SEQ ID NO: 3337033 - RNA, 16 nt, Mycobacterium tuberculosis H37Rv
cggcgcggcggcgucg

SEQ ID NO: 3337034 - RNA, 21 nt, Mycobacterium tuberculosis H37Rv
cggcgcgggucggcgaccgcg

SEQ ID NO: 3337035 - RNA, 19 nt, Mycobacterium tuberculosis H37Rv
cggcgcgguggggcgcgcc

SEQ ID NO: 3337036 - RNA, 23 nt, Mycobacterium tuberculosis H37Rv
cggcgcgguggggcgcgccggcu

SEQ ID NO: 3337037 - RNA, 21 nt, Mycobacterium tuberculosis H37Rv
cggcgcgguuuccagacgacc

SEQ ID NO: 3337038 - RNA, 22 nt, Mycobacterium tuberculosis H37Rv
cggcgcgguuucggcgucaccg

SEQ ID NO: 3337039 - RNA, 13 nt, Mycobacterium tuberculosis H37Rv
cggcgcgucggca

SEQ ID NO: 3337040 - RNA, 21 nt, Mycobacterium tuberculosis H37Rv
cggcgcgucggcaccgauccu

SEQ ID NO: 3337041 - RNA, 21 nt, Mycobacterium tuberculosis H37Rv
cggcgcguggcaccaccaagg

SEQ ID NO: 3337042 - RNA, 19 nt, Mycobacterium tuberculosis H37Rv
cggcgcguggugccuacac

SEQ ID NO: 3337043 - RNA, 16 nt, Mycobacterium tuberculosis H37Rv
cggcgcguucgucguc

SEQ ID NO: 3337044 - RNA, 15 nt, Mycobacterium tuberculosis H37Rv
cggcgcuagcgccgc

SEQ ID NO: 3337045 - RNA, 19 nt, Mycobacterium tuberculosis H37Rv
cggcgcuagcgccgcgcuu

SEQ ID NO: 3337046 - RNA, 17 nt, Mycobacterium tuberculosis H37Rv
cggcgcuaugaagucga

SEQ ID NO: 3337047 - RNA, 14 nt, Mycobacterium tuberculosis H37Rv
cggcgcuccaacgc

SEQ ID NO: 3337048 - RNA, 17 nt, Mycobacterium tuberculosis H37Rv
cggcgcuccacugacca

SEQ ID NO: 3337049 - RNA, 15 nt, Mycobacterium tuberculosis H37Rv
cggcgcuccccucgg

SEQ ID NO: 3337050 - RNA, 14 nt, Mycobacterium tuberculosis H37Rv
cggcgcuccgccag

SEQ ID NO: 3337051 - RNA, 16 nt, Mycobacterium tuberculosis H37Rv
cggcgcucgcggcggc

SEQ ID NO: 3337052 - RNA, 13 nt, Mycobacterium tuberculosis H37Rv
cggcgcucggcga

SEQ ID NO: 3337053 - RNA, 14 nt, Mycobacterium tuberculosis H37Rv
cggcgcucggcgag

SEQ ID NO: 3337054 - RNA, 18 nt, Mycobacterium tuberculosis H37Rv
cggcgcucuugcucacca

SEQ ID NO: 3337055 - RNA, 13 nt, Mycobacterium tuberculosis H37Rv
cggcgcugaucgc

SEQ ID NO: 3337056 - RNA, 15 nt, Mycobacterium tuberculosis H37Rv
cggcgcugaucgcga

SEQ ID NO: 3337057 - RNA, 18 nt, Mycobacterium tuberculosis H37Rv
cggcgcugaucgcgaagc

SEQ ID NO: 3337058 - RNA, 15 nt, Mycobacterium tuberculosis H37Rv
cggcgcugaucgcgc

SEQ ID NO: 3337059 - RNA, 21 nt, Mycobacterium tuberculosis H37Rv
cggcgcugcagcugcucgucg

SEQ ID NO: 3337060 - RNA, 21 nt, Mycobacterium tuberculosis H37Rv
cggcgcugcccgggcugccgc

SEQ ID NO: 3337061 - RNA, 20 nt, Mycobacterium tuberculosis H37Rv
cggcgcugcgcaccgccgcg

SEQ ID NO: 3337062 - RNA, 14 nt, Mycobacterium tuberculosis H37Rv
cggcgcugcugcca

SEQ ID NO: 3337063 - RNA, 20 nt, Mycobacterium tuberculosis H37Rv
cggcgcugcugccauugccg

SEQ ID NO: 3337064 - RNA, 15 nt, Mycobacterium tuberculosis H37Rv
cggcgcuggccagca

SEQ ID NO: 3337065 - RNA, 15 nt, Mycobacterium tuberculosis H37Rv
cggcgcuggccgucg

SEQ ID NO: 3337066 - RNA, 15 nt, Mycobacterium tuberculosis H37Rv
cggcgcuggcgggca

SEQ ID NO: 3337067 - RNA, 18 nt, Mycobacterium tuberculosis H37Rv
cggcgcugggacggucgc

SEQ ID NO: 3337068 - RNA, 19 nt, Mycobacterium tuberculosis H37Rv
cggcgcuggucgcgguggc

SEQ ID NO: 3337069 - RNA, 20 nt, Mycobacterium tuberculosis H37Rv
cggcggaagaccggaucgcc

SEQ ID NO: 3337070 - RNA, 19 nt, Mycobacterium tuberculosis H37Rv
cggcggaaggacggcagcc

SEQ ID NO: 3337071 - RNA, 15 nt, Mycobacterium tuberculosis H37Rv
cggcggaaggcgucg

SEQ ID NO: 3337072 - RNA, 16 nt, Mycobacterium tuberculosis H37Rv
cggcggaaggcgucga

SEQ ID NO: 3337073 - RNA, 15 nt, Mycobacterium tuberculosis H37Rv
cggcggacaccucgg

SEQ ID NO: 3337074 - RNA, 20 nt, Mycobacterium tuberculosis H37Rv
cggcggacaccucgggcgcc

SEQ ID NO: 3337075 - RNA, 13 nt, Mycobacterium tuberculosis H37Rv
cggcggacccgcu

SEQ ID NO: 3337076 - RNA, 18 nt, Mycobacterium tuberculosis H37Rv
cggcggacccgcucgcgg

SEQ ID NO: 3337077 - RNA, 12 nt, Mycobacterium tuberculosis H37Rv
cggcggaccgca

SEQ ID NO: 3337078 - RNA, 15 nt, Mycobacterium tuberculosis H37Rv
cggcggaccguccga

SEQ ID NO: 3337079 - RNA, 21 nt, Mycobacterium tuberculosis H37Rv
cggcggaccguccgacggcgg

SEQ ID NO: 3337080 - RNA, 23 nt, Mycobacterium tuberculosis H37Rv
cggcggacgcgggugccagaucg

SEQ ID NO: 3337081 - RNA, 14 nt, Mycobacterium tuberculosis H37Rv
cggcggacgugacc

SEQ ID NO: 3337082 - RNA, 19 nt, Mycobacterium tuberculosis H37Rv
cggcggacugagagauggu

SEQ ID NO: 3337083 - RNA, 22 nt, Mycobacterium tuberculosis H37Rv
cggcggacugagagauggucgg

SEQ ID NO: 3337084 - RNA, 24 nt, Mycobacterium tuberculosis H37Rv
cggcggacugagagauggucgggc

SEQ ID NO: 3337085 - RNA, 19 nt, Mycobacterium tuberculosis H37Rv
cggcggagacggcggccau

SEQ ID NO: 3337086 - RNA, 12 nt, Mycobacterium tuberculosis H37Rv
cggcggagucga

SEQ ID NO: 3337087 - RNA, 16 nt, Mycobacterium tuberculosis H37Rv
cggcggagucgacggu

SEQ ID NO: 3337088 - RNA, 12 nt, Mycobacterium tuberculosis H37Rv
cggcggagugca

SEQ ID NO: 3337089 - RNA, 18 nt, Mycobacterium tuberculosis H37Rv
cggcggaucccgaggcgc

SEQ ID NO: 3337090 - RNA, 20 nt, Mycobacterium tuberculosis H37Rv
cggcggaucccgaggcgccc

SEQ ID NO: 3337091 - RNA, 20 nt, Mycobacterium tuberculosis H37Rv
cggcggcaaagagcagccgg

SEQ ID NO: 3337092 - RNA, 22 nt, Mycobacterium tuberculosis H37Rv
cggcggcaaagagcagccggcc

SEQ ID NO: 3337093 - RNA, 23 nt, Mycobacterium tuberculosis H37Rv
cggcggcaaagagcagccggcca

SEQ ID NO: 3337094 - RNA, 22 nt, Mycobacterium tuberculosis H37Rv
cggcggcaaccccgagcggagc

SEQ ID NO: 3337095 - RNA, 17 nt, Mycobacterium tuberculosis H37Rv
cggcggcacccgggugg

SEQ ID NO: 3337096 - RNA, 21 nt, Mycobacterium tuberculosis H37Rv
cggcggcacccggguggcacg

SEQ ID NO: 3337097 - RNA, 18 nt, Mycobacterium tuberculosis H37Rv
cggcggcacgcucgcgca

SEQ ID NO: 3337098 - RNA, 16 nt, Mycobacterium tuberculosis H37Rv
cggcggcacgcugacc

SEQ ID NO: 3337099 - RNA, 22 nt, Mycobacterium tuberculosis H37Rv
cggcggcacuacgcagccguag

SEQ ID NO: 3337100 - RNA, 19 nt, Mycobacterium tuberculosis H37Rv
cggcggcagcauauccgcc

SEQ ID NO: 3337101 - RNA, 14 nt, Mycobacterium tuberculosis H37Rv
cggcggcagcgauc

SEQ ID NO: 3337102 - RNA, 15 nt, Mycobacterium tuberculosis H37Rv
cggcggcagcgaucg

SEQ ID NO: 3337103 - RNA, 15 nt, Mycobacterium tuberculosis H37Rv
cggcggcagcggcga

SEQ ID NO: 3337104 - RNA, 18 nt, Mycobacterium tuberculosis H37Rv
cggcggcagcggcgccgc

SEQ ID NO: 3337105 - RNA, 21 nt, Mycobacterium tuberculosis H37Rv
cggcggcagguagaucagcau

SEQ ID NO: 3337106 - RNA, 15 nt, Mycobacterium tuberculosis H37Rv
cggcggcagucgcgg

SEQ ID NO: 3337107 - RNA, 20 nt, Mycobacterium tuberculosis H37Rv
cggcggcauagugcgacugc

SEQ ID NO: 3337108 - RNA, 15 nt, Mycobacterium tuberculosis H37Rv
cggcggcaucgaguu

SEQ ID NO: 3337109 - RNA, 23 nt, Mycobacterium tuberculosis H37Rv
cggcggcaucgaguucggcccgc

SEQ ID NO: 3337110 - RNA, 20 nt, Mycobacterium tuberculosis H37Rv
cggcggcaugggucgugcag

SEQ ID NO: 3337111 - RNA, 20 nt, Mycobacterium tuberculosis H37Rv
cggcggcauguucaucgcag

SEQ ID NO: 3337112 - RNA, 18 nt, Mycobacterium tuberculosis H37Rv
cggcggccaacagcaccc

SEQ ID NO: 3337113 - RNA, 22 nt, Mycobacterium tuberculosis H37Rv
cggcggccaacagcacccgggc

SEQ ID NO: 3337114 - RNA, 20 nt, Mycobacterium tuberculosis H37Rv
cggcggccaaggucgaccca

SEQ ID NO: 3337115 - RNA, 15 nt, Mycobacterium tuberculosis H37Rv
cggcggccaccaugu

SEQ ID NO: 3337116 - RNA, 20 nt, Mycobacterium tuberculosis H37Rv
cggcggccaccucuucucgg

SEQ ID NO: 3337117 - RNA, 18 nt, Mycobacterium tuberculosis H37Rv
cggcggccaccugcuggc

SEQ ID NO: 3337118 - RNA, 13 nt, Mycobacterium tuberculosis H37Rv
cggcggccagcga

SEQ ID NO: 3337119 - RNA, 14 nt, Mycobacterium tuberculosis H37Rv
cggcggccagcgca

SEQ ID NO: 3337120 - RNA, 12 nt, Mycobacterium tuberculosis H37Rv
cggcggccagcu

SEQ ID NO: 3337121 - RNA, 17 nt, Mycobacterium tuberculosis H37Rv
cggcggccagcuccagc

SEQ ID NO: 3337122 - RNA, 22 nt, Mycobacterium tuberculosis H37Rv
cggcggccagcuccagcgccgc

SEQ ID NO: 3337123 - RNA, 18 nt, Mycobacterium tuberculosis H37Rv
cggcggccagcucggcca

SEQ ID NO: 3337124 - RNA, 12 nt, Mycobacterium tuberculosis H37Rv
cggcggccagga

SEQ ID NO: 3337125 - RNA, 22 nt, Mycobacterium tuberculosis H37Rv
cggcggccauguugcccugcaa

SEQ ID NO: 3337126 - RNA, 22 nt, Mycobacterium tuberculosis H37Rv
cggcggccauucggucagccag

SEQ ID NO: 3337127 - RNA, 18 nt, Mycobacterium tuberculosis H37Rv
cggcggcccacgcgcacu

SEQ ID NO: 3337128 - RNA, 16 nt, Mycobacterium tuberculosis H37Rv
cggcggcccaucgacc

SEQ ID NO: 3337129 - RNA, 13 nt, Mycobacterium tuberculosis H37Rv
cggcggccccagg

SEQ ID NO: 3337130 - RNA, 22 nt, Mycobacterium tuberculosis H37Rv
cggcggccccaggggcaccagc

SEQ ID NO: 3337131 - RNA, 13 nt, Mycobacterium tuberculosis H37Rv
cggcggccccggc

SEQ ID NO: 3337132 - RNA, 20 nt, Mycobacterium tuberculosis H37Rv
cggcggcccgauagaucgcg

SEQ ID NO: 3337133 - RNA, 17 nt, Mycobacterium tuberculosis H37Rv
cggcggcccgcagcccg

SEQ ID NO: 3337134 - RNA, 19 nt, Mycobacterium tuberculosis H37Rv
cggcggcccguuugccggu

SEQ ID NO: 3337135 - RNA, 13 nt, Mycobacterium tuberculosis H37Rv
cggcggccgagcg

SEQ ID NO: 3337136 - RNA, 18 nt, Mycobacterium tuberculosis H37Rv
cggcggccgcagcggcca

SEQ ID NO: 3337137 - RNA, 13 nt, Mycobacterium tuberculosis H37Rv
cggcggccgccau

SEQ ID NO: 3337138 - RNA, 12 nt, Mycobacterium tuberculosis H37Rv
cggcggccgccc

SEQ ID NO: 3337139 - RNA, 15 nt, Mycobacterium tuberculosis H37Rv
cggcggccgcccaga

SEQ ID NO: 3337140 - RNA, 16 nt, Mycobacterium tuberculosis H37Rv
cggcggccgcgauggc

SEQ ID NO: 3337141 - RNA, 14 nt, Mycobacterium tuberculosis H37Rv
cggcggccgcgugc

SEQ ID NO: 3337142 - RNA, 16 nt, Mycobacterium tuberculosis H37Rv
cggcggccgguagauc

SEQ ID NO: 3337143 - RNA, 15 nt, Mycobacterium tuberculosis H37Rv
cggcggccgucaccg

SEQ ID NO: 3337144 - RNA, 17 nt, Mycobacterium tuberculosis H37Rv
cggcggccgugucgggc

SEQ ID NO: 3337145 - RNA, 23 nt, Mycobacterium tuberculosis H37Rv
cggcggccuccaccacgucggga

SEQ ID NO: 3337146 - RNA, 16 nt, Mycobacterium tuberculosis H37Rv
cggcggccucgcugcu

SEQ ID NO: 3337147 - RNA, 21 nt, Mycobacterium tuberculosis H37Rv
cggcggccugagcgucgucgc

SEQ ID NO: 3337148 - RNA, 15 nt, Mycobacterium tuberculosis H37Rv
cggcggccugggcca

SEQ ID NO: 3337149 - RNA, 16 nt, Mycobacterium tuberculosis H37Rv
cggcggccugggccag

SEQ ID NO: 3337150 - RNA, 18 nt, Mycobacterium tuberculosis H37Rv
cggcggccugggccagcc

SEQ ID NO: 3337151 - RNA, 17 nt, Mycobacterium tuberculosis H37Rv
cggcggccuucggccgg

SEQ ID NO: 3337152 - RNA, 15 nt, Mycobacterium tuberculosis H37Rv
cggcggccuugcggg

SEQ ID NO: 3337153 - RNA, 16 nt, Mycobacterium tuberculosis H37Rv
cggcggccuugcgggc

SEQ ID NO: 3337154 - RNA, 14 nt, Mycobacterium tuberculosis H37Rv
cggcggcgacgugu

SEQ ID NO: 3337155 - RNA, 23 nt, Mycobacterium tuberculosis H37Rv
cggcggcgagaaucccgggccgu

SEQ ID NO: 3337156 - RNA, 13 nt, Mycobacterium tuberculosis H37Rv
cggcggcgauguc

SEQ ID NO: 3337157 - RNA, 18 nt, Mycobacterium tuberculosis H37Rv
cggcggcgaugucaacca

SEQ ID NO: 3337158 - RNA, 15 nt, Mycobacterium tuberculosis H37Rv
cggcggcgccccggu

SEQ ID NO: 3337159 - RNA, 14 nt, Mycobacterium tuberculosis H37Rv
cggcggcgccgccc

SEQ ID NO: 3337160 - RNA, 14 nt, Mycobacterium tuberculosis H37Rv
cggcggcgccguuc

SEQ ID NO: 3337161 - RNA, 12 nt, Mycobacterium tuberculosis H37Rv
cggcggcgcgcc

SEQ ID NO: 3337162 - RNA, 15 nt, Mycobacterium tuberculosis H37Rv
cggcggcgcucgucg

SEQ ID NO: 3337163 - RNA, 16 nt, Mycobacterium tuberculosis H37Rv
cggcggcgcucgucga

SEQ ID NO: 3337164 - RNA, 17 nt, Mycobacterium tuberculosis H37Rv
cggcggcgcuggcgggc

SEQ ID NO: 3337165 - RNA, 18 nt, Mycobacterium tuberculosis H37Rv
cggcggcgcuggcgggca

SEQ ID NO: 3337166 - RNA, 12 nt, Mycobacterium tuberculosis H37Rv
cggcggcggagg

SEQ ID NO: 3337167 - RNA, 10 nt, Mycobacterium tuberculosis H37Rv
cggcggcggc

SEQ ID NO: 3337168 - RNA, 13 nt, Mycobacterium tuberculosis H37Rv
cggcggcggccag

SEQ ID NO: 3337169 - RNA, 12 nt, Mycobacterium tuberculosis H37Rv
cggcggcggccg

SEQ ID NO: 3337170 - RNA, 14 nt, Mycobacterium tuberculosis H37Rv
cggcggcggcggca

SEQ ID NO: 3337171 - RNA, 15 nt, Mycobacterium tuberculosis H37Rv
cggcggcggcggccc

SEQ ID NO: 3337172 - RNA, 17 nt, Mycobacterium tuberculosis H37Rv
cggcggcggcgucggga

SEQ ID NO: 3337173 - RNA, 16 nt, Mycobacterium tuberculosis H37Rv
cggcggcggucugaga

SEQ ID NO: 3337174 - RNA, 16 nt, Mycobacterium tuberculosis H37Rv
cggcggcggugcgccc

SEQ ID NO: 3337175 - RNA, 19 nt, Mycobacterium tuberculosis H37Rv
cggcggcggugcgccccgc

SEQ ID NO: 3337176 - RNA, 15 nt, Mycobacterium tuberculosis H37Rv
cggcggcgucgaggg

SEQ ID NO: 3337177 - RNA, 14 nt, Mycobacterium tuberculosis H37Rv
cggcggcgucgcgg

SEQ ID NO: 3337178 - RNA, 15 nt, Mycobacterium tuberculosis H37Rv
cggcggcgucgcggu

SEQ ID NO: 3337179 - RNA, 14 nt, Mycobacterium tuberculosis H37Rv
cggcggcgucuuuc

SEQ ID NO: 3337180 - RNA, 16 nt, Mycobacterium tuberculosis H37Rv
cggcggcuacggcugc

SEQ ID NO: 3337181 - RNA, 15 nt, Mycobacterium tuberculosis H37Rv
cggcggcuaggcacc

SEQ ID NO: 3337182 - RNA, 24 nt, Mycobacterium tuberculosis H37Rv
cggcggcucccauggcgcgagcag

SEQ ID NO: 3337183 - RNA, 17 nt, Mycobacterium tuberculosis H37Rv
cggcggcugaaccgcug

SEQ ID NO: 3337184 - RNA, 14 nt, Mycobacterium tuberculosis H37Rv
cggcggcugcggcg

SEQ ID NO: 3337185 - RNA, 13 nt, Mycobacterium tuberculosis H37Rv
cggcggcuggucu

SEQ ID NO: 3337186 - RNA, 19 nt, Mycobacterium tuberculosis H37Rv
cggcggcugucggccgggu

SEQ ID NO: 3337187 - RNA, 16 nt, Mycobacterium tuberculosis H37Rv
cggcggcuucgauugc

SEQ ID NO: 3337188 - RNA, 22 nt, Mycobacterium tuberculosis H37Rv
cggcggcuucguggcggcgcgc

SEQ ID NO: 3337189 - RNA, 23 nt, Mycobacterium tuberculosis H37Rv
cggcggcuucguggcggcgcgcg

SEQ ID NO: 3337190 - RNA, 14 nt, Mycobacterium tuberculosis H37Rv
cggcggcuuggccg

SEQ ID NO: 3337191 - RNA, 18 nt, Mycobacterium tuberculosis H37Rv
cggcggcuuggccgcccc

SEQ ID NO: 3337192 - RNA, 21 nt, Mycobacterium tuberculosis H37Rv
cggcggcuuggccgccccggc

SEQ ID NO: 3337193 - RNA, 19 nt, Mycobacterium tuberculosis H37Rv
cggcggcuuuggccgccgu

SEQ ID NO: 3337194 - RNA, 22 nt, Mycobacterium tuberculosis H37Rv
cggcgggaacccuugccacgaa

SEQ ID NO: 3337195 - RNA, 14 nt, Mycobacterium tuberculosis H37Rv
cggcgggacgucgc

SEQ ID NO: 3337196 - RNA, 17 nt, Mycobacterium tuberculosis H37Rv
cggcgggaugcgcgccc

SEQ ID NO: 3337197 - RNA, 14 nt, Mycobacterium tuberculosis H37Rv
cggcgggcagaugg

SEQ ID NO: 3337198 - RNA, 17 nt, Mycobacterium tuberculosis H37Rv
cggcgggcagcgggccc

SEQ ID NO: 3337199 - RNA, 18 nt, Mycobacterium tuberculosis H37Rv
cggcgggccgcgcggcga

SEQ ID NO: 3337200 - RNA, 16 nt, Mycobacterium tuberculosis H37Rv
cggcgggccucggcga

SEQ ID NO: 3337201 - RNA, 15 nt, Mycobacterium tuberculosis H37Rv
cggcgggcgcgggcg

SEQ ID NO: 3337202 - RNA, 14 nt, Mycobacterium tuberculosis H37Rv
cggcgggcgcgggu

SEQ ID NO: 3337203 - RNA, 16 nt, Mycobacterium tuberculosis H37Rv
cggcgggcgcgggugg

SEQ ID NO: 3337204 - RNA, 23 nt, Mycobacterium tuberculosis H37Rv
cggcgggcgcggguggcgccagu

SEQ ID NO: 3337205 - RNA, 14 nt, Mycobacterium tuberculosis H37Rv
cggcgggcggcagc

SEQ ID NO: 3337206 - RNA, 16 nt, Mycobacterium tuberculosis H37Rv
cggcgggcggugggca

SEQ ID NO: 3337207 - RNA, 18 nt, Mycobacterium tuberculosis H37Rv
cggcgggcguaccuucga

SEQ ID NO: 3337208 - RNA, 14 nt, Mycobacterium tuberculosis H37Rv
cggcgggcucgccc

SEQ ID NO: 3337209 - RNA, 19 nt, Mycobacterium tuberculosis H37Rv
cggcggggacucugccacc

SEQ ID NO: 3337210 - RNA, 15 nt, Mycobacterium tuberculosis H37Rv
cggcggggaucgcug

SEQ ID NO: 3337211 - RNA, 15 nt, Mycobacterium tuberculosis H37Rv
cggcggggccggcgg

SEQ ID NO: 3337212 - RNA, 17 nt, Mycobacterium tuberculosis H37Rv
cggcggggccggcggcu

SEQ ID NO: 3337213 - RNA, 16 nt, Mycobacterium tuberculosis H37Rv
cggcgggggaccccgc

SEQ ID NO: 3337214 - RNA, 20 nt, Mycobacterium tuberculosis H37Rv
cggcgggggaccccgccagc

SEQ ID NO: 3337215 - RNA, 22 nt, Mycobacterium tuberculosis H37Rv
cggcggggguggaaucaggguc

SEQ ID NO: 3337216 - RNA, 21 nt, Mycobacterium tuberculosis H37Rv
cggcggggucgaacagcucga

SEQ ID NO: 3337217 - RNA, 15 nt, Mycobacterium tuberculosis H37Rv
cggcggggugcgccc

SEQ ID NO: 3337218 - RNA, 18 nt, Mycobacterium tuberculosis H37Rv
cggcggguagaaccagcc

SEQ ID NO: 3337219 - RNA, 20 nt, Mycobacterium tuberculosis H37Rv
cggcggguagaaccagcccg

SEQ ID NO: 3337220 - RNA, 18 nt, Mycobacterium tuberculosis H37Rv
cggcgucgaauaggccgc

SEQ ID NO: 3337221 - RNA, 20 nt, Mycobacterium tuberculosis H37Rv
cggcgucgacggcuccuccg

SEQ ID NO: 3337222 - RNA, 15 nt, Mycobacterium tuberculosis H37Rv
cggcgucgacgucgg

SEQ ID NO: 3337223 - RNA, 13 nt, Mycobacterium tuberculosis H37Rv
cggcgucgacugg

SEQ ID NO: 3337224 - RNA, 18 nt, Mycobacterium tuberculosis H37Rv
cggcgucgacuggccguu

SEQ ID NO: 3337225 - RNA, 15 nt, Mycobacterium tuberculosis H37Rv
cggcgucgagcaccu

SEQ ID NO: 3337226 - RNA, 19 nt, Mycobacterium tuberculosis H37Rv
cggcgucgagcucguccuc

SEQ ID NO: 3337227 - RNA, 16 nt, Mycobacterium tuberculosis H37Rv
cggcgucgaucaacaa

SEQ ID NO: 3337228 - RNA, 13 nt, Mycobacterium tuberculosis H37Rv
cggcgucgaugac

SEQ ID NO: 3337229 - RNA, 15 nt, Mycobacterium tuberculosis H37Rv
cggcgucgccgccau

SEQ ID NO: 3337230 - RNA, 19 nt, Mycobacterium tuberculosis H37Rv
cggcgucgccgccauugcc

SEQ ID NO: 3337231 - RNA, 20 nt, Mycobacterium tuberculosis H37Rv
cggcgucgccgccauugccg

SEQ ID NO: 3337232 - RNA, 13 nt, Mycobacterium tuberculosis H37Rv
cggcgucggccac

SEQ ID NO: 3337233 - RNA, 15 nt, Mycobacterium tuberculosis H37Rv
cggcgucggccaccg

SEQ ID NO: 3337234 - RNA, 18 nt, Mycobacterium tuberculosis H37Rv
cggcgucggccaccgccu

SEQ ID NO: 3337235 - RNA, 13 nt, Mycobacterium tuberculosis H37Rv
cggcgucggcgcc

SEQ ID NO: 3337236 - RNA, 17 nt, Mycobacterium tuberculosis H37Rv
cggcgucggcgcccagc

SEQ ID NO: 3337237 - RNA, 19 nt, Mycobacterium tuberculosis H37Rv
cggcgucgggaugcucgau

SEQ ID NO: 3337238 - RNA, 15 nt, Mycobacterium tuberculosis H37Rv
cggcgucggucgggu

SEQ ID NO: 3337239 - RNA, 18 nt, Mycobacterium tuberculosis H37Rv
cggcgucggucgucgggu

SEQ ID NO: 3337240 - RNA, 20 nt, Mycobacterium tuberculosis H37Rv
cggcgucggugagcgcgucg

SEQ ID NO: 3337241 - RNA, 21 nt, Mycobacterium tuberculosis H37Rv
cggcgucggugagcgcgucgc

SEQ ID NO: 3337242 - RNA, 15 nt, Mycobacterium tuberculosis H37Rv
cggcgucgucgaugg

SEQ ID NO: 3337243 - RNA, 22 nt, Mycobacterium tuberculosis H37Rv
cggcgucgucgauggcugcgcc

SEQ ID NO: 3337244 - RNA, 15 nt, Mycobacterium tuberculosis H37Rv
cggcgucgucgucga

SEQ ID NO: 3337245 - RNA, 20 nt, Mycobacterium tuberculosis H37Rv
cggcgucguucgagaccccg

SEQ ID NO: 3337246 - RNA, 22 nt, Mycobacterium tuberculosis H37Rv
cggcgucuagcccgccauccgc

SEQ ID NO: 3337247 - RNA, 16 nt, Mycobacterium tuberculosis H37Rv
cggcgucucgcagcaa

SEQ ID NO: 3337248 - RNA, 23 nt, Mycobacterium tuberculosis H37Rv
cggcgucucgcagcaacggcggc

SEQ ID NO: 3337249 - RNA, 16 nt, Mycobacterium tuberculosis H37Rv
cggcgucugcccgccc

SEQ ID NO: 3337250 - RNA, 19 nt, Mycobacterium tuberculosis H37Rv
cggcgucugcccgcccagc

SEQ ID NO: 3337251 - RNA, 14 nt, Mycobacterium tuberculosis H37Rv
cggcgucugcggug

SEQ ID NO: 3337252 - RNA, 11 nt, Mycobacterium tuberculosis H37Rv
cggcgucugua

SEQ ID NO: 3337253 - RNA, 22 nt, Mycobacterium tuberculosis H37Rv
cggcgucuuaccugaagccgcg

SEQ ID NO: 3337254 - RNA, 15 nt, Mycobacterium tuberculosis H37Rv
cggcgucuuccucgg

SEQ ID NO: 3337255 - RNA, 18 nt, Mycobacterium tuberculosis H37Rv
cggcgucuuccucggcca

SEQ ID NO: 3337256 - RNA, 20 nt, Mycobacterium tuberculosis H37Rv
cggcgucuuccucggccacc

SEQ ID NO: 3337257 - RNA, 21 nt, Mycobacterium tuberculosis H37Rv
cggcgucuuccucggccaccc

SEQ ID NO: 3337258 - RNA, 23 nt, Mycobacterium tuberculosis H37Rv
cggcgucuuccucggccacccgc

SEQ ID NO: 3337259 - RNA, 19 nt, Mycobacterium tuberculosis H37Rv
cggcgucuucgucggaguc

SEQ ID NO: 3337260 - RNA, 21 nt, Mycobacterium tuberculosis H37Rv
cggcgucuucgucggagucuu

SEQ ID NO: 3337261 - RNA, 16 nt, Mycobacterium tuberculosis H37Rv
cggcgugagcuccgca

SEQ ID NO: 3337262 - RNA, 15 nt, Mycobacterium tuberculosis H37Rv
cggcgugcagaaucc

SEQ ID NO: 3337263 - RNA, 20 nt, Mycobacterium tuberculosis H37Rv
cggcgugcagcagcuugacc

SEQ ID NO: 3337264 - RNA, 23 nt, Mycobacterium tuberculosis H37Rv
cggcgugcagcagcuugacccac

SEQ ID NO: 3337265 - RNA, 16 nt, Mycobacterium tuberculosis H37Rv
cggcgugcggacugac

SEQ ID NO: 3337266 - RNA, 20 nt, Mycobacterium tuberculosis H37Rv
cggcgugcuugcccagguug

SEQ ID NO: 3337267 - RNA, 22 nt, Mycobacterium tuberculosis H37Rv
cggcguggaucaguuugccauc

SEQ ID NO: 3337268 - RNA, 18 nt, Mycobacterium tuberculosis H37Rv
cggcguggaugcccgguu

SEQ ID NO: 3337269 - RNA, 23 nt, Mycobacterium tuberculosis H37Rv
cggcguggcaguacaccggcgug

SEQ ID NO: 3337270 - RNA, 17 nt, Mycobacterium tuberculosis H37Rv
cggcguggccccaccga

SEQ ID NO: 3337271 - RNA, 22 nt, Mycobacterium tuberculosis H37Rv
cggcguggcuucacccaacccc

SEQ ID NO: 3337272 - RNA, 18 nt, Mycobacterium tuberculosis H37Rv
cggcgugggagguggcgc

SEQ ID NO: 3337273 - RNA, 14 nt, Mycobacterium tuberculosis H37Rv
cggcgugggcaccu

SEQ ID NO: 3337274 - RNA, 17 nt, Mycobacterium tuberculosis H37Rv
cggcguggucgcgcggc

SEQ ID NO: 3337275 - RNA, 21 nt, Mycobacterium tuberculosis H37Rv
cggcguggucgcgcggcaccg

SEQ ID NO: 3337276 - RNA, 22 nt, Mycobacterium tuberculosis H37Rv
cggcguggucgcgcggcaccga

SEQ ID NO: 3337277 - RNA, 17 nt, Mycobacterium tuberculosis H37Rv
cggcguggucggcggug

SEQ ID NO: 3337278 - RNA, 15 nt, Mycobacterium tuberculosis H37Rv
cggcgugguguccac

SEQ ID NO: 3337279 - RNA, 17 nt, Mycobacterium tuberculosis H37Rv
cggcgugguguccaccg

SEQ ID NO: 3337280 - RNA, 15 nt, Mycobacterium tuberculosis H37Rv
cggcguguacgucga

SEQ ID NO: 3337281 - RNA, 16 nt, Mycobacterium tuberculosis H37Rv
cggcgugucacgucgc

SEQ ID NO: 3337282 - RNA, 13 nt, Mycobacterium tuberculosis H37Rv
cggcguguccgcc

SEQ ID NO: 3337283 - RNA, 15 nt, Mycobacterium tuberculosis H37Rv
cggcguguccgccga

SEQ ID NO: 3337284 - RNA, 14 nt, Mycobacterium tuberculosis H37Rv
cggcgugucgaggg

SEQ ID NO: 3337285 - RNA, 19 nt, Mycobacterium tuberculosis H37Rv
cggcgugucgccgccacca

SEQ ID NO: 3337286 - RNA, 16 nt, Mycobacterium tuberculosis H37Rv
cggcgugucgguguac

SEQ ID NO: 3337287 - RNA, 19 nt, Mycobacterium tuberculosis H37Rv
cggcgugucguugccaggg

SEQ ID NO: 3337288 - RNA, 16 nt, Mycobacterium tuberculosis H37Rv
cggcgugucucgucgc

SEQ ID NO: 3337289 - RNA, 19 nt, Mycobacterium tuberculosis H37Rv
cggcgugucucgucgcccc

SEQ ID NO: 3337290 - RNA, 16 nt, Mycobacterium tuberculosis H37Rv
cggcgugucugcccga

SEQ ID NO: 3337291 - RNA, 20 nt, Mycobacterium tuberculosis H37Rv
cggcgugucugcccgagguc

SEQ ID NO: 3337292 - RNA, 22 nt, Mycobacterium tuberculosis H37Rv
cggcguuaagguacccggucgg

SEQ ID NO: 3337293 - RNA, 20 nt, Mycobacterium tuberculosis H37Rv
cggcguuaccaccgucaccg

SEQ ID NO: 3337294 - RNA, 15 nt, Mycobacterium tuberculosis H37Rv
cggcguuaccgaccu

SEQ ID NO: 3337295 - RNA, 17 nt, Mycobacterium tuberculosis H37Rv
cggcguuacguggugga

SEQ ID NO: 3337296 - RNA, 20 nt, Mycobacterium tuberculosis H37Rv
cggcguucaccugcgucggc

SEQ ID NO: 3337297 - RNA, 16 nt, Mycobacterium tuberculosis H37Rv
cggcguuccaacucgg

SEQ ID NO: 3337298 - RNA, 20 nt, Mycobacterium tuberculosis H37Rv
cggcguucccgccauugccg

SEQ ID NO: 3337299 - RNA, 14 nt, Mycobacterium tuberculosis H37Rv
cggcguucgaugcc

SEQ ID NO: 3337300 - RNA, 20 nt, Mycobacterium tuberculosis H37Rv
cggcguugauccgcacccca

SEQ ID NO: 3337301 - RNA, 13 nt, Mycobacterium tuberculosis H37Rv
cggcguugaucga

SEQ ID NO: 3337302 - RNA, 18 nt, Mycobacterium tuberculosis H37Rv
cggcguugccgaaacccg

SEQ ID NO: 3337303 - RNA, 23 nt, Mycobacterium tuberculosis H37Rv
cggcguugccggagaaguucgug

SEQ ID NO: 3337304 - RNA, 23 nt, Mycobacterium tuberculosis H37Rv
cggcguuggaaaagucgggcacu

SEQ ID NO: 3337305 - RNA, 15 nt, Mycobacterium tuberculosis H37Rv
cggcguuggcgccgu

SEQ ID NO: 3337306 - RNA, 21 nt, Mycobacterium tuberculosis H37Rv
cggcguuguaguugcccacgu

SEQ ID NO: 3337307 - RNA, 18 nt, Mycobacterium tuberculosis H37Rv
cggcguugugaccgccga

SEQ ID NO: 3337308 - RNA, 17 nt, Mycobacterium tuberculosis H37Rv
cggcguuguugaccagc

SEQ ID NO: 3337309 - RNA, 23 nt, Mycobacterium tuberculosis H37Rv
cggcguuuagggcgauuuccauc

SEQ ID NO: 3337310 - RNA, 18 nt, Mycobacterium tuberculosis H37Rv
cggcguuugagaacaacg

SEQ ID NO: 3337311 - RNA, 16 nt, Mycobacterium tuberculosis H37Rv
cggcguuuucggugag

SEQ ID NO: 3337312 - RNA, 21 nt, Mycobacterium tuberculosis H37Rv
cggcuacaucggcggcgucga

SEQ ID NO: 3337313 - RNA, 19 nt, Mycobacterium tuberculosis H37Rv
cggcuaccccgcagaaucc

SEQ ID NO: 3337314 - RNA, 17 nt, Mycobacterium tuberculosis H37Rv
cggcuaccgccgaccgg

SEQ ID NO: 3337315 - RNA, 14 nt, Mycobacterium tuberculosis H37Rv
cggcuaccgcgcuc

SEQ ID NO: 3337316 - RNA, 21 nt, Mycobacterium tuberculosis H37Rv
cggcugccgcaaacgcggcgu

SEQ ID NO: 3337317 - RNA, 14 nt, Mycobacterium tuberculosis H37Rv
cggcugccgcacca

SEQ ID NO: 3337318 - RNA, 17 nt, Mycobacterium tuberculosis H37Rv
cggcugccgcaccaagg

SEQ ID NO: 3337319 - RNA, 15 nt, Mycobacterium tuberculosis H37Rv
cggcugccgcgcgcu

SEQ ID NO: 3337320 - RNA, 14 nt, Mycobacterium tuberculosis H37Rv
cggcugccgcggcu

SEQ ID NO: 3337321 - RNA, 18 nt, Mycobacterium tuberculosis H37Rv
cggcugccgcggcugcca

SEQ ID NO: 3337322 - RNA, 14 nt, Mycobacterium tuberculosis H37Rv
cggcugccgcggug

SEQ ID NO: 3337323 - RNA, 16 nt, Mycobacterium tuberculosis H37Rv
cggcugccgcucgacc

SEQ ID NO: 3337324 - RNA, 15 nt, Mycobacterium tuberculosis H37Rv
cggcugccuccauga

SEQ ID NO: 3337325 - RNA, 21 nt, Mycobacterium tuberculosis H37Rv
cggcugccucccuuccgcgcu

SEQ ID NO: 3337326 - RNA, 19 nt, Mycobacterium tuberculosis H37Rv
cggcugcgaaagccacucg

SEQ ID NO: 3337327 - RNA, 13 nt, Mycobacterium tuberculosis H37Rv
cggcugcgccggg

SEQ ID NO: 3337328 - RNA, 17 nt, Mycobacterium tuberculosis H37Rv
cggcugcgcgcucggcc

SEQ ID NO: 3337329 - RNA, 18 nt, Mycobacterium tuberculosis H37Rv
cggcugcgcgcucggcca

SEQ ID NO: 3337330 - RNA, 22 nt, Mycobacterium tuberculosis H37Rv
cggcugcggcgucguugaggaa

SEQ ID NO: 3337331 - RNA, 13 nt, Mycobacterium tuberculosis H37Rv
cggcugcgggccc

SEQ ID NO: 3337332 - RNA, 14 nt, Mycobacterium tuberculosis H37Rv
cggcugcggggcga

SEQ ID NO: 3337333 - RNA, 11 nt, Mycobacterium tuberculosis H37Rv
cggcugcggua

SEQ ID NO: 3337334 - RNA, 22 nt, Mycobacterium tuberculosis H37Rv
cggcugcgguaaucgccaccgc

SEQ ID NO: 3337335 - RNA, 17 nt, Mycobacterium tuberculosis H37Rv
cggcugcgucgucugca

SEQ ID NO: 3337336 - RNA, 16 nt, Mycobacterium tuberculosis H37Rv
cggcugcguuggcugg

SEQ ID NO: 3337337 - RNA, 17 nt, Mycobacterium tuberculosis H37Rv
cggcugcguuggcuggu

SEQ ID NO: 3337338 - RNA, 23 nt, Mycobacterium tuberculosis H37Rv
cggcugcguuguguuccguugcg

SEQ ID NO: 3337339 - RNA, 16 nt, Mycobacterium tuberculosis H37Rv
cggcugcucgacggcu

SEQ ID NO: 3337340 - RNA, 20 nt, Mycobacterium tuberculosis H37Rv
cggcugcucgacggcuccga

SEQ ID NO: 3337341 - RNA, 17 nt, Mycobacterium tuberculosis H37Rv
cggcugcugcgcggugc

SEQ ID NO: 3337342 - RNA, 16 nt, Mycobacterium tuberculosis H37Rv
cggcugcuuggucgcc

SEQ ID NO: 3337343 - RNA, 19 nt, Mycobacterium tuberculosis H37Rv
cggcugcuuggucgcccag

SEQ ID NO: 3337344 - RNA, 20 nt, Mycobacterium tuberculosis H37Rv
cggcugcuuggucgcccagc

SEQ ID NO: 3337345 - RNA, 18 nt, Mycobacterium tuberculosis H37Rv
cggcuggacggcgccggu

SEQ ID NO: 3337346 - RNA, 21 nt, Mycobacterium tuberculosis H37Rv
cggcuggccagguggccgcau

SEQ ID NO: 3337347 - RNA, 14 nt, Mycobacterium tuberculosis H37Rv
cggcuggcccgcau

SEQ ID NO: 3337348 - RNA, 19 nt, Mycobacterium tuberculosis H37Rv
cggcuggccgcgccucggu

SEQ ID NO: 3337349 - RNA, 21 nt, Mycobacterium tuberculosis H37Rv
cggcuggccgcgccucggucu

SEQ ID NO: 3337350 - RNA, 13 nt, Mycobacterium tuberculosis H37Rv
cggcuggcggccu

SEQ ID NO: 3337351 - RNA, 15 nt, Mycobacterium tuberculosis H37Rv
cggcuggcgucgaug

SEQ ID NO: 3337352 - RNA, 17 nt, Mycobacterium tuberculosis H37Rv
cggcugggcgaagccca

SEQ ID NO: 3337353 - RNA, 16 nt, Mycobacterium tuberculosis H37Rv
cggcugggcgccacca

SEQ ID NO: 3337354 - RNA, 15 nt, Mycobacterium tuberculosis H37Rv
cggcugggcggucgg

SEQ ID NO: 3337355 - RNA, 18 nt, Mycobacterium tuberculosis H37Rv
cggcugguagcugcggua

SEQ ID NO: 3337356 - RNA, 15 nt, Mycobacterium tuberculosis H37Rv
cggcuggucacccgu

SEQ ID NO: 3337357 - RNA, 15 nt, Mycobacterium tuberculosis H37Rv
cggcuggugucgggc

SEQ ID NO: 3337358 - RNA, 17 nt, Mycobacterium tuberculosis H37Rv
cggcugguuacucacca

SEQ ID NO: 3337359 - RNA, 11 nt, Mycobacterium tuberculosis H37Rv
cggcugguugc

SEQ ID NO: 3337360 - RNA, 21 nt, Mycobacterium tuberculosis H37Rv
cggcugguugcgccacugcgu

SEQ ID NO: 3337361 - RNA, 20 nt, Mycobacterium tuberculosis H37Rv
cggcugucacgccugccacc

SEQ ID NO: 3337362 - RNA, 14 nt, Mycobacterium tuberculosis H37Rv
cggcugugcccgau

SEQ ID NO: 3337363 - RNA, 22 nt, Mycobacterium tuberculosis H37Rv
cggcugugcccgaucagccgug

SEQ ID NO: 3337364 - RNA, 20 nt, Mycobacterium tuberculosis H37Rv
cggcuguggucgcugcugcc

SEQ ID NO: 3337365 - RNA, 21 nt, Mycobacterium tuberculosis H37Rv
cggcuguuaggcgauaucgca

SEQ ID NO: 3337366 - RNA, 18 nt, Mycobacterium tuberculosis H37Rv
cggcuguugcggcggcgc

SEQ ID NO: 3337367 - RNA, 19 nt, Mycobacterium tuberculosis H37Rv
cggcuguugcggcggcgcu

SEQ ID NO: 3337368 - RNA, 16 nt, Mycobacterium tuberculosis H37Rv
cggcuguugcguucgg

SEQ ID NO: 3337369 - RNA, 14 nt, Mycobacterium tuberculosis H37Rv
cggcuuccuccucg

SEQ ID NO: 3337370 - RNA, 15 nt, Mycobacterium tuberculosis H37Rv
cggcuuccuccucgg

SEQ ID NO: 3337371 - RNA, 20 nt, Mycobacterium tuberculosis H37Rv
cggcuuccuccucggcgcga

SEQ ID NO: 3337372 - RNA, 15 nt, Mycobacterium tuberculosis H37Rv
cggcuucgacgucgg

SEQ ID NO: 3337373 - RNA, 15 nt, Mycobacterium tuberculosis H37Rv
cggcuucggcaacca

SEQ ID NO: 3337374 - RNA, 13 nt, Mycobacterium tuberculosis H37Rv
cggcuucggcaga

SEQ ID NO: 3337375 - RNA, 21 nt, Mycobacterium tuberculosis H37Rv
cggcuucggcagaccggcauc

SEQ ID NO: 3337376 - RNA, 12 nt, Mycobacterium tuberculosis H37Rv
cggcuucggcga

SEQ ID NO: 3337377 - RNA, 16 nt, Mycobacterium tuberculosis H37Rv
cggcuucggguguucg

SEQ ID NO: 3337378 - RNA, 15 nt, Mycobacterium tuberculosis H37Rv
cggcuucguccaccg

SEQ ID NO: 3337379 - RNA, 22 nt, Mycobacterium tuberculosis H37Rv
cggcuucgucgacaucgccaua

SEQ ID NO: 3337380 - RNA, 18 nt, Mycobacterium tuberculosis H37Rv
cggcuucgucggccagca

SEQ ID NO: 3337381 - RNA, 21 nt, Mycobacterium tuberculosis H37Rv
cggcuucgucggccagcagca

SEQ ID NO: 3337382 - RNA, 18 nt, Mycobacterium tuberculosis H37Rv
cggcuucuugaccacgaa

SEQ ID NO: 3337383 - RNA, 23 nt, Mycobacterium tuberculosis H37Rv
cggcuugcagugaggucaucguc

SEQ ID NO: 3337384 - RNA, 17 nt, Mycobacterium tuberculosis H37Rv
cggcuugcccuccgggu

SEQ ID NO: 3337385 - RNA, 19 nt, Mycobacterium tuberculosis H37Rv
cggcuugcgguggcggauc

SEQ ID NO: 3337386 - RNA, 13 nt, Mycobacterium tuberculosis H37Rv
cggcuugcugccc

SEQ ID NO: 3337387 - RNA, 15 nt, Mycobacterium tuberculosis H37Rv
cggcuuggccggcgg

SEQ ID NO: 3337388 - RNA, 18 nt, Mycobacterium tuberculosis H37Rv
cggcuuggccuagccgcg

SEQ ID NO: 3337389 - RNA, 19 nt, Mycobacterium tuberculosis H37Rv
cggcuuggccuagccgcgg

SEQ ID NO: 3337390 - RNA, 23 nt, Mycobacterium tuberculosis H37Rv
cggcuuggccuagccgcggcacc

SEQ ID NO: 3337391 - RNA, 19 nt, Mycobacterium tuberculosis H37Rv
cggcuuggccuuugccguc

SEQ ID NO: 3337392 - RNA, 24 nt, Mycobacterium tuberculosis H37Rv
cggcuuggcggcgaucaacucggg

SEQ ID NO: 3337393 - RNA, 16 nt, Mycobacterium tuberculosis H37Rv
cggcuuggcugccucc

SEQ ID NO: 3337394 - RNA, 19 nt, Mycobacterium tuberculosis H37Rv
cggcuugggaaacccggcc

SEQ ID NO: 3337395 - RNA, 13 nt, Mycobacterium tuberculosis H37Rv
cggcuugggccag

SEQ ID NO: 3337396 - RNA, 18 nt, Mycobacterium tuberculosis H37Rv
cggcuugggccaggccca

SEQ ID NO: 3337397 - RNA, 21 nt, Mycobacterium tuberculosis H37Rv
cggcuugggccaggcccagcu

SEQ ID NO: 3337398 - RNA, 14 nt, Mycobacterium tuberculosis H37Rv
cggcuugucgacca

SEQ ID NO: 3337399 - RNA, 15 nt, Mycobacterium tuberculosis H37Rv
cggcuugucgcggug

SEQ ID NO: 3337400 - RNA, 21 nt, Mycobacterium tuberculosis H37Rv
cggcuuugacgcccggcaccc

SEQ ID NO: 3337401 - RNA, 15 nt, Mycobacterium tuberculosis H37Rv
cggcuuugagccgcu

SEQ ID NO: 3337402 - RNA, 16 nt, Mycobacterium tuberculosis H37Rv
cggcuuugagccgcuc

SEQ ID NO: 3337403 - RNA, 17 nt, Mycobacterium tuberculosis H37Rv
cggcuuugagccgcucg

SEQ ID NO: 3337404 - RNA, 18 nt, Mycobacterium tuberculosis H37Rv
cggcuuugagccgcucga

SEQ ID NO: 3337405 - RNA, 14 nt, Mycobacterium tuberculosis H37Rv
cggcuuugcuugcc

SEQ ID NO: 3337406 - RNA, 11 nt, Mycobacterium tuberculosis H37Rv
cggcuuuugcg

SEQ ID NO: 3337407 - RNA, 13 nt, Mycobacterium tuberculosis H37Rv
cgggaaacaccgg

SEQ ID NO: 3337408 - RNA, 23 nt, Mycobacterium tuberculosis H37Rv
cgggaaacacguucucaccacca

SEQ ID NO: 3337409 - RNA, 22 nt, Mycobacterium tuberculosis H37Rv
cgggaacgggcaaaccauugcg

SEQ ID NO: 3337410 - RNA, 22 nt, Mycobacterium tuberculosis H37Rv
cgggaacuucgccgaagcgccg

SEQ ID NO: 3337411 - RNA, 13 nt, Mycobacterium tuberculosis H37Rv
cgggaagccgcau

SEQ ID NO: 3337412 - RNA, 15 nt, Mycobacterium tuberculosis H37Rv
cgggcaacgcagcac

SEQ ID NO: 3337413 - RNA, 14 nt, Mycobacterium tuberculosis H37Rv
cgggcaacggcagc

SEQ ID NO: 3337414 - RNA, 15 nt, Mycobacterium tuberculosis H37Rv
cgggcaacggcagcc

SEQ ID NO: 3337415 - RNA, 22 nt, Mycobacterium tuberculosis H37Rv
cgggcaacggcggggccggcgg

SEQ ID NO: 3337416 - RNA, 16 nt, Mycobacterium tuberculosis H37Rv
cgggcaacucggugac

SEQ ID NO: 3337417 - RNA, 19 nt, Mycobacterium tuberculosis H37Rv
cgggcaagccggacagauc

SEQ ID NO: 3337418 - RNA, 15 nt, Mycobacterium tuberculosis H37Rv
cgggcaaggccaccg

SEQ ID NO: 3337419 - RNA, 16 nt, Mycobacterium tuberculosis H37Rv
cgggcaaggcccgguc

SEQ ID NO: 3337420 - RNA, 16 nt, Mycobacterium tuberculosis H37Rv
cgggcaagucgcccag

SEQ ID NO: 3337421 - RNA, 17 nt, Mycobacterium tuberculosis H37Rv
cgggcaagucgcccagc

SEQ ID NO: 3337422 - RNA, 20 nt, Mycobacterium tuberculosis H37Rv
cgggcacaccgacgccgcca

SEQ ID NO: 3337423 - RNA, 15 nt, Mycobacterium tuberculosis H37Rv
cgggcacaccgcacc

SEQ ID NO: 3337424 - RNA, 16 nt, Mycobacterium tuberculosis H37Rv
cgggcacaccgcaccu

SEQ ID NO: 3337425 - RNA, 17 nt, Mycobacterium tuberculosis H37Rv
cgggcaccaaccugagc

SEQ ID NO: 3337426 - RNA, 21 nt, Mycobacterium tuberculosis H37Rv
cgggcaccaauaccgcacccg

SEQ ID NO: 3337427 - RNA, 19 nt, Mycobacterium tuberculosis H37Rv
cgggcacccgagccgcaca

SEQ ID NO: 3337428 - RNA, 15 nt, Mycobacterium tuberculosis H37Rv
cgggcaccgcgcgcu

SEQ ID NO: 3337429 - RNA, 18 nt, Mycobacterium tuberculosis H37Rv
cgggcaccgcgcgcucca

SEQ ID NO: 3337430 - RNA, 12 nt, Mycobacterium tuberculosis H37Rv
cgggcaccgguu

SEQ ID NO: 3337431 - RNA, 20 nt, Mycobacterium tuberculosis H37Rv
cgggcaccgucggaacugac

SEQ ID NO: 3337432 - RNA, 22 nt, Mycobacterium tuberculosis H37Rv
cgggcaccgucggaacugacca

SEQ ID NO: 3337433 - RNA, 14 nt, Mycobacterium tuberculosis H37Rv
cgggcaccuggucg

SEQ ID NO: 3337434 - RNA, 23 nt, Mycobacterium tuberculosis H37Rv
cgggcacgcccucgucgaucgcc

SEQ ID NO: 3337435 - RNA, 17 nt, Mycobacterium tuberculosis H37Rv
cgggcacgccgccgacg

SEQ ID NO: 3337436 - RNA, 14 nt, Mycobacterium tuberculosis H37Rv
cgggcacgcgaggc

SEQ ID NO: 3337437 - RNA, 20 nt, Mycobacterium tuberculosis H37Rv
cgggcacgcgaggcgcucac

SEQ ID NO: 3337438 - RNA, 14 nt, Mycobacterium tuberculosis H37Rv
cgggcacgcggcga

SEQ ID NO: 3337439 - RNA, 13 nt, Mycobacterium tuberculosis H37Rv
cgggcacggguga

SEQ ID NO: 3337440 - RNA, 17 nt, Mycobacterium tuberculosis H37Rv
cgggcacugugagguca

SEQ ID NO: 3337441 - RNA, 13 nt, Mycobacterium tuberculosis H37Rv
cgggcacugugau

SEQ ID NO: 3337442 - RNA, 23 nt, Mycobacterium tuberculosis H37Rv
cgggcagauacgccaaccgcuuc

SEQ ID NO: 3337443 - RNA, 16 nt, Mycobacterium tuberculosis H37Rv
cgggcagauucuucac

SEQ ID NO: 3337444 - RNA, 11 nt, Mycobacterium tuberculosis H37Rv
cgggcagcacc

SEQ ID NO: 3337445 - RNA, 14 nt, Mycobacterium tuberculosis H37Rv
cgggcagcaccagc

SEQ ID NO: 3337446 - RNA, 20 nt, Mycobacterium tuberculosis H37Rv
cgggcagcaccagcgccuug

SEQ ID NO: 3337447 - RNA, 11 nt, Mycobacterium tuberculosis H37Rv
cgggcagcacu

SEQ ID NO: 3337448 - RNA, 13 nt, Mycobacterium tuberculosis H37Rv
cgggcagccccuc

SEQ ID NO: 3337449 - RNA, 15 nt, Mycobacterium tuberculosis H37Rv
cgggcagccgcccgc

SEQ ID NO: 3337450 - RNA, 12 nt, Mycobacterium tuberculosis H37Rv
cgggcagccugc

SEQ ID NO: 3337451 - RNA, 17 nt, Mycobacterium tuberculosis H37Rv
cgggcagccugcugcau

SEQ ID NO: 3337452 - RNA, 11 nt, Mycobacterium tuberculosis H37Rv
cgggcagcgcg

SEQ ID NO: 3337453 - RNA, 18 nt, Mycobacterium tuberculosis H37Rv
cgggcagcgcggccagug

SEQ ID NO: 3337454 - RNA, 21 nt, Mycobacterium tuberculosis H37Rv
cgggcagcugguaggucaccg

SEQ ID NO: 3337455 - RNA, 22 nt, Mycobacterium tuberculosis H37Rv
cgggcagcuguucggccaaccc

SEQ ID NO: 3337456 - RNA, 17 nt, Mycobacterium tuberculosis H37Rv
cgggcaggccgcugggc

SEQ ID NO: 3337457 - RNA, 18 nt, Mycobacterium tuberculosis H37Rv
cgggcagggaccgcaucg

SEQ ID NO: 3337458 - RNA, 20 nt, Mycobacterium tuberculosis H37Rv
cgggcagguaggucugggca

SEQ ID NO: 3337459 - RNA, 15 nt, Mycobacterium tuberculosis H37Rv
cgggcagugugguca

SEQ ID NO: 3337460 - RNA, 15 nt, Mycobacterium tuberculosis H37Rv
cgggcaguucacggu

SEQ ID NO: 3337461 - RNA, 18 nt, Mycobacterium tuberculosis H37Rv
cgggcaguucacgguuga

SEQ ID NO: 3337462 - RNA, 15 nt, Mycobacterium tuberculosis H37Rv
cgggcaguugaccca

SEQ ID NO: 3337463 - RNA, 16 nt, Mycobacterium tuberculosis H37Rv
cgggcaguuugcgggc

SEQ ID NO: 3337464 - RNA, 20 nt, Mycobacterium tuberculosis H37Rv
cgggcauaacccgcaccggg

SEQ ID NO: 3337465 - RNA, 14 nt, Mycobacterium tuberculosis H37Rv
cgggcauaggcgcu

SEQ ID NO: 3337466 - RNA, 16 nt, Mycobacterium tuberculosis H37Rv
cgggcauccuucacca

SEQ ID NO: 3337467 - RNA, 20 nt, Mycobacterium tuberculosis H37Rv
cgggcaugauccccguugac

SEQ ID NO: 3337468 - RNA, 20 nt, Mycobacterium tuberculosis H37Rv
cgggcaugcgccguagccga

SEQ ID NO: 3337469 - RNA, 19 nt, Mycobacterium tuberculosis H37Rv
cgggcaugcucuggcaaug

SEQ ID NO: 3337470 - RNA, 19 nt, Mycobacterium tuberculosis H37Rv
cgggcauggucgccggaga

SEQ ID NO: 3337471 - RNA, 22 nt, Mycobacterium tuberculosis H37Rv
cgggcauuucguggcacggguc

SEQ ID NO: 3337472 - RNA, 14 nt, Mycobacterium tuberculosis H37Rv
cgggccaaagccgu

SEQ ID NO: 3337473 - RNA, 16 nt, Mycobacterium tuberculosis H37Rv
cgggccaaagccguca

SEQ ID NO: 3337474 - RNA, 18 nt, Mycobacterium tuberculosis H37Rv
cgggccaagacggcgggc

SEQ ID NO: 3337475 - RNA, 16 nt, Mycobacterium tuberculosis H37Rv
cgggccaaugccguug

SEQ ID NO: 3337476 - RNA, 16 nt, Mycobacterium tuberculosis H37Rv
cgggccaccaccgagu

SEQ ID NO: 3337477 - RNA, 18 nt, Mycobacterium tuberculosis H37Rv
cgggccaccacgcgccgc

SEQ ID NO: 3337478 - RNA, 13 nt, Mycobacterium tuberculosis H37Rv
cgggccacgucga

SEQ ID NO: 3337479 - RNA, 20 nt, Mycobacterium tuberculosis H37Rv
cgggccacgucgagcacccg

SEQ ID NO: 3337480 - RNA, 17 nt, Mycobacterium tuberculosis H37Rv
cgggccagcacccgcuc

SEQ ID NO: 3337481 - RNA, 12 nt, Mycobacterium tuberculosis H37Rv
cgggccagcgau

SEQ ID NO: 3337482 - RNA, 16 nt, Mycobacterium tuberculosis H37Rv
cgggccaggauccgac

SEQ ID NO: 3337483 - RNA, 22 nt, Mycobacterium tuberculosis H37Rv
cgggccaggccgaugccgaccu

SEQ ID NO: 3337484 - RNA, 16 nt, Mycobacterium tuberculosis H37Rv
cgggccaucaagcgau

SEQ ID NO: 3337485 - RNA, 23 nt, Mycobacterium tuberculosis H37Rv
cgggccaucgcauccccagcaca

SEQ ID NO: 3337486 - RNA, 20 nt, Mycobacterium tuberculosis H37Rv
cgggccauggguagccgccc

SEQ ID NO: 3337487 - RNA, 22 nt, Mycobacterium tuberculosis H37Rv
cgggccauggguagccgcccag

SEQ ID NO: 3337488 - RNA, 23 nt, Mycobacterium tuberculosis H37Rv
cgggccauggguagccgcccagc

SEQ ID NO: 3337489 - RNA, 19 nt, Mycobacterium tuberculosis H37Rv
cgggccauucaccgcgcac

SEQ ID NO: 3337490 - RNA, 22 nt, Mycobacterium tuberculosis H37Rv
cgggccauucaccgcgcacgac

SEQ ID NO: 3337491 - RNA, 18 nt, Mycobacterium tuberculosis H37Rv
cgggcccacguuggcccc

SEQ ID NO: 3337492 - RNA, 20 nt, Mycobacterium tuberculosis H37Rv
cgggcccacuugugacccgg

SEQ ID NO: 3337493 - RNA, 21 nt, Mycobacterium tuberculosis H37Rv
cgggcccacuugugacccggc

SEQ ID NO: 3337494 - RNA, 14 nt, Mycobacterium tuberculosis H37Rv
cgggcccagcagcg

SEQ ID NO: 3337495 - RNA, 20 nt, Mycobacterium tuberculosis H37Rv
cgggcccagcaggucgucgg

SEQ ID NO: 3337496 - RNA, 13 nt, Mycobacterium tuberculosis H37Rv
cgggcccagccgg

SEQ ID NO: 3337497 - RNA, 23 nt, Mycobacterium tuberculosis H37Rv
cgggccccacaucgccccccagu

SEQ ID NO: 3337498 - RNA, 13 nt, Mycobacterium tuberculosis H37Rv
cgggccccacggc

SEQ ID NO: 3337499 - RNA, 22 nt, Mycobacterium tuberculosis H37Rv
cgggcccccgccuacgacgcag

SEQ ID NO: 3337500 - RNA, 19 nt, Mycobacterium tuberculosis H37Rv
cgggcccccuggaucgcgc

SEQ ID NO: 3337501 - RNA, 19 nt, Mycobacterium tuberculosis H37Rv
cgggccccggggugccccc

SEQ ID NO: 3337502 - RNA, 13 nt, Mycobacterium tuberculosis H37Rv
cgggcccgacgac

SEQ ID NO: 3337503 - RNA, 15 nt, Mycobacterium tuberculosis H37Rv
cgggcccgacgacga

SEQ ID NO: 3337504 - RNA, 17 nt, Mycobacterium tuberculosis H37Rv
cgggcccgccggccccg

SEQ ID NO: 3337505 - RNA, 19 nt, Mycobacterium tuberculosis H37Rv
cgggcccgccggccccgcc

SEQ ID NO: 3337506 - RNA, 12 nt, Mycobacterium tuberculosis H37Rv
cgggcccgccgu

SEQ ID NO: 3337507 - RNA, 17 nt, Mycobacterium tuberculosis H37Rv
cgggcccgccguccccg

SEQ ID NO: 3337508 - RNA, 14 nt, Mycobacterium tuberculosis H37Rv
cgggcgauggccag

SEQ ID NO: 3337509 - RNA, 17 nt, Mycobacterium tuberculosis H37Rv
cgggcgauuucggcgcc

SEQ ID NO: 3337510 - RNA, 22 nt, Mycobacterium tuberculosis H37Rv
cgggcgcaacgggacgucaccg

SEQ ID NO: 3337511 - RNA, 21 nt, Mycobacterium tuberculosis H37Rv
cgggcgcaccaagacgccacc

SEQ ID NO: 3337512 - RNA, 14 nt, Mycobacterium tuberculosis H37Rv
cgggcgcaccaggg

SEQ ID NO: 3337513 - RNA, 22 nt, Mycobacterium tuberculosis H37Rv
cgggcgcacgguccacgguggc

SEQ ID NO: 3337514 - RNA, 15 nt, Mycobacterium tuberculosis H37Rv
cgggcgccaacgggc

SEQ ID NO: 3337515 - RNA, 17 nt, Mycobacterium tuberculosis H37Rv
cgggcgccaacgggcug

SEQ ID NO: 3337516 - RNA, 18 nt, Mycobacterium tuberculosis H37Rv
cgggcgccaacgggcugc

SEQ ID NO: 3337517 - RNA, 13 nt, Mycobacterium tuberculosis H37Rv
cgggcgccccacc

SEQ ID NO: 3337518 - RNA, 16 nt, Mycobacterium tuberculosis H37Rv
cgggcgccccaccggc

SEQ ID NO: 3337519 - RNA, 17 nt, Mycobacterium tuberculosis H37Rv
cgggcgccccaccggcc

SEQ ID NO: 3337520 - RNA, 19 nt, Mycobacterium tuberculosis H37Rv
cgggcgccccaccggcccg

SEQ ID NO: 3337521 - RNA, 13 nt, Mycobacterium tuberculosis H37Rv
cgggcgccgcagc

SEQ ID NO: 3337522 - RNA, 17 nt, Mycobacterium tuberculosis H37Rv
cgggcgccgcagcgcuc

SEQ ID NO: 3337523 - RNA, 12 nt, Mycobacterium tuberculosis H37Rv
cgggcgccgcua

SEQ ID NO: 3337524 - RNA, 15 nt, Mycobacterium tuberculosis H37Rv
cgggcgccggaacga

SEQ ID NO: 3337525 - RNA, 19 nt, Mycobacterium tuberculosis H37Rv
cgggcgccgguuacccgga

SEQ ID NO: 3337526 - RNA, 21 nt, Mycobacterium tuberculosis H37Rv
cgggcgccucggugacgucgc

SEQ ID NO: 3337527 - RNA, 18 nt, Mycobacterium tuberculosis H37Rv
cgggcgccuuggucgccg

SEQ ID NO: 3337528 - RNA, 15 nt, Mycobacterium tuberculosis H37Rv
cgggcgcgccggcca

SEQ ID NO: 3337529 - RNA, 15 nt, Mycobacterium tuberculosis H37Rv
cgggcgcgcucgugg

SEQ ID NO: 3337530 - RNA, 12 nt, Mycobacterium tuberculosis H37Rv
cgggcgcgcugc

SEQ ID NO: 3337531 - RNA, 11 nt, Mycobacterium tuberculosis H37Rv
cgggcgcgcuu

SEQ ID NO: 3337532 - RNA, 16 nt, Mycobacterium tuberculosis H37Rv
cgggcgcggggcggcc

SEQ ID NO: 3337533 - RNA, 22 nt, Mycobacterium tuberculosis H37Rv
cgggcgcgggugaccaggcggc

SEQ ID NO: 3337534 - RNA, 16 nt, Mycobacterium tuberculosis H37Rv
cgggcgcggguggcgc

SEQ ID NO: 3337535 - RNA, 20 nt, Mycobacterium tuberculosis H37Rv
cgggcgcgguucgucggcga

SEQ ID NO: 3337536 - RNA, 20 nt, Mycobacterium tuberculosis H37Rv
cgggcgcguccucgccgcac

SEQ ID NO: 3337537 - RNA, 15 nt, Mycobacterium tuberculosis H37Rv
cgggcgcgucggcgu

SEQ ID NO: 3337538 - RNA, 20 nt, Mycobacterium tuberculosis H37Rv
cgggcgcuguagucgcgccu

SEQ ID NO: 3337539 - RNA, 18 nt, Mycobacterium tuberculosis H37Rv
cgggcgcuugcaccaggg

SEQ ID NO: 3337540 - RNA, 20 nt, Mycobacterium tuberculosis H37Rv
cgggcgcuugcaccaggggc

SEQ ID NO: 3337541 - RNA, 18 nt, Mycobacterium tuberculosis H37Rv
cgggcggaaaagaacccg

SEQ ID NO: 3337542 - RNA, 19 nt, Mycobacterium tuberculosis H37Rv
cgggcggaaagcccgucgg

SEQ ID NO: 3337543 - RNA, 20 nt, Mycobacterium tuberculosis H37Rv
cgggcggaaagcccgucggg

SEQ ID NO: 3337544 - RNA, 13 nt, Mycobacterium tuberculosis H37Rv
cgggcggaggccg

SEQ ID NO: 3337545 - RNA, 14 nt, Mycobacterium tuberculosis H37Rv
cgggcggaucgccg

SEQ ID NO: 3337546 - RNA, 12 nt, Mycobacterium tuberculosis H37Rv
cgggcggcaccg

SEQ ID NO: 3337547 - RNA, 17 nt, Mycobacterium tuberculosis H37Rv
cgggcggccaggcgcga

SEQ ID NO: 3337548 - RNA, 20 nt, Mycobacterium tuberculosis H37Rv
cgggcggccgcggcgcggcg

SEQ ID NO: 3337549 - RNA, 15 nt, Mycobacterium tuberculosis H37Rv
cgggcggccucccgg

SEQ ID NO: 3337550 - RNA, 13 nt, Mycobacterium tuberculosis H37Rv
cgggcggcgaugg

SEQ ID NO: 3337551 - RNA, 20 nt, Mycobacterium tuberculosis H37Rv
cgggcggcgcuggcgucguc

SEQ ID NO: 3337552 - RNA, 13 nt, Mycobacterium tuberculosis H37Rv
cgggcggcgucgg

SEQ ID NO: 3337553 - RNA, 17 nt, Mycobacterium tuberculosis H37Rv
cgggcgggacucggcga

SEQ ID NO: 3337554 - RNA, 20 nt, Mycobacterium tuberculosis H37Rv
cgggcgggagucgucgagcu

SEQ ID NO: 3337555 - RNA, 15 nt, Mycobacterium tuberculosis H37Rv
cgggcgggauccacc

SEQ ID NO: 3337556 - RNA, 18 nt, Mycobacterium tuberculosis H37Rv
cgggcgggauccacccag

SEQ ID NO: 3337557 - RNA, 14 nt, Mycobacterium tuberculosis H37Rv
cgggcgggaugacg

SEQ ID NO: 3337558 - RNA, 19 nt, Mycobacterium tuberculosis H37Rv
cgggcgggguaucaaccgg

SEQ ID NO: 3337559 - RNA, 23 nt, Mycobacterium tuberculosis H37Rv
cgggcgggguaucaaccggccgg

SEQ ID NO: 3337560 - RNA, 15 nt, Mycobacterium tuberculosis H37Rv
cgggcgggucggcgg

SEQ ID NO: 3337561 - RNA, 17 nt, Mycobacterium tuberculosis H37Rv
cgggcgggugaacgcgu

SEQ ID NO: 3337562 - RNA, 16 nt, Mycobacterium tuberculosis H37Rv
cgggcgguaaucgcga

SEQ ID NO: 3337563 - RNA, 17 nt, Mycobacterium tuberculosis H37Rv
cgggcgguaaucgcgag

SEQ ID NO: 3337564 - RNA, 19 nt, Mycobacterium tuberculosis H37Rv
cgggcggugcacaccgucg

SEQ ID NO: 3337565 - RNA, 16 nt, Mycobacterium tuberculosis H37Rv
cgggcggugggcagca

SEQ ID NO: 3337566 - RNA, 17 nt, Mycobacterium tuberculosis H37Rv
cgggcggugggcagcag

SEQ ID NO: 3337567 - RNA, 19 nt, Mycobacterium tuberculosis H37Rv
cgggcggugggcagcagcu

SEQ ID NO: 3337568 - RNA, 17 nt, Mycobacterium tuberculosis H37Rv
cgggcgucaagccacac

SEQ ID NO: 3337569 - RNA, 15 nt, Mycobacterium tuberculosis H37Rv
cgggcgucacggugc

SEQ ID NO: 3337570 - RNA, 23 nt, Mycobacterium tuberculosis H37Rv
cgggcgucacggugcguucgugc

SEQ ID NO: 3337571 - RNA, 21 nt, Mycobacterium tuberculosis H37Rv
cgggcgucagcaguucggcga

SEQ ID NO: 3337572 - RNA, 19 nt, Mycobacterium tuberculosis H37Rv
cgggcgucauccgcggcag

SEQ ID NO: 3337573 - RNA, 19 nt, Mycobacterium tuberculosis H37Rv
cgggcguccacgcugacca

SEQ ID NO: 3337574 - RNA, 21 nt, Mycobacterium tuberculosis H37Rv
cgggcguccacgcugaccaac

SEQ ID NO: 3337575 - RNA, 15 nt, Mycobacterium tuberculosis H37Rv
cgggcgucccaaucg

SEQ ID NO: 3337576 - RNA, 21 nt, Mycobacterium tuberculosis H37Rv
cgggcgucccggcggucagcg

SEQ ID NO: 3337577 - RNA, 12 nt, Mycobacterium tuberculosis H37Rv
cgggcgucgggg

SEQ ID NO: 3337578 - RNA, 13 nt, Mycobacterium tuberculosis H37Rv
cgggcgucgucgg

SEQ ID NO: 3337579 - RNA, 15 nt, Mycobacterium tuberculosis H37Rv
cgggcgugaucccgc

SEQ ID NO: 3337580 - RNA, 12 nt, Mycobacterium tuberculosis H37Rv
cgggcgugccga

SEQ ID NO: 3337581 - RNA, 13 nt, Mycobacterium tuberculosis H37Rv
cgggcgugccgac

SEQ ID NO: 3337582 - RNA, 18 nt, Mycobacterium tuberculosis H37Rv
cgggcgugccgaccagca

SEQ ID NO: 3337583 - RNA, 21 nt, Mycobacterium tuberculosis H37Rv
cgggcgugccgaccagcaucu

SEQ ID NO: 3337584 - RNA, 21 nt, Mycobacterium tuberculosis H37Rv
cgggcgugcuacacccguaga

SEQ ID NO: 3337585 - RNA, 15 nt, Mycobacterium tuberculosis H37Rv
cgggcgugcucgccg

SEQ ID NO: 3337586 - RNA, 15 nt, Mycobacterium tuberculosis H37Rv
cgggcgugguaucgc

SEQ ID NO: 3337587 - RNA, 14 nt, Mycobacterium tuberculosis H37Rv
cgggcguggugagc

SEQ ID NO: 3337588 - RNA, 13 nt, Mycobacterium tuberculosis H37Rv
cgggcgugucggg

SEQ ID NO: 3337589 - RNA, 14 nt, Mycobacterium tuberculosis H37Rv
cgggcgugugcagu

SEQ ID NO: 3337590 - RNA, 14 nt, Mycobacterium tuberculosis H37Rv
cgggcguuggccag

SEQ ID NO: 3337591 - RNA, 22 nt, Mycobacterium tuberculosis H37Rv
cgggcguuguuaucgaagcccg

SEQ ID NO: 3337592 - RNA, 15 nt, Mycobacterium tuberculosis H37Rv
cgggcuaccggcagc

SEQ ID NO: 3337593 - RNA, 15 nt, Mycobacterium tuberculosis H37Rv
cgggcucaacaccag

SEQ ID NO: 3337594 - RNA, 17 nt, Mycobacterium tuberculosis H37Rv
cgggcucaacaccagcc

SEQ ID NO: 3337595 - RNA, 19 nt, Mycobacterium tuberculosis H37Rv
cgggcucaacaccagccgg

SEQ ID NO: 3337596 - RNA, 16 nt, Mycobacterium tuberculosis H37Rv
cgggcucagcugggcc

SEQ ID NO: 3337597 - RNA, 15 nt, Mycobacterium tuberculosis H37Rv
cgggcuccaacaggu

SEQ ID NO: 3337598 - RNA, 14 nt, Mycobacterium tuberculosis H37Rv
cgggcuccagcagc

SEQ ID NO: 3337599 - RNA, 17 nt, Mycobacterium tuberculosis H37Rv
cgggcuccagcagcgcc

SEQ ID NO: 3337600 - RNA, 18 nt, Mycobacterium tuberculosis H37Rv
cgggcuccccaagucgac

SEQ ID NO: 3337601 - RNA, 19 nt, Mycobacterium tuberculosis H37Rv
cgggcuccccaagucgacg

SEQ ID NO: 3337602 - RNA, 22 nt, Mycobacterium tuberculosis H37Rv
cgggcuccccggauuccucguc

SEQ ID NO: 3337603 - RNA, 20 nt, Mycobacterium tuberculosis H37Rv
cgggcuccgugguugccgaa

SEQ ID NO: 3337604 - RNA, 17 nt, Mycobacterium tuberculosis H37Rv
cgggcucgcauguucuc

SEQ ID NO: 3337605 - RNA, 13 nt, Mycobacterium tuberculosis H37Rv
cgggggcagcgcg

SEQ ID NO: 3337606 - RNA, 14 nt, Mycobacterium tuberculosis H37Rv
cgggggcagcgcga

SEQ ID NO: 3337607 - RNA, 15 nt, Mycobacterium tuberculosis H37Rv
cgggggcgccgccgu

SEQ ID NO: 3337608 - RNA, 12 nt, Mycobacterium tuberculosis H37Rv
cgggggcgcgcg

SEQ ID NO: 3337609 - RNA, 19 nt, Mycobacterium tuberculosis H37Rv
cgggggcuuaugcgacugc

SEQ ID NO: 3337610 - RNA, 20 nt, Mycobacterium tuberculosis H37Rv
cgggggcuuaugcgacugcu

SEQ ID NO: 3337611 - RNA, 21 nt, Mycobacterium tuberculosis H37Rv
cgggggcuuauguguccgcuc

SEQ ID NO: 3337612 - RNA, 20 nt, Mycobacterium tuberculosis H37Rv
cgggggcuuuuacgucugcu

SEQ ID NO: 3337613 - RNA, 20 nt, Mycobacterium tuberculosis H37Rv
cgggggcuuuugcgucugcu

SEQ ID NO: 3337614 - RNA, 16 nt, Mycobacterium tuberculosis H37Rv
cgggggucagacaaca

SEQ ID NO: 3337615 - RNA, 13 nt, Mycobacterium tuberculosis H37Rv
cggggguccaguu

SEQ ID NO: 3337616 - RNA, 12 nt, Mycobacterium tuberculosis H37Rv
cgggggucgggc

SEQ ID NO: 3337617 - RNA, 17 nt, Mycobacterium tuberculosis H37Rv
cgggggugggcgugacg

SEQ ID NO: 3337618 - RNA, 17 nt, Mycobacterium tuberculosis H37Rv
cggggguugcggcagcu

SEQ ID NO: 3337619 - RNA, 21 nt, Mycobacterium tuberculosis H37Rv
cgggguaaggcuugucagccg

SEQ ID NO: 3337620 - RNA, 16 nt, Mycobacterium tuberculosis H37Rv
cgggguacagacacgc

SEQ ID NO: 3337621 - RNA, 22 nt, Mycobacterium tuberculosis H37Rv
cgggguacagacacgcgcgcuc

SEQ ID NO: 3337622 - RNA, 19 nt, Mycobacterium tuberculosis H37Rv
cgggguacccgguggcacc

SEQ ID NO: 3337623 - RNA, 20 nt, Mycobacterium tuberculosis H37Rv
cgggguacugcggcucgcug

SEQ ID NO: 3337624 - RNA, 16 nt, Mycobacterium tuberculosis H37Rv
cgggguaguugaggcc

SEQ ID NO: 3337625 - RNA, 15 nt, Mycobacterium tuberculosis H37Rv
cgggguaucaaccgg

SEQ ID NO: 3337626 - RNA, 18 nt, Mycobacterium tuberculosis H37Rv
cgggguaucgacccucca

SEQ ID NO: 3337627 - RNA, 14 nt, Mycobacterium tuberculosis H37Rv
cgggguccgaugcg

SEQ ID NO: 3337628 - RNA, 18 nt, Mycobacterium tuberculosis H37Rv
cgggguccgaugcgugcc

SEQ ID NO: 3337629 - RNA, 20 nt, Mycobacterium tuberculosis H37Rv
cgggguccgaugcgugccga

SEQ ID NO: 3337630 - RNA, 21 nt, Mycobacterium tuberculosis H37Rv
cgggguccgaugcgugccgac

SEQ ID NO: 3337631 - RNA, 18 nt, Mycobacterium tuberculosis H37Rv
cggggucggccugcggca

SEQ ID NO: 3337632 - RNA, 21 nt, Mycobacterium tuberculosis H37Rv
cggggucggccugcggcaccg

SEQ ID NO: 3337633 - RNA, 22 nt, Mycobacterium tuberculosis H37Rv
cggggucggccugcggcaccgg

SEQ ID NO: 3337634 - RNA, 22 nt, Mycobacterium tuberculosis H37Rv
cggggucggggaagacgaccgu

SEQ ID NO: 3337635 - RNA, 16 nt, Mycobacterium tuberculosis H37Rv
cggggucguugaggcc

SEQ ID NO: 3337636 - RNA, 19 nt, Mycobacterium tuberculosis H37Rv
cggggugagccauacgcgc

SEQ ID NO: 3337637 - RNA, 14 nt, Mycobacterium tuberculosis H37Rv
cggggugagccgac

SEQ ID NO: 3337638 - RNA, 16 nt, Mycobacterium tuberculosis H37Rv
cggggugagugaccac

SEQ ID NO: 3337639 - RNA, 13 nt, Mycobacterium tuberculosis H37Rv
cggggugcacacc

SEQ ID NO: 3337640 - RNA, 18 nt, Mycobacterium tuberculosis H37Rv
cggggugcacaccgucgc

SEQ ID NO: 3337641 - RNA, 20 nt, Mycobacterium tuberculosis H37Rv
cggggugcccggccgccagc

SEQ ID NO: 3337642 - RNA, 16 nt, Mycobacterium tuberculosis H37Rv
cggggugcgcgcgacc

SEQ ID NO: 3337643 - RNA, 14 nt, Mycobacterium tuberculosis H37Rv
cgggguggcacgca

SEQ ID NO: 3337644 - RNA, 18 nt, Mycobacterium tuberculosis H37Rv
cgggguggccaccagcgg

SEQ ID NO: 3337645 - RNA, 12 nt, Mycobacterium tuberculosis H37Rv
cgggguggcgcg

SEQ ID NO: 3337646 - RNA, 13 nt, Mycobacterium tuberculosis H37Rv
cgggguggcggcg

SEQ ID NO: 3337647 - RNA, 15 nt, Mycobacterium tuberculosis H37Rv
cgggguggcggcgcu

SEQ ID NO: 3337648 - RNA, 20 nt, Mycobacterium tuberculosis H37Rv
cggggugggaaguagugcau

SEQ ID NO: 3337649 - RNA, 22 nt, Mycobacterium tuberculosis H37Rv
cggggugggaaguagugcaucg

SEQ ID NO: 3337650 - RNA, 23 nt, Mycobacterium tuberculosis H37Rv
cggggugugcgggcggugcacac

SEQ ID NO: 3337651 - RNA, 22 nt, Mycobacterium tuberculosis H37Rv
cgggguguucgucgaccaugcg

SEQ ID NO: 3337652 - RNA, 17 nt, Mycobacterium tuberculosis H37Rv
cgggguuacucgcagcg

SEQ ID NO: 3337653 - RNA, 16 nt, Mycobacterium tuberculosis H37Rv
cgggguuaggcgcagu

SEQ ID NO: 3337654 - RNA, 18 nt, Mycobacterium tuberculosis H37Rv
cgggguugaccgccaccc

SEQ ID NO: 3337655 - RNA, 19 nt, Mycobacterium tuberculosis H37Rv
cgggguugacuggccgccc

SEQ ID NO: 3337656 - RNA, 17 nt, Mycobacterium tuberculosis H37Rv
cgggguugaucaccgac

SEQ ID NO: 3337657 - RNA, 23 nt, Mycobacterium tuberculosis H37Rv
cgggguugaucaccgacaccgug

SEQ ID NO: 3337658 - RNA, 14 nt, Mycobacterium tuberculosis H37Rv
cgggguugcucgcg

SEQ ID NO: 3337659 - RNA, 14 nt, Mycobacterium tuberculosis H37Rv
cgggguugggcgga

SEQ ID NO: 3337660 - RNA, 20 nt, Mycobacterium tuberculosis H37Rv
cgggguuggggaacaggccg

SEQ ID NO: 3337661 - RNA, 22 nt, Mycobacterium tuberculosis H37Rv
cgggguuguccucggcgaucac

SEQ ID NO: 3337662 - RNA, 17 nt, Mycobacterium tuberculosis H37Rv
cggguaaccccaccugg

SEQ ID NO: 3337663 - RNA, 18 nt, Mycobacterium tuberculosis H37Rv
cggguacacccgcucgcc

SEQ ID NO: 3337664 - RNA, 19 nt, Mycobacterium tuberculosis H37Rv
cggguacacccgcucgccc

SEQ ID NO: 3337665 - RNA, 16 nt, Mycobacterium tuberculosis H37Rv
cggguaccagcaccga

SEQ ID NO: 3337666 - RNA, 17 nt, Mycobacterium tuberculosis H37Rv
cggguacccaucugcuc

SEQ ID NO: 3337667 - RNA, 16 nt, Mycobacterium tuberculosis H37Rv
cggguacuuacggguc

SEQ ID NO: 3337668 - RNA, 19 nt, Mycobacterium tuberculosis H37Rv
cggguagaaccagcccggc

SEQ ID NO: 3337669 - RNA, 15 nt, Mycobacterium tuberculosis H37Rv
cggguagacaccgcg

SEQ ID NO: 3337670 - RNA, 17 nt, Mycobacterium tuberculosis H37Rv
cggguagacaccgcgau

SEQ ID NO: 3337671 - RNA, 17 nt, Mycobacterium tuberculosis H37Rv
cggguagacccacauca

SEQ ID NO: 3337672 - RNA, 13 nt, Mycobacterium tuberculosis H37Rv
cggguagccggcg

SEQ ID NO: 3337673 - RNA, 18 nt, Mycobacterium tuberculosis H37Rv
cggguagcggcgccgccc

SEQ ID NO: 3337674 - RNA, 14 nt, Mycobacterium tuberculosis H37Rv
cggguagcucccug

SEQ ID NO: 3337675 - RNA, 20 nt, Mycobacterium tuberculosis H37Rv
cggguaggccgccgugguga

SEQ ID NO: 3337676 - RNA, 13 nt, Mycobacterium tuberculosis H37Rv
cggguaggugacg

SEQ ID NO: 3337677 - RNA, 17 nt, Mycobacterium tuberculosis H37Rv
cggguaggugacgacgu

SEQ ID NO: 3337678 - RNA, 13 nt, Mycobacterium tuberculosis H37Rv
cggguagucgggc

SEQ ID NO: 3337679 - RNA, 17 nt, Mycobacterium tuberculosis H37Rv
cggguagugcacggaca

SEQ ID NO: 3337680 - RNA, 23 nt, Mycobacterium tuberculosis H37Rv
cggguaucgccaguggugcaccg

SEQ ID NO: 3337681 - RNA, 19 nt, Mycobacterium tuberculosis H37Rv
cggguauugaaguucgggc

SEQ ID NO: 3337682 - RNA, 14 nt, Mycobacterium tuberculosis H37Rv
cgggucaccagcgc

SEQ ID NO: 3337683 - RNA, 14 nt, Mycobacterium tuberculosis H37Rv
cgggucacccagau

SEQ ID NO: 3337684 - RNA, 19 nt, Mycobacterium tuberculosis H37Rv
cgggucacccccggccagc

SEQ ID NO: 3337685 - RNA, 12 nt, Mycobacterium tuberculosis H37Rv
cgggucacgacc

SEQ ID NO: 3337686 - RNA, 14 nt, Mycobacterium tuberculosis H37Rv
cgggucagcaccac

SEQ ID NO: 3337687 - RNA, 20 nt, Mycobacterium tuberculosis H37Rv
cgggucagcaccaccagcag

SEQ ID NO: 3337688 - RNA, 14 nt, Mycobacterium tuberculosis H37Rv
cgggucagcccagc

SEQ ID NO: 3337689 - RNA, 13 nt, Mycobacterium tuberculosis H37Rv
cgggucagcccgg

SEQ ID NO: 3337690 - RNA, 18 nt, Mycobacterium tuberculosis H37Rv
cgggucagcucgaccuga

SEQ ID NO: 3337691 - RNA, 23 nt, Mycobacterium tuberculosis H37Rv
cgggucauccgugucgagaucuc

SEQ ID NO: 3337692 - RNA, 17 nt, Mycobacterium tuberculosis H37Rv
cgggucaucuugccacc

SEQ ID NO: 3337693 - RNA, 14 nt, Mycobacterium tuberculosis H37Rv
cggguccaacgccg

SEQ ID NO: 3337694 - RNA, 23 nt, Mycobacterium tuberculosis H37Rv
cggguccaagaaccacgacguug

SEQ ID NO: 3337695 - RNA, 19 nt, Mycobacterium tuberculosis H37Rv
cggguccaucaaccccagc

SEQ ID NO: 3337696 - RNA, 17 nt, Mycobacterium tuberculosis H37Rv
cgggucccaaucgucgg

SEQ ID NO: 3337697 - RNA, 18 nt, Mycobacterium tuberculosis H37Rv
cgggucccagccuggcaa

SEQ ID NO: 3337698 - RNA, 19 nt, Mycobacterium tuberculosis H37Rv
cggguccgaaguacuggcc

SEQ ID NO: 3337699 - RNA, 22 nt, Mycobacterium tuberculosis H37Rv
cggguccgaaguacuggccgcc

SEQ ID NO: 3337700 - RNA, 16 nt, Mycobacterium tuberculosis H37Rv
cggguccgacagcccc

SEQ ID NO: 3337701 - RNA, 22 nt, Mycobacterium tuberculosis H37Rv
cggguggugccaggucggcggg

SEQ ID NO: 3337702 - RNA, 23 nt, Mycobacterium tuberculosis H37Rv
cggguggugccaggucggcgggc

SEQ ID NO: 3337703 - RNA, 18 nt, Mycobacterium tuberculosis H37Rv
cggguggugcggccgugg

SEQ ID NO: 3337704 - RNA, 24 nt, Mycobacterium tuberculosis H37Rv
cggguggugcggccguggcguggc

SEQ ID NO: 3337705 - RNA, 20 nt, Mycobacterium tuberculosis H37Rv
cgggugguucaccucggcga

SEQ ID NO: 3337706 - RNA, 17 nt, Mycobacterium tuberculosis H37Rv
cggguguagcucggacc

SEQ ID NO: 3337707 - RNA, 16 nt, Mycobacterium tuberculosis H37Rv
cgggugucgggcagca

SEQ ID NO: 3337708 - RNA, 18 nt, Mycobacterium tuberculosis H37Rv
cgggugucgggcagcaac

SEQ ID NO: 3337709 - RNA, 15 nt, Mycobacterium tuberculosis H37Rv
cgggugucgggcgcg

SEQ ID NO: 3337710 - RNA, 17 nt, Mycobacterium tuberculosis H37Rv
cgggugugacgcgcgcc

SEQ ID NO: 3337711 - RNA, 14 nt, Mycobacterium tuberculosis H37Rv
cggguguggcagug

SEQ ID NO: 3337712 - RNA, 14 nt, Mycobacterium tuberculosis H37Rv
cggguguggccguu

SEQ ID NO: 3337713 - RNA, 17 nt, Mycobacterium tuberculosis H37Rv
cggguguggucaccagg

SEQ ID NO: 3337714 - RNA, 18 nt, Mycobacterium tuberculosis H37Rv
cggguguggucaccaggc

SEQ ID NO: 3337715 - RNA, 16 nt, Mycobacterium tuberculosis H37Rv
cggguguggucggugg

SEQ ID NO: 3337716 - RNA, 18 nt, Mycobacterium tuberculosis H37Rv
cggguguuccacaccagg

SEQ ID NO: 3337717 - RNA, 21 nt, Mycobacterium tuberculosis H37Rv
cggguguuccacaccaggccg

SEQ ID NO: 3337718 - RNA, 13 nt, Mycobacterium tuberculosis H37Rv
cggguguucgcgc

SEQ ID NO: 3337719 - RNA, 20 nt, Mycobacterium tuberculosis H37Rv
cggguguucucgcgcgucgc

SEQ ID NO: 3337720 - RNA, 16 nt, Mycobacterium tuberculosis H37Rv
cggguuaucggcagca

SEQ ID NO: 3337721 - RNA, 19 nt, Mycobacterium tuberculosis H37Rv
cggguuaucggcagcagga

SEQ ID NO: 3337722 - RNA, 22 nt, Mycobacterium tuberculosis H37Rv
cggguucaacgcgcgcacgcca

SEQ ID NO: 3337723 - RNA, 18 nt, Mycobacterium tuberculosis H37Rv
cggguuccagcggcaccg

SEQ ID NO: 3337724 - RNA, 16 nt, Mycobacterium tuberculosis H37Rv
cggguuccuccucggc

SEQ ID NO: 3337725 - RNA, 23 nt, Mycobacterium tuberculosis H37Rv
cggguucgacguugaucgccaug

SEQ ID NO: 3337726 - RNA, 19 nt, Mycobacterium tuberculosis H37Rv
cggguucgccggauccgau

SEQ ID NO: 3337727 - RNA, 13 nt, Mycobacterium tuberculosis H37Rv
cggguugcagcag

SEQ ID NO: 3337728 - RNA, 18 nt, Mycobacterium tuberculosis H37Rv
cggguuggaagccgcacc

SEQ ID NO: 3337729 - RNA, 15 nt, Mycobacterium tuberculosis H37Rv
cggguuggccgggcu

SEQ ID NO: 3337730 - RNA, 21 nt, Mycobacterium tuberculosis H37Rv
cggguugggcaucaggccgcg

SEQ ID NO: 3337731 - RNA, 19 nt, Mycobacterium tuberculosis H37Rv
cggguuggucccgaugacc

SEQ ID NO: 3337732 - RNA, 14 nt, Mycobacterium tuberculosis H37Rv
cggguuguggcacc

SEQ ID NO: 3337733 - RNA, 17 nt, Mycobacterium tuberculosis H37Rv
cggguuguggcacccgg

SEQ ID NO: 3337734 - RNA, 20 nt, Mycobacterium tuberculosis H37Rv
cggguuugaucagcucgguc

SEQ ID NO: 3337735 - RNA, 18 nt, Mycobacterium tuberculosis H37Rv
cggguuugaucuccaccu

SEQ ID NO: 3337736 - RNA, 16 nt, Mycobacterium tuberculosis H37Rv
cggguuuggccgacag

SEQ ID NO: 3337737 - RNA, 13 nt, Mycobacterium tuberculosis H37Rv
cgguaaacguugg

SEQ ID NO: 3337738 - RNA, 14 nt, Mycobacterium tuberculosis H37Rv
cgguaaagccccgc

SEQ ID NO: 3337739 - RNA, 22 nt, Mycobacterium tuberculosis H37Rv
cgguaaccgcgcguaggccgcu

SEQ ID NO: 3337740 - RNA, 20 nt, Mycobacterium tuberculosis H37Rv
cgguaaccggcccgaugacc

SEQ ID NO: 3337741 - RNA, 18 nt, Mycobacterium tuberculosis H37Rv
cgguaacgaacagcguca

SEQ ID NO: 3337742 - RNA, 19 nt, Mycobacterium tuberculosis H37Rv
cgguaacggcgguaagggc

SEQ ID NO: 3337743 - RNA, 15 nt, Mycobacterium tuberculosis H37Rv
cgguaacuguccgcc

SEQ ID NO: 3337744 - RNA, 17 nt, Mycobacterium tuberculosis H37Rv
cgguaacuguccgcccg

SEQ ID NO: 3337745 - RNA, 18 nt, Mycobacterium tuberculosis H37Rv
cgguaacuguccgcccgg

SEQ ID NO: 3337746 - RNA, 19 nt, Mycobacterium tuberculosis H37Rv
cgguaaucgccaccgcaag

SEQ ID NO: 3337747 - RNA, 22 nt, Mycobacterium tuberculosis H37Rv
cgguaaugccagcggcacaccc

SEQ ID NO: 3337748 - RNA, 15 nt, Mycobacterium tuberculosis H37Rv
cgguaauggccgccg

SEQ ID NO: 3337749 - RNA, 19 nt, Mycobacterium tuberculosis H37Rv
cgguaauggcgugcagacc

SEQ ID NO: 3337750 - RNA, 14 nt, Mycobacterium tuberculosis H37Rv
cgguacaucgacca

SEQ ID NO: 3337751 - RNA, 21 nt, Mycobacterium tuberculosis H37Rv
cgguacaucgaccaccucgau

SEQ ID NO: 3337752 - RNA, 21 nt, Mycobacterium tuberculosis H37Rv
cgguaccaucaccgcgccagc

SEQ ID NO: 3337753 - RNA, 20 nt, Mycobacterium tuberculosis H37Rv
cgguacccaccucccgcagc

SEQ ID NO: 3337754 - RNA, 17 nt, Mycobacterium tuberculosis H37Rv
cgguacccgcacccguu

SEQ ID NO: 3337755 - RNA, 20 nt, Mycobacterium tuberculosis H37Rv
cgguacccguagcaccacau

SEQ ID NO: 3337756 - RNA, 18 nt, Mycobacterium tuberculosis H37Rv
cgguaccgaucagcaggg

SEQ ID NO: 3337757 - RNA, 14 nt, Mycobacterium tuberculosis H37Rv
cgguaccgcccgca

SEQ ID NO: 3337758 - RNA, 19 nt, Mycobacterium tuberculosis H37Rv
cgguaccgcccgcaccgug

SEQ ID NO: 3337759 - RNA, 13 nt, Mycobacterium tuberculosis H37Rv
cgguaccgggauc

SEQ ID NO: 3337760 - RNA, 21 nt, Mycobacterium tuberculosis H37Rv
cgguacgaauugggcucuacu

SEQ ID NO: 3337761 - RNA, 18 nt, Mycobacterium tuberculosis H37Rv
cgguacgcaaccaaccgu

SEQ ID NO: 3337762 - RNA, 22 nt, Mycobacterium tuberculosis H37Rv
cgguacgcaaccaaccgucggu

SEQ ID NO: 3337763 - RNA, 13 nt, Mycobacterium tuberculosis H37Rv
cgguacgccgccg

SEQ ID NO: 3337764 - RNA, 13 nt, Mycobacterium tuberculosis H37Rv
cgguacggacagc

SEQ ID NO: 3337765 - RNA, 16 nt, Mycobacterium tuberculosis H37Rv
cgguacggucugaugg

SEQ ID NO: 3337766 - RNA, 14 nt, Mycobacterium tuberculosis H37Rv
cgguacugagccgc

SEQ ID NO: 3337767 - RNA, 19 nt, Mycobacterium tuberculosis H37Rv
cgguagacaagucggcgcu

SEQ ID NO: 3337768 - RNA, 14 nt, Mycobacterium tuberculosis H37Rv
cgguagacguugcc

SEQ ID NO: 3337769 - RNA, 20 nt, Mycobacterium tuberculosis H37Rv
cgguagaucuucggccgcac

SEQ ID NO: 3337770 - RNA, 16 nt, Mycobacterium tuberculosis H37Rv
cgguagcacagcagca

SEQ ID NO: 3337771 - RNA, 14 nt, Mycobacterium tuberculosis H37Rv
cgguagcacggucu

SEQ ID NO: 3337772 - RNA, 18 nt, Mycobacterium tuberculosis H37Rv
cgguagcacugucgaggu

SEQ ID NO: 3337773 - RNA, 14 nt, Mycobacterium tuberculosis H37Rv
cgguagccauccgu

SEQ ID NO: 3337774 - RNA, 20 nt, Mycobacterium tuberculosis H37Rv
cgguagccccgucgaccucc

SEQ ID NO: 3337775 - RNA, 16 nt, Mycobacterium tuberculosis H37Rv
cgguagccgaccagcg

SEQ ID NO: 3337776 - RNA, 17 nt, Mycobacterium tuberculosis H37Rv
cgguagccgaccagcgc

SEQ ID NO: 3337777 - RNA, 20 nt, Mycobacterium tuberculosis H37Rv
cgguagccgacgacacgggu

SEQ ID NO: 3337778 - RNA, 18 nt, Mycobacterium tuberculosis H37Rv
cgguagccuggcuguccg

SEQ ID NO: 3337779 - RNA, 22 nt, Mycobacterium tuberculosis H37Rv
cgguagcgaucgugcugcccgc

SEQ ID NO: 3337780 - RNA, 20 nt, Mycobacterium tuberculosis H37Rv
cgguagcgauuccaggaugg

SEQ ID NO: 3337781 - RNA, 23 nt, Mycobacterium tuberculosis H37Rv
cgguagcgauuccaggauggcca

SEQ ID NO: 3337782 - RNA, 21 nt, Mycobacterium tuberculosis H37Rv
cgguagcggcuccgaaggccg

SEQ ID NO: 3337783 - RNA, 14 nt, Mycobacterium tuberculosis H37Rv
cgguagcucgucga

SEQ ID NO: 3337784 - RNA, 17 nt, Mycobacterium tuberculosis H37Rv
cgguagcucgucgagga

SEQ ID NO: 3337785 - RNA, 22 nt, Mycobacterium tuberculosis H37Rv
cgguagcuuccgcgacgcucgc

SEQ ID NO: 3337786 - RNA, 19 nt, Mycobacterium tuberculosis H37Rv
cgguaggccaucugcucgc

SEQ ID NO: 3337787 - RNA, 20 nt, Mycobacterium tuberculosis H37Rv
cgguaggggugaucccacga

SEQ ID NO: 3337788 - RNA, 18 nt, Mycobacterium tuberculosis H37Rv
cgguaggugcaugucgau

SEQ ID NO: 3337789 - RNA, 14 nt, Mycobacterium tuberculosis H37Rv
cgguagucggccag

SEQ ID NO: 3337790 - RNA, 13 nt, Mycobacterium tuberculosis H37Rv
cgguagucgucgc

SEQ ID NO: 3337791 - RNA, 19 nt, Mycobacterium tuberculosis H37Rv
cgguaguggggugcggguc

SEQ ID NO: 3337792 - RNA, 17 nt, Mycobacterium tuberculosis H37Rv
cgguaguuaacccaggg

SEQ ID NO: 3337793 - RNA, 20 nt, Mycobacterium tuberculosis H37Rv
cgguaguugcgcggcauccc

SEQ ID NO: 3337794 - RNA, 17 nt, Mycobacterium tuberculosis H37Rv
cgguauacucggccccg

SEQ ID NO: 3337795 - RNA, 17 nt, Mycobacterium tuberculosis H37Rv
cgguaucccccagccgc

SEQ ID NO: 3337796 - RNA, 19 nt, Mycobacterium tuberculosis H37Rv
cgguaucccccagccgcgg

SEQ ID NO: 3337797 - RNA, 16 nt, Mycobacterium tuberculosis H37Rv
cggucccaaggcguug

SEQ ID NO: 3337798 - RNA, 19 nt, Mycobacterium tuberculosis H37Rv
cggucccacugccggugcu

SEQ ID NO: 3337799 - RNA, 18 nt, Mycobacterium tuberculosis H37Rv
cggucccaugugcccgca

SEQ ID NO: 3337800 - RNA, 23 nt, Mycobacterium tuberculosis H37Rv
cgguccccccguugccgccguug

SEQ ID NO: 3337801 - RNA, 21 nt, Mycobacterium tuberculosis H37Rv
cggucccccgaaguggugacc

SEQ ID NO: 3337802 - RNA, 20 nt, Mycobacterium tuberculosis H37Rv
cgguccccgcagcucgacca

SEQ ID NO: 3337803 - RNA, 13 nt, Mycobacterium tuberculosis H37Rv
cgguccccucggu

SEQ ID NO: 3337804 - RNA, 13 nt, Mycobacterium tuberculosis H37Rv
cggucccgccgug

SEQ ID NO: 3337805 - RNA, 17 nt, Mycobacterium tuberculosis H37Rv
cggucccguugccgccc

SEQ ID NO: 3337806 - RNA, 14 nt, Mycobacterium tuberculosis H37Rv
cggucccucaugcu

SEQ ID NO: 3337807 - RNA, 15 nt, Mycobacterium tuberculosis H37Rv
cggucccugcgccgu

SEQ ID NO: 3337808 - RNA, 15 nt, Mycobacterium tuberculosis H37Rv
cgguccgccacggcg

SEQ ID NO: 3337809 - RNA, 17 nt, Mycobacterium tuberculosis H37Rv
cgguccgccacggcggg

SEQ ID NO: 3337810 - RNA, 13 nt, Mycobacterium tuberculosis H37Rv
cgguccgccgccu

SEQ ID NO: 3337811 - RNA, 23 nt, Mycobacterium tuberculosis H37Rv
cgguccggcgaaaagacugcgcc

SEQ ID NO: 3337812 - RNA, 22 nt, Mycobacterium tuberculosis H37Rv
cgguccggcuucggcgaacccu

SEQ ID NO: 3337813 - RNA, 20 nt, Mycobacterium tuberculosis H37Rv
cgguccgggaagucgcugaa

SEQ ID NO: 3337814 - RNA, 22 nt, Mycobacterium tuberculosis H37Rv
cgguccggggcaacgaucaggu

SEQ ID NO: 3337815 - RNA, 14 nt, Mycobacterium tuberculosis H37Rv
cgguccgucaccac

SEQ ID NO: 3337816 - RNA, 19 nt, Mycobacterium tuberculosis H37Rv
cgguccguucgcgccguug

SEQ ID NO: 3337817 - RNA, 16 nt, Mycobacterium tuberculosis H37Rv
cgguccugccaaugcu

SEQ ID NO: 3337818 - RNA, 13 nt, Mycobacterium tuberculosis H37Rv
cgguccugcucgc

SEQ ID NO: 3337819 - RNA, 18 nt, Mycobacterium tuberculosis H37Rv
cgguccugcucgcacagc

SEQ ID NO: 3337820 - RNA, 16 nt, Mycobacterium tuberculosis H37Rv
cggucgaagagguggg

SEQ ID NO: 3337821 - RNA, 17 nt, Mycobacterium tuberculosis H37Rv
cggucgaagcuggcacg

SEQ ID NO: 3337822 - RNA, 13 nt, Mycobacterium tuberculosis H37Rv
cggucgacaacgg

SEQ ID NO: 3337823 - RNA, 16 nt, Mycobacterium tuberculosis H37Rv
cggucgaccugagccc

SEQ ID NO: 3337824 - RNA, 15 nt, Mycobacterium tuberculosis H37Rv
cggucgacuccagca

SEQ ID NO: 3337825 - RNA, 20 nt, Mycobacterium tuberculosis H37Rv
cggucgacuccagcaccagc

SEQ ID NO: 3337826 - RNA, 19 nt, Mycobacterium tuberculosis H37Rv
cggucgacugggacgacgc

SEQ ID NO: 3337827 - RNA, 17 nt, Mycobacterium tuberculosis H37Rv
cggucgacuguucggga

SEQ ID NO: 3337828 - RNA, 16 nt, Mycobacterium tuberculosis H37Rv
cggucgagccagcgga

SEQ ID NO: 3337829 - RNA, 14 nt, Mycobacterium tuberculosis H37Rv
cggucgagcucgua

SEQ ID NO: 3337830 - RNA, 21 nt, Mycobacterium tuberculosis H37Rv
cggucgagcuucaucccggag

SEQ ID NO: 3337831 - RNA, 12 nt, Mycobacterium tuberculosis H37Rv
cggucgauagcg

SEQ ID NO: 3337832 - RNA, 15 nt, Mycobacterium tuberculosis H37Rv
cggucgaucacaucu

SEQ ID NO: 3337833 - RNA, 16 nt, Mycobacterium tuberculosis H37Rv
cggucgauccggccag

SEQ ID NO: 3337834 - RNA, 12 nt, Mycobacterium tuberculosis H37Rv
cggucgaugccg

SEQ ID NO: 3337835 - RNA, 17 nt, Mycobacterium tuberculosis H37Rv
cggucgaugccgaugcg

SEQ ID NO: 3337836 - RNA, 22 nt, Mycobacterium tuberculosis H37Rv
cggucgaugucagccaccaucu

SEQ ID NO: 3337837 - RNA, 19 nt, Mycobacterium tuberculosis H37Rv
cggucgauguccgcagcac

SEQ ID NO: 3337838 - RNA, 18 nt, Mycobacterium tuberculosis H37Rv
cggucgcaacggucacau

SEQ ID NO: 3337839 - RNA, 20 nt, Mycobacterium tuberculosis H37Rv
cggucgcacuuggcccccga

SEQ ID NO: 3337840 - RNA, 21 nt, Mycobacterium tuberculosis H37Rv
cggucgcagcagaccacaacg

SEQ ID NO: 3337841 - RNA, 16 nt, Mycobacterium tuberculosis H37Rv
cggucgcagugcaccc

SEQ ID NO: 3337842 - RNA, 18 nt, Mycobacterium tuberculosis H37Rv
cggucgcagugcacccgg

SEQ ID NO: 3337843 - RNA, 15 nt, Mycobacterium tuberculosis H37Rv
cggucgcauggucga

SEQ ID NO: 3337844 - RNA, 18 nt, Mycobacterium tuberculosis H37Rv
cggucgcauggucgacga

SEQ ID NO: 3337845 - RNA, 17 nt, Mycobacterium tuberculosis H37Rv
cggucgccaagaucggg

SEQ ID NO: 3337846 - RNA, 15 nt, Mycobacterium tuberculosis H37Rv
cggucgccaccgccg

SEQ ID NO: 3337847 - RNA, 16 nt, Mycobacterium tuberculosis H37Rv
cggucgccaccgccgg

SEQ ID NO: 3337848 - RNA, 20 nt, Mycobacterium tuberculosis H37Rv
cggucgccaccgccggcagc

SEQ ID NO: 3337849 - RNA, 21 nt, Mycobacterium tuberculosis H37Rv
cggucgccaccgccggcagca

SEQ ID NO: 3337850 - RNA, 13 nt, Mycobacterium tuberculosis H37Rv
cggucgccaccgu

SEQ ID NO: 3337851 - RNA, 16 nt, Mycobacterium tuberculosis H37Rv
cggucgccaccguguc

SEQ ID NO: 3337852 - RNA, 16 nt, Mycobacterium tuberculosis H37Rv
cggucgccucaccggc

SEQ ID NO: 3337853 - RNA, 22 nt, Mycobacterium tuberculosis H37Rv
cggucgccucaccggcgcgagc

SEQ ID NO: 3337854 - RNA, 21 nt, Mycobacterium tuberculosis H37Rv
cggucgcgacuaccaucgccg

SEQ ID NO: 3337855 - RNA, 22 nt, Mycobacterium tuberculosis H37Rv
cggucgcgcauuucguggcgcg

SEQ ID NO: 3337856 - RNA, 18 nt, Mycobacterium tuberculosis H37Rv
cggucgcgcgauggaccc

SEQ ID NO: 3337857 - RNA, 12 nt, Mycobacterium tuberculosis H37Rv
cggucgcggaac

SEQ ID NO: 3337858 - RNA, 23 nt, Mycobacterium tuberculosis H37Rv
cggucgcguugcagaccaccagu

SEQ ID NO: 3337859 - RNA, 22 nt, Mycobacterium tuberculosis H37Rv
cggucgcuauccggcggccagu

SEQ ID NO: 3337860 - RNA, 23 nt, Mycobacterium tuberculosis H37Rv
cggucgcucgauggauccaaccg

SEQ ID NO: 3337861 - RNA, 21 nt, Mycobacterium tuberculosis H37Rv
cggucgcucggcaugagucga

SEQ ID NO: 3337862 - RNA, 15 nt, Mycobacterium tuberculosis H37Rv
cggucgcugaugagc

SEQ ID NO: 3337863 - RNA, 20 nt, Mycobacterium tuberculosis H37Rv
cggucgcugcgaugcugauc

SEQ ID NO: 3337864 - RNA, 17 nt, Mycobacterium tuberculosis H37Rv
cggucgcuguccacugc

SEQ ID NO: 3337865 - RNA, 20 nt, Mycobacterium tuberculosis H37Rv
cggucggaccacccggcgcg

SEQ ID NO: 3337866 - RNA, 16 nt, Mycobacterium tuberculosis H37Rv
cggucggagucgagca

SEQ ID NO: 3337867 - RNA, 23 nt, Mycobacterium tuberculosis H37Rv
cggucggagucgagcacaccgag

SEQ ID NO: 3337868 - RNA, 14 nt, Mycobacterium tuberculosis H37Rv
cggucggaucggug

SEQ ID NO: 3337869 - RNA, 13 nt, Mycobacterium tuberculosis H37Rv
cggucggcaccac

SEQ ID NO: 3337870 - RNA, 17 nt, Mycobacterium tuberculosis H37Rv
cggucggcagaccgacc

SEQ ID NO: 3337871 - RNA, 13 nt, Mycobacterium tuberculosis H37Rv
cggucggccacca

SEQ ID NO: 3337872 - RNA, 13 nt, Mycobacterium tuberculosis H37Rv
cggucggccaggc

SEQ ID NO: 3337873 - RNA, 18 nt, Mycobacterium tuberculosis H37Rv
cggucggccauccaccgc

SEQ ID NO: 3337874 - RNA, 17 nt, Mycobacterium tuberculosis H37Rv
cggucggccugcggcaa

SEQ ID NO: 3337875 - RNA, 21 nt, Mycobacterium tuberculosis H37Rv
cggucggccugcggcaacggc

SEQ ID NO: 3337876 - RNA, 18 nt, Mycobacterium tuberculosis H37Rv
cggucggcgaccaccagc

SEQ ID NO: 3337877 - RNA, 19 nt, Mycobacterium tuberculosis H37Rv
cggucggcgaccaccagcg

SEQ ID NO: 3337878 - RNA, 18 nt, Mycobacterium tuberculosis H37Rv
cggucggcgacguagacg

SEQ ID NO: 3337879 - RNA, 14 nt, Mycobacterium tuberculosis H37Rv
cggucggcugggcg

SEQ ID NO: 3337880 - RNA, 18 nt, Mycobacterium tuberculosis H37Rv
cggucggggauccgaccu

SEQ ID NO: 3337881 - RNA, 18 nt, Mycobacterium tuberculosis H37Rv
cggucgggggcagcgccu

SEQ ID NO: 3337882 - RNA, 16 nt, Mycobacterium tuberculosis H37Rv
cggucggguccaacgc

SEQ ID NO: 3337883 - RNA, 15 nt, Mycobacterium tuberculosis H37Rv
cggucggguuggccg

SEQ ID NO: 3337884 - RNA, 18 nt, Mycobacterium tuberculosis H37Rv
cggucggucaccauggcg

SEQ ID NO: 3337885 - RNA, 16 nt, Mycobacterium tuberculosis H37Rv
cggucggugaacccgc

SEQ ID NO: 3337886 - RNA, 16 nt, Mycobacterium tuberculosis H37Rv
cggucggugagccgug

SEQ ID NO: 3337887 - RNA, 17 nt, Mycobacterium tuberculosis H37Rv
cggucgguguagcaacg

SEQ ID NO: 3337888 - RNA, 22 nt, Mycobacterium tuberculosis H37Rv
cggucguacaugucuaucgugg

SEQ ID NO: 3337889 - RNA, 20 nt, Mycobacterium tuberculosis H37Rv
cggucguagacagucugcga

SEQ ID NO: 3337890 - RNA, 23 nt, Mycobacterium tuberculosis H37Rv
cggucguagcuucggguccagcg

SEQ ID NO: 3337891 - RNA, 16 nt, Mycobacterium tuberculosis H37Rv
cggucguccggaucgg

SEQ ID NO: 3337892 - RNA, 22 nt, Mycobacterium tuberculosis H37Rv
cggucguccggaucggucggca

SEQ ID NO: 3337893 - RNA, 18 nt, Mycobacterium tuberculosis H37Rv
cggugaucgagguugacg

SEQ ID NO: 3337894 - RNA, 22 nt, Mycobacterium tuberculosis H37Rv
cggugaucgauccggcuccacc

SEQ ID NO: 3337895 - RNA, 16 nt, Mycobacterium tuberculosis H37Rv
cggugaucgcgguggc

SEQ ID NO: 3337896 - RNA, 18 nt, Mycobacterium tuberculosis H37Rv
cggugaucuugccggcca

SEQ ID NO: 3337897 - RNA, 19 nt, Mycobacterium tuberculosis H37Rv
cggugaucuugccggccag

SEQ ID NO: 3337898 - RNA, 21 nt, Mycobacterium tuberculosis H37Rv
cggugaucuugccggccagca

SEQ ID NO: 3337899 - RNA, 23 nt, Mycobacterium tuberculosis H37Rv
cggugaucuugccggccagcagg

SEQ ID NO: 3337900 - RNA, 22 nt, Mycobacterium tuberculosis H37Rv
cggugaugaacgacauccggcc

SEQ ID NO: 3337901 - RNA, 23 nt, Mycobacterium tuberculosis H37Rv
cggugaugaacgacauccggccg

SEQ ID NO: 3337902 - RNA, 14 nt, Mycobacterium tuberculosis H37Rv
cggugaugaagcgc

SEQ ID NO: 3337903 - RNA, 21 nt, Mycobacterium tuberculosis H37Rv
cggugaugaccgcguagagca

SEQ ID NO: 3337904 - RNA, 19 nt, Mycobacterium tuberculosis H37Rv
cggugaugcccagcgccga

SEQ ID NO: 3337905 - RNA, 16 nt, Mycobacterium tuberculosis H37Rv
cggugauggccgacca

SEQ ID NO: 3337906 - RNA, 21 nt, Mycobacterium tuberculosis H37Rv
cggugauggccgaccagccga

SEQ ID NO: 3337907 - RNA, 14 nt, Mycobacterium tuberculosis H37Rv
cggugaugggccag

SEQ ID NO: 3337908 - RNA, 20 nt, Mycobacterium tuberculosis H37Rv
cggugaugggccaggcgccc

SEQ ID NO: 3337909 - RNA, 16 nt, Mycobacterium tuberculosis H37Rv
cggugaugggggagcc

SEQ ID NO: 3337910 - RNA, 20 nt, Mycobacterium tuberculosis H37Rv
cggugaugggggagccggug

SEQ ID NO: 3337911 - RNA, 20 nt, Mycobacterium tuberculosis H37Rv
cggugauggugaccagcagg

SEQ ID NO: 3337912 - RNA, 21 nt, Mycobacterium tuberculosis H37Rv
cggugaugguuucggcgggaa

SEQ ID NO: 3337913 - RNA, 20 nt, Mycobacterium tuberculosis H37Rv
cggugauguccgcacaacga

SEQ ID NO: 3337914 - RNA, 21 nt, Mycobacterium tuberculosis H37Rv
cggugauguccgcacaacgau

SEQ ID NO: 3337915 - RNA, 15 nt, Mycobacterium tuberculosis H37Rv
cggugcacaccgucg

SEQ ID NO: 3337916 - RNA, 21 nt, Mycobacterium tuberculosis H37Rv
cggugcacggcgcuaccagcc

SEQ ID NO: 3337917 - RNA, 17 nt, Mycobacterium tuberculosis H37Rv
cggugcagaucggcuca

SEQ ID NO: 3337918 - RNA, 12 nt, Mycobacterium tuberculosis H37Rv
cggugcagcacg

SEQ ID NO: 3337919 - RNA, 18 nt, Mycobacterium tuberculosis H37Rv
cggugcagcagggcgcgc

SEQ ID NO: 3337920 - RNA, 21 nt, Mycobacterium tuberculosis H37Rv
cggugcagcagggcgcgcauc

SEQ ID NO: 3337921 - RNA, 22 nt, Mycobacterium tuberculosis H37Rv
cggugcagcagggcgcgcaucu

SEQ ID NO: 3337922 - RNA, 19 nt, Mycobacterium tuberculosis H37Rv
cggugcagcccgccgcuga

SEQ ID NO: 3337923 - RNA, 12 nt, Mycobacterium tuberculosis H37Rv
cggugcagcgca

SEQ ID NO: 3337924 - RNA, 19 nt, Mycobacterium tuberculosis H37Rv
cggugcagcgcacgcagcc

SEQ ID NO: 3337925 - RNA, 17 nt, Mycobacterium tuberculosis H37Rv
cggugcagcuccccgcc

SEQ ID NO: 3337926 - RNA, 14 nt, Mycobacterium tuberculosis H37Rv
cggugcagcuccgg

SEQ ID NO: 3337927 - RNA, 21 nt, Mycobacterium tuberculosis H37Rv
cggugcaggaccagaacucgu

SEQ ID NO: 3337928 - RNA, 21 nt, Mycobacterium tuberculosis H37Rv
cggugcauauuggaucgucgg

SEQ ID NO: 3337929 - RNA, 18 nt, Mycobacterium tuberculosis H37Rv
cggugccaaaggacgaca

SEQ ID NO: 3337930 - RNA, 12 nt, Mycobacterium tuberculosis H37Rv
cggugccaccag

SEQ ID NO: 3337931 - RNA, 17 nt, Mycobacterium tuberculosis H37Rv
cggugccaccagugagc

SEQ ID NO: 3337932 - RNA, 18 nt, Mycobacterium tuberculosis H37Rv
cggugccacugccggugg

SEQ ID NO: 3337933 - RNA, 13 nt, Mycobacterium tuberculosis H37Rv
cggugccagcagg

SEQ ID NO: 3337934 - RNA, 22 nt, Mycobacterium tuberculosis H37Rv
cggugccaucgggcgcgguaac

SEQ ID NO: 3337935 - RNA, 12 nt, Mycobacterium tuberculosis H37Rv
cggugcccacca

SEQ ID NO: 3337936 - RNA, 15 nt, Mycobacterium tuberculosis H37Rv
cggugcccagcagcg

SEQ ID NO: 3337937 - RNA, 22 nt, Mycobacterium tuberculosis H37Rv
cggugcccagcagcgcgacggu

SEQ ID NO: 3337938 - RNA, 20 nt, Mycobacterium tuberculosis H37Rv
cggugcccgggcgucaagcc

SEQ ID NO: 3337939 - RNA, 16 nt, Mycobacterium tuberculosis H37Rv
cggugcccugccggca

SEQ ID NO: 3337940 - RNA, 18 nt, Mycobacterium tuberculosis H37Rv
cggugcccugccggcagc

SEQ ID NO: 3337941 - RNA, 19 nt, Mycobacterium tuberculosis H37Rv
cggugcccugccggcagcg

SEQ ID NO: 3337942 - RNA, 14 nt, Mycobacterium tuberculosis H37Rv
cggugccgaacagc

SEQ ID NO: 3337943 - RNA, 18 nt, Mycobacterium tuberculosis H37Rv
cggugccgaagcugccca

SEQ ID NO: 3337944 - RNA, 14 nt, Mycobacterium tuberculosis H37Rv
cggugccgaccggu

SEQ ID NO: 3337945 - RNA, 13 nt, Mycobacterium tuberculosis H37Rv
cggugccgacggu

SEQ ID NO: 3337946 - RNA, 15 nt, Mycobacterium tuberculosis H37Rv
cggugccgacgguga

SEQ ID NO: 3337947 - RNA, 17 nt, Mycobacterium tuberculosis H37Rv
cggugccgacggugggc

SEQ ID NO: 3337948 - RNA, 14 nt, Mycobacterium tuberculosis H37Rv
cggugccgagcacu

SEQ ID NO: 3337949 - RNA, 12 nt, Mycobacterium tuberculosis H37Rv
cggugccgagcg

SEQ ID NO: 3337950 - RNA, 16 nt, Mycobacterium tuberculosis H37Rv
cggugccgaucagcag

SEQ ID NO: 3337951 - RNA, 14 nt, Mycobacterium tuberculosis H37Rv
cggugccgcagcag

SEQ ID NO: 3337952 - RNA, 23 nt, Mycobacterium tuberculosis H37Rv
cggugccgcagcaggggacgacc

SEQ ID NO: 3337953 - RNA, 15 nt, Mycobacterium tuberculosis H37Rv
cggugccgccaccgg

SEQ ID NO: 3337954 - RNA, 17 nt, Mycobacterium tuberculosis H37Rv
cggugccgccaucgccg

SEQ ID NO: 3337955 - RNA, 13 nt, Mycobacterium tuberculosis H37Rv
cggugccgcccga

SEQ ID NO: 3337956 - RNA, 13 nt, Mycobacterium tuberculosis H37Rv
cggugccgcccgc

SEQ ID NO: 3337957 - RNA, 20 nt, Mycobacterium tuberculosis H37Rv
cggugccgcccgcgccuccg

SEQ ID NO: 3337958 - RNA, 17 nt, Mycobacterium tuberculosis H37Rv
cggugccgccgauaccg

SEQ ID NO: 3337959 - RNA, 13 nt, Mycobacterium tuberculosis H37Rv
cggugccgccgcc

SEQ ID NO: 3337960 - RNA, 23 nt, Mycobacterium tuberculosis H37Rv
cggugccgccgcggccaccaccg

SEQ ID NO: 3337961 - RNA, 14 nt, Mycobacterium tuberculosis H37Rv
cggugccgccggaa

SEQ ID NO: 3337962 - RNA, 14 nt, Mycobacterium tuberculosis H37Rv
cggugccgccgggu

SEQ ID NO: 3337963 - RNA, 22 nt, Mycobacterium tuberculosis H37Rv
cggugccgccgggugcaacggc

SEQ ID NO: 3337964 - RNA, 23 nt, Mycobacterium tuberculosis H37Rv
cggugccgccgggugcaacggcg

SEQ ID NO: 3337965 - RNA, 21 nt, Mycobacterium tuberculosis H37Rv
cggugccgccggugccgccug

SEQ ID NO: 3337966 - RNA, 14 nt, Mycobacterium tuberculosis H37Rv
cggugccgccgucg

SEQ ID NO: 3337967 - RNA, 18 nt, Mycobacterium tuberculosis H37Rv
cggugccgccguucccac

SEQ ID NO: 3337968 - RNA, 14 nt, Mycobacterium tuberculosis H37Rv
cggugccgccguug

SEQ ID NO: 3337969 - RNA, 15 nt, Mycobacterium tuberculosis H37Rv
cggugccgccuccgc

SEQ ID NO: 3337970 - RNA, 15 nt, Mycobacterium tuberculosis H37Rv
cggugccgcggacgu

SEQ ID NO: 3337971 - RNA, 15 nt, Mycobacterium tuberculosis H37Rv
cggugccgcgguagg

SEQ ID NO: 3337972 - RNA, 21 nt, Mycobacterium tuberculosis H37Rv
cggugccgcugaugcuggcca

SEQ ID NO: 3337973 - RNA, 15 nt, Mycobacterium tuberculosis H37Rv
cggugccggccaucg

SEQ ID NO: 3337974 - RNA, 23 nt, Mycobacterium tuberculosis H37Rv
cggugccggcccugcucggccaa

SEQ ID NO: 3337975 - RNA, 14 nt, Mycobacterium tuberculosis H37Rv
cggugccggccgca

SEQ ID NO: 3337976 - RNA, 13 nt, Mycobacterium tuberculosis H37Rv
cggugccggcgca

SEQ ID NO: 3337977 - RNA, 15 nt, Mycobacterium tuberculosis H37Rv
cggugccggcggauc

SEQ ID NO: 3337978 - RNA, 16 nt, Mycobacterium tuberculosis H37Rv
cggugccggcggcgca

SEQ ID NO: 3337979 - RNA, 14 nt, Mycobacterium tuberculosis H37Rv
cggugccggcguag

SEQ ID NO: 3337980 - RNA, 14 nt, Mycobacterium tuberculosis H37Rv
cggugccggcguug

SEQ ID NO: 3337981 - RNA, 17 nt, Mycobacterium tuberculosis H37Rv
cggugccgggcaccacc

SEQ ID NO: 3337982 - RNA, 23 nt, Mycobacterium tuberculosis H37Rv
cggugccggucgagugccucgac

SEQ ID NO: 3337983 - RNA, 19 nt, Mycobacterium tuberculosis H37Rv
cggugccgucagcggcggc

SEQ ID NO: 3337984 - RNA, 20 nt, Mycobacterium tuberculosis H37Rv
cggugccgucgaguccaggc

SEQ ID NO: 3337985 - RNA, 16 nt, Mycobacterium tuberculosis H37Rv
cggugccgucggugcc

SEQ ID NO: 3337986 - RNA, 15 nt, Mycobacterium tuberculosis H37Rv
cggugccguggugga

SEQ ID NO: 3337987 - RNA, 18 nt, Mycobacterium tuberculosis H37Rv
cggugcgaccaacacggu

SEQ ID NO: 3337988 - RNA, 23 nt, Mycobacterium tuberculosis H37Rv
cggugcgacgauccagggucacc

SEQ ID NO: 3337989 - RNA, 20 nt, Mycobacterium tuberculosis H37Rv
cgguggucaggaacacucgc

SEQ ID NO: 3337990 - RNA, 19 nt, Mycobacterium tuberculosis H37Rv
cgguggucagguuggcacg

SEQ ID NO: 3337991 - RNA, 17 nt, Mycobacterium tuberculosis H37Rv
cgguggucccccgcagc

SEQ ID NO: 3337992 - RNA, 13 nt, Mycobacterium tuberculosis H37Rv
cggugguccuggc

SEQ ID NO: 3337993 - RNA, 14 nt, Mycobacterium tuberculosis H37Rv
cgguggucggcgcg

SEQ ID NO: 3337994 - RNA, 16 nt, Mycobacterium tuberculosis H37Rv
cgguggucggcgcgcc

SEQ ID NO: 3337995 - RNA, 14 nt, Mycobacterium tuberculosis H37Rv
cgguggucguaggu

SEQ ID NO: 3337996 - RNA, 14 nt, Mycobacterium tuberculosis H37Rv
cgguggucugcgcg

SEQ ID NO: 3337997 - RNA, 16 nt, Mycobacterium tuberculosis H37Rv
cgguggucugcgcggu

SEQ ID NO: 3337998 - RNA, 18 nt, Mycobacterium tuberculosis H37Rv
cgguggucugcgcggugc

SEQ ID NO: 3337999 - RNA, 16 nt, Mycobacterium tuberculosis H37Rv
cgguggugaccgcggg

SEQ ID NO: 3338000 - RNA, 19 nt, Mycobacterium tuberculosis H37Rv
cgguggugaccgcgggcgc

SEQ ID NO: 3338001 - RNA, 15 nt, Mycobacterium tuberculosis H37Rv
cgguggugacgucga

SEQ ID NO: 3338002 - RNA, 18 nt, Mycobacterium tuberculosis H37Rv
cgguggugacgucgaggu

SEQ ID NO: 3338003 - RNA, 15 nt, Mycobacterium tuberculosis H37Rv
cgguggugaucacgu

SEQ ID NO: 3338004 - RNA, 13 nt, Mycobacterium tuberculosis H37Rv
cgguggugccgcg

SEQ ID NO: 3338005 - RNA, 17 nt, Mycobacterium tuberculosis H37Rv
cgguggugccgcggcca

SEQ ID NO: 3338006 - RNA, 20 nt, Mycobacterium tuberculosis H37Rv
cgguggugccgcggccaccg

SEQ ID NO: 3338007 - RNA, 18 nt, Mycobacterium tuberculosis H37Rv
cgguggugccggcgccgc

SEQ ID NO: 3338008 - RNA, 23 nt, Mycobacterium tuberculosis H37Rv
cgguggugccggcgccgccagca

SEQ ID NO: 3338009 - RNA, 15 nt, Mycobacterium tuberculosis H37Rv
cgguggugcggucuc

SEQ ID NO: 3338010 - RNA, 16 nt, Mycobacterium tuberculosis H37Rv
cgguggugcucgucgg

SEQ ID NO: 3338011 - RNA, 18 nt, Mycobacterium tuberculosis H37Rv
cgguggugcucgucggug

SEQ ID NO: 3338012 - RNA, 14 nt, Mycobacterium tuberculosis H37Rv
cggugguggccaug

SEQ ID NO: 3338013 - RNA, 15 nt, Mycobacterium tuberculosis H37Rv
cgguggugggcggga

SEQ ID NO: 3338014 - RNA, 24 nt, Mycobacterium tuberculosis H37Rv
cgguggugguguaggaguacaaca

SEQ ID NO: 3338015 - RNA, 18 nt, Mycobacterium tuberculosis H37Rv
cggugguguagcuucgau

SEQ ID NO: 3338016 - RNA, 14 nt, Mycobacterium tuberculosis H37Rv
cgguggugucagcc

SEQ ID NO: 3338017 - RNA, 13 nt, Mycobacterium tuberculosis H37Rv
cgguggugucggu

SEQ ID NO: 3338018 - RNA, 20 nt, Mycobacterium tuberculosis H37Rv
cggugguuagguggcuggcu

SEQ ID NO: 3338019 - RNA, 23 nt, Mycobacterium tuberculosis H37Rv
cggugguugugcuguggucggug

SEQ ID NO: 3338020 - RNA, 16 nt, Mycobacterium tuberculosis H37Rv
cggugguuuggcgcgc

SEQ ID NO: 3338021 - RNA, 15 nt, Mycobacterium tuberculosis H37Rv
cgguguaacccucga

SEQ ID NO: 3338022 - RNA, 16 nt, Mycobacterium tuberculosis H37Rv
cgguguaacccuggcg

SEQ ID NO: 3338023 - RNA, 17 nt, Mycobacterium tuberculosis H37Rv
cgguguaacccuggcgg

SEQ ID NO: 3338024 - RNA, 19 nt, Mycobacterium tuberculosis H37Rv
cgguguacaccgcgcccgc

SEQ ID NO: 3338025 - RNA, 14 nt, Mycobacterium tuberculosis H37Rv
cgguguacgcccgc

SEQ ID NO: 3338026 - RNA, 18 nt, Mycobacterium tuberculosis H37Rv
cgguguacgcccgcucgg

SEQ ID NO: 3338027 - RNA, 17 nt, Mycobacterium tuberculosis H37Rv
cgguguagaagcgggcg

SEQ ID NO: 3338028 - RNA, 19 nt, Mycobacterium tuberculosis H37Rv
cgguguagcagcgccagca

SEQ ID NO: 3338029 - RNA, 15 nt, Mycobacterium tuberculosis H37Rv
cgguguagcccaucg

SEQ ID NO: 3338030 - RNA, 20 nt, Mycobacterium tuberculosis H37Rv
cgguguaggccucggcagca

SEQ ID NO: 3338031 - RNA, 19 nt, Mycobacterium tuberculosis H37Rv
cggugucaaaaccguuguc

SEQ ID NO: 3338032 - RNA, 21 nt, Mycobacterium tuberculosis H37Rv
cggugucagccgucgccacca

SEQ ID NO: 3338033 - RNA, 23 nt, Mycobacterium tuberculosis H37Rv
cggugucaguccgacaccacgga

SEQ ID NO: 3338034 - RNA, 16 nt, Mycobacterium tuberculosis H37Rv
cggugucaugaacgac

SEQ ID NO: 3338035 - RNA, 12 nt, Mycobacterium tuberculosis H37Rv
cgguguccagcc

SEQ ID NO: 3338036 - RNA, 15 nt, Mycobacterium tuberculosis H37Rv
cgguguccagccacg

SEQ ID NO: 3338037 - RNA, 19 nt, Mycobacterium tuberculosis H37Rv
cgguguccagccacgcugu

SEQ ID NO: 3338038 - RNA, 15 nt, Mycobacterium tuberculosis H37Rv
cgguguccagugcau

SEQ ID NO: 3338039 - RNA, 16 nt, Mycobacterium tuberculosis H37Rv
cggugucccgcgaggc

SEQ ID NO: 3338040 - RNA, 12 nt, Mycobacterium tuberculosis H37Rv
cggugucgacgg

SEQ ID NO: 3338041 - RNA, 14 nt, Mycobacterium tuberculosis H37Rv
cggugucggcgccg

SEQ ID NO: 3338042 - RNA, 15 nt, Mycobacterium tuberculosis H37Rv
cggugucggcugguc

SEQ ID NO: 3338043 - RNA, 19 nt, Mycobacterium tuberculosis H37Rv
cggugucgggcuggguggc

SEQ ID NO: 3338044 - RNA, 17 nt, Mycobacterium tuberculosis H37Rv
cggugucgggcugucag

SEQ ID NO: 3338045 - RNA, 13 nt, Mycobacterium tuberculosis H37Rv
cggugucggugac

SEQ ID NO: 3338046 - RNA, 14 nt, Mycobacterium tuberculosis H37Rv
cggugucggugaca

SEQ ID NO: 3338047 - RNA, 12 nt, Mycobacterium tuberculosis H37Rv
cggugucgucga

SEQ ID NO: 3338048 - RNA, 15 nt, Mycobacterium tuberculosis H37Rv
cggugucgucgaggu

SEQ ID NO: 3338049 - RNA, 22 nt, Mycobacterium tuberculosis H37Rv
cggugucguucggcgaggacgg

SEQ ID NO: 3338050 - RNA, 21 nt, Mycobacterium tuberculosis H37Rv
cggugucucccuugccgccau

SEQ ID NO: 3338051 - RNA, 17 nt, Mycobacterium tuberculosis H37Rv
cggugucucgcccacca

SEQ ID NO: 3338052 - RNA, 15 nt, Mycobacterium tuberculosis H37Rv
cggugucugaaccgc

SEQ ID NO: 3338053 - RNA, 13 nt, Mycobacterium tuberculosis H37Rv
cggugugcgugcg

SEQ ID NO: 3338054 - RNA, 16 nt, Mycobacterium tuberculosis H37Rv
cggugugcgugcgguc

SEQ ID NO: 3338055 - RNA, 13 nt, Mycobacterium tuberculosis H37Rv
cggugugcucacg

SEQ ID NO: 3338056 - RNA, 16 nt, Mycobacterium tuberculosis H37Rv
cggugugcuugcucgg

SEQ ID NO: 3338057 - RNA, 20 nt, Mycobacterium tuberculosis H37Rv
cgguguggacuucagcaggc

SEQ ID NO: 3338058 - RNA, 17 nt, Mycobacterium tuberculosis H37Rv
cgguguggccgugggug

SEQ ID NO: 3338059 - RNA, 15 nt, Mycobacterium tuberculosis H37Rv
cgguguuagccccga

SEQ ID NO: 3338060 - RNA, 15 nt, Mycobacterium tuberculosis H37Rv
cgguguuccgcccag

SEQ ID NO: 3338061 - RNA, 12 nt, Mycobacterium tuberculosis H37Rv
cgguguugauuc

SEQ ID NO: 3338062 - RNA, 18 nt, Mycobacterium tuberculosis H37Rv
cgguguugccgaagcccg

SEQ ID NO: 3338063 - RNA, 14 nt, Mycobacterium tuberculosis H37Rv
cgguguugcgcacc

SEQ ID NO: 3338064 - RNA, 22 nt, Mycobacterium tuberculosis H37Rv
cgguguugcucccggccgccga

SEQ ID NO: 3338065 - RNA, 21 nt, Mycobacterium tuberculosis H37Rv
cgguguuggacacucccgggu

SEQ ID NO: 3338066 - RNA, 21 nt, Mycobacterium tuberculosis H37Rv
cgguguuggacgcgggccgac

SEQ ID NO: 3338067 - RNA, 22 nt, Mycobacterium tuberculosis H37Rv
cgguguuggcgccagccccgcc

SEQ ID NO: 3338068 - RNA, 14 nt, Mycobacterium tuberculosis H37Rv
cgguuacccggacc

SEQ ID NO: 3338069 - RNA, 14 nt, Mycobacterium tuberculosis H37Rv
cgguuagaucaccc

SEQ ID NO: 3338070 - RNA, 22 nt, Mycobacterium tuberculosis H37Rv
cgguucaccaugucggccaccc

SEQ ID NO: 3338071 - RNA, 13 nt, Mycobacterium tuberculosis H37Rv
cgguucagcugcg

SEQ ID NO: 3338072 - RNA, 16 nt, Mycobacterium tuberculosis H37Rv
cgguucagcugcgcca

SEQ ID NO: 3338073 - RNA, 16 nt, Mycobacterium tuberculosis H37Rv
cgguuccggccccguc

SEQ ID NO: 3338074 - RNA, 15 nt, Mycobacterium tuberculosis H37Rv
cgguuccggccggcu

SEQ ID NO: 3338075 - RNA, 20 nt, Mycobacterium tuberculosis H37Rv
cgguuccggcuucguccacc

SEQ ID NO: 3338076 - RNA, 15 nt, Mycobacterium tuberculosis H37Rv
cgguuccucagcggc

SEQ ID NO: 3338077 - RNA, 15 nt, Mycobacterium tuberculosis H37Rv
cgguucgaacgcgau

SEQ ID NO: 3338078 - RNA, 23 nt, Mycobacterium tuberculosis H37Rv
cgguucgccccugcacagcaggc

SEQ ID NO: 3338079 - RNA, 21 nt, Mycobacterium tuberculosis H37Rv
cgguucgcugcggcgguaugc

SEQ ID NO: 3338080 - RNA, 22 nt, Mycobacterium tuberculosis H37Rv
cgguucggagucacgcagccgc

SEQ ID NO: 3338081 - RNA, 21 nt, Mycobacterium tuberculosis H37Rv
cgguucgggcagcacccgcgc

SEQ ID NO: 3338082 - RNA, 20 nt, Mycobacterium tuberculosis H37Rv
cgguucgucggcgagcgcgg

SEQ ID NO: 3338083 - RNA, 17 nt, Mycobacterium tuberculosis H37Rv
cgguucgucgggcaugc

SEQ ID NO: 3338084 - RNA, 15 nt, Mycobacterium tuberculosis H37Rv
cgguucuuccugguc

SEQ ID NO: 3338085 - RNA, 13 nt, Mycobacterium tuberculosis H37Rv
cgguugacccaca

SEQ ID NO: 3338086 - RNA, 18 nt, Mycobacterium tuberculosis H37Rv
cguagcccaggucgaugc

SEQ ID NO: 3338087 - RNA, 16 nt, Mycobacterium tuberculosis H37Rv
cguagcccugcucagc

SEQ ID NO: 3338088 - RNA, 15 nt, Mycobacterium tuberculosis H37Rv
cguagccgcugcacg

SEQ ID NO: 3338089 - RNA, 14 nt, Mycobacterium tuberculosis H37Rv
cguagccggcggug

SEQ ID NO: 3338090 - RNA, 15 nt, Mycobacterium tuberculosis H37Rv
cguagccguggagca

SEQ ID NO: 3338091 - RNA, 22 nt, Mycobacterium tuberculosis H37Rv
cguagccguggagcacagcacg

SEQ ID NO: 3338092 - RNA, 24 nt, Mycobacterium tuberculosis H37Rv
cguagccguggagcacagcacggc

SEQ ID NO: 3338093 - RNA, 20 nt, Mycobacterium tuberculosis H37Rv
cguagcgcccaccguagacg

SEQ ID NO: 3338094 - RNA, 15 nt, Mycobacterium tuberculosis H37Rv
cguagcgcggccgau

SEQ ID NO: 3338095 - RNA, 17 nt, Mycobacterium tuberculosis H37Rv
cguagcggcgauaccgg

SEQ ID NO: 3338096 - RNA, 16 nt, Mycobacterium tuberculosis H37Rv
cguagcggcggcgccc

SEQ ID NO: 3338097 - RNA, 23 nt, Mycobacterium tuberculosis H37Rv
cguagcggcuccgggaugaagcu

SEQ ID NO: 3338098 - RNA, 20 nt, Mycobacterium tuberculosis H37Rv
cguagcgggggagcgaacgg

SEQ ID NO: 3338099 - RNA, 22 nt, Mycobacterium tuberculosis H37Rv
cguagcgggggagcgaacggcg

SEQ ID NO: 3338100 - RNA, 20 nt, Mycobacterium tuberculosis H37Rv
cguagcgggucagcucgacc

SEQ ID NO: 3338101 - RNA, 17 nt, Mycobacterium tuberculosis H37Rv
cguagcggucuccccag

SEQ ID NO: 3338102 - RNA, 22 nt, Mycobacterium tuberculosis H37Rv
cguagcggucugugcugcgcug

SEQ ID NO: 3338103 - RNA, 15 nt, Mycobacterium tuberculosis H37Rv
cguagcucagcggua

SEQ ID NO: 3338104 - RNA, 20 nt, Mycobacterium tuberculosis H37Rv
cguagcucuuugagugccgu

SEQ ID NO: 3338105 - RNA, 21 nt, Mycobacterium tuberculosis H37Rv
cguagcugcgcagcgcaaaca

SEQ ID NO: 3338106 - RNA, 15 nt, Mycobacterium tuberculosis H37Rv
cguagcuggucccac

SEQ ID NO: 3338107 - RNA, 21 nt, Mycobacterium tuberculosis H37Rv
cguagcuggugcguagcccac

SEQ ID NO: 3338108 - RNA, 17 nt, Mycobacterium tuberculosis H37Rv
cguagcuucccuccaga

SEQ ID NO: 3338109 - RNA, 18 nt, Mycobacterium tuberculosis H37Rv
cguagcuucccuccagau

SEQ ID NO: 3338110 - RNA, 16 nt, Mycobacterium tuberculosis H37Rv
cguaggacucggcgga

SEQ ID NO: 3338111 - RNA, 12 nt, Mycobacterium tuberculosis H37Rv
cguaggcacccc

SEQ ID NO: 3338112 - RNA, 21 nt, Mycobacterium tuberculosis H37Rv
cguaggccgcuaugcagguca

SEQ ID NO: 3338113 - RNA, 17 nt, Mycobacterium tuberculosis H37Rv
cguaggcgaucucacgc

SEQ ID NO: 3338114 - RNA, 14 nt, Mycobacterium tuberculosis H37Rv
cguaggcgaugagc

SEQ ID NO: 3338115 - RNA, 23 nt, Mycobacterium tuberculosis H37Rv
cguaggcgauggcggcgcguucg

SEQ ID NO: 3338116 - RNA, 14 nt, Mycobacterium tuberculosis H37Rv
cguaggcgccgaac

SEQ ID NO: 3338117 - RNA, 14 nt, Mycobacterium tuberculosis H37Rv
cguaggcgccguug

SEQ ID NO: 3338118 - RNA, 13 nt, Mycobacterium tuberculosis H37Rv
cguaggcgcugaa

SEQ ID NO: 3338119 - RNA, 13 nt, Mycobacterium tuberculosis H37Rv
cguaggcggcggc

SEQ ID NO: 3338120 - RNA, 22 nt, Mycobacterium tuberculosis H37Rv
cguaggcguuguagcgguccag

SEQ ID NO: 3338121 - RNA, 12 nt, Mycobacterium tuberculosis H37Rv
cguagggugggu

SEQ ID NO: 3338122 - RNA, 15 nt, Mycobacterium tuberculosis H37Rv
cguaggugcacaacc

SEQ ID NO: 3338123 - RNA, 16 nt, Mycobacterium tuberculosis H37Rv
cguagguggccggcuu

SEQ ID NO: 3338124 - RNA, 19 nt, Mycobacterium tuberculosis H37Rv
cguagguggccggcuugca

SEQ ID NO: 3338125 - RNA, 23 nt, Mycobacterium tuberculosis H37Rv
cguagguggccggcuugcaguga

SEQ ID NO: 3338126 - RNA, 16 nt, Mycobacterium tuberculosis H37Rv
cguagguugcgccccg

SEQ ID NO: 3338127 - RNA, 18 nt, Mycobacterium tuberculosis H37Rv
cguaguaaugcucgacgu

SEQ ID NO: 3338128 - RNA, 14 nt, Mycobacterium tuberculosis H37Rv
cguaguacagcgcg

SEQ ID NO: 3338129 - RNA, 15 nt, Mycobacterium tuberculosis H37Rv
cguaguacagcgcga

SEQ ID NO: 3338130 - RNA, 16 nt, Mycobacterium tuberculosis H37Rv
cguaguagcgaugcac

SEQ ID NO: 3338131 - RNA, 17 nt, Mycobacterium tuberculosis H37Rv
cguaguagcgaugcacc

SEQ ID NO: 3338132 - RNA, 20 nt, Mycobacterium tuberculosis H37Rv
cguaguccaggccgucguug

SEQ ID NO: 3338133 - RNA, 17 nt, Mycobacterium tuberculosis H37Rv
cguagucgcugucggca

SEQ ID NO: 3338134 - RNA, 14 nt, Mycobacterium tuberculosis H37Rv
cguagucguagcag

SEQ ID NO: 3338135 - RNA, 18 nt, Mycobacterium tuberculosis H37Rv
cguagugaacggcucggg

SEQ ID NO: 3338136 - RNA, 13 nt, Mycobacterium tuberculosis H37Rv
cguagugaucgca

SEQ ID NO: 3338137 - RNA, 22 nt, Mycobacterium tuberculosis H37Rv
cguauagccacucgaucaccgg

SEQ ID NO: 3338138 - RNA, 17 nt, Mycobacterium tuberculosis H37Rv
cguauaggucagaauug

SEQ ID NO: 3338139 - RNA, 20 nt, Mycobacterium tuberculosis H37Rv
cguauccacggucgaccagg

SEQ ID NO: 3338140 - RNA, 18 nt, Mycobacterium tuberculosis H37Rv
cguaucgucgagcaccuu

SEQ ID NO: 3338141 - RNA, 18 nt, Mycobacterium tuberculosis H37Rv
cguaucucccaacggcag

SEQ ID NO: 3338142 - RNA, 17 nt, Mycobacterium tuberculosis H37Rv
cguaugacgcccaccga

SEQ ID NO: 3338143 - RNA, 19 nt, Mycobacterium tuberculosis H37Rv
cguauugauacugcccgcg

SEQ ID NO: 3338144 - RNA, 22 nt, Mycobacterium tuberculosis H37Rv
cguauuucguccacgaccccgg

SEQ ID NO: 3338145 - RNA, 23 nt, Mycobacterium tuberculosis H37Rv
cgucaaacccgacaucggccagc

SEQ ID NO: 3338146 - RNA, 17 nt, Mycobacterium tuberculosis H37Rv
cgucaaacgacagcccu

SEQ ID NO: 3338147 - RNA, 18 nt, Mycobacterium tuberculosis H37Rv
cgucaaacgacagcccua

SEQ ID NO: 3338148 - RNA, 22 nt, Mycobacterium tuberculosis H37Rv
cgucaaacgcaaagacagcgcg

SEQ ID NO: 3338149 - RNA, 16 nt, Mycobacterium tuberculosis H37Rv
cgucaaauccagcgag

SEQ ID NO: 3338150 - RNA, 20 nt, Mycobacterium tuberculosis H37Rv
cgucaaauccagcgagguga

SEQ ID NO: 3338151 - RNA, 23 nt, Mycobacterium tuberculosis H37Rv
cgucaacaccaugguggugaugc

SEQ ID NO: 3338152 - RNA, 14 nt, Mycobacterium tuberculosis H37Rv
cgucaacagccagg

SEQ ID NO: 3338153 - RNA, 14 nt, Mycobacterium tuberculosis H37Rv
cgucaacagcgugg

SEQ ID NO: 3338154 - RNA, 24 nt, Mycobacterium tuberculosis H37Rv
cgucaaccaccaggagcggauagc

SEQ ID NO: 3338155 - RNA, 22 nt, Mycobacterium tuberculosis H37Rv
cgucaaccucgccacgcucggc

SEQ ID NO: 3338156 - RNA, 23 nt, Mycobacterium tuberculosis H37Rv
cgucaaccugcgcaucaccacug

SEQ ID NO: 3338157 - RNA, 20 nt, Mycobacterium tuberculosis H37Rv
cgucaacgacuggguggugc

SEQ ID NO: 3338158 - RNA, 20 nt, Mycobacterium tuberculosis H37Rv
cgucaacgccucugcucagc

SEQ ID NO: 3338159 - RNA, 22 nt, Mycobacterium tuberculosis H37Rv
cgucaacggaagaagcaguagc

SEQ ID NO: 3338160 - RNA, 17 nt, Mycobacterium tuberculosis H37Rv
cgucaagaacgccacga

SEQ ID NO: 3338161 - RNA, 21 nt, Mycobacterium tuberculosis H37Rv
cgucaagagugcucagcgcgc

SEQ ID NO: 3338162 - RNA, 23 nt, Mycobacterium tuberculosis H37Rv
cgucaagagugcucagcgcgcgc

SEQ ID NO: 3338163 - RNA, 19 nt, Mycobacterium tuberculosis H37Rv
cgucaagucugugcucacg

SEQ ID NO: 3338164 - RNA, 20 nt, Mycobacterium tuberculosis H37Rv
cgucaaucaccaccgccagc

SEQ ID NO: 3338165 - RNA, 14 nt, Mycobacterium tuberculosis H37Rv
cgucacaagucgac

SEQ ID NO: 3338166 - RNA, 20 nt, Mycobacterium tuberculosis H37Rv
cgucacaagucgacacgccg

SEQ ID NO: 3338167 - RNA, 21 nt, Mycobacterium tuberculosis H37Rv
cgucacaagucgacacgccga

SEQ ID NO: 3338168 - RNA, 22 nt, Mycobacterium tuberculosis H37Rv
cgucacaaugcccaggcucgca

SEQ ID NO: 3338169 - RNA, 15 nt, Mycobacterium tuberculosis H37Rv
cgucacaccagcggg

SEQ ID NO: 3338170 - RNA, 18 nt, Mycobacterium tuberculosis H37Rv
cgucacaggccgccuggg

SEQ ID NO: 3338171 - RNA, 14 nt, Mycobacterium tuberculosis H37Rv
cgucaccaccgccg

SEQ ID NO: 3338172 - RNA, 15 nt, Mycobacterium tuberculosis H37Rv
cgucaccaccgccgc

SEQ ID NO: 3338173 - RNA, 15 nt, Mycobacterium tuberculosis H37Rv
cgucaccacgagggc

SEQ ID NO: 3338174 - RNA, 13 nt, Mycobacterium tuberculosis H37Rv
cgucaccaucggg

SEQ ID NO: 3338175 - RNA, 14 nt, Mycobacterium tuberculosis H37Rv
cgucaccaucgggu

SEQ ID NO: 3338176 - RNA, 13 nt, Mycobacterium tuberculosis H37Rv
cgucaccccgguc

SEQ ID NO: 3338177 - RNA, 13 nt, Mycobacterium tuberculosis H37Rv
cgucacccgcaac

SEQ ID NO: 3338178 - RNA, 13 nt, Mycobacterium tuberculosis H37Rv
cgucaccgaucga

SEQ ID NO: 3338179 - RNA, 20 nt, Mycobacterium tuberculosis H37Rv
cgucaccgaugcgccggacc

SEQ ID NO: 3338180 - RNA, 17 nt, Mycobacterium tuberculosis H37Rv
cgucaccgccggcaccg

SEQ ID NO: 3338181 - RNA, 12 nt, Mycobacterium tuberculosis H37Rv
cgucaccgccgu

SEQ ID NO: 3338182 - RNA, 20 nt, Mycobacterium tuberculosis H37Rv
cguccaccgauacccccggc

SEQ ID NO: 3338183 - RNA, 20 nt, Mycobacterium tuberculosis H37Rv
cguccaccgccgacauggcg

SEQ ID NO: 3338184 - RNA, 17 nt, Mycobacterium tuberculosis H37Rv
cguccacgacagcagag

SEQ ID NO: 3338185 - RNA, 18 nt, Mycobacterium tuberculosis H37Rv
cguccacgcugaccaacg

SEQ ID NO: 3338186 - RNA, 20 nt, Mycobacterium tuberculosis H37Rv
cguccagauagugcuccacg

SEQ ID NO: 3338187 - RNA, 14 nt, Mycobacterium tuberculosis H37Rv
cguccagcaggacg

SEQ ID NO: 3338188 - RNA, 22 nt, Mycobacterium tuberculosis H37Rv
cguccagcaggacggugaagca

SEQ ID NO: 3338189 - RNA, 19 nt, Mycobacterium tuberculosis H37Rv
cguccagcccagauccagc

SEQ ID NO: 3338190 - RNA, 21 nt, Mycobacterium tuberculosis H37Rv
cguccagcccguccaggcgcu

SEQ ID NO: 3338191 - RNA, 17 nt, Mycobacterium tuberculosis H37Rv
cguccagccguggcggc

SEQ ID NO: 3338192 - RNA, 18 nt, Mycobacterium tuberculosis H37Rv
cguccagcgcggccuugg

SEQ ID NO: 3338193 - RNA, 18 nt, Mycobacterium tuberculosis H37Rv
cguccaggcgcugcagca

SEQ ID NO: 3338194 - RNA, 21 nt, Mycobacterium tuberculosis H37Rv
cguccagggauuaccagugga

SEQ ID NO: 3338195 - RNA, 13 nt, Mycobacterium tuberculosis H37Rv
cguccagggcgcc

SEQ ID NO: 3338196 - RNA, 17 nt, Mycobacterium tuberculosis H37Rv
cguccaguccgaucacc

SEQ ID NO: 3338197 - RNA, 21 nt, Mycobacterium tuberculosis H37Rv
cguccaguggcagccagcggc

SEQ ID NO: 3338198 - RNA, 22 nt, Mycobacterium tuberculosis H37Rv
cguccaguggcagccagcggcg

SEQ ID NO: 3338199 - RNA, 22 nt, Mycobacterium tuberculosis H37Rv
cguccaucagagacagcagcgu

SEQ ID NO: 3338200 - RNA, 18 nt, Mycobacterium tuberculosis H37Rv
cguccaucccggcgccgc

SEQ ID NO: 3338201 - RNA, 13 nt, Mycobacterium tuberculosis H37Rv
cguccaucgccac

SEQ ID NO: 3338202 - RNA, 16 nt, Mycobacterium tuberculosis H37Rv
cguccaucgcgcgccg

SEQ ID NO: 3338203 - RNA, 15 nt, Mycobacterium tuberculosis H37Rv
cguccaucucggacc

SEQ ID NO: 3338204 - RNA, 12 nt, Mycobacterium tuberculosis H37Rv
cgucccagaagu

SEQ ID NO: 3338205 - RNA, 13 nt, Mycobacterium tuberculosis H37Rv
cgucccagaaguc

SEQ ID NO: 3338206 - RNA, 19 nt, Mycobacterium tuberculosis H37Rv
cgucccagagaaucagcgu

SEQ ID NO: 3338207 - RNA, 17 nt, Mycobacterium tuberculosis H37Rv
cgucccagccgaucacg

SEQ ID NO: 3338208 - RNA, 16 nt, Mycobacterium tuberculosis H37Rv
cgucccagcgcggugu

SEQ ID NO: 3338209 - RNA, 23 nt, Mycobacterium tuberculosis H37Rv
cgucccagcgguagccgagcucg

SEQ ID NO: 3338210 - RNA, 21 nt, Mycobacterium tuberculosis H37Rv
cgucccaggacuccggccgca

SEQ ID NO: 3338211 - RNA, 21 nt, Mycobacterium tuberculosis H37Rv
cgucccaguguucgacgaggu

SEQ ID NO: 3338212 - RNA, 14 nt, Mycobacterium tuberculosis H37Rv
cguccccaccgacg

SEQ ID NO: 3338213 - RNA, 19 nt, Mycobacterium tuberculosis H37Rv
cguccccagaccggcggcu

SEQ ID NO: 3338214 - RNA, 12 nt, Mycobacterium tuberculosis H37Rv
cguccccgacgu

SEQ ID NO: 3338215 - RNA, 17 nt, Mycobacterium tuberculosis H37Rv
cguccccgccgccguuc

SEQ ID NO: 3338216 - RNA, 23 nt, Mycobacterium tuberculosis H37Rv
cguccccgccgucgccaccaucg

SEQ ID NO: 3338217 - RNA, 14 nt, Mycobacterium tuberculosis H37Rv
cguccccggccgau

SEQ ID NO: 3338218 - RNA, 19 nt, Mycobacterium tuberculosis H37Rv
cgucccgaaccgaucauca

SEQ ID NO: 3338219 - RNA, 14 nt, Mycobacterium tuberculosis H37Rv
cgucccgagcccgu

SEQ ID NO: 3338220 - RNA, 17 nt, Mycobacterium tuberculosis H37Rv
cgucccgcccggaugcg

SEQ ID NO: 3338221 - RNA, 15 nt, Mycobacterium tuberculosis H37Rv
cgucccgccggcccc

SEQ ID NO: 3338222 - RNA, 17 nt, Mycobacterium tuberculosis H37Rv
cgucccgccggccccgc

SEQ ID NO: 3338223 - RNA, 20 nt, Mycobacterium tuberculosis H37Rv
cgucccgccggccccgccga

SEQ ID NO: 3338224 - RNA, 22 nt, Mycobacterium tuberculosis H37Rv
cgucccgcgagcagcccggcga

SEQ ID NO: 3338225 - RNA, 17 nt, Mycobacterium tuberculosis H37Rv
cgucccggaaaaaguca

SEQ ID NO: 3338226 - RNA, 15 nt, Mycobacterium tuberculosis H37Rv
cgucccggcgaccgg

SEQ ID NO: 3338227 - RNA, 16 nt, Mycobacterium tuberculosis H37Rv
cgucccggcucgagcu

SEQ ID NO: 3338228 - RNA, 15 nt, Mycobacterium tuberculosis H37Rv
cgucccgguugacgc

SEQ ID NO: 3338229 - RNA, 20 nt, Mycobacterium tuberculosis H37Rv
cguccgaccgauaacacccg

SEQ ID NO: 3338230 - RNA, 21 nt, Mycobacterium tuberculosis H37Rv
cguccgaccgauaacacccgg

SEQ ID NO: 3338231 - RNA, 14 nt, Mycobacterium tuberculosis H37Rv
cguccgacggcgga

SEQ ID NO: 3338232 - RNA, 15 nt, Mycobacterium tuberculosis H37Rv
cguccgaucggcgcg

SEQ ID NO: 3338233 - RNA, 16 nt, Mycobacterium tuberculosis H37Rv
cguccgaucggcgcgc

SEQ ID NO: 3338234 - RNA, 15 nt, Mycobacterium tuberculosis H37Rv
cguccgcccagcacc

SEQ ID NO: 3338235 - RNA, 17 nt, Mycobacterium tuberculosis H37Rv
cguccgcccagccgcag

SEQ ID NO: 3338236 - RNA, 20 nt, Mycobacterium tuberculosis H37Rv
cguccgcccagccgcagcac

SEQ ID NO: 3338237 - RNA, 15 nt, Mycobacterium tuberculosis H37Rv
cguccgccgcagacg

SEQ ID NO: 3338238 - RNA, 14 nt, Mycobacterium tuberculosis H37Rv
cguccgccgcagcg

SEQ ID NO: 3338239 - RNA, 15 nt, Mycobacterium tuberculosis H37Rv
cguccgccugcaccg

SEQ ID NO: 3338240 - RNA, 18 nt, Mycobacterium tuberculosis H37Rv
cguccgccugcaccgccg

SEQ ID NO: 3338241 - RNA, 18 nt, Mycobacterium tuberculosis H37Rv
cguccgcgaucugcagcg

SEQ ID NO: 3338242 - RNA, 22 nt, Mycobacterium tuberculosis H37Rv
cguccgcggacuuggcggucgg

SEQ ID NO: 3338243 - RNA, 16 nt, Mycobacterium tuberculosis H37Rv
cguccgcggagcucaa

SEQ ID NO: 3338244 - RNA, 18 nt, Mycobacterium tuberculosis H37Rv
cguccgcgggcggaggcc

SEQ ID NO: 3338245 - RNA, 21 nt, Mycobacterium tuberculosis H37Rv
cguccgcgggcggaggccgcc

SEQ ID NO: 3338246 - RNA, 21 nt, Mycobacterium tuberculosis H37Rv
cguccgcgggggaccgcccga

SEQ ID NO: 3338247 - RNA, 17 nt, Mycobacterium tuberculosis H37Rv
cguccgcggucgcagca

SEQ ID NO: 3338248 - RNA, 18 nt, Mycobacterium tuberculosis H37Rv
cguccgcggucgcagcag

SEQ ID NO: 3338249 - RNA, 14 nt, Mycobacterium tuberculosis H37Rv
cguccgcgguguug

SEQ ID NO: 3338250 - RNA, 19 nt, Mycobacterium tuberculosis H37Rv
cguccgcugacccgccaau

SEQ ID NO: 3338251 - RNA, 21 nt, Mycobacterium tuberculosis H37Rv
cguccgcugcagguccagggu

SEQ ID NO: 3338252 - RNA, 17 nt, Mycobacterium tuberculosis H37Rv
cguccggccacgguccg

SEQ ID NO: 3338253 - RNA, 12 nt, Mycobacterium tuberculosis H37Rv
cguccggcgaug

SEQ ID NO: 3338254 - RNA, 21 nt, Mycobacterium tuberculosis H37Rv
cguccggcgcccacaucgucg

SEQ ID NO: 3338255 - RNA, 17 nt, Mycobacterium tuberculosis H37Rv
cguccggcgccugcugc

SEQ ID NO: 3338256 - RNA, 16 nt, Mycobacterium tuberculosis H37Rv
cguccgggaucucccc

SEQ ID NO: 3338257 - RNA, 18 nt, Mycobacterium tuberculosis H37Rv
cguccgggcggccucccg

SEQ ID NO: 3338258 - RNA, 20 nt, Mycobacterium tuberculosis H37Rv
cguccgggcggccucccggg

SEQ ID NO: 3338259 - RNA, 15 nt, Mycobacterium tuberculosis H37Rv
cguccgggcucgcgc

SEQ ID NO: 3338260 - RNA, 16 nt, Mycobacterium tuberculosis H37Rv
cguccgggucaccagc

SEQ ID NO: 3338261 - RNA, 20 nt, Mycobacterium tuberculosis H37Rv
cguccgggucgacgcgauga

SEQ ID NO: 3338262 - RNA, 16 nt, Mycobacterium tuberculosis H37Rv
cguccgguccgucggg

SEQ ID NO: 3338263 - RNA, 18 nt, Mycobacterium tuberculosis H37Rv
cguccggucgccucaccg

SEQ ID NO: 3338264 - RNA, 20 nt, Mycobacterium tuberculosis H37Rv
cguccggucgccucaccggc

SEQ ID NO: 3338265 - RNA, 16 nt, Mycobacterium tuberculosis H37Rv
cguccgguggaccgcc

SEQ ID NO: 3338266 - RNA, 18 nt, Mycobacterium tuberculosis H37Rv
cguccgguggaccgccga

SEQ ID NO: 3338267 - RNA, 17 nt, Mycobacterium tuberculosis H37Rv
cguccuagcgugccgcc

SEQ ID NO: 3338268 - RNA, 20 nt, Mycobacterium tuberculosis H37Rv
cguccuccccuacugcguug

SEQ ID NO: 3338269 - RNA, 14 nt, Mycobacterium tuberculosis H37Rv
cguccucgacccgg

SEQ ID NO: 3338270 - RNA, 15 nt, Mycobacterium tuberculosis H37Rv
cguccucgacccggc

SEQ ID NO: 3338271 - RNA, 20 nt, Mycobacterium tuberculosis H37Rv
cguccucggucacgaucacg

SEQ ID NO: 3338272 - RNA, 21 nt, Mycobacterium tuberculosis H37Rv
cguccugaaucgguucggcca

SEQ ID NO: 3338273 - RNA, 21 nt, Mycobacterium tuberculosis H37Rv
cguccugacgguacagcucca

SEQ ID NO: 3338274 - RNA, 18 nt, Mycobacterium tuberculosis H37Rv
cguccugccaguccgcag

SEQ ID NO: 3338275 - RNA, 21 nt, Mycobacterium tuberculosis H37Rv
cguccuggugagauugguggc

SEQ ID NO: 3338276 - RNA, 15 nt, Mycobacterium tuberculosis H37Rv
cguccuucgcuggua

SEQ ID NO: 3338277 - RNA, 14 nt, Mycobacterium tuberculosis H37Rv
cguccuuuccagga

SEQ ID NO: 3338278 - RNA, 16 nt, Mycobacterium tuberculosis H37Rv
cgucgauggucuccgg

SEQ ID NO: 3338279 - RNA, 17 nt, Mycobacterium tuberculosis H37Rv
cgucgauggugcggccc

SEQ ID NO: 3338280 - RNA, 19 nt, Mycobacterium tuberculosis H37Rv
cgucgauguauccgaugcg

SEQ ID NO: 3338281 - RNA, 14 nt, Mycobacterium tuberculosis H37Rv
cgucgaugucgacg

SEQ ID NO: 3338282 - RNA, 14 nt, Mycobacterium tuberculosis H37Rv
cgucgaugucgucg

SEQ ID NO: 3338283 - RNA, 21 nt, Mycobacterium tuberculosis H37Rv
cgucgauguggcgcuccggcg

SEQ ID NO: 3338284 - RNA, 20 nt, Mycobacterium tuberculosis H37Rv
cgucgauuagcccacccaug

SEQ ID NO: 3338285 - RNA, 16 nt, Mycobacterium tuberculosis H37Rv
cgucgauuucgacgac

SEQ ID NO: 3338286 - RNA, 13 nt, Mycobacterium tuberculosis H37Rv
cgucgcaaacaga

SEQ ID NO: 3338287 - RNA, 19 nt, Mycobacterium tuberculosis H37Rv
cgucgcaaacuucgcgcac

SEQ ID NO: 3338288 - RNA, 22 nt, Mycobacterium tuberculosis H37Rv
cgucgcaacguguccgcagucc

SEQ ID NO: 3338289 - RNA, 21 nt, Mycobacterium tuberculosis H37Rv
cgucgcaauaugccacagacc

SEQ ID NO: 3338290 - RNA, 13 nt, Mycobacterium tuberculosis H37Rv
cgucgcaccagcg

SEQ ID NO: 3338291 - RNA, 23 nt, Mycobacterium tuberculosis H37Rv
cgucgcacccaacuccaucagcg

SEQ ID NO: 3338292 - RNA, 20 nt, Mycobacterium tuberculosis H37Rv
cgucgcagaaaccauucggc

SEQ ID NO: 3338293 - RNA, 18 nt, Mycobacterium tuberculosis H37Rv
cgucgcaguauucacagu

SEQ ID NO: 3338294 - RNA, 23 nt, Mycobacterium tuberculosis H37Rv
cgucgcauacgcccacuccagca

SEQ ID NO: 3338295 - RNA, 15 nt, Mycobacterium tuberculosis H37Rv
cgucgcaucaccagg

SEQ ID NO: 3338296 - RNA, 16 nt, Mycobacterium tuberculosis H37Rv
cgucgcaucaccaggg

SEQ ID NO: 3338297 - RNA, 17 nt, Mycobacterium tuberculosis H37Rv
cgucgccaagcccaggc

SEQ ID NO: 3338298 - RNA, 22 nt, Mycobacterium tuberculosis H37Rv
cgucgccaagcccaggcgaucg

SEQ ID NO: 3338299 - RNA, 21 nt, Mycobacterium tuberculosis H37Rv
cgucgccaccagagucaacau

SEQ ID NO: 3338300 - RNA, 12 nt, Mycobacterium tuberculosis H37Rv
cgucgccaccga

SEQ ID NO: 3338301 - RNA, 14 nt, Mycobacterium tuberculosis H37Rv
cgucgccaccgaug

SEQ ID NO: 3338302 - RNA, 14 nt, Mycobacterium tuberculosis H37Rv
cgucgccaccggua

SEQ ID NO: 3338303 - RNA, 15 nt, Mycobacterium tuberculosis H37Rv
cgucgccaccgguac

SEQ ID NO: 3338304 - RNA, 13 nt, Mycobacterium tuberculosis H37Rv
cgucgccaugcug

SEQ ID NO: 3338305 - RNA, 23 nt, Mycobacterium tuberculosis H37Rv
cgucgccauuccaucgcgcaccg

SEQ ID NO: 3338306 - RNA, 14 nt, Mycobacterium tuberculosis H37Rv
cgucgcccagcgug

SEQ ID NO: 3338307 - RNA, 17 nt, Mycobacterium tuberculosis H37Rv
cgucgccccguuucggu

SEQ ID NO: 3338308 - RNA, 23 nt, Mycobacterium tuberculosis H37Rv
cgucgccgaaguuccagccgacg

SEQ ID NO: 3338309 - RNA, 18 nt, Mycobacterium tuberculosis H37Rv
cgucgccgacccgggggc

SEQ ID NO: 3338310 - RNA, 16 nt, Mycobacterium tuberculosis H37Rv
cgucgccgaccgucac

SEQ ID NO: 3338311 - RNA, 13 nt, Mycobacterium tuberculosis H37Rv
cgucgccgacggu

SEQ ID NO: 3338312 - RNA, 13 nt, Mycobacterium tuberculosis H37Rv
cgucgccgccgaa

SEQ ID NO: 3338313 - RNA, 14 nt, Mycobacterium tuberculosis H37Rv
cgucgccgccgcua

SEQ ID NO: 3338314 - RNA, 21 nt, Mycobacterium tuberculosis H37Rv
cgucgccgccgcuaccgccgg

SEQ ID NO: 3338315 - RNA, 18 nt, Mycobacterium tuberculosis H37Rv
cgucgccgccggcgccgc

SEQ ID NO: 3338316 - RNA, 18 nt, Mycobacterium tuberculosis H37Rv
cgucgccgccgggcagug

SEQ ID NO: 3338317 - RNA, 14 nt, Mycobacterium tuberculosis H37Rv
cgucgccgccguug

SEQ ID NO: 3338318 - RNA, 21 nt, Mycobacterium tuberculosis H37Rv
cgucgccgccguugccgccag

SEQ ID NO: 3338319 - RNA, 14 nt, Mycobacterium tuberculosis H37Rv
cgucgccgcggcgg

SEQ ID NO: 3338320 - RNA, 16 nt, Mycobacterium tuberculosis H37Rv
cgucgccgcggcggca

SEQ ID NO: 3338321 - RNA, 19 nt, Mycobacterium tuberculosis H37Rv
cgucgccgcggcggcagcg

SEQ ID NO: 3338322 - RNA, 15 nt, Mycobacterium tuberculosis H37Rv
cgucgccgcgguaga

SEQ ID NO: 3338323 - RNA, 15 nt, Mycobacterium tuberculosis H37Rv
cgucgccggacgaca

SEQ ID NO: 3338324 - RNA, 13 nt, Mycobacterium tuberculosis H37Rv
cgucgccggcccc

SEQ ID NO: 3338325 - RNA, 13 nt, Mycobacterium tuberculosis H37Rv
cgucgccggcggc

SEQ ID NO: 3338326 - RNA, 15 nt, Mycobacterium tuberculosis H37Rv
cgucgccgucggugc

SEQ ID NO: 3338327 - RNA, 17 nt, Mycobacterium tuberculosis H37Rv
cgucgccguuggagacg

SEQ ID NO: 3338328 - RNA, 20 nt, Mycobacterium tuberculosis H37Rv
cgucgccucgauaucgucgg

SEQ ID NO: 3338329 - RNA, 13 nt, Mycobacterium tuberculosis H37Rv
cgucgccugcgac

SEQ ID NO: 3338330 - RNA, 17 nt, Mycobacterium tuberculosis H37Rv
cgucgccuucggguucg

SEQ ID NO: 3338331 - RNA, 18 nt, Mycobacterium tuberculosis H37Rv
cgucgcgaaucugcgcga

SEQ ID NO: 3338332 - RNA, 14 nt, Mycobacterium tuberculosis H37Rv
cgucgcgacgucgg

SEQ ID NO: 3338333 - RNA, 18 nt, Mycobacterium tuberculosis H37Rv
cgucgcgcgccuuggcca

SEQ ID NO: 3338334 - RNA, 16 nt, Mycobacterium tuberculosis H37Rv
cgucgcgcucgcacca

SEQ ID NO: 3338335 - RNA, 19 nt, Mycobacterium tuberculosis H37Rv
cgucgcgcucgcaccacca

SEQ ID NO: 3338336 - RNA, 15 nt, Mycobacterium tuberculosis H37Rv
cgucgcgcugccggc

SEQ ID NO: 3338337 - RNA, 16 nt, Mycobacterium tuberculosis H37Rv
cgucgcgcugccggcc

SEQ ID NO: 3338338 - RNA, 16 nt, Mycobacterium tuberculosis H37Rv
cgucgcggaaucgcga

SEQ ID NO: 3338339 - RNA, 16 nt, Mycobacterium tuberculosis H37Rv
cgucgcggaguagccg

SEQ ID NO: 3338340 - RNA, 20 nt, Mycobacterium tuberculosis H37Rv
cgucgcggaguagccgcagc

SEQ ID NO: 3338341 - RNA, 16 nt, Mycobacterium tuberculosis H37Rv
cgucgcggaucagccc

SEQ ID NO: 3338342 - RNA, 23 nt, Mycobacterium tuberculosis H37Rv
cgucgcggaucagcccgcgcagc

SEQ ID NO: 3338343 - RNA, 13 nt, Mycobacterium tuberculosis H37Rv
cgucgcggaucug

SEQ ID NO: 3338344 - RNA, 16 nt, Mycobacterium tuberculosis H37Rv
cgucgcggcacgccca

SEQ ID NO: 3338345 - RNA, 18 nt, Mycobacterium tuberculosis H37Rv
cgucgcggccacggucag

SEQ ID NO: 3338346 - RNA, 19 nt, Mycobacterium tuberculosis H37Rv
cgucgcggccacggucagc

SEQ ID NO: 3338347 - RNA, 15 nt, Mycobacterium tuberculosis H37Rv
cgucgcggccagcag

SEQ ID NO: 3338348 - RNA, 16 nt, Mycobacterium tuberculosis H37Rv
cgucgcggccagcagg

SEQ ID NO: 3338349 - RNA, 18 nt, Mycobacterium tuberculosis H37Rv
cgucgcggccgagacggc

SEQ ID NO: 3338350 - RNA, 19 nt, Mycobacterium tuberculosis H37Rv
cgucgcggccgagacggcg

SEQ ID NO: 3338351 - RNA, 22 nt, Mycobacterium tuberculosis H37Rv
cgucgcggccgagacggcguug

SEQ ID NO: 3338352 - RNA, 17 nt, Mycobacterium tuberculosis H37Rv
cgucgcggccggcggcc

SEQ ID NO: 3338353 - RNA, 15 nt, Mycobacterium tuberculosis H37Rv
cgucgcggcgccuga

SEQ ID NO: 3338354 - RNA, 15 nt, Mycobacterium tuberculosis H37Rv
cgucgcggcggcacu

SEQ ID NO: 3338355 - RNA, 19 nt, Mycobacterium tuberculosis H37Rv
cgucgcgggauugcgcgcu

SEQ ID NO: 3338356 - RNA, 16 nt, Mycobacterium tuberculosis H37Rv
cgucgcggguccaggc

SEQ ID NO: 3338357 - RNA, 20 nt, Mycobacterium tuberculosis H37Rv
cgucgcggguccaggcguug

SEQ ID NO: 3338358 - RNA, 12 nt, Mycobacterium tuberculosis H37Rv
cgucgcgguagg

SEQ ID NO: 3338359 - RNA, 23 nt, Mycobacterium tuberculosis H37Rv
cgucgcgguuguggcugaucccg

SEQ ID NO: 3338360 - RNA, 18 nt, Mycobacterium tuberculosis H37Rv
cgucgcguccgcgaucug

SEQ ID NO: 3338361 - RNA, 18 nt, Mycobacterium tuberculosis H37Rv
cgucgcgugggaugucga

SEQ ID NO: 3338362 - RNA, 22 nt, Mycobacterium tuberculosis H37Rv
cgucgcguuggcgguagacacc

SEQ ID NO: 3338363 - RNA, 15 nt, Mycobacterium tuberculosis H37Rv
cgucgcuagauccca

SEQ ID NO: 3338364 - RNA, 16 nt, Mycobacterium tuberculosis H37Rv
cgucgcuagaucccag

SEQ ID NO: 3338365 - RNA, 18 nt, Mycobacterium tuberculosis H37Rv
cgucgcuaugcgccgcau

SEQ ID NO: 3338366 - RNA, 14 nt, Mycobacterium tuberculosis H37Rv
cgucgcucacggcc

SEQ ID NO: 3338367 - RNA, 22 nt, Mycobacterium tuberculosis H37Rv
cgucgcucacggcccgagccgc

SEQ ID NO: 3338368 - RNA, 14 nt, Mycobacterium tuberculosis H37Rv
cgucgcugacgccc

SEQ ID NO: 3338369 - RNA, 18 nt, Mycobacterium tuberculosis H37Rv
cgucgcugcccgcgcggc

SEQ ID NO: 3338370 - RNA, 22 nt, Mycobacterium tuberculosis H37Rv
cgucgcuggugggaucgcagcg

SEQ ID NO: 3338371 - RNA, 20 nt, Mycobacterium tuberculosis H37Rv
cgucgcuguaggccagcccg

SEQ ID NO: 3338372 - RNA, 20 nt, Mycobacterium tuberculosis H37Rv
cgucgcuucggcaccgacug

SEQ ID NO: 3338373 - RNA, 21 nt, Mycobacterium tuberculosis H37Rv
cgucgcuucggcaccgacugc

SEQ ID NO: 3338374 - RNA, 18 nt, Mycobacterium tuberculosis H37Rv
cgucgucccagcgcggug

SEQ ID NO: 3338375 - RNA, 16 nt, Mycobacterium tuberculosis H37Rv
cgucgucccagggcug

SEQ ID NO: 3338376 - RNA, 15 nt, Mycobacterium tuberculosis H37Rv
cgucguccgacgggc

SEQ ID NO: 3338377 - RNA, 18 nt, Mycobacterium tuberculosis H37Rv
cgucguccgacgggccgu

SEQ ID NO: 3338378 - RNA, 20 nt, Mycobacterium tuberculosis H37Rv
cgucguccgacgggccgucg

SEQ ID NO: 3338379 - RNA, 23 nt, Mycobacterium tuberculosis H37Rv
cgucguccgcgccaguggccacc

SEQ ID NO: 3338380 - RNA, 19 nt, Mycobacterium tuberculosis H37Rv
cgucguccggccacggucc

SEQ ID NO: 3338381 - RNA, 15 nt, Mycobacterium tuberculosis H37Rv
cgucguccuguccgg

SEQ ID NO: 3338382 - RNA, 17 nt, Mycobacterium tuberculosis H37Rv
cgucgucgacacgguga

SEQ ID NO: 3338383 - RNA, 19 nt, Mycobacterium tuberculosis H37Rv
cgucgucgacacggugauc

SEQ ID NO: 3338384 - RNA, 15 nt, Mycobacterium tuberculosis H37Rv
cgucgucgaccacga

SEQ ID NO: 3338385 - RNA, 21 nt, Mycobacterium tuberculosis H37Rv
cgucgucgaccacgacguucg

SEQ ID NO: 3338386 - RNA, 20 nt, Mycobacterium tuberculosis H37Rv
cgucgucgagauagccgacg

SEQ ID NO: 3338387 - RNA, 13 nt, Mycobacterium tuberculosis H37Rv
cgucgucgaucca

SEQ ID NO: 3338388 - RNA, 17 nt, Mycobacterium tuberculosis H37Rv
cgucgucgauccagccc

SEQ ID NO: 3338389 - RNA, 17 nt, Mycobacterium tuberculosis H37Rv
cgucgucgccgucggug

SEQ ID NO: 3338390 - RNA, 23 nt, Mycobacterium tuberculosis H37Rv
cgucgucgccgucggugccgccg

SEQ ID NO: 3338391 - RNA, 14 nt, Mycobacterium tuberculosis H37Rv
cgucgucgcggccg

SEQ ID NO: 3338392 - RNA, 19 nt, Mycobacterium tuberculosis H37Rv
cgucgucggaaucggaguc

SEQ ID NO: 3338393 - RNA, 15 nt, Mycobacterium tuberculosis H37Rv
cgucgucggcaggca

SEQ ID NO: 3338394 - RNA, 14 nt, Mycobacterium tuberculosis H37Rv
cgucgucggguucg

SEQ ID NO: 3338395 - RNA, 14 nt, Mycobacterium tuberculosis H37Rv
cgucgucgucgacg

SEQ ID NO: 3338396 - RNA, 18 nt, Mycobacterium tuberculosis H37Rv
cgucgucguuucgccagc

SEQ ID NO: 3338397 - RNA, 15 nt, Mycobacterium tuberculosis H37Rv
cgucgugaucggcga

SEQ ID NO: 3338398 - RNA, 13 nt, Mycobacterium tuberculosis H37Rv
cgucgugauguca

SEQ ID NO: 3338399 - RNA, 15 nt, Mycobacterium tuberculosis H37Rv
cgucgugcaccucgu

SEQ ID NO: 3338400 - RNA, 14 nt, Mycobacterium tuberculosis H37Rv
cgucgugcacgacg

SEQ ID NO: 3338401 - RNA, 19 nt, Mycobacterium tuberculosis H37Rv
cgucgugcacgacgacauc

SEQ ID NO: 3338402 - RNA, 14 nt, Mycobacterium tuberculosis H37Rv
cgucgugcacggcg

SEQ ID NO: 3338403 - RNA, 19 nt, Mycobacterium tuberculosis H37Rv
cgucgugcacggcggccag

SEQ ID NO: 3338404 - RNA, 15 nt, Mycobacterium tuberculosis H37Rv
cgucguggagcucac

SEQ ID NO: 3338405 - RNA, 21 nt, Mycobacterium tuberculosis H37Rv
cgucguggaucuucgcgcugu

SEQ ID NO: 3338406 - RNA, 18 nt, Mycobacterium tuberculosis H37Rv
cgucguggcgcucggcga

SEQ ID NO: 3338407 - RNA, 20 nt, Mycobacterium tuberculosis H37Rv
cgucguggcgguggccgucg

SEQ ID NO: 3338408 - RNA, 14 nt, Mycobacterium tuberculosis H37Rv
cgucgugguagcgc

SEQ ID NO: 3338409 - RNA, 17 nt, Mycobacterium tuberculosis H37Rv
cgucgugucgccgccgu

SEQ ID NO: 3338410 - RNA, 18 nt, Mycobacterium tuberculosis H37Rv
cgucguguggggcgggaa

SEQ ID NO: 3338411 - RNA, 19 nt, Mycobacterium tuberculosis H37Rv
cgucgugugguucacucuc

SEQ ID NO: 3338412 - RNA, 20 nt, Mycobacterium tuberculosis H37Rv
cgucguucgagaccccgacg

SEQ ID NO: 3338413 - RNA, 16 nt, Mycobacterium tuberculosis H37Rv
cgucguucgcgggugc

SEQ ID NO: 3338414 - RNA, 22 nt, Mycobacterium tuberculosis H37Rv
cgucguucuccauccgcacugc

SEQ ID NO: 3338415 - RNA, 18 nt, Mycobacterium tuberculosis H37Rv
cgucguugaggaagcccg

SEQ ID NO: 3338416 - RNA, 19 nt, Mycobacterium tuberculosis H37Rv
cgucguugaggaagcccga

SEQ ID NO: 3338417 - RNA, 18 nt, Mycobacterium tuberculosis H37Rv
cgucguugcccgacccgc

SEQ ID NO: 3338418 - RNA, 17 nt, Mycobacterium tuberculosis H37Rv
cgucguugcucggucuc

SEQ ID NO: 3338419 - RNA, 19 nt, Mycobacterium tuberculosis H37Rv
cgucguugggauccggugg

SEQ ID NO: 3338420 - RNA, 21 nt, Mycobacterium tuberculosis H37Rv
cgucguugggcaugucgccga

SEQ ID NO: 3338421 - RNA, 14 nt, Mycobacterium tuberculosis H37Rv
cgucguugucgucg

SEQ ID NO: 3338422 - RNA, 15 nt, Mycobacterium tuberculosis H37Rv
cgucguuucgccagc

SEQ ID NO: 3338423 - RNA, 17 nt, Mycobacterium tuberculosis H37Rv
cgucuaccccgagccuu

SEQ ID NO: 3338424 - RNA, 18 nt, Mycobacterium tuberculosis H37Rv
cgucuaccccgagccuug

SEQ ID NO: 3338425 - RNA, 13 nt, Mycobacterium tuberculosis H37Rv
cgucuagcccgcc

SEQ ID NO: 3338426 - RNA, 17 nt, Mycobacterium tuberculosis H37Rv
cgucuaucuggucgggu

SEQ ID NO: 3338427 - RNA, 15 nt, Mycobacterium tuberculosis H37Rv
cgucuccaccgcgau

SEQ ID NO: 3338428 - RNA, 13 nt, Mycobacterium tuberculosis H37Rv
cgucuccggcgcc

SEQ ID NO: 3338429 - RNA, 18 nt, Mycobacterium tuberculosis H37Rv
cgucuccggcgccaccgc

SEQ ID NO: 3338430 - RNA, 21 nt, Mycobacterium tuberculosis H37Rv
cgucuccggcgccaccgccgc

SEQ ID NO: 3338431 - RNA, 21 nt, Mycobacterium tuberculosis H37Rv
cgucuccuguggggauuccgc

SEQ ID NO: 3338432 - RNA, 17 nt, Mycobacterium tuberculosis H37Rv
cgucucgaagcucagcu

SEQ ID NO: 3338433 - RNA, 18 nt, Mycobacterium tuberculosis H37Rv
cgucucgagcgcgccgcg

SEQ ID NO: 3338434 - RNA, 13 nt, Mycobacterium tuberculosis H37Rv
cgucucgcaccgc

SEQ ID NO: 3338435 - RNA, 14 nt, Mycobacterium tuberculosis H37Rv
cgucucgcccccuc

SEQ ID NO: 3338436 - RNA, 13 nt, Mycobacterium tuberculosis H37Rv
cgucucgcggugc

SEQ ID NO: 3338437 - RNA, 19 nt, Mycobacterium tuberculosis H37Rv
cgucucgcggugcggcaac

SEQ ID NO: 3338438 - RNA, 22 nt, Mycobacterium tuberculosis H37Rv
cgucucgcggugcggcaacagc

SEQ ID NO: 3338439 - RNA, 13 nt, Mycobacterium tuberculosis H37Rv
cgucucggugauc

SEQ ID NO: 3338440 - RNA, 15 nt, Mycobacterium tuberculosis H37Rv
cgucucggugaucuc

SEQ ID NO: 3338441 - RNA, 18 nt, Mycobacterium tuberculosis H37Rv
cgucucggugcagcagcg

SEQ ID NO: 3338442 - RNA, 16 nt, Mycobacterium tuberculosis H37Rv
cgucucgguggcugcg

SEQ ID NO: 3338443 - RNA, 14 nt, Mycobacterium tuberculosis H37Rv
cgucucggugguga

SEQ ID NO: 3338444 - RNA, 15 nt, Mycobacterium tuberculosis H37Rv
cgucugacaucgucg

SEQ ID NO: 3338445 - RNA, 20 nt, Mycobacterium tuberculosis H37Rv
cgucugcacguacucggcca

SEQ ID NO: 3338446 - RNA, 24 nt, Mycobacterium tuberculosis H37Rv
cgucugcacguacucggccagcuc

SEQ ID NO: 3338447 - RNA, 22 nt, Mycobacterium tuberculosis H37Rv
cgucugccacgucggcgaacgg

SEQ ID NO: 3338448 - RNA, 14 nt, Mycobacterium tuberculosis H37Rv
cgucugccaggcgc

SEQ ID NO: 3338449 - RNA, 15 nt, Mycobacterium tuberculosis H37Rv
cgucugcccgcccag

SEQ ID NO: 3338450 - RNA, 16 nt, Mycobacterium tuberculosis H37Rv
cgucugcccgcccagc

SEQ ID NO: 3338451 - RNA, 17 nt, Mycobacterium tuberculosis H37Rv
cgucugcccgcccagcc

SEQ ID NO: 3338452 - RNA, 18 nt, Mycobacterium tuberculosis H37Rv
cgucugcccgcccagccc

SEQ ID NO: 3338453 - RNA, 20 nt, Mycobacterium tuberculosis H37Rv
cgucugcggaccggcgcgcu

SEQ ID NO: 3338454 - RNA, 16 nt, Mycobacterium tuberculosis H37Rv
cgucugcucacgcggu

SEQ ID NO: 3338455 - RNA, 12 nt, Mycobacterium tuberculosis H37Rv
cgucugcucgcc

SEQ ID NO: 3338456 - RNA, 20 nt, Mycobacterium tuberculosis H37Rv
cgucugcucgccagcggggc

SEQ ID NO: 3338457 - RNA, 13 nt, Mycobacterium tuberculosis H37Rv
cgucugcucgccc

SEQ ID NO: 3338458 - RNA, 16 nt, Mycobacterium tuberculosis H37Rv
cgucugcucgccgggc

SEQ ID NO: 3338459 - RNA, 15 nt, Mycobacterium tuberculosis H37Rv
cgucugcucgcgccg

SEQ ID NO: 3338460 - RNA, 18 nt, Mycobacterium tuberculosis H37Rv
cgucugcucgcgccggug

SEQ ID NO: 3338461 - RNA, 11 nt, Mycobacterium tuberculosis H37Rv
cgucugcucgg

SEQ ID NO: 3338462 - RNA, 15 nt, Mycobacterium tuberculosis H37Rv
cgucugcucggcgcg

SEQ ID NO: 3338463 - RNA, 15 nt, Mycobacterium tuberculosis H37Rv
cgucugcucggcgga

SEQ ID NO: 3338464 - RNA, 15 nt, Mycobacterium tuberculosis H37Rv
cgucugcucggcgua

SEQ ID NO: 3338465 - RNA, 17 nt, Mycobacterium tuberculosis H37Rv
cgucugcuuggcggggc

SEQ ID NO: 3338466 - RNA, 21 nt, Mycobacterium tuberculosis H37Rv
cgucuggaguucgucaccguu

SEQ ID NO: 3338467 - RNA, 14 nt, Mycobacterium tuberculosis H37Rv
cgucuggccgucgc

SEQ ID NO: 3338468 - RNA, 18 nt, Mycobacterium tuberculosis H37Rv
cgucuggccguugcccga

SEQ ID NO: 3338469 - RNA, 22 nt, Mycobacterium tuberculosis H37Rv
cgucuggucagccgcggcggca

SEQ ID NO: 3338470 - RNA, 17 nt, Mycobacterium tuberculosis H37Rv
cgucugguggcagcgca

SEQ ID NO: 3338471 - RNA, 16 nt, Mycobacterium tuberculosis H37Rv
cgugccccaguccgaa

SEQ ID NO: 3338472 - RNA, 15 nt, Mycobacterium tuberculosis H37Rv
cgugcccgccaccgg

SEQ ID NO: 3338473 - RNA, 16 nt, Mycobacterium tuberculosis H37Rv
cgugcccgccaccggc

SEQ ID NO: 3338474 - RNA, 19 nt, Mycobacterium tuberculosis H37Rv
cgugcccgccaccggcgcg

SEQ ID NO: 3338475 - RNA, 15 nt, Mycobacterium tuberculosis H37Rv
cgugcccgguguuca

SEQ ID NO: 3338476 - RNA, 20 nt, Mycobacterium tuberculosis H37Rv
cgugcccguauaaccggcca

SEQ ID NO: 3338477 - RNA, 20 nt, Mycobacterium tuberculosis H37Rv
cgugcccugggugauggccg

SEQ ID NO: 3338478 - RNA, 15 nt, Mycobacterium tuberculosis H37Rv
cgugccgaaaaucgc

SEQ ID NO: 3338479 - RNA, 22 nt, Mycobacterium tuberculosis H37Rv
cgugccgaacacgguguauugg

SEQ ID NO: 3338480 - RNA, 23 nt, Mycobacterium tuberculosis H37Rv
cgugccgaacgccagaccgccga

SEQ ID NO: 3338481 - RNA, 14 nt, Mycobacterium tuberculosis H37Rv
cgugccgaccacca

SEQ ID NO: 3338482 - RNA, 15 nt, Mycobacterium tuberculosis H37Rv
cgugccgaccagcau

SEQ ID NO: 3338483 - RNA, 14 nt, Mycobacterium tuberculosis H37Rv
cgugccgagcgugc

SEQ ID NO: 3338484 - RNA, 12 nt, Mycobacterium tuberculosis H37Rv
cgugccgcacag

SEQ ID NO: 3338485 - RNA, 12 nt, Mycobacterium tuberculosis H37Rv
cgugccgccagc

SEQ ID NO: 3338486 - RNA, 18 nt, Mycobacterium tuberculosis H37Rv
cgugccgcccgccucugu

SEQ ID NO: 3338487 - RNA, 17 nt, Mycobacterium tuberculosis H37Rv
cgugccgcccggucggg

SEQ ID NO: 3338488 - RNA, 21 nt, Mycobacterium tuberculosis H37Rv
cgugccgcccucaccgccugu

SEQ ID NO: 3338489 - RNA, 19 nt, Mycobacterium tuberculosis H37Rv
cgugccgccgacaccaccg

SEQ ID NO: 3338490 - RNA, 17 nt, Mycobacterium tuberculosis H37Rv
cgugccgggcgacgguu

SEQ ID NO: 3338491 - RNA, 14 nt, Mycobacterium tuberculosis H37Rv
cgugccgguccccc

SEQ ID NO: 3338492 - RNA, 20 nt, Mycobacterium tuberculosis H37Rv
cgugccgguggcgccgccgc

SEQ ID NO: 3338493 - RNA, 16 nt, Mycobacterium tuberculosis H37Rv
cgugccucucgggggc

SEQ ID NO: 3338494 - RNA, 17 nt, Mycobacterium tuberculosis H37Rv
cgugccugcuuggccac

SEQ ID NO: 3338495 - RNA, 15 nt, Mycobacterium tuberculosis H37Rv
cgugccuuccucgcc

SEQ ID NO: 3338496 - RNA, 17 nt, Mycobacterium tuberculosis H37Rv
cgugccuugaucugagc

SEQ ID NO: 3338497 - RNA, 21 nt, Mycobacterium tuberculosis H37Rv
cgugccuugaucugagcgcgg

SEQ ID NO: 3338498 - RNA, 24 nt, Mycobacterium tuberculosis H37Rv
cgugcgauucacacucgggcggcu

SEQ ID NO: 3338499 - RNA, 20 nt, Mycobacterium tuberculosis H37Rv
cgugcgauucugcgucugcu

SEQ ID NO: 3338500 - RNA, 18 nt, Mycobacterium tuberculosis H37Rv
cgugcgcacugaggcuca

SEQ ID NO: 3338501 - RNA, 16 nt, Mycobacterium tuberculosis H37Rv
cgugcgcaucagcggu

SEQ ID NO: 3338502 - RNA, 13 nt, Mycobacterium tuberculosis H37Rv
cgugcgcaucccg

SEQ ID NO: 3338503 - RNA, 15 nt, Mycobacterium tuberculosis H37Rv
cgugcgcaucgucga

SEQ ID NO: 3338504 - RNA, 19 nt, Mycobacterium tuberculosis H37Rv
cgugcgccggggacacagc

SEQ ID NO: 3338505 - RNA, 20 nt, Mycobacterium tuberculosis H37Rv
cgugcgccgugcgaucguca

SEQ ID NO: 3338506 - RNA, 15 nt, Mycobacterium tuberculosis H37Rv
cgugcgcgcgcagcu

SEQ ID NO: 3338507 - RNA, 22 nt, Mycobacterium tuberculosis H37Rv
cgugcgcgcgcagcugacguca

SEQ ID NO: 3338508 - RNA, 22 nt, Mycobacterium tuberculosis H37Rv
cgugcgcuuggucgaccgccga

SEQ ID NO: 3338509 - RNA, 18 nt, Mycobacterium tuberculosis H37Rv
cgugcggcacucccuggg

SEQ ID NO: 3338510 - RNA, 21 nt, Mycobacterium tuberculosis H37Rv
cgugcggcgaccgucaaccug

SEQ ID NO: 3338511 - RNA, 17 nt, Mycobacterium tuberculosis H37Rv
cgugcggcgcggcgaca

SEQ ID NO: 3338512 - RNA, 15 nt, Mycobacterium tuberculosis H37Rv
cgugcggcugccagu

SEQ ID NO: 3338513 - RNA, 13 nt, Mycobacterium tuberculosis H37Rv
cgugcgggcgggc

SEQ ID NO: 3338514 - RNA, 14 nt, Mycobacterium tuberculosis H37Rv
cgugcgggcgggcg

SEQ ID NO: 3338515 - RNA, 22 nt, Mycobacterium tuberculosis H37Rv
cgugcggguucacugccggcca

SEQ ID NO: 3338516 - RNA, 15 nt, Mycobacterium tuberculosis H37Rv
cgugcgucgauggcg

SEQ ID NO: 3338517 - RNA, 19 nt, Mycobacterium tuberculosis H37Rv
cgugcgucggcccggugcu

SEQ ID NO: 3338518 - RNA, 16 nt, Mycobacterium tuberculosis H37Rv
cgugcgugcgggggcu

SEQ ID NO: 3338519 - RNA, 20 nt, Mycobacterium tuberculosis H37Rv
cgugcgugggcgcggcgcca

SEQ ID NO: 3338520 - RNA, 20 nt, Mycobacterium tuberculosis H37Rv
cgugcguugucggcuggacg

SEQ ID NO: 3338521 - RNA, 12 nt, Mycobacterium tuberculosis H37Rv
cgugcucaccgg

SEQ ID NO: 3338522 - RNA, 15 nt, Mycobacterium tuberculosis H37Rv
cgugcuccugcccga

SEQ ID NO: 3338523 - RNA, 16 nt, Mycobacterium tuberculosis H37Rv
cgugcucgagcaccuc

SEQ ID NO: 3338524 - RNA, 13 nt, Mycobacterium tuberculosis H37Rv
cgugcucgccgua

SEQ ID NO: 3338525 - RNA, 18 nt, Mycobacterium tuberculosis H37Rv
cgugcucggaggcgauca

SEQ ID NO: 3338526 - RNA, 21 nt, Mycobacterium tuberculosis H37Rv
cgugcucgucguacaugggca

SEQ ID NO: 3338527 - RNA, 12 nt, Mycobacterium tuberculosis H37Rv
cgugcugccauu

SEQ ID NO: 3338528 - RNA, 23 nt, Mycobacterium tuberculosis H37Rv
cgugcugccguauccaggcgugc

SEQ ID NO: 3338529 - RNA, 14 nt, Mycobacterium tuberculosis H37Rv
cgugcuggaacagg

SEQ ID NO: 3338530 - RNA, 15 nt, Mycobacterium tuberculosis H37Rv
cgugcugggccgacg

SEQ ID NO: 3338531 - RNA, 17 nt, Mycobacterium tuberculosis H37Rv
cgugcugggugacaccg

SEQ ID NO: 3338532 - RNA, 17 nt, Mycobacterium tuberculosis H37Rv
cgugcuggugggccgga

SEQ ID NO: 3338533 - RNA, 21 nt, Mycobacterium tuberculosis H37Rv
cgugcuggugguaucggcgug

SEQ ID NO: 3338534 - RNA, 16 nt, Mycobacterium tuberculosis H37Rv
cgugcuguggaugccg

SEQ ID NO: 3338535 - RNA, 18 nt, Mycobacterium tuberculosis H37Rv
cgugcuguggaugccgac

SEQ ID NO: 3338536 - RNA, 20 nt, Mycobacterium tuberculosis H37Rv
cgugcuguuccagcgucugc

SEQ ID NO: 3338537 - RNA, 21 nt, Mycobacterium tuberculosis H37Rv
cgugcuguuguacugcggaug

SEQ ID NO: 3338538 - RNA, 15 nt, Mycobacterium tuberculosis H37Rv
cgugcuugaccgccu

SEQ ID NO: 3338539 - RNA, 18 nt, Mycobacterium tuberculosis H37Rv
cguggaacuccguccgcc

SEQ ID NO: 3338540 - RNA, 14 nt, Mycobacterium tuberculosis H37Rv
cguggaagccgacg

SEQ ID NO: 3338541 - RNA, 20 nt, Mycobacterium tuberculosis H37Rv
cguggaagccgacgaccagc

SEQ ID NO: 3338542 - RNA, 22 nt, Mycobacterium tuberculosis H37Rv
cguggaagccgacgaccagcag

SEQ ID NO: 3338543 - RNA, 15 nt, Mycobacterium tuberculosis H37Rv
cguggacaagcacag

SEQ ID NO: 3338544 - RNA, 17 nt, Mycobacterium tuberculosis H37Rv
cguggacaagcacagcg

SEQ ID NO: 3338545 - RNA, 17 nt, Mycobacterium tuberculosis H37Rv
cguggacuuuggugucg

SEQ ID NO: 3338546 - RNA, 22 nt, Mycobacterium tuberculosis H37Rv
cguggaguggacugagucguag

SEQ ID NO: 3338547 - RNA, 22 nt, Mycobacterium tuberculosis H37Rv
cguggauaacgacugacaacgg

SEQ ID NO: 3338548 - RNA, 16 nt, Mycobacterium tuberculosis H37Rv
cguggaucugccucuc

SEQ ID NO: 3338549 - RNA, 20 nt, Mycobacterium tuberculosis H37Rv
cguggaucugccucucgacc

SEQ ID NO: 3338550 - RNA, 15 nt, Mycobacterium tuberculosis H37Rv
cguggaucuuggcca

SEQ ID NO: 3338551 - RNA, 17 nt, Mycobacterium tuberculosis H37Rv
cguggaucuuggccagc

SEQ ID NO: 3338552 - RNA, 20 nt, Mycobacterium tuberculosis H37Rv
cguggaucuuggccagcagc

SEQ ID NO: 3338553 - RNA, 14 nt, Mycobacterium tuberculosis H37Rv
cguggauggccgcc

SEQ ID NO: 3338554 - RNA, 20 nt, Mycobacterium tuberculosis H37Rv
cguggauggccgccaggcgc

SEQ ID NO: 3338555 - RNA, 14 nt, Mycobacterium tuberculosis H37Rv
cguggaugucgcgg

SEQ ID NO: 3338556 - RNA, 15 nt, Mycobacterium tuberculosis H37Rv
cguggaugucgcggu

SEQ ID NO: 3338557 - RNA, 23 nt, Mycobacterium tuberculosis H37Rv
cguggcagucgcacggugccgcc

SEQ ID NO: 3338558 - RNA, 18 nt, Mycobacterium tuberculosis H37Rv
cguggcagugcaggcggc

SEQ ID NO: 3338559 - RNA, 16 nt, Mycobacterium tuberculosis H37Rv
cguggcaucgccucca

SEQ ID NO: 3338560 - RNA, 16 nt, Mycobacterium tuberculosis H37Rv
cguggccaauccggcg

SEQ ID NO: 3338561 - RNA, 17 nt, Mycobacterium tuberculosis H37Rv
cguggccacggcauucg

SEQ ID NO: 3338562 - RNA, 20 nt, Mycobacterium tuberculosis H37Rv
cguggccccaccgaacgugu

SEQ ID NO: 3338563 - RNA, 17 nt, Mycobacterium tuberculosis H37Rv
cguggcccgcucccugc

SEQ ID NO: 3338564 - RNA, 22 nt, Mycobacterium tuberculosis H37Rv
cguggcccgcucccugcaccca

SEQ ID NO: 3338565 - RNA, 15 nt, Mycobacterium tuberculosis H37Rv
cguggcccuccucgg

SEQ ID NO: 3338566 - RNA, 17 nt, Mycobacterium tuberculosis H37Rv
cguggcccuccucggug

SEQ ID NO: 3338567 - RNA, 19 nt, Mycobacterium tuberculosis H37Rv
cgugucggugaaccaacgc

SEQ ID NO: 3338568 - RNA, 17 nt, Mycobacterium tuberculosis H37Rv
cgugucggugcgcgcag

SEQ ID NO: 3338569 - RNA, 15 nt, Mycobacterium tuberculosis H37Rv
cgugucguugccagg

SEQ ID NO: 3338570 - RNA, 19 nt, Mycobacterium tuberculosis H37Rv
cgugucuggcgaacaguga

SEQ ID NO: 3338571 - RNA, 17 nt, Mycobacterium tuberculosis H37Rv
cgugucuugucgcgcag

SEQ ID NO: 3338572 - RNA, 18 nt, Mycobacterium tuberculosis H37Rv
cgugucuugucgcgcagc

SEQ ID NO: 3338573 - RNA, 23 nt, Mycobacterium tuberculosis H37Rv
cgugucuugucgcgcagcaucuc

SEQ ID NO: 3338574 - RNA, 19 nt, Mycobacterium tuberculosis H37Rv
cgugugcaccaucaucacc

SEQ ID NO: 3338575 - RNA, 22 nt, Mycobacterium tuberculosis H37Rv
cgugugcaccaucaucaccucu

SEQ ID NO: 3338576 - RNA, 21 nt, Mycobacterium tuberculosis H37Rv
cgugugccacggggcaggucc

SEQ ID NO: 3338577 - RNA, 19 nt, Mycobacterium tuberculosis H37Rv
cgugugcgcgugcugcgga

SEQ ID NO: 3338578 - RNA, 19 nt, Mycobacterium tuberculosis H37Rv
cguguggcacguggcgacc

SEQ ID NO: 3338579 - RNA, 19 nt, Mycobacterium tuberculosis H37Rv
cguguggugugucaccgga

SEQ ID NO: 3338580 - RNA, 16 nt, Mycobacterium tuberculosis H37Rv
cgugugugcgccuccg

SEQ ID NO: 3338581 - RNA, 13 nt, Mycobacterium tuberculosis H37Rv
cguguuaaccggg

SEQ ID NO: 3338582 - RNA, 20 nt, Mycobacterium tuberculosis H37Rv
cguguucgccacacccgugu

SEQ ID NO: 3338583 - RNA, 20 nt, Mycobacterium tuberculosis H37Rv
cguguucgggggcggucgcg

SEQ ID NO: 3338584 - RNA, 20 nt, Mycobacterium tuberculosis H37Rv
cguguucgucacgggcguug

SEQ ID NO: 3338585 - RNA, 14 nt, Mycobacterium tuberculosis H37Rv
cguguugaagaagc

SEQ ID NO: 3338586 - RNA, 14 nt, Mycobacterium tuberculosis H37Rv
cguguugaccgggu

SEQ ID NO: 3338587 - RNA, 16 nt, Mycobacterium tuberculosis H37Rv
cguguugcguucggug

SEQ ID NO: 3338588 - RNA, 17 nt, Mycobacterium tuberculosis H37Rv
cguguuguagaaaccgg

SEQ ID NO: 3338589 - RNA, 21 nt, Mycobacterium tuberculosis H37Rv
cguuaaugcuucgcgucgacc

SEQ ID NO: 3338590 - RNA, 15 nt, Mycobacterium tuberculosis H37Rv
cguuaccgacgccgg

SEQ ID NO: 3338591 - RNA, 19 nt, Mycobacterium tuberculosis H37Rv
cguuaccgccggcgccggu

SEQ ID NO: 3338592 - RNA, 12 nt, Mycobacterium tuberculosis H37Rv
cguuaccgccgu

SEQ ID NO: 3338593 - RNA, 12 nt, Mycobacterium tuberculosis H37Rv
cguuacgccgag

SEQ ID NO: 3338594 - RNA, 22 nt, Mycobacterium tuberculosis H37Rv
cguuacuggcgucgaugucgcc

SEQ ID NO: 3338595 - RNA, 18 nt, Mycobacterium tuberculosis H37Rv
cguuagcauugaguucgg

SEQ ID NO: 3338596 - RNA, 21 nt, Mycobacterium tuberculosis H37Rv
cguuagcauugaguucggcca

SEQ ID NO: 3338597 - RNA, 17 nt, Mycobacterium tuberculosis H37Rv
cguuagcuuagcugccg

SEQ ID NO: 3338598 - RNA, 22 nt, Mycobacterium tuberculosis H37Rv
cguuagcuuagcugccgucggu

SEQ ID NO: 3338599 - RNA, 15 nt, Mycobacterium tuberculosis H37Rv
cguuagggccgccau

SEQ ID NO: 3338600 - RNA, 18 nt, Mycobacterium tuberculosis H37Rv
cguuauccgacgaaccgg

SEQ ID NO: 3338601 - RNA, 21 nt, Mycobacterium tuberculosis H37Rv
cguuaucgucggcuugcugcc

SEQ ID NO: 3338602 - RNA, 14 nt, Mycobacterium tuberculosis H37Rv
cguucaacgacggc

SEQ ID NO: 3338603 - RNA, 18 nt, Mycobacterium tuberculosis H37Rv
cguucaacgacggcaagc

SEQ ID NO: 3338604 - RNA, 13 nt, Mycobacterium tuberculosis H37Rv
cguucaaggucuc

SEQ ID NO: 3338605 - RNA, 18 nt, Mycobacterium tuberculosis H37Rv
cguucaaggucuccagac

SEQ ID NO: 3338606 - RNA, 15 nt, Mycobacterium tuberculosis H37Rv
cguucaccacgaucg

SEQ ID NO: 3338607 - RNA, 16 nt, Mycobacterium tuberculosis H37Rv
cguucaccugcgucgg

SEQ ID NO: 3338608 - RNA, 14 nt, Mycobacterium tuberculosis H37Rv
cguucagccaggcg

SEQ ID NO: 3338609 - RNA, 18 nt, Mycobacterium tuberculosis H37Rv
cguucagcgaccaaugca

SEQ ID NO: 3338610 - RNA, 19 nt, Mycobacterium tuberculosis H37Rv
cguucagcggccagcagug

SEQ ID NO: 3338611 - RNA, 20 nt, Mycobacterium tuberculosis H37Rv
cguucagcggccagcagugc

SEQ ID NO: 3338612 - RNA, 17 nt, Mycobacterium tuberculosis H37Rv
cguucagggcauugacg

SEQ ID NO: 3338613 - RNA, 19 nt, Mycobacterium tuberculosis H37Rv
cguucagguguugacgcca

SEQ ID NO: 3338614 - RNA, 18 nt, Mycobacterium tuberculosis H37Rv
cguucaugaucggcagaa

SEQ ID NO: 3338615 - RNA, 21 nt, Mycobacterium tuberculosis H37Rv
cguucaugaucggcagaaucc

SEQ ID NO: 3338616 - RNA, 15 nt, Mycobacterium tuberculosis H37Rv
cguucaugcggcggc

SEQ ID NO: 3338617 - RNA, 16 nt, Mycobacterium tuberculosis H37Rv
cguucaugcggcggcg

SEQ ID NO: 3338618 - RNA, 14 nt, Mycobacterium tuberculosis H37Rv
cguuccacacagau

SEQ ID NO: 3338619 - RNA, 23 nt, Mycobacterium tuberculosis H37Rv
cguuccacaucaaaacggcggug

SEQ ID NO: 3338620 - RNA, 17 nt, Mycobacterium tuberculosis H37Rv
cguuccacgccggcauc

SEQ ID NO: 3338621 - RNA, 19 nt, Mycobacterium tuberculosis H37Rv
cguuccagcacacccagau

SEQ ID NO: 3338622 - RNA, 20 nt, Mycobacterium tuberculosis H37Rv
cguuccagcaguacaccgcc

SEQ ID NO: 3338623 - RNA, 23 nt, Mycobacterium tuberculosis H37Rv
cguuccagcaguacaccgcccgg

SEQ ID NO: 3338624 - RNA, 14 nt, Mycobacterium tuberculosis H37Rv
cguuccaucacgga

SEQ ID NO: 3338625 - RNA, 17 nt, Mycobacterium tuberculosis H37Rv
cguuccaucacggacca

SEQ ID NO: 3338626 - RNA, 21 nt, Mycobacterium tuberculosis H37Rv
cguucccacccacgccgacua

SEQ ID NO: 3338627 - RNA, 19 nt, Mycobacterium tuberculosis H37Rv
cguucccgccauugccgcc

SEQ ID NO: 3338628 - RNA, 22 nt, Mycobacterium tuberculosis H37Rv
cguucccgccauugccgccguc

SEQ ID NO: 3338629 - RNA, 20 nt, Mycobacterium tuberculosis H37Rv
cguucccgccggccccgccg

SEQ ID NO: 3338630 - RNA, 13 nt, Mycobacterium tuberculosis H37Rv
cguucccgcucgg

SEQ ID NO: 3338631 - RNA, 17 nt, Mycobacterium tuberculosis H37Rv
cguuccgcgacagcggc

SEQ ID NO: 3338632 - RNA, 18 nt, Mycobacterium tuberculosis H37Rv
cguuccgcgacagcggcg

SEQ ID NO: 3338633 - RNA, 13 nt, Mycobacterium tuberculosis H37Rv
cguuccgcucgag

SEQ ID NO: 3338634 - RNA, 17 nt, Mycobacterium tuberculosis H37Rv
cguuccgcucgccguuu

SEQ ID NO: 3338635 - RNA, 14 nt, Mycobacterium tuberculosis H37Rv
cguuccgcuggacg

SEQ ID NO: 3338636 - RNA, 18 nt, Mycobacterium tuberculosis H37Rv
cguuccgggccgaucacc

SEQ ID NO: 3338637 - RNA, 15 nt, Mycobacterium tuberculosis H37Rv
cguuccgggccggcg

SEQ ID NO: 3338638 - RNA, 15 nt, Mycobacterium tuberculosis H37Rv
cguuccuccagcagc

SEQ ID NO: 3338639 - RNA, 18 nt, Mycobacterium tuberculosis H37Rv
cguucgaaggccacccgc

SEQ ID NO: 3338640 - RNA, 14 nt, Mycobacterium tuberculosis H37Rv
cguucgacccagcg

SEQ ID NO: 3338641 - RNA, 16 nt, Mycobacterium tuberculosis H37Rv
cguucgaccguguaac

SEQ ID NO: 3338642 - RNA, 23 nt, Mycobacterium tuberculosis H37Rv
cguucgagagccccgaccagcag

SEQ ID NO: 3338643 - RNA, 17 nt, Mycobacterium tuberculosis H37Rv
cguucgccgaguauugg

SEQ ID NO: 3338644 - RNA, 21 nt, Mycobacterium tuberculosis H37Rv
cguucgccggaauacaccagc

SEQ ID NO: 3338645 - RNA, 20 nt, Mycobacterium tuberculosis H37Rv
cguucgcgggugcgcugcag

SEQ ID NO: 3338646 - RNA, 22 nt, Mycobacterium tuberculosis H37Rv
cguucgcgggugcgcugcagcg

SEQ ID NO: 3338647 - RNA, 18 nt, Mycobacterium tuberculosis H37Rv
cguucgcgucacaccagc

SEQ ID NO: 3338648 - RNA, 19 nt, Mycobacterium tuberculosis H37Rv
cguucgcgucacaccagcg

SEQ ID NO: 3338649 - RNA, 22 nt, Mycobacterium tuberculosis H37Rv
cguucgcgucacaccagcgggc

SEQ ID NO: 3338650 - RNA, 17 nt, Mycobacterium tuberculosis H37Rv
cguucgcgugccagcgc

SEQ ID NO: 3338651 - RNA, 23 nt, Mycobacterium tuberculosis H37Rv
cguucgcucccccgcuacgcgcg

SEQ ID NO: 3338652 - RNA, 18 nt, Mycobacterium tuberculosis H37Rv
cguucgcugguccuuguc

SEQ ID NO: 3338653 - RNA, 18 nt, Mycobacterium tuberculosis H37Rv
cguucggcacaaccaacg

SEQ ID NO: 3338654 - RNA, 14 nt, Mycobacterium tuberculosis H37Rv
cguucggcgagcag

SEQ ID NO: 3338655 - RNA, 13 nt, Mycobacterium tuberculosis H37Rv
cguucggcgcaca

SEQ ID NO: 3338656 - RNA, 14 nt, Mycobacterium tuberculosis H37Rv
cguucggcgcacag

SEQ ID NO: 3338657 - RNA, 23 nt, Mycobacterium tuberculosis H37Rv
cguucggcgcccgcucggccgca

SEQ ID NO: 3338658 - RNA, 19 nt, Mycobacterium tuberculosis H37Rv
cguucggcgcugaucgcgc

SEQ ID NO: 3338659 - RNA, 15 nt, Mycobacterium tuberculosis H37Rv
cguucggcgucguug

SEQ ID NO: 3338660 - RNA, 23 nt, Mycobacterium tuberculosis H37Rv
cguucgggugagcacccagcggc

SEQ ID NO: 3338661 - RNA, 15 nt, Mycobacterium tuberculosis H37Rv
cguucggugaucucg

SEQ ID NO: 3338662 - RNA, 14 nt, Mycobacterium tuberculosis H37Rv
cguucgucgcgggu

SEQ ID NO: 3338663 - RNA, 21 nt, Mycobacterium tuberculosis H37Rv
cguuggcuucuucggucaccu

SEQ ID NO: 3338664 - RNA, 18 nt, Mycobacterium tuberculosis H37Rv
cguugggaucccagcgca

SEQ ID NO: 3338665 - RNA, 19 nt, Mycobacterium tuberculosis H37Rv
cguugggaucccagcgcag

SEQ ID NO: 3338666 - RNA, 14 nt, Mycobacterium tuberculosis H37Rv
cguugggauccggu

SEQ ID NO: 3338667 - RNA, 16 nt, Mycobacterium tuberculosis H37Rv
cguugggauccggugg

SEQ ID NO: 3338668 - RNA, 21 nt, Mycobacterium tuberculosis H37Rv
cguugggauccgguggugggc

SEQ ID NO: 3338669 - RNA, 20 nt, Mycobacterium tuberculosis H37Rv
cguugggcagcuccaccagg

SEQ ID NO: 3338670 - RNA, 22 nt, Mycobacterium tuberculosis H37Rv
cguugggcguacucggcgcgca

SEQ ID NO: 3338671 - RNA, 20 nt, Mycobacterium tuberculosis H37Rv
cguuggguugaaaacgcccg

SEQ ID NO: 3338672 - RNA, 15 nt, Mycobacterium tuberculosis H37Rv
cguugguagccggug

SEQ ID NO: 3338673 - RNA, 17 nt, Mycobacterium tuberculosis H37Rv
cguuggugaggcccccc

SEQ ID NO: 3338674 - RNA, 21 nt, Mycobacterium tuberculosis H37Rv
cguuggugccuucaccgccgu

SEQ ID NO: 3338675 - RNA, 20 nt, Mycobacterium tuberculosis H37Rv
cguugguggucugccaaaag

SEQ ID NO: 3338676 - RNA, 13 nt, Mycobacterium tuberculosis H37Rv
cguuguagacggc

SEQ ID NO: 3338677 - RNA, 17 nt, Mycobacterium tuberculosis H37Rv
cguuguagacggcggca

SEQ ID NO: 3338678 - RNA, 14 nt, Mycobacterium tuberculosis H37Rv
cguuguaggagaac

SEQ ID NO: 3338679 - RNA, 13 nt, Mycobacterium tuberculosis H37Rv
cguuguaggcuuc

SEQ ID NO: 3338680 - RNA, 20 nt, Mycobacterium tuberculosis H37Rv
cguuguaguugcccacguug

SEQ ID NO: 3338681 - RNA, 17 nt, Mycobacterium tuberculosis H37Rv
cguuguccaagcccucg

SEQ ID NO: 3338682 - RNA, 18 nt, Mycobacterium tuberculosis H37Rv
cguuguccaccgccacca

SEQ ID NO: 3338683 - RNA, 16 nt, Mycobacterium tuberculosis H37Rv
cguugucuagcuggug

SEQ ID NO: 3338684 - RNA, 17 nt, Mycobacterium tuberculosis H37Rv
cguugugagccacgcgc

SEQ ID NO: 3338685 - RNA, 17 nt, Mycobacterium tuberculosis H37Rv
cguuguggcguguggcu

SEQ ID NO: 3338686 - RNA, 18 nt, Mycobacterium tuberculosis H37Rv
cguugugugccagcgugg

SEQ ID NO: 3338687 - RNA, 17 nt, Mycobacterium tuberculosis H37Rv
cguuguugaccaccacg

SEQ ID NO: 3338688 - RNA, 13 nt, Mycobacterium tuberculosis H37Rv
cguuguugaggau

SEQ ID NO: 3338689 - RNA, 19 nt, Mycobacterium tuberculosis H37Rv
cguuguuggauccggccac

SEQ ID NO: 3338690 - RNA, 12 nt, Mycobacterium tuberculosis H37Rv
cguuguugucga

SEQ ID NO: 3338691 - RNA, 17 nt, Mycobacterium tuberculosis H37Rv
cguuuagggugcccgcg

SEQ ID NO: 3338692 - RNA, 15 nt, Mycobacterium tuberculosis H37Rv
cguuuagucuccggc

SEQ ID NO: 3338693 - RNA, 22 nt, Mycobacterium tuberculosis H37Rv
cguuuauuguccugccgacagu

SEQ ID NO: 3338694 - RNA, 17 nt, Mycobacterium tuberculosis H37Rv
cguuucaagucccuuca

SEQ ID NO: 3338695 - RNA, 24 nt, Mycobacterium tuberculosis H37Rv
cguuucagcuagaccgaucaccgg

SEQ ID NO: 3338696 - RNA, 21 nt, Mycobacterium tuberculosis H37Rv
cguuucccaggcccgacacgg

SEQ ID NO: 3338697 - RNA, 22 nt, Mycobacterium tuberculosis H37Rv
cguuucccggguccuggaucag

SEQ ID NO: 3338698 - RNA, 14 nt, Mycobacterium tuberculosis H37Rv
cguuucgcagccgc

SEQ ID NO: 3338699 - RNA, 15 nt, Mycobacterium tuberculosis H37Rv
cguuucgccagccgg

SEQ ID NO: 3338700 - RNA, 16 nt, Mycobacterium tuberculosis H37Rv
cguuucgcgacgucug

SEQ ID NO: 3338701 - RNA, 23 nt, Mycobacterium tuberculosis H37Rv
cguuucgcgacgucugccaggcg

SEQ ID NO: 3338702 - RNA, 12 nt, Mycobacterium tuberculosis H37Rv
cguuucgcuguc

SEQ ID NO: 3338703 - RNA, 14 nt, Mycobacterium tuberculosis H37Rv
cguuucggucgaca

SEQ ID NO: 3338704 - RNA, 14 nt, Mycobacterium tuberculosis H37Rv
cguuugccggccga

SEQ ID NO: 3338705 - RNA, 15 nt, Mycobacterium tuberculosis H37Rv
cguuugcgaagccca

SEQ ID NO: 3338706 - RNA, 18 nt, Mycobacterium tuberculosis H37Rv
cguuuggcagagccgacu

SEQ ID NO: 3338707 - RNA, 16 nt, Mycobacterium tuberculosis H37Rv
cguuugggcgccggug

SEQ ID NO: 3338708 - RNA, 16 nt, Mycobacterium tuberculosis H37Rv
cguuuucgccgauccc

SEQ ID NO: 3338709 - RNA, 14 nt, Mycobacterium tuberculosis H37Rv
cguuuugcggcccg

SEQ ID NO: 3338710 - RNA, 15 nt, Mycobacterium tuberculosis H37Rv
cuaaacaggccgcca

SEQ ID NO: 3338711 - RNA, 17 nt, Mycobacterium tuberculosis H37Rv
cuaaagcccccgacacg

SEQ ID NO: 3338712 - RNA, 17 nt, Mycobacterium tuberculosis H37Rv
cuaaagcccucgacacg

SEQ ID NO: 3338713 - RNA, 18 nt, Mycobacterium tuberculosis H37Rv
cuaaagcccucgacacgc

SEQ ID NO: 3338714 - RNA, 20 nt, Mycobacterium tuberculosis H37Rv
cuaaagcgugucgcccuguu

SEQ ID NO: 3338715 - RNA, 14 nt, Mycobacterium tuberculosis H37Rv
cuaaagcuaaaccc

SEQ ID NO: 3338716 - RNA, 21 nt, Mycobacterium tuberculosis H37Rv
cuaacagccggcucccguacu

SEQ ID NO: 3338717 - RNA, 19 nt, Mycobacterium tuberculosis H37Rv
cuaacggcagccaccguca

SEQ ID NO: 3338718 - RNA, 13 nt, Mycobacterium tuberculosis H37Rv
cuaacucgccugc

SEQ ID NO: 3338719 - RNA, 19 nt, Mycobacterium tuberculosis H37Rv
cuaagcauucagcgcgccg

SEQ ID NO: 3338720 - RNA, 14 nt, Mycobacterium tuberculosis H37Rv
cuaagcgccugaua

SEQ ID NO: 3338721 - RNA, 13 nt, Mycobacterium tuberculosis H37Rv
cuaaggcucacca

SEQ ID NO: 3338722 - RNA, 22 nt, Mycobacterium tuberculosis H37Rv
cuaaguccccgcuuggcgagcc

SEQ ID NO: 3338723 - RNA, 21 nt, Mycobacterium tuberculosis H37Rv
cuaaugucgauuucgaugacg

SEQ ID NO: 3338724 - RNA, 16 nt, Mycobacterium tuberculosis H37Rv
cuaauucggggccgcg

SEQ ID NO: 3338725 - RNA, 22 nt, Mycobacterium tuberculosis H37Rv
cuacacccauuacugagcuucc

SEQ ID NO: 3338726 - RNA, 20 nt, Mycobacterium tuberculosis H37Rv
cuacacccguagaccuucga

SEQ ID NO: 3338727 - RNA, 21 nt, Mycobacterium tuberculosis H37Rv
cuacaccggcaagccacgccg

SEQ ID NO: 3338728 - RNA, 23 nt, Mycobacterium tuberculosis H37Rv
cuacaccugcggcgucaaaucca

SEQ ID NO: 3338729 - RNA, 18 nt, Mycobacterium tuberculosis H37Rv
cuacaggguuggcagcaa

SEQ ID NO: 3338730 - RNA, 18 nt, Mycobacterium tuberculosis H37Rv
cuaccaaaucgacacccu

SEQ ID NO: 3338731 - RNA, 22 nt, Mycobacterium tuberculosis H37Rv
cuaccaaccgguacuccugggu

SEQ ID NO: 3338732 - RNA, 15 nt, Mycobacterium tuberculosis H37Rv
cuaccaacgcaacac

SEQ ID NO: 3338733 - RNA, 22 nt, Mycobacterium tuberculosis H37Rv
cuaccaacgcaacacgggcgcc

SEQ ID NO: 3338734 - RNA, 13 nt, Mycobacterium tuberculosis H37Rv
cuaccagcaccgg

SEQ ID NO: 3338735 - RNA, 17 nt, Mycobacterium tuberculosis H37Rv
cuacccauggcccguug

SEQ ID NO: 3338736 - RNA, 19 nt, Mycobacterium tuberculosis H37Rv
cuaccccacaagcgauggc

SEQ ID NO: 3338737 - RNA, 15 nt, Mycobacterium tuberculosis H37Rv
cuacccgcgcgaccu

SEQ ID NO: 3338738 - RNA, 16 nt, Mycobacterium tuberculosis H37Rv
cuacccgcggcgcgaa

SEQ ID NO: 3338739 - RNA, 12 nt, Mycobacterium tuberculosis H37Rv
cuacccgggcca

SEQ ID NO: 3338740 - RNA, 18 nt, Mycobacterium tuberculosis H37Rv
cuaccgagaucaccgcca

SEQ ID NO: 3338741 - RNA, 17 nt, Mycobacterium tuberculosis H37Rv
cuaccgaugaaccaggc

SEQ ID NO: 3338742 - RNA, 17 nt, Mycobacterium tuberculosis H37Rv
cuaccgcccgcgccacc

SEQ ID NO: 3338743 - RNA, 21 nt, Mycobacterium tuberculosis H37Rv
cuaccgccggcggcggccgca

SEQ ID NO: 3338744 - RNA, 18 nt, Mycobacterium tuberculosis H37Rv
cuaccgccuugucggcga

SEQ ID NO: 3338745 - RNA, 20 nt, Mycobacterium tuberculosis H37Rv
cuaccgccuugucggcgaug

SEQ ID NO: 3338746 - RNA, 12 nt, Mycobacterium tuberculosis H37Rv
cuaccggcccga

SEQ ID NO: 3338747 - RNA, 15 nt, Mycobacterium tuberculosis H37Rv
cuaccggccuuucca

SEQ ID NO: 3338748 - RNA, 17 nt, Mycobacterium tuberculosis H37Rv
cuaccggccuuuccagc

SEQ ID NO: 3338749 - RNA, 12 nt, Mycobacterium tuberculosis H37Rv
cuaccggcgccg

SEQ ID NO: 3338750 - RNA, 20 nt, Mycobacterium tuberculosis H37Rv
cuaccggcgccgcgcggcuu

SEQ ID NO: 3338751 - RNA, 17 nt, Mycobacterium tuberculosis H37Rv
cuaccggcucguagcug

SEQ ID NO: 3338752 - RNA, 17 nt, Mycobacterium tuberculosis H37Rv
cuaccguacgcagcgug

SEQ ID NO: 3338753 - RNA, 19 nt, Mycobacterium tuberculosis H37Rv
cuaccgucaguagccacgc

SEQ ID NO: 3338754 - RNA, 15 nt, Mycobacterium tuberculosis H37Rv
cuaccuaacccgcgc

SEQ ID NO: 3338755 - RNA, 16 nt, Mycobacterium tuberculosis H37Rv
cuaccuguugacacaa

SEQ ID NO: 3338756 - RNA, 22 nt, Mycobacterium tuberculosis H37Rv
cuaccuuagcgccguugccgcc

SEQ ID NO: 3338757 - RNA, 12 nt, Mycobacterium tuberculosis H37Rv
cuaccuucuugg

SEQ ID NO: 3338758 - RNA, 15 nt, Mycobacterium tuberculosis H37Rv
cuacgccccacugcc

SEQ ID NO: 3338759 - RNA, 21 nt, Mycobacterium tuberculosis H37Rv
cuauggaugaccgaaccuggu

SEQ ID NO: 3338760 - RNA, 15 nt, Mycobacterium tuberculosis H37Rv
cuauggcccgggccg

SEQ ID NO: 3338761 - RNA, 20 nt, Mycobacterium tuberculosis H37Rv
cuaugggucguugucggggu

SEQ ID NO: 3338762 - RNA, 22 nt, Mycobacterium tuberculosis H37Rv
cuauggguucgcgguuguccuc

SEQ ID NO: 3338763 - RNA, 17 nt, Mycobacterium tuberculosis H37Rv
cuaugucauagcgcacc

SEQ ID NO: 3338764 - RNA, 20 nt, Mycobacterium tuberculosis H37Rv
cuauugcuauuccgcggcac

SEQ ID NO: 3338765 - RNA, 18 nt, Mycobacterium tuberculosis H37Rv
cucaaaccggaaacagca

SEQ ID NO: 3338766 - RNA, 17 nt, Mycobacterium tuberculosis H37Rv
cucaacaaucggugguc

SEQ ID NO: 3338767 - RNA, 14 nt, Mycobacterium tuberculosis H37Rv
cucaacaccagcaa

SEQ ID NO: 3338768 - RNA, 12 nt, Mycobacterium tuberculosis H37Rv
cucaacaccagg

SEQ ID NO: 3338769 - RNA, 15 nt, Mycobacterium tuberculosis H37Rv
cucaacaccaggccg

SEQ ID NO: 3338770 - RNA, 21 nt, Mycobacterium tuberculosis H37Rv
cucaacacuuccgggcgguga

SEQ ID NO: 3338771 - RNA, 19 nt, Mycobacterium tuberculosis H37Rv
cucaaccagcagacgccgu

SEQ ID NO: 3338772 - RNA, 20 nt, Mycobacterium tuberculosis H37Rv
cucaacgggaccgaucuugg

SEQ ID NO: 3338773 - RNA, 13 nt, Mycobacterium tuberculosis H37Rv
cucaacgggccgc

SEQ ID NO: 3338774 - RNA, 15 nt, Mycobacterium tuberculosis H37Rv
cucaagauuuccauc

SEQ ID NO: 3338775 - RNA, 21 nt, Mycobacterium tuberculosis H37Rv
cucaagauuuccaucgcaaug

SEQ ID NO: 3338776 - RNA, 22 nt, Mycobacterium tuberculosis H37Rv
cucaagcaauggugcggucugg

SEQ ID NO: 3338777 - RNA, 18 nt, Mycobacterium tuberculosis H37Rv
cucaagcgaagagcgcac

SEQ ID NO: 3338778 - RNA, 19 nt, Mycobacterium tuberculosis H37Rv
cucaagcgcgucgucacga

SEQ ID NO: 3338779 - RNA, 19 nt, Mycobacterium tuberculosis H37Rv
cucaaggacgcaccgccag

SEQ ID NO: 3338780 - RNA, 12 nt, Mycobacterium tuberculosis H37Rv
cucaaggcggcc

SEQ ID NO: 3338781 - RNA, 13 nt, Mycobacterium tuberculosis H37Rv
cucaaggcuucgg

SEQ ID NO: 3338782 - RNA, 18 nt, Mycobacterium tuberculosis H37Rv
cucaaggcuucggcggcc

SEQ ID NO: 3338783 - RNA, 20 nt, Mycobacterium tuberculosis H37Rv
cucaagguccagcgauccgg

SEQ ID NO: 3338784 - RNA, 13 nt, Mycobacterium tuberculosis H37Rv
cucaagucucccg

SEQ ID NO: 3338785 - RNA, 16 nt, Mycobacterium tuberculosis H37Rv
cucaagucucccggcc

SEQ ID NO: 3338786 - RNA, 19 nt, Mycobacterium tuberculosis H37Rv
cucaaguugguucaccgcg

SEQ ID NO: 3338787 - RNA, 13 nt, Mycobacterium tuberculosis H37Rv
cucaauuccaugc

SEQ ID NO: 3338788 - RNA, 12 nt, Mycobacterium tuberculosis H37Rv
cucacacuggcu

SEQ ID NO: 3338789 - RNA, 15 nt, Mycobacterium tuberculosis H37Rv
cucacacuggcuuug

SEQ ID NO: 3338790 - RNA, 23 nt, Mycobacterium tuberculosis H37Rv
cucacagcacagcgcagccugca

SEQ ID NO: 3338791 - RNA, 17 nt, Mycobacterium tuberculosis H37Rv
cucaccaaggucggcga

SEQ ID NO: 3338792 - RNA, 21 nt, Mycobacterium tuberculosis H37Rv
cucaccaaucugcgggccggu

SEQ ID NO: 3338793 - RNA, 23 nt, Mycobacterium tuberculosis H37Rv
cucaccaaucugcgggccgguga

SEQ ID NO: 3338794 - RNA, 15 nt, Mycobacterium tuberculosis H37Rv
cucaccacaucggug

SEQ ID NO: 3338795 - RNA, 18 nt, Mycobacterium tuberculosis H37Rv
cucaccacccagauugcc

SEQ ID NO: 3338796 - RNA, 18 nt, Mycobacterium tuberculosis H37Rv
cucaccacccgcacucca

SEQ ID NO: 3338797 - RNA, 14 nt, Mycobacterium tuberculosis H37Rv
cucaccaccgaccu

SEQ ID NO: 3338798 - RNA, 20 nt, Mycobacterium tuberculosis H37Rv
cucaccacgaggcuugcggc

SEQ ID NO: 3338799 - RNA, 20 nt, Mycobacterium tuberculosis H37Rv
cucaccacgucgaccgaacc

SEQ ID NO: 3338800 - RNA, 12 nt, Mycobacterium tuberculosis H37Rv
cucaccaggcga

SEQ ID NO: 3338801 - RNA, 21 nt, Mycobacterium tuberculosis H37Rv
cucaccaugggacacaaucca

SEQ ID NO: 3338802 - RNA, 22 nt, Mycobacterium tuberculosis H37Rv
cucacccagcugggucccgcug

SEQ ID NO: 3338803 - RNA, 14 nt, Mycobacterium tuberculosis H37Rv
cucacccgcccgga

SEQ ID NO: 3338804 - RNA, 23 nt, Mycobacterium tuberculosis H37Rv
cucacccgccgcgguuaucgccg

SEQ ID NO: 3338805 - RNA, 19 nt, Mycobacterium tuberculosis H37Rv
cucacccggcgucucgcag

SEQ ID NO: 3338806 - RNA, 22 nt, Mycobacterium tuberculosis H37Rv
cucacccugcucgaacgcugag

SEQ ID NO: 3338807 - RNA, 18 nt, Mycobacterium tuberculosis H37Rv
cucaccgaucucgaccag

SEQ ID NO: 3338808 - RNA, 11 nt, Mycobacterium tuberculosis H37Rv
cucaccgccgc

SEQ ID NO: 3338809 - RNA, 20 nt, Mycobacterium tuberculosis H37Rv
cucaccgcgcaucaucgccc

SEQ ID NO: 3338810 - RNA, 20 nt, Mycobacterium tuberculosis H37Rv
cucaccggcgcccagcgccu

SEQ ID NO: 3338811 - RNA, 20 nt, Mycobacterium tuberculosis H37Rv
cucaccggcuggugccaacu

SEQ ID NO: 3338812 - RNA, 20 nt, Mycobacterium tuberculosis H37Rv
cucaccgggcccgacgacga

SEQ ID NO: 3338813 - RNA, 20 nt, Mycobacterium tuberculosis H37Rv
cucaccgugaaccgcccgcc

SEQ ID NO: 3338814 - RNA, 21 nt, Mycobacterium tuberculosis H37Rv
cucaccuuuggccgcgaccgg

SEQ ID NO: 3338815 - RNA, 16 nt, Mycobacterium tuberculosis H37Rv
cucacgaagaccgcgu

SEQ ID NO: 3338816 - RNA, 21 nt, Mycobacterium tuberculosis H37Rv
cucacgaggcacaaucaccgc

SEQ ID NO: 3338817 - RNA, 23 nt, Mycobacterium tuberculosis H37Rv
cucacgaggcacaaucaccgccg

SEQ ID NO: 3338818 - RNA, 21 nt, Mycobacterium tuberculosis H37Rv
cucacgcaggaaaaccccggc

SEQ ID NO: 3338819 - RNA, 19 nt, Mycobacterium tuberculosis H37Rv
cucacgccguccggugugg

SEQ ID NO: 3338820 - RNA, 19 nt, Mycobacterium tuberculosis H37Rv
cucacgcugaagccgcugg

SEQ ID NO: 3338821 - RNA, 21 nt, Mycobacterium tuberculosis H37Rv
cucacggauucgggcgaagcu

SEQ ID NO: 3338822 - RNA, 18 nt, Mycobacterium tuberculosis H37Rv
cucacgggcgaucgugcg

SEQ ID NO: 3338823 - RNA, 15 nt, Mycobacterium tuberculosis H37Rv
cucacgugcccgcgc

SEQ ID NO: 3338824 - RNA, 19 nt, Mycobacterium tuberculosis H37Rv
cucacgugcccgcgcggcg

SEQ ID NO: 3338825 - RNA, 20 nt, Mycobacterium tuberculosis H37Rv
cucacgugcugccgauagcg

SEQ ID NO: 3338826 - RNA, 17 nt, Mycobacterium tuberculosis H37Rv
cucacguggacugaccu

SEQ ID NO: 3338827 - RNA, 22 nt, Mycobacterium tuberculosis H37Rv
cucacguugugagccacgcgca

SEQ ID NO: 3338828 - RNA, 23 nt, Mycobacterium tuberculosis H37Rv
cucacguuugaggaccuugccgg

SEQ ID NO: 3338829 - RNA, 14 nt, Mycobacterium tuberculosis H37Rv
cucacguuugccgg

SEQ ID NO: 3338830 - RNA, 17 nt, Mycobacterium tuberculosis H37Rv
cucacguuugccggccc

SEQ ID NO: 3338831 - RNA, 22 nt, Mycobacterium tuberculosis H37Rv
cucacucgccgaaucgcugacc

SEQ ID NO: 3338832 - RNA, 13 nt, Mycobacterium tuberculosis H37Rv
cucagccgcggcc

SEQ ID NO: 3338833 - RNA, 13 nt, Mycobacterium tuberculosis H37Rv
cucagccggcggc

SEQ ID NO: 3338834 - RNA, 17 nt, Mycobacterium tuberculosis H37Rv
cucagccgugcccaggc

SEQ ID NO: 3338835 - RNA, 12 nt, Mycobacterium tuberculosis H37Rv
cucagcgcggcc

SEQ ID NO: 3338836 - RNA, 22 nt, Mycobacterium tuberculosis H37Rv
cucagcggcccgcugcgcggcc

SEQ ID NO: 3338837 - RNA, 20 nt, Mycobacterium tuberculosis H37Rv
cucagcuccggcgacucugu

SEQ ID NO: 3338838 - RNA, 13 nt, Mycobacterium tuberculosis H37Rv
cucagcugcucgu

SEQ ID NO: 3338839 - RNA, 18 nt, Mycobacterium tuberculosis H37Rv
cucaggaucccgguggca

SEQ ID NO: 3338840 - RNA, 20 nt, Mycobacterium tuberculosis H37Rv
cucaggccgguaccgggacg

SEQ ID NO: 3338841 - RNA, 17 nt, Mycobacterium tuberculosis H37Rv
cucagggugcgccgcag

SEQ ID NO: 3338842 - RNA, 19 nt, Mycobacterium tuberculosis H37Rv
cucaggguguucacguuca

SEQ ID NO: 3338843 - RNA, 17 nt, Mycobacterium tuberculosis H37Rv
cucaggucaccggccgc

SEQ ID NO: 3338844 - RNA, 18 nt, Mycobacterium tuberculosis H37Rv
cucaggucaccggccgcc

SEQ ID NO: 3338845 - RNA, 15 nt, Mycobacterium tuberculosis H37Rv
cucaggucgcagacc

SEQ ID NO: 3338846 - RNA, 17 nt, Mycobacterium tuberculosis H37Rv
cucaggucgcagaccag

SEQ ID NO: 3338847 - RNA, 15 nt, Mycobacterium tuberculosis H37Rv
cucagguucagcuug

SEQ ID NO: 3338848 - RNA, 16 nt, Mycobacterium tuberculosis H37Rv
cucagucacgcacucc

SEQ ID NO: 3338849 - RNA, 17 nt, Mycobacterium tuberculosis H37Rv
cucagugaugcgccccg

SEQ ID NO: 3338850 - RNA, 23 nt, Mycobacterium tuberculosis H37Rv
cucauaccgggaggacaccagcu

SEQ ID NO: 3338851 - RNA, 17 nt, Mycobacterium tuberculosis H37Rv
cucauagagcggcacca

SEQ ID NO: 3338852 - RNA, 15 nt, Mycobacterium tuberculosis H37Rv
cucauagcgacggcg

SEQ ID NO: 3338853 - RNA, 15 nt, Mycobacterium tuberculosis H37Rv
cucauagugcagguc

SEQ ID NO: 3338854 - RNA, 16 nt, Mycobacterium tuberculosis H37Rv
cucauagugcaggucg

SEQ ID NO: 3338855 - RNA, 22 nt, Mycobacterium tuberculosis H37Rv
cuccauggcauugcuccgguug

SEQ ID NO: 3338856 - RNA, 18 nt, Mycobacterium tuberculosis H37Rv
cuccauugccggauuugu

SEQ ID NO: 3338857 - RNA, 21 nt, Mycobacterium tuberculosis H37Rv
cucccaaaugucguaggccgc

SEQ ID NO: 3338858 - RNA, 15 nt, Mycobacterium tuberculosis H37Rv
cucccaagaaggaca

SEQ ID NO: 3338859 - RNA, 20 nt, Mycobacterium tuberculosis H37Rv
cucccacagguagaccgucu

SEQ ID NO: 3338860 - RNA, 19 nt, Mycobacterium tuberculosis H37Rv
cucccacgcuucggccugu

SEQ ID NO: 3338861 - RNA, 21 nt, Mycobacterium tuberculosis H37Rv
cucccacgcuucggccugugc

SEQ ID NO: 3338862 - RNA, 22 nt, Mycobacterium tuberculosis H37Rv
cucccacgcuucggccugugcg

SEQ ID NO: 3338863 - RNA, 16 nt, Mycobacterium tuberculosis H37Rv
cucccagccaacccgu

SEQ ID NO: 3338864 - RNA, 18 nt, Mycobacterium tuberculosis H37Rv
cucccagggcucggcggc

SEQ ID NO: 3338865 - RNA, 22 nt, Mycobacterium tuberculosis H37Rv
cucccagggcucggcggcccgg

SEQ ID NO: 3338866 - RNA, 20 nt, Mycobacterium tuberculosis H37Rv
cucccaucccaugucgagga

SEQ ID NO: 3338867 - RNA, 14 nt, Mycobacterium tuberculosis H37Rv
cucccaugaucgcc

SEQ ID NO: 3338868 - RNA, 14 nt, Mycobacterium tuberculosis H37Rv
cuccccagagcugg

SEQ ID NO: 3338869 - RNA, 19 nt, Mycobacterium tuberculosis H37Rv
cuccccgaucugcuccucg

SEQ ID NO: 3338870 - RNA, 13 nt, Mycobacterium tuberculosis H37Rv
cuccccgccgggc

SEQ ID NO: 3338871 - RNA, 16 nt, Mycobacterium tuberculosis H37Rv
cuccccgcgcgcugau

SEQ ID NO: 3338872 - RNA, 18 nt, Mycobacterium tuberculosis H37Rv
cuccccggauuccucguc

SEQ ID NO: 3338873 - RNA, 20 nt, Mycobacterium tuberculosis H37Rv
cucccgaacacuuugcgcac

SEQ ID NO: 3338874 - RNA, 19 nt, Mycobacterium tuberculosis H37Rv
cucccgcaacauuuucgcc

SEQ ID NO: 3338875 - RNA, 22 nt, Mycobacterium tuberculosis H37Rv
cucccgcaacauuuucgcccgc

SEQ ID NO: 3338876 - RNA, 20 nt, Mycobacterium tuberculosis H37Rv
cucccgcacggccgggucga

SEQ ID NO: 3338877 - RNA, 13 nt, Mycobacterium tuberculosis H37Rv
cucccgccggcag

SEQ ID NO: 3338878 - RNA, 22 nt, Mycobacterium tuberculosis H37Rv
cucccgccggcagcgucggccg

SEQ ID NO: 3338879 - RNA, 15 nt, Mycobacterium tuberculosis H37Rv
cucccgcgcgggcgg

SEQ ID NO: 3338880 - RNA, 16 nt, Mycobacterium tuberculosis H37Rv
cucccgcggcgccacc

SEQ ID NO: 3338881 - RNA, 13 nt, Mycobacterium tuberculosis H37Rv
cucccgggccgcc

SEQ ID NO: 3338882 - RNA, 14 nt, Mycobacterium tuberculosis H37Rv
cucccgggccgccg

SEQ ID NO: 3338883 - RNA, 19 nt, Mycobacterium tuberculosis H37Rv
cucccgggcggcggccugg

SEQ ID NO: 3338884 - RNA, 22 nt, Mycobacterium tuberculosis H37Rv
cucccgggugcgacgcgaccgc

SEQ ID NO: 3338885 - RNA, 15 nt, Mycobacterium tuberculosis H37Rv
cucccgucucgacag

SEQ ID NO: 3338886 - RNA, 22 nt, Mycobacterium tuberculosis H37Rv
cucccugcacccagccgugccc

SEQ ID NO: 3338887 - RNA, 18 nt, Mycobacterium tuberculosis H37Rv
cucccugggcgucgacca

SEQ ID NO: 3338888 - RNA, 15 nt, Mycobacterium tuberculosis H37Rv
cucccuggggccguc

SEQ ID NO: 3338889 - RNA, 16 nt, Mycobacterium tuberculosis H37Rv
cucccuuccgcgcuuc

SEQ ID NO: 3338890 - RNA, 18 nt, Mycobacterium tuberculosis H37Rv
cuccgaacauggccagca

SEQ ID NO: 3338891 - RNA, 14 nt, Mycobacterium tuberculosis H37Rv
cuccgaaggccgcc

SEQ ID NO: 3338892 - RNA, 16 nt, Mycobacterium tuberculosis H37Rv
cuccgaaguccacgca

SEQ ID NO: 3338893 - RNA, 21 nt, Mycobacterium tuberculosis H37Rv
cuccgaaguccacgcaccacg

SEQ ID NO: 3338894 - RNA, 20 nt, Mycobacterium tuberculosis H37Rv
cuccgagcacaggaucaccc

SEQ ID NO: 3338895 - RNA, 16 nt, Mycobacterium tuberculosis H37Rv
cuccgagggcugcgug

SEQ ID NO: 3338896 - RNA, 23 nt, Mycobacterium tuberculosis H37Rv
cuccgaucgggcccaccgcugcg

SEQ ID NO: 3338897 - RNA, 18 nt, Mycobacterium tuberculosis H37Rv
cuccgaugccgacggcgc

SEQ ID NO: 3338898 - RNA, 20 nt, Mycobacterium tuberculosis H37Rv
cuccgaugccgacggcgccc

SEQ ID NO: 3338899 - RNA, 16 nt, Mycobacterium tuberculosis H37Rv
cuccgcagcgaagacc

SEQ ID NO: 3338900 - RNA, 14 nt, Mycobacterium tuberculosis H37Rv
cuccgccaaggagg

SEQ ID NO: 3338901 - RNA, 23 nt, Mycobacterium tuberculosis H37Rv
cuccgcccucaguucacguucgg

SEQ ID NO: 3338902 - RNA, 20 nt, Mycobacterium tuberculosis H37Rv
cuccgccgaggaaaccacca

SEQ ID NO: 3338903 - RNA, 19 nt, Mycobacterium tuberculosis H37Rv
cuccgccggcaccuccggc

SEQ ID NO: 3338904 - RNA, 24 nt, Mycobacterium tuberculosis H37Rv
cuccgccggcaccuccggcaccgc

SEQ ID NO: 3338905 - RNA, 22 nt, Mycobacterium tuberculosis H37Rv
cuccgccggguuggcgccggcc

SEQ ID NO: 3338906 - RNA, 23 nt, Mycobacterium tuberculosis H37Rv
cuccgccggguuggcgccggcca

SEQ ID NO: 3338907 - RNA, 24 nt, Mycobacterium tuberculosis H37Rv
cuccgccggguuggcgccggccag

SEQ ID NO: 3338908 - RNA, 20 nt, Mycobacterium tuberculosis H37Rv
cuccgccgucgccgccggcg

SEQ ID NO: 3338909 - RNA, 15 nt, Mycobacterium tuberculosis H37Rv
cuccgccguugccgc

SEQ ID NO: 3338910 - RNA, 17 nt, Mycobacterium tuberculosis H37Rv
cuccgccguugccgccg

SEQ ID NO: 3338911 - RNA, 18 nt, Mycobacterium tuberculosis H37Rv
cuccgccguugccgccgc

SEQ ID NO: 3338912 - RNA, 13 nt, Mycobacterium tuberculosis H37Rv
cuccgccugcccc

SEQ ID NO: 3338913 - RNA, 15 nt, Mycobacterium tuberculosis H37Rv
cuccgcgagcccggc

SEQ ID NO: 3338914 - RNA, 16 nt, Mycobacterium tuberculosis H37Rv
cuccgcgaucaccgac

SEQ ID NO: 3338915 - RNA, 14 nt, Mycobacterium tuberculosis H37Rv
cuccgcgccgccga

SEQ ID NO: 3338916 - RNA, 17 nt, Mycobacterium tuberculosis H37Rv
cuccgcggaacccagca

SEQ ID NO: 3338917 - RNA, 18 nt, Mycobacterium tuberculosis H37Rv
cuccgcggaacccagcac

SEQ ID NO: 3338918 - RNA, 19 nt, Mycobacterium tuberculosis H37Rv
cuccgcggcgcgcaacaca

SEQ ID NO: 3338919 - RNA, 18 nt, Mycobacterium tuberculosis H37Rv
cuccgcgguuguuucggc

SEQ ID NO: 3338920 - RNA, 21 nt, Mycobacterium tuberculosis H37Rv
cuccgcguagaguguccccgg

SEQ ID NO: 3338921 - RNA, 18 nt, Mycobacterium tuberculosis H37Rv
cuccgcugaugagccgca

SEQ ID NO: 3338922 - RNA, 13 nt, Mycobacterium tuberculosis H37Rv
cuccgcugccgcc

SEQ ID NO: 3338923 - RNA, 19 nt, Mycobacterium tuberculosis H37Rv
cuccgcugccgcccgcgcc

SEQ ID NO: 3338924 - RNA, 16 nt, Mycobacterium tuberculosis H37Rv
cuccggaaagcucucg

SEQ ID NO: 3338925 - RNA, 19 nt, Mycobacterium tuberculosis H37Rv
cuccggaaagcucucggca

SEQ ID NO: 3338926 - RNA, 22 nt, Mycobacterium tuberculosis H37Rv
cuccggaaagcucucggcaccc

SEQ ID NO: 3338927 - RNA, 13 nt, Mycobacterium tuberculosis H37Rv
cuccggaaccacu

SEQ ID NO: 3338928 - RNA, 22 nt, Mycobacterium tuberculosis H37Rv
cuccggaaccacucgcucagga

SEQ ID NO: 3338929 - RNA, 13 nt, Mycobacterium tuberculosis H37Rv
cuccggacgcacg

SEQ ID NO: 3338930 - RNA, 21 nt, Mycobacterium tuberculosis H37Rv
cuccggagcccacacgcucac

SEQ ID NO: 3338931 - RNA, 23 nt, Mycobacterium tuberculosis H37Rv
cuccggauaacccagcggcgcca

SEQ ID NO: 3338932 - RNA, 15 nt, Mycobacterium tuberculosis H37Rv
cuccggauccucggc

SEQ ID NO: 3338933 - RNA, 17 nt, Mycobacterium tuberculosis H37Rv
cuccggcaacagcacca

SEQ ID NO: 3338934 - RNA, 21 nt, Mycobacterium tuberculosis H37Rv
cuccggcaacagcaccagugu

SEQ ID NO: 3338935 - RNA, 16 nt, Mycobacterium tuberculosis H37Rv
cuccggcaagcacacc

SEQ ID NO: 3338936 - RNA, 22 nt, Mycobacterium tuberculosis H37Rv
cuccggcaccuccagcaccacc

SEQ ID NO: 3338937 - RNA, 16 nt, Mycobacterium tuberculosis H37Rv
cuccggcccugccgcc

SEQ ID NO: 3338938 - RNA, 16 nt, Mycobacterium tuberculosis H37Rv
cuccggccgcacgccu

SEQ ID NO: 3338939 - RNA, 21 nt, Mycobacterium tuberculosis H37Rv
cuccggccgcacgccuacgau

SEQ ID NO: 3338940 - RNA, 14 nt, Mycobacterium tuberculosis H37Rv
cuccggccggccua

SEQ ID NO: 3338941 - RNA, 15 nt, Mycobacterium tuberculosis H37Rv
cuccggcgcaccugg

SEQ ID NO: 3338942 - RNA, 16 nt, Mycobacterium tuberculosis H37Rv
cuccggcgcaccuggg

SEQ ID NO: 3338943 - RNA, 20 nt, Mycobacterium tuberculosis H37Rv
cuccggcgcaccugggcugc

SEQ ID NO: 3338944 - RNA, 21 nt, Mycobacterium tuberculosis H37Rv
cuccggcgcaccugggcugcc

SEQ ID NO: 3338945 - RNA, 17 nt, Mycobacterium tuberculosis H37Rv
cuccggcgcagcgaccg

SEQ ID NO: 3338946 - RNA, 13 nt, Mycobacterium tuberculosis H37Rv
cuccggcgccacc

SEQ ID NO: 3338947 - RNA, 13 nt, Mycobacterium tuberculosis H37Rv
cuccggcgccgcc

SEQ ID NO: 3338948 - RNA, 14 nt, Mycobacterium tuberculosis H37Rv
cuccggcgccgccc

SEQ ID NO: 3338949 - RNA, 23 nt, Mycobacterium tuberculosis H37Rv
cuccggcgcuccacugaccaggu

SEQ ID NO: 3338950 - RNA, 18 nt, Mycobacterium tuberculosis H37Rv
cucgaccaaguugaccuu

SEQ ID NO: 3338951 - RNA, 14 nt, Mycobacterium tuberculosis H37Rv
cucgaccagcgccg

SEQ ID NO: 3338952 - RNA, 16 nt, Mycobacterium tuberculosis H37Rv
cucgaccagcgccgau

SEQ ID NO: 3338953 - RNA, 22 nt, Mycobacterium tuberculosis H37Rv
cucgaccagcgccgauaccagc

SEQ ID NO: 3338954 - RNA, 18 nt, Mycobacterium tuberculosis H37Rv
cucgaccgacugcccgau

SEQ ID NO: 3338955 - RNA, 15 nt, Mycobacterium tuberculosis H37Rv
cucgaccgauagcug

SEQ ID NO: 3338956 - RNA, 16 nt, Mycobacterium tuberculosis H37Rv
cucgaccgccagcccg

SEQ ID NO: 3338957 - RNA, 20 nt, Mycobacterium tuberculosis H37Rv
cucgaccgccagcccgguga

SEQ ID NO: 3338958 - RNA, 15 nt, Mycobacterium tuberculosis H37Rv
cucgaccgccagccg

SEQ ID NO: 3338959 - RNA, 16 nt, Mycobacterium tuberculosis H37Rv
cucgaccgccagccgc

SEQ ID NO: 3338960 - RNA, 18 nt, Mycobacterium tuberculosis H37Rv
cucgaccgcccggcuagg

SEQ ID NO: 3338961 - RNA, 14 nt, Mycobacterium tuberculosis H37Rv
cucgaccgcgacgg

SEQ ID NO: 3338962 - RNA, 19 nt, Mycobacterium tuberculosis H37Rv
cucgaccguauugaccagc

SEQ ID NO: 3338963 - RNA, 18 nt, Mycobacterium tuberculosis H37Rv
cucgacgagcacgccgac

SEQ ID NO: 3338964 - RNA, 16 nt, Mycobacterium tuberculosis H37Rv
cucgacgaucagcacg

SEQ ID NO: 3338965 - RNA, 16 nt, Mycobacterium tuberculosis H37Rv
cucgacggcgccgcuc

SEQ ID NO: 3338966 - RNA, 12 nt, Mycobacterium tuberculosis H37Rv
cucgacggugac

SEQ ID NO: 3338967 - RNA, 15 nt, Mycobacterium tuberculosis H37Rv
cucgacggugaccgg

SEQ ID NO: 3338968 - RNA, 15 nt, Mycobacterium tuberculosis H37Rv
cucgacguaggccag

SEQ ID NO: 3338969 - RNA, 16 nt, Mycobacterium tuberculosis H37Rv
cucgacguaggccagg

SEQ ID NO: 3338970 - RNA, 17 nt, Mycobacterium tuberculosis H37Rv
cucgacguagucgcgca

SEQ ID NO: 3338971 - RNA, 19 nt, Mycobacterium tuberculosis H37Rv
cucgacguccaucccggcg

SEQ ID NO: 3338972 - RNA, 15 nt, Mycobacterium tuberculosis H37Rv
cucgacgucggugaa

SEQ ID NO: 3338973 - RNA, 15 nt, Mycobacterium tuberculosis H37Rv
cucgacugccaccgu

SEQ ID NO: 3338974 - RNA, 13 nt, Mycobacterium tuberculosis H37Rv
cucgacuucggcg

SEQ ID NO: 3338975 - RNA, 14 nt, Mycobacterium tuberculosis H37Rv
cucgagacggucga

SEQ ID NO: 3338976 - RNA, 21 nt, Mycobacterium tuberculosis H37Rv
cucgagcaccgcgaacauggu

SEQ ID NO: 3338977 - RNA, 21 nt, Mycobacterium tuberculosis H37Rv
cucgagcaggaugcgaucguc

SEQ ID NO: 3338978 - RNA, 16 nt, Mycobacterium tuberculosis H37Rv
cucgagcaggcgcacc

SEQ ID NO: 3338979 - RNA, 17 nt, Mycobacterium tuberculosis H37Rv
cucgagcaggcgcacca

SEQ ID NO: 3338980 - RNA, 15 nt, Mycobacterium tuberculosis H37Rv
cucgagccagcuccg

SEQ ID NO: 3338981 - RNA, 19 nt, Mycobacterium tuberculosis H37Rv
cucgagcccgcguucagga

SEQ ID NO: 3338982 - RNA, 13 nt, Mycobacterium tuberculosis H37Rv
cucgagcgcgccg

SEQ ID NO: 3338983 - RNA, 14 nt, Mycobacterium tuberculosis H37Rv
cucgagcgcgccgc

SEQ ID NO: 3338984 - RNA, 13 nt, Mycobacterium tuberculosis H37Rv
cucgaggaccacc

SEQ ID NO: 3338985 - RNA, 13 nt, Mycobacterium tuberculosis H37Rv
cucgaggaccugc

SEQ ID NO: 3338986 - RNA, 19 nt, Mycobacterium tuberculosis H37Rv
cucgaggacggcguagacg

SEQ ID NO: 3338987 - RNA, 21 nt, Mycobacterium tuberculosis H37Rv
cucgagggauguagugcugcu

SEQ ID NO: 3338988 - RNA, 18 nt, Mycobacterium tuberculosis H37Rv
cucgaggucgagcgccgc

SEQ ID NO: 3338989 - RNA, 13 nt, Mycobacterium tuberculosis H37Rv
cucgaggucucca

SEQ ID NO: 3338990 - RNA, 17 nt, Mycobacterium tuberculosis H37Rv
cucgaguaccgucugga

SEQ ID NO: 3338991 - RNA, 19 nt, Mycobacterium tuberculosis H37Rv
cucgaguccaggcagcuug

SEQ ID NO: 3338992 - RNA, 15 nt, Mycobacterium tuberculosis H37Rv
cucgagugccgccgu

SEQ ID NO: 3338993 - RNA, 22 nt, Mycobacterium tuberculosis H37Rv
cucgaguucgaccggcgggacg

SEQ ID NO: 3338994 - RNA, 16 nt, Mycobacterium tuberculosis H37Rv
cucgauacccaggaug

SEQ ID NO: 3338995 - RNA, 23 nt, Mycobacterium tuberculosis H37Rv
cucgauauaacccggcuccagca

SEQ ID NO: 3338996 - RNA, 21 nt, Mycobacterium tuberculosis H37Rv
cucgauauggguugccagcga

SEQ ID NO: 3338997 - RNA, 17 nt, Mycobacterium tuberculosis H37Rv
cucgaucaccggcaugc

SEQ ID NO: 3338998 - RNA, 21 nt, Mycobacterium tuberculosis H37Rv
cucgaucacuagcgccccugg

SEQ ID NO: 3338999 - RNA, 21 nt, Mycobacterium tuberculosis H37Rv
cucgaucagccgggugcgcac

SEQ ID NO: 3339000 - RNA, 14 nt, Mycobacterium tuberculosis H37Rv
cucgaucagcgccg

SEQ ID NO: 3339001 - RNA, 21 nt, Mycobacterium tuberculosis H37Rv
cucgaucaucaugucggcgca

SEQ ID NO: 3339002 - RNA, 16 nt, Mycobacterium tuberculosis H37Rv
cucgaucaucgggagc

SEQ ID NO: 3339003 - RNA, 19 nt, Mycobacterium tuberculosis H37Rv
cucgaucaucgggagccgc

SEQ ID NO: 3339004 - RNA, 16 nt, Mycobacterium tuberculosis H37Rv
cucgauccgcagaaug

SEQ ID NO: 3339005 - RNA, 21 nt, Mycobacterium tuberculosis H37Rv
cucgauccggauucagaucuc

SEQ ID NO: 3339006 - RNA, 14 nt, Mycobacterium tuberculosis H37Rv
cucgaucgacucga

SEQ ID NO: 3339007 - RNA, 12 nt, Mycobacterium tuberculosis H37Rv
cucgaucggcag

SEQ ID NO: 3339008 - RNA, 15 nt, Mycobacterium tuberculosis H37Rv
cucgaucgucgacgc

SEQ ID NO: 3339009 - RNA, 18 nt, Mycobacterium tuberculosis H37Rv
cucgaucuggucaagacc

SEQ ID NO: 3339010 - RNA, 21 nt, Mycobacterium tuberculosis H37Rv
cucgaucuggucaagacccgc

SEQ ID NO: 3339011 - RNA, 19 nt, Mycobacterium tuberculosis H37Rv
cucgaucuugggccacgcu

SEQ ID NO: 3339012 - RNA, 21 nt, Mycobacterium tuberculosis H37Rv
cucgaugacaucggucagcgg

SEQ ID NO: 3339013 - RNA, 20 nt, Mycobacterium tuberculosis H37Rv
cucgaugaugucgagcacac

SEQ ID NO: 3339014 - RNA, 15 nt, Mycobacterium tuberculosis H37Rv
cucgaugcgggcgcc

SEQ ID NO: 3339015 - RNA, 13 nt, Mycobacterium tuberculosis H37Rv
cucgauggaccgc

SEQ ID NO: 3339016 - RNA, 14 nt, Mycobacterium tuberculosis H37Rv
cucgauggccuugu

SEQ ID NO: 3339017 - RNA, 20 nt, Mycobacterium tuberculosis H37Rv
cucgauggucucccggcuga

SEQ ID NO: 3339018 - RNA, 21 nt, Mycobacterium tuberculosis H37Rv
cucgaugguuuucucgaaguc

SEQ ID NO: 3339019 - RNA, 18 nt, Mycobacterium tuberculosis H37Rv
cucgauguacagcgggau

SEQ ID NO: 3339020 - RNA, 14 nt, Mycobacterium tuberculosis H37Rv
cucgaugucagcgg

SEQ ID NO: 3339021 - RNA, 19 nt, Mycobacterium tuberculosis H37Rv
cucgauguccucgauccgg

SEQ ID NO: 3339022 - RNA, 17 nt, Mycobacterium tuberculosis H37Rv
cucgauuguggccagcg

SEQ ID NO: 3339023 - RNA, 15 nt, Mycobacterium tuberculosis H37Rv
cucgcacagcaccac

SEQ ID NO: 3339024 - RNA, 14 nt, Mycobacterium tuberculosis H37Rv
cucgcacagccgcu

SEQ ID NO: 3339025 - RNA, 23 nt, Mycobacterium tuberculosis H37Rv
cucgcaccgugaguacucgguca

SEQ ID NO: 3339026 - RNA, 21 nt, Mycobacterium tuberculosis H37Rv
cucgcacgacaccucgaaggc

SEQ ID NO: 3339027 - RNA, 23 nt, Mycobacterium tuberculosis H37Rv
cucgcacucguugccgaccaugc

SEQ ID NO: 3339028 - RNA, 21 nt, Mycobacterium tuberculosis H37Rv
cucgcagcaacggcggcgucg

SEQ ID NO: 3339029 - RNA, 20 nt, Mycobacterium tuberculosis H37Rv
cucgcagcauguccgcagcg

SEQ ID NO: 3339030 - RNA, 21 nt, Mycobacterium tuberculosis H37Rv
cucgcaggaauucgccauagc

SEQ ID NO: 3339031 - RNA, 22 nt, Mycobacterium tuberculosis H37Rv
cucgcaucaucggaaccguuug

SEQ ID NO: 3339032 - RNA, 13 nt, Mycobacterium tuberculosis H37Rv
cucgcaucggccu

SEQ ID NO: 3339033 - RNA, 22 nt, Mycobacterium tuberculosis H37Rv
cucgccacgcucggcggccagc

SEQ ID NO: 3339034 - RNA, 19 nt, Mycobacterium tuberculosis H37Rv
cucgccagagucggagacc

SEQ ID NO: 3339035 - RNA, 22 nt, Mycobacterium tuberculosis H37Rv
cucgccagagucggagacccgu

SEQ ID NO: 3339036 - RNA, 17 nt, Mycobacterium tuberculosis H37Rv
cucgccagccugaaccg

SEQ ID NO: 3339037 - RNA, 18 nt, Mycobacterium tuberculosis H37Rv
cucgccaggccuaggccg

SEQ ID NO: 3339038 - RNA, 16 nt, Mycobacterium tuberculosis H37Rv
cucgccagggucgcga

SEQ ID NO: 3339039 - RNA, 22 nt, Mycobacterium tuberculosis H37Rv
cucgccagggucgcgagcccgc

SEQ ID NO: 3339040 - RNA, 15 nt, Mycobacterium tuberculosis H37Rv
cucgcccaccaccac

SEQ ID NO: 3339041 - RNA, 15 nt, Mycobacterium tuberculosis H37Rv
cucgcccacccgcug

SEQ ID NO: 3339042 - RNA, 20 nt, Mycobacterium tuberculosis H37Rv
cucgcccaccuccugguuga

SEQ ID NO: 3339043 - RNA, 20 nt, Mycobacterium tuberculosis H37Rv
cucgcccagugaaucggacc

SEQ ID NO: 3339044 - RNA, 22 nt, Mycobacterium tuberculosis H37Rv
cucgcccccucuagcgccucgc

SEQ ID NO: 3339045 - RNA, 15 nt, Mycobacterium tuberculosis H37Rv
cucgcccgccgccac

SEQ ID NO: 3339046 - RNA, 23 nt, Mycobacterium tuberculosis H37Rv
cucggccacgaacccucagccgc

SEQ ID NO: 3339047 - RNA, 16 nt, Mycobacterium tuberculosis H37Rv
cucggccacggcgucg

SEQ ID NO: 3339048 - RNA, 15 nt, Mycobacterium tuberculosis H37Rv
cucggccagcacgcc

SEQ ID NO: 3339049 - RNA, 17 nt, Mycobacterium tuberculosis H37Rv
cucggccagcacgccgc

SEQ ID NO: 3339050 - RNA, 14 nt, Mycobacterium tuberculosis H37Rv
cucggccagcgccu

SEQ ID NO: 3339051 - RNA, 17 nt, Mycobacterium tuberculosis H37Rv
cucggccauagcgccgc

SEQ ID NO: 3339052 - RNA, 22 nt, Mycobacterium tuberculosis H37Rv
cucggccaucagaaccuccucg

SEQ ID NO: 3339053 - RNA, 22 nt, Mycobacterium tuberculosis H37Rv
cucggccaucugcucgugggua

SEQ ID NO: 3339054 - RNA, 17 nt, Mycobacterium tuberculosis H37Rv
cucggcccagcgcgcca

SEQ ID NO: 3339055 - RNA, 18 nt, Mycobacterium tuberculosis H37Rv
cucggcccagcgcgccag

SEQ ID NO: 3339056 - RNA, 13 nt, Mycobacterium tuberculosis H37Rv
cucggccccgucc

SEQ ID NO: 3339057 - RNA, 14 nt, Mycobacterium tuberculosis H37Rv
cucggccgacgaga

SEQ ID NO: 3339058 - RNA, 15 nt, Mycobacterium tuberculosis H37Rv
cucggccgcaccagc

SEQ ID NO: 3339059 - RNA, 16 nt, Mycobacterium tuberculosis H37Rv
cucggccgcaccagca

SEQ ID NO: 3339060 - RNA, 15 nt, Mycobacterium tuberculosis H37Rv
cucggccgccagccc

SEQ ID NO: 3339061 - RNA, 13 nt, Mycobacterium tuberculosis H37Rv
cucggccggcggc

SEQ ID NO: 3339062 - RNA, 14 nt, Mycobacterium tuberculosis H37Rv
cucggccggcggcg

SEQ ID NO: 3339063 - RNA, 13 nt, Mycobacterium tuberculosis H37Rv
cucggccgugacc

SEQ ID NO: 3339064 - RNA, 21 nt, Mycobacterium tuberculosis H37Rv
cucggccgugaccgagccgcg

SEQ ID NO: 3339065 - RNA, 23 nt, Mycobacterium tuberculosis H37Rv
cucggccgugugcucgaaggacc

SEQ ID NO: 3339066 - RNA, 22 nt, Mycobacterium tuberculosis H37Rv
cucggccugcugcugcagcgau

SEQ ID NO: 3339067 - RNA, 13 nt, Mycobacterium tuberculosis H37Rv
cucggccuggaug

SEQ ID NO: 3339068 - RNA, 22 nt, Mycobacterium tuberculosis H37Rv
cucggccuguucggcggcugcc

SEQ ID NO: 3339069 - RNA, 20 nt, Mycobacterium tuberculosis H37Rv
cucggcgaaggccgcgcgca

SEQ ID NO: 3339070 - RNA, 14 nt, Mycobacterium tuberculosis H37Rv
cucggcgacugcgu

SEQ ID NO: 3339071 - RNA, 14 nt, Mycobacterium tuberculosis H37Rv
cucggcgagcaccg

SEQ ID NO: 3339072 - RNA, 15 nt, Mycobacterium tuberculosis H37Rv
cucggcgagccgcuc

SEQ ID NO: 3339073 - RNA, 23 nt, Mycobacterium tuberculosis H37Rv
cucggcgagugucuuagccagca

SEQ ID NO: 3339074 - RNA, 17 nt, Mycobacterium tuberculosis H37Rv
cucggcgaguucggcag

SEQ ID NO: 3339075 - RNA, 22 nt, Mycobacterium tuberculosis H37Rv
cucggcgaucaauugcccggca

SEQ ID NO: 3339076 - RNA, 13 nt, Mycobacterium tuberculosis H37Rv
cucggcgcagcac

SEQ ID NO: 3339077 - RNA, 13 nt, Mycobacterium tuberculosis H37Rv
cucggcgcagccg

SEQ ID NO: 3339078 - RNA, 15 nt, Mycobacterium tuberculosis H37Rv
cucggcgcagccggu

SEQ ID NO: 3339079 - RNA, 17 nt, Mycobacterium tuberculosis H37Rv
cucggcgcagccgguga

SEQ ID NO: 3339080 - RNA, 14 nt, Mycobacterium tuberculosis H37Rv
cucggcgcccagcu

SEQ ID NO: 3339081 - RNA, 21 nt, Mycobacterium tuberculosis H37Rv
cucggcgccgaacucaacgac

SEQ ID NO: 3339082 - RNA, 13 nt, Mycobacterium tuberculosis H37Rv
cucggcgccgccc

SEQ ID NO: 3339083 - RNA, 14 nt, Mycobacterium tuberculosis H37Rv
cucggcgccgccca

SEQ ID NO: 3339084 - RNA, 15 nt, Mycobacterium tuberculosis H37Rv
cucggcgccgcccag

SEQ ID NO: 3339085 - RNA, 15 nt, Mycobacterium tuberculosis H37Rv
cucggcgcgcgacga

SEQ ID NO: 3339086 - RNA, 16 nt, Mycobacterium tuberculosis H37Rv
cucggcgcgcucggcc

SEQ ID NO: 3339087 - RNA, 22 nt, Mycobacterium tuberculosis H37Rv
cucggcgcucaugggcgccauc

SEQ ID NO: 3339088 - RNA, 12 nt, Mycobacterium tuberculosis H37Rv
cucggcgcugac

SEQ ID NO: 3339089 - RNA, 16 nt, Mycobacterium tuberculosis H37Rv
cucggcgcugcgcacc

SEQ ID NO: 3339090 - RNA, 17 nt, Mycobacterium tuberculosis H37Rv
cucggcggacccgguga

SEQ ID NO: 3339091 - RNA, 18 nt, Mycobacterium tuberculosis H37Rv
cucggcggacccggugac

SEQ ID NO: 3339092 - RNA, 21 nt, Mycobacterium tuberculosis H37Rv
cucggcggagacggcggccau

SEQ ID NO: 3339093 - RNA, 16 nt, Mycobacterium tuberculosis H37Rv
cucggcggccaacagc

SEQ ID NO: 3339094 - RNA, 12 nt, Mycobacterium tuberculosis H37Rv
cucggcggccag

SEQ ID NO: 3339095 - RNA, 14 nt, Mycobacterium tuberculosis H37Rv
cucggcggccagcg

SEQ ID NO: 3339096 - RNA, 15 nt, Mycobacterium tuberculosis H37Rv
cucggcggccagcga

SEQ ID NO: 3339097 - RNA, 16 nt, Mycobacterium tuberculosis H37Rv
cucggcggccagcgcg

SEQ ID NO: 3339098 - RNA, 19 nt, Mycobacterium tuberculosis H37Rv
cucggcggccagcucccgc

SEQ ID NO: 3339099 - RNA, 12 nt, Mycobacterium tuberculosis H37Rv
cucggcggccgc

SEQ ID NO: 3339100 - RNA, 12 nt, Mycobacterium tuberculosis H37Rv
cucggcggccuc

SEQ ID NO: 3339101 - RNA, 15 nt, Mycobacterium tuberculosis H37Rv
cucggcggccucgcu

SEQ ID NO: 3339102 - RNA, 22 nt, Mycobacterium tuberculosis H37Rv
cucggcggcgcggucgaagcug

SEQ ID NO: 3339103 - RNA, 15 nt, Mycobacterium tuberculosis H37Rv
cucggcggcggcacg

SEQ ID NO: 3339104 - RNA, 21 nt, Mycobacterium tuberculosis H37Rv
cucggcgggauccucgaaggc

SEQ ID NO: 3339105 - RNA, 21 nt, Mycobacterium tuberculosis H37Rv
cucggcgggggaccccgccag

SEQ ID NO: 3339106 - RNA, 18 nt, Mycobacterium tuberculosis H37Rv
cucggcggugccgcggcu

SEQ ID NO: 3339107 - RNA, 17 nt, Mycobacterium tuberculosis H37Rv
cucggcguacucgugca

SEQ ID NO: 3339108 - RNA, 20 nt, Mycobacterium tuberculosis H37Rv
cucggcguccgcccagcacc

SEQ ID NO: 3339109 - RNA, 14 nt, Mycobacterium tuberculosis H37Rv
cucggcgucgccgc

SEQ ID NO: 3339110 - RNA, 17 nt, Mycobacterium tuberculosis H37Rv
cucggcgucgccgccau

SEQ ID NO: 3339111 - RNA, 21 nt, Mycobacterium tuberculosis H37Rv
cucggcgucgccgccauugcc

SEQ ID NO: 3339112 - RNA, 22 nt, Mycobacterium tuberculosis H37Rv
cucggcgucgugguggccacgg

SEQ ID NO: 3339113 - RNA, 16 nt, Mycobacterium tuberculosis H37Rv
cucggcgugcucggcc

SEQ ID NO: 3339114 - RNA, 16 nt, Mycobacterium tuberculosis H37Rv
cucggcguugccgccg

SEQ ID NO: 3339115 - RNA, 18 nt, Mycobacterium tuberculosis H37Rv
cucggcuagugugaccgu

SEQ ID NO: 3339116 - RNA, 16 nt, Mycobacterium tuberculosis H37Rv
cucggcuauggguucg

SEQ ID NO: 3339117 - RNA, 16 nt, Mycobacterium tuberculosis H37Rv
cucggcugcucgacgg

SEQ ID NO: 3339118 - RNA, 23 nt, Mycobacterium tuberculosis H37Rv
cucggcugcucgacggcuccgau

SEQ ID NO: 3339119 - RNA, 13 nt, Mycobacterium tuberculosis H37Rv
cucggcuucggag

SEQ ID NO: 3339120 - RNA, 22 nt, Mycobacterium tuberculosis H37Rv
cucggcuucggagccgacaacg

SEQ ID NO: 3339121 - RNA, 17 nt, Mycobacterium tuberculosis H37Rv
cucggcuuggccggcgg

SEQ ID NO: 3339122 - RNA, 19 nt, Mycobacterium tuberculosis H37Rv
cucgggacggccgccgccg

SEQ ID NO: 3339123 - RNA, 13 nt, Mycobacterium tuberculosis H37Rv
cucgggaucggcg

SEQ ID NO: 3339124 - RNA, 18 nt, Mycobacterium tuberculosis H37Rv
cucgggcaacucggugac

SEQ ID NO: 3339125 - RNA, 14 nt, Mycobacterium tuberculosis H37Rv
cucgggcagcgcgg

SEQ ID NO: 3339126 - RNA, 19 nt, Mycobacterium tuberculosis H37Rv
cucgggcagcgucacccug

SEQ ID NO: 3339127 - RNA, 18 nt, Mycobacterium tuberculosis H37Rv
cucgggcaggccccacug

SEQ ID NO: 3339128 - RNA, 19 nt, Mycobacterium tuberculosis H37Rv
cucgggcaggcggccagcg

SEQ ID NO: 3339129 - RNA, 15 nt, Mycobacterium tuberculosis H37Rv
cucgggcgaagccgc

SEQ ID NO: 3339130 - RNA, 17 nt, Mycobacterium tuberculosis H37Rv
cucgggcgcgggugacc

SEQ ID NO: 3339131 - RNA, 21 nt, Mycobacterium tuberculosis H37Rv
cucgggcgcgggugaccaggc

SEQ ID NO: 3339132 - RNA, 12 nt, Mycobacterium tuberculosis H37Rv
cucgggcggcuu

SEQ ID NO: 3339133 - RNA, 15 nt, Mycobacterium tuberculosis H37Rv
cucggggaacaccgc

SEQ ID NO: 3339134 - RNA, 23 nt, Mycobacterium tuberculosis H37Rv
cucggggaguuccaaaucggugg

SEQ ID NO: 3339135 - RNA, 13 nt, Mycobacterium tuberculosis H37Rv
cucggggcgauga

SEQ ID NO: 3339136 - RNA, 22 nt, Mycobacterium tuberculosis H37Rv
cucggggcucucgaguccaggc

SEQ ID NO: 3339137 - RNA, 16 nt, Mycobacterium tuberculosis H37Rv
cucgggggauccggcg

SEQ ID NO: 3339138 - RNA, 18 nt, Mycobacterium tuberculosis H37Rv
cucgggggauccggcgca

SEQ ID NO: 3339139 - RNA, 14 nt, Mycobacterium tuberculosis H37Rv
cucgggggccgacc

SEQ ID NO: 3339140 - RNA, 12 nt, Mycobacterium tuberculosis H37Rv
cucgggggcugc

SEQ ID NO: 3339141 - RNA, 17 nt, Mycobacterium tuberculosis H37Rv
cucgggggcugcacgcu

SEQ ID NO: 3339142 - RNA, 14 nt, Mycobacterium tuberculosis H37Rv
cucggggugguggu

SEQ ID NO: 3339143 - RNA, 21 nt, Mycobacterium tuberculosis H37Rv
cucguggauggccgccaggcg

SEQ ID NO: 3339144 - RNA, 21 nt, Mycobacterium tuberculosis H37Rv
cucguggguccguuuuaccuc

SEQ ID NO: 3339145 - RNA, 16 nt, Mycobacterium tuberculosis H37Rv
cucguggucgacguga

SEQ ID NO: 3339146 - RNA, 20 nt, Mycobacterium tuberculosis H37Rv
cucguguccggggaccucgg

SEQ ID NO: 3339147 - RNA, 14 nt, Mycobacterium tuberculosis H37Rv
cucgugucugccuc

SEQ ID NO: 3339148 - RNA, 20 nt, Mycobacterium tuberculosis H37Rv
cucguuagaguaggccacca

SEQ ID NO: 3339149 - RNA, 23 nt, Mycobacterium tuberculosis H37Rv
cucguucaacuuggggucguucg

SEQ ID NO: 3339150 - RNA, 17 nt, Mycobacterium tuberculosis H37Rv
cucguucauguagcagc

SEQ ID NO: 3339151 - RNA, 17 nt, Mycobacterium tuberculosis H37Rv
cucguucauguccaccg

SEQ ID NO: 3339152 - RNA, 18 nt, Mycobacterium tuberculosis H37Rv
cucguugauacggcaugc

SEQ ID NO: 3339153 - RNA, 16 nt, Mycobacterium tuberculosis H37Rv
cucguugcugccggcg

SEQ ID NO: 3339154 - RNA, 17 nt, Mycobacterium tuberculosis H37Rv
cucguuugcgagcaggg

SEQ ID NO: 3339155 - RNA, 21 nt, Mycobacterium tuberculosis H37Rv
cucuagcaaagccagcgcagc

SEQ ID NO: 3339156 - RNA, 23 nt, Mycobacterium tuberculosis H37Rv
cucuagcgccucgccggccaccc

SEQ ID NO: 3339157 - RNA, 19 nt, Mycobacterium tuberculosis H37Rv
cucuaucagacgauucggc

SEQ ID NO: 3339158 - RNA, 20 nt, Mycobacterium tuberculosis H37Rv
cucucagcacgguuguugua

SEQ ID NO: 3339159 - RNA, 20 nt, Mycobacterium tuberculosis H37Rv
cucuccauggccgauuccgc

SEQ ID NO: 3339160 - RNA, 14 nt, Mycobacterium tuberculosis H37Rv
cucuccccuggccc

SEQ ID NO: 3339161 - RNA, 13 nt, Mycobacterium tuberculosis H37Rv
cucuccguccucg

SEQ ID NO: 3339162 - RNA, 19 nt, Mycobacterium tuberculosis H37Rv
cucucggucaguuccucua

SEQ ID NO: 3339163 - RNA, 21 nt, Mycobacterium tuberculosis H37Rv
cucucggugaacgccgccccg

SEQ ID NO: 3339164 - RNA, 19 nt, Mycobacterium tuberculosis H37Rv
cucucguggauggccgcca

SEQ ID NO: 3339165 - RNA, 15 nt, Mycobacterium tuberculosis H37Rv
cucucuucgcgcgcu

SEQ ID NO: 3339166 - RNA, 21 nt, Mycobacterium tuberculosis H37Rv
cucucuucgcgcgcugggcgc

SEQ ID NO: 3339167 - RNA, 14 nt, Mycobacterium tuberculosis H37Rv
cucugaccagccgg

SEQ ID NO: 3339168 - RNA, 22 nt, Mycobacterium tuberculosis H37Rv
cucugccacgcguuccuccagc

SEQ ID NO: 3339169 - RNA, 17 nt, Mycobacterium tuberculosis H37Rv
cucugcgacaccacgaa

SEQ ID NO: 3339170 - RNA, 22 nt, Mycobacterium tuberculosis H37Rv
cucugcgucugcucaccagcgg

SEQ ID NO: 3339171 - RNA, 22 nt, Mycobacterium tuberculosis H37Rv
cucuggauucuucagcgcggca

SEQ ID NO: 3339172 - RNA, 14 nt, Mycobacterium tuberculosis H37Rv
cucugggcuguccu

SEQ ID NO: 3339173 - RNA, 20 nt, Mycobacterium tuberculosis H37Rv
cucugggcuguccuccugaa

SEQ ID NO: 3339174 - RNA, 13 nt, Mycobacterium tuberculosis H37Rv
cucuggugacggu

SEQ ID NO: 3339175 - RNA, 20 nt, Mycobacterium tuberculosis H37Rv
cucugguggcgcugaagccg

SEQ ID NO: 3339176 - RNA, 23 nt, Mycobacterium tuberculosis H37Rv
cucugguuuuacacaccagcggu

SEQ ID NO: 3339177 - RNA, 17 nt, Mycobacterium tuberculosis H37Rv
cucugucuucagcugcg

SEQ ID NO: 3339178 - RNA, 22 nt, Mycobacterium tuberculosis H37Rv
cucuucaggcccucgggacugc

SEQ ID NO: 3339179 - RNA, 20 nt, Mycobacterium tuberculosis H37Rv
cucuuccuggcgugagccga

SEQ ID NO: 3339180 - RNA, 20 nt, Mycobacterium tuberculosis H37Rv
cucuucgaugaagcugguga

SEQ ID NO: 3339181 - RNA, 16 nt, Mycobacterium tuberculosis H37Rv
cucuucgggugcagcc

SEQ ID NO: 3339182 - RNA, 20 nt, Mycobacterium tuberculosis H37Rv
cucuucggucagggugggcu

SEQ ID NO: 3339183 - RNA, 21 nt, Mycobacterium tuberculosis H37Rv
cucuucggucagggugggcuc

SEQ ID NO: 3339184 - RNA, 13 nt, Mycobacterium tuberculosis H37Rv
cucuugcaccagg

SEQ ID NO: 3339185 - RNA, 13 nt, Mycobacterium tuberculosis H37Rv
cucuugcccuucu

SEQ ID NO: 3339186 - RNA, 14 nt, Mycobacterium tuberculosis H37Rv
cucuuuuagccaca

SEQ ID NO: 3339187 - RNA, 16 nt, Mycobacterium tuberculosis H37Rv
cugaaaauugaccccc

SEQ ID NO: 3339188 - RNA, 19 nt, Mycobacterium tuberculosis H37Rv
cugaaaugccgucgucaaa

SEQ ID NO: 3339189 - RNA, 13 nt, Mycobacterium tuberculosis H37Rv
cugaacaggccgg

SEQ ID NO: 3339190 - RNA, 20 nt, Mycobacterium tuberculosis H37Rv
cugaacauuccggcaccucc

SEQ ID NO: 3339191 - RNA, 22 nt, Mycobacterium tuberculosis H37Rv
cugaaccagaugggugacccgc

SEQ ID NO: 3339192 - RNA, 19 nt, Mycobacterium tuberculosis H37Rv
cugaaccggccgcgacgac

SEQ ID NO: 3339193 - RNA, 23 nt, Mycobacterium tuberculosis H37Rv
cugaaccgguugacacccgggcc

SEQ ID NO: 3339194 - RNA, 21 nt, Mycobacterium tuberculosis H37Rv
cugaacgcuguaagcaugccg

SEQ ID NO: 3339195 - RNA, 19 nt, Mycobacterium tuberculosis H37Rv
cugaagccagcgcagcacc

SEQ ID NO: 3339196 - RNA, 13 nt, Mycobacterium tuberculosis H37Rv
cugaagcccgaca

SEQ ID NO: 3339197 - RNA, 15 nt, Mycobacterium tuberculosis H37Rv
cugaagccgcgcugc

SEQ ID NO: 3339198 - RNA, 22 nt, Mycobacterium tuberculosis H37Rv
cugaagccgucguaugcgguga

SEQ ID NO: 3339199 - RNA, 17 nt, Mycobacterium tuberculosis H37Rv
cugaaggacggcagcuu

SEQ ID NO: 3339200 - RNA, 13 nt, Mycobacterium tuberculosis H37Rv
cugaaggccagcc

SEQ ID NO: 3339201 - RNA, 16 nt, Mycobacterium tuberculosis H37Rv
cugaaggccagccaac

SEQ ID NO: 3339202 - RNA, 15 nt, Mycobacterium tuberculosis H37Rv
cugaaggccgguagc

SEQ ID NO: 3339203 - RNA, 21 nt, Mycobacterium tuberculosis H37Rv
cugaaggccgguagcgcgggu

SEQ ID NO: 3339204 - RNA, 14 nt, Mycobacterium tuberculosis H37Rv
cugaaggcggcgau

SEQ ID NO: 3339205 - RNA, 13 nt, Mycobacterium tuberculosis H37Rv
cugaagggccgcc

SEQ ID NO: 3339206 - RNA, 16 nt, Mycobacterium tuberculosis H37Rv
cugaagguggcgaacc

SEQ ID NO: 3339207 - RNA, 14 nt, Mycobacterium tuberculosis H37Rv
cugaagguguccgc

SEQ ID NO: 3339208 - RNA, 17 nt, Mycobacterium tuberculosis H37Rv
cugaagucuaaguguug

SEQ ID NO: 3339209 - RNA, 19 nt, Mycobacterium tuberculosis H37Rv
cugaaguggcacaagcugg

SEQ ID NO: 3339210 - RNA, 22 nt, Mycobacterium tuberculosis H37Rv
cugaaucgguucggccagaacg

SEQ ID NO: 3339211 - RNA, 18 nt, Mycobacterium tuberculosis H37Rv
cugaaucguucucggucc

SEQ ID NO: 3339212 - RNA, 18 nt, Mycobacterium tuberculosis H37Rv
cugacaacgacaacaccc

SEQ ID NO: 3339213 - RNA, 22 nt, Mycobacterium tuberculosis H37Rv
cugacacccacggcgccaccac

SEQ ID NO: 3339214 - RNA, 17 nt, Mycobacterium tuberculosis H37Rv
cugacaccgaaccgccg

SEQ ID NO: 3339215 - RNA, 20 nt, Mycobacterium tuberculosis H37Rv
cugacaccgaaccgccgcug

SEQ ID NO: 3339216 - RNA, 18 nt, Mycobacterium tuberculosis H37Rv
cugacacgcccgcgagcu

SEQ ID NO: 3339217 - RNA, 15 nt, Mycobacterium tuberculosis H37Rv
cugacauagucacgg

SEQ ID NO: 3339218 - RNA, 14 nt, Mycobacterium tuberculosis H37Rv
cugacaucggccaa

SEQ ID NO: 3339219 - RNA, 15 nt, Mycobacterium tuberculosis H37Rv
cugacaucggccaag

SEQ ID NO: 3339220 - RNA, 21 nt, Mycobacterium tuberculosis H37Rv
cugaccaacucguggaacucc

SEQ ID NO: 3339221 - RNA, 13 nt, Mycobacterium tuberculosis H37Rv
cugaccacgguag

SEQ ID NO: 3339222 - RNA, 17 nt, Mycobacterium tuberculosis H37Rv
cugaccacgucggacag

SEQ ID NO: 3339223 - RNA, 24 nt, Mycobacterium tuberculosis H37Rv
cugaccagccuuaugcagugacag

SEQ ID NO: 3339224 - RNA, 13 nt, Mycobacterium tuberculosis H37Rv
cugacccaccgcc

SEQ ID NO: 3339225 - RNA, 18 nt, Mycobacterium tuberculosis H37Rv
cugacccaccgccccggc

SEQ ID NO: 3339226 - RNA, 12 nt, Mycobacterium tuberculosis H37Rv
cugaccccgccg

SEQ ID NO: 3339227 - RNA, 20 nt, Mycobacterium tuberculosis H37Rv
cugaccccgccgccacgggu

SEQ ID NO: 3339228 - RNA, 15 nt, Mycobacterium tuberculosis H37Rv
cugacccgccacaac

SEQ ID NO: 3339229 - RNA, 15 nt, Mycobacterium tuberculosis H37Rv
cugaccgaagaagcc

SEQ ID NO: 3339230 - RNA, 16 nt, Mycobacterium tuberculosis H37Rv
cugaccgaagaagccc

SEQ ID NO: 3339231 - RNA, 17 nt, Mycobacterium tuberculosis H37Rv
cugaccgaagaagcccg

SEQ ID NO: 3339232 - RNA, 18 nt, Mycobacterium tuberculosis H37Rv
cugaccgaagaagcccga

SEQ ID NO: 3339233 - RNA, 20 nt, Mycobacterium tuberculosis H37Rv
cugaccgaauggccgccgca

SEQ ID NO: 3339234 - RNA, 22 nt, Mycobacterium tuberculosis H37Rv
cugaccgaauggccgccgcagc

SEQ ID NO: 3339235 - RNA, 14 nt, Mycobacterium tuberculosis H37Rv
cugaccgccacccc

SEQ ID NO: 3339236 - RNA, 22 nt, Mycobacterium tuberculosis H37Rv
cugaccgcuaccagcugggcga

SEQ ID NO: 3339237 - RNA, 13 nt, Mycobacterium tuberculosis H37Rv
cugaccggcuauu

SEQ ID NO: 3339238 - RNA, 17 nt, Mycobacterium tuberculosis H37Rv
cugaccggucacccgug

SEQ ID NO: 3339239 - RNA, 15 nt, Mycobacterium tuberculosis H37Rv
cugcacagcaggcuc

SEQ ID NO: 3339240 - RNA, 20 nt, Mycobacterium tuberculosis H37Rv
cugcaccacggcggccaccu

SEQ ID NO: 3339241 - RNA, 23 nt, Mycobacterium tuberculosis H37Rv
cugcaccagcgaguugagcaugu

SEQ ID NO: 3339242 - RNA, 23 nt, Mycobacterium tuberculosis H37Rv
cugcacccaggcaucggugagcc

SEQ ID NO: 3339243 - RNA, 14 nt, Mycobacterium tuberculosis H37Rv
cugcacccgccagg

SEQ ID NO: 3339244 - RNA, 18 nt, Mycobacterium tuberculosis H37Rv
cugcacccgccagggcgg

SEQ ID NO: 3339245 - RNA, 16 nt, Mycobacterium tuberculosis H37Rv
cugcaccggcaggcgg

SEQ ID NO: 3339246 - RNA, 22 nt, Mycobacterium tuberculosis H37Rv
cugcaccggcuugggccaggcc

SEQ ID NO: 3339247 - RNA, 12 nt, Mycobacterium tuberculosis H37Rv
cugcaccgucac

SEQ ID NO: 3339248 - RNA, 18 nt, Mycobacterium tuberculosis H37Rv
cugcaccgucagcccgac

SEQ ID NO: 3339249 - RNA, 23 nt, Mycobacterium tuberculosis H37Rv
cugcaccuggcgcagcaacucga

SEQ ID NO: 3339250 - RNA, 17 nt, Mycobacterium tuberculosis H37Rv
cugcacguacucggcca

SEQ ID NO: 3339251 - RNA, 20 nt, Mycobacterium tuberculosis H37Rv
cugcacguacucggccagcu

SEQ ID NO: 3339252 - RNA, 14 nt, Mycobacterium tuberculosis H37Rv
cugcacgucggccc

SEQ ID NO: 3339253 - RNA, 21 nt, Mycobacterium tuberculosis H37Rv
cugcacuugaaauugagccgg

SEQ ID NO: 3339254 - RNA, 23 nt, Mycobacterium tuberculosis H37Rv
cugcacuugaaauugagccggcc

SEQ ID NO: 3339255 - RNA, 15 nt, Mycobacterium tuberculosis H37Rv
cugcagaaaggccaa

SEQ ID NO: 3339256 - RNA, 18 nt, Mycobacterium tuberculosis H37Rv
cugcagauaggacccagc

SEQ ID NO: 3339257 - RNA, 19 nt, Mycobacterium tuberculosis H37Rv
cugcagauaggacccagcc

SEQ ID NO: 3339258 - RNA, 14 nt, Mycobacterium tuberculosis H37Rv
cugcagaucggccg

SEQ ID NO: 3339259 - RNA, 21 nt, Mycobacterium tuberculosis H37Rv
cugcagcacucggugucggcc

SEQ ID NO: 3339260 - RNA, 19 nt, Mycobacterium tuberculosis H37Rv
cugcagcauggcccuggcg

SEQ ID NO: 3339261 - RNA, 23 nt, Mycobacterium tuberculosis H37Rv
cugcagccauucuucgaucagcg

SEQ ID NO: 3339262 - RNA, 16 nt, Mycobacterium tuberculosis H37Rv
cugcagcccgggcagc

SEQ ID NO: 3339263 - RNA, 17 nt, Mycobacterium tuberculosis H37Rv
cugcagcccgggcagca

SEQ ID NO: 3339264 - RNA, 18 nt, Mycobacterium tuberculosis H37Rv
cugcagcccgggcagcac

SEQ ID NO: 3339265 - RNA, 15 nt, Mycobacterium tuberculosis H37Rv
cugcagcccugcgca

SEQ ID NO: 3339266 - RNA, 19 nt, Mycobacterium tuberculosis H37Rv
cugcagcgaugacgaccaa

SEQ ID NO: 3339267 - RNA, 14 nt, Mycobacterium tuberculosis H37Rv
cugcagcgcggugg

SEQ ID NO: 3339268 - RNA, 20 nt, Mycobacterium tuberculosis H37Rv
cugcagcgucaagggcuggg

SEQ ID NO: 3339269 - RNA, 21 nt, Mycobacterium tuberculosis H37Rv
cugcagcucacgacuggcgcc

SEQ ID NO: 3339270 - RNA, 18 nt, Mycobacterium tuberculosis H37Rv
cugcagcucgggcaggga

SEQ ID NO: 3339271 - RNA, 15 nt, Mycobacterium tuberculosis H37Rv
cugcaggaaggcuuc

SEQ ID NO: 3339272 - RNA, 21 nt, Mycobacterium tuberculosis H37Rv
cugcaggcccaggcuguccga

SEQ ID NO: 3339273 - RNA, 20 nt, Mycobacterium tuberculosis H37Rv
cugcaggcggccgagcuggu

SEQ ID NO: 3339274 - RNA, 16 nt, Mycobacterium tuberculosis H37Rv
cugcaggcggccuugc

SEQ ID NO: 3339275 - RNA, 18 nt, Mycobacterium tuberculosis H37Rv
cugcaggcggccuugccg

SEQ ID NO: 3339276 - RNA, 21 nt, Mycobacterium tuberculosis H37Rv
cugcaggcugucgagucgguc

SEQ ID NO: 3339277 - RNA, 22 nt, Mycobacterium tuberculosis H37Rv
cugcagggccaauuccaugacg

SEQ ID NO: 3339278 - RNA, 14 nt, Mycobacterium tuberculosis H37Rv
cugcagggcgugau

SEQ ID NO: 3339279 - RNA, 15 nt, Mycobacterium tuberculosis H37Rv
cugcagggucgaguu

SEQ ID NO: 3339280 - RNA, 21 nt, Mycobacterium tuberculosis H37Rv
cugcagguuaggguccagguc

SEQ ID NO: 3339281 - RNA, 18 nt, Mycobacterium tuberculosis H37Rv
cugcagguuccacgcguu

SEQ ID NO: 3339282 - RNA, 20 nt, Mycobacterium tuberculosis H37Rv
cugcagguuccacgcguuga

SEQ ID NO: 3339283 - RNA, 17 nt, Mycobacterium tuberculosis H37Rv
cugcagguuuccggccu

SEQ ID NO: 3339284 - RNA, 14 nt, Mycobacterium tuberculosis H37Rv
cugcaguacggcca

SEQ ID NO: 3339285 - RNA, 23 nt, Mycobacterium tuberculosis H37Rv
cugcagucuuucccggggcuggg

SEQ ID NO: 3339286 - RNA, 18 nt, Mycobacterium tuberculosis H37Rv
cugcagugacucgaucac

SEQ ID NO: 3339287 - RNA, 20 nt, Mycobacterium tuberculosis H37Rv
cugcagugacucgaucacca

SEQ ID NO: 3339288 - RNA, 23 nt, Mycobacterium tuberculosis H37Rv
cugcagugacucgaucaccauga

SEQ ID NO: 3339289 - RNA, 16 nt, Mycobacterium tuberculosis H37Rv
cugcagugcggcguua

SEQ ID NO: 3339290 - RNA, 17 nt, Mycobacterium tuberculosis H37Rv
cugcauaggcgcgguca

SEQ ID NO: 3339291 - RNA, 15 nt, Mycobacterium tuberculosis H37Rv
cugcaucacaagggu

SEQ ID NO: 3339292 - RNA, 16 nt, Mycobacterium tuberculosis H37Rv
cugcaucacgccgucg

SEQ ID NO: 3339293 - RNA, 14 nt, Mycobacterium tuberculosis H37Rv
cugcauccuccucg

SEQ ID NO: 3339294 - RNA, 23 nt, Mycobacterium tuberculosis H37Rv
cugcaucgucgccaagcccaggc

SEQ ID NO: 3339295 - RNA, 15 nt, Mycobacterium tuberculosis H37Rv
cugcaugcccagaaa

SEQ ID NO: 3339296 - RNA, 18 nt, Mycobacterium tuberculosis H37Rv
cugcaugguggcgccgac

SEQ ID NO: 3339297 - RNA, 16 nt, Mycobacterium tuberculosis H37Rv
cugcauguccuccccg

SEQ ID NO: 3339298 - RNA, 17 nt, Mycobacterium tuberculosis H37Rv
cugccaaaagggcggca

SEQ ID NO: 3339299 - RNA, 19 nt, Mycobacterium tuberculosis H37Rv
cugccaaaagggcggcagc

SEQ ID NO: 3339300 - RNA, 15 nt, Mycobacterium tuberculosis H37Rv
cugccaacgggccau

SEQ ID NO: 3339301 - RNA, 16 nt, Mycobacterium tuberculosis H37Rv
cugccaaugcugcagg

SEQ ID NO: 3339302 - RNA, 18 nt, Mycobacterium tuberculosis H37Rv
cugccaaugcugcagguu

SEQ ID NO: 3339303 - RNA, 17 nt, Mycobacterium tuberculosis H37Rv
cugccacagcgacagcg

SEQ ID NO: 3339304 - RNA, 16 nt, Mycobacterium tuberculosis H37Rv
cugccacccggccagg

SEQ ID NO: 3339305 - RNA, 20 nt, Mycobacterium tuberculosis H37Rv
cugccacgaacgcuuccagc

SEQ ID NO: 3339306 - RNA, 20 nt, Mycobacterium tuberculosis H37Rv
cugccacgcguuccuccagc

SEQ ID NO: 3339307 - RNA, 19 nt, Mycobacterium tuberculosis H37Rv
cugccacguugaucccgaa

SEQ ID NO: 3339308 - RNA, 15 nt, Mycobacterium tuberculosis H37Rv
cugccagaaugggcg

SEQ ID NO: 3339309 - RNA, 19 nt, Mycobacterium tuberculosis H37Rv
cugccagaucggucggcca

SEQ ID NO: 3339310 - RNA, 20 nt, Mycobacterium tuberculosis H37Rv
cugccagaucggucggccaa

SEQ ID NO: 3339311 - RNA, 23 nt, Mycobacterium tuberculosis H37Rv
cugccagaucggucggccaaagc

SEQ ID NO: 3339312 - RNA, 12 nt, Mycobacterium tuberculosis H37Rv
cugccagcaccc

SEQ ID NO: 3339313 - RNA, 17 nt, Mycobacterium tuberculosis H37Rv
cugccagcacccugaug

SEQ ID NO: 3339314 - RNA, 20 nt, Mycobacterium tuberculosis H37Rv
cugccagcacccugauguga

SEQ ID NO: 3339315 - RNA, 13 nt, Mycobacterium tuberculosis H37Rv
cugccagccaugg

SEQ ID NO: 3339316 - RNA, 15 nt, Mycobacterium tuberculosis H37Rv
cugccagccauggcc

SEQ ID NO: 3339317 - RNA, 16 nt, Mycobacterium tuberculosis H37Rv
cugccagcguugcgga

SEQ ID NO: 3339318 - RNA, 22 nt, Mycobacterium tuberculosis H37Rv
cugccagcguugcggagaugcc

SEQ ID NO: 3339319 - RNA, 21 nt, Mycobacterium tuberculosis H37Rv
cugccaggcccgugccuggcc

SEQ ID NO: 3339320 - RNA, 22 nt, Mycobacterium tuberculosis H37Rv
cugccaguagucgccgggcggc

SEQ ID NO: 3339321 - RNA, 15 nt, Mycobacterium tuberculosis H37Rv
cugccagugccgccc

SEQ ID NO: 3339322 - RNA, 20 nt, Mycobacterium tuberculosis H37Rv
cugccaguucuuggcgaccu

SEQ ID NO: 3339323 - RNA, 18 nt, Mycobacterium tuberculosis H37Rv
cugccaucacgcgcucac

SEQ ID NO: 3339324 - RNA, 18 nt, Mycobacterium tuberculosis H37Rv
cugccaucccgaucccgg

SEQ ID NO: 3339325 - RNA, 19 nt, Mycobacterium tuberculosis H37Rv
cugccaucccgaucccggc

SEQ ID NO: 3339326 - RNA, 18 nt, Mycobacterium tuberculosis H37Rv
cugccaugugucccggac

SEQ ID NO: 3339327 - RNA, 16 nt, Mycobacterium tuberculosis H37Rv
cugccauugccugggc

SEQ ID NO: 3339328 - RNA, 20 nt, Mycobacterium tuberculosis H37Rv
cugcccaaaagcgcggcaac

SEQ ID NO: 3339329 - RNA, 14 nt, Mycobacterium tuberculosis H37Rv
cugcccaccgcagc

SEQ ID NO: 3339330 - RNA, 13 nt, Mycobacterium tuberculosis H37Rv
cugcccaccuucg

SEQ ID NO: 3339331 - RNA, 23 nt, Mycobacterium tuberculosis H37Rv
cugcccacgcggauaucuugcgc

SEQ ID NO: 3339332 - RNA, 15 nt, Mycobacterium tuberculosis H37Rv
cugcccagcaccacc

SEQ ID NO: 3339333 - RNA, 13 nt, Mycobacterium tuberculosis H37Rv
cugcccagcaccc

SEQ ID NO: 3339334 - RNA, 12 nt, Mycobacterium tuberculosis H37Rv
cugcccagcaga

SEQ ID NO: 3339335 - RNA, 14 nt, Mycobacterium tuberculosis H37Rv
cugcgaaugcuggg

SEQ ID NO: 3339336 - RNA, 21 nt, Mycobacterium tuberculosis H37Rv
cugcgaaugcugggcccgcca

SEQ ID NO: 3339337 - RNA, 21 nt, Mycobacterium tuberculosis H37Rv
cugcgacaagaccggcgggca

SEQ ID NO: 3339338 - RNA, 18 nt, Mycobacterium tuberculosis H37Rv
cugcgacagcacgugccc

SEQ ID NO: 3339339 - RNA, 21 nt, Mycobacterium tuberculosis H37Rv
cugcgaccaagucaugcccac

SEQ ID NO: 3339340 - RNA, 20 nt, Mycobacterium tuberculosis H37Rv
cugcgacgagcccaccgucg

SEQ ID NO: 3339341 - RNA, 23 nt, Mycobacterium tuberculosis H37Rv
cugcgacguuaacugcgccuaac

SEQ ID NO: 3339342 - RNA, 18 nt, Mycobacterium tuberculosis H37Rv
cugcgacuaagggcacuc

SEQ ID NO: 3339343 - RNA, 22 nt, Mycobacterium tuberculosis H37Rv
cugcgacuaagggcacuccacc

SEQ ID NO: 3339344 - RNA, 16 nt, Mycobacterium tuberculosis H37Rv
cugcgacuggaucgcg

SEQ ID NO: 3339345 - RNA, 16 nt, Mycobacterium tuberculosis H37Rv
cugcgacugugaaucu

SEQ ID NO: 3339346 - RNA, 22 nt, Mycobacterium tuberculosis H37Rv
cugcgagaggugcugcaccugg

SEQ ID NO: 3339347 - RNA, 19 nt, Mycobacterium tuberculosis H37Rv
cugcgagauguccucccau

SEQ ID NO: 3339348 - RNA, 14 nt, Mycobacterium tuberculosis H37Rv
cugcgagcgcagcg

SEQ ID NO: 3339349 - RNA, 16 nt, Mycobacterium tuberculosis H37Rv
cugcgagcgcagcgca

SEQ ID NO: 3339350 - RNA, 18 nt, Mycobacterium tuberculosis H37Rv
cugcgaugcugaucaccg

SEQ ID NO: 3339351 - RNA, 20 nt, Mycobacterium tuberculosis H37Rv
cugcgcaaauugcaacagag

SEQ ID NO: 3339352 - RNA, 15 nt, Mycobacterium tuberculosis H37Rv
cugcgcaaauuugaa

SEQ ID NO: 3339353 - RNA, 18 nt, Mycobacterium tuberculosis H37Rv
cugcgcaauagcgacagc

SEQ ID NO: 3339354 - RNA, 20 nt, Mycobacterium tuberculosis H37Rv
cugcgcaauagcgacagcag

SEQ ID NO: 3339355 - RNA, 14 nt, Mycobacterium tuberculosis H37Rv
cugcgcaccaaggc

SEQ ID NO: 3339356 - RNA, 22 nt, Mycobacterium tuberculosis H37Rv
cugcgcaccgccgcgcgacagg

SEQ ID NO: 3339357 - RNA, 12 nt, Mycobacterium tuberculosis H37Rv
cugcgcaccugg

SEQ ID NO: 3339358 - RNA, 21 nt, Mycobacterium tuberculosis H37Rv
cugcgcagaaucgccugcgac

SEQ ID NO: 3339359 - RNA, 15 nt, Mycobacterium tuberculosis H37Rv
cugcgcagccgccuc

SEQ ID NO: 3339360 - RNA, 17 nt, Mycobacterium tuberculosis H37Rv
cugcgcagccgccucaa

SEQ ID NO: 3339361 - RNA, 12 nt, Mycobacterium tuberculosis H37Rv
cugcgcagcgca

SEQ ID NO: 3339362 - RNA, 13 nt, Mycobacterium tuberculosis H37Rv
cugcgcagcggca

SEQ ID NO: 3339363 - RNA, 23 nt, Mycobacterium tuberculosis H37Rv
cugcgcagugaauugcccaagcg

SEQ ID NO: 3339364 - RNA, 20 nt, Mycobacterium tuberculosis H37Rv
cugcgcagugacgccucgac

SEQ ID NO: 3339365 - RNA, 18 nt, Mycobacterium tuberculosis H37Rv
cugcgcaucaccacuggc

SEQ ID NO: 3339366 - RNA, 20 nt, Mycobacterium tuberculosis H37Rv
cugcgcaucgguccaaagca

SEQ ID NO: 3339367 - RNA, 21 nt, Mycobacterium tuberculosis H37Rv
cugcgccaaaauccgcccacc

SEQ ID NO: 3339368 - RNA, 16 nt, Mycobacterium tuberculosis H37Rv
cugcgccacagcagcg

SEQ ID NO: 3339369 - RNA, 18 nt, Mycobacterium tuberculosis H37Rv
cugcgccacagcagcguu

SEQ ID NO: 3339370 - RNA, 16 nt, Mycobacterium tuberculosis H37Rv
cugcgccagcaacagc

SEQ ID NO: 3339371 - RNA, 17 nt, Mycobacterium tuberculosis H37Rv
cugcgccaggaauugcc

SEQ ID NO: 3339372 - RNA, 14 nt, Mycobacterium tuberculosis H37Rv
cugcgccaggcggc

SEQ ID NO: 3339373 - RNA, 17 nt, Mycobacterium tuberculosis H37Rv
cugcgccaggggcacca

SEQ ID NO: 3339374 - RNA, 23 nt, Mycobacterium tuberculosis H37Rv
cugcgccaguaggcuucgaccgu

SEQ ID NO: 3339375 - RNA, 15 nt, Mycobacterium tuberculosis H37Rv
cugcgcccauagcug

SEQ ID NO: 3339376 - RNA, 14 nt, Mycobacterium tuberculosis H37Rv
cugcgcccguccgc

SEQ ID NO: 3339377 - RNA, 18 nt, Mycobacterium tuberculosis H37Rv
cugcgcccguccgcgcgc

SEQ ID NO: 3339378 - RNA, 19 nt, Mycobacterium tuberculosis H37Rv
cugcgcccguccgcgcgcc

SEQ ID NO: 3339379 - RNA, 19 nt, Mycobacterium tuberculosis H37Rv
cugcgccgaacaccacacc

SEQ ID NO: 3339380 - RNA, 22 nt, Mycobacterium tuberculosis H37Rv
cugcgccgaacaccacaccgag

SEQ ID NO: 3339381 - RNA, 18 nt, Mycobacterium tuberculosis H37Rv
cugcgccgaacgcuccag

SEQ ID NO: 3339382 - RNA, 20 nt, Mycobacterium tuberculosis H37Rv
cugcgccgaacgcuccaggc

SEQ ID NO: 3339383 - RNA, 12 nt, Mycobacterium tuberculosis H37Rv
cugcgccgaccc

SEQ ID NO: 3339384 - RNA, 16 nt, Mycobacterium tuberculosis H37Rv
cugcgccgauacguga

SEQ ID NO: 3339385 - RNA, 15 nt, Mycobacterium tuberculosis H37Rv
cugcgccgccacagc

SEQ ID NO: 3339386 - RNA, 19 nt, Mycobacterium tuberculosis H37Rv
cugcgccgccacagcaccc

SEQ ID NO: 3339387 - RNA, 16 nt, Mycobacterium tuberculosis H37Rv
cugcgccgggcucgcg

SEQ ID NO: 3339388 - RNA, 22 nt, Mycobacterium tuberculosis H37Rv
cugcgccgggucuguccaaugc

SEQ ID NO: 3339389 - RNA, 19 nt, Mycobacterium tuberculosis H37Rv
cugcgccggugccggccau

SEQ ID NO: 3339390 - RNA, 21 nt, Mycobacterium tuberculosis H37Rv
cugcgccggugccggccaucg

SEQ ID NO: 3339391 - RNA, 23 nt, Mycobacterium tuberculosis H37Rv
cugcgccgucaacaccauggugg

SEQ ID NO: 3339392 - RNA, 15 nt, Mycobacterium tuberculosis H37Rv
cugcgccguucgcuc

SEQ ID NO: 3339393 - RNA, 21 nt, Mycobacterium tuberculosis H37Rv
cugcgccguucgcucccccgc

SEQ ID NO: 3339394 - RNA, 23 nt, Mycobacterium tuberculosis H37Rv
cugcgccguucgcucccccgcua

SEQ ID NO: 3339395 - RNA, 21 nt, Mycobacterium tuberculosis H37Rv
cugcgccucggcggccagcuc

SEQ ID NO: 3339396 - RNA, 17 nt, Mycobacterium tuberculosis H37Rv
cugcgccuucgccagcg

SEQ ID NO: 3339397 - RNA, 21 nt, Mycobacterium tuberculosis H37Rv
cugcgccuucgccagcggcgc

SEQ ID NO: 3339398 - RNA, 18 nt, Mycobacterium tuberculosis H37Rv
cugcgccuugaagcggug

SEQ ID NO: 3339399 - RNA, 18 nt, Mycobacterium tuberculosis H37Rv
cugcgccuuggucgccgg

SEQ ID NO: 3339400 - RNA, 15 nt, Mycobacterium tuberculosis H37Rv
cugcgcgaagccacc

SEQ ID NO: 3339401 - RNA, 18 nt, Mycobacterium tuberculosis H37Rv
cugcgcgaagccaccagg

SEQ ID NO: 3339402 - RNA, 18 nt, Mycobacterium tuberculosis H37Rv
cugcgcgauccgcgcgca

SEQ ID NO: 3339403 - RNA, 14 nt, Mycobacterium tuberculosis H37Rv
cugcgcgaugcgau

SEQ ID NO: 3339404 - RNA, 15 nt, Mycobacterium tuberculosis H37Rv
cugcgcgaugcgauu

SEQ ID NO: 3339405 - RNA, 15 nt, Mycobacterium tuberculosis H37Rv
cugcgcgauggccgu

SEQ ID NO: 3339406 - RNA, 18 nt, Mycobacterium tuberculosis H37Rv
cugcgcgcccaccgggcg

SEQ ID NO: 3339407 - RNA, 21 nt, Mycobacterium tuberculosis H37Rv
cugcgcgcccaccgggcggcg

SEQ ID NO: 3339408 - RNA, 23 nt, Mycobacterium tuberculosis H37Rv
cugcgcgccguucacccuggugg

SEQ ID NO: 3339409 - RNA, 14 nt, Mycobacterium tuberculosis H37Rv
cugcgcgcggccgc

SEQ ID NO: 3339410 - RNA, 21 nt, Mycobacterium tuberculosis H37Rv
cugcgcgcggcggccgcggcu

SEQ ID NO: 3339411 - RNA, 15 nt, Mycobacterium tuberculosis H37Rv
cugcgcggcgcgggu

SEQ ID NO: 3339412 - RNA, 19 nt, Mycobacterium tuberculosis H37Rv
cugcgcggcuucgucgaca

SEQ ID NO: 3339413 - RNA, 22 nt, Mycobacterium tuberculosis H37Rv
cugcgcggcuucgucgacaucg

SEQ ID NO: 3339414 - RNA, 23 nt, Mycobacterium tuberculosis H37Rv
cugcgcggcuucgucgacaucgc

SEQ ID NO: 3339415 - RNA, 17 nt, Mycobacterium tuberculosis H37Rv
cugcgcggcuugucgcg

SEQ ID NO: 3339416 - RNA, 22 nt, Mycobacterium tuberculosis H37Rv
cugcgcgggcgaguagucgacg

SEQ ID NO: 3339417 - RNA, 22 nt, Mycobacterium tuberculosis H37Rv
cugcgcgggucguagaccuucu

SEQ ID NO: 3339418 - RNA, 16 nt, Mycobacterium tuberculosis H37Rv
cugcgcgucgagcagc

SEQ ID NO: 3339419 - RNA, 17 nt, Mycobacterium tuberculosis H37Rv
cugcgcgucgagcagca

SEQ ID NO: 3339420 - RNA, 19 nt, Mycobacterium tuberculosis H37Rv
cugcgcgucgagcagcacc

SEQ ID NO: 3339421 - RNA, 17 nt, Mycobacterium tuberculosis H37Rv
cugcgcgucgagcgacc

SEQ ID NO: 3339422 - RNA, 21 nt, Mycobacterium tuberculosis H37Rv
cugcgcgugggcacagccaug

SEQ ID NO: 3339423 - RNA, 19 nt, Mycobacterium tuberculosis H37Rv
cugcgcucgggcugccgca

SEQ ID NO: 3339424 - RNA, 13 nt, Mycobacterium tuberculosis H37Rv
cugcgcugcacca

SEQ ID NO: 3339425 - RNA, 22 nt, Mycobacterium tuberculosis H37Rv
cugcgcuuugcacagcggcauc

SEQ ID NO: 3339426 - RNA, 20 nt, Mycobacterium tuberculosis H37Rv
cugcggaaaugaccuccugg

SEQ ID NO: 3339427 - RNA, 20 nt, Mycobacterium tuberculosis H37Rv
cugcggacaagucggcaccg

SEQ ID NO: 3339428 - RNA, 15 nt, Mycobacterium tuberculosis H37Rv
cugcggaccggcgcg

SEQ ID NO: 3339429 - RNA, 18 nt, Mycobacterium tuberculosis H37Rv
cugcggaccggcgcgcuc

SEQ ID NO: 3339430 - RNA, 15 nt, Mycobacterium tuberculosis H37Rv
cugcucggcgcagcu

SEQ ID NO: 3339431 - RNA, 18 nt, Mycobacterium tuberculosis H37Rv
cugcucggcgcagcuaac

SEQ ID NO: 3339432 - RNA, 15 nt, Mycobacterium tuberculosis H37Rv
cugcucggcgcggug

SEQ ID NO: 3339433 - RNA, 16 nt, Mycobacterium tuberculosis H37Rv
cugcucggcgcggugg

SEQ ID NO: 3339434 - RNA, 22 nt, Mycobacterium tuberculosis H37Rv
cugcucggcgcuagcugcugau

SEQ ID NO: 3339435 - RNA, 14 nt, Mycobacterium tuberculosis H37Rv
cugcucggcggccu

SEQ ID NO: 3339436 - RNA, 17 nt, Mycobacterium tuberculosis H37Rv
cugcucggcggugccgc

SEQ ID NO: 3339437 - RNA, 21 nt, Mycobacterium tuberculosis H37Rv
cugcucggucaggcggcuggc

SEQ ID NO: 3339438 - RNA, 21 nt, Mycobacterium tuberculosis H37Rv
cugcucguagcggcggcgccc

SEQ ID NO: 3339439 - RNA, 20 nt, Mycobacterium tuberculosis H37Rv
cugcucgucgagccgaccgc

SEQ ID NO: 3339440 - RNA, 17 nt, Mycobacterium tuberculosis H37Rv
cugcucgucggccaccg

SEQ ID NO: 3339441 - RNA, 16 nt, Mycobacterium tuberculosis H37Rv
cugcucgucggcgccg

SEQ ID NO: 3339442 - RNA, 13 nt, Mycobacterium tuberculosis H37Rv
cugcucgucgguc

SEQ ID NO: 3339443 - RNA, 23 nt, Mycobacterium tuberculosis H37Rv
cugcucgucggucaccgaaugcg

SEQ ID NO: 3339444 - RNA, 21 nt, Mycobacterium tuberculosis H37Rv
cugcucgucgugagacugggc

SEQ ID NO: 3339445 - RNA, 14 nt, Mycobacterium tuberculosis H37Rv
cugcucgugagccc

SEQ ID NO: 3339446 - RNA, 23 nt, Mycobacterium tuberculosis H37Rv
cugcucguggguaccgagcagca

SEQ ID NO: 3339447 - RNA, 19 nt, Mycobacterium tuberculosis H37Rv
cugcucuccgucgcucacg

SEQ ID NO: 3339448 - RNA, 17 nt, Mycobacterium tuberculosis H37Rv
cugcugaaucacaccau

SEQ ID NO: 3339449 - RNA, 12 nt, Mycobacterium tuberculosis H37Rv
cugcugcagcaa

SEQ ID NO: 3339450 - RNA, 15 nt, Mycobacterium tuberculosis H37Rv
cugcugcagcaauug

SEQ ID NO: 3339451 - RNA, 13 nt, Mycobacterium tuberculosis H37Rv
cugcugcagccug

SEQ ID NO: 3339452 - RNA, 23 nt, Mycobacterium tuberculosis H37Rv
cugcugcauguuaugggugacga

SEQ ID NO: 3339453 - RNA, 15 nt, Mycobacterium tuberculosis H37Rv
cugcugccagccgaa

SEQ ID NO: 3339454 - RNA, 20 nt, Mycobacterium tuberculosis H37Rv
cugcugccagccgaagccga

SEQ ID NO: 3339455 - RNA, 20 nt, Mycobacterium tuberculosis H37Rv
cugcugccauugccgauggu

SEQ ID NO: 3339456 - RNA, 16 nt, Mycobacterium tuberculosis H37Rv
cugcugccgcaccggu

SEQ ID NO: 3339457 - RNA, 14 nt, Mycobacterium tuberculosis H37Rv
cugcugcggcagcg

SEQ ID NO: 3339458 - RNA, 11 nt, Mycobacterium tuberculosis H37Rv
cugcugcucgg

SEQ ID NO: 3339459 - RNA, 14 nt, Mycobacterium tuberculosis H37Rv
cugcugcucggccu

SEQ ID NO: 3339460 - RNA, 22 nt, Mycobacterium tuberculosis H37Rv
cugcugcuugacuccgcgcgcu

SEQ ID NO: 3339461 - RNA, 16 nt, Mycobacterium tuberculosis H37Rv
cugcuggaagccgucu

SEQ ID NO: 3339462 - RNA, 14 nt, Mycobacterium tuberculosis H37Rv
cugcuggagcagcu

SEQ ID NO: 3339463 - RNA, 20 nt, Mycobacterium tuberculosis H37Rv
cugcuggaucgucucgcgca

SEQ ID NO: 3339464 - RNA, 14 nt, Mycobacterium tuberculosis H37Rv
cugcuggaucucgg

SEQ ID NO: 3339465 - RNA, 11 nt, Mycobacterium tuberculosis H37Rv
cugcuggaugu

SEQ ID NO: 3339466 - RNA, 13 nt, Mycobacterium tuberculosis H37Rv
cugcuggcagacc

SEQ ID NO: 3339467 - RNA, 13 nt, Mycobacterium tuberculosis H37Rv
cugcuggcccugc

SEQ ID NO: 3339468 - RNA, 16 nt, Mycobacterium tuberculosis H37Rv
cugcuggccgcggccu

SEQ ID NO: 3339469 - RNA, 19 nt, Mycobacterium tuberculosis H37Rv
cugcuggccgcggccucgu

SEQ ID NO: 3339470 - RNA, 13 nt, Mycobacterium tuberculosis H37Rv
cugcuggcuggga

SEQ ID NO: 3339471 - RNA, 14 nt, Mycobacterium tuberculosis H37Rv
cugcugggcacgau

SEQ ID NO: 3339472 - RNA, 16 nt, Mycobacterium tuberculosis H37Rv
cugcugguaccgggcu

SEQ ID NO: 3339473 - RNA, 13 nt, Mycobacterium tuberculosis H37Rv
cugcuggugacga

SEQ ID NO: 3339474 - RNA, 18 nt, Mycobacterium tuberculosis H37Rv
cugcuggugucggcucga

SEQ ID NO: 3339475 - RNA, 21 nt, Mycobacterium tuberculosis H37Rv
cugcugucgauuucgccgucg

SEQ ID NO: 3339476 - RNA, 20 nt, Mycobacterium tuberculosis H37Rv
cugcugugucguacccggca

SEQ ID NO: 3339477 - RNA, 19 nt, Mycobacterium tuberculosis H37Rv
cugcuuccggaacaaaggc

SEQ ID NO: 3339478 - RNA, 20 nt, Mycobacterium tuberculosis H37Rv
cugcuucuucggacagcagc

SEQ ID NO: 3339479 - RNA, 13 nt, Mycobacterium tuberculosis H37Rv
cugcuugccaccg

SEQ ID NO: 3339480 - RNA, 18 nt, Mycobacterium tuberculosis H37Rv
cugcuugccaccgccgcc

SEQ ID NO: 3339481 - RNA, 20 nt, Mycobacterium tuberculosis H37Rv
cugcuuggucgcccagccac

SEQ ID NO: 3339482 - RNA, 20 nt, Mycobacterium tuberculosis H37Rv
cugcuuugccuuagcccggc

SEQ ID NO: 3339483 - RNA, 23 nt, Mycobacterium tuberculosis H37Rv
cugcuuugccuuagcccggccgc

SEQ ID NO: 3339484 - RNA, 14 nt, Mycobacterium tuberculosis H37Rv
cuggaaaacccagg

SEQ ID NO: 3339485 - RNA, 13 nt, Mycobacterium tuberculosis H37Rv
cuggaaagcagca

SEQ ID NO: 3339486 - RNA, 16 nt, Mycobacterium tuberculosis H37Rv
cuggaaagggccgccg

SEQ ID NO: 3339487 - RNA, 16 nt, Mycobacterium tuberculosis H37Rv
cuggaacggcagcacg

SEQ ID NO: 3339488 - RNA, 16 nt, Mycobacterium tuberculosis H37Rv
cuggaacgugaugcgg

SEQ ID NO: 3339489 - RNA, 13 nt, Mycobacterium tuberculosis H37Rv
cuggaagccgucu

SEQ ID NO: 3339490 - RNA, 22 nt, Mycobacterium tuberculosis H37Rv
cuggaagcggcgacuacccagc

SEQ ID NO: 3339491 - RNA, 15 nt, Mycobacterium tuberculosis H37Rv
cuggaaggucagcgc

SEQ ID NO: 3339492 - RNA, 23 nt, Mycobacterium tuberculosis H37Rv
cuggacaacggcggucugguugu

SEQ ID NO: 3339493 - RNA, 15 nt, Mycobacterium tuberculosis H37Rv
cuggacaagcuccuc

SEQ ID NO: 3339494 - RNA, 13 nt, Mycobacterium tuberculosis H37Rv
cuggaccaccgcc

SEQ ID NO: 3339495 - RNA, 20 nt, Mycobacterium tuberculosis H37Rv
cuggaccgcggugacccgga

SEQ ID NO: 3339496 - RNA, 20 nt, Mycobacterium tuberculosis H37Rv
cuggaccgggucgggcaccg

SEQ ID NO: 3339497 - RNA, 22 nt, Mycobacterium tuberculosis H37Rv
cuggacgccgccggagaucuug

SEQ ID NO: 3339498 - RNA, 16 nt, Mycobacterium tuberculosis H37Rv
cuggacggcgccgguu

SEQ ID NO: 3339499 - RNA, 15 nt, Mycobacterium tuberculosis H37Rv
cuggacggggaagcc

SEQ ID NO: 3339500 - RNA, 21 nt, Mycobacterium tuberculosis H37Rv
cuggacgggguacugcggcuc

SEQ ID NO: 3339501 - RNA, 18 nt, Mycobacterium tuberculosis H37Rv
cuggagaacucugcgaga

SEQ ID NO: 3339502 - RNA, 16 nt, Mycobacterium tuberculosis H37Rv
cuggagcagcuaccga

SEQ ID NO: 3339503 - RNA, 23 nt, Mycobacterium tuberculosis H37Rv
cuggagccgugcggucgcgcccu

SEQ ID NO: 3339504 - RNA, 17 nt, Mycobacterium tuberculosis H37Rv
cuggagcuguggcgggc

SEQ ID NO: 3339505 - RNA, 13 nt, Mycobacterium tuberculosis H37Rv
cuggaggccacca

SEQ ID NO: 3339506 - RNA, 22 nt, Mycobacterium tuberculosis H37Rv
cuggaggugaacucguucagcg

SEQ ID NO: 3339507 - RNA, 17 nt, Mycobacterium tuberculosis H37Rv
cuggagguguuugacgc

SEQ ID NO: 3339508 - RNA, 16 nt, Mycobacterium tuberculosis H37Rv
cuggagugaggcugug

SEQ ID NO: 3339509 - RNA, 16 nt, Mycobacterium tuberculosis H37Rv
cuggaguucgucaccg

SEQ ID NO: 3339510 - RNA, 17 nt, Mycobacterium tuberculosis H37Rv
cuggaguucgucaccgu

SEQ ID NO: 3339511 - RNA, 21 nt, Mycobacterium tuberculosis H37Rv
cuggaguucgucaccguuggc

SEQ ID NO: 3339512 - RNA, 13 nt, Mycobacterium tuberculosis H37Rv
cuggauacccagc

SEQ ID NO: 3339513 - RNA, 15 nt, Mycobacterium tuberculosis H37Rv
cuggaucacgucgau

SEQ ID NO: 3339514 - RNA, 15 nt, Mycobacterium tuberculosis H37Rv
cuggaucagcgucgg

SEQ ID NO: 3339515 - RNA, 19 nt, Mycobacterium tuberculosis H37Rv
cuggauccccugauggacc

SEQ ID NO: 3339516 - RNA, 19 nt, Mycobacterium tuberculosis H37Rv
cuggaucgucucgcgcacc

SEQ ID NO: 3339517 - RNA, 15 nt, Mycobacterium tuberculosis H37Rv
cuggaucgugagcuu

SEQ ID NO: 3339518 - RNA, 21 nt, Mycobacterium tuberculosis H37Rv
cuggaucgugccgaacacggu

SEQ ID NO: 3339519 - RNA, 15 nt, Mycobacterium tuberculosis H37Rv
cuggaucuucgacag

SEQ ID NO: 3339520 - RNA, 12 nt, Mycobacterium tuberculosis H37Rv
cuggaugccgau

SEQ ID NO: 3339521 - RNA, 12 nt, Mycobacterium tuberculosis H37Rv
cuggauggcgcu

SEQ ID NO: 3339522 - RNA, 22 nt, Mycobacterium tuberculosis H37Rv
cuggcaaaguaucgcagcaucu

SEQ ID NO: 3339523 - RNA, 22 nt, Mycobacterium tuberculosis H37Rv
cuggcaacgacacgccgcuccc

SEQ ID NO: 3339524 - RNA, 16 nt, Mycobacterium tuberculosis H37Rv
cuggcaacgccgcgcc

SEQ ID NO: 3339525 - RNA, 17 nt, Mycobacterium tuberculosis H37Rv
cuggcacacuccugcac

SEQ ID NO: 3339526 - RNA, 19 nt, Mycobacterium tuberculosis H37Rv
cuggcacccggggugcccg

SEQ ID NO: 3339527 - RNA, 14 nt, Mycobacterium tuberculosis H37Rv
cuggcggcgccgca

SEQ ID NO: 3339528 - RNA, 15 nt, Mycobacterium tuberculosis H37Rv
cuggcggcugcagcc

SEQ ID NO: 3339529 - RNA, 22 nt, Mycobacterium tuberculosis H37Rv
cuggcggcugcagccgaccgaa

SEQ ID NO: 3339530 - RNA, 20 nt, Mycobacterium tuberculosis H37Rv
cuggcgggcacucagcaggg

SEQ ID NO: 3339531 - RNA, 23 nt, Mycobacterium tuberculosis H37Rv
cuggcgggcagcuguucggccaa

SEQ ID NO: 3339532 - RNA, 20 nt, Mycobacterium tuberculosis H37Rv
cuggcgggcgaucucggcga

SEQ ID NO: 3339533 - RNA, 19 nt, Mycobacterium tuberculosis H37Rv
cuggcggggaucagcgagu

SEQ ID NO: 3339534 - RNA, 19 nt, Mycobacterium tuberculosis H37Rv
cuggcggguaagcgaccga

SEQ ID NO: 3339535 - RNA, 17 nt, Mycobacterium tuberculosis H37Rv
cuggcggguggcgauga

SEQ ID NO: 3339536 - RNA, 17 nt, Mycobacterium tuberculosis H37Rv
cuggcgguaucgaaagc

SEQ ID NO: 3339537 - RNA, 13 nt, Mycobacterium tuberculosis H37Rv
cuggcggucccgc

SEQ ID NO: 3339538 - RNA, 16 nt, Mycobacterium tuberculosis H37Rv
cuggcguagugcagcu

SEQ ID NO: 3339539 - RNA, 22 nt, Mycobacterium tuberculosis H37Rv
cuggcgucgaugccggcugccg

SEQ ID NO: 3339540 - RNA, 23 nt, Mycobacterium tuberculosis H37Rv
cuggcgucgucuucgguuaaggu

SEQ ID NO: 3339541 - RNA, 16 nt, Mycobacterium tuberculosis H37Rv
cuggcgugcagcagga

SEQ ID NO: 3339542 - RNA, 17 nt, Mycobacterium tuberculosis H37Rv
cuggcgugucgccgcca

SEQ ID NO: 3339543 - RNA, 21 nt, Mycobacterium tuberculosis H37Rv
cuggcgugucgccgccaccag

SEQ ID NO: 3339544 - RNA, 13 nt, Mycobacterium tuberculosis H37Rv
cuggcguucccgc

SEQ ID NO: 3339545 - RNA, 22 nt, Mycobacterium tuberculosis H37Rv
cuggcguuguugacgaucaccc

SEQ ID NO: 3339546 - RNA, 23 nt, Mycobacterium tuberculosis H37Rv
cuggcguuguugacgaucacccc

SEQ ID NO: 3339547 - RNA, 16 nt, Mycobacterium tuberculosis H37Rv
cuggcuacgggccgcg

SEQ ID NO: 3339548 - RNA, 18 nt, Mycobacterium tuberculosis H37Rv
cuggcuaucugauccagc

SEQ ID NO: 3339549 - RNA, 20 nt, Mycobacterium tuberculosis H37Rv
cuggcugaacauuccggcac

SEQ ID NO: 3339550 - RNA, 21 nt, Mycobacterium tuberculosis H37Rv
cuggcugaacauuccggcacc

SEQ ID NO: 3339551 - RNA, 22 nt, Mycobacterium tuberculosis H37Rv
cuggcugaacauuccggcaccu

SEQ ID NO: 3339552 - RNA, 13 nt, Mycobacterium tuberculosis H37Rv
cuggcugaccgaa

SEQ ID NO: 3339553 - RNA, 16 nt, Mycobacterium tuberculosis H37Rv
cuggcugacgauuucc

SEQ ID NO: 3339554 - RNA, 15 nt, Mycobacterium tuberculosis H37Rv
cuggcugagcacugc

SEQ ID NO: 3339555 - RNA, 18 nt, Mycobacterium tuberculosis H37Rv
cuggcuggaccacucgcc

SEQ ID NO: 3339556 - RNA, 15 nt, Mycobacterium tuberculosis H37Rv
cuggcuggugauggc

SEQ ID NO: 3339557 - RNA, 22 nt, Mycobacterium tuberculosis H37Rv
cuggcuguggcugaacaccgcg

SEQ ID NO: 3339558 - RNA, 15 nt, Mycobacterium tuberculosis H37Rv
cuggcuucucgcagu

SEQ ID NO: 3339559 - RNA, 14 nt, Mycobacterium tuberculosis H37Rv
cuggcuugugccca

SEQ ID NO: 3339560 - RNA, 14 nt, Mycobacterium tuberculosis H37Rv
cugggacggcggca

SEQ ID NO: 3339561 - RNA, 14 nt, Mycobacterium tuberculosis H37Rv
cugggagcggaugu

SEQ ID NO: 3339562 - RNA, 13 nt, Mycobacterium tuberculosis H37Rv
cugggaucccgac

SEQ ID NO: 3339563 - RNA, 18 nt, Mycobacterium tuberculosis H37Rv
cugggaucccgacgaagg

SEQ ID NO: 3339564 - RNA, 18 nt, Mycobacterium tuberculosis H37Rv
cugggcaaguucugcgcu

SEQ ID NO: 3339565 - RNA, 19 nt, Mycobacterium tuberculosis H37Rv
cugggcaaugacuugcgac

SEQ ID NO: 3339566 - RNA, 23 nt, Mycobacterium tuberculosis H37Rv
cugggcaaugacuugcgacccgu

SEQ ID NO: 3339567 - RNA, 20 nt, Mycobacterium tuberculosis H37Rv
cugggcacucggcccggccc

SEQ ID NO: 3339568 - RNA, 13 nt, Mycobacterium tuberculosis H37Rv
cugggcaucaccg

SEQ ID NO: 3339569 - RNA, 15 nt, Mycobacterium tuberculosis H37Rv
cugggcaucaccgac

SEQ ID NO: 3339570 - RNA, 14 nt, Mycobacterium tuberculosis H37Rv
cugggcaucaccgc

SEQ ID NO: 3339571 - RNA, 15 nt, Mycobacterium tuberculosis H37Rv
cugggccaacacagc

SEQ ID NO: 3339572 - RNA, 17 nt, Mycobacterium tuberculosis H37Rv
cugggccagcagccguu

SEQ ID NO: 3339573 - RNA, 23 nt, Mycobacterium tuberculosis H37Rv
cugggcccccaaucagugcagcg

SEQ ID NO: 3339574 - RNA, 23 nt, Mycobacterium tuberculosis H37Rv
cugggcccgaaucgccugccaca

SEQ ID NO: 3339575 - RNA, 14 nt, Mycobacterium tuberculosis H37Rv
cugggcccgccagc

SEQ ID NO: 3339576 - RNA, 17 nt, Mycobacterium tuberculosis H37Rv
cugggccgacgggacaa

SEQ ID NO: 3339577 - RNA, 14 nt, Mycobacterium tuberculosis H37Rv
cugggccgccgccc

SEQ ID NO: 3339578 - RNA, 16 nt, Mycobacterium tuberculosis H37Rv
cugggccgccgcccug

SEQ ID NO: 3339579 - RNA, 23 nt, Mycobacterium tuberculosis H37Rv
cugggcgaagcccagaucuugca

SEQ ID NO: 3339580 - RNA, 15 nt, Mycobacterium tuberculosis H37Rv
cugggcgagacggcg

SEQ ID NO: 3339581 - RNA, 14 nt, Mycobacterium tuberculosis H37Rv
cugggcgccaccau

SEQ ID NO: 3339582 - RNA, 21 nt, Mycobacterium tuberculosis H37Rv
cugggcgcccgcgguccggcg

SEQ ID NO: 3339583 - RNA, 22 nt, Mycobacterium tuberculosis H37Rv
cugggcgcccgcgguccggcga

SEQ ID NO: 3339584 - RNA, 20 nt, Mycobacterium tuberculosis H37Rv
cugggcgccgcgcucgacga

SEQ ID NO: 3339585 - RNA, 21 nt, Mycobacterium tuberculosis H37Rv
cugggcgccgucgggccugcc

SEQ ID NO: 3339586 - RNA, 18 nt, Mycobacterium tuberculosis H37Rv
cugggcgcgcucaucgac

SEQ ID NO: 3339587 - RNA, 19 nt, Mycobacterium tuberculosis H37Rv
cugggcgcgcucaucgacc

SEQ ID NO: 3339588 - RNA, 17 nt, Mycobacterium tuberculosis H37Rv
cugggcggccuuuuccg

SEQ ID NO: 3339589 - RNA, 19 nt, Mycobacterium tuberculosis H37Rv
cugggcggcuacccauggc

SEQ ID NO: 3339590 - RNA, 24 nt, Mycobacterium tuberculosis H37Rv
cugggcgguagcuuccgcgacgcu

SEQ ID NO: 3339591 - RNA, 15 nt, Mycobacterium tuberculosis H37Rv
cugggcggugaaggc

SEQ ID NO: 3339592 - RNA, 17 nt, Mycobacterium tuberculosis H37Rv
cugggcggugaaggccc

SEQ ID NO: 3339593 - RNA, 17 nt, Mycobacterium tuberculosis H37Rv
cugggcuggcugaccga

SEQ ID NO: 3339594 - RNA, 15 nt, Mycobacterium tuberculosis H37Rv
cugggcuuucagcac

SEQ ID NO: 3339595 - RNA, 17 nt, Mycobacterium tuberculosis H37Rv
cugggcuuucagcaccg

SEQ ID NO: 3339596 - RNA, 19 nt, Mycobacterium tuberculosis H37Rv
cugggcuuucagcaccgga

SEQ ID NO: 3339597 - RNA, 17 nt, Mycobacterium tuberculosis H37Rv
cugggcuuugcagcguu

SEQ ID NO: 3339598 - RNA, 15 nt, Mycobacterium tuberculosis H37Rv
cuggggaggccaacc

SEQ ID NO: 3339599 - RNA, 16 nt, Mycobacterium tuberculosis H37Rv
cuggggcagccgggcg

SEQ ID NO: 3339600 - RNA, 17 nt, Mycobacterium tuberculosis H37Rv
cuggggcagccgggcgu

SEQ ID NO: 3339601 - RNA, 20 nt, Mycobacterium tuberculosis H37Rv
cuggggccguccggcuuggc

SEQ ID NO: 3339602 - RNA, 19 nt, Mycobacterium tuberculosis H37Rv
cuggggcggauaugaugau

SEQ ID NO: 3339603 - RNA, 21 nt, Mycobacterium tuberculosis H37Rv
cuggggcggcaugcucaccga

SEQ ID NO: 3339604 - RNA, 13 nt, Mycobacterium tuberculosis H37Rv
cugggguagccau

SEQ ID NO: 3339605 - RNA, 21 nt, Mycobacterium tuberculosis H37Rv
cugggguagccaucggcuagg

SEQ ID NO: 3339606 - RNA, 17 nt, Mycobacterium tuberculosis H37Rv
cugggguccggugacga

SEQ ID NO: 3339607 - RNA, 13 nt, Mycobacterium tuberculosis H37Rv
cuggggugcugcg

SEQ ID NO: 3339608 - RNA, 23 nt, Mycobacterium tuberculosis H37Rv
cuggggugcugcgcgcggcggcc

SEQ ID NO: 3339609 - RNA, 19 nt, Mycobacterium tuberculosis H37Rv
cuggggugucaaucaccca

SEQ ID NO: 3339610 - RNA, 24 nt, Mycobacterium tuberculosis H37Rv
cuggguccacgcgcucggugccgc

SEQ ID NO: 3339611 - RNA, 21 nt, Mycobacterium tuberculosis H37Rv
cugggucggaccuuccgggug

SEQ ID NO: 3339612 - RNA, 23 nt, Mycobacterium tuberculosis H37Rv
cugggugagcaccugggcgcgcu

SEQ ID NO: 3339613 - RNA, 21 nt, Mycobacterium tuberculosis H37Rv
cugggugaugagcgcuucgag

SEQ ID NO: 3339614 - RNA, 16 nt, Mycobacterium tuberculosis H37Rv
cugggugccggcagcg

SEQ ID NO: 3339615 - RNA, 21 nt, Mycobacterium tuberculosis H37Rv
cugggugcgcggccgcccgua

SEQ ID NO: 3339616 - RNA, 18 nt, Mycobacterium tuberculosis H37Rv
cuggguggccaaccaacc

SEQ ID NO: 3339617 - RNA, 22 nt, Mycobacterium tuberculosis H37Rv
cuggguucccgaugugaacgca

SEQ ID NO: 3339618 - RNA, 21 nt, Mycobacterium tuberculosis H37Rv
cuggguuucaaagcgacagcg

SEQ ID NO: 3339619 - RNA, 15 nt, Mycobacterium tuberculosis H37Rv
cugguaagucagcuc

SEQ ID NO: 3339620 - RNA, 20 nt, Mycobacterium tuberculosis H37Rv
cugguaccccagcacaaggc

SEQ ID NO: 3339621 - RNA, 21 nt, Mycobacterium tuberculosis H37Rv
cugguagcacccacggcgaga

SEQ ID NO: 3339622 - RNA, 15 nt, Mycobacterium tuberculosis H37Rv
cuguccaggucuggg

SEQ ID NO: 3339623 - RNA, 15 nt, Mycobacterium tuberculosis H37Rv
cugucccgcgggcca

SEQ ID NO: 3339624 - RNA, 21 nt, Mycobacterium tuberculosis H37Rv
cuguccgaccucgccgcgcgu

SEQ ID NO: 3339625 - RNA, 19 nt, Mycobacterium tuberculosis H37Rv
cuguccgacuucuccaggc

SEQ ID NO: 3339626 - RNA, 16 nt, Mycobacterium tuberculosis H37Rv
cuguccggcauaccga

SEQ ID NO: 3339627 - RNA, 20 nt, Mycobacterium tuberculosis H37Rv
cuguccgguggaauccacca

SEQ ID NO: 3339628 - RNA, 12 nt, Mycobacterium tuberculosis H37Rv
cuguccuccuga

SEQ ID NO: 3339629 - RNA, 15 nt, Mycobacterium tuberculosis H37Rv
cuguccucgcgggcu

SEQ ID NO: 3339630 - RNA, 22 nt, Mycobacterium tuberculosis H37Rv
cugucgagguggucgacccggc

SEQ ID NO: 3339631 - RNA, 21 nt, Mycobacterium tuberculosis H37Rv
cugucgccagggagcgcagcg

SEQ ID NO: 3339632 - RNA, 14 nt, Mycobacterium tuberculosis H37Rv
cugucgcgggccac

SEQ ID NO: 3339633 - RNA, 15 nt, Mycobacterium tuberculosis H37Rv
cugucggcuuccucc

SEQ ID NO: 3339634 - RNA, 17 nt, Mycobacterium tuberculosis H37Rv
cugucggcuuccuccuc

SEQ ID NO: 3339635 - RNA, 18 nt, Mycobacterium tuberculosis H37Rv
cugucggcuuccuccucg

SEQ ID NO: 3339636 - RNA, 14 nt, Mycobacterium tuberculosis H37Rv
cugucguaccgcuc

SEQ ID NO: 3339637 - RNA, 14 nt, Mycobacterium tuberculosis H37Rv
cugucguccccgga

SEQ ID NO: 3339638 - RNA, 16 nt, Mycobacterium tuberculosis H37Rv
cugucgucuuggcgau

SEQ ID NO: 3339639 - RNA, 20 nt, Mycobacterium tuberculosis H37Rv
cugucgucuuggcgaucggg

SEQ ID NO: 3339640 - RNA, 21 nt, Mycobacterium tuberculosis H37Rv
cugucgugauacagcucggug

SEQ ID NO: 3339641 - RNA, 23 nt, Mycobacterium tuberculosis H37Rv
cugucgugauacagcucggugca

SEQ ID NO: 3339642 - RNA, 22 nt, Mycobacterium tuberculosis H37Rv
cugugacacccgagggccugac

SEQ ID NO: 3339643 - RNA, 23 nt, Mycobacterium tuberculosis H37Rv
cugugauuucggucugguugggc

SEQ ID NO: 3339644 - RNA, 16 nt, Mycobacterium tuberculosis H37Rv
cugugccagcagcagc

SEQ ID NO: 3339645 - RNA, 16 nt, Mycobacterium tuberculosis H37Rv
cugugccccagggcag

SEQ ID NO: 3339646 - RNA, 20 nt, Mycobacterium tuberculosis H37Rv
cugugccccagggcagugcg

SEQ ID NO: 3339647 - RNA, 21 nt, Mycobacterium tuberculosis H37Rv
cugugcccucaacgucccagc

SEQ ID NO: 3339648 - RNA, 19 nt, Mycobacterium tuberculosis H37Rv
cugugccgccggcgccacc

SEQ ID NO: 3339649 - RNA, 17 nt, Mycobacterium tuberculosis H37Rv
cugugccuucgccucgu

SEQ ID NO: 3339650 - RNA, 14 nt, Mycobacterium tuberculosis H37Rv
cugugcgcagacau

SEQ ID NO: 3339651 - RNA, 12 nt, Mycobacterium tuberculosis H37Rv
cugugcgccgca

SEQ ID NO: 3339652 - RNA, 13 nt, Mycobacterium tuberculosis H37Rv
cugugcgccgcag

SEQ ID NO: 3339653 - RNA, 21 nt, Mycobacterium tuberculosis H37Rv
cugugcgccgcagccugcaac

SEQ ID NO: 3339654 - RNA, 18 nt, Mycobacterium tuberculosis H37Rv
cugugcgcggacaccuuu

SEQ ID NO: 3339655 - RNA, 14 nt, Mycobacterium tuberculosis H37Rv
cugugcggcgggca

SEQ ID NO: 3339656 - RNA, 18 nt, Mycobacterium tuberculosis H37Rv
cugugcggucgucaccgu

SEQ ID NO: 3339657 - RNA, 15 nt, Mycobacterium tuberculosis H37Rv
cugugcguuccugau

SEQ ID NO: 3339658 - RNA, 14 nt, Mycobacterium tuberculosis H37Rv
cugugcucacggcg

SEQ ID NO: 3339659 - RNA, 17 nt, Mycobacterium tuberculosis H37Rv
cugugcucacggcggcg

SEQ ID NO: 3339660 - RNA, 13 nt, Mycobacterium tuberculosis H37Rv
cuguggaagcccg

SEQ ID NO: 3339661 - RNA, 17 nt, Mycobacterium tuberculosis H37Rv
cuguggaugccgacggc

SEQ ID NO: 3339662 - RNA, 15 nt, Mycobacterium tuberculosis H37Rv
cuguggccgcgucgc

SEQ ID NO: 3339663 - RNA, 13 nt, Mycobacterium tuberculosis H37Rv
cuguggcgccgcc

SEQ ID NO: 3339664 - RNA, 20 nt, Mycobacterium tuberculosis H37Rv
cuguggcgccgccggcaccg

SEQ ID NO: 3339665 - RNA, 20 nt, Mycobacterium tuberculosis H37Rv
cuguggcgcgcaugguggcu

SEQ ID NO: 3339666 - RNA, 15 nt, Mycobacterium tuberculosis H37Rv
cugugggcugagaug

SEQ ID NO: 3339667 - RNA, 16 nt, Mycobacterium tuberculosis H37Rv
cugugguaggccggug

SEQ ID NO: 3339668 - RNA, 16 nt, Mycobacterium tuberculosis H37Rv
cugugguggugauggg

SEQ ID NO: 3339669 - RNA, 18 nt, Mycobacterium tuberculosis H37Rv
cugugucguacccggcaa

SEQ ID NO: 3339670 - RNA, 17 nt, Mycobacterium tuberculosis H37Rv
cugugucugcucgcgcc

SEQ ID NO: 3339671 - RNA, 18 nt, Mycobacterium tuberculosis H37Rv
cuguguugagcggcagcc

SEQ ID NO: 3339672 - RNA, 19 nt, Mycobacterium tuberculosis H37Rv
cuguuacuccgacggcccg

SEQ ID NO: 3339673 - RNA, 20 nt, Mycobacterium tuberculosis H37Rv
cuguuacuccgacggcccgg

SEQ ID NO: 3339674 - RNA, 14 nt, Mycobacterium tuberculosis H37Rv
cuguucccacaggc

SEQ ID NO: 3339675 - RNA, 16 nt, Mycobacterium tuberculosis H37Rv
cuguucgauaagcagc

SEQ ID NO: 3339676 - RNA, 13 nt, Mycobacterium tuberculosis H37Rv
cuguucgccgacg

SEQ ID NO: 3339677 - RNA, 21 nt, Mycobacterium tuberculosis H37Rv
cuguucggcggcugccagcgc

SEQ ID NO: 3339678 - RNA, 16 nt, Mycobacterium tuberculosis H37Rv
cuguucuccgugaucg

SEQ ID NO: 3339679 - RNA, 20 nt, Mycobacterium tuberculosis H37Rv
cuguucucgccgaagcccgg

SEQ ID NO: 3339680 - RNA, 19 nt, Mycobacterium tuberculosis H37Rv
cuguucugcuggcuguggc

SEQ ID NO: 3339681 - RNA, 21 nt, Mycobacterium tuberculosis H37Rv
cuguucuuggugaccaaugcg

SEQ ID NO: 3339682 - RNA, 15 nt, Mycobacterium tuberculosis H37Rv
cuguugaacggccgc

SEQ ID NO: 3339683 - RNA, 15 nt, Mycobacterium tuberculosis H37Rv
cuguugaagaagccc

SEQ ID NO: 3339684 - RNA, 23 nt, Mycobacterium tuberculosis H37Rv
cuguugaagaggcgcaccuccug

SEQ ID NO: 3339685 - RNA, 13 nt, Mycobacterium tuberculosis H37Rv
cuguugaagccgc

SEQ ID NO: 3339686 - RNA, 20 nt, Mycobacterium tuberculosis H37Rv
cuguugaagccgcccgaguu

SEQ ID NO: 3339687 - RNA, 18 nt, Mycobacterium tuberculosis H37Rv
cuguugacgccacgacgc

SEQ ID NO: 3339688 - RNA, 17 nt, Mycobacterium tuberculosis H37Rv
cuguugacuaccaccgc

SEQ ID NO: 3339689 - RNA, 18 nt, Mycobacterium tuberculosis H37Rv
cuguugaucugcccuguu

SEQ ID NO: 3339690 - RNA, 15 nt, Mycobacterium tuberculosis H37Rv
cuguugccaucgacg

SEQ ID NO: 3339691 - RNA, 20 nt, Mycobacterium tuberculosis H37Rv
cuguugcccaauucgacugc

SEQ ID NO: 3339692 - RNA, 18 nt, Mycobacterium tuberculosis H37Rv
cuguuggccagccgacaa

SEQ ID NO: 3339693 - RNA, 19 nt, Mycobacterium tuberculosis H37Rv
cuguuggcgaaggccgcaa

SEQ ID NO: 3339694 - RNA, 22 nt, Mycobacterium tuberculosis H37Rv
cuguuggcguggaucuuggcca

SEQ ID NO: 3339695 - RNA, 17 nt, Mycobacterium tuberculosis H37Rv
cuguuggugccgccacc

SEQ ID NO: 3339696 - RNA, 18 nt, Mycobacterium tuberculosis H37Rv
cuguuggugccgccacca

SEQ ID NO: 3339697 - RNA, 21 nt, Mycobacterium tuberculosis H37Rv
cuguuggugccgccaccaccg

SEQ ID NO: 3339698 - RNA, 15 nt, Mycobacterium tuberculosis H37Rv
cuguugucguccaac

SEQ ID NO: 3339699 - RNA, 21 nt, Mycobacterium tuberculosis H37Rv
cuguugugagauuggcagacc

SEQ ID NO: 3339700 - RNA, 14 nt, Mycobacterium tuberculosis H37Rv
cuguuguugccccg

SEQ ID NO: 3339701 - RNA, 24 nt, Mycobacterium tuberculosis H37Rv
cuguuguugccccggucggcgacg

SEQ ID NO: 3339702 - RNA, 17 nt, Mycobacterium tuberculosis H37Rv
cuguuuggggcugugca

SEQ ID NO: 3339703 - RNA, 16 nt, Mycobacterium tuberculosis H37Rv
cuuacuuccauccaca

SEQ ID NO: 3339704 - RNA, 23 nt, Mycobacterium tuberculosis H37Rv
cuuacuugaucucggcgagcacc

SEQ ID NO: 3339705 - RNA, 18 nt, Mycobacterium tuberculosis H37Rv
cuuagaacgugcuggugg

SEQ ID NO: 3339706 - RNA, 23 nt, Mycobacterium tuberculosis H37Rv
cuuagauagggguggcccguagc

SEQ ID NO: 3339707 - RNA, 19 nt, Mycobacterium tuberculosis H37Rv
cuuagcccggccgcggccc

SEQ ID NO: 3339708 - RNA, 20 nt, Mycobacterium tuberculosis H37Rv
cuuagcgccguugccgccac

SEQ ID NO: 3339709 - RNA, 15 nt, Mycobacterium tuberculosis H37Rv
cuuagcgcgaaagcg

SEQ ID NO: 3339710 - RNA, 17 nt, Mycobacterium tuberculosis H37Rv
cuuagcggaaaacccag

SEQ ID NO: 3339711 - RNA, 16 nt, Mycobacterium tuberculosis H37Rv
cuuaggcacucccgga

SEQ ID NO: 3339712 - RNA, 18 nt, Mycobacterium tuberculosis H37Rv
cuuauccggccagugaca

SEQ ID NO: 3339713 - RNA, 21 nt, Mycobacterium tuberculosis H37Rv
cuuaucgaacgucucggccag

SEQ ID NO: 3339714 - RNA, 18 nt, Mycobacterium tuberculosis H37Rv
cuuaugcgucugcucgcc

SEQ ID NO: 3339715 - RNA, 20 nt, Mycobacterium tuberculosis H37Rv
cuuaugcgucugcucgcccu

SEQ ID NO: 3339716 - RNA, 15 nt, Mycobacterium tuberculosis H37Rv
cuuauguguccgcuc

SEQ ID NO: 3339717 - RNA, 19 nt, Mycobacterium tuberculosis H37Rv
cuuauugccgagcucggcu

SEQ ID NO: 3339718 - RNA, 21 nt, Mycobacterium tuberculosis H37Rv
cuucggcgaucgucucgguga

SEQ ID NO: 3339719 - RNA, 20 nt, Mycobacterium tuberculosis H37Rv
cuucggcggccgagcgcacc

SEQ ID NO: 3339720 - RNA, 23 nt, Mycobacterium tuberculosis H37Rv
cuucggcggucagcggcugggcg

SEQ ID NO: 3339721 - RNA, 16 nt, Mycobacterium tuberculosis H37Rv
cuucggcggucgccgc

SEQ ID NO: 3339722 - RNA, 18 nt, Mycobacterium tuberculosis H37Rv
cuucggcggugccaccag

SEQ ID NO: 3339723 - RNA, 19 nt, Mycobacterium tuberculosis H37Rv
cuucggcggugcccagcag

SEQ ID NO: 3339724 - RNA, 13 nt, Mycobacterium tuberculosis H37Rv
cuucgggaacgcu

SEQ ID NO: 3339725 - RNA, 22 nt, Mycobacterium tuberculosis H37Rv
cuucgggcgucauccgcggcag

SEQ ID NO: 3339726 - RNA, 16 nt, Mycobacterium tuberculosis H37Rv
cuucggggucaccggc

SEQ ID NO: 3339727 - RNA, 18 nt, Mycobacterium tuberculosis H37Rv
cuucggggugcacgcgga

SEQ ID NO: 3339728 - RNA, 17 nt, Mycobacterium tuberculosis H37Rv
cuucggucaccucgaug

SEQ ID NO: 3339729 - RNA, 14 nt, Mycobacterium tuberculosis H37Rv
cuucggucagggug

SEQ ID NO: 3339730 - RNA, 16 nt, Mycobacterium tuberculosis H37Rv
cuucggucgcggccuc

SEQ ID NO: 3339731 - RNA, 19 nt, Mycobacterium tuberculosis H37Rv
cuucggugacccgggcggc

SEQ ID NO: 3339732 - RNA, 12 nt, Mycobacterium tuberculosis H37Rv
cuucggugaucu

SEQ ID NO: 3339733 - RNA, 20 nt, Mycobacterium tuberculosis H37Rv
cuucggugucgccgaacacc

SEQ ID NO: 3339734 - RNA, 15 nt, Mycobacterium tuberculosis H37Rv
cuucguaaccacgac

SEQ ID NO: 3339735 - RNA, 21 nt, Mycobacterium tuberculosis H37Rv
cuucgucgccgaacagcgacg

SEQ ID NO: 3339736 - RNA, 12 nt, Mycobacterium tuberculosis H37Rv
cuucgucggcca

SEQ ID NO: 3339737 - RNA, 15 nt, Mycobacterium tuberculosis H37Rv
cuucgucggccagca

SEQ ID NO: 3339738 - RNA, 16 nt, Mycobacterium tuberculosis H37Rv
cuucgucggccggcac

SEQ ID NO: 3339739 - RNA, 20 nt, Mycobacterium tuberculosis H37Rv
cuucgucggccggcacccca

SEQ ID NO: 3339740 - RNA, 21 nt, Mycobacterium tuberculosis H37Rv
cuucgucggccggcaccccac

SEQ ID NO: 3339741 - RNA, 16 nt, Mycobacterium tuberculosis H37Rv
cuucgucgguguccuc

SEQ ID NO: 3339742 - RNA, 15 nt, Mycobacterium tuberculosis H37Rv
cuucguggccuugac

SEQ ID NO: 3339743 - RNA, 15 nt, Mycobacterium tuberculosis H37Rv
cuucguugucggcgg

SEQ ID NO: 3339744 - RNA, 20 nt, Mycobacterium tuberculosis H37Rv
cuucucagcaccaugcucgg

SEQ ID NO: 3339745 - RNA, 23 nt, Mycobacterium tuberculosis H37Rv
cuucuccgagaucagcggcccga

SEQ ID NO: 3339746 - RNA, 14 nt, Mycobacterium tuberculosis H37Rv
cuucuccuccagag

SEQ ID NO: 3339747 - RNA, 22 nt, Mycobacterium tuberculosis H37Rv
cuucucgcggaccucggcgacc

SEQ ID NO: 3339748 - RNA, 14 nt, Mycobacterium tuberculosis H37Rv
cuucucgcggacgg

SEQ ID NO: 3339749 - RNA, 18 nt, Mycobacterium tuberculosis H37Rv
cuucucggacacgcugua

SEQ ID NO: 3339750 - RNA, 20 nt, Mycobacterium tuberculosis H37Rv
cuucucggcgggucaggcca

SEQ ID NO: 3339751 - RNA, 19 nt, Mycobacterium tuberculosis H37Rv
cuucucgucggugcgcgcg

SEQ ID NO: 3339752 - RNA, 22 nt, Mycobacterium tuberculosis H37Rv
cuucucgucggugcgcgcggcg

SEQ ID NO: 3339753 - RNA, 15 nt, Mycobacterium tuberculosis H37Rv
cuucugacgcggccg

SEQ ID NO: 3339754 - RNA, 14 nt, Mycobacterium tuberculosis H37Rv
cuucugagacugcc

SEQ ID NO: 3339755 - RNA, 18 nt, Mycobacterium tuberculosis H37Rv
cuucugagacugccgccg

SEQ ID NO: 3339756 - RNA, 19 nt, Mycobacterium tuberculosis H37Rv
cuucugcacgaacgccugc

SEQ ID NO: 3339757 - RNA, 22 nt, Mycobacterium tuberculosis H37Rv
cuucugccgggagacgcugcgc

SEQ ID NO: 3339758 - RNA, 15 nt, Mycobacterium tuberculosis H37Rv
cuucugccugcgcac

SEQ ID NO: 3339759 - RNA, 16 nt, Mycobacterium tuberculosis H37Rv
cuucugccuuggccgg

SEQ ID NO: 3339760 - RNA, 18 nt, Mycobacterium tuberculosis H37Rv
cuucugccuuggccggcu

SEQ ID NO: 3339761 - RNA, 15 nt, Mycobacterium tuberculosis H37Rv
cuucugcgucugcuc

SEQ ID NO: 3339762 - RNA, 21 nt, Mycobacterium tuberculosis H37Rv
cuucugggguuggcucggcgc

SEQ ID NO: 3339763 - RNA, 17 nt, Mycobacterium tuberculosis H37Rv
cuucuucgcuaccuucu

SEQ ID NO: 3339764 - RNA, 21 nt, Mycobacterium tuberculosis H37Rv
cuucuucgcuaccuucuuggc

SEQ ID NO: 3339765 - RNA, 19 nt, Mycobacterium tuberculosis H37Rv
cuucuucggacagcagccg

SEQ ID NO: 3339766 - RNA, 13 nt, Mycobacterium tuberculosis H37Rv
cuucuucuugacc

SEQ ID NO: 3339767 - RNA, 14 nt, Mycobacterium tuberculosis H37Rv
cuucuugaccacga

SEQ ID NO: 3339768 - RNA, 19 nt, Mycobacterium tuberculosis H37Rv
cuucuuggcaggugccuuc

SEQ ID NO: 3339769 - RNA, 21 nt, Mycobacterium tuberculosis H37Rv
cuucuuggcaggugccuucuu

SEQ ID NO: 3339770 - RNA, 22 nt, Mycobacterium tuberculosis H37Rv
cuugaaauugagccggcccugc

SEQ ID NO: 3339771 - RNA, 20 nt, Mycobacterium tuberculosis H37Rv
cuugaagaaacccugcugcg

SEQ ID NO: 3339772 - RNA, 17 nt, Mycobacterium tuberculosis H37Rv
cuugaccacagaaccgg

SEQ ID NO: 3339773 - RNA, 13 nt, Mycobacterium tuberculosis H37Rv
cuugaccacagcg

SEQ ID NO: 3339774 - RNA, 12 nt, Mycobacterium tuberculosis H37Rv
cuugaccagcag

SEQ ID NO: 3339775 - RNA, 15 nt, Mycobacterium tuberculosis H37Rv
cuugaccccuggccg

SEQ ID NO: 3339776 - RNA, 23 nt, Mycobacterium tuberculosis H37Rv
cuugaccgcggucuucuucaccg

SEQ ID NO: 3339777 - RNA, 14 nt, Mycobacterium tuberculosis H37Rv
cuugaccgcgguga

SEQ ID NO: 3339778 - RNA, 16 nt, Mycobacterium tuberculosis H37Rv
cuugaccgcugcccag

SEQ ID NO: 3339779 - RNA, 17 nt, Mycobacterium tuberculosis H37Rv
cuugaccgcugcccagu

SEQ ID NO: 3339780 - RNA, 21 nt, Mycobacterium tuberculosis H37Rv
cuugaccgggucgaugacgcc

SEQ ID NO: 3339781 - RNA, 20 nt, Mycobacterium tuberculosis H37Rv
cuugacuccgcgcgcugggc

SEQ ID NO: 3339782 - RNA, 15 nt, Mycobacterium tuberculosis H37Rv
cuugacugcacacca

SEQ ID NO: 3339783 - RNA, 16 nt, Mycobacterium tuberculosis H37Rv
cuugacugcacaccac

SEQ ID NO: 3339784 - RNA, 13 nt, Mycobacterium tuberculosis H37Rv
cuugagacgccgg

SEQ ID NO: 3339785 - RNA, 24 nt, Mycobacterium tuberculosis H37Rv
cuugagccggacguucuggaucgu

SEQ ID NO: 3339786 - RNA, 21 nt, Mycobacterium tuberculosis H37Rv
cuugagccgggcaaccagcag

SEQ ID NO: 3339787 - RNA, 22 nt, Mycobacterium tuberculosis H37Rv
cuugagcuccucacggauccgc

SEQ ID NO: 3339788 - RNA, 20 nt, Mycobacterium tuberculosis H37Rv
cuugagcucgcugaucaggu

SEQ ID NO: 3339789 - RNA, 16 nt, Mycobacterium tuberculosis H37Rv
cuugagcuucucgucg

SEQ ID NO: 3339790 - RNA, 18 nt, Mycobacterium tuberculosis H37Rv
cuugauaacgacccucaa

SEQ ID NO: 3339791 - RNA, 17 nt, Mycobacterium tuberculosis H37Rv
cuugaugcucgaugcga

SEQ ID NO: 3339792 - RNA, 17 nt, Mycobacterium tuberculosis H37Rv
cuugcaaggucgcugcu

SEQ ID NO: 3339793 - RNA, 12 nt, Mycobacterium tuberculosis H37Rv
cuugcacaagcu

SEQ ID NO: 3339794 - RNA, 16 nt, Mycobacterium tuberculosis H37Rv
cuugcagcgcguucgg

SEQ ID NO: 3339795 - RNA, 20 nt, Mycobacterium tuberculosis H37Rv
cuugccaccgcugccggcac

SEQ ID NO: 3339796 - RNA, 16 nt, Mycobacterium tuberculosis H37Rv
cuugccacuccaggag

SEQ ID NO: 3339797 - RNA, 23 nt, Mycobacterium tuberculosis H37Rv
cuugcccaagaucucgcgggccc

SEQ ID NO: 3339798 - RNA, 17 nt, Mycobacterium tuberculosis H37Rv
cuugcccgagcccagcc

SEQ ID NO: 3339799 - RNA, 17 nt, Mycobacterium tuberculosis H37Rv
cuugccgaaauccuuga

SEQ ID NO: 3339800 - RNA, 19 nt, Mycobacterium tuberculosis H37Rv
cuugccgaccugcgcgacg

SEQ ID NO: 3339801 - RNA, 13 nt, Mycobacterium tuberculosis H37Rv
cuugccgaucagc

SEQ ID NO: 3339802 - RNA, 15 nt, Mycobacterium tuberculosis H37Rv
cuugccgaucgccga

SEQ ID NO: 3339803 - RNA, 15 nt, Mycobacterium tuberculosis H37Rv
cuugccgccagcccc

SEQ ID NO: 3339804 - RNA, 18 nt, Mycobacterium tuberculosis H37Rv
cuugccgccagccccagc

SEQ ID NO: 3339805 - RNA, 15 nt, Mycobacterium tuberculosis H37Rv
cuugccgccgcgccg

SEQ ID NO: 3339806 - RNA, 16 nt, Mycobacterium tuberculosis H37Rv
cuugccgccggccccg

SEQ ID NO: 3339807 - RNA, 21 nt, Mycobacterium tuberculosis H37Rv
cuugccgccggcuccgccagc

SEQ ID NO: 3339808 - RNA, 17 nt, Mycobacterium tuberculosis H37Rv
cuugccgccuuggcccc

SEQ ID NO: 3339809 - RNA, 17 nt, Mycobacterium tuberculosis H37Rv
cuugccgcugagcccug

SEQ ID NO: 3339810 - RNA, 18 nt, Mycobacterium tuberculosis H37Rv
cuugccggccagcagguc

SEQ ID NO: 3339811 - RNA, 20 nt, Mycobacterium tuberculosis H37Rv
cuugccggguuugaucagcu

SEQ ID NO: 3339812 - RNA, 23 nt, Mycobacterium tuberculosis H37Rv
cuugccguagaagcgcuccagcu

SEQ ID NO: 3339813 - RNA, 17 nt, Mycobacterium tuberculosis H37Rv
cuugccgucuucgccgc

SEQ ID NO: 3339814 - RNA, 15 nt, Mycobacterium tuberculosis H37Rv
cuuggucaccuucuu

SEQ ID NO: 3339815 - RNA, 16 nt, Mycobacterium tuberculosis H37Rv
cuuggucaccuucuug

SEQ ID NO: 3339816 - RNA, 17 nt, Mycobacterium tuberculosis H37Rv
cuuggucaccuucuugg

SEQ ID NO: 3339817 - RNA, 21 nt, Mycobacterium tuberculosis H37Rv
cuuggucagugugaacugucc

SEQ ID NO: 3339818 - RNA, 15 nt, Mycobacterium tuberculosis H37Rv
cuuggucgcccagcc

SEQ ID NO: 3339819 - RNA, 21 nt, Mycobacterium tuberculosis H37Rv
cuuggucgcccagccacugac

SEQ ID NO: 3339820 - RNA, 17 nt, Mycobacterium tuberculosis H37Rv
cuuggucgccgccuucu

SEQ ID NO: 3339821 - RNA, 18 nt, Mycobacterium tuberculosis H37Rv
cuuggucgccgccuucuu

SEQ ID NO: 3339822 - RNA, 22 nt, Mycobacterium tuberculosis H37Rv
cuuggucgccgcuuucuuggcg

SEQ ID NO: 3339823 - RNA, 13 nt, Mycobacterium tuberculosis H37Rv
cuuggucgccggc

SEQ ID NO: 3339824 - RNA, 16 nt, Mycobacterium tuberculosis H37Rv
cuuggugaaccgcgcg

SEQ ID NO: 3339825 - RNA, 19 nt, Mycobacterium tuberculosis H37Rv
cuuggugaaccgcgcggcg

SEQ ID NO: 3339826 - RNA, 23 nt, Mycobacterium tuberculosis H37Rv
cuuggugaagaucgacacccguu

SEQ ID NO: 3339827 - RNA, 15 nt, Mycobacterium tuberculosis H37Rv
cuuggugccauucga

SEQ ID NO: 3339828 - RNA, 14 nt, Mycobacterium tuberculosis H37Rv
cuugguggccacca

SEQ ID NO: 3339829 - RNA, 16 nt, Mycobacterium tuberculosis H37Rv
cuugguggcguggccc

SEQ ID NO: 3339830 - RNA, 20 nt, Mycobacterium tuberculosis H37Rv
cuugguggucuuggccggug

SEQ ID NO: 3339831 - RNA, 19 nt, Mycobacterium tuberculosis H37Rv
cuuguacgaacugcugaug

SEQ ID NO: 3339832 - RNA, 16 nt, Mycobacterium tuberculosis H37Rv
cuuguagcgcaucgcc

SEQ ID NO: 3339833 - RNA, 19 nt, Mycobacterium tuberculosis H37Rv
cuuguagcgcaucgccaau

SEQ ID NO: 3339834 - RNA, 20 nt, Mycobacterium tuberculosis H37Rv
cuuguauaggccguugaucg

SEQ ID NO: 3339835 - RNA, 21 nt, Mycobacterium tuberculosis H37Rv
cuuguaucccucggggaacac

SEQ ID NO: 3339836 - RNA, 17 nt, Mycobacterium tuberculosis H37Rv
cuuguccgggccccacg

SEQ ID NO: 3339837 - RNA, 14 nt, Mycobacterium tuberculosis H37Rv
cuuguccucacaug

SEQ ID NO: 3339838 - RNA, 14 nt, Mycobacterium tuberculosis H37Rv
cuuguccuccgcgg

SEQ ID NO: 3339839 - RNA, 24 nt, Mycobacterium tuberculosis H37Rv
cuuguccuuauuggacugcagcgu

SEQ ID NO: 3339840 - RNA, 15 nt, Mycobacterium tuberculosis H37Rv
cuugucgaccccuga

SEQ ID NO: 3339841 - RNA, 16 nt, Mycobacterium tuberculosis H37Rv
cuugucgccccaugcg

SEQ ID NO: 3339842 - RNA, 18 nt, Mycobacterium tuberculosis H37Rv
cuugucgcggugcggcag

SEQ ID NO: 3339843 - RNA, 15 nt, Mycobacterium tuberculosis H37Rv
cuugucgggcaccgg

SEQ ID NO: 3339844 - RNA, 17 nt, Mycobacterium tuberculosis H37Rv
cuugugccccgagcugc

SEQ ID NO: 3339845 - RNA, 22 nt, Mycobacterium tuberculosis H37Rv
cuugugcugcaaggaauuccgg

SEQ ID NO: 3339846 - RNA, 15 nt, Mycobacterium tuberculosis H37Rv
cuuguggacccgcca

SEQ ID NO: 3339847 - RNA, 20 nt, Mycobacterium tuberculosis H37Rv
cuuguuagccuccagauucg

SEQ ID NO: 3339848 - RNA, 16 nt, Mycobacterium tuberculosis H37Rv
cuuguucaucaucugg

SEQ ID NO: 3339849 - RNA, 15 nt, Mycobacterium tuberculosis H37Rv
cuuguugaagccgau

SEQ ID NO: 3339850 - RNA, 15 nt, Mycobacterium tuberculosis H37Rv
cuuguugaccaccac

SEQ ID NO: 3339851 - RNA, 18 nt, Mycobacterium tuberculosis H37Rv
cuuguugacgaacccacc

SEQ ID NO: 3339852 - RNA, 18 nt, Mycobacterium tuberculosis H37Rv
cuuguugccgccggccau

SEQ ID NO: 3339853 - RNA, 24 nt, Mycobacterium tuberculosis H37Rv
cuuguuggcgaagucgucgagguc

SEQ ID NO: 3339854 - RNA, 13 nt, Mycobacterium tuberculosis H37Rv
cuuguuguggugg

SEQ ID NO: 3339855 - RNA, 23 nt, Mycobacterium tuberculosis H37Rv
cuuuaauccagcgccgaccuccu

SEQ ID NO: 3339856 - RNA, 19 nt, Mycobacterium tuberculosis H37Rv
cuuuagcgcgugcugcaga

SEQ ID NO: 3339857 - RNA, 18 nt, Mycobacterium tuberculosis H37Rv
cuuuagugucugcucgcg

SEQ ID NO: 3339858 - RNA, 13 nt, Mycobacterium tuberculosis H37Rv
cuuucagcgcuuc

SEQ ID NO: 3339859 - RNA, 21 nt, Mycobacterium tuberculosis H37Rv
cuuucauugacacugugcgcc

SEQ ID NO: 3339860 - RNA, 23 nt, Mycobacterium tuberculosis H37Rv
cuuuccaauuuagggauaacgac

SEQ ID NO: 3339861 - RNA, 19 nt, Mycobacterium tuberculosis H37Rv
cuuuccaccugaacggcaa

SEQ ID NO: 3339862 - RNA, 14 nt, Mycobacterium tuberculosis H37Rv
cuuuccagaguucc

SEQ ID NO: 3339863 - RNA, 19 nt, Mycobacterium tuberculosis H37Rv
cuuuccagaguucccgaaa

SEQ ID NO: 3339864 - RNA, 17 nt, Mycobacterium tuberculosis H37Rv
cuuucccggggcugggg

SEQ ID NO: 3339865 - RNA, 22 nt, Mycobacterium tuberculosis H37Rv
cuuuccgcgaaucaacaggacc

SEQ ID NO: 3339866 - RNA, 14 nt, Mycobacterium tuberculosis H37Rv
cuuuccggcggugg

SEQ ID NO: 3339867 - RNA, 14 nt, Mycobacterium tuberculosis H37Rv
cuuucgaugauggg

SEQ ID NO: 3339868 - RNA, 24 nt, Mycobacterium tuberculosis H37Rv
cuuucgcgccgcgaggcaccgaca

SEQ ID NO: 3339869 - RNA, 18 nt, Mycobacterium tuberculosis H37Rv
cuuucgcgucugcucgcg

SEQ ID NO: 3339870 - RNA, 19 nt, Mycobacterium tuberculosis H37Rv
cuuucgcgugcggcugcca

SEQ ID NO: 3339871 - RNA, 22 nt, Mycobacterium tuberculosis H37Rv
cuuucggaaaaccgcaccgucc

SEQ ID NO: 3339872 - RNA, 21 nt, Mycobacterium tuberculosis H37Rv
cuuucggaugcaacccgguga

SEQ ID NO: 3339873 - RNA, 19 nt, Mycobacterium tuberculosis H37Rv
cuuucggguccgacagccc

SEQ ID NO: 3339874 - RNA, 22 nt, Mycobacterium tuberculosis H37Rv
cuuucguugguuaucccagacu

SEQ ID NO: 3339875 - RNA, 19 nt, Mycobacterium tuberculosis H37Rv
cuuucuuggcgggcgccuu

SEQ ID NO: 3339876 - RNA, 17 nt, Mycobacterium tuberculosis H37Rv
cuuugaauugcgcgccc

SEQ ID NO: 3339877 - RNA, 20 nt, Mycobacterium tuberculosis H37Rv
cuuugacccguuccacgccg

SEQ ID NO: 3339878 - RNA, 16 nt, Mycobacterium tuberculosis H37Rv
cuuugacgcccggcac

SEQ ID NO: 3339879 - RNA, 17 nt, Mycobacterium tuberculosis H37Rv
cuuugacgcccucggcg

SEQ ID NO: 3339880 - RNA, 18 nt, Mycobacterium tuberculosis H37Rv
cuuugagaauucgccaag

SEQ ID NO: 3339881 - RNA, 18 nt, Mycobacterium tuberculosis H37Rv
cuuugagugccgugucga

SEQ ID NO: 3339882 - RNA, 20 nt, Mycobacterium tuberculosis H37Rv
cuuugaucgcccgguucagc

SEQ ID NO: 3339883 - RNA, 14 nt, Mycobacterium tuberculosis H37Rv
cuuugcacagcggc

SEQ ID NO: 3339884 - RNA, 22 nt, Mycobacterium tuberculosis H37Rv
cuuugcccccggugucugcaaa

SEQ ID NO: 3339885 - RNA, 15 nt, Mycobacterium tuberculosis H37Rv
cuuugccgccggcac

SEQ ID NO: 3339886 - RNA, 17 nt, Mycobacterium tuberculosis H37Rv
cuuugccgccggcaccg

SEQ ID NO: 3339887 - RNA, 22 nt, Mycobacterium tuberculosis H37Rv
cuuugcgaaucggcccgugcca

SEQ ID NO: 3339888 - RNA, 15 nt, Mycobacterium tuberculosis H37Rv
cuuugcucgccagca

SEQ ID NO: 3339889 - RNA, 15 nt, Mycobacterium tuberculosis H37Rv
cuuugcucucggucu

SEQ ID NO: 3339890 - RNA, 19 nt, Mycobacterium tuberculosis H37Rv
cuuugcucucggucugcau

SEQ ID NO: 3339891 - RNA, 21 nt, Mycobacterium tuberculosis H37Rv
cuuugcucucggucugcaugc

SEQ ID NO: 3339892 - RNA, 14 nt, Mycobacterium tuberculosis H37Rv
cuuugcuugccgca

SEQ ID NO: 3339893 - RNA, 17 nt, Mycobacterium tuberculosis H37Rv
cuuugcuugccgcauac

SEQ ID NO: 3339894 - RNA, 23 nt, Mycobacterium tuberculosis H37Rv
cuuuggacgaugaaccgggcagc

SEQ ID NO: 3339895 - RNA, 17 nt, Mycobacterium tuberculosis H37Rv
cuuuggccgcgaccggc

SEQ ID NO: 3339896 - RNA, 19 nt, Mycobacterium tuberculosis H37Rv
cuuuggguagcaaaccccg

SEQ ID NO: 3339897 - RNA, 23 nt, Mycobacterium tuberculosis H37Rv
cuuugguacccagcgcggccacc

SEQ ID NO: 3339898 - RNA, 23 nt, Mycobacterium tuberculosis H37Rv
cuuuggucgccggaccagagcca

SEQ ID NO: 3339899 - RNA, 13 nt, Mycobacterium tuberculosis H37Rv
cuuuggugucgcu

SEQ ID NO: 3339900 - RNA, 21 nt, Mycobacterium tuberculosis H37Rv
cuuugguugcccgcauugcca

SEQ ID NO: 3339901 - RNA, 22 nt, Mycobacterium tuberculosis H37Rv
cuuugguuguuggugccagccg

SEQ ID NO: 3339902 - RNA, 23 nt, Mycobacterium tuberculosis H37Rv
cuuugguuguuggugccagccgg

SEQ ID NO: 3339903 - RNA, 16 nt, Mycobacterium tuberculosis H37Rv
cuuugucgccuucuug

SEQ ID NO: 3339904 - RNA, 18 nt, Mycobacterium tuberculosis H37Rv
cuuugucgccuucuuggc

SEQ ID NO: 3339905 - RNA, 19 nt, Mycobacterium tuberculosis H37Rv
cuuuuccagugugaacugg

SEQ ID NO: 3339906 - RNA, 16 nt, Mycobacterium tuberculosis H37Rv
cuuuuccgccgggcuc

SEQ ID NO: 3339907 - RNA, 15 nt, Mycobacterium tuberculosis H37Rv
cuuuuccggcguucc

SEQ ID NO: 3339908 - RNA, 15 nt, Mycobacterium tuberculosis H37Rv
cuuuugauugaccaa

SEQ ID NO: 3339909 - RNA, 20 nt, Mycobacterium tuberculosis H37Rv
gaacaacgcgacgaagcaga

SEQ ID NO: 3339910 - RNA, 22 nt, Mycobacterium tuberculosis H37Rv
gaacaacgcggacuucguuccg

SEQ ID NO: 3339911 - RNA, 19 nt, Mycobacterium tuberculosis H37Rv
gaacaacggcguaaucggg

SEQ ID NO: 3339912 - RNA, 21 nt, Mycobacterium tuberculosis H37Rv
gaacaacgggauccgcgcgcu

SEQ ID NO: 3339913 - RNA, 16 nt, Mycobacterium tuberculosis H37Rv
gaacaauaaggccgca

SEQ ID NO: 3339914 - RNA, 21 nt, Mycobacterium tuberculosis H37Rv
gaacacauccgcuugcggggc

SEQ ID NO: 3339915 - RNA, 15 nt, Mycobacterium tuberculosis H37Rv
gaacaccacaccgag

SEQ ID NO: 3339916 - RNA, 23 nt, Mycobacterium tuberculosis H37Rv
gaacaccacaccgagcaccugac

SEQ ID NO: 3339917 - RNA, 22 nt, Mycobacterium tuberculosis H37Rv
gaacaccagauggcucucggug

SEQ ID NO: 3339918 - RNA, 13 nt, Mycobacterium tuberculosis H37Rv
gaacaccagcagg

SEQ ID NO: 3339919 - RNA, 16 nt, Mycobacterium tuberculosis H37Rv
gaacaccagcaggcgg

SEQ ID NO: 3339920 - RNA, 16 nt, Mycobacterium tuberculosis H37Rv
gaacaccagcgcgccg

SEQ ID NO: 3339921 - RNA, 22 nt, Mycobacterium tuberculosis H37Rv
gaacaccgaggcgaccggaccg

SEQ ID NO: 3339922 - RNA, 21 nt, Mycobacterium tuberculosis H37Rv
gaacaccgccgcgucgagcac

SEQ ID NO: 3339923 - RNA, 23 nt, Mycobacterium tuberculosis H37Rv
gaacaccggccaacagucgcagc

SEQ ID NO: 3339924 - RNA, 15 nt, Mycobacterium tuberculosis H37Rv
gaacaccggccaggc

SEQ ID NO: 3339925 - RNA, 18 nt, Mycobacterium tuberculosis H37Rv
gaacacgaauccggccac

SEQ ID NO: 3339926 - RNA, 18 nt, Mycobacterium tuberculosis H37Rv
gaacacgcacacgaucgc

SEQ ID NO: 3339927 - RNA, 14 nt, Mycobacterium tuberculosis H37Rv
gaacacgucgacac

SEQ ID NO: 3339928 - RNA, 13 nt, Mycobacterium tuberculosis H37Rv
gaacacgucggcc

SEQ ID NO: 3339929 - RNA, 21 nt, Mycobacterium tuberculosis H37Rv
gaacacguuauucaugcccau

SEQ ID NO: 3339930 - RNA, 22 nt, Mycobacterium tuberculosis H37Rv
gaacacguucggguacccggga

SEQ ID NO: 3339931 - RNA, 22 nt, Mycobacterium tuberculosis H37Rv
gaacagacggcucagcgugcgc

SEQ ID NO: 3339932 - RNA, 19 nt, Mycobacterium tuberculosis H37Rv
gaacagacggggucgcccg

SEQ ID NO: 3339933 - RNA, 21 nt, Mycobacterium tuberculosis H37Rv
gaacagcacauaugugcccgg

SEQ ID NO: 3339934 - RNA, 15 nt, Mycobacterium tuberculosis H37Rv
gaacagcaccgccgg

SEQ ID NO: 3339935 - RNA, 19 nt, Mycobacterium tuberculosis H37Rv
gaacagcaccgccggcgac

SEQ ID NO: 3339936 - RNA, 14 nt, Mycobacterium tuberculosis H37Rv
gaacagcaccuccg

SEQ ID NO: 3339937 - RNA, 13 nt, Mycobacterium tuberculosis H37Rv
gaacagcacgacu

SEQ ID NO: 3339938 - RNA, 16 nt, Mycobacterium tuberculosis H37Rv
gaacagcagcccgccc

SEQ ID NO: 3339939 - RNA, 15 nt, Mycobacterium tuberculosis H37Rv
gaacagcaggccucc

SEQ ID NO: 3339940 - RNA, 15 nt, Mycobacterium tuberculosis H37Rv
gaacagcaugauccg

SEQ ID NO: 3339941 - RNA, 12 nt, Mycobacterium tuberculosis H37Rv
gaacagccccag

SEQ ID NO: 3339942 - RNA, 15 nt, Mycobacterium tuberculosis H37Rv
gaacagccgagccag

SEQ ID NO: 3339943 - RNA, 13 nt, Mycobacterium tuberculosis H37Rv
gaacagcgaaccg

SEQ ID NO: 3339944 - RNA, 19 nt, Mycobacterium tuberculosis H37Rv
gaacagcgaaccgccggca

SEQ ID NO: 3339945 - RNA, 20 nt, Mycobacterium tuberculosis H37Rv
gaacagcgaaccgccggcac

SEQ ID NO: 3339946 - RNA, 14 nt, Mycobacterium tuberculosis H37Rv
gaacagcgacgcca

SEQ ID NO: 3339947 - RNA, 22 nt, Mycobacterium tuberculosis H37Rv
gaacagcgacgccauggucaga

SEQ ID NO: 3339948 - RNA, 21 nt, Mycobacterium tuberculosis H37Rv
gaacagcgcgucggagccggg

SEQ ID NO: 3339949 - RNA, 20 nt, Mycobacterium tuberculosis H37Rv
gaacagcgggggcagcgcga

SEQ ID NO: 3339950 - RNA, 19 nt, Mycobacterium tuberculosis H37Rv
gaacagcgguccagccacc

SEQ ID NO: 3339951 - RNA, 17 nt, Mycobacterium tuberculosis H37Rv
gaacagcugaucccaga

SEQ ID NO: 3339952 - RNA, 19 nt, Mycobacterium tuberculosis H37Rv
gaacagcugaucccagauc

SEQ ID NO: 3339953 - RNA, 22 nt, Mycobacterium tuberculosis H37Rv
gaacagcugcccgccagcgccg

SEQ ID NO: 3339954 - RNA, 11 nt, Mycobacterium tuberculosis H37Rv
gaacagcugga

SEQ ID NO: 3339955 - RNA, 18 nt, Mycobacterium tuberculosis H37Rv
gaacagcuucgcgcagcc

SEQ ID NO: 3339956 - RNA, 23 nt, Mycobacterium tuberculosis H37Rv
gaacaggaucagcgacuugcugg

SEQ ID NO: 3339957 - RNA, 15 nt, Mycobacterium tuberculosis H37Rv
gaacaggccgaggcg

SEQ ID NO: 3339958 - RNA, 19 nt, Mycobacterium tuberculosis H37Rv
gaacaggccggccgcgauc

SEQ ID NO: 3339959 - RNA, 23 nt, Mycobacterium tuberculosis H37Rv
gaacaggccggccgcgauccagc

SEQ ID NO: 3339960 - RNA, 22 nt, Mycobacterium tuberculosis H37Rv
gaacagggaggucgccgcaucg

SEQ ID NO: 3339961 - RNA, 14 nt, Mycobacterium tuberculosis H37Rv
gaacaggguggugg

SEQ ID NO: 3339962 - RNA, 20 nt, Mycobacterium tuberculosis H37Rv
gaacagucgcagccaggcac

SEQ ID NO: 3339963 - RNA, 20 nt, Mycobacterium tuberculosis H37Rv
gaacagugacgccacgaccg

SEQ ID NO: 3339964 - RNA, 21 nt, Mycobacterium tuberculosis H37Rv
gaacaguucggcgagcacaug

SEQ ID NO: 3339965 - RNA, 16 nt, Mycobacterium tuberculosis H37Rv
gaacaguuucggcaug

SEQ ID NO: 3339966 - RNA, 18 nt, Mycobacterium tuberculosis H37Rv
gaacauccgcacuggguc

SEQ ID NO: 3339967 - RNA, 21 nt, Mycobacterium tuberculosis H37Rv
gaacauccgccgcccccgccc

SEQ ID NO: 3339968 - RNA, 14 nt, Mycobacterium tuberculosis H37Rv
gaacaucgccagcg

SEQ ID NO: 3339969 - RNA, 13 nt, Mycobacterium tuberculosis H37Rv
gaacaucgucauc

SEQ ID NO: 3339970 - RNA, 24 nt, Mycobacterium tuberculosis H37Rv
gaacauggccagcaucagcgccag

SEQ ID NO: 3339971 - RNA, 20 nt, Mycobacterium tuberculosis H37Rv
gaacaugggaugcucaccgg

SEQ ID NO: 3339972 - RNA, 18 nt, Mycobacterium tuberculosis H37Rv
gaacauuccggcaccucc

SEQ ID NO: 3339973 - RNA, 19 nt, Mycobacterium tuberculosis H37Rv
gaacauuccggcaccuccg

SEQ ID NO: 3339974 - RNA, 17 nt, Mycobacterium tuberculosis H37Rv
gaacauugcgcccagcg

SEQ ID NO: 3339975 - RNA, 23 nt, Mycobacterium tuberculosis H37Rv
gaaccaaccucggaucgccaggc

SEQ ID NO: 3339976 - RNA, 22 nt, Mycobacterium tuberculosis H37Rv
gaaccaacgcgaccgcaucucg

SEQ ID NO: 3339977 - RNA, 24 nt, Mycobacterium tuberculosis H37Rv
gaaccaaucgcacgccagcuuggc

SEQ ID NO: 3339978 - RNA, 12 nt, Mycobacterium tuberculosis H37Rv
gaaccaccaccg

SEQ ID NO: 3339979 - RNA, 18 nt, Mycobacterium tuberculosis H37Rv
gaaccaccagcacggcga

SEQ ID NO: 3339980 - RNA, 21 nt, Mycobacterium tuberculosis H37Rv
gaaccaccggcgccgccggca

SEQ ID NO: 3339981 - RNA, 23 nt, Mycobacterium tuberculosis H37Rv
gaaccacgacguugcgaggccgc

SEQ ID NO: 3339982 - RNA, 19 nt, Mycobacterium tuberculosis H37Rv
gaaccacgccaucgagcag

SEQ ID NO: 3339983 - RNA, 23 nt, Mycobacterium tuberculosis H37Rv
gaaccacgcgcccgcaccaccgg

SEQ ID NO: 3339984 - RNA, 18 nt, Mycobacterium tuberculosis H37Rv
gaaccacggcagccaacc

SEQ ID NO: 3339985 - RNA, 17 nt, Mycobacterium tuberculosis H37Rv
gaaccacggcaggcagg

SEQ ID NO: 3339986 - RNA, 11 nt, Mycobacterium tuberculosis H37Rv
gaaccacggcg

SEQ ID NO: 3339987 - RNA, 17 nt, Mycobacterium tuberculosis H37Rv
gaaccacggucagcacg

SEQ ID NO: 3339988 - RNA, 22 nt, Mycobacterium tuberculosis H37Rv
gaaccacuuuccgaggagggcc

SEQ ID NO: 3339989 - RNA, 22 nt, Mycobacterium tuberculosis H37Rv
gaaccagaguucggccagcgug

SEQ ID NO: 3339990 - RNA, 17 nt, Mycobacterium tuberculosis H37Rv
gaaccagcccgccgauc

SEQ ID NO: 3339991 - RNA, 14 nt, Mycobacterium tuberculosis H37Rv
gaaccagcgcgugg

SEQ ID NO: 3339992 - RNA, 22 nt, Mycobacterium tuberculosis H37Rv
gaaccagcggucggcgaccacc

SEQ ID NO: 3339993 - RNA, 20 nt, Mycobacterium tuberculosis H37Rv
gaaccagcuugcgccgcagc

SEQ ID NO: 3339994 - RNA, 19 nt, Mycobacterium tuberculosis H37Rv
gaaccaggcggccgcgucg

SEQ ID NO: 3339995 - RNA, 21 nt, Mycobacterium tuberculosis H37Rv
gaaccagucgaagaagacccg

SEQ ID NO: 3339996 - RNA, 13 nt, Mycobacterium tuberculosis H37Rv
gaaccagucgacc

SEQ ID NO: 3339997 - RNA, 15 nt, Mycobacterium tuberculosis H37Rv
gaaccagucgaccca

SEQ ID NO: 3339998 - RNA, 16 nt, Mycobacterium tuberculosis H37Rv
gaaccagucgacccag

SEQ ID NO: 3339999 - RNA, 20 nt, Mycobacterium tuberculosis H37Rv
gaaccagucgacccagcgcg

SEQ ID NO: 3340000 - RNA, 17 nt, Mycobacterium tuberculosis H37Rv
gaaccauugcccgacga

SEQ ID NO: 3340001 - RNA, 24 nt, Mycobacterium tuberculosis H37Rv
gaacccacugcccgccgacgccag

SEQ ID NO: 3340002 - RNA, 13 nt, Mycobacterium tuberculosis H37Rv
gaacccagcacug

SEQ ID NO: 3340003 - RNA, 15 nt, Mycobacterium tuberculosis H37Rv
gaacccagcacuggg

SEQ ID NO: 3340004 - RNA, 18 nt, Mycobacterium tuberculosis H37Rv
gaacgcgcgcagccgggc

SEQ ID NO: 3340005 - RNA, 13 nt, Mycobacterium tuberculosis H37Rv
gaacgcgcgcgug

SEQ ID NO: 3340006 - RNA, 22 nt, Mycobacterium tuberculosis H37Rv
gaacgcgcgcguggucgccccg

SEQ ID NO: 3340007 - RNA, 16 nt, Mycobacterium tuberculosis H37Rv
gaacgcgcgugcagcc

SEQ ID NO: 3340008 - RNA, 14 nt, Mycobacterium tuberculosis H37Rv
gaacgcggaagccg

SEQ ID NO: 3340009 - RNA, 16 nt, Mycobacterium tuberculosis H37Rv
gaacgcggaagccgcc

SEQ ID NO: 3340010 - RNA, 18 nt, Mycobacterium tuberculosis H37Rv
gaacgcggccaacggacc

SEQ ID NO: 3340011 - RNA, 19 nt, Mycobacterium tuberculosis H37Rv
gaacgcggccaccgaccgc

SEQ ID NO: 3340012 - RNA, 18 nt, Mycobacterium tuberculosis H37Rv
gaacgcggccucgucgag

SEQ ID NO: 3340013 - RNA, 12 nt, Mycobacterium tuberculosis H37Rv
gaacgcggcgaa

SEQ ID NO: 3340014 - RNA, 16 nt, Mycobacterium tuberculosis H37Rv
gaacgcguccagcgcg

SEQ ID NO: 3340015 - RNA, 14 nt, Mycobacterium tuberculosis H37Rv
gaacgcgucgccga

SEQ ID NO: 3340016 - RNA, 16 nt, Mycobacterium tuberculosis H37Rv
gaacgcgucggucgac

SEQ ID NO: 3340017 - RNA, 20 nt, Mycobacterium tuberculosis H37Rv
gaacgcgucguagcgcucgu

SEQ ID NO: 3340018 - RNA, 23 nt, Mycobacterium tuberculosis H37Rv
gaacgcuagcgccaaauccggcu

SEQ ID NO: 3340019 - RNA, 22 nt, Mycobacterium tuberculosis H37Rv
gaacgcuaggcgauccagacgg

SEQ ID NO: 3340020 - RNA, 17 nt, Mycobacterium tuberculosis H37Rv
gaacgcuccaggccuag

SEQ ID NO: 3340021 - RNA, 15 nt, Mycobacterium tuberculosis H37Rv
gaacgcucgucgaca

SEQ ID NO: 3340022 - RNA, 16 nt, Mycobacterium tuberculosis H37Rv
gaacgcugcccaacgg

SEQ ID NO: 3340023 - RNA, 20 nt, Mycobacterium tuberculosis H37Rv
gaacgcuguaagcaugccgu

SEQ ID NO: 3340024 - RNA, 16 nt, Mycobacterium tuberculosis H37Rv
gaacgcuucaccucgu

SEQ ID NO: 3340025 - RNA, 20 nt, Mycobacterium tuberculosis H37Rv
gaacgcuucaccucgucgac

SEQ ID NO: 3340026 - RNA, 13 nt, Mycobacterium tuberculosis H37Rv
gaacgcuuccagc

SEQ ID NO: 3340027 - RNA, 20 nt, Mycobacterium tuberculosis H37Rv
gaacgcuuuccggcgguggu

SEQ ID NO: 3340028 - RNA, 16 nt, Mycobacterium tuberculosis H37Rv
gaacggaauucagcga

SEQ ID NO: 3340029 - RNA, 15 nt, Mycobacterium tuberculosis H37Rv
gaacggauaccuggg

SEQ ID NO: 3340030 - RNA, 15 nt, Mycobacterium tuberculosis H37Rv
gaacggauucccgcc

SEQ ID NO: 3340031 - RNA, 22 nt, Mycobacterium tuberculosis H37Rv
gaacggauucccgcccagcagc

SEQ ID NO: 3340032 - RNA, 17 nt, Mycobacterium tuberculosis H37Rv
gaacggcgcaguuggca

SEQ ID NO: 3340033 - RNA, 18 nt, Mycobacterium tuberculosis H37Rv
gaacggcgcaguuggcac

SEQ ID NO: 3340034 - RNA, 13 nt, Mycobacterium tuberculosis H37Rv
gaacggcgggcga

SEQ ID NO: 3340035 - RNA, 14 nt, Mycobacterium tuberculosis H37Rv
gaacggcgucgaau

SEQ ID NO: 3340036 - RNA, 19 nt, Mycobacterium tuberculosis H37Rv
gaacggcguugcggaauca

SEQ ID NO: 3340037 - RNA, 13 nt, Mycobacterium tuberculosis H37Rv
gaacggcucggcc

SEQ ID NO: 3340038 - RNA, 16 nt, Mycobacterium tuberculosis H37Rv
gaacggcucggccgga

SEQ ID NO: 3340039 - RNA, 19 nt, Mycobacterium tuberculosis H37Rv
gaacggcucgggcagcguc

SEQ ID NO: 3340040 - RNA, 23 nt, Mycobacterium tuberculosis H37Rv
gaacggcuugcgauuggcugggu

SEQ ID NO: 3340041 - RNA, 17 nt, Mycobacterium tuberculosis H37Rv
gaacgggaucgacccgc

SEQ ID NO: 3340042 - RNA, 19 nt, Mycobacterium tuberculosis H37Rv
gaacgguagcacugucgag

SEQ ID NO: 3340043 - RNA, 19 nt, Mycobacterium tuberculosis H37Rv
gaacggugcacagcaguga

SEQ ID NO: 3340044 - RNA, 12 nt, Mycobacterium tuberculosis H37Rv
gaacggugccga

SEQ ID NO: 3340045 - RNA, 14 nt, Mycobacterium tuberculosis H37Rv
gaacggugccgauc

SEQ ID NO: 3340046 - RNA, 19 nt, Mycobacterium tuberculosis H37Rv
gaacggugucaacggcacc

SEQ ID NO: 3340047 - RNA, 14 nt, Mycobacterium tuberculosis H37Rv
gaacgucacguggu

SEQ ID NO: 3340048 - RNA, 22 nt, Mycobacterium tuberculosis H37Rv
gaacguccagccguggcggcgg

SEQ ID NO: 3340049 - RNA, 16 nt, Mycobacterium tuberculosis H37Rv
gaacguccgcgccgag

SEQ ID NO: 3340050 - RNA, 14 nt, Mycobacterium tuberculosis H37Rv
gaacgucucggcca

SEQ ID NO: 3340051 - RNA, 16 nt, Mycobacterium tuberculosis H37Rv
gaacgucucggccagc

SEQ ID NO: 3340052 - RNA, 20 nt, Mycobacterium tuberculosis H37Rv
gaacgugaacucacggcggu

SEQ ID NO: 3340053 - RNA, 19 nt, Mycobacterium tuberculosis H37Rv
gaacgugcaaccacggcgg

SEQ ID NO: 3340054 - RNA, 20 nt, Mycobacterium tuberculosis H37Rv
gaacgugcaaccacggcggc

SEQ ID NO: 3340055 - RNA, 16 nt, Mycobacterium tuberculosis H37Rv
gaacgugccuuccucg

SEQ ID NO: 3340056 - RNA, 22 nt, Mycobacterium tuberculosis H37Rv
gaacgugccuuccucgccggaa

SEQ ID NO: 3340057 - RNA, 14 nt, Mycobacterium tuberculosis H37Rv
gaacgugucgggug

SEQ ID NO: 3340058 - RNA, 22 nt, Mycobacterium tuberculosis H37Rv
gaacguuuucgucaccccacca

SEQ ID NO: 3340059 - RNA, 19 nt, Mycobacterium tuberculosis H37Rv
gaacuacugcgaucgcgag

SEQ ID NO: 3340060 - RNA, 17 nt, Mycobacterium tuberculosis H37Rv
gaacucaacaccagcaa

SEQ ID NO: 3340061 - RNA, 17 nt, Mycobacterium tuberculosis H37Rv
gaacuccagcagcccgg

SEQ ID NO: 3340062 - RNA, 14 nt, Mycobacterium tuberculosis H37Rv
gaacuccaucacca

SEQ ID NO: 3340063 - RNA, 17 nt, Mycobacterium tuberculosis H37Rv
gaacuccaucaccacac

SEQ ID NO: 3340064 - RNA, 13 nt, Mycobacterium tuberculosis H37Rv
gaacuccgccacc

SEQ ID NO: 3340065 - RNA, 18 nt, Mycobacterium tuberculosis H37Rv
gaacuccgggaccaggcc

SEQ ID NO: 3340066 - RNA, 20 nt, Mycobacterium tuberculosis H37Rv
gaacuccggguggcggcggc

SEQ ID NO: 3340067 - RNA, 23 nt, Mycobacterium tuberculosis H37Rv
gaacuccggguggcggcggcgga

SEQ ID NO: 3340068 - RNA, 22 nt, Mycobacterium tuberculosis H37Rv
gaacuccucgcugucgaucagc

SEQ ID NO: 3340069 - RNA, 16 nt, Mycobacterium tuberculosis H37Rv
gaacucgaacuggguc

SEQ ID NO: 3340070 - RNA, 15 nt, Mycobacterium tuberculosis H37Rv
gaacucgaccaccgc

SEQ ID NO: 3340071 - RNA, 14 nt, Mycobacterium tuberculosis H37Rv
gaacucgcccaggg

SEQ ID NO: 3340072 - RNA, 15 nt, Mycobacterium tuberculosis H37Rv
gaacucgcgggcgac

SEQ ID NO: 3340073 - RNA, 16 nt, Mycobacterium tuberculosis H37Rv
gaacucgcgggcgacc

SEQ ID NO: 3340074 - RNA, 18 nt, Mycobacterium tuberculosis H37Rv
gaacucgcgggcgaccac

SEQ ID NO: 3340075 - RNA, 16 nt, Mycobacterium tuberculosis H37Rv
gaacucggacccaccc

SEQ ID NO: 3340076 - RNA, 15 nt, Mycobacterium tuberculosis H37Rv
gaacucggcccacac

SEQ ID NO: 3340077 - RNA, 13 nt, Mycobacterium tuberculosis H37Rv
gaacucgggcgac

SEQ ID NO: 3340078 - RNA, 17 nt, Mycobacterium tuberculosis H37Rv
gaacucggugcccccac

SEQ ID NO: 3340079 - RNA, 15 nt, Mycobacterium tuberculosis H37Rv
gaacucgucgcugcc

SEQ ID NO: 3340080 - RNA, 14 nt, Mycobacterium tuberculosis H37Rv
gaacucgugacagc

SEQ ID NO: 3340081 - RNA, 20 nt, Mycobacterium tuberculosis H37Rv
gaacucguugagcagcugga

SEQ ID NO: 3340082 - RNA, 22 nt, Mycobacterium tuberculosis H37Rv
gaacucguugagcagcuggacc

SEQ ID NO: 3340083 - RNA, 20 nt, Mycobacterium tuberculosis H37Rv
gaacucuggauucuucagcg

SEQ ID NO: 3340084 - RNA, 17 nt, Mycobacterium tuberculosis H37Rv
gaacucuggugacggug

SEQ ID NO: 3340085 - RNA, 22 nt, Mycobacterium tuberculosis H37Rv
gaacugaaacgcuuggcccugg

SEQ ID NO: 3340086 - RNA, 21 nt, Mycobacterium tuberculosis H37Rv
gaacugaggauuucauacgcg

SEQ ID NO: 3340087 - RNA, 15 nt, Mycobacterium tuberculosis H37Rv
gaacugaucgaccgc

SEQ ID NO: 3340088 - RNA, 19 nt, Mycobacterium tuberculosis H37Rv
gaacugaugaaccacggca

SEQ ID NO: 3340089 - RNA, 23 nt, Mycobacterium tuberculosis H37Rv
gaacugaugaaccacggcaggca

SEQ ID NO: 3340090 - RNA, 18 nt, Mycobacterium tuberculosis H37Rv
gaacugcaucauggccgu

SEQ ID NO: 3340091 - RNA, 21 nt, Mycobacterium tuberculosis H37Rv
gaacugcugaugaaacgccgu

SEQ ID NO: 3340092 - RNA, 21 nt, Mycobacterium tuberculosis H37Rv
gaacuggacaagcuccucgcg

SEQ ID NO: 3340093 - RNA, 18 nt, Mycobacterium tuberculosis H37Rv
gaacuggaccacagccgc

SEQ ID NO: 3340094 - RNA, 22 nt, Mycobacterium tuberculosis H37Rv
gaacuggacggggaagcccggc

SEQ ID NO: 3340095 - RNA, 12 nt, Mycobacterium tuberculosis H37Rv
gaacuggcuggu

SEQ ID NO: 3340096 - RNA, 19 nt, Mycobacterium tuberculosis H37Rv
gaacuggcuguaguccgcu

SEQ ID NO: 3340097 - RNA, 24 nt, Mycobacterium tuberculosis H37Rv
gaacugggcccccaaucagugcag

SEQ ID NO: 3340098 - RNA, 13 nt, Mycobacterium tuberculosis H37Rv
gaacugggccuca

SEQ ID NO: 3340099 - RNA, 15 nt, Mycobacterium tuberculosis H37Rv
gaacugggcgaucga

SEQ ID NO: 3340100 - RNA, 19 nt, Mycobacterium tuberculosis H37Rv
gaagcgucguugcucgguc

SEQ ID NO: 3340101 - RNA, 20 nt, Mycobacterium tuberculosis H37Rv
gaagcgucuggucagccgcg

SEQ ID NO: 3340102 - RNA, 19 nt, Mycobacterium tuberculosis H37Rv
gaagcguugcacugcuggu

SEQ ID NO: 3340103 - RNA, 14 nt, Mycobacterium tuberculosis H37Rv
gaagcuagagccag

SEQ ID NO: 3340104 - RNA, 20 nt, Mycobacterium tuberculosis H37Rv
gaagcucaauuccaugcagu

SEQ ID NO: 3340105 - RNA, 23 nt, Mycobacterium tuberculosis H37Rv
gaagcugcgggucucgcugggaa

SEQ ID NO: 3340106 - RNA, 16 nt, Mycobacterium tuberculosis H37Rv
gaagcugcugcugcuu

SEQ ID NO: 3340107 - RNA, 23 nt, Mycobacterium tuberculosis H37Rv
gaagcuggcacgcagagccaaca

SEQ ID NO: 3340108 - RNA, 14 nt, Mycobacterium tuberculosis H37Rv
gaagcuggccaccg

SEQ ID NO: 3340109 - RNA, 16 nt, Mycobacterium tuberculosis H37Rv
gaagcuggcgugcagc

SEQ ID NO: 3340110 - RNA, 21 nt, Mycobacterium tuberculosis H37Rv
gaagcuguaggcgaccagaua

SEQ ID NO: 3340111 - RNA, 20 nt, Mycobacterium tuberculosis H37Rv
gaaggaaccgggcaaaucaa

SEQ ID NO: 3340112 - RNA, 23 nt, Mycobacterium tuberculosis H37Rv
gaaggacaucacgaaggcguucg

SEQ ID NO: 3340113 - RNA, 16 nt, Mycobacterium tuberculosis H37Rv
gaaggaccggcaccug

SEQ ID NO: 3340114 - RNA, 17 nt, Mycobacterium tuberculosis H37Rv
gaaggacggcagccacc

SEQ ID NO: 3340115 - RNA, 23 nt, Mycobacterium tuberculosis H37Rv
gaaggagauccuuaucgcucucg

SEQ ID NO: 3340116 - RNA, 23 nt, Mycobacterium tuberculosis H37Rv
gaaggaucagcgcacuggccgcu

SEQ ID NO: 3340117 - RNA, 22 nt, Mycobacterium tuberculosis H37Rv
gaaggaugcggccccaugcgcc

SEQ ID NO: 3340118 - RNA, 16 nt, Mycobacterium tuberculosis H37Rv
gaaggcaaacaccagc

SEQ ID NO: 3340119 - RNA, 22 nt, Mycobacterium tuberculosis H37Rv
gaaggcaccgaaaaacaccagc

SEQ ID NO: 3340120 - RNA, 13 nt, Mycobacterium tuberculosis H37Rv
gaaggcauugccc

SEQ ID NO: 3340121 - RNA, 14 nt, Mycobacterium tuberculosis H37Rv
gaaggccgaacugc

SEQ ID NO: 3340122 - RNA, 23 nt, Mycobacterium tuberculosis H37Rv
gaaggccgaacugccgcgccgac

SEQ ID NO: 3340123 - RNA, 17 nt, Mycobacterium tuberculosis H37Rv
gaaggccgcaccgccac

SEQ ID NO: 3340124 - RNA, 18 nt, Mycobacterium tuberculosis H37Rv
gaaggcgacccgcugggu

SEQ ID NO: 3340125 - RNA, 16 nt, Mycobacterium tuberculosis H37Rv
gaaggcgacgccgaaa

SEQ ID NO: 3340126 - RNA, 16 nt, Mycobacterium tuberculosis H37Rv
gaaggcgcgcgcccgg

SEQ ID NO: 3340127 - RNA, 16 nt, Mycobacterium tuberculosis H37Rv
gaaggcggccaggugc

SEQ ID NO: 3340128 - RNA, 21 nt, Mycobacterium tuberculosis H37Rv
gaaggcguucgacucgaccgc

SEQ ID NO: 3340129 - RNA, 20 nt, Mycobacterium tuberculosis H37Rv
gaaggcuucggugacccggg

SEQ ID NO: 3340130 - RNA, 17 nt, Mycobacterium tuberculosis H37Rv
gaagggcuugucgccgg

SEQ ID NO: 3340131 - RNA, 17 nt, Mycobacterium tuberculosis H37Rv
gaaggucagcagggccg

SEQ ID NO: 3340132 - RNA, 22 nt, Mycobacterium tuberculosis H37Rv
gaaggucagcgacuugcggugc

SEQ ID NO: 3340133 - RNA, 22 nt, Mycobacterium tuberculosis H37Rv
gaagguccgugccgaugccggc

SEQ ID NO: 3340134 - RNA, 16 nt, Mycobacterium tuberculosis H37Rv
gaaggucgaaucgcug

SEQ ID NO: 3340135 - RNA, 14 nt, Mycobacterium tuberculosis H37Rv
gaaggugacgacga

SEQ ID NO: 3340136 - RNA, 17 nt, Mycobacterium tuberculosis H37Rv
gaaggugcugcgcgggu

SEQ ID NO: 3340137 - RNA, 12 nt, Mycobacterium tuberculosis H37Rv
gaaggugcuggu

SEQ ID NO: 3340138 - RNA, 19 nt, Mycobacterium tuberculosis H37Rv
gaagguggcauucgucgag

SEQ ID NO: 3340139 - RNA, 21 nt, Mycobacterium tuberculosis H37Rv
gaaggugggauugaagcuggc

SEQ ID NO: 3340140 - RNA, 15 nt, Mycobacterium tuberculosis H37Rv
gaagguguccuccag

SEQ ID NO: 3340141 - RNA, 15 nt, Mycobacterium tuberculosis H37Rv
gaaguaauagcuguu

SEQ ID NO: 3340142 - RNA, 13 nt, Mycobacterium tuberculosis H37Rv
gaaguacacggcg

SEQ ID NO: 3340143 - RNA, 13 nt, Mycobacterium tuberculosis H37Rv
gaaguacgugcac

SEQ ID NO: 3340144 - RNA, 21 nt, Mycobacterium tuberculosis H37Rv
gaaguacuccacccaggccga

SEQ ID NO: 3340145 - RNA, 14 nt, Mycobacterium tuberculosis H37Rv
gaaguaggcggcga

SEQ ID NO: 3340146 - RNA, 15 nt, Mycobacterium tuberculosis H37Rv
gaaguagugcucgca

SEQ ID NO: 3340147 - RNA, 18 nt, Mycobacterium tuberculosis H37Rv
gaaguagugcucgcagcc

SEQ ID NO: 3340148 - RNA, 13 nt, Mycobacterium tuberculosis H37Rv
gaagucacaggau

SEQ ID NO: 3340149 - RNA, 15 nt, Mycobacterium tuberculosis H37Rv
gaagucccggauacg

SEQ ID NO: 3340150 - RNA, 23 nt, Mycobacterium tuberculosis H37Rv
gaagucccgggcaccgucggaac

SEQ ID NO: 3340151 - RNA, 16 nt, Mycobacterium tuberculosis H37Rv
gaaguccuccacgcug

SEQ ID NO: 3340152 - RNA, 15 nt, Mycobacterium tuberculosis H37Rv
gaagucgacucgcca

SEQ ID NO: 3340153 - RNA, 16 nt, Mycobacterium tuberculosis H37Rv
gaagucgacucgccac

SEQ ID NO: 3340154 - RNA, 16 nt, Mycobacterium tuberculosis H37Rv
gaagucgaggucccga

SEQ ID NO: 3340155 - RNA, 21 nt, Mycobacterium tuberculosis H37Rv
gaagucgcggacgucgccccg

SEQ ID NO: 3340156 - RNA, 17 nt, Mycobacterium tuberculosis H37Rv
gaagucggucugcgggg

SEQ ID NO: 3340157 - RNA, 15 nt, Mycobacterium tuberculosis H37Rv
gaagucgucggccau

SEQ ID NO: 3340158 - RNA, 21 nt, Mycobacterium tuberculosis H37Rv
gaagugagcucggcugcucga

SEQ ID NO: 3340159 - RNA, 20 nt, Mycobacterium tuberculosis H37Rv
gaagugcucacauccgguca

SEQ ID NO: 3340160 - RNA, 22 nt, Mycobacterium tuberculosis H37Rv
gaaguggagccccgacugcuga

SEQ ID NO: 3340161 - RNA, 16 nt, Mycobacterium tuberculosis H37Rv
gaaguggaucuggcgc

SEQ ID NO: 3340162 - RNA, 21 nt, Mycobacterium tuberculosis H37Rv
gaaguguucgacacccucggg

SEQ ID NO: 3340163 - RNA, 22 nt, Mycobacterium tuberculosis H37Rv
gaaguucgucgguugccacgcc

SEQ ID NO: 3340164 - RNA, 14 nt, Mycobacterium tuberculosis H37Rv
gaaguucucggugc

SEQ ID NO: 3340165 - RNA, 16 nt, Mycobacterium tuberculosis H37Rv
gaaguugaagaagcca

SEQ ID NO: 3340166 - RNA, 18 nt, Mycobacterium tuberculosis H37Rv
gaaguugccggucaggca

SEQ ID NO: 3340167 - RNA, 14 nt, Mycobacterium tuberculosis H37Rv
gaaguuggcguggu

SEQ ID NO: 3340168 - RNA, 20 nt, Mycobacterium tuberculosis H37Rv
gaaguugggaagugcgguga

SEQ ID NO: 3340169 - RNA, 13 nt, Mycobacterium tuberculosis H37Rv
gaauacaacagcu

SEQ ID NO: 3340170 - RNA, 16 nt, Mycobacterium tuberculosis H37Rv
gaauacaccugcugga

SEQ ID NO: 3340171 - RNA, 21 nt, Mycobacterium tuberculosis H37Rv
gaauacaccugcuggaagccg

SEQ ID NO: 3340172 - RNA, 22 nt, Mycobacterium tuberculosis H37Rv
gaauacagcuugaucgccgagg

SEQ ID NO: 3340173 - RNA, 17 nt, Mycobacterium tuberculosis H37Rv
gaauaccgguggcagcc

SEQ ID NO: 3340174 - RNA, 16 nt, Mycobacterium tuberculosis H37Rv
gaauacgaccgucgcg

SEQ ID NO: 3340175 - RNA, 21 nt, Mycobacterium tuberculosis H37Rv
gaaucaacaggaccgggaucg

SEQ ID NO: 3340176 - RNA, 15 nt, Mycobacterium tuberculosis H37Rv
gaaucaccccggcgg

SEQ ID NO: 3340177 - RNA, 17 nt, Mycobacterium tuberculosis H37Rv
gaaucaccccggcggcc

SEQ ID NO: 3340178 - RNA, 16 nt, Mycobacterium tuberculosis H37Rv
gaaucacguggaccac

SEQ ID NO: 3340179 - RNA, 13 nt, Mycobacterium tuberculosis H37Rv
gaaucagcacccc

SEQ ID NO: 3340180 - RNA, 19 nt, Mycobacterium tuberculosis H37Rv
gaaucagcaccccauggcc

SEQ ID NO: 3340181 - RNA, 15 nt, Mycobacterium tuberculosis H37Rv
gaaucaggcucgccg

SEQ ID NO: 3340182 - RNA, 17 nt, Mycobacterium tuberculosis H37Rv
gaaucagggucugcgcc

SEQ ID NO: 3340183 - RNA, 15 nt, Mycobacterium tuberculosis H37Rv
gaaucagugaagaca

SEQ ID NO: 3340184 - RNA, 22 nt, Mycobacterium tuberculosis H37Rv
gaaucagugaagacaccaggcc

SEQ ID NO: 3340185 - RNA, 21 nt, Mycobacterium tuberculosis H37Rv
gaaucauguacguugucgugg

SEQ ID NO: 3340186 - RNA, 16 nt, Mycobacterium tuberculosis H37Rv
gaauccaccagccggu

SEQ ID NO: 3340187 - RNA, 19 nt, Mycobacterium tuberculosis H37Rv
gaauccaccagccgguagc

SEQ ID NO: 3340188 - RNA, 21 nt, Mycobacterium tuberculosis H37Rv
gaauccaccagccgguagccg

SEQ ID NO: 3340189 - RNA, 22 nt, Mycobacterium tuberculosis H37Rv
gaauccaccagccgguagccgg

SEQ ID NO: 3340190 - RNA, 16 nt, Mycobacterium tuberculosis H37Rv
gaauccaggagcccca

SEQ ID NO: 3340191 - RNA, 13 nt, Mycobacterium tuberculosis H37Rv
gaauccagguggu

SEQ ID NO: 3340192 - RNA, 15 nt, Mycobacterium tuberculosis H37Rv
gaauccccccugucg

SEQ ID NO: 3340193 - RNA, 17 nt, Mycobacterium tuberculosis H37Rv
gaaucccgcgcccggcc

SEQ ID NO: 3340194 - RNA, 23 nt, Mycobacterium tuberculosis H37Rv
gaaucccguauugauacugcccg

SEQ ID NO: 3340195 - RNA, 21 nt, Mycobacterium tuberculosis H37Rv
gaauccggaguuuaagacgcc

SEQ ID NO: 3340196 - RNA, 14 nt, Mycobacterium tuberculosis H37Rv
gacaaucucggccg

SEQ ID NO: 3340197 - RNA, 21 nt, Mycobacterium tuberculosis H37Rv
gacaaucucggcguugccgcc

SEQ ID NO: 3340198 - RNA, 13 nt, Mycobacterium tuberculosis H37Rv
gacaauggacacc

SEQ ID NO: 3340199 - RNA, 15 nt, Mycobacterium tuberculosis H37Rv
gacaauggacaccaa

SEQ ID NO: 3340200 - RNA, 17 nt, Mycobacterium tuberculosis H37Rv
gacaauggacaccaacc

SEQ ID NO: 3340201 - RNA, 19 nt, Mycobacterium tuberculosis H37Rv
gacaaugucggcgaugcgu

SEQ ID NO: 3340202 - RNA, 16 nt, Mycobacterium tuberculosis H37Rv
gacaauuccuggaucg

SEQ ID NO: 3340203 - RNA, 17 nt, Mycobacterium tuberculosis H37Rv
gacaauuuucgcaccua

SEQ ID NO: 3340204 - RNA, 15 nt, Mycobacterium tuberculosis H37Rv
gacacaacgaucugc

SEQ ID NO: 3340205 - RNA, 12 nt, Mycobacterium tuberculosis H37Rv
gacacacaggcg

SEQ ID NO: 3340206 - RNA, 22 nt, Mycobacterium tuberculosis H37Rv
gacacaccgcgucggccgaaca

SEQ ID NO: 3340207 - RNA, 22 nt, Mycobacterium tuberculosis H37Rv
gacacagaaucgcacgaaauca

SEQ ID NO: 3340208 - RNA, 12 nt, Mycobacterium tuberculosis H37Rv
gacaccaccucg

SEQ ID NO: 3340209 - RNA, 21 nt, Mycobacterium tuberculosis H37Rv
gacaccacggaccagcgccgg

SEQ ID NO: 3340210 - RNA, 13 nt, Mycobacterium tuberculosis H37Rv
gacaccacggcgc

SEQ ID NO: 3340211 - RNA, 20 nt, Mycobacterium tuberculosis H37Rv
gacaccacggcgcgcagcga

SEQ ID NO: 3340212 - RNA, 21 nt, Mycobacterium tuberculosis H37Rv
gacaccacggcgcgcagcgac

SEQ ID NO: 3340213 - RNA, 20 nt, Mycobacterium tuberculosis H37Rv
gacaccacguugugcagcgc

SEQ ID NO: 3340214 - RNA, 15 nt, Mycobacterium tuberculosis H37Rv
gacaccagcgugugg

SEQ ID NO: 3340215 - RNA, 13 nt, Mycobacterium tuberculosis H37Rv
gacaccagcucga

SEQ ID NO: 3340216 - RNA, 16 nt, Mycobacterium tuberculosis H37Rv
gacaccauaggccgac

SEQ ID NO: 3340217 - RNA, 22 nt, Mycobacterium tuberculosis H37Rv
gacaccaucuccgccgucgcca

SEQ ID NO: 3340218 - RNA, 14 nt, Mycobacterium tuberculosis H37Rv
gacacccagccgca

SEQ ID NO: 3340219 - RNA, 15 nt, Mycobacterium tuberculosis H37Rv
gacacccaucgaccg

SEQ ID NO: 3340220 - RNA, 16 nt, Mycobacterium tuberculosis H37Rv
gacacccaucgaccgc

SEQ ID NO: 3340221 - RNA, 18 nt, Mycobacterium tuberculosis H37Rv
gacaccccaccacagacg

SEQ ID NO: 3340222 - RNA, 18 nt, Mycobacterium tuberculosis H37Rv
gacacccccggugccggc

SEQ ID NO: 3340223 - RNA, 15 nt, Mycobacterium tuberculosis H37Rv
gacaccccgcacgga

SEQ ID NO: 3340224 - RNA, 16 nt, Mycobacterium tuberculosis H37Rv
gacacccgcagcugug

SEQ ID NO: 3340225 - RNA, 15 nt, Mycobacterium tuberculosis H37Rv
gacacccgccaggcc

SEQ ID NO: 3340226 - RNA, 12 nt, Mycobacterium tuberculosis H37Rv
gacacccgggcc

SEQ ID NO: 3340227 - RNA, 16 nt, Mycobacterium tuberculosis H37Rv
gacaccgaaccgccgc

SEQ ID NO: 3340228 - RNA, 23 nt, Mycobacterium tuberculosis H37Rv
gacaccgaaccgccgcugccgcg

SEQ ID NO: 3340229 - RNA, 15 nt, Mycobacterium tuberculosis H37Rv
gacaccgaccggguc

SEQ ID NO: 3340230 - RNA, 20 nt, Mycobacterium tuberculosis H37Rv
gacaccgagccacgacccag

SEQ ID NO: 3340231 - RNA, 17 nt, Mycobacterium tuberculosis H37Rv
gacaccgaucugcuuca

SEQ ID NO: 3340232 - RNA, 12 nt, Mycobacterium tuberculosis H37Rv
gacaccgcccga

SEQ ID NO: 3340233 - RNA, 22 nt, Mycobacterium tuberculosis H37Rv
gacaccgcccgacccaucacca

SEQ ID NO: 3340234 - RNA, 23 nt, Mycobacterium tuberculosis H37Rv
gacaccgccggggugcaccgucg

SEQ ID NO: 3340235 - RNA, 21 nt, Mycobacterium tuberculosis H37Rv
gacaccgcggcgaucugcgac

SEQ ID NO: 3340236 - RNA, 17 nt, Mycobacterium tuberculosis H37Rv
gacaccggccaccagcc

SEQ ID NO: 3340237 - RNA, 14 nt, Mycobacterium tuberculosis H37Rv
gacaccggccgcga

SEQ ID NO: 3340238 - RNA, 15 nt, Mycobacterium tuberculosis H37Rv
gacaccggccgcgac

SEQ ID NO: 3340239 - RNA, 14 nt, Mycobacterium tuberculosis H37Rv
gacaccggcggcau

SEQ ID NO: 3340240 - RNA, 17 nt, Mycobacterium tuberculosis H37Rv
gacaccggcggcaucga

SEQ ID NO: 3340241 - RNA, 22 nt, Mycobacterium tuberculosis H37Rv
gacaccggcuauaucccgcccc

SEQ ID NO: 3340242 - RNA, 17 nt, Mycobacterium tuberculosis H37Rv
gacaccgucaugccguu

SEQ ID NO: 3340243 - RNA, 16 nt, Mycobacterium tuberculosis H37Rv
gacaccguccagcagc

SEQ ID NO: 3340244 - RNA, 17 nt, Mycobacterium tuberculosis H37Rv
gacaccguccagcagcu

SEQ ID NO: 3340245 - RNA, 18 nt, Mycobacterium tuberculosis H37Rv
gacacgaaauugggcgcu

SEQ ID NO: 3340246 - RNA, 16 nt, Mycobacterium tuberculosis H37Rv
gacacgaccccgucga

SEQ ID NO: 3340247 - RNA, 15 nt, Mycobacterium tuberculosis H37Rv
gacacgacgugcagg

SEQ ID NO: 3340248 - RNA, 14 nt, Mycobacterium tuberculosis H37Rv
gacacgagucgcca

SEQ ID NO: 3340249 - RNA, 16 nt, Mycobacterium tuberculosis H37Rv
gacacgagucgccaga

SEQ ID NO: 3340250 - RNA, 19 nt, Mycobacterium tuberculosis H37Rv
gacacgagucgccagaccg

SEQ ID NO: 3340251 - RNA, 15 nt, Mycobacterium tuberculosis H37Rv
gacacgccgaugccg

SEQ ID NO: 3340252 - RNA, 19 nt, Mycobacterium tuberculosis H37Rv
gacacgccgaugccgaacu

SEQ ID NO: 3340253 - RNA, 13 nt, Mycobacterium tuberculosis H37Rv
gacacgcgcgcuc

SEQ ID NO: 3340254 - RNA, 20 nt, Mycobacterium tuberculosis H37Rv
gacacgcgcgcucgcggguu

SEQ ID NO: 3340255 - RNA, 21 nt, Mycobacterium tuberculosis H37Rv
gacacgcgcgcucgcggguuc

SEQ ID NO: 3340256 - RNA, 20 nt, Mycobacterium tuberculosis H37Rv
gacacgcgcugcgucgucga

SEQ ID NO: 3340257 - RNA, 22 nt, Mycobacterium tuberculosis H37Rv
gacacggccauccguaucacgg

SEQ ID NO: 3340258 - RNA, 13 nt, Mycobacterium tuberculosis H37Rv
gacacggcucgcc

SEQ ID NO: 3340259 - RNA, 16 nt, Mycobacterium tuberculosis H37Rv
gacacggguacggucu

SEQ ID NO: 3340260 - RNA, 15 nt, Mycobacterium tuberculosis H37Rv
gacacgugcaucugu

SEQ ID NO: 3340261 - RNA, 23 nt, Mycobacterium tuberculosis H37Rv
gacacguugacccaucucgucgu

SEQ ID NO: 3340262 - RNA, 24 nt, Mycobacterium tuberculosis H37Rv
gacacguugacccaucucgucguc

SEQ ID NO: 3340263 - RNA, 21 nt, Mycobacterium tuberculosis H37Rv
gacacguugcagcucgauccg

SEQ ID NO: 3340264 - RNA, 15 nt, Mycobacterium tuberculosis H37Rv
gacacguuggcggau

SEQ ID NO: 3340265 - RNA, 19 nt, Mycobacterium tuberculosis H37Rv
gacacguuguucaccgacg

SEQ ID NO: 3340266 - RNA, 23 nt, Mycobacterium tuberculosis H37Rv
gacacugcgaaggaccagagcuc

SEQ ID NO: 3340267 - RNA, 15 nt, Mycobacterium tuberculosis H37Rv
gacacugcugcggca

SEQ ID NO: 3340268 - RNA, 19 nt, Mycobacterium tuberculosis H37Rv
gacacugggaucccgacga

SEQ ID NO: 3340269 - RNA, 16 nt, Mycobacterium tuberculosis H37Rv
gacagaaucgaccgcc

SEQ ID NO: 3340270 - RNA, 19 nt, Mycobacterium tuberculosis H37Rv
gacagaaucgaccgccgcu

SEQ ID NO: 3340271 - RNA, 13 nt, Mycobacterium tuberculosis H37Rv
gacagacaggauu

SEQ ID NO: 3340272 - RNA, 19 nt, Mycobacterium tuberculosis H37Rv
gacagagcggguucgacgu

SEQ ID NO: 3340273 - RNA, 23 nt, Mycobacterium tuberculosis H37Rv
gacagauagacuagccgauccag

SEQ ID NO: 3340274 - RNA, 23 nt, Mycobacterium tuberculosis H37Rv
gacagauggucggucgcuucagc

SEQ ID NO: 3340275 - RNA, 22 nt, Mycobacterium tuberculosis H37Rv
gacagaugugguaccagcccgc

SEQ ID NO: 3340276 - RNA, 14 nt, Mycobacterium tuberculosis H37Rv
gacagcacccggcc

SEQ ID NO: 3340277 - RNA, 19 nt, Mycobacterium tuberculosis H37Rv
gacagcacgccaggcaugc

SEQ ID NO: 3340278 - RNA, 23 nt, Mycobacterium tuberculosis H37Rv
gacagcacgccaggcaugccgcc

SEQ ID NO: 3340279 - RNA, 16 nt, Mycobacterium tuberculosis H37Rv
gacagcagcgccaccc

SEQ ID NO: 3340280 - RNA, 16 nt, Mycobacterium tuberculosis H37Rv
gacagcaggaaaaagg

SEQ ID NO: 3340281 - RNA, 21 nt, Mycobacterium tuberculosis H37Rv
gacagcaggaaaaagggcuuc

SEQ ID NO: 3340282 - RNA, 17 nt, Mycobacterium tuberculosis H37Rv
gacagcagguugccgaa

SEQ ID NO: 3340283 - RNA, 19 nt, Mycobacterium tuberculosis H37Rv
gacagcaucacgaucacgu

SEQ ID NO: 3340284 - RNA, 23 nt, Mycobacterium tuberculosis H37Rv
gacagccccaucaccaccggcac

SEQ ID NO: 3340285 - RNA, 14 nt, Mycobacterium tuberculosis H37Rv
gacagccccgccgc

SEQ ID NO: 3340286 - RNA, 16 nt, Mycobacterium tuberculosis H37Rv
gacagccccgccgccc

SEQ ID NO: 3340287 - RNA, 18 nt, Mycobacterium tuberculosis H37Rv
gacagcccgaacgaggcg

SEQ ID NO: 3340288 - RNA, 22 nt, Mycobacterium tuberculosis H37Rv
gacagcccuaucagccgagaca

SEQ ID NO: 3340289 - RNA, 18 nt, Mycobacterium tuberculosis H37Rv
gacagcccuucgcgggag

SEQ ID NO: 3340290 - RNA, 17 nt, Mycobacterium tuberculosis H37Rv
gacagccguggcgcgac

SEQ ID NO: 3340291 - RNA, 14 nt, Mycobacterium tuberculosis H37Rv
gacagcgccuggcc

SEQ ID NO: 3340292 - RNA, 22 nt, Mycobacterium tuberculosis H37Rv
gaccaccggaauuugcgucgug

SEQ ID NO: 3340293 - RNA, 17 nt, Mycobacterium tuberculosis H37Rv
gaccaccggcagcgcga

SEQ ID NO: 3340294 - RNA, 19 nt, Mycobacterium tuberculosis H37Rv
gaccaccgggccgacagca

SEQ ID NO: 3340295 - RNA, 21 nt, Mycobacterium tuberculosis H37Rv
gaccaccgggccgacagcacg

SEQ ID NO: 3340296 - RNA, 20 nt, Mycobacterium tuberculosis H37Rv
gaccaccggguagccggcgu

SEQ ID NO: 3340297 - RNA, 17 nt, Mycobacterium tuberculosis H37Rv
gaccaccucagcugcgg

SEQ ID NO: 3340298 - RNA, 18 nt, Mycobacterium tuberculosis H37Rv
gaccaccugagccggggu

SEQ ID NO: 3340299 - RNA, 14 nt, Mycobacterium tuberculosis H37Rv
gaccaccugcugca

SEQ ID NO: 3340300 - RNA, 16 nt, Mycobacterium tuberculosis H37Rv
gaccaccugcugcacg

SEQ ID NO: 3340301 - RNA, 14 nt, Mycobacterium tuberculosis H37Rv
gaccaccuggucgc

SEQ ID NO: 3340302 - RNA, 21 nt, Mycobacterium tuberculosis H37Rv
gaccaccuucugacgcggccg

SEQ ID NO: 3340303 - RNA, 21 nt, Mycobacterium tuberculosis H37Rv
gaccacgaaccgggugccgga

SEQ ID NO: 3340304 - RNA, 23 nt, Mycobacterium tuberculosis H37Rv
gaccacgaacgcgcgcagccggg

SEQ ID NO: 3340305 - RNA, 17 nt, Mycobacterium tuberculosis H37Rv
gaccacgaauggggcca

SEQ ID NO: 3340306 - RNA, 12 nt, Mycobacterium tuberculosis H37Rv
gaccacgacgug

SEQ ID NO: 3340307 - RNA, 12 nt, Mycobacterium tuberculosis H37Rv
gaccacgcaccg

SEQ ID NO: 3340308 - RNA, 14 nt, Mycobacterium tuberculosis H37Rv
gaccacgcaccgcc

SEQ ID NO: 3340309 - RNA, 14 nt, Mycobacterium tuberculosis H37Rv
gaccacgccgacgu

SEQ ID NO: 3340310 - RNA, 19 nt, Mycobacterium tuberculosis H37Rv
gaccacgcgagggcauccg

SEQ ID NO: 3340311 - RNA, 22 nt, Mycobacterium tuberculosis H37Rv
gaccacucgccggcggacgccc

SEQ ID NO: 3340312 - RNA, 21 nt, Mycobacterium tuberculosis H37Rv
gaccacucggcggccaccucg

SEQ ID NO: 3340313 - RNA, 18 nt, Mycobacterium tuberculosis H37Rv
gaccacugcccggggucc

SEQ ID NO: 3340314 - RNA, 23 nt, Mycobacterium tuberculosis H37Rv
gaccacuuagcuggcgggggucc

SEQ ID NO: 3340315 - RNA, 16 nt, Mycobacterium tuberculosis H37Rv
gaccacuucgauggcg

SEQ ID NO: 3340316 - RNA, 15 nt, Mycobacterium tuberculosis H37Rv
gaccacuugcagcac

SEQ ID NO: 3340317 - RNA, 19 nt, Mycobacterium tuberculosis H37Rv
gaccacuugcagcacaacg

SEQ ID NO: 3340318 - RNA, 20 nt, Mycobacterium tuberculosis H37Rv
gaccacuugcagcacaacgu

SEQ ID NO: 3340319 - RNA, 16 nt, Mycobacterium tuberculosis H37Rv
gaccagaaccuggagc

SEQ ID NO: 3340320 - RNA, 16 nt, Mycobacterium tuberculosis H37Rv
gaccagaacucgugau

SEQ ID NO: 3340321 - RNA, 14 nt, Mycobacterium tuberculosis H37Rv
gaccagacccacga

SEQ ID NO: 3340322 - RNA, 14 nt, Mycobacterium tuberculosis H37Rv
gaccagagcuucgc

SEQ ID NO: 3340323 - RNA, 18 nt, Mycobacterium tuberculosis H37Rv
gaccagaggcgcuucgcc

SEQ ID NO: 3340324 - RNA, 17 nt, Mycobacterium tuberculosis H37Rv
gaccagauacgucgucg

SEQ ID NO: 3340325 - RNA, 16 nt, Mycobacterium tuberculosis H37Rv
gaccagauguaccuca

SEQ ID NO: 3340326 - RNA, 13 nt, Mycobacterium tuberculosis H37Rv
gaccagcacaccg

SEQ ID NO: 3340327 - RNA, 13 nt, Mycobacterium tuberculosis H37Rv
gaccagcaccaga

SEQ ID NO: 3340328 - RNA, 15 nt, Mycobacterium tuberculosis H37Rv
gaccagcaccagaac

SEQ ID NO: 3340329 - RNA, 22 nt, Mycobacterium tuberculosis H37Rv
gaccagcacccgcucggccgcc

SEQ ID NO: 3340330 - RNA, 16 nt, Mycobacterium tuberculosis H37Rv
gaccagcagaccaagc

SEQ ID NO: 3340331 - RNA, 14 nt, Mycobacterium tuberculosis H37Rv
gaccagcagaucca

SEQ ID NO: 3340332 - RNA, 18 nt, Mycobacterium tuberculosis H37Rv
gaccagccgaucaucacc

SEQ ID NO: 3340333 - RNA, 20 nt, Mycobacterium tuberculosis H37Rv
gaccagccgaucaucaccgg

SEQ ID NO: 3340334 - RNA, 21 nt, Mycobacterium tuberculosis H37Rv
gaccagcgccgauaccagcca

SEQ ID NO: 3340335 - RNA, 15 nt, Mycobacterium tuberculosis H37Rv
gaccagcgggcggcc

SEQ ID NO: 3340336 - RNA, 17 nt, Mycobacterium tuberculosis H37Rv
gaccagcgggcggcccu

SEQ ID NO: 3340337 - RNA, 18 nt, Mycobacterium tuberculosis H37Rv
gaccagcguccagccgcc

SEQ ID NO: 3340338 - RNA, 22 nt, Mycobacterium tuberculosis H37Rv
gaccagcguggggccgccacca

SEQ ID NO: 3340339 - RNA, 17 nt, Mycobacterium tuberculosis H37Rv
gaccagcugccggcgac

SEQ ID NO: 3340340 - RNA, 18 nt, Mycobacterium tuberculosis H37Rv
gaccagcugccggcgacc

SEQ ID NO: 3340341 - RNA, 20 nt, Mycobacterium tuberculosis H37Rv
gaccagcuugaccgaccacg

SEQ ID NO: 3340342 - RNA, 17 nt, Mycobacterium tuberculosis H37Rv
gaccaggaagcagguga

SEQ ID NO: 3340343 - RNA, 22 nt, Mycobacterium tuberculosis H37Rv
gaccaggaaguagaugagcaga

SEQ ID NO: 3340344 - RNA, 14 nt, Mycobacterium tuberculosis H37Rv
gaccaggcgcggcg

SEQ ID NO: 3340345 - RNA, 15 nt, Mycobacterium tuberculosis H37Rv
gaccaggcgcggcga

SEQ ID NO: 3340346 - RNA, 16 nt, Mycobacterium tuberculosis H37Rv
gaccaggcgcggcgac

SEQ ID NO: 3340347 - RNA, 15 nt, Mycobacterium tuberculosis H37Rv
gaccaggcggacgcc

SEQ ID NO: 3340348 - RNA, 17 nt, Mycobacterium tuberculosis H37Rv
gaccaggcggcgcgggu

SEQ ID NO: 3340349 - RNA, 16 nt, Mycobacterium tuberculosis H37Rv
gaccagggcagcggcc

SEQ ID NO: 3340350 - RNA, 23 nt, Mycobacterium tuberculosis H37Rv
gaccagggcagcggccagggcac

SEQ ID NO: 3340351 - RNA, 14 nt, Mycobacterium tuberculosis H37Rv
gaccagggccgccg

SEQ ID NO: 3340352 - RNA, 16 nt, Mycobacterium tuberculosis H37Rv
gaccagggucugcuca

SEQ ID NO: 3340353 - RNA, 16 nt, Mycobacterium tuberculosis H37Rv
gaccagguagaccagg

SEQ ID NO: 3340354 - RNA, 17 nt, Mycobacterium tuberculosis H37Rv
gaccaggucggcuucga

SEQ ID NO: 3340355 - RNA, 18 nt, Mycobacterium tuberculosis H37Rv
gaccaggucugcggugcu

SEQ ID NO: 3340356 - RNA, 17 nt, Mycobacterium tuberculosis H37Rv
gaccagucgcggcguuc

SEQ ID NO: 3340357 - RNA, 18 nt, Mycobacterium tuberculosis H37Rv
gaccauacccgcgcgcac

SEQ ID NO: 3340358 - RNA, 19 nt, Mycobacterium tuberculosis H37Rv
gaccauagucgccgucgug

SEQ ID NO: 3340359 - RNA, 16 nt, Mycobacterium tuberculosis H37Rv
gaccaucaccacggcc

SEQ ID NO: 3340360 - RNA, 17 nt, Mycobacterium tuberculosis H37Rv
gaccaucaccacggccg

SEQ ID NO: 3340361 - RNA, 16 nt, Mycobacterium tuberculosis H37Rv
gaccaucacgcccugu

SEQ ID NO: 3340362 - RNA, 21 nt, Mycobacterium tuberculosis H37Rv
gaccaucgaggcgaucaccgc

SEQ ID NO: 3340363 - RNA, 15 nt, Mycobacterium tuberculosis H37Rv
gaccaucgccaggcc

SEQ ID NO: 3340364 - RNA, 20 nt, Mycobacterium tuberculosis H37Rv
gaccaucuuaacgucggcaa

SEQ ID NO: 3340365 - RNA, 13 nt, Mycobacterium tuberculosis H37Rv
gaccaugaagaac

SEQ ID NO: 3340366 - RNA, 19 nt, Mycobacterium tuberculosis H37Rv
gaccaugagcuugguggcc

SEQ ID NO: 3340367 - RNA, 22 nt, Mycobacterium tuberculosis H37Rv
gaccaugagcuugguggccacc

SEQ ID NO: 3340368 - RNA, 23 nt, Mycobacterium tuberculosis H37Rv
gaccaugagcuugguggccacca

SEQ ID NO: 3340369 - RNA, 18 nt, Mycobacterium tuberculosis H37Rv
gaccaugcgaccggcaac

SEQ ID NO: 3340370 - RNA, 21 nt, Mycobacterium tuberculosis H37Rv
gaccaugcuccuaucacugga

SEQ ID NO: 3340371 - RNA, 12 nt, Mycobacterium tuberculosis H37Rv
gacccaaagcac

SEQ ID NO: 3340372 - RNA, 16 nt, Mycobacterium tuberculosis H37Rv
gacccaagucgccgag

SEQ ID NO: 3340373 - RNA, 16 nt, Mycobacterium tuberculosis H37Rv
gacccacagucgccgg

SEQ ID NO: 3340374 - RNA, 23 nt, Mycobacterium tuberculosis H37Rv
gacccacagucgccggccggccc

SEQ ID NO: 3340375 - RNA, 20 nt, Mycobacterium tuberculosis H37Rv
gacccacaucaggucggcga

SEQ ID NO: 3340376 - RNA, 22 nt, Mycobacterium tuberculosis H37Rv
gacccacauuccguagccggcg

SEQ ID NO: 3340377 - RNA, 17 nt, Mycobacterium tuberculosis H37Rv
gacccacccgcaccgcc

SEQ ID NO: 3340378 - RNA, 23 nt, Mycobacterium tuberculosis H37Rv
gacccacccgcaccgccggcaau

SEQ ID NO: 3340379 - RNA, 18 nt, Mycobacterium tuberculosis H37Rv
gacccaccgccccggcgg

SEQ ID NO: 3340380 - RNA, 14 nt, Mycobacterium tuberculosis H37Rv
gacccacugcaggc

SEQ ID NO: 3340381 - RNA, 12 nt, Mycobacterium tuberculosis H37Rv
gacccagcaccc

SEQ ID NO: 3340382 - RNA, 18 nt, Mycobacterium tuberculosis H37Rv
gacccagcacccgagcga

SEQ ID NO: 3340383 - RNA, 14 nt, Mycobacterium tuberculosis H37Rv
gacccagcagcggc

SEQ ID NO: 3340384 - RNA, 15 nt, Mycobacterium tuberculosis H37Rv
gacccagcagcggca

SEQ ID NO: 3340385 - RNA, 16 nt, Mycobacterium tuberculosis H37Rv
gacccagcagcggcac

SEQ ID NO: 3340386 - RNA, 23 nt, Mycobacterium tuberculosis H37Rv
gacccagcauggggucagcucgc

SEQ ID NO: 3340387 - RNA, 18 nt, Mycobacterium tuberculosis H37Rv
gacccagccagcagcggc

SEQ ID NO: 3340388 - RNA, 14 nt, Mycobacterium tuberculosis H37Rv
gaccgaaagccgca

SEQ ID NO: 3340389 - RNA, 16 nt, Mycobacterium tuberculosis H37Rv
gaccgaaagccgcacc

SEQ ID NO: 3340390 - RNA, 13 nt, Mycobacterium tuberculosis H37Rv
gaccgaacaacag

SEQ ID NO: 3340391 - RNA, 18 nt, Mycobacterium tuberculosis H37Rv
gaccgaacaacagcggca

SEQ ID NO: 3340392 - RNA, 13 nt, Mycobacterium tuberculosis H37Rv
gaccgaaccguca

SEQ ID NO: 3340393 - RNA, 15 nt, Mycobacterium tuberculosis H37Rv
gaccgaaccgucagc

SEQ ID NO: 3340394 - RNA, 13 nt, Mycobacterium tuberculosis H37Rv
gaccgaaccuggu

SEQ ID NO: 3340395 - RNA, 14 nt, Mycobacterium tuberculosis H37Rv
gaccgaacgacucg

SEQ ID NO: 3340396 - RNA, 15 nt, Mycobacterium tuberculosis H37Rv
gaccgaagaagcccg

SEQ ID NO: 3340397 - RNA, 17 nt, Mycobacterium tuberculosis H37Rv
gaccgaagaccuccucg

SEQ ID NO: 3340398 - RNA, 16 nt, Mycobacterium tuberculosis H37Rv
gaccgaagagcgcgcg

SEQ ID NO: 3340399 - RNA, 21 nt, Mycobacterium tuberculosis H37Rv
gaccgaaucagcacggugugc

SEQ ID NO: 3340400 - RNA, 22 nt, Mycobacterium tuberculosis H37Rv
gaccgaaugugaaaugcgcgau

SEQ ID NO: 3340401 - RNA, 22 nt, Mycobacterium tuberculosis H37Rv
gaccgacaggugcucgucaucc

SEQ ID NO: 3340402 - RNA, 17 nt, Mycobacterium tuberculosis H37Rv
gaccgaccaccgcgaaa

SEQ ID NO: 3340403 - RNA, 17 nt, Mycobacterium tuberculosis H37Rv
gaccgaccgcauggugg

SEQ ID NO: 3340404 - RNA, 16 nt, Mycobacterium tuberculosis H37Rv
gaccgaccucggcgac

SEQ ID NO: 3340405 - RNA, 12 nt, Mycobacterium tuberculosis H37Rv
gaccgaccuggu

SEQ ID NO: 3340406 - RNA, 14 nt, Mycobacterium tuberculosis H37Rv
gaccgaccuggucg

SEQ ID NO: 3340407 - RNA, 14 nt, Mycobacterium tuberculosis H37Rv
gaccgagacuugcu

SEQ ID NO: 3340408 - RNA, 21 nt, Mycobacterium tuberculosis H37Rv
gaccgagcaacaccccugggu

SEQ ID NO: 3340409 - RNA, 13 nt, Mycobacterium tuberculosis H37Rv
gaccgauaacacc

SEQ ID NO: 3340410 - RNA, 15 nt, Mycobacterium tuberculosis H37Rv
gaccgauagcuggcc

SEQ ID NO: 3340411 - RNA, 18 nt, Mycobacterium tuberculosis H37Rv
gaccgaucggcaggccgc

SEQ ID NO: 3340412 - RNA, 18 nt, Mycobacterium tuberculosis H37Rv
gaccgaucuuggccaccg

SEQ ID NO: 3340413 - RNA, 21 nt, Mycobacterium tuberculosis H37Rv
gaccgaugacgaucggcggcg

SEQ ID NO: 3340414 - RNA, 16 nt, Mycobacterium tuberculosis H37Rv
gaccgauugucggcaa

SEQ ID NO: 3340415 - RNA, 19 nt, Mycobacterium tuberculosis H37Rv
gaccgauugucggcaacga

SEQ ID NO: 3340416 - RNA, 18 nt, Mycobacterium tuberculosis H37Rv
gaccgauuucgccugcgg

SEQ ID NO: 3340417 - RNA, 20 nt, Mycobacterium tuberculosis H37Rv
gaccgauuucgccugcggcc

SEQ ID NO: 3340418 - RNA, 15 nt, Mycobacterium tuberculosis H37Rv
gaccgcaccggccgc

SEQ ID NO: 3340419 - RNA, 13 nt, Mycobacterium tuberculosis H37Rv
gaccgcaccgugc

SEQ ID NO: 3340420 - RNA, 17 nt, Mycobacterium tuberculosis H37Rv
gaccgcaccgugccgac

SEQ ID NO: 3340421 - RNA, 21 nt, Mycobacterium tuberculosis H37Rv
gaccgcacgaucgcaccgagg

SEQ ID NO: 3340422 - RNA, 17 nt, Mycobacterium tuberculosis H37Rv
gaccgcacuugaucgac

SEQ ID NO: 3340423 - RNA, 12 nt, Mycobacterium tuberculosis H37Rv
gaccgcagcacu

SEQ ID NO: 3340424 - RNA, 18 nt, Mycobacterium tuberculosis H37Rv
gaccgcagggaccgguua

SEQ ID NO: 3340425 - RNA, 19 nt, Mycobacterium tuberculosis H37Rv
gaccgcaucauggugcgcu

SEQ ID NO: 3340426 - RNA, 18 nt, Mycobacterium tuberculosis H37Rv
gaccgcaucucgggcgaa

SEQ ID NO: 3340427 - RNA, 21 nt, Mycobacterium tuberculosis H37Rv
gaccgcaucucgggcgaagcc

SEQ ID NO: 3340428 - RNA, 21 nt, Mycobacterium tuberculosis H37Rv
gaccgcauugaacagcggauc

SEQ ID NO: 3340429 - RNA, 18 nt, Mycobacterium tuberculosis H37Rv
gaccgccacacggggccg

SEQ ID NO: 3340430 - RNA, 21 nt, Mycobacterium tuberculosis H37Rv
gaccgccacacggggccgcca

SEQ ID NO: 3340431 - RNA, 11 nt, Mycobacterium tuberculosis H37Rv
gaccgccaccc

SEQ ID NO: 3340432 - RNA, 12 nt, Mycobacterium tuberculosis H37Rv
gaccgccacccc

SEQ ID NO: 3340433 - RNA, 16 nt, Mycobacterium tuberculosis H37Rv
gaccgccaccccgcuu

SEQ ID NO: 3340434 - RNA, 23 nt, Mycobacterium tuberculosis H37Rv
gaccgccaccgccagcgucgaca

SEQ ID NO: 3340435 - RNA, 14 nt, Mycobacterium tuberculosis H37Rv
gaccgccaccggcu

SEQ ID NO: 3340436 - RNA, 16 nt, Mycobacterium tuberculosis H37Rv
gaccgccaccggcuga

SEQ ID NO: 3340437 - RNA, 19 nt, Mycobacterium tuberculosis H37Rv
gaccgccaccuuggcguug

SEQ ID NO: 3340438 - RNA, 21 nt, Mycobacterium tuberculosis H37Rv
gaccgccacguaauuccccag

SEQ ID NO: 3340439 - RNA, 15 nt, Mycobacterium tuberculosis H37Rv
gaccgccagcccggu

SEQ ID NO: 3340440 - RNA, 18 nt, Mycobacterium tuberculosis H37Rv
gaccgccagcggccgcuc

SEQ ID NO: 3340441 - RNA, 20 nt, Mycobacterium tuberculosis H37Rv
gaccgccccggccaggacau

SEQ ID NO: 3340442 - RNA, 13 nt, Mycobacterium tuberculosis H37Rv
gaccgcccgcacc

SEQ ID NO: 3340443 - RNA, 18 nt, Mycobacterium tuberculosis H37Rv
gaccgcccgcacccccga

SEQ ID NO: 3340444 - RNA, 14 nt, Mycobacterium tuberculosis H37Rv
gaccgcccgccagc

SEQ ID NO: 3340445 - RNA, 16 nt, Mycobacterium tuberculosis H37Rv
gaccgcccgccagcga

SEQ ID NO: 3340446 - RNA, 15 nt, Mycobacterium tuberculosis H37Rv
gaccgcccgugccgu

SEQ ID NO: 3340447 - RNA, 22 nt, Mycobacterium tuberculosis H37Rv
gaccgcccgugccgucgcccuu

SEQ ID NO: 3340448 - RNA, 15 nt, Mycobacterium tuberculosis H37Rv
gaccgccgacgccgu

SEQ ID NO: 3340449 - RNA, 16 nt, Mycobacterium tuberculosis H37Rv
gaccgccgacgccguu

SEQ ID NO: 3340450 - RNA, 16 nt, Mycobacterium tuberculosis H37Rv
gaccgccgaucggcca

SEQ ID NO: 3340451 - RNA, 12 nt, Mycobacterium tuberculosis H37Rv
gaccgccgccga

SEQ ID NO: 3340452 - RNA, 21 nt, Mycobacterium tuberculosis H37Rv
gaccgccgccgacaaucacca

SEQ ID NO: 3340453 - RNA, 12 nt, Mycobacterium tuberculosis H37Rv
gaccgccgcgag

SEQ ID NO: 3340454 - RNA, 14 nt, Mycobacterium tuberculosis H37Rv
gaccgccgcgagca

SEQ ID NO: 3340455 - RNA, 21 nt, Mycobacterium tuberculosis H37Rv
gaccgccgcgagcagaaacaa

SEQ ID NO: 3340456 - RNA, 15 nt, Mycobacterium tuberculosis H37Rv
gaccgccgcgccggc

SEQ ID NO: 3340457 - RNA, 14 nt, Mycobacterium tuberculosis H37Rv
gaccgccgcugggu

SEQ ID NO: 3340458 - RNA, 21 nt, Mycobacterium tuberculosis H37Rv
gaccgccgggauaucgucgac

SEQ ID NO: 3340459 - RNA, 13 nt, Mycobacterium tuberculosis H37Rv
gaccgccuccucg

SEQ ID NO: 3340460 - RNA, 17 nt, Mycobacterium tuberculosis H37Rv
gaccgccugcgcggcug

SEQ ID NO: 3340461 - RNA, 23 nt, Mycobacterium tuberculosis H37Rv
gaccgcgaacccgugggcggccg

SEQ ID NO: 3340462 - RNA, 13 nt, Mycobacterium tuberculosis H37Rv
gaccgcgacccgg

SEQ ID NO: 3340463 - RNA, 14 nt, Mycobacterium tuberculosis H37Rv
gaccgcgacccggc

SEQ ID NO: 3340464 - RNA, 19 nt, Mycobacterium tuberculosis H37Rv
gaccgcgacggcgccggca

SEQ ID NO: 3340465 - RNA, 19 nt, Mycobacterium tuberculosis H37Rv
gaccgcgagggccagcaag

SEQ ID NO: 3340466 - RNA, 15 nt, Mycobacterium tuberculosis H37Rv
gaccgcgauccccac

SEQ ID NO: 3340467 - RNA, 20 nt, Mycobacterium tuberculosis H37Rv
gaccgcgaucgccgacgcca

SEQ ID NO: 3340468 - RNA, 17 nt, Mycobacterium tuberculosis H37Rv
gaccgcgaugucacgga

SEQ ID NO: 3340469 - RNA, 22 nt, Mycobacterium tuberculosis H37Rv
gaccgcgaugucacggaugugc

SEQ ID NO: 3340470 - RNA, 20 nt, Mycobacterium tuberculosis H37Rv
gaccgcgccaacagaugcca

SEQ ID NO: 3340471 - RNA, 13 nt, Mycobacterium tuberculosis H37Rv
gaccgcgccgauc

SEQ ID NO: 3340472 - RNA, 16 nt, Mycobacterium tuberculosis H37Rv
gaccgcgccgaucacc

SEQ ID NO: 3340473 - RNA, 20 nt, Mycobacterium tuberculosis H37Rv
gaccgcgccgaucaccaccg

SEQ ID NO: 3340474 - RNA, 15 nt, Mycobacterium tuberculosis H37Rv
gaccgcgccgcauca

SEQ ID NO: 3340475 - RNA, 20 nt, Mycobacterium tuberculosis H37Rv
gaccgcgccggacagcgcau

SEQ ID NO: 3340476 - RNA, 13 nt, Mycobacterium tuberculosis H37Rv
gaccgcgcucacc

SEQ ID NO: 3340477 - RNA, 15 nt, Mycobacterium tuberculosis H37Rv
gaccgcggccaccgc

SEQ ID NO: 3340478 - RNA, 15 nt, Mycobacterium tuberculosis H37Rv
gaccgcggcccgcac

SEQ ID NO: 3340479 - RNA, 13 nt, Mycobacterium tuberculosis H37Rv
gaccgcggccgcu

SEQ ID NO: 3340480 - RNA, 15 nt, Mycobacterium tuberculosis H37Rv
gaccgcggccuuggc

SEQ ID NO: 3340481 - RNA, 13 nt, Mycobacterium tuberculosis H37Rv
gaccgcggcggca

SEQ ID NO: 3340482 - RNA, 15 nt, Mycobacterium tuberculosis H37Rv
gaccgcggcggcauc

SEQ ID NO: 3340483 - RNA, 15 nt, Mycobacterium tuberculosis H37Rv
gaccgcggcggccga

SEQ ID NO: 3340484 - RNA, 22 nt, Mycobacterium tuberculosis H37Rv
gaccgcggcugucacgccugcc

SEQ ID NO: 3340485 - RNA, 21 nt, Mycobacterium tuberculosis H37Rv
gaccguggucggagguggggu

SEQ ID NO: 3340486 - RNA, 21 nt, Mycobacterium tuberculosis H37Rv
gaccuaccgucgaccacuagc

SEQ ID NO: 3340487 - RNA, 15 nt, Mycobacterium tuberculosis H37Rv
gaccuagucaccuug

SEQ ID NO: 3340488 - RNA, 21 nt, Mycobacterium tuberculosis H37Rv
gaccuagucaccuugaccggg

SEQ ID NO: 3340489 - RNA, 19 nt, Mycobacterium tuberculosis H37Rv
gaccuauuggucgcucgcg

SEQ ID NO: 3340490 - RNA, 23 nt, Mycobacterium tuberculosis H37Rv
gaccuauuggucgcucgcgguca

SEQ ID NO: 3340491 - RNA, 21 nt, Mycobacterium tuberculosis H37Rv
gaccucaauuggcucggcguc

SEQ ID NO: 3340492 - RNA, 13 nt, Mycobacterium tuberculosis H37Rv
gaccucaccaacc

SEQ ID NO: 3340493 - RNA, 11 nt, Mycobacterium tuberculosis H37Rv
gaccucagccg

SEQ ID NO: 3340494 - RNA, 15 nt, Mycobacterium tuberculosis H37Rv
gaccucagccggcgg

SEQ ID NO: 3340495 - RNA, 18 nt, Mycobacterium tuberculosis H37Rv
gaccuccagugcggccuu

SEQ ID NO: 3340496 - RNA, 16 nt, Mycobacterium tuberculosis H37Rv
gaccucccacccccgg

SEQ ID NO: 3340497 - RNA, 18 nt, Mycobacterium tuberculosis H37Rv
gaccuccgcgaucaccga

SEQ ID NO: 3340498 - RNA, 22 nt, Mycobacterium tuberculosis H37Rv
gaccuccggauaacccagcggc

SEQ ID NO: 3340499 - RNA, 21 nt, Mycobacterium tuberculosis H37Rv
gaccucgagcuugccgucgcu

SEQ ID NO: 3340500 - RNA, 16 nt, Mycobacterium tuberculosis H37Rv
gaccucgccgcgcgug

SEQ ID NO: 3340501 - RNA, 22 nt, Mycobacterium tuberculosis H37Rv
gaccucgccgcgcgugacagug

SEQ ID NO: 3340502 - RNA, 19 nt, Mycobacterium tuberculosis H37Rv
gaccucgcgcggggcggcu

SEQ ID NO: 3340503 - RNA, 13 nt, Mycobacterium tuberculosis H37Rv
gaccucggcgauc

SEQ ID NO: 3340504 - RNA, 18 nt, Mycobacterium tuberculosis H37Rv
gaccucggcgaugucgcg

SEQ ID NO: 3340505 - RNA, 15 nt, Mycobacterium tuberculosis H37Rv
gaccucggcgcgcuc

SEQ ID NO: 3340506 - RNA, 20 nt, Mycobacterium tuberculosis H37Rv
gaccucggcgcgcucggccg

SEQ ID NO: 3340507 - RNA, 17 nt, Mycobacterium tuberculosis H37Rv
gaccucggcggcggcac

SEQ ID NO: 3340508 - RNA, 19 nt, Mycobacterium tuberculosis H37Rv
gaccucggcgugucugccc

SEQ ID NO: 3340509 - RNA, 22 nt, Mycobacterium tuberculosis H37Rv
gaccucgucaaucaccaccgcc

SEQ ID NO: 3340510 - RNA, 16 nt, Mycobacterium tuberculosis H37Rv
gaccucgucgaccggg

SEQ ID NO: 3340511 - RNA, 16 nt, Mycobacterium tuberculosis H37Rv
gaccucgucgcgucgc

SEQ ID NO: 3340512 - RNA, 17 nt, Mycobacterium tuberculosis H37Rv
gaccucgucgcgucgcc

SEQ ID NO: 3340513 - RNA, 20 nt, Mycobacterium tuberculosis H37Rv
gaccucgucgcgucgccaga

SEQ ID NO: 3340514 - RNA, 20 nt, Mycobacterium tuberculosis H37Rv
gaccucguucgucaccacga

SEQ ID NO: 3340515 - RNA, 16 nt, Mycobacterium tuberculosis H37Rv
gaccucucugcgccag

SEQ ID NO: 3340516 - RNA, 21 nt, Mycobacterium tuberculosis H37Rv
gaccucucugcgccaggcggc

SEQ ID NO: 3340517 - RNA, 21 nt, Mycobacterium tuberculosis H37Rv
gaccugaggcaccucggccuu

SEQ ID NO: 3340518 - RNA, 20 nt, Mycobacterium tuberculosis H37Rv
gaccugaugagcucaccggg

SEQ ID NO: 3340519 - RNA, 19 nt, Mycobacterium tuberculosis H37Rv
gaccugauggcgcugcacc

SEQ ID NO: 3340520 - RNA, 23 nt, Mycobacterium tuberculosis H37Rv
gaccugauggcgcugcaccguag

SEQ ID NO: 3340521 - RNA, 11 nt, Mycobacterium tuberculosis H37Rv
gaccugcagcg

SEQ ID NO: 3340522 - RNA, 20 nt, Mycobacterium tuberculosis H37Rv
gaccugcaugggcagcuggu

SEQ ID NO: 3340523 - RNA, 17 nt, Mycobacterium tuberculosis H37Rv
gaccugcgggaucgccg

SEQ ID NO: 3340524 - RNA, 14 nt, Mycobacterium tuberculosis H37Rv
gaccugcucgcugg

SEQ ID NO: 3340525 - RNA, 22 nt, Mycobacterium tuberculosis H37Rv
gaccugcucgggcgugaucccg

SEQ ID NO: 3340526 - RNA, 20 nt, Mycobacterium tuberculosis H37Rv
gaccuggaacugcauggugg

SEQ ID NO: 3340527 - RNA, 19 nt, Mycobacterium tuberculosis H37Rv
gaccuggacaaccucgucg

SEQ ID NO: 3340528 - RNA, 22 nt, Mycobacterium tuberculosis H37Rv
gaccuggacaaccucgucgauc

SEQ ID NO: 3340529 - RNA, 11 nt, Mycobacterium tuberculosis H37Rv
gaccuggccac

SEQ ID NO: 3340530 - RNA, 22 nt, Mycobacterium tuberculosis H37Rv
gaccuggccgcccgcugcggcg

SEQ ID NO: 3340531 - RNA, 16 nt, Mycobacterium tuberculosis H37Rv
gaccugguaugccgcc

SEQ ID NO: 3340532 - RNA, 21 nt, Mycobacterium tuberculosis H37Rv
gaccugguaugccgcccgcag

SEQ ID NO: 3340533 - RNA, 23 nt, Mycobacterium tuberculosis H37Rv
gaccugguaugccgcccgcagcg

SEQ ID NO: 3340534 - RNA, 23 nt, Mycobacterium tuberculosis H37Rv
gaccuguagaucagcagcggcga

SEQ ID NO: 3340535 - RNA, 13 nt, Mycobacterium tuberculosis H37Rv
gaccuguccggua

SEQ ID NO: 3340536 - RNA, 16 nt, Mycobacterium tuberculosis H37Rv
gaccuguccggugauc

SEQ ID NO: 3340537 - RNA, 17 nt, Mycobacterium tuberculosis H37Rv
gaccuuauugccgagcu

SEQ ID NO: 3340538 - RNA, 15 nt, Mycobacterium tuberculosis H37Rv
gaccuucgagccgca

SEQ ID NO: 3340539 - RNA, 22 nt, Mycobacterium tuberculosis H37Rv
gaccuucgagccgcacaaacgg

SEQ ID NO: 3340540 - RNA, 20 nt, Mycobacterium tuberculosis H37Rv
gaccuucgcuauggcggcuu

SEQ ID NO: 3340541 - RNA, 20 nt, Mycobacterium tuberculosis H37Rv
gaccuucucacgcaccaugu

SEQ ID NO: 3340542 - RNA, 19 nt, Mycobacterium tuberculosis H37Rv
gaccuucucgucggccagu

SEQ ID NO: 3340543 - RNA, 23 nt, Mycobacterium tuberculosis H37Rv
gaccuugaucgagcagggugacc

SEQ ID NO: 3340544 - RNA, 14 nt, Mycobacterium tuberculosis H37Rv
gaccuugcccugcg

SEQ ID NO: 3340545 - RNA, 14 nt, Mycobacterium tuberculosis H37Rv
gaccuuggacacuu

SEQ ID NO: 3340546 - RNA, 21 nt, Mycobacterium tuberculosis H37Rv
gaccuugguguggggcggcuu

SEQ ID NO: 3340547 - RNA, 13 nt, Mycobacterium tuberculosis H37Rv
gacgaaauccgcc

SEQ ID NO: 3340548 - RNA, 20 nt, Mycobacterium tuberculosis H37Rv
gacgaaauccgccgggcgcc

SEQ ID NO: 3340549 - RNA, 20 nt, Mycobacterium tuberculosis H37Rv
gacgaacaacgcgacgaagc

SEQ ID NO: 3340550 - RNA, 23 nt, Mycobacterium tuberculosis H37Rv
gacgaacaccccgggcgccgauc

SEQ ID NO: 3340551 - RNA, 21 nt, Mycobacterium tuberculosis H37Rv
gacgaacccaccgugccgggc

SEQ ID NO: 3340552 - RNA, 16 nt, Mycobacterium tuberculosis H37Rv
gacgaaccgccagaau

SEQ ID NO: 3340553 - RNA, 19 nt, Mycobacterium tuberculosis H37Rv
gacgaaccggaucaucgcc

SEQ ID NO: 3340554 - RNA, 13 nt, Mycobacterium tuberculosis H37Rv
gacgaacgacggg

SEQ ID NO: 3340555 - RNA, 22 nt, Mycobacterium tuberculosis H37Rv
gacgaacgacggggcaaaggag

SEQ ID NO: 3340556 - RNA, 16 nt, Mycobacterium tuberculosis H37Rv
gacgaacgccgucgac

SEQ ID NO: 3340557 - RNA, 18 nt, Mycobacterium tuberculosis H37Rv
gacgaacgccgucgacgc

SEQ ID NO: 3340558 - RNA, 22 nt, Mycobacterium tuberculosis H37Rv
gacgaacgccucaccgacgucg

SEQ ID NO: 3340559 - RNA, 19 nt, Mycobacterium tuberculosis H37Rv
gacgaacgcgucggucgac

SEQ ID NO: 3340560 - RNA, 20 nt, Mycobacterium tuberculosis H37Rv
gacgaacuagguucagcgac

SEQ ID NO: 3340561 - RNA, 17 nt, Mycobacterium tuberculosis H37Rv
gacgaagagcaccgcgc

SEQ ID NO: 3340562 - RNA, 20 nt, Mycobacterium tuberculosis H37Rv
gacgaaggucuccggcaagc

SEQ ID NO: 3340563 - RNA, 21 nt, Mycobacterium tuberculosis H37Rv
gacgaaguagccgaccauggu

SEQ ID NO: 3340564 - RNA, 18 nt, Mycobacterium tuberculosis H37Rv
gacgaauccacuggucaa

SEQ ID NO: 3340565 - RNA, 22 nt, Mycobacterium tuberculosis H37Rv
gacgaauccacuggucaacggg

SEQ ID NO: 3340566 - RNA, 15 nt, Mycobacterium tuberculosis H37Rv
gacgaauuggcccga

SEQ ID NO: 3340567 - RNA, 16 nt, Mycobacterium tuberculosis H37Rv
gacgacaaacggcgac

SEQ ID NO: 3340568 - RNA, 15 nt, Mycobacterium tuberculosis H37Rv
gacgacaaucgggac

SEQ ID NO: 3340569 - RNA, 13 nt, Mycobacterium tuberculosis H37Rv
gacgacaccgcga

SEQ ID NO: 3340570 - RNA, 20 nt, Mycobacterium tuberculosis H37Rv
gacgacauacgagcagugac

SEQ ID NO: 3340571 - RNA, 19 nt, Mycobacterium tuberculosis H37Rv
gacgacauuggugcugaca

SEQ ID NO: 3340572 - RNA, 20 nt, Mycobacterium tuberculosis H37Rv
gacgaccacaccacgauggc

SEQ ID NO: 3340573 - RNA, 13 nt, Mycobacterium tuberculosis H37Rv
gacgaccagcaga

SEQ ID NO: 3340574 - RNA, 15 nt, Mycobacterium tuberculosis H37Rv
gacgaccagcagauc

SEQ ID NO: 3340575 - RNA, 22 nt, Mycobacterium tuberculosis H37Rv
gacgaccagcagauccaggcgu

SEQ ID NO: 3340576 - RNA, 16 nt, Mycobacterium tuberculosis H37Rv
gacgaccagccccgcu

SEQ ID NO: 3340577 - RNA, 20 nt, Mycobacterium tuberculosis H37Rv
gacgaccccggugagcucuu

SEQ ID NO: 3340578 - RNA, 17 nt, Mycobacterium tuberculosis H37Rv
gacgacccgggucggca

SEQ ID NO: 3340579 - RNA, 12 nt, Mycobacterium tuberculosis H37Rv
gacgaccgcgcg

SEQ ID NO: 3340580 - RNA, 18 nt, Mycobacterium tuberculosis H37Rv
gacgcccaggcauggccu

SEQ ID NO: 3340581 - RNA, 19 nt, Mycobacterium tuberculosis H37Rv
gacgcccauggcgucgaac

SEQ ID NO: 3340582 - RNA, 21 nt, Mycobacterium tuberculosis H37Rv
gacgccccuucccuaucacga

SEQ ID NO: 3340583 - RNA, 19 nt, Mycobacterium tuberculosis H37Rv
gacgcccgacgaugugcac

SEQ ID NO: 3340584 - RNA, 16 nt, Mycobacterium tuberculosis H37Rv
gacgcccgcuccgcgg

SEQ ID NO: 3340585 - RNA, 15 nt, Mycobacterium tuberculosis H37Rv
gacgcccggcgcacc

SEQ ID NO: 3340586 - RNA, 17 nt, Mycobacterium tuberculosis H37Rv
gacgcccggcgcaccau

SEQ ID NO: 3340587 - RNA, 19 nt, Mycobacterium tuberculosis H37Rv
gacgcccggcgcaccaucg

SEQ ID NO: 3340588 - RNA, 14 nt, Mycobacterium tuberculosis H37Rv
gacgcccucacgcc

SEQ ID NO: 3340589 - RNA, 22 nt, Mycobacterium tuberculosis H37Rv
gacgcccuccuggcggguggcg

SEQ ID NO: 3340590 - RNA, 14 nt, Mycobacterium tuberculosis H37Rv
gacgcccucggggu

SEQ ID NO: 3340591 - RNA, 24 nt, Mycobacterium tuberculosis H37Rv
gacgccgaaaaugccgcccagcga

SEQ ID NO: 3340592 - RNA, 19 nt, Mycobacterium tuberculosis H37Rv
gacgccgaacgcgagguuc

SEQ ID NO: 3340593 - RNA, 20 nt, Mycobacterium tuberculosis H37Rv
gacgccgaauacggcugccu

SEQ ID NO: 3340594 - RNA, 19 nt, Mycobacterium tuberculosis H37Rv
gacgccgaugugcucgguu

SEQ ID NO: 3340595 - RNA, 13 nt, Mycobacterium tuberculosis H37Rv
gacgccgcagcgu

SEQ ID NO: 3340596 - RNA, 19 nt, Mycobacterium tuberculosis H37Rv
gacgccgccacccggcggg

SEQ ID NO: 3340597 - RNA, 16 nt, Mycobacterium tuberculosis H37Rv
gacgccgccagcaccu

SEQ ID NO: 3340598 - RNA, 13 nt, Mycobacterium tuberculosis H37Rv
gacgccgccaggu

SEQ ID NO: 3340599 - RNA, 21 nt, Mycobacterium tuberculosis H37Rv
gacgccgccgcugccgcccuu

SEQ ID NO: 3340600 - RNA, 13 nt, Mycobacterium tuberculosis H37Rv
gacgccgccguug

SEQ ID NO: 3340601 - RNA, 21 nt, Mycobacterium tuberculosis H37Rv
gacgccgcucccgcacaagcc

SEQ ID NO: 3340602 - RNA, 23 nt, Mycobacterium tuberculosis H37Rv
gacgccgcuggagaucacgccga

SEQ ID NO: 3340603 - RNA, 15 nt, Mycobacterium tuberculosis H37Rv
gacgccggccagcgg

SEQ ID NO: 3340604 - RNA, 16 nt, Mycobacterium tuberculosis H37Rv
gacgccggccagucgu

SEQ ID NO: 3340605 - RNA, 13 nt, Mycobacterium tuberculosis H37Rv
gacgccggcgaug

SEQ ID NO: 3340606 - RNA, 23 nt, Mycobacterium tuberculosis H37Rv
gacgccggggaaccuugaccgac

SEQ ID NO: 3340607 - RNA, 22 nt, Mycobacterium tuberculosis H37Rv
gacgccggguccaucaacccca

SEQ ID NO: 3340608 - RNA, 22 nt, Mycobacterium tuberculosis H37Rv
gacgccgguggcagagccgccg

SEQ ID NO: 3340609 - RNA, 21 nt, Mycobacterium tuberculosis H37Rv
gacgccguagccggccggccc

SEQ ID NO: 3340610 - RNA, 17 nt, Mycobacterium tuberculosis H37Rv
gacgccguugcccacgu

SEQ ID NO: 3340611 - RNA, 15 nt, Mycobacterium tuberculosis H37Rv
gacgccguugccgcc

SEQ ID NO: 3340612 - RNA, 16 nt, Mycobacterium tuberculosis H37Rv
gacgccguugccgccg

SEQ ID NO: 3340613 - RNA, 19 nt, Mycobacterium tuberculosis H37Rv
gacgccguugccgccguug

SEQ ID NO: 3340614 - RNA, 12 nt, Mycobacterium tuberculosis H37Rv
gacgccucgaca

SEQ ID NO: 3340615 - RNA, 21 nt, Mycobacterium tuberculosis H37Rv
gacgccuuccagcccgagcag

SEQ ID NO: 3340616 - RNA, 21 nt, Mycobacterium tuberculosis H37Rv
gacgccuugaucggcgagguc

SEQ ID NO: 3340617 - RNA, 16 nt, Mycobacterium tuberculosis H37Rv
gacgccuugcacaagc

SEQ ID NO: 3340618 - RNA, 19 nt, Mycobacterium tuberculosis H37Rv
gacgccuugcacaagcuga

SEQ ID NO: 3340619 - RNA, 21 nt, Mycobacterium tuberculosis H37Rv
gacgcgaaaucccccgacacg

SEQ ID NO: 3340620 - RNA, 20 nt, Mycobacterium tuberculosis H37Rv
gacgcgaaauccccugcgcu

SEQ ID NO: 3340621 - RNA, 19 nt, Mycobacterium tuberculosis H37Rv
gacgcgacacacgccgccg

SEQ ID NO: 3340622 - RNA, 15 nt, Mycobacterium tuberculosis H37Rv
gacgcgacacgccga

SEQ ID NO: 3340623 - RNA, 20 nt, Mycobacterium tuberculosis H37Rv
gacgcgaucuguccgcgaac

SEQ ID NO: 3340624 - RNA, 20 nt, Mycobacterium tuberculosis H37Rv
gacgcgcaugccccgaccgc

SEQ ID NO: 3340625 - RNA, 16 nt, Mycobacterium tuberculosis H37Rv
gacgcgcauucgccgg

SEQ ID NO: 3340626 - RNA, 14 nt, Mycobacterium tuberculosis H37Rv
gacgcgcccgacga

SEQ ID NO: 3340627 - RNA, 12 nt, Mycobacterium tuberculosis H37Rv
gacgcgccgguu

SEQ ID NO: 3340628 - RNA, 17 nt, Mycobacterium tuberculosis H37Rv
gacgcgcgagaacaccc

SEQ ID NO: 3340629 - RNA, 24 nt, Mycobacterium tuberculosis H37Rv
gacgcgcgagaacacccgugccuu

SEQ ID NO: 3340630 - RNA, 15 nt, Mycobacterium tuberculosis H37Rv
gacgcgcgcgaugga

SEQ ID NO: 3340631 - RNA, 13 nt, Mycobacterium tuberculosis H37Rv
gacgcgcucgcgc

SEQ ID NO: 3340632 - RNA, 12 nt, Mycobacterium tuberculosis H37Rv
gacgcgcugcac

SEQ ID NO: 3340633 - RNA, 16 nt, Mycobacterium tuberculosis H37Rv
gacgcggcaggccggu

SEQ ID NO: 3340634 - RNA, 14 nt, Mycobacterium tuberculosis H37Rv
gacgcggcgccgcc

SEQ ID NO: 3340635 - RNA, 22 nt, Mycobacterium tuberculosis H37Rv
gacgcggcgccgccaucaacaa

SEQ ID NO: 3340636 - RNA, 20 nt, Mycobacterium tuberculosis H37Rv
gacgcgggagucaucgcggc

SEQ ID NO: 3340637 - RNA, 16 nt, Mycobacterium tuberculosis H37Rv
gacgcgggccgcgaaa

SEQ ID NO: 3340638 - RNA, 19 nt, Mycobacterium tuberculosis H37Rv
gacgcgggcuaucgguuca

SEQ ID NO: 3340639 - RNA, 20 nt, Mycobacterium tuberculosis H37Rv
gacgcgguccucgagccgau

SEQ ID NO: 3340640 - RNA, 14 nt, Mycobacterium tuberculosis H37Rv
gacgcggucgacga

SEQ ID NO: 3340641 - RNA, 15 nt, Mycobacterium tuberculosis H37Rv
gacgcggucgacgac

SEQ ID NO: 3340642 - RNA, 17 nt, Mycobacterium tuberculosis H37Rv
gacgcguagcacggcga

SEQ ID NO: 3340643 - RNA, 20 nt, Mycobacterium tuberculosis H37Rv
gacgcguagcucgcggggcg

SEQ ID NO: 3340644 - RNA, 15 nt, Mycobacterium tuberculosis H37Rv
gacgcgucagcggcg

SEQ ID NO: 3340645 - RNA, 16 nt, Mycobacterium tuberculosis H37Rv
gacgcgucagcggcga

SEQ ID NO: 3340646 - RNA, 15 nt, Mycobacterium tuberculosis H37Rv
gacgcgucggcgacg

SEQ ID NO: 3340647 - RNA, 17 nt, Mycobacterium tuberculosis H37Rv
gacgcguggcauccagc

SEQ ID NO: 3340648 - RNA, 20 nt, Mycobacterium tuberculosis H37Rv
gacgcguggcauccagcagc

SEQ ID NO: 3340649 - RNA, 16 nt, Mycobacterium tuberculosis H37Rv
gacgcgugucugggac

SEQ ID NO: 3340650 - RNA, 17 nt, Mycobacterium tuberculosis H37Rv
gacgcguuccucgacgu

SEQ ID NO: 3340651 - RNA, 19 nt, Mycobacterium tuberculosis H37Rv
gacgcuaggacggcugccg

SEQ ID NO: 3340652 - RNA, 19 nt, Mycobacterium tuberculosis H37Rv
gacgcucgccgagcagaca

SEQ ID NO: 3340653 - RNA, 16 nt, Mycobacterium tuberculosis H37Rv
gacgcucgcugcagca

SEQ ID NO: 3340654 - RNA, 20 nt, Mycobacterium tuberculosis H37Rv
gacgcucgcugcagcagggc

SEQ ID NO: 3340655 - RNA, 20 nt, Mycobacterium tuberculosis H37Rv
gacgcucggucgccaccgcc

SEQ ID NO: 3340656 - RNA, 19 nt, Mycobacterium tuberculosis H37Rv
gacgcugcauuggcggcgc

SEQ ID NO: 3340657 - RNA, 22 nt, Mycobacterium tuberculosis H37Rv
gacgcugcauuggcggcgcggu

SEQ ID NO: 3340658 - RNA, 18 nt, Mycobacterium tuberculosis H37Rv
gacgcugccaagcgaccu

SEQ ID NO: 3340659 - RNA, 17 nt, Mycobacterium tuberculosis H37Rv
gacgcuggucggcggcu

SEQ ID NO: 3340660 - RNA, 17 nt, Mycobacterium tuberculosis H37Rv
gacgcuguccaggucug

SEQ ID NO: 3340661 - RNA, 16 nt, Mycobacterium tuberculosis H37Rv
gacgcuuuccgccgca

SEQ ID NO: 3340662 - RNA, 16 nt, Mycobacterium tuberculosis H37Rv
gacggacuucccgcgc

SEQ ID NO: 3340663 - RNA, 20 nt, Mycobacterium tuberculosis H37Rv
gacggaggucggagcgggcu

SEQ ID NO: 3340664 - RNA, 16 nt, Mycobacterium tuberculosis H37Rv
gacggaugaucagcga

SEQ ID NO: 3340665 - RNA, 19 nt, Mycobacterium tuberculosis H37Rv
gacggcaaaccaguuggcg

SEQ ID NO: 3340666 - RNA, 19 nt, Mycobacterium tuberculosis H37Rv
gacggcaagggcauacagc

SEQ ID NO: 3340667 - RNA, 16 nt, Mycobacterium tuberculosis H37Rv
gacggcacccgacucg

SEQ ID NO: 3340668 - RNA, 21 nt, Mycobacterium tuberculosis H37Rv
gacggcacccgacucgucggc

SEQ ID NO: 3340669 - RNA, 17 nt, Mycobacterium tuberculosis H37Rv
gacggcaccggcccaga

SEQ ID NO: 3340670 - RNA, 16 nt, Mycobacterium tuberculosis H37Rv
gacggcacgaucaucg

SEQ ID NO: 3340671 - RNA, 19 nt, Mycobacterium tuberculosis H37Rv
gacggcagccaccagcgac

SEQ ID NO: 3340672 - RNA, 14 nt, Mycobacterium tuberculosis H37Rv
gacggcagccagcc

SEQ ID NO: 3340673 - RNA, 15 nt, Mycobacterium tuberculosis H37Rv
gacggcaggaaugau

SEQ ID NO: 3340674 - RNA, 12 nt, Mycobacterium tuberculosis H37Rv
gacggcaggcgg

SEQ ID NO: 3340675 - RNA, 13 nt, Mycobacterium tuberculosis H37Rv
gacggcagugcug

SEQ ID NO: 3340676 - RNA, 13 nt, Mycobacterium tuberculosis H37Rv
gacgguggugacg

SEQ ID NO: 3340677 - RNA, 23 nt, Mycobacterium tuberculosis H37Rv
gacgguguaacugcguuggcgac

SEQ ID NO: 3340678 - RNA, 13 nt, Mycobacterium tuberculosis H37Rv
gacgguguagccc

SEQ ID NO: 3340679 - RNA, 17 nt, Mycobacterium tuberculosis H37Rv
gacggugucagccgucg

SEQ ID NO: 3340680 - RNA, 20 nt, Mycobacterium tuberculosis H37Rv
gacggugucagccgucgcca

SEQ ID NO: 3340681 - RNA, 19 nt, Mycobacterium tuberculosis H37Rv
gacggugucaugaacgacc

SEQ ID NO: 3340682 - RNA, 21 nt, Mycobacterium tuberculosis H37Rv
gacgguguugccuagguucgc

SEQ ID NO: 3340683 - RNA, 14 nt, Mycobacterium tuberculosis H37Rv
gacgguuccggcuu

SEQ ID NO: 3340684 - RNA, 14 nt, Mycobacterium tuberculosis H37Rv
gacgguuccggucg

SEQ ID NO: 3340685 - RNA, 16 nt, Mycobacterium tuberculosis H37Rv
gacgguuccggucggg

SEQ ID NO: 3340686 - RNA, 16 nt, Mycobacterium tuberculosis H37Rv
gacguacagcgcggcg

SEQ ID NO: 3340687 - RNA, 14 nt, Mycobacterium tuberculosis H37Rv
gacguaccacggcg

SEQ ID NO: 3340688 - RNA, 15 nt, Mycobacterium tuberculosis H37Rv
gacguaccacggcga

SEQ ID NO: 3340689 - RNA, 17 nt, Mycobacterium tuberculosis H37Rv
gacguaccacggcgauc

SEQ ID NO: 3340690 - RNA, 21 nt, Mycobacterium tuberculosis H37Rv
gacguacggggucgccggcac

SEQ ID NO: 3340691 - RNA, 18 nt, Mycobacterium tuberculosis H37Rv
gacguagaaugcgccguc

SEQ ID NO: 3340692 - RNA, 17 nt, Mycobacterium tuberculosis H37Rv
gacguagacgacgucgg

SEQ ID NO: 3340693 - RNA, 18 nt, Mycobacterium tuberculosis H37Rv
gacguagacgacgucggc

SEQ ID NO: 3340694 - RNA, 15 nt, Mycobacterium tuberculosis H37Rv
gacguaggccagguc

SEQ ID NO: 3340695 - RNA, 16 nt, Mycobacterium tuberculosis H37Rv
gacguaggcggcggcc

SEQ ID NO: 3340696 - RNA, 16 nt, Mycobacterium tuberculosis H37Rv
gacguagggcagcgcc

SEQ ID NO: 3340697 - RNA, 16 nt, Mycobacterium tuberculosis H37Rv
gacguauaucgguugc

SEQ ID NO: 3340698 - RNA, 17 nt, Mycobacterium tuberculosis H37Rv
gacgucaccacgaucgc

SEQ ID NO: 3340699 - RNA, 15 nt, Mycobacterium tuberculosis H37Rv
gacgucacguucggc

SEQ ID NO: 3340700 - RNA, 18 nt, Mycobacterium tuberculosis H37Rv
gacgucaggcagcuccgc

SEQ ID NO: 3340701 - RNA, 15 nt, Mycobacterium tuberculosis H37Rv
gacgucaucgccgac

SEQ ID NO: 3340702 - RNA, 19 nt, Mycobacterium tuberculosis H37Rv
gacgucaucgucggcggau

SEQ ID NO: 3340703 - RNA, 14 nt, Mycobacterium tuberculosis H37Rv
gacguccaacagcg

SEQ ID NO: 3340704 - RNA, 15 nt, Mycobacterium tuberculosis H37Rv
gacguccaacagcgc

SEQ ID NO: 3340705 - RNA, 17 nt, Mycobacterium tuberculosis H37Rv
gacguccaccagccggu

SEQ ID NO: 3340706 - RNA, 18 nt, Mycobacterium tuberculosis H37Rv
gacguccaccagccgguu

SEQ ID NO: 3340707 - RNA, 22 nt, Mycobacterium tuberculosis H37Rv
gacguccagggccacgaucugu

SEQ ID NO: 3340708 - RNA, 14 nt, Mycobacterium tuberculosis H37Rv
gacguccucgacga

SEQ ID NO: 3340709 - RNA, 16 nt, Mycobacterium tuberculosis H37Rv
gacguccucgacgauc

SEQ ID NO: 3340710 - RNA, 13 nt, Mycobacterium tuberculosis H37Rv
gacgucgaccugu

SEQ ID NO: 3340711 - RNA, 23 nt, Mycobacterium tuberculosis H37Rv
gacgucgacgccggccagcggcc

SEQ ID NO: 3340712 - RNA, 15 nt, Mycobacterium tuberculosis H37Rv
gacgucgagcagcgc

SEQ ID NO: 3340713 - RNA, 18 nt, Mycobacterium tuberculosis H37Rv
gacgucgagcagcgccac

SEQ ID NO: 3340714 - RNA, 23 nt, Mycobacterium tuberculosis H37Rv
gacgucgauggugcggcccaacc

SEQ ID NO: 3340715 - RNA, 20 nt, Mycobacterium tuberculosis H37Rv
gacgucgccaagaccagaag

SEQ ID NO: 3340716 - RNA, 12 nt, Mycobacterium tuberculosis H37Rv
gacgucgccgac

SEQ ID NO: 3340717 - RNA, 18 nt, Mycobacterium tuberculosis H37Rv
gacgucgccgggcggcgg

SEQ ID NO: 3340718 - RNA, 22 nt, Mycobacterium tuberculosis H37Rv
gacgucgcggcgccugaggugc

SEQ ID NO: 3340719 - RNA, 14 nt, Mycobacterium tuberculosis H37Rv
gacgucggaccagc

SEQ ID NO: 3340720 - RNA, 18 nt, Mycobacterium tuberculosis H37Rv
gacgucggcaaucucgau

SEQ ID NO: 3340721 - RNA, 14 nt, Mycobacterium tuberculosis H37Rv
gacgucggcaucgg

SEQ ID NO: 3340722 - RNA, 19 nt, Mycobacterium tuberculosis H37Rv
gacgucggcaucggcggcg

SEQ ID NO: 3340723 - RNA, 17 nt, Mycobacterium tuberculosis H37Rv
gacgucggcguggucgc

SEQ ID NO: 3340724 - RNA, 23 nt, Mycobacterium tuberculosis H37Rv
gacgucgguaagcgccaaggcga

SEQ ID NO: 3340725 - RNA, 20 nt, Mycobacterium tuberculosis H37Rv
gacgucggugaccucggcga

SEQ ID NO: 3340726 - RNA, 23 nt, Mycobacterium tuberculosis H37Rv
gacgucguagacaccuucgacgu

SEQ ID NO: 3340727 - RNA, 19 nt, Mycobacterium tuberculosis H37Rv
gacgucgucggugcgccac

SEQ ID NO: 3340728 - RNA, 15 nt, Mycobacterium tuberculosis H37Rv
gacgucguggcgcuc

SEQ ID NO: 3340729 - RNA, 20 nt, Mycobacterium tuberculosis H37Rv
gacgucguuacuggagauac

SEQ ID NO: 3340730 - RNA, 18 nt, Mycobacterium tuberculosis H37Rv
gacgucguugccguccac

SEQ ID NO: 3340731 - RNA, 22 nt, Mycobacterium tuberculosis H37Rv
gacgucguuggaaaucccuggc

SEQ ID NO: 3340732 - RNA, 16 nt, Mycobacterium tuberculosis H37Rv
gacgucuccaccgcga

SEQ ID NO: 3340733 - RNA, 18 nt, Mycobacterium tuberculosis H37Rv
gacgucucuggugcaggu

SEQ ID NO: 3340734 - RNA, 12 nt, Mycobacterium tuberculosis H37Rv
gacgucugccag

SEQ ID NO: 3340735 - RNA, 22 nt, Mycobacterium tuberculosis H37Rv
gacgucuuggaacacggccgga

SEQ ID NO: 3340736 - RNA, 23 nt, Mycobacterium tuberculosis H37Rv
gacgucuuugacgaacuggucuc

SEQ ID NO: 3340737 - RNA, 19 nt, Mycobacterium tuberculosis H37Rv
gacgugaagaugcccuucg

SEQ ID NO: 3340738 - RNA, 14 nt, Mycobacterium tuberculosis H37Rv
gacgugaagcagac

SEQ ID NO: 3340739 - RNA, 17 nt, Mycobacterium tuberculosis H37Rv
gacgugaaugguggugu

SEQ ID NO: 3340740 - RNA, 20 nt, Mycobacterium tuberculosis H37Rv
gacgugaucgcgguccaaca

SEQ ID NO: 3340741 - RNA, 17 nt, Mycobacterium tuberculosis H37Rv
gacgugcaggaacaccc

SEQ ID NO: 3340742 - RNA, 19 nt, Mycobacterium tuberculosis H37Rv
gacgugccgguccccccgu

SEQ ID NO: 3340743 - RNA, 14 nt, Mycobacterium tuberculosis H37Rv
gacgugcgcggcau

SEQ ID NO: 3340744 - RNA, 18 nt, Mycobacterium tuberculosis H37Rv
gacguggacuuugguguc

SEQ ID NO: 3340745 - RNA, 13 nt, Mycobacterium tuberculosis H37Rv
gacguggccgacg

SEQ ID NO: 3340746 - RNA, 17 nt, Mycobacterium tuberculosis H37Rv
gacguggcugcguucgc

SEQ ID NO: 3340747 - RNA, 20 nt, Mycobacterium tuberculosis H37Rv
gacguggcugcguucgccgg

SEQ ID NO: 3340748 - RNA, 20 nt, Mycobacterium tuberculosis H37Rv
gacguggugggcuuggcugu

SEQ ID NO: 3340749 - RNA, 23 nt, Mycobacterium tuberculosis H37Rv
gacguggugggcuuggcuguggu

SEQ ID NO: 3340750 - RNA, 16 nt, Mycobacterium tuberculosis H37Rv
gacguuaccgaccgcg

SEQ ID NO: 3340751 - RNA, 21 nt, Mycobacterium tuberculosis H37Rv
gacguuagcauugaguucggc

SEQ ID NO: 3340752 - RNA, 15 nt, Mycobacterium tuberculosis H37Rv
gacguucuugggacc

SEQ ID NO: 3340753 - RNA, 23 nt, Mycobacterium tuberculosis H37Rv
gacguugagguucuucugcgcca

SEQ ID NO: 3340754 - RNA, 14 nt, Mycobacterium tuberculosis H37Rv
gacguugaucgcca

SEQ ID NO: 3340755 - RNA, 17 nt, Mycobacterium tuberculosis H37Rv
gacguugcagccggcau

SEQ ID NO: 3340756 - RNA, 17 nt, Mycobacterium tuberculosis H37Rv
gacguugccgggcuugu

SEQ ID NO: 3340757 - RNA, 23 nt, Mycobacterium tuberculosis H37Rv
gacguugcgaggccgcacgucga

SEQ ID NO: 3340758 - RNA, 11 nt, Mycobacterium tuberculosis H37Rv
gacguugcgua

SEQ ID NO: 3340759 - RNA, 12 nt, Mycobacterium tuberculosis H37Rv
gacguuguccac

SEQ ID NO: 3340760 - RNA, 18 nt, Mycobacterium tuberculosis H37Rv
gacguuguccaccgccac

SEQ ID NO: 3340761 - RNA, 15 nt, Mycobacterium tuberculosis H37Rv
gacguuucagccggg

SEQ ID NO: 3340762 - RNA, 24 nt, Mycobacterium tuberculosis H37Rv
gacguuucagccgggugccacaac

SEQ ID NO: 3340763 - RNA, 15 nt, Mycobacterium tuberculosis H37Rv
gacuacccagccagc

SEQ ID NO: 3340764 - RNA, 18 nt, Mycobacterium tuberculosis H37Rv
gacuaccgccggcggcgg

SEQ ID NO: 3340765 - RNA, 19 nt, Mycobacterium tuberculosis H37Rv
gacuaccgccggcggcggc

SEQ ID NO: 3340766 - RNA, 20 nt, Mycobacterium tuberculosis H37Rv
gacuaccgccggcggcggcc

SEQ ID NO: 3340767 - RNA, 15 nt, Mycobacterium tuberculosis H37Rv
gacuagacgccgccg

SEQ ID NO: 3340768 - RNA, 22 nt, Mycobacterium tuberculosis H37Rv
gacuagcugcuagcccggcggc

SEQ ID NO: 3340769 - RNA, 18 nt, Mycobacterium tuberculosis H37Rv
gacuagcuggggucaaag

SEQ ID NO: 3340770 - RNA, 18 nt, Mycobacterium tuberculosis H37Rv
gacuaucggccgccggau

SEQ ID NO: 3340771 - RNA, 13 nt, Mycobacterium tuberculosis H37Rv
gacucacgaggca

SEQ ID NO: 3340772 - RNA, 17 nt, Mycobacterium tuberculosis H37Rv
gacuugugccacuucuu

SEQ ID NO: 3340773 - RNA, 19 nt, Mycobacterium tuberculosis H37Rv
gagaacacguucggcgucg

SEQ ID NO: 3340774 - RNA, 19 nt, Mycobacterium tuberculosis H37Rv
gagaacgcccgagugacca

SEQ ID NO: 3340775 - RNA, 18 nt, Mycobacterium tuberculosis H37Rv
gagaacgcccgcugcaga

SEQ ID NO: 3340776 - RNA, 20 nt, Mycobacterium tuberculosis H37Rv
gagaacgcgucgcgcgccuu

SEQ ID NO: 3340777 - RNA, 17 nt, Mycobacterium tuberculosis H37Rv
gagaacggcgggcgauu

SEQ ID NO: 3340778 - RNA, 17 nt, Mycobacterium tuberculosis H37Rv
gagaacguaggguggcc

SEQ ID NO: 3340779 - RNA, 17 nt, Mycobacterium tuberculosis H37Rv
gagaacuugagcuccuc

SEQ ID NO: 3340780 - RNA, 12 nt, Mycobacterium tuberculosis H37Rv
gagaagacaccg

SEQ ID NO: 3340781 - RNA, 18 nt, Mycobacterium tuberculosis H37Rv
gagaagagauccuggagg

SEQ ID NO: 3340782 - RNA, 23 nt, Mycobacterium tuberculosis H37Rv
gagaagcguugcacugcugguug

SEQ ID NO: 3340783 - RNA, 18 nt, Mycobacterium tuberculosis H37Rv
gagaaggugcugcgcggg

SEQ ID NO: 3340784 - RNA, 17 nt, Mycobacterium tuberculosis H37Rv
gagaagucgcagcgagg

SEQ ID NO: 3340785 - RNA, 15 nt, Mycobacterium tuberculosis H37Rv
gagaagucucgcggc

SEQ ID NO: 3340786 - RNA, 23 nt, Mycobacterium tuberculosis H37Rv
gagaaguuagccaccuuggacac

SEQ ID NO: 3340787 - RNA, 15 nt, Mycobacterium tuberculosis H37Rv
gagaaguucgugagc

SEQ ID NO: 3340788 - RNA, 21 nt, Mycobacterium tuberculosis H37Rv
gagaaugcugacggugcagga

SEQ ID NO: 3340789 - RNA, 18 nt, Mycobacterium tuberculosis H37Rv
gagaauuccccagccgca

SEQ ID NO: 3340790 - RNA, 13 nt, Mycobacterium tuberculosis H37Rv
gagacaugccggc

SEQ ID NO: 3340791 - RNA, 17 nt, Mycobacterium tuberculosis H37Rv
gagaccaugccgacgac

SEQ ID NO: 3340792 - RNA, 23 nt, Mycobacterium tuberculosis H37Rv
gagaccgccgcugccgccgagcu

SEQ ID NO: 3340793 - RNA, 14 nt, Mycobacterium tuberculosis H37Rv
gagaccggcaccgg

SEQ ID NO: 3340794 - RNA, 16 nt, Mycobacterium tuberculosis H37Rv
gagaccggcaccggcc

SEQ ID NO: 3340795 - RNA, 16 nt, Mycobacterium tuberculosis H37Rv
gagaccggccggguga

SEQ ID NO: 3340796 - RNA, 21 nt, Mycobacterium tuberculosis H37Rv
gagaccucgucgucgaaguug

SEQ ID NO: 3340797 - RNA, 18 nt, Mycobacterium tuberculosis H37Rv
gagaccuucgggguaguu

SEQ ID NO: 3340798 - RNA, 21 nt, Mycobacterium tuberculosis H37Rv
gagacgaucaucucgucgucg

SEQ ID NO: 3340799 - RNA, 14 nt, Mycobacterium tuberculosis H37Rv
gagacgaucgccag

SEQ ID NO: 3340800 - RNA, 14 nt, Mycobacterium tuberculosis H37Rv
gagacgaugccgua

SEQ ID NO: 3340801 - RNA, 17 nt, Mycobacterium tuberculosis H37Rv
gagacgcacggccaccg

SEQ ID NO: 3340802 - RNA, 21 nt, Mycobacterium tuberculosis H37Rv
gagacgcaugucgggccaggc

SEQ ID NO: 3340803 - RNA, 20 nt, Mycobacterium tuberculosis H37Rv
gagacgcuccaguggcgcca

SEQ ID NO: 3340804 - RNA, 13 nt, Mycobacterium tuberculosis H37Rv
gagacgucgccgc

SEQ ID NO: 3340805 - RNA, 14 nt, Mycobacterium tuberculosis H37Rv
gagacuccagcaag

SEQ ID NO: 3340806 - RNA, 18 nt, Mycobacterium tuberculosis H37Rv
gagacuucgacgcggcga

SEQ ID NO: 3340807 - RNA, 13 nt, Mycobacterium tuberculosis H37Rv
gagacuuggggcg

SEQ ID NO: 3340808 - RNA, 21 nt, Mycobacterium tuberculosis H37Rv
gagagaguaucgacccgauga

SEQ ID NO: 3340809 - RNA, 22 nt, Mycobacterium tuberculosis H37Rv
gagagaucgucgacccaccaug

SEQ ID NO: 3340810 - RNA, 18 nt, Mycobacterium tuberculosis H37Rv
gagagcagcacgucugcg

SEQ ID NO: 3340811 - RNA, 13 nt, Mycobacterium tuberculosis H37Rv
gagagcagccagc

SEQ ID NO: 3340812 - RNA, 19 nt, Mycobacterium tuberculosis H37Rv
gagagcaugcgggagguuu

SEQ ID NO: 3340813 - RNA, 16 nt, Mycobacterium tuberculosis H37Rv
gagagccccgaccagc

SEQ ID NO: 3340814 - RNA, 17 nt, Mycobacterium tuberculosis H37Rv
gagagccccgaccagca

SEQ ID NO: 3340815 - RNA, 18 nt, Mycobacterium tuberculosis H37Rv
gagagccccgaccagcag

SEQ ID NO: 3340816 - RNA, 22 nt, Mycobacterium tuberculosis H37Rv
gagagccugcucgcagcgggcg

SEQ ID NO: 3340817 - RNA, 13 nt, Mycobacterium tuberculosis H37Rv
gagagggcggggc

SEQ ID NO: 3340818 - RNA, 15 nt, Mycobacterium tuberculosis H37Rv
gagaguaggaccucg

SEQ ID NO: 3340819 - RNA, 14 nt, Mycobacterium tuberculosis H37Rv
gagaguucgcaugc

SEQ ID NO: 3340820 - RNA, 17 nt, Mycobacterium tuberculosis H37Rv
gagauacggccaccagg

SEQ ID NO: 3340821 - RNA, 14 nt, Mycobacterium tuberculosis H37Rv
gagauacgggccac

SEQ ID NO: 3340822 - RNA, 24 nt, Mycobacterium tuberculosis H37Rv
gagaucaccuugccuagccgcagc

SEQ ID NO: 3340823 - RNA, 20 nt, Mycobacterium tuberculosis H37Rv
gagaucaccuuggcaagcac

SEQ ID NO: 3340824 - RNA, 16 nt, Mycobacterium tuberculosis H37Rv
gagaucagucugggcg

SEQ ID NO: 3340825 - RNA, 22 nt, Mycobacterium tuberculosis H37Rv
gagaucauggcgagcguuugga

SEQ ID NO: 3340826 - RNA, 20 nt, Mycobacterium tuberculosis H37Rv
gagauccagcgccuugucua

SEQ ID NO: 3340827 - RNA, 14 nt, Mycobacterium tuberculosis H37Rv
gagauccagggccu

SEQ ID NO: 3340828 - RNA, 15 nt, Mycobacterium tuberculosis H37Rv
gagauccagggccuu

SEQ ID NO: 3340829 - RNA, 11 nt, Mycobacterium tuberculosis H37Rv
gagaucgcccg

SEQ ID NO: 3340830 - RNA, 14 nt, Mycobacterium tuberculosis H37Rv
gagaucgcggcgac

SEQ ID NO: 3340831 - RNA, 19 nt, Mycobacterium tuberculosis H37Rv
gagaucguagggacgccga

SEQ ID NO: 3340832 - RNA, 13 nt, Mycobacterium tuberculosis H37Rv
gagaucgucgcga

SEQ ID NO: 3340833 - RNA, 18 nt, Mycobacterium tuberculosis H37Rv
gagaucgucgcguaguga

SEQ ID NO: 3340834 - RNA, 14 nt, Mycobacterium tuberculosis H37Rv
gagaucucugagcg

SEQ ID NO: 3340835 - RNA, 18 nt, Mycobacterium tuberculosis H37Rv
gagaugaucauguggugg

SEQ ID NO: 3340836 - RNA, 20 nt, Mycobacterium tuberculosis H37Rv
gagaugauugccaagcgggu

SEQ ID NO: 3340837 - RNA, 21 nt, Mycobacterium tuberculosis H37Rv
gagaugccaucggugaugagu

SEQ ID NO: 3340838 - RNA, 20 nt, Mycobacterium tuberculosis H37Rv
gagaugccgcgaucgugcag

SEQ ID NO: 3340839 - RNA, 22 nt, Mycobacterium tuberculosis H37Rv
gagaugccgcgaucgugcaggu

SEQ ID NO: 3340840 - RNA, 14 nt, Mycobacterium tuberculosis H37Rv
gagaugcguuccgc

SEQ ID NO: 3340841 - RNA, 17 nt, Mycobacterium tuberculosis H37Rv
gagaugcguuccgcgac

SEQ ID NO: 3340842 - RNA, 18 nt, Mycobacterium tuberculosis H37Rv
gagauggucgggcggcgu

SEQ ID NO: 3340843 - RNA, 19 nt, Mycobacterium tuberculosis H37Rv
gagauggucgggcggcguc

SEQ ID NO: 3340844 - RNA, 15 nt, Mycobacterium tuberculosis H37Rv
gagauugggcuggga

SEQ ID NO: 3340845 - RNA, 15 nt, Mycobacterium tuberculosis H37Rv
gagauuggugcagac

SEQ ID NO: 3340846 - RNA, 21 nt, Mycobacterium tuberculosis H37Rv
gagauuucuugaccgcgguga

SEQ ID NO: 3340847 - RNA, 15 nt, Mycobacterium tuberculosis H37Rv
gagcaaaauggccac

SEQ ID NO: 3340848 - RNA, 21 nt, Mycobacterium tuberculosis H37Rv
gagcaaaccagauugccgagc

SEQ ID NO: 3340849 - RNA, 20 nt, Mycobacterium tuberculosis H37Rv
gagcaacaccccuggguuga

SEQ ID NO: 3340850 - RNA, 23 nt, Mycobacterium tuberculosis H37Rv
gagcaacaccgucggcagcagcg

SEQ ID NO: 3340851 - RNA, 15 nt, Mycobacterium tuberculosis H37Rv
gagcaacacgagcgc

SEQ ID NO: 3340852 - RNA, 17 nt, Mycobacterium tuberculosis H37Rv
gagcaacgccacgccga

SEQ ID NO: 3340853 - RNA, 24 nt, Mycobacterium tuberculosis H37Rv
gagcaacgcgaccaucucgacguc

SEQ ID NO: 3340854 - RNA, 21 nt, Mycobacterium tuberculosis H37Rv
gagcaacugcucgacgaggcc

SEQ ID NO: 3340855 - RNA, 14 nt, Mycobacterium tuberculosis H37Rv
gagcaagaucaccu

SEQ ID NO: 3340856 - RNA, 16 nt, Mycobacterium tuberculosis H37Rv
gagcaauuccacgauc

SEQ ID NO: 3340857 - RNA, 20 nt, Mycobacterium tuberculosis H37Rv
gagcacaccgacagcaccca

SEQ ID NO: 3340858 - RNA, 13 nt, Mycobacterium tuberculosis H37Rv
gagcacacguccg

SEQ ID NO: 3340859 - RNA, 22 nt, Mycobacterium tuberculosis H37Rv
gagcacacguccggcgaugacc

SEQ ID NO: 3340860 - RNA, 19 nt, Mycobacterium tuberculosis H37Rv
gagcacacuccuagccaac

SEQ ID NO: 3340861 - RNA, 22 nt, Mycobacterium tuberculosis H37Rv
gagcacaugcucgacgcccgcc

SEQ ID NO: 3340862 - RNA, 20 nt, Mycobacterium tuberculosis H37Rv
gagcaccaccccagcggcca

SEQ ID NO: 3340863 - RNA, 21 nt, Mycobacterium tuberculosis H37Rv
gagcaccacccgggccucggc

SEQ ID NO: 3340864 - RNA, 12 nt, Mycobacterium tuberculosis H37Rv
gagcaccagcag

SEQ ID NO: 3340865 - RNA, 15 nt, Mycobacterium tuberculosis H37Rv
gagcacccagcggcg

SEQ ID NO: 3340866 - RNA, 14 nt, Mycobacterium tuberculosis H37Rv
gagcaccccgacgu

SEQ ID NO: 3340867 - RNA, 14 nt, Mycobacterium tuberculosis H37Rv
gagcaccgacaccg

SEQ ID NO: 3340868 - RNA, 15 nt, Mycobacterium tuberculosis H37Rv
gagccgaucgcccgc

SEQ ID NO: 3340869 - RNA, 13 nt, Mycobacterium tuberculosis H37Rv
gagccgcagcacc

SEQ ID NO: 3340870 - RNA, 19 nt, Mycobacterium tuberculosis H37Rv
gagccgcagcaccucgucg

SEQ ID NO: 3340871 - RNA, 18 nt, Mycobacterium tuberculosis H37Rv
gagccgccaccgaggccg

SEQ ID NO: 3340872 - RNA, 12 nt, Mycobacterium tuberculosis H37Rv
gagccgccagga

SEQ ID NO: 3340873 - RNA, 20 nt, Mycobacterium tuberculosis H37Rv
gagccgccaggugcucgucg

SEQ ID NO: 3340874 - RNA, 24 nt, Mycobacterium tuberculosis H37Rv
gagccgcccuugccuccggcgccg

SEQ ID NO: 3340875 - RNA, 22 nt, Mycobacterium tuberculosis H37Rv
gagccgccgacucggcaccgcg

SEQ ID NO: 3340876 - RNA, 12 nt, Mycobacterium tuberculosis H37Rv
gagccgccggau

SEQ ID NO: 3340877 - RNA, 17 nt, Mycobacterium tuberculosis H37Rv
gagccgccggaucgcca

SEQ ID NO: 3340878 - RNA, 18 nt, Mycobacterium tuberculosis H37Rv
gagccgccggaucgccac

SEQ ID NO: 3340879 - RNA, 19 nt, Mycobacterium tuberculosis H37Rv
gagccgccguggaacacga

SEQ ID NO: 3340880 - RNA, 12 nt, Mycobacterium tuberculosis H37Rv
gagccgccguug

SEQ ID NO: 3340881 - RNA, 17 nt, Mycobacterium tuberculosis H37Rv
gagccgcgaaaucaccg

SEQ ID NO: 3340882 - RNA, 20 nt, Mycobacterium tuberculosis H37Rv
gagccgcgaaaucaccgcug

SEQ ID NO: 3340883 - RNA, 14 nt, Mycobacterium tuberculosis H37Rv
gagccgcgcccaau

SEQ ID NO: 3340884 - RNA, 14 nt, Mycobacterium tuberculosis H37Rv
gagccgcgcgccgg

SEQ ID NO: 3340885 - RNA, 18 nt, Mycobacterium tuberculosis H37Rv
gagccgcucgcugaaccg

SEQ ID NO: 3340886 - RNA, 22 nt, Mycobacterium tuberculosis H37Rv
gagccgcugcgacaaaucggcg

SEQ ID NO: 3340887 - RNA, 14 nt, Mycobacterium tuberculosis H37Rv
gagccgcugcggca

SEQ ID NO: 3340888 - RNA, 16 nt, Mycobacterium tuberculosis H37Rv
gagccggaacagugcc

SEQ ID NO: 3340889 - RNA, 20 nt, Mycobacterium tuberculosis H37Rv
gagccggaugcggccgaacu

SEQ ID NO: 3340890 - RNA, 16 nt, Mycobacterium tuberculosis H37Rv
gagccggauucggcug

SEQ ID NO: 3340891 - RNA, 13 nt, Mycobacterium tuberculosis H37Rv
gagccggccaccu

SEQ ID NO: 3340892 - RNA, 16 nt, Mycobacterium tuberculosis H37Rv
gagccggcccugcucg

SEQ ID NO: 3340893 - RNA, 15 nt, Mycobacterium tuberculosis H37Rv
gagccggcgaagugc

SEQ ID NO: 3340894 - RNA, 21 nt, Mycobacterium tuberculosis H37Rv
gagccggcgaagugcuccacc

SEQ ID NO: 3340895 - RNA, 18 nt, Mycobacterium tuberculosis H37Rv
gagccgggaccauagucg

SEQ ID NO: 3340896 - RNA, 17 nt, Mycobacterium tuberculosis H37Rv
gagccgggcaaccagca

SEQ ID NO: 3340897 - RNA, 18 nt, Mycobacterium tuberculosis H37Rv
gagccgggugcgagcgac

SEQ ID NO: 3340898 - RNA, 17 nt, Mycobacterium tuberculosis H37Rv
gagccgguagaucagcg

SEQ ID NO: 3340899 - RNA, 18 nt, Mycobacterium tuberculosis H37Rv
gagccgguauacucggcc

SEQ ID NO: 3340900 - RNA, 20 nt, Mycobacterium tuberculosis H37Rv
gagccggugacgguguuggu

SEQ ID NO: 3340901 - RNA, 14 nt, Mycobacterium tuberculosis H37Rv
gagccggugccacu

SEQ ID NO: 3340902 - RNA, 13 nt, Mycobacterium tuberculosis H37Rv
gagccggugccga

SEQ ID NO: 3340903 - RNA, 19 nt, Mycobacterium tuberculosis H37Rv
gagccgguggcccgccggc

SEQ ID NO: 3340904 - RNA, 22 nt, Mycobacterium tuberculosis H37Rv
gagccguccaauuccgcagaga

SEQ ID NO: 3340905 - RNA, 16 nt, Mycobacterium tuberculosis H37Rv
gagccguccgaccagg

SEQ ID NO: 3340906 - RNA, 22 nt, Mycobacterium tuberculosis H37Rv
gagccgucgaagcgaacacccg

SEQ ID NO: 3340907 - RNA, 18 nt, Mycobacterium tuberculosis H37Rv
gagccgucggcgccucgg

SEQ ID NO: 3340908 - RNA, 22 nt, Mycobacterium tuberculosis H37Rv
gagccgugccucgaggacggcg

SEQ ID NO: 3340909 - RNA, 15 nt, Mycobacterium tuberculosis H37Rv
gagccucgcgcgcca

SEQ ID NO: 3340910 - RNA, 19 nt, Mycobacterium tuberculosis H37Rv
gagccucgcgcgccacggu

SEQ ID NO: 3340911 - RNA, 16 nt, Mycobacterium tuberculosis H37Rv
gagccugauaaagccc

SEQ ID NO: 3340912 - RNA, 19 nt, Mycobacterium tuberculosis H37Rv
gagccugcaggccgccggc

SEQ ID NO: 3340913 - RNA, 13 nt, Mycobacterium tuberculosis H37Rv
gagccugcucgca

SEQ ID NO: 3340914 - RNA, 21 nt, Mycobacterium tuberculosis H37Rv
gagccugcucgcagcgggcga

SEQ ID NO: 3340915 - RNA, 20 nt, Mycobacterium tuberculosis H37Rv
gagcgaaccgaagccgucga

SEQ ID NO: 3340916 - RNA, 15 nt, Mycobacterium tuberculosis H37Rv
gagcgaacggcgcag

SEQ ID NO: 3340917 - RNA, 22 nt, Mycobacterium tuberculosis H37Rv
gagcgaacgggcuuccgacaug

SEQ ID NO: 3340918 - RNA, 19 nt, Mycobacterium tuberculosis H37Rv
gagcgaccccacacgccga

SEQ ID NO: 3340919 - RNA, 19 nt, Mycobacterium tuberculosis H37Rv
gagcgacccccagcgcccg

SEQ ID NO: 3340920 - RNA, 17 nt, Mycobacterium tuberculosis H37Rv
gagcgaccgcgagggcc

SEQ ID NO: 3340921 - RNA, 20 nt, Mycobacterium tuberculosis H37Rv
gagcgaccgcgagggccagc

SEQ ID NO: 3340922 - RNA, 23 nt, Mycobacterium tuberculosis H37Rv
gagcgaccgucccagcgccgcag

SEQ ID NO: 3340923 - RNA, 17 nt, Mycobacterium tuberculosis H37Rv
gagcgacgucggugaag

SEQ ID NO: 3340924 - RNA, 20 nt, Mycobacterium tuberculosis H37Rv
gagcgacugcagcggcgcau

SEQ ID NO: 3340925 - RNA, 16 nt, Mycobacterium tuberculosis H37Rv
gagcgagaaucacggu

SEQ ID NO: 3340926 - RNA, 16 nt, Mycobacterium tuberculosis H37Rv
gagcgaguccagcgca

SEQ ID NO: 3340927 - RNA, 16 nt, Mycobacterium tuberculosis H37Rv
gagcgauacgucguca

SEQ ID NO: 3340928 - RNA, 19 nt, Mycobacterium tuberculosis H37Rv
gagcgauacgucgucagcc

SEQ ID NO: 3340929 - RNA, 13 nt, Mycobacterium tuberculosis H37Rv
gagcgaucaacgg

SEQ ID NO: 3340930 - RNA, 13 nt, Mycobacterium tuberculosis H37Rv
gagcgcaacuccc

SEQ ID NO: 3340931 - RNA, 20 nt, Mycobacterium tuberculosis H37Rv
gagcgcaacucccagcacgg

SEQ ID NO: 3340932 - RNA, 18 nt, Mycobacterium tuberculosis H37Rv
gagcgcaagagccguccg

SEQ ID NO: 3340933 - RNA, 16 nt, Mycobacterium tuberculosis H37Rv
gagcgcacaccggcuu

SEQ ID NO: 3340934 - RNA, 13 nt, Mycobacterium tuberculosis H37Rv
gagcgcaccugaa

SEQ ID NO: 3340935 - RNA, 13 nt, Mycobacterium tuberculosis H37Rv
gagcgcagcgccg

SEQ ID NO: 3340936 - RNA, 21 nt, Mycobacterium tuberculosis H37Rv
gagcgcagcgccggcagcagc

SEQ ID NO: 3340937 - RNA, 19 nt, Mycobacterium tuberculosis H37Rv
gagcgcagcuugaucccau

SEQ ID NO: 3340938 - RNA, 19 nt, Mycobacterium tuberculosis H37Rv
gagcgccacgccgaggcgu

SEQ ID NO: 3340939 - RNA, 22 nt, Mycobacterium tuberculosis H37Rv
gagcgccacgccgaggcguucg

SEQ ID NO: 3340940 - RNA, 12 nt, Mycobacterium tuberculosis H37Rv
gagcgccagcgc

SEQ ID NO: 3340941 - RNA, 15 nt, Mycobacterium tuberculosis H37Rv
gagcgccgcggcgac

SEQ ID NO: 3340942 - RNA, 15 nt, Mycobacterium tuberculosis H37Rv
gagcgccgcggcgga

SEQ ID NO: 3340943 - RNA, 14 nt, Mycobacterium tuberculosis H37Rv
gagcgcgcagcagu

SEQ ID NO: 3340944 - RNA, 22 nt, Mycobacterium tuberculosis H37Rv
gagcgcgccgcgcucgccgaua

SEQ ID NO: 3340945 - RNA, 18 nt, Mycobacterium tuberculosis H37Rv
gagcgcgccucgcccagc

SEQ ID NO: 3340946 - RNA, 17 nt, Mycobacterium tuberculosis H37Rv
gagcgcgccuucacgcu

SEQ ID NO: 3340947 - RNA, 15 nt, Mycobacterium tuberculosis H37Rv
gagcgcgcgcggugc

SEQ ID NO: 3340948 - RNA, 17 nt, Mycobacterium tuberculosis H37Rv
gagcgcgcguagcgggg

SEQ ID NO: 3340949 - RNA, 18 nt, Mycobacterium tuberculosis H37Rv
gagcgcgcguagcggggg

SEQ ID NO: 3340950 - RNA, 12 nt, Mycobacterium tuberculosis H37Rv
gagcgcgcucga

SEQ ID NO: 3340951 - RNA, 18 nt, Mycobacterium tuberculosis H37Rv
gagcgcgcucgagggugg

SEQ ID NO: 3340952 - RNA, 13 nt, Mycobacterium tuberculosis H37Rv
gagcgcggcaacc

SEQ ID NO: 3340953 - RNA, 16 nt, Mycobacterium tuberculosis H37Rv
gagcgcggccugcacc

SEQ ID NO: 3340954 - RNA, 18 nt, Mycobacterium tuberculosis H37Rv
gagcgcggcgacggcggu

SEQ ID NO: 3340955 - RNA, 18 nt, Mycobacterium tuberculosis H37Rv
gagcgcggcggcggaggc

SEQ ID NO: 3340956 - RNA, 18 nt, Mycobacterium tuberculosis H37Rv
gagcgcggugccgccacc

SEQ ID NO: 3340957 - RNA, 17 nt, Mycobacterium tuberculosis H37Rv
gagcgcgucgcgggauu

SEQ ID NO: 3340958 - RNA, 14 nt, Mycobacterium tuberculosis H37Rv
gagcgcgucgguca

SEQ ID NO: 3340959 - RNA, 14 nt, Mycobacterium tuberculosis H37Rv
gagcgcuaucaccg

SEQ ID NO: 3340960 - RNA, 16 nt, Mycobacterium tuberculosis H37Rv
gagcgcuucgaggugg

SEQ ID NO: 3340961 - RNA, 20 nt, Mycobacterium tuberculosis H37Rv
gagcgcuuggucaaaaagcu

SEQ ID NO: 3340962 - RNA, 19 nt, Mycobacterium tuberculosis H37Rv
gagcggaacgucacugcga

SEQ ID NO: 3340963 - RNA, 22 nt, Mycobacterium tuberculosis H37Rv
gagcggacucgagucugcgcag

SEQ ID NO: 3340964 - RNA, 14 nt, Mycobacterium tuberculosis H37Rv
gaggaccugcucgg

SEQ ID NO: 3340965 - RNA, 16 nt, Mycobacterium tuberculosis H37Rv
gaggaccugcucgggc

SEQ ID NO: 3340966 - RNA, 15 nt, Mycobacterium tuberculosis H37Rv
gaggaccuugccggu

SEQ ID NO: 3340967 - RNA, 12 nt, Mycobacterium tuberculosis H37Rv
gaggacgagguu

SEQ ID NO: 3340968 - RNA, 14 nt, Mycobacterium tuberculosis H37Rv
gaggacgccggcgc

SEQ ID NO: 3340969 - RNA, 21 nt, Mycobacterium tuberculosis H37Rv
gaggacgccggcgccgccauu

SEQ ID NO: 3340970 - RNA, 20 nt, Mycobacterium tuberculosis H37Rv
gaggacgcugauccacgaua

SEQ ID NO: 3340971 - RNA, 16 nt, Mycobacterium tuberculosis H37Rv
gaggacggcggccagg

SEQ ID NO: 3340972 - RNA, 12 nt, Mycobacterium tuberculosis H37Rv
gaggacggcuug

SEQ ID NO: 3340973 - RNA, 22 nt, Mycobacterium tuberculosis H37Rv
gaggacuggaaagcagcagcgg

SEQ ID NO: 3340974 - RNA, 18 nt, Mycobacterium tuberculosis H37Rv
gaggagaugccgacgaac

SEQ ID NO: 3340975 - RNA, 17 nt, Mycobacterium tuberculosis H37Rv
gaggauccgcaccacgc

SEQ ID NO: 3340976 - RNA, 19 nt, Mycobacterium tuberculosis H37Rv
gaggauccgcaccacgccc

SEQ ID NO: 3340977 - RNA, 15 nt, Mycobacterium tuberculosis H37Rv
gaggaucgcugguug

SEQ ID NO: 3340978 - RNA, 22 nt, Mycobacterium tuberculosis H37Rv
gaggaugacgacggugaccggg

SEQ ID NO: 3340979 - RNA, 18 nt, Mycobacterium tuberculosis H37Rv
gaggaugcugagcgccag

SEQ ID NO: 3340980 - RNA, 19 nt, Mycobacterium tuberculosis H37Rv
gaggauguaguuggugaug

SEQ ID NO: 3340981 - RNA, 18 nt, Mycobacterium tuberculosis H37Rv
gaggauguugugccgauc

SEQ ID NO: 3340982 - RNA, 13 nt, Mycobacterium tuberculosis H37Rv
gaggcaacaagca

SEQ ID NO: 3340983 - RNA, 16 nt, Mycobacterium tuberculosis H37Rv
gaggcaagcaaccggu

SEQ ID NO: 3340984 - RNA, 17 nt, Mycobacterium tuberculosis H37Rv
gaggcaagcaaccggug

SEQ ID NO: 3340985 - RNA, 16 nt, Mycobacterium tuberculosis H37Rv
gaggcacaaucaccgc

SEQ ID NO: 3340986 - RNA, 15 nt, Mycobacterium tuberculosis H37Rv
gaggcaccgacaucg

SEQ ID NO: 3340987 - RNA, 23 nt, Mycobacterium tuberculosis H37Rv
gaggcauugguguagccaaccgu

SEQ ID NO: 3340988 - RNA, 18 nt, Mycobacterium tuberculosis H37Rv
gaggccaaguugcagcgg

SEQ ID NO: 3340989 - RNA, 19 nt, Mycobacterium tuberculosis H37Rv
gaggccacggggcuuggcg

SEQ ID NO: 3340990 - RNA, 11 nt, Mycobacterium tuberculosis H37Rv
gaggccagcag

SEQ ID NO: 3340991 - RNA, 13 nt, Mycobacterium tuberculosis H37Rv
gaggccagcagcu

SEQ ID NO: 3340992 - RNA, 19 nt, Mycobacterium tuberculosis H37Rv
gaggccauguugccgugga

SEQ ID NO: 3340993 - RNA, 23 nt, Mycobacterium tuberculosis H37Rv
gaggcccgccacaacggcggcgc

SEQ ID NO: 3340994 - RNA, 14 nt, Mycobacterium tuberculosis H37Rv
gaggcccgcggugg

SEQ ID NO: 3340995 - RNA, 15 nt, Mycobacterium tuberculosis H37Rv
gaggcccgcggugga

SEQ ID NO: 3340996 - RNA, 13 nt, Mycobacterium tuberculosis H37Rv
gaggcccgggugc

SEQ ID NO: 3340997 - RNA, 19 nt, Mycobacterium tuberculosis H37Rv
gaggcccgucacaaugccc

SEQ ID NO: 3340998 - RNA, 13 nt, Mycobacterium tuberculosis H37Rv
gaggccgaccagc

SEQ ID NO: 3340999 - RNA, 24 nt, Mycobacterium tuberculosis H37Rv
gaggccgcacgucgaccucggcaa

SEQ ID NO: 3341000 - RNA, 17 nt, Mycobacterium tuberculosis H37Rv
gaggccgccaucgccgc

SEQ ID NO: 3341001 - RNA, 18 nt, Mycobacterium tuberculosis H37Rv
gaggccgccaucgccgcc

SEQ ID NO: 3341002 - RNA, 15 nt, Mycobacterium tuberculosis H37Rv
gaggccgcugccagc

SEQ ID NO: 3341003 - RNA, 23 nt, Mycobacterium tuberculosis H37Rv
gaggccggugaacggcagcacgg

SEQ ID NO: 3341004 - RNA, 13 nt, Mycobacterium tuberculosis H37Rv
gaggcgaaagaug

SEQ ID NO: 3341005 - RNA, 16 nt, Mycobacterium tuberculosis H37Rv
gaggcgcagcgccagc

SEQ ID NO: 3341006 - RNA, 12 nt, Mycobacterium tuberculosis H37Rv
gaggcgcccaac

SEQ ID NO: 3341007 - RNA, 16 nt, Mycobacterium tuberculosis H37Rv
gaggcgcucacccgcc

SEQ ID NO: 3341008 - RNA, 15 nt, Mycobacterium tuberculosis H37Rv
gaggcgcuucgccac

SEQ ID NO: 3341009 - RNA, 15 nt, Mycobacterium tuberculosis H37Rv
gaggcggcgacgacc

SEQ ID NO: 3341010 - RNA, 15 nt, Mycobacterium tuberculosis H37Rv
gaggcgggucgccgc

SEQ ID NO: 3341011 - RNA, 13 nt, Mycobacterium tuberculosis H37Rv
gaggcgucggcaa

SEQ ID NO: 3341012 - RNA, 15 nt, Mycobacterium tuberculosis H37Rv
gaggcgugucgacuc

SEQ ID NO: 3341013 - RNA, 20 nt, Mycobacterium tuberculosis H37Rv
gaggcuaggcguuuggugug

SEQ ID NO: 3341014 - RNA, 21 nt, Mycobacterium tuberculosis H37Rv
gaggcugaccguggcgccggu

SEQ ID NO: 3341015 - RNA, 17 nt, Mycobacterium tuberculosis H37Rv
gaggcugggcugagggu

SEQ ID NO: 3341016 - RNA, 16 nt, Mycobacterium tuberculosis H37Rv
gaggcuggucugcagg

SEQ ID NO: 3341017 - RNA, 19 nt, Mycobacterium tuberculosis H37Rv
gaggcuggucugcaggcgg

SEQ ID NO: 3341018 - RNA, 21 nt, Mycobacterium tuberculosis H37Rv
gaggcuuucgauauagccgcc

SEQ ID NO: 3341019 - RNA, 18 nt, Mycobacterium tuberculosis H37Rv
gaggcuuuuggagcggcu

SEQ ID NO: 3341020 - RNA, 21 nt, Mycobacterium tuberculosis H37Rv
gagggaacccacaguggcucg

SEQ ID NO: 3341021 - RNA, 22 nt, Mycobacterium tuberculosis H37Rv
gagggagcgccgcagggucccg

SEQ ID NO: 3341022 - RNA, 14 nt, Mycobacterium tuberculosis H37Rv
gagggaucacgcca

SEQ ID NO: 3341023 - RNA, 21 nt, Mycobacterium tuberculosis H37Rv
gagggcaaggacaagccgcug

SEQ ID NO: 3341024 - RNA, 13 nt, Mycobacterium tuberculosis H37Rv
gagggcagccgcc

SEQ ID NO: 3341025 - RNA, 15 nt, Mycobacterium tuberculosis H37Rv
gagggcaucgggccu

SEQ ID NO: 3341026 - RNA, 13 nt, Mycobacterium tuberculosis H37Rv
gagggccacggcu

SEQ ID NO: 3341027 - RNA, 21 nt, Mycobacterium tuberculosis H37Rv
gagggccacguagcagcagac

SEQ ID NO: 3341028 - RNA, 13 nt, Mycobacterium tuberculosis H37Rv
gagggccagcagc

SEQ ID NO: 3341029 - RNA, 15 nt, Mycobacterium tuberculosis H37Rv
gagggcggccgcggu

SEQ ID NO: 3341030 - RNA, 17 nt, Mycobacterium tuberculosis H37Rv
gagggcggccgcgguga

SEQ ID NO: 3341031 - RNA, 15 nt, Mycobacterium tuberculosis H37Rv
gagggcgggacccgu

SEQ ID NO: 3341032 - RNA, 14 nt, Mycobacterium tuberculosis H37Rv
gagggcgucgccgc

SEQ ID NO: 3341033 - RNA, 19 nt, Mycobacterium tuberculosis H37Rv
gagggcgucgccgccguug

SEQ ID NO: 3341034 - RNA, 12 nt, Mycobacterium tuberculosis H37Rv
gagggcucggug

SEQ ID NO: 3341035 - RNA, 16 nt, Mycobacterium tuberculosis H37Rv
gagggcucgguggcgc

SEQ ID NO: 3341036 - RNA, 18 nt, Mycobacterium tuberculosis H37Rv
gagggcuguugacgccac

SEQ ID NO: 3341037 - RNA, 21 nt, Mycobacterium tuberculosis H37Rv
gagggcuuuagugucugcucg

SEQ ID NO: 3341038 - RNA, 12 nt, Mycobacterium tuberculosis H37Rv
gaggggacccag

SEQ ID NO: 3341039 - RNA, 21 nt, Mycobacterium tuberculosis H37Rv
gagggguucacccagcggcgc

SEQ ID NO: 3341040 - RNA, 23 nt, Mycobacterium tuberculosis H37Rv
gagggucaugucgaucagcgcga

SEQ ID NO: 3341041 - RNA, 22 nt, Mycobacterium tuberculosis H37Rv
gagggugugagguagucggcgc

SEQ ID NO: 3341042 - RNA, 19 nt, Mycobacterium tuberculosis H37Rv
gaggguucggacggcuggu

SEQ ID NO: 3341043 - RNA, 14 nt, Mycobacterium tuberculosis H37Rv
gaggguuuccaagu

SEQ ID NO: 3341044 - RNA, 22 nt, Mycobacterium tuberculosis H37Rv
gaggguuuucgcauagugcggc

SEQ ID NO: 3341045 - RNA, 17 nt, Mycobacterium tuberculosis H37Rv
gagguacaacgggcacg

SEQ ID NO: 3341046 - RNA, 23 nt, Mycobacterium tuberculosis H37Rv
gagguacccaucgucgagccgcc

SEQ ID NO: 3341047 - RNA, 16 nt, Mycobacterium tuberculosis H37Rv
gagguacccccagcac

SEQ ID NO: 3341048 - RNA, 22 nt, Mycobacterium tuberculosis H37Rv
gagguagaccugguugaccucg

SEQ ID NO: 3341049 - RNA, 20 nt, Mycobacterium tuberculosis H37Rv
gagguagcugcgcgggucgu

SEQ ID NO: 3341050 - RNA, 13 nt, Mycobacterium tuberculosis H37Rv
gagguagucggcg

SEQ ID NO: 3341051 - RNA, 19 nt, Mycobacterium tuberculosis H37Rv
gagguauucguggucggcc

SEQ ID NO: 3341052 - RNA, 22 nt, Mycobacterium tuberculosis H37Rv
gagguauucguggucggccucg

SEQ ID NO: 3341053 - RNA, 17 nt, Mycobacterium tuberculosis H37Rv
gaggucaaaaucagggu

SEQ ID NO: 3341054 - RNA, 16 nt, Mycobacterium tuberculosis H37Rv
gaggucaacgccacgc

SEQ ID NO: 3341055 - RNA, 19 nt, Mycobacterium tuberculosis H37Rv
gaggucaacgccacgccga

SEQ ID NO: 3341056 - RNA, 19 nt, Mycobacterium tuberculosis H37Rv
gaggucaaggucgucgugg

SEQ ID NO: 3341057 - RNA, 14 nt, Mycobacterium tuberculosis H37Rv
gaggucacccggua

SEQ ID NO: 3341058 - RNA, 14 nt, Mycobacterium tuberculosis H37Rv
gaggucaccggcga

SEQ ID NO: 3341059 - RNA, 14 nt, Mycobacterium tuberculosis H37Rv
gaggucagcucccg

SEQ ID NO: 3341060 - RNA, 12 nt, Mycobacterium tuberculosis H37Rv
gaggucccggcc

SEQ ID NO: 3341061 - RNA, 12 nt, Mycobacterium tuberculosis H37Rv
gaguucggugcu

SEQ ID NO: 3341062 - RNA, 14 nt, Mycobacterium tuberculosis H37Rv
gaguucggugcugu

SEQ ID NO: 3341063 - RNA, 22 nt, Mycobacterium tuberculosis H37Rv
gaguucgguugcccccagggcc

SEQ ID NO: 3341064 - RNA, 14 nt, Mycobacterium tuberculosis H37Rv
gaguugagcgccaa

SEQ ID NO: 3341065 - RNA, 15 nt, Mycobacterium tuberculosis H37Rv
gaguugagcugucgc

SEQ ID NO: 3341066 - RNA, 13 nt, Mycobacterium tuberculosis H37Rv
gaguugcagaccg

SEQ ID NO: 3341067 - RNA, 14 nt, Mycobacterium tuberculosis H37Rv
gaguugcccguuca

SEQ ID NO: 3341068 - RNA, 12 nt, Mycobacterium tuberculosis H37Rv
gaguugcggugc

SEQ ID NO: 3341069 - RNA, 12 nt, Mycobacterium tuberculosis H37Rv
gaguuggccaag

SEQ ID NO: 3341070 - RNA, 23 nt, Mycobacterium tuberculosis H37Rv
gaguuggccaagcaggcggggga

SEQ ID NO: 3341071 - RNA, 15 nt, Mycobacterium tuberculosis H37Rv
gaguuggcccgacgc

SEQ ID NO: 3341072 - RNA, 19 nt, Mycobacterium tuberculosis H37Rv
gaguuggcgaagcccgaga

SEQ ID NO: 3341073 - RNA, 22 nt, Mycobacterium tuberculosis H37Rv
gaguugguguuauugaugcccg

SEQ ID NO: 3341074 - RNA, 20 nt, Mycobacterium tuberculosis H37Rv
gaguugucgacggccacccc

SEQ ID NO: 3341075 - RNA, 12 nt, Mycobacterium tuberculosis H37Rv
gaguuucugcuc

SEQ ID NO: 3341076 - RNA, 14 nt, Mycobacterium tuberculosis H37Rv
gaguuuguuuuugc

SEQ ID NO: 3341077 - RNA, 12 nt, Mycobacterium tuberculosis H37Rv
gaguuuuucggg

SEQ ID NO: 3341078 - RNA, 18 nt, Mycobacterium tuberculosis H37Rv
gauaaaaaccacccccac

SEQ ID NO: 3341079 - RNA, 15 nt, Mycobacterium tuberculosis H37Rv
gauaaagccgcugaa

SEQ ID NO: 3341080 - RNA, 14 nt, Mycobacterium tuberculosis H37Rv
gauaaccaccaucu

SEQ ID NO: 3341081 - RNA, 15 nt, Mycobacterium tuberculosis H37Rv
gauaaccaccaucug

SEQ ID NO: 3341082 - RNA, 15 nt, Mycobacterium tuberculosis H37Rv
gauaacccaaccgcg

SEQ ID NO: 3341083 - RNA, 13 nt, Mycobacterium tuberculosis H37Rv
gauaaccggcaug

SEQ ID NO: 3341084 - RNA, 17 nt, Mycobacterium tuberculosis H37Rv
gauaacgucacaccgau

SEQ ID NO: 3341085 - RNA, 24 nt, Mycobacterium tuberculosis H37Rv
gauaagccugggaaacugggucua

SEQ ID NO: 3341086 - RNA, 13 nt, Mycobacterium tuberculosis H37Rv
gauaaggaucaga

SEQ ID NO: 3341087 - RNA, 23 nt, Mycobacterium tuberculosis H37Rv
gauaauccaugacacuggggugc

SEQ ID NO: 3341088 - RNA, 21 nt, Mycobacterium tuberculosis H37Rv
gauaaugcgugugagcugcuc

SEQ ID NO: 3341089 - RNA, 14 nt, Mycobacterium tuberculosis H37Rv
gauacacggcggcg

SEQ ID NO: 3341090 - RNA, 21 nt, Mycobacterium tuberculosis H37Rv
gauacagacggggaucggucu

SEQ ID NO: 3341091 - RNA, 13 nt, Mycobacterium tuberculosis H37Rv
gauacccagcgcc

SEQ ID NO: 3341092 - RNA, 15 nt, Mycobacterium tuberculosis H37Rv
gauacccagcgcccg

SEQ ID NO: 3341093 - RNA, 21 nt, Mycobacterium tuberculosis H37Rv
gauacccagcgcccggccacu

SEQ ID NO: 3341094 - RNA, 14 nt, Mycobacterium tuberculosis H37Rv
gauaccgaccaucg

SEQ ID NO: 3341095 - RNA, 15 nt, Mycobacterium tuberculosis H37Rv
gauaccggcgugcag

SEQ ID NO: 3341096 - RNA, 16 nt, Mycobacterium tuberculosis H37Rv
gauaccggcgugcagu

SEQ ID NO: 3341097 - RNA, 15 nt, Mycobacterium tuberculosis H37Rv
gauaccggucagcac

SEQ ID NO: 3341098 - RNA, 15 nt, Mycobacterium tuberculosis H37Rv
gauaccgucagcgcc

SEQ ID NO: 3341099 - RNA, 15 nt, Mycobacterium tuberculosis H37Rv
gauaccuagccccug

SEQ ID NO: 3341100 - RNA, 14 nt, Mycobacterium tuberculosis H37Rv
gauaccucgccauc

SEQ ID NO: 3341101 - RNA, 19 nt, Mycobacterium tuberculosis H37Rv
gauaccugcccacgcggau

SEQ ID NO: 3341102 - RNA, 20 nt, Mycobacterium tuberculosis H37Rv
gauaccugggacaggacgac

SEQ ID NO: 3341103 - RNA, 13 nt, Mycobacterium tuberculosis H37Rv
gauacgagcugua

SEQ ID NO: 3341104 - RNA, 23 nt, Mycobacterium tuberculosis H37Rv
gauacgugaggucccggcuggga

SEQ ID NO: 3341105 - RNA, 23 nt, Mycobacterium tuberculosis H37Rv
gauacuaaacaggccgccaccgu

SEQ ID NO: 3341106 - RNA, 21 nt, Mycobacterium tuberculosis H37Rv
gauacucgaguggcgaacggg

SEQ ID NO: 3341107 - RNA, 16 nt, Mycobacterium tuberculosis H37Rv
gauacucggcgacugc

SEQ ID NO: 3341108 - RNA, 20 nt, Mycobacterium tuberculosis H37Rv
gauacugcccgcguuugcga

SEQ ID NO: 3341109 - RNA, 17 nt, Mycobacterium tuberculosis H37Rv
gauagacggcgacgaug

SEQ ID NO: 3341110 - RNA, 23 nt, Mycobacterium tuberculosis H37Rv
gauagacuagccgauccagcagg

SEQ ID NO: 3341111 - RNA, 19 nt, Mycobacterium tuberculosis H37Rv
gauagcaacgaagccggcg

SEQ ID NO: 3341112 - RNA, 22 nt, Mycobacterium tuberculosis H37Rv
gauagcaacggugcucuucgau

SEQ ID NO: 3341113 - RNA, 14 nt, Mycobacterium tuberculosis H37Rv
gauagcaccggaau

SEQ ID NO: 3341114 - RNA, 19 nt, Mycobacterium tuberculosis H37Rv
gauagcaccggcacccgca

SEQ ID NO: 3341115 - RNA, 21 nt, Mycobacterium tuberculosis H37Rv
gauagcccagauagagcuggu

SEQ ID NO: 3341116 - RNA, 22 nt, Mycobacterium tuberculosis H37Rv
gauagcccagauagagcuggug

SEQ ID NO: 3341117 - RNA, 13 nt, Mycobacterium tuberculosis H37Rv
gauagccugcggc

SEQ ID NO: 3341118 - RNA, 14 nt, Mycobacterium tuberculosis H37Rv
gauagccugcggcg

SEQ ID NO: 3341119 - RNA, 21 nt, Mycobacterium tuberculosis H37Rv
gauagcggcaaagccggguga

SEQ ID NO: 3341120 - RNA, 22 nt, Mycobacterium tuberculosis H37Rv
gauagcggcccgaucaccagcc

SEQ ID NO: 3341121 - RNA, 15 nt, Mycobacterium tuberculosis H37Rv
gauagcggucgguca

SEQ ID NO: 3341122 - RNA, 22 nt, Mycobacterium tuberculosis H37Rv
gauaggaccacgggaugcaugu

SEQ ID NO: 3341123 - RNA, 14 nt, Mycobacterium tuberculosis H37Rv
gauaggccccgagg

SEQ ID NO: 3341124 - RNA, 20 nt, Mycobacterium tuberculosis H37Rv
gauaggcccggucuugggcg

SEQ ID NO: 3341125 - RNA, 16 nt, Mycobacterium tuberculosis H37Rv
gauaggcgcgcaguga

SEQ ID NO: 3341126 - RNA, 18 nt, Mycobacterium tuberculosis H37Rv
gauaggucgggcaugacg

SEQ ID NO: 3341127 - RNA, 12 nt, Mycobacterium tuberculosis H37Rv
gauagucgccgc

SEQ ID NO: 3341128 - RNA, 14 nt, Mycobacterium tuberculosis H37Rv
gauagucgccgccg

SEQ ID NO: 3341129 - RNA, 21 nt, Mycobacterium tuberculosis H37Rv
gauagucgccgucgccccacc

SEQ ID NO: 3341130 - RNA, 22 nt, Mycobacterium tuberculosis H37Rv
gauagucgccgucgccccacca

SEQ ID NO: 3341131 - RNA, 23 nt, Mycobacterium tuberculosis H37Rv
gauagucgccgucgccccaccaa

SEQ ID NO: 3341132 - RNA, 13 nt, Mycobacterium tuberculosis H37Rv
gauaguucaccac

SEQ ID NO: 3341133 - RNA, 23 nt, Mycobacterium tuberculosis H37Rv
gauaguucaccacaugggagccg

SEQ ID NO: 3341134 - RNA, 19 nt, Mycobacterium tuberculosis H37Rv
gauaguugccgaggcggau

SEQ ID NO: 3341135 - RNA, 23 nt, Mycobacterium tuberculosis H37Rv
gauaucaauggcagcugaaucgu

SEQ ID NO: 3341136 - RNA, 19 nt, Mycobacterium tuberculosis H37Rv
gauauccaaugccagaucg

SEQ ID NO: 3341137 - RNA, 16 nt, Mycobacterium tuberculosis H37Rv
gauauccuuugccgcc

SEQ ID NO: 3341138 - RNA, 21 nt, Mycobacterium tuberculosis H37Rv
gauaucgccgagaaccagcga

SEQ ID NO: 3341139 - RNA, 14 nt, Mycobacterium tuberculosis H37Rv
gauaucggcggcuu

SEQ ID NO: 3341140 - RNA, 15 nt, Mycobacterium tuberculosis H37Rv
gauaucguacuggcu

SEQ ID NO: 3341141 - RNA, 15 nt, Mycobacterium tuberculosis H37Rv
gauaucgucggugca

SEQ ID NO: 3341142 - RNA, 16 nt, Mycobacterium tuberculosis H37Rv
gauaucuauggaugac

SEQ ID NO: 3341143 - RNA, 20 nt, Mycobacterium tuberculosis H37Rv
gauaugacggcagaccaugg

SEQ ID NO: 3341144 - RNA, 20 nt, Mycobacterium tuberculosis H37Rv
gauaugcgucgauugccgcg

SEQ ID NO: 3341145 - RNA, 22 nt, Mycobacterium tuberculosis H37Rv
gauauuggacgcgcaugccccg

SEQ ID NO: 3341146 - RNA, 15 nt, Mycobacterium tuberculosis H37Rv
gaucaaaccggccuu

SEQ ID NO: 3341147 - RNA, 15 nt, Mycobacterium tuberculosis H37Rv
gaucaacaugccggu

SEQ ID NO: 3341148 - RNA, 17 nt, Mycobacterium tuberculosis H37Rv
gaucaaccgggucagcc

SEQ ID NO: 3341149 - RNA, 22 nt, Mycobacterium tuberculosis H37Rv
gaucaaccgggucagcccagcc

SEQ ID NO: 3341150 - RNA, 21 nt, Mycobacterium tuberculosis H37Rv
gaucaacucgggcagcgcggc

SEQ ID NO: 3341151 - RNA, 19 nt, Mycobacterium tuberculosis H37Rv
gaucaacucgugcgggcag

SEQ ID NO: 3341152 - RNA, 22 nt, Mycobacterium tuberculosis H37Rv
gaucaagcuggcccgcucauac

SEQ ID NO: 3341153 - RNA, 20 nt, Mycobacterium tuberculosis H37Rv
gaucaaugcugcguccugga

SEQ ID NO: 3341154 - RNA, 20 nt, Mycobacterium tuberculosis H37Rv
gaucacaacgugcccaccaa

SEQ ID NO: 3341155 - RNA, 17 nt, Mycobacterium tuberculosis H37Rv
gaucacaccccaggcac

SEQ ID NO: 3341156 - RNA, 18 nt, Mycobacterium tuberculosis H37Rv
gaucacaccccaggcacc

SEQ ID NO: 3341157 - RNA, 18 nt, Mycobacterium tuberculosis H37Rv
gaucccgguggcagcaca

SEQ ID NO: 3341158 - RNA, 18 nt, Mycobacterium tuberculosis H37Rv
gaucccgugguggcgcca

SEQ ID NO: 3341159 - RNA, 17 nt, Mycobacterium tuberculosis H37Rv
gauccgaagagccagca

SEQ ID NO: 3341160 - RNA, 18 nt, Mycobacterium tuberculosis H37Rv
gauccgaagagccagcaa

SEQ ID NO: 3341161 - RNA, 13 nt, Mycobacterium tuberculosis H37Rv
gauccgauccgcu

SEQ ID NO: 3341162 - RNA, 20 nt, Mycobacterium tuberculosis H37Rv
gauccgauuggcgaucuugc

SEQ ID NO: 3341163 - RNA, 14 nt, Mycobacterium tuberculosis H37Rv
gauccgcacagcaa

SEQ ID NO: 3341164 - RNA, 17 nt, Mycobacterium tuberculosis H37Rv
gauccgcaccacgcccg

SEQ ID NO: 3341165 - RNA, 21 nt, Mycobacterium tuberculosis H37Rv
gauccgcaccacgcccgacga

SEQ ID NO: 3341166 - RNA, 14 nt, Mycobacterium tuberculosis H37Rv
gauccgccgacagc

SEQ ID NO: 3341167 - RNA, 15 nt, Mycobacterium tuberculosis H37Rv
gauccgccgacagcc

SEQ ID NO: 3341168 - RNA, 16 nt, Mycobacterium tuberculosis H37Rv
gauccgccugccgacg

SEQ ID NO: 3341169 - RNA, 16 nt, Mycobacterium tuberculosis H37Rv
gauccgcuagccccga

SEQ ID NO: 3341170 - RNA, 17 nt, Mycobacterium tuberculosis H37Rv
gauccggaucccaccac

SEQ ID NO: 3341171 - RNA, 19 nt, Mycobacterium tuberculosis H37Rv
gauccggcagcagccggcg

SEQ ID NO: 3341172 - RNA, 14 nt, Mycobacterium tuberculosis H37Rv
gauccggccagagu

SEQ ID NO: 3341173 - RNA, 23 nt, Mycobacterium tuberculosis H37Rv
gauccggccgccaacuucaccac

SEQ ID NO: 3341174 - RNA, 16 nt, Mycobacterium tuberculosis H37Rv
gauccggcgcagcgaa

SEQ ID NO: 3341175 - RNA, 16 nt, Mycobacterium tuberculosis H37Rv
gauccggcgccauucg

SEQ ID NO: 3341176 - RNA, 14 nt, Mycobacterium tuberculosis H37Rv
gauccggcuccacc

SEQ ID NO: 3341177 - RNA, 15 nt, Mycobacterium tuberculosis H37Rv
gauccgggcgccgau

SEQ ID NO: 3341178 - RNA, 13 nt, Mycobacterium tuberculosis H37Rv
gauccggguggcg

SEQ ID NO: 3341179 - RNA, 14 nt, Mycobacterium tuberculosis H37Rv
gauccggucggcca

SEQ ID NO: 3341180 - RNA, 23 nt, Mycobacterium tuberculosis H37Rv
gauccggugguuguggcggguca

SEQ ID NO: 3341181 - RNA, 20 nt, Mycobacterium tuberculosis H37Rv
gauccguccgcuggugguca

SEQ ID NO: 3341182 - RNA, 14 nt, Mycobacterium tuberculosis H37Rv
gauccguggccaaa

SEQ ID NO: 3341183 - RNA, 17 nt, Mycobacterium tuberculosis H37Rv
gauccgugucgcagauc

SEQ ID NO: 3341184 - RNA, 15 nt, Mycobacterium tuberculosis H37Rv
gauccucgcccgcac

SEQ ID NO: 3341185 - RNA, 22 nt, Mycobacterium tuberculosis H37Rv
gauccucggccgccaucgcccg

SEQ ID NO: 3341186 - RNA, 17 nt, Mycobacterium tuberculosis H37Rv
gauccuggccacuccca

SEQ ID NO: 3341187 - RNA, 14 nt, Mycobacterium tuberculosis H37Rv
gauccuucgcguug

SEQ ID NO: 3341188 - RNA, 14 nt, Mycobacterium tuberculosis H37Rv
gaucgacaccguga

SEQ ID NO: 3341189 - RNA, 16 nt, Mycobacterium tuberculosis H37Rv
gaucgacaccgugacc

SEQ ID NO: 3341190 - RNA, 24 nt, Mycobacterium tuberculosis H37Rv
gaucgacagccccgcggccagcag

SEQ ID NO: 3341191 - RNA, 21 nt, Mycobacterium tuberculosis H37Rv
gaucgacaguugcgccagcgu

SEQ ID NO: 3341192 - RNA, 15 nt, Mycobacterium tuberculosis H37Rv
gaucgacaucguugg

SEQ ID NO: 3341193 - RNA, 21 nt, Mycobacterium tuberculosis H37Rv
gaucgaccaauucgaccgcgc

SEQ ID NO: 3341194 - RNA, 16 nt, Mycobacterium tuberculosis H37Rv
gaucgaccauggucga

SEQ ID NO: 3341195 - RNA, 16 nt, Mycobacterium tuberculosis H37Rv
gaucgaccgcuggauc

SEQ ID NO: 3341196 - RNA, 15 nt, Mycobacterium tuberculosis H37Rv
gaucgacgccgccac

SEQ ID NO: 3341197 - RNA, 12 nt, Mycobacterium tuberculosis H37Rv
gaucgacggcca

SEQ ID NO: 3341198 - RNA, 14 nt, Mycobacterium tuberculosis H37Rv
gaucgagacuucuu

SEQ ID NO: 3341199 - RNA, 18 nt, Mycobacterium tuberculosis H37Rv
gaucgagagccgaccggg

SEQ ID NO: 3341200 - RNA, 13 nt, Mycobacterium tuberculosis H37Rv
gaucgagcagggu

SEQ ID NO: 3341201 - RNA, 20 nt, Mycobacterium tuberculosis H37Rv
gaucgagcagggugaccagg

SEQ ID NO: 3341202 - RNA, 21 nt, Mycobacterium tuberculosis H37Rv
gaucgagcaguuccagcucgc

SEQ ID NO: 3341203 - RNA, 16 nt, Mycobacterium tuberculosis H37Rv
gaucgaggcggcgguc

SEQ ID NO: 3341204 - RNA, 18 nt, Mycobacterium tuberculosis H37Rv
gaucgagguugacgucag

SEQ ID NO: 3341205 - RNA, 21 nt, Mycobacterium tuberculosis H37Rv
gaucgagguugacgucaggcu

SEQ ID NO: 3341206 - RNA, 18 nt, Mycobacterium tuberculosis H37Rv
gaucgaguuccgcaucgg

SEQ ID NO: 3341207 - RNA, 21 nt, Mycobacterium tuberculosis H37Rv
gaucgauuuggaucggcugcg

SEQ ID NO: 3341208 - RNA, 16 nt, Mycobacterium tuberculosis H37Rv
gaucgcacaccaacac

SEQ ID NO: 3341209 - RNA, 13 nt, Mycobacterium tuberculosis H37Rv
gaucgcagcgcca

SEQ ID NO: 3341210 - RNA, 17 nt, Mycobacterium tuberculosis H37Rv
gaucgcagugagcagcc

SEQ ID NO: 3341211 - RNA, 14 nt, Mycobacterium tuberculosis H37Rv
gaucgcaucgacgu

SEQ ID NO: 3341212 - RNA, 21 nt, Mycobacterium tuberculosis H37Rv
gaucgcaucgacgugcgcggc

SEQ ID NO: 3341213 - RNA, 15 nt, Mycobacterium tuberculosis H37Rv
gaucgccaggccgag

SEQ ID NO: 3341214 - RNA, 15 nt, Mycobacterium tuberculosis H37Rv
gaucgccaggccguc

SEQ ID NO: 3341215 - RNA, 17 nt, Mycobacterium tuberculosis H37Rv
gaucgcccaggcgcgac

SEQ ID NO: 3341216 - RNA, 18 nt, Mycobacterium tuberculosis H37Rv
gaucgccccagccaugcu

SEQ ID NO: 3341217 - RNA, 23 nt, Mycobacterium tuberculosis H37Rv
gaucgcccgaguugaagaagccg

SEQ ID NO: 3341218 - RNA, 20 nt, Mycobacterium tuberculosis H37Rv
gaucgccgaaucggcaguug

SEQ ID NO: 3341219 - RNA, 17 nt, Mycobacterium tuberculosis H37Rv
gaucgccgacgccagaa

SEQ ID NO: 3341220 - RNA, 12 nt, Mycobacterium tuberculosis H37Rv
gaucgccgagca

SEQ ID NO: 3341221 - RNA, 20 nt, Mycobacterium tuberculosis H37Rv
gaucgccgagcaggucggca

SEQ ID NO: 3341222 - RNA, 21 nt, Mycobacterium tuberculosis H37Rv
gaucgccgagcaggucggcaa

SEQ ID NO: 3341223 - RNA, 18 nt, Mycobacterium tuberculosis H37Rv
gaucgccgaggcagcguc

SEQ ID NO: 3341224 - RNA, 22 nt, Mycobacterium tuberculosis H37Rv
gaucgccgaggcagcgucgucg

SEQ ID NO: 3341225 - RNA, 16 nt, Mycobacterium tuberculosis H37Rv
gaucgccgccggcgcc

SEQ ID NO: 3341226 - RNA, 19 nt, Mycobacterium tuberculosis H37Rv
gaucgccgcuaacgcaccu

SEQ ID NO: 3341227 - RNA, 15 nt, Mycobacterium tuberculosis H37Rv
gaucgccggccgcgu

SEQ ID NO: 3341228 - RNA, 20 nt, Mycobacterium tuberculosis H37Rv
gaucgccggccugcucggcg

SEQ ID NO: 3341229 - RNA, 21 nt, Mycobacterium tuberculosis H37Rv
gaucgccggccugcucggcga

SEQ ID NO: 3341230 - RNA, 23 nt, Mycobacterium tuberculosis H37Rv
gaucgccggcuucgcccagagcc

SEQ ID NO: 3341231 - RNA, 18 nt, Mycobacterium tuberculosis H37Rv
gaucgccggugaacaggg

SEQ ID NO: 3341232 - RNA, 15 nt, Mycobacterium tuberculosis H37Rv
gaucgccguccagca

SEQ ID NO: 3341233 - RNA, 13 nt, Mycobacterium tuberculosis H37Rv
gaucgccugggcu

SEQ ID NO: 3341234 - RNA, 20 nt, Mycobacterium tuberculosis H37Rv
gaucgccugggcuuggcgac

SEQ ID NO: 3341235 - RNA, 19 nt, Mycobacterium tuberculosis H37Rv
gaucgcgaacaucgccagc

SEQ ID NO: 3341236 - RNA, 14 nt, Mycobacterium tuberculosis H37Rv
gaucgcgcccugcg

SEQ ID NO: 3341237 - RNA, 17 nt, Mycobacterium tuberculosis H37Rv
gaucgcgcccugcggau

SEQ ID NO: 3341238 - RNA, 23 nt, Mycobacterium tuberculosis H37Rv
gaucgcgcccugcggaucggaca

SEQ ID NO: 3341239 - RNA, 17 nt, Mycobacterium tuberculosis H37Rv
gaucgcgccgggcucgg

SEQ ID NO: 3341240 - RNA, 22 nt, Mycobacterium tuberculosis H37Rv
gaucgcgccgggcucggcguug

SEQ ID NO: 3341241 - RNA, 23 nt, Mycobacterium tuberculosis H37Rv
gaucgcgccgucgucgaccacga

SEQ ID NO: 3341242 - RNA, 14 nt, Mycobacterium tuberculosis H37Rv
gaucgcgcgagcga

SEQ ID NO: 3341243 - RNA, 14 nt, Mycobacterium tuberculosis H37Rv
gaucgcgcgcaccg

SEQ ID NO: 3341244 - RNA, 13 nt, Mycobacterium tuberculosis H37Rv
gaucgcgcugauc

SEQ ID NO: 3341245 - RNA, 19 nt, Mycobacterium tuberculosis H37Rv
gaucgcgcugaucagccca

SEQ ID NO: 3341246 - RNA, 14 nt, Mycobacterium tuberculosis H37Rv
gaucgcgcugcggg

SEQ ID NO: 3341247 - RNA, 18 nt, Mycobacterium tuberculosis H37Rv
gaucgcggcgcccaggaa

SEQ ID NO: 3341248 - RNA, 13 nt, Mycobacterium tuberculosis H37Rv
gaucgcggcggcc

SEQ ID NO: 3341249 - RNA, 19 nt, Mycobacterium tuberculosis H37Rv
gaucgcggcggccuccacc

SEQ ID NO: 3341250 - RNA, 18 nt, Mycobacterium tuberculosis H37Rv
gaucgcgguccaacagcg

SEQ ID NO: 3341251 - RNA, 21 nt, Mycobacterium tuberculosis H37Rv
gaucgcgguccgagcggcauc

SEQ ID NO: 3341252 - RNA, 15 nt, Mycobacterium tuberculosis H37Rv
gaucgcguccuccuc

SEQ ID NO: 3341253 - RNA, 14 nt, Mycobacterium tuberculosis H37Rv
gaucugcugggcaa

SEQ ID NO: 3341254 - RNA, 20 nt, Mycobacterium tuberculosis H37Rv
gaucuggccgaagcccgauc

SEQ ID NO: 3341255 - RNA, 19 nt, Mycobacterium tuberculosis H37Rv
gaucuggcguucagcggcc

SEQ ID NO: 3341256 - RNA, 21 nt, Mycobacterium tuberculosis H37Rv
gaucuggcguucagcggccag

SEQ ID NO: 3341257 - RNA, 14 nt, Mycobacterium tuberculosis H37Rv
gaucugggcgguga

SEQ ID NO: 3341258 - RNA, 22 nt, Mycobacterium tuberculosis H37Rv
gaucugggcuuucgcgugcggc

SEQ ID NO: 3341259 - RNA, 18 nt, Mycobacterium tuberculosis H37Rv
gaucuggucggcggccuc

SEQ ID NO: 3341260 - RNA, 17 nt, Mycobacterium tuberculosis H37Rv
gaucuucgagcgcauca

SEQ ID NO: 3341261 - RNA, 21 nt, Mycobacterium tuberculosis H37Rv
gaucuucugccuuggccggcu

SEQ ID NO: 3341262 - RNA, 17 nt, Mycobacterium tuberculosis H37Rv
gaucuugacgaaaucca

SEQ ID NO: 3341263 - RNA, 13 nt, Mycobacterium tuberculosis H37Rv
gaucuugacgguc

SEQ ID NO: 3341264 - RNA, 22 nt, Mycobacterium tuberculosis H37Rv
gaucuugccgccgcgccggcag

SEQ ID NO: 3341265 - RNA, 18 nt, Mycobacterium tuberculosis H37Rv
gaucuugccggccagcag

SEQ ID NO: 3341266 - RNA, 15 nt, Mycobacterium tuberculosis H37Rv
gaucuugguguuggu

SEQ ID NO: 3341267 - RNA, 18 nt, Mycobacterium tuberculosis H37Rv
gaucuugucgcguucggc

SEQ ID NO: 3341268 - RNA, 13 nt, Mycobacterium tuberculosis H37Rv
gaugaaacgccgu

SEQ ID NO: 3341269 - RNA, 17 nt, Mycobacterium tuberculosis H37Rv
gaugaaccacggcaggc

SEQ ID NO: 3341270 - RNA, 12 nt, Mycobacterium tuberculosis H37Rv
gaugaaccaggc

SEQ ID NO: 3341271 - RNA, 13 nt, Mycobacterium tuberculosis H37Rv
gaugaaccaggcg

SEQ ID NO: 3341272 - RNA, 16 nt, Mycobacterium tuberculosis H37Rv
gaugaacucggcgauc

SEQ ID NO: 3341273 - RNA, 20 nt, Mycobacterium tuberculosis H37Rv
gaugaaggugacgacgaggg

SEQ ID NO: 3341274 - RNA, 22 nt, Mycobacterium tuberculosis H37Rv
gaugaaguguuuggcguugggc

SEQ ID NO: 3341275 - RNA, 21 nt, Mycobacterium tuberculosis H37Rv
gaugaauucauguggcgcggg

SEQ ID NO: 3341276 - RNA, 20 nt, Mycobacterium tuberculosis H37Rv
gaugacaaagaaguggucgg

SEQ ID NO: 3341277 - RNA, 18 nt, Mycobacterium tuberculosis H37Rv
gaugaccagggucugcuc

SEQ ID NO: 3341278 - RNA, 13 nt, Mycobacterium tuberculosis H37Rv
gaugaccagugau

SEQ ID NO: 3341279 - RNA, 19 nt, Mycobacterium tuberculosis H37Rv
gaugaccaugaugaccggc

SEQ ID NO: 3341280 - RNA, 14 nt, Mycobacterium tuberculosis H37Rv
gaugacccacugca

SEQ ID NO: 3341281 - RNA, 15 nt, Mycobacterium tuberculosis H37Rv
gaugacccggaaucc

SEQ ID NO: 3341282 - RNA, 20 nt, Mycobacterium tuberculosis H37Rv
gaugacccggaaucccgagu

SEQ ID NO: 3341283 - RNA, 24 nt, Mycobacterium tuberculosis H37Rv
gaugacccggaaucccgagucugc

SEQ ID NO: 3341284 - RNA, 19 nt, Mycobacterium tuberculosis H37Rv
gaugaccgaaccuggucuu

SEQ ID NO: 3341285 - RNA, 13 nt, Mycobacterium tuberculosis H37Rv
gaugaccgcagca

SEQ ID NO: 3341286 - RNA, 21 nt, Mycobacterium tuberculosis H37Rv
gaugaccgccaucgccaacac

SEQ ID NO: 3341287 - RNA, 20 nt, Mycobacterium tuberculosis H37Rv
gaugaccgcguagagcagca

SEQ ID NO: 3341288 - RNA, 21 nt, Mycobacterium tuberculosis H37Rv
gaugaccgguauuaccgccgu

SEQ ID NO: 3341289 - RNA, 15 nt, Mycobacterium tuberculosis H37Rv
gaugacgaccgaucg

SEQ ID NO: 3341290 - RNA, 15 nt, Mycobacterium tuberculosis H37Rv
gaugacgcagucgcc

SEQ ID NO: 3341291 - RNA, 16 nt, Mycobacterium tuberculosis H37Rv
gaugacgcagucgccc

SEQ ID NO: 3341292 - RNA, 17 nt, Mycobacterium tuberculosis H37Rv
gaugacgcagucgccca

SEQ ID NO: 3341293 - RNA, 23 nt, Mycobacterium tuberculosis H37Rv
gaugacgcccagggcgucggcga

SEQ ID NO: 3341294 - RNA, 17 nt, Mycobacterium tuberculosis H37Rv
gaugacggugccgaccg

SEQ ID NO: 3341295 - RNA, 17 nt, Mycobacterium tuberculosis H37Rv
gaugacguugcagccgg

SEQ ID NO: 3341296 - RNA, 15 nt, Mycobacterium tuberculosis H37Rv
gaugacuagccugcu

SEQ ID NO: 3341297 - RNA, 21 nt, Mycobacterium tuberculosis H37Rv
gaugagccgauccaggaguga

SEQ ID NO: 3341298 - RNA, 15 nt, Mycobacterium tuberculosis H37Rv
gaugagccgcagaug

SEQ ID NO: 3341299 - RNA, 15 nt, Mycobacterium tuberculosis H37Rv
gaugaggaucaucga

SEQ ID NO: 3341300 - RNA, 14 nt, Mycobacterium tuberculosis H37Rv
gaugaggcccauca

SEQ ID NO: 3341301 - RNA, 22 nt, Mycobacterium tuberculosis H37Rv
gaugaggcgccauuugggccca

SEQ ID NO: 3341302 - RNA, 23 nt, Mycobacterium tuberculosis H37Rv
gaugagggcuuguggugagcgga

SEQ ID NO: 3341303 - RNA, 16 nt, Mycobacterium tuberculosis H37Rv
gaugagguggccgcgc

SEQ ID NO: 3341304 - RNA, 19 nt, Mycobacterium tuberculosis H37Rv
gaugagguucaucgccggc

SEQ ID NO: 3341305 - RNA, 22 nt, Mycobacterium tuberculosis H37Rv
gaugaucgcgaacaucgccagc

SEQ ID NO: 3341306 - RNA, 19 nt, Mycobacterium tuberculosis H37Rv
gaugaucuugccgcggcgc

SEQ ID NO: 3341307 - RNA, 16 nt, Mycobacterium tuberculosis H37Rv
gaugaugacggcggcc

SEQ ID NO: 3341308 - RNA, 18 nt, Mycobacterium tuberculosis H37Rv
gaugaugacggcggcccg

SEQ ID NO: 3341309 - RNA, 19 nt, Mycobacterium tuberculosis H37Rv
gaugaugcccaacgacaug

SEQ ID NO: 3341310 - RNA, 16 nt, Mycobacterium tuberculosis H37Rv
gaugaugccggcguug

SEQ ID NO: 3341311 - RNA, 17 nt, Mycobacterium tuberculosis H37Rv
gaugaugcgugaccagu

SEQ ID NO: 3341312 - RNA, 15 nt, Mycobacterium tuberculosis H37Rv
gaugaugugcgguga

SEQ ID NO: 3341313 - RNA, 14 nt, Mycobacterium tuberculosis H37Rv
gaugauguggugug

SEQ ID NO: 3341314 - RNA, 22 nt, Mycobacterium tuberculosis H37Rv
gaugauguggugugccugcguc

SEQ ID NO: 3341315 - RNA, 19 nt, Mycobacterium tuberculosis H37Rv
gaugauguuuuccccgccc

SEQ ID NO: 3341316 - RNA, 14 nt, Mycobacterium tuberculosis H37Rv
gaugcaacccggug

SEQ ID NO: 3341317 - RNA, 22 nt, Mycobacterium tuberculosis H37Rv
gaugcaacucggcagauugucg

SEQ ID NO: 3341318 - RNA, 17 nt, Mycobacterium tuberculosis H37Rv
gaugcaagcgggcauga

SEQ ID NO: 3341319 - RNA, 21 nt, Mycobacterium tuberculosis H37Rv
gaugcacaaccgcugcugcug

SEQ ID NO: 3341320 - RNA, 16 nt, Mycobacterium tuberculosis H37Rv
gaugcacaggccgacg

SEQ ID NO: 3341321 - RNA, 21 nt, Mycobacterium tuberculosis H37Rv
gaugcaccucgcccugcagac

SEQ ID NO: 3341322 - RNA, 12 nt, Mycobacterium tuberculosis H37Rv
gaugcacgucga

SEQ ID NO: 3341323 - RNA, 16 nt, Mycobacterium tuberculosis H37Rv
gaugcagugcgacccg

SEQ ID NO: 3341324 - RNA, 21 nt, Mycobacterium tuberculosis H37Rv
gaugcaucccaacgagaugug

SEQ ID NO: 3341325 - RNA, 22 nt, Mycobacterium tuberculosis H37Rv
gaugcauggcuugcucugcgca

SEQ ID NO: 3341326 - RNA, 19 nt, Mycobacterium tuberculosis H37Rv
gaugcaugucuuguggugg

SEQ ID NO: 3341327 - RNA, 19 nt, Mycobacterium tuberculosis H37Rv
gaugccagugcaucgguca

SEQ ID NO: 3341328 - RNA, 19 nt, Mycobacterium tuberculosis H37Rv
gaugccaucaacgacuucg

SEQ ID NO: 3341329 - RNA, 18 nt, Mycobacterium tuberculosis H37Rv
gaugcccacggugccggc

SEQ ID NO: 3341330 - RNA, 16 nt, Mycobacterium tuberculosis H37Rv
gaugccccacggugcg

SEQ ID NO: 3341331 - RNA, 17 nt, Mycobacterium tuberculosis H37Rv
gaugccccuucaaagcg

SEQ ID NO: 3341332 - RNA, 13 nt, Mycobacterium tuberculosis H37Rv
gaugcccgcgauc

SEQ ID NO: 3341333 - RNA, 20 nt, Mycobacterium tuberculosis H37Rv
gaugcccuccucgaccgcgg

SEQ ID NO: 3341334 - RNA, 17 nt, Mycobacterium tuberculosis H37Rv
gaugcccucgauggcca

SEQ ID NO: 3341335 - RNA, 22 nt, Mycobacterium tuberculosis H37Rv
gaugcccuugagaucggaaccc

SEQ ID NO: 3341336 - RNA, 23 nt, Mycobacterium tuberculosis H37Rv
gaugccgaacuccgcggaaccca

SEQ ID NO: 3341337 - RNA, 15 nt, Mycobacterium tuberculosis H37Rv
gaugccgacggcggg

SEQ ID NO: 3341338 - RNA, 19 nt, Mycobacterium tuberculosis H37Rv
gaugccgacggcgggcgau

SEQ ID NO: 3341339 - RNA, 16 nt, Mycobacterium tuberculosis H37Rv
gaugccgccggcaccg

SEQ ID NO: 3341340 - RNA, 19 nt, Mycobacterium tuberculosis H37Rv
gaugccgccggcaccgccg

SEQ ID NO: 3341341 - RNA, 12 nt, Mycobacterium tuberculosis H37Rv
gaugccgcggga

SEQ ID NO: 3341342 - RNA, 19 nt, Mycobacterium tuberculosis H37Rv
gaugccggacagcucgcgc

SEQ ID NO: 3341343 - RNA, 15 nt, Mycobacterium tuberculosis H37Rv
gaugccggacgccau

SEQ ID NO: 3341344 - RNA, 20 nt, Mycobacterium tuberculosis H37Rv
gaugccggcgaaggccagca

SEQ ID NO: 3341345 - RNA, 15 nt, Mycobacterium tuberculosis H37Rv
gaugccggcgagggc

SEQ ID NO: 3341346 - RNA, 23 nt, Mycobacterium tuberculosis H37Rv
gaugccggcgccggcccgcagcc

SEQ ID NO: 3341347 - RNA, 22 nt, Mycobacterium tuberculosis H37Rv
gaugccggcuagauaacccaac

SEQ ID NO: 3341348 - RNA, 22 nt, Mycobacterium tuberculosis H37Rv
gaugccgggcugaggcggcgac

SEQ ID NO: 3341349 - RNA, 17 nt, Mycobacterium tuberculosis H37Rv
gaugggcaugguggugg

SEQ ID NO: 3341350 - RNA, 21 nt, Mycobacterium tuberculosis H37Rv
gaugggccaggcgcccagcac

SEQ ID NO: 3341351 - RNA, 23 nt, Mycobacterium tuberculosis H37Rv
gaugggccgguuccucagcggcc

SEQ ID NO: 3341352 - RNA, 21 nt, Mycobacterium tuberculosis H37Rv
gaugggcgaauugcaggacgc

SEQ ID NO: 3341353 - RNA, 15 nt, Mycobacterium tuberculosis H37Rv
gaugggcgucgguca

SEQ ID NO: 3341354 - RNA, 23 nt, Mycobacterium tuberculosis H37Rv
gauggggaacggguagugcacgg

SEQ ID NO: 3341355 - RNA, 17 nt, Mycobacterium tuberculosis H37Rv
gaugggggagccgguga

SEQ ID NO: 3341356 - RNA, 17 nt, Mycobacterium tuberculosis H37Rv
gauggguaccgcgggga

SEQ ID NO: 3341357 - RNA, 15 nt, Mycobacterium tuberculosis H37Rv
gaugggucaggccga

SEQ ID NO: 3341358 - RNA, 19 nt, Mycobacterium tuberculosis H37Rv
gaugggucgaccggaaugc

SEQ ID NO: 3341359 - RNA, 12 nt, Mycobacterium tuberculosis H37Rv
gaugggugcacc

SEQ ID NO: 3341360 - RNA, 14 nt, Mycobacterium tuberculosis H37Rv
gaugguacucaggu

SEQ ID NO: 3341361 - RNA, 16 nt, Mycobacterium tuberculosis H37Rv
gauggucaaugccggc

SEQ ID NO: 3341362 - RNA, 19 nt, Mycobacterium tuberculosis H37Rv
gauggucaaugcgcuggcg

SEQ ID NO: 3341363 - RNA, 17 nt, Mycobacterium tuberculosis H37Rv
gauggucagcagcucca

SEQ ID NO: 3341364 - RNA, 20 nt, Mycobacterium tuberculosis H37Rv
gauggucccgagggcggcag

SEQ ID NO: 3341365 - RNA, 16 nt, Mycobacterium tuberculosis H37Rv
gaugguccgccagauc

SEQ ID NO: 3341366 - RNA, 19 nt, Mycobacterium tuberculosis H37Rv
gauggucgagagcaccgca

SEQ ID NO: 3341367 - RNA, 22 nt, Mycobacterium tuberculosis H37Rv
gauggucuccggacgcacgauc

SEQ ID NO: 3341368 - RNA, 15 nt, Mycobacterium tuberculosis H37Rv
gauggugaccagcag

SEQ ID NO: 3341369 - RNA, 22 nt, Mycobacterium tuberculosis H37Rv
gauggugaugggggagccggug

SEQ ID NO: 3341370 - RNA, 14 nt, Mycobacterium tuberculosis H37Rv
gauggugccgaccc

SEQ ID NO: 3341371 - RNA, 22 nt, Mycobacterium tuberculosis H37Rv
gauggugcggcccaaccggucg

SEQ ID NO: 3341372 - RNA, 19 nt, Mycobacterium tuberculosis H37Rv
gauggugcggccgcggcga

SEQ ID NO: 3341373 - RNA, 21 nt, Mycobacterium tuberculosis H37Rv
gaugguggugccaaccugggc

SEQ ID NO: 3341374 - RNA, 17 nt, Mycobacterium tuberculosis H37Rv
gaugguggugccgaccu

SEQ ID NO: 3341375 - RNA, 23 nt, Mycobacterium tuberculosis H37Rv
gaugguguacugcugcuugagcu

SEQ ID NO: 3341376 - RNA, 17 nt, Mycobacterium tuberculosis H37Rv
gaugguguccucgucga

SEQ ID NO: 3341377 - RNA, 20 nt, Mycobacterium tuberculosis H37Rv
gaugguguccucgucgaggu

SEQ ID NO: 3341378 - RNA, 16 nt, Mycobacterium tuberculosis H37Rv
gauggugugcagcagc

SEQ ID NO: 3341379 - RNA, 15 nt, Mycobacterium tuberculosis H37Rv
gaugguucuggaucc

SEQ ID NO: 3341380 - RNA, 14 nt, Mycobacterium tuberculosis H37Rv
gaugguuggaucgc

SEQ ID NO: 3341381 - RNA, 14 nt, Mycobacterium tuberculosis H37Rv
gauguaaugcgggc

SEQ ID NO: 3341382 - RNA, 14 nt, Mycobacterium tuberculosis H37Rv
gauguaccccagcg

SEQ ID NO: 3341383 - RNA, 14 nt, Mycobacterium tuberculosis H37Rv
gauguacccggcga

SEQ ID NO: 3341384 - RNA, 16 nt, Mycobacterium tuberculosis H37Rv
gauguaccucaucgca

SEQ ID NO: 3341385 - RNA, 17 nt, Mycobacterium tuberculosis H37Rv
gauguaguccucggugg

SEQ ID NO: 3341386 - RNA, 16 nt, Mycobacterium tuberculosis H37Rv
gaugucaacgugguca

SEQ ID NO: 3341387 - RNA, 17 nt, Mycobacterium tuberculosis H37Rv
gaugucagcggccgcga

SEQ ID NO: 3341388 - RNA, 20 nt, Mycobacterium tuberculosis H37Rv
gaugucagugaucaccaacc

SEQ ID NO: 3341389 - RNA, 13 nt, Mycobacterium tuberculosis H37Rv
gauguccaggagu

SEQ ID NO: 3341390 - RNA, 19 nt, Mycobacterium tuberculosis H37Rv
gauguccaggagugcgggc

SEQ ID NO: 3341391 - RNA, 15 nt, Mycobacterium tuberculosis H37Rv
gauguccagguggcg

SEQ ID NO: 3341392 - RNA, 14 nt, Mycobacterium tuberculosis H37Rv
gauguccccgacgg

SEQ ID NO: 3341393 - RNA, 16 nt, Mycobacterium tuberculosis H37Rv
gauguccgacgcacca

SEQ ID NO: 3341394 - RNA, 19 nt, Mycobacterium tuberculosis H37Rv
gauguccgacgccaccgcc

SEQ ID NO: 3341395 - RNA, 13 nt, Mycobacterium tuberculosis H37Rv
gauguccgcagca

SEQ ID NO: 3341396 - RNA, 14 nt, Mycobacterium tuberculosis H37Rv
gauguccgcagcac

SEQ ID NO: 3341397 - RNA, 15 nt, Mycobacterium tuberculosis H37Rv
gauguccgcagcacc

SEQ ID NO: 3341398 - RNA, 20 nt, Mycobacterium tuberculosis H37Rv
gauguccgcagcaccgucgg

SEQ ID NO: 3341399 - RNA, 18 nt, Mycobacterium tuberculosis H37Rv
gauguccgcggccaccac

SEQ ID NO: 3341400 - RNA, 16 nt, Mycobacterium tuberculosis H37Rv
gauguccggguaccga

SEQ ID NO: 3341401 - RNA, 16 nt, Mycobacterium tuberculosis H37Rv
gauguccucgacaccc

SEQ ID NO: 3341402 - RNA, 17 nt, Mycobacterium tuberculosis H37Rv
gauguccucgacaccca

SEQ ID NO: 3341403 - RNA, 14 nt, Mycobacterium tuberculosis H37Rv
gauguccucgaugc

SEQ ID NO: 3341404 - RNA, 18 nt, Mycobacterium tuberculosis H37Rv
gauguccucgaugcgggc

SEQ ID NO: 3341405 - RNA, 14 nt, Mycobacterium tuberculosis H37Rv
gaugucgacgacaa

SEQ ID NO: 3341406 - RNA, 19 nt, Mycobacterium tuberculosis H37Rv
gaugucgcggucgaggucc

SEQ ID NO: 3341407 - RNA, 22 nt, Mycobacterium tuberculosis H37Rv
gaugucggacacauggucgcga

SEQ ID NO: 3341408 - RNA, 14 nt, Mycobacterium tuberculosis H37Rv
gaugucgugcgggc

SEQ ID NO: 3341409 - RNA, 15 nt, Mycobacterium tuberculosis H37Rv
gaugucguucgcguc

SEQ ID NO: 3341410 - RNA, 17 nt, Mycobacterium tuberculosis H37Rv
gaugucucggcaccaca

SEQ ID NO: 3341411 - RNA, 13 nt, Mycobacterium tuberculosis H37Rv
gaugucuuccugc

SEQ ID NO: 3341412 - RNA, 14 nt, Mycobacterium tuberculosis H37Rv
gaugugaccgaaca

SEQ ID NO: 3341413 - RNA, 19 nt, Mycobacterium tuberculosis H37Rv
gaugugacuuauccggcca

SEQ ID NO: 3341414 - RNA, 22 nt, Mycobacterium tuberculosis H37Rv
gaugugagcacaccgacagcac

SEQ ID NO: 3341415 - RNA, 15 nt, Mycobacterium tuberculosis H37Rv
gaugugaguccagcc

SEQ ID NO: 3341416 - RNA, 21 nt, Mycobacterium tuberculosis H37Rv
gaugugcccggcucucagcga

SEQ ID NO: 3341417 - RNA, 20 nt, Mycobacterium tuberculosis H37Rv
gaugugccgauuggccugcc

SEQ ID NO: 3341418 - RNA, 22 nt, Mycobacterium tuberculosis H37Rv
gaugugcucaggucgcagacca

SEQ ID NO: 3341419 - RNA, 14 nt, Mycobacterium tuberculosis H37Rv
gaugugcucgguac

SEQ ID NO: 3341420 - RNA, 16 nt, Mycobacterium tuberculosis H37Rv
gaugugggcgcucgca

SEQ ID NO: 3341421 - RNA, 17 nt, Mycobacterium tuberculosis H37Rv
gaugugguccaucgcgc

SEQ ID NO: 3341422 - RNA, 15 nt, Mycobacterium tuberculosis H37Rv
gauguggucggacag

SEQ ID NO: 3341423 - RNA, 15 nt, Mycobacterium tuberculosis H37Rv
gauguggugugccug

SEQ ID NO: 3341424 - RNA, 17 nt, Mycobacterium tuberculosis H37Rv
gaugugguuggugcugg

SEQ ID NO: 3341425 - RNA, 19 nt, Mycobacterium tuberculosis H37Rv
gauguuacacuaaccgaau

SEQ ID NO: 3341426 - RNA, 20 nt, Mycobacterium tuberculosis H37Rv
gauguugcagaacucgcgua

SEQ ID NO: 3341427 - RNA, 15 nt, Mycobacterium tuberculosis H37Rv
gauuaccagcggcac

SEQ ID NO: 3341428 - RNA, 17 nt, Mycobacterium tuberculosis H37Rv
gauuacgccggaggcau

SEQ ID NO: 3341429 - RNA, 18 nt, Mycobacterium tuberculosis H37Rv
gauuauucgcgguagccg

SEQ ID NO: 3341430 - RNA, 20 nt, Mycobacterium tuberculosis H37Rv
gauucaucaacacgacguca

SEQ ID NO: 3341431 - RNA, 12 nt, Mycobacterium tuberculosis H37Rv
gauucauggcgg

SEQ ID NO: 3341432 - RNA, 13 nt, Mycobacterium tuberculosis H37Rv
gauucauggcggc

SEQ ID NO: 3341433 - RNA, 19 nt, Mycobacterium tuberculosis H37Rv
gauuccaccuuggccagac

SEQ ID NO: 3341434 - RNA, 19 nt, Mycobacterium tuberculosis H37Rv
gauucccgcccagcagcac

SEQ ID NO: 3341435 - RNA, 20 nt, Mycobacterium tuberculosis H37Rv
gauucccgcccagcagcacc

SEQ ID NO: 3341436 - RNA, 22 nt, Mycobacterium tuberculosis H37Rv
gauuccgcacccccgucgauca

SEQ ID NO: 3341437 - RNA, 18 nt, Mycobacterium tuberculosis H37Rv
gauuccggcggccacgcc

SEQ ID NO: 3341438 - RNA, 16 nt, Mycobacterium tuberculosis H37Rv
gauucgaaggcaccua

SEQ ID NO: 3341439 - RNA, 15 nt, Mycobacterium tuberculosis H37Rv
gauucgagccacaug

SEQ ID NO: 3341440 - RNA, 14 nt, Mycobacterium tuberculosis H37Rv
gauucgcgcugcuu

SEQ ID NO: 3341441 - RNA, 14 nt, Mycobacterium tuberculosis H37Rv
gauucggcagcggc

SEQ ID NO: 3341442 - RNA, 18 nt, Mycobacterium tuberculosis H37Rv
gauucgggcgccgcagcg

SEQ ID NO: 3341443 - RNA, 17 nt, Mycobacterium tuberculosis H37Rv
gauucgggcuucuccau

SEQ ID NO: 3341444 - RNA, 15 nt, Mycobacterium tuberculosis H37Rv
gauucgugucggugc

SEQ ID NO: 3341445 - RNA, 12 nt, Mycobacterium tuberculosis H37Rv
gcaaccagcagc

SEQ ID NO: 3341446 - RNA, 16 nt, Mycobacterium tuberculosis H37Rv
gcaaccagcagcaggu

SEQ ID NO: 3341447 - RNA, 20 nt, Mycobacterium tuberculosis H37Rv
gcaaccauuagcgccaagcc

SEQ ID NO: 3341448 - RNA, 22 nt, Mycobacterium tuberculosis H37Rv
gcaacccacacgcccucgacgc

SEQ ID NO: 3341449 - RNA, 16 nt, Mycobacterium tuberculosis H37Rv
gcaacccagccgcgcc

SEQ ID NO: 3341450 - RNA, 21 nt, Mycobacterium tuberculosis H37Rv
gcaaccccaaguccagcagcg

SEQ ID NO: 3341451 - RNA, 14 nt, Mycobacterium tuberculosis H37Rv
gcaacccgccguug

SEQ ID NO: 3341452 - RNA, 19 nt, Mycobacterium tuberculosis H37Rv
gcaacccgccguugccacc

SEQ ID NO: 3341453 - RNA, 21 nt, Mycobacterium tuberculosis H37Rv
gcaacccggucggcagcuggg

SEQ ID NO: 3341454 - RNA, 14 nt, Mycobacterium tuberculosis H37Rv
gcaacccguugugg

SEQ ID NO: 3341455 - RNA, 16 nt, Mycobacterium tuberculosis H37Rv
gcaacccugccgcgau

SEQ ID NO: 3341456 - RNA, 14 nt, Mycobacterium tuberculosis H37Rv
gcaacccugcggug

SEQ ID NO: 3341457 - RNA, 19 nt, Mycobacterium tuberculosis H37Rv
gcaaccgaugacgcguuca

SEQ ID NO: 3341458 - RNA, 13 nt, Mycobacterium tuberculosis H37Rv
gcaaccgccaucg

SEQ ID NO: 3341459 - RNA, 17 nt, Mycobacterium tuberculosis H37Rv
gcaaccgccaucgucga

SEQ ID NO: 3341460 - RNA, 17 nt, Mycobacterium tuberculosis H37Rv
gcaaccgccggugccga

SEQ ID NO: 3341461 - RNA, 19 nt, Mycobacterium tuberculosis H37Rv
gcaaccgccgugugccacg

SEQ ID NO: 3341462 - RNA, 14 nt, Mycobacterium tuberculosis H37Rv
gcaaccgcucggcg

SEQ ID NO: 3341463 - RNA, 18 nt, Mycobacterium tuberculosis H37Rv
gcaaccggagaucccggu

SEQ ID NO: 3341464 - RNA, 16 nt, Mycobacterium tuberculosis H37Rv
gcaaccggcgugucga

SEQ ID NO: 3341465 - RNA, 18 nt, Mycobacterium tuberculosis H37Rv
gcaaccgggaggccaccg

SEQ ID NO: 3341466 - RNA, 19 nt, Mycobacterium tuberculosis H37Rv
gcaaccgggaggccaccgc

SEQ ID NO: 3341467 - RNA, 18 nt, Mycobacterium tuberculosis H37Rv
gcaaccgguaucgccgcu

SEQ ID NO: 3341468 - RNA, 14 nt, Mycobacterium tuberculosis H37Rv
gcaaccgguggaug

SEQ ID NO: 3341469 - RNA, 17 nt, Mycobacterium tuberculosis H37Rv
gcaaccgugccgcauca

SEQ ID NO: 3341470 - RNA, 20 nt, Mycobacterium tuberculosis H37Rv
gcaaccgugccgcaucaccc

SEQ ID NO: 3341471 - RNA, 21 nt, Mycobacterium tuberculosis H37Rv
gcaaccgugccgcaucacccg

SEQ ID NO: 3341472 - RNA, 20 nt, Mycobacterium tuberculosis H37Rv
gcaaccuaaauugccgggcc

SEQ ID NO: 3341473 - RNA, 23 nt, Mycobacterium tuberculosis H37Rv
gcaaccucaugcacgccguagca

SEQ ID NO: 3341474 - RNA, 23 nt, Mycobacterium tuberculosis H37Rv
gcaaccucgguugguccucggcg

SEQ ID NO: 3341475 - RNA, 15 nt, Mycobacterium tuberculosis H37Rv
gcaaccugccgggcc

SEQ ID NO: 3341476 - RNA, 21 nt, Mycobacterium tuberculosis H37Rv
gcaaccugccgggccacggcu

SEQ ID NO: 3341477 - RNA, 22 nt, Mycobacterium tuberculosis H37Rv
gcaaccuggacugcagcgccuc

SEQ ID NO: 3341478 - RNA, 16 nt, Mycobacterium tuberculosis H37Rv
gcaacgaagagggcgc

SEQ ID NO: 3341479 - RNA, 22 nt, Mycobacterium tuberculosis H37Rv
gcaacgaagagggcgccgcgcg

SEQ ID NO: 3341480 - RNA, 13 nt, Mycobacterium tuberculosis H37Rv
gcaacgacacgcc

SEQ ID NO: 3341481 - RNA, 16 nt, Mycobacterium tuberculosis H37Rv
gcaacgacauccagau

SEQ ID NO: 3341482 - RNA, 17 nt, Mycobacterium tuberculosis H37Rv
gcaacgacccgccgccc

SEQ ID NO: 3341483 - RNA, 23 nt, Mycobacterium tuberculosis H37Rv
gcaacgaucagguuggcggcugc

SEQ ID NO: 3341484 - RNA, 12 nt, Mycobacterium tuberculosis H37Rv
gcaacgaucgac

SEQ ID NO: 3341485 - RNA, 15 nt, Mycobacterium tuberculosis H37Rv
gcaacgaucgacacc

SEQ ID NO: 3341486 - RNA, 17 nt, Mycobacterium tuberculosis H37Rv
gcaacgcaaucgucgcc

SEQ ID NO: 3341487 - RNA, 12 nt, Mycobacterium tuberculosis H37Rv
gcaacgcaucga

SEQ ID NO: 3341488 - RNA, 18 nt, Mycobacterium tuberculosis H37Rv
gcaacgccauaccagcgu

SEQ ID NO: 3341489 - RNA, 23 nt, Mycobacterium tuberculosis H37Rv
gcaacgcccaacgucgccagguc

SEQ ID NO: 3341490 - RNA, 18 nt, Mycobacterium tuberculosis H37Rv
gcaacgcgaaccggccau

SEQ ID NO: 3341491 - RNA, 21 nt, Mycobacterium tuberculosis H37Rv
gcaacgcgaucaccucgccac

SEQ ID NO: 3341492 - RNA, 22 nt, Mycobacterium tuberculosis H37Rv
gcaacgcggccuugcgcacagg

SEQ ID NO: 3341493 - RNA, 19 nt, Mycobacterium tuberculosis H37Rv
gcaacgcggcgaagugcac

SEQ ID NO: 3341494 - RNA, 19 nt, Mycobacterium tuberculosis H37Rv
gcaacgcguauucggcauc

SEQ ID NO: 3341495 - RNA, 20 nt, Mycobacterium tuberculosis H37Rv
gcaacgcguauucggcaucg

SEQ ID NO: 3341496 - RNA, 18 nt, Mycobacterium tuberculosis H37Rv
gcaacgcuucggcagcuc

SEQ ID NO: 3341497 - RNA, 14 nt, Mycobacterium tuberculosis H37Rv
gcaacggcagcgug

SEQ ID NO: 3341498 - RNA, 18 nt, Mycobacterium tuberculosis H37Rv
gcaacggcgcgccgacca

SEQ ID NO: 3341499 - RNA, 20 nt, Mycobacterium tuberculosis H37Rv
gcaacggcgcgccgaccacc

SEQ ID NO: 3341500 - RNA, 21 nt, Mycobacterium tuberculosis H37Rv
gcaacggcggggccggcggcu

SEQ ID NO: 3341501 - RNA, 22 nt, Mycobacterium tuberculosis H37Rv
gcaacggcggggccggcggcuc

SEQ ID NO: 3341502 - RNA, 23 nt, Mycobacterium tuberculosis H37Rv
gcaacggcguuuucaauuucacu

SEQ ID NO: 3341503 - RNA, 16 nt, Mycobacterium tuberculosis H37Rv
gcaacgggacgucacc

SEQ ID NO: 3341504 - RNA, 17 nt, Mycobacterium tuberculosis H37Rv
gcaacgggacgucaccg

SEQ ID NO: 3341505 - RNA, 14 nt, Mycobacterium tuberculosis H37Rv
gcaacgggucgggu

SEQ ID NO: 3341506 - RNA, 19 nt, Mycobacterium tuberculosis H37Rv
gcaacgggucgguccacuu

SEQ ID NO: 3341507 - RNA, 16 nt, Mycobacterium tuberculosis H37Rv
gcaacgguuggucgaa

SEQ ID NO: 3341508 - RNA, 21 nt, Mycobacterium tuberculosis H37Rv
gcaacguagccagcagcggcu

SEQ ID NO: 3341509 - RNA, 22 nt, Mycobacterium tuberculosis H37Rv
gcaacguagccagcagcggcuc

SEQ ID NO: 3341510 - RNA, 18 nt, Mycobacterium tuberculosis H37Rv
gcaacgugugcaccauca

SEQ ID NO: 3341511 - RNA, 21 nt, Mycobacterium tuberculosis H37Rv
gcaacguguuaaccgggcacg

SEQ ID NO: 3341512 - RNA, 22 nt, Mycobacterium tuberculosis H37Rv
gcaacguuuacgaugcucagcu

SEQ ID NO: 3341513 - RNA, 19 nt, Mycobacterium tuberculosis H37Rv
gcaacuacggcguccccga

SEQ ID NO: 3341514 - RNA, 16 nt, Mycobacterium tuberculosis H37Rv
gcaacuacucauccag

SEQ ID NO: 3341515 - RNA, 16 nt, Mycobacterium tuberculosis H37Rv
gcaacuagccgcugcc

SEQ ID NO: 3341516 - RNA, 20 nt, Mycobacterium tuberculosis H37Rv
gcaacuccggucaacacccg

SEQ ID NO: 3341517 - RNA, 15 nt, Mycobacterium tuberculosis H37Rv
gcaacucgaucgccu

SEQ ID NO: 3341518 - RNA, 20 nt, Mycobacterium tuberculosis H37Rv
gcaacucgaucgccugagac

SEQ ID NO: 3341519 - RNA, 23 nt, Mycobacterium tuberculosis H37Rv
gcaacucggccacggcgucggcc

SEQ ID NO: 3341520 - RNA, 15 nt, Mycobacterium tuberculosis H37Rv
gcaacucguccagca

SEQ ID NO: 3341521 - RNA, 17 nt, Mycobacterium tuberculosis H37Rv
gcaacucguccagcagu

SEQ ID NO: 3341522 - RNA, 18 nt, Mycobacterium tuberculosis H37Rv
gcaacucguccagcagug

SEQ ID NO: 3341523 - RNA, 15 nt, Mycobacterium tuberculosis H37Rv
gcaacugggcggccu

SEQ ID NO: 3341524 - RNA, 23 nt, Mycobacterium tuberculosis H37Rv
gcaacuucuucagcagcggcgga

SEQ ID NO: 3341525 - RNA, 18 nt, Mycobacterium tuberculosis H37Rv
gcaagaaaguuccacgac

SEQ ID NO: 3341526 - RNA, 22 nt, Mycobacterium tuberculosis H37Rv
gcaagaaccgugucgccgccgc

SEQ ID NO: 3341527 - RNA, 12 nt, Mycobacterium tuberculosis H37Rv
gcaagaaucagc

SEQ ID NO: 3341528 - RNA, 15 nt, Mycobacterium tuberculosis H37Rv
gcaagaaucagcagc

SEQ ID NO: 3341529 - RNA, 22 nt, Mycobacterium tuberculosis H37Rv
gcaagaccgcguuccgggccgg

SEQ ID NO: 3341530 - RNA, 19 nt, Mycobacterium tuberculosis H37Rv
gcaagaccguuacaccauc

SEQ ID NO: 3341531 - RNA, 14 nt, Mycobacterium tuberculosis H37Rv
gcaagacgaugaca

SEQ ID NO: 3341532 - RNA, 20 nt, Mycobacterium tuberculosis H37Rv
gcaagagccgcagccacguc

SEQ ID NO: 3341533 - RNA, 15 nt, Mycobacterium tuberculosis H37Rv
gcaagaucaccuucg

SEQ ID NO: 3341534 - RNA, 12 nt, Mycobacterium tuberculosis H37Rv
gcaagcacaccg

SEQ ID NO: 3341535 - RNA, 20 nt, Mycobacterium tuberculosis H37Rv
gcaagcacaccgccagcggc

SEQ ID NO: 3341536 - RNA, 20 nt, Mycobacterium tuberculosis H37Rv
gcaagcccaaaaagaccgcc

SEQ ID NO: 3341537 - RNA, 21 nt, Mycobacterium tuberculosis H37Rv
gcaagccgaacaccgucagcg

SEQ ID NO: 3341538 - RNA, 15 nt, Mycobacterium tuberculosis H37Rv
gcaagccgccggugc

SEQ ID NO: 3341539 - RNA, 17 nt, Mycobacterium tuberculosis H37Rv
gcaagccggacagauca

SEQ ID NO: 3341540 - RNA, 22 nt, Mycobacterium tuberculosis H37Rv
gcacacagaggucggucagcca

SEQ ID NO: 3341541 - RNA, 14 nt, Mycobacterium tuberculosis H37Rv
gcacaccaacaccg

SEQ ID NO: 3341542 - RNA, 20 nt, Mycobacterium tuberculosis H37Rv
gcacaccaacaccgcggcgc

SEQ ID NO: 3341543 - RNA, 22 nt, Mycobacterium tuberculosis H37Rv
gcacaccaaccgagcgcccucc

SEQ ID NO: 3341544 - RNA, 15 nt, Mycobacterium tuberculosis H37Rv
gcacaccaccgccga

SEQ ID NO: 3341545 - RNA, 17 nt, Mycobacterium tuberculosis H37Rv
gcacacccaucaccgcc

SEQ ID NO: 3341546 - RNA, 19 nt, Mycobacterium tuberculosis H37Rv
gcacacccaucaccgccag

SEQ ID NO: 3341547 - RNA, 21 nt, Mycobacterium tuberculosis H37Rv
gcacacccaucagcccucggc

SEQ ID NO: 3341548 - RNA, 18 nt, Mycobacterium tuberculosis H37Rv
gcacacccccgucugcgu

SEQ ID NO: 3341549 - RNA, 14 nt, Mycobacterium tuberculosis H37Rv
gcacacccgcaccg

SEQ ID NO: 3341550 - RNA, 21 nt, Mycobacterium tuberculosis H37Rv
gcacacccuccacagcggcca

SEQ ID NO: 3341551 - RNA, 17 nt, Mycobacterium tuberculosis H37Rv
gcacaccgacagcaccc

SEQ ID NO: 3341552 - RNA, 17 nt, Mycobacterium tuberculosis H37Rv
gcacaccgaggucgcca

SEQ ID NO: 3341553 - RNA, 14 nt, Mycobacterium tuberculosis H37Rv
gcacaccgccagcg

SEQ ID NO: 3341554 - RNA, 16 nt, Mycobacterium tuberculosis H37Rv
gcacaccgccagcggc

SEQ ID NO: 3341555 - RNA, 13 nt, Mycobacterium tuberculosis H37Rv
gcacaccggcacu

SEQ ID NO: 3341556 - RNA, 18 nt, Mycobacterium tuberculosis H37Rv
gcacaccggcacugccca

SEQ ID NO: 3341557 - RNA, 21 nt, Mycobacterium tuberculosis H37Rv
gcacaccggcacugcccagca

SEQ ID NO: 3341558 - RNA, 13 nt, Mycobacterium tuberculosis H37Rv
gcacaccggcuuu

SEQ ID NO: 3341559 - RNA, 14 nt, Mycobacterium tuberculosis H37Rv
gcacaccgguggac

SEQ ID NO: 3341560 - RNA, 19 nt, Mycobacterium tuberculosis H37Rv
gcacaccgguggacccggc

SEQ ID NO: 3341561 - RNA, 17 nt, Mycobacterium tuberculosis H37Rv
gcacaccgguggcgccc

SEQ ID NO: 3341562 - RNA, 14 nt, Mycobacterium tuberculosis H37Rv
gcacaccgucgcac

SEQ ID NO: 3341563 - RNA, 22 nt, Mycobacterium tuberculosis H37Rv
gcacaccgucgcgcucgcacca

SEQ ID NO: 3341564 - RNA, 13 nt, Mycobacterium tuberculosis H37Rv
gcacaccgucguc

SEQ ID NO: 3341565 - RNA, 16 nt, Mycobacterium tuberculosis H37Rv
gcacaccugcgcggcg

SEQ ID NO: 3341566 - RNA, 23 nt, Mycobacterium tuberculosis H37Rv
gcacaccugcgcggcgugcgcgg

SEQ ID NO: 3341567 - RNA, 13 nt, Mycobacterium tuberculosis H37Rv
gcacacgaucgcg

SEQ ID NO: 3341568 - RNA, 22 nt, Mycobacterium tuberculosis H37Rv
gcacacgcuuguacaagucgac

SEQ ID NO: 3341569 - RNA, 20 nt, Mycobacterium tuberculosis H37Rv
gcacacggccuugccgauca

SEQ ID NO: 3341570 - RNA, 19 nt, Mycobacterium tuberculosis H37Rv
gcacacgucgggaguaagg

SEQ ID NO: 3341571 - RNA, 15 nt, Mycobacterium tuberculosis H37Rv
gcacacuccuagcca

SEQ ID NO: 3341572 - RNA, 15 nt, Mycobacterium tuberculosis H37Rv
gcacacuccugcacc

SEQ ID NO: 3341573 - RNA, 15 nt, Mycobacterium tuberculosis H37Rv
gcacacugccgcgcu

SEQ ID NO: 3341574 - RNA, 17 nt, Mycobacterium tuberculosis H37Rv
gcacacugccgcgcucg

SEQ ID NO: 3341575 - RNA, 22 nt, Mycobacterium tuberculosis H37Rv
gcacacuguuacuccgacggcc

SEQ ID NO: 3341576 - RNA, 23 nt, Mycobacterium tuberculosis H37Rv
gcacacuguuacuccgacggccc

SEQ ID NO: 3341577 - RNA, 12 nt, Mycobacterium tuberculosis H37Rv
gcacagcaacaa

SEQ ID NO: 3341578 - RNA, 12 nt, Mycobacterium tuberculosis H37Rv
gcacagcaccac

SEQ ID NO: 3341579 - RNA, 17 nt, Mycobacterium tuberculosis H37Rv
gcacagcaccacaucga

SEQ ID NO: 3341580 - RNA, 16 nt, Mycobacterium tuberculosis H37Rv
gcacagcaccacgugc

SEQ ID NO: 3341581 - RNA, 16 nt, Mycobacterium tuberculosis H37Rv
gcacagcacggcaucg

SEQ ID NO: 3341582 - RNA, 12 nt, Mycobacterium tuberculosis H37Rv
gcacagcccggc

SEQ ID NO: 3341583 - RNA, 14 nt, Mycobacterium tuberculosis H37Rv
gcacagcgaccauc

SEQ ID NO: 3341584 - RNA, 13 nt, Mycobacterium tuberculosis H37Rv
gcacagcgcagcc

SEQ ID NO: 3341585 - RNA, 14 nt, Mycobacterium tuberculosis H37Rv
gcacagcgccgcgu

SEQ ID NO: 3341586 - RNA, 22 nt, Mycobacterium tuberculosis H37Rv
gcacagcgccgcguugucggcg

SEQ ID NO: 3341587 - RNA, 22 nt, Mycobacterium tuberculosis H37Rv
gcacagcggauucggcgucgaa

SEQ ID NO: 3341588 - RNA, 12 nt, Mycobacterium tuberculosis H37Rv
gcacagcggcau

SEQ ID NO: 3341589 - RNA, 23 nt, Mycobacterium tuberculosis H37Rv
gcacaggcaucguccgccgggcu

SEQ ID NO: 3341590 - RNA, 18 nt, Mycobacterium tuberculosis H37Rv
gcacaggcggccagcauc

SEQ ID NO: 3341591 - RNA, 19 nt, Mycobacterium tuberculosis H37Rv
gcacaggcggccagcaucg

SEQ ID NO: 3341592 - RNA, 19 nt, Mycobacterium tuberculosis H37Rv
gcacaggcuggcgauggcc

SEQ ID NO: 3341593 - RNA, 15 nt, Mycobacterium tuberculosis H37Rv
gcacagguccggguu

SEQ ID NO: 3341594 - RNA, 17 nt, Mycobacterium tuberculosis H37Rv
gcacagguccggguugg

SEQ ID NO: 3341595 - RNA, 22 nt, Mycobacterium tuberculosis H37Rv
gcacagguccggguuggccacc

SEQ ID NO: 3341596 - RNA, 14 nt, Mycobacterium tuberculosis H37Rv
gcacagugcggccc

SEQ ID NO: 3341597 - RNA, 14 nt, Mycobacterium tuberculosis H37Rv
gcacaguucgccgg

SEQ ID NO: 3341598 - RNA, 13 nt, Mycobacterium tuberculosis H37Rv
gcacauaggcgau

SEQ ID NO: 3341599 - RNA, 14 nt, Mycobacterium tuberculosis H37Rv
gcacauccugcagc

SEQ ID NO: 3341600 - RNA, 18 nt, Mycobacterium tuberculosis H37Rv
gcacauccugcagcucgg

SEQ ID NO: 3341601 - RNA, 12 nt, Mycobacterium tuberculosis H37Rv
gcacaucgcaca

SEQ ID NO: 3341602 - RNA, 20 nt, Mycobacterium tuberculosis H37Rv
gcacaugcugccgcugcgaa

SEQ ID NO: 3341603 - RNA, 18 nt, Mycobacterium tuberculosis H37Rv
gcacauuauucuucgcgg

SEQ ID NO: 3341604 - RNA, 16 nt, Mycobacterium tuberculosis H37Rv
gcaccaacaccagcgc

SEQ ID NO: 3341605 - RNA, 20 nt, Mycobacterium tuberculosis H37Rv
gcaccaacgagauccagcgc

SEQ ID NO: 3341606 - RNA, 19 nt, Mycobacterium tuberculosis H37Rv
gcaccaacgccaccgucgc

SEQ ID NO: 3341607 - RNA, 15 nt, Mycobacterium tuberculosis H37Rv
gcaccaagacgccac

SEQ ID NO: 3341608 - RNA, 16 nt, Mycobacterium tuberculosis H37Rv
gcaccaagacgccacc

SEQ ID NO: 3341609 - RNA, 19 nt, Mycobacterium tuberculosis H37Rv
gcaccaagcagcgaccagc

SEQ ID NO: 3341610 - RNA, 15 nt, Mycobacterium tuberculosis H37Rv
gcaccaaggccgccu

SEQ ID NO: 3341611 - RNA, 21 nt, Mycobacterium tuberculosis H37Rv
gcaccaaggccgccugcaaca

SEQ ID NO: 3341612 - RNA, 19 nt, Mycobacterium tuberculosis H37Rv
gcaccaaggucuucaggcc

SEQ ID NO: 3341613 - RNA, 22 nt, Mycobacterium tuberculosis H37Rv
gcaccacaaacaccccacacag

SEQ ID NO: 3341614 - RNA, 20 nt, Mycobacterium tuberculosis H37Rv
gcaccacaacgucggcaccg

SEQ ID NO: 3341615 - RNA, 14 nt, Mycobacterium tuberculosis H37Rv
gcaccacaauccac

SEQ ID NO: 3341616 - RNA, 19 nt, Mycobacterium tuberculosis H37Rv
gcaccacaauccacgcacu

SEQ ID NO: 3341617 - RNA, 14 nt, Mycobacterium tuberculosis H37Rv
gcaccacaccacgg

SEQ ID NO: 3341618 - RNA, 19 nt, Mycobacterium tuberculosis H37Rv
gcaccacaccacgguggcc

SEQ ID NO: 3341619 - RNA, 22 nt, Mycobacterium tuberculosis H37Rv
gcaccacaccacgguggccgcu

SEQ ID NO: 3341620 - RNA, 20 nt, Mycobacterium tuberculosis H37Rv
gcaccacaccgugggcgacg

SEQ ID NO: 3341621 - RNA, 21 nt, Mycobacterium tuberculosis H37Rv
gcaccacaccgugggcgacgg

SEQ ID NO: 3341622 - RNA, 16 nt, Mycobacterium tuberculosis H37Rv
gcaccacacuggcagu

SEQ ID NO: 3341623 - RNA, 14 nt, Mycobacterium tuberculosis H37Rv
gcaccacagugcca

SEQ ID NO: 3341624 - RNA, 14 nt, Mycobacterium tuberculosis H37Rv
gcaccaccacaccg

SEQ ID NO: 3341625 - RNA, 19 nt, Mycobacterium tuberculosis H37Rv
gcaccaccacaccggagcc

SEQ ID NO: 3341626 - RNA, 15 nt, Mycobacterium tuberculosis H37Rv
gcaccaccacccgau

SEQ ID NO: 3341627 - RNA, 19 nt, Mycobacterium tuberculosis H37Rv
gcaccaccacccgauccac

SEQ ID NO: 3341628 - RNA, 16 nt, Mycobacterium tuberculosis H37Rv
gcaccaccacgccgac

SEQ ID NO: 3341629 - RNA, 20 nt, Mycobacterium tuberculosis H37Rv
gcaccaccacgugaucagau

SEQ ID NO: 3341630 - RNA, 14 nt, Mycobacterium tuberculosis H37Rv
gcaccaccagcagc

SEQ ID NO: 3341631 - RNA, 20 nt, Mycobacterium tuberculosis H37Rv
gcaccaccccagcggccacc

SEQ ID NO: 3341632 - RNA, 21 nt, Mycobacterium tuberculosis H37Rv
gcaccaccccgaggccgaccu

SEQ ID NO: 3341633 - RNA, 16 nt, Mycobacterium tuberculosis H37Rv
gcaccaccgcggcggc

SEQ ID NO: 3341634 - RNA, 12 nt, Mycobacterium tuberculosis H37Rv
gcaccaccggaa

SEQ ID NO: 3341635 - RNA, 16 nt, Mycobacterium tuberculosis H37Rv
gcaccaccggccccac

SEQ ID NO: 3341636 - RNA, 17 nt, Mycobacterium tuberculosis H37Rv
gcacccggccaccggac

SEQ ID NO: 3341637 - RNA, 14 nt, Mycobacterium tuberculosis H37Rv
gcacccggccgcgc

SEQ ID NO: 3341638 - RNA, 18 nt, Mycobacterium tuberculosis H37Rv
gcacccggcuguucucgc

SEQ ID NO: 3341639 - RNA, 17 nt, Mycobacterium tuberculosis H37Rv
gcacccggcuucgccgc

SEQ ID NO: 3341640 - RNA, 19 nt, Mycobacterium tuberculosis H37Rv
gcacccggcuucgccgcgc

SEQ ID NO: 3341641 - RNA, 20 nt, Mycobacterium tuberculosis H37Rv
gcacccgggccacgucgagc

SEQ ID NO: 3341642 - RNA, 18 nt, Mycobacterium tuberculosis H37Rv
gcacccgggccgccucga

SEQ ID NO: 3341643 - RNA, 17 nt, Mycobacterium tuberculosis H37Rv
gcacccgggccugggac

SEQ ID NO: 3341644 - RNA, 23 nt, Mycobacterium tuberculosis H37Rv
gcacccgggccugggacggcggc

SEQ ID NO: 3341645 - RNA, 17 nt, Mycobacterium tuberculosis H37Rv
gcacccggggggccucg

SEQ ID NO: 3341646 - RNA, 17 nt, Mycobacterium tuberculosis H37Rv
gcacccggggugcccgg

SEQ ID NO: 3341647 - RNA, 22 nt, Mycobacterium tuberculosis H37Rv
gcacccgggugcgcucuucucc

SEQ ID NO: 3341648 - RNA, 15 nt, Mycobacterium tuberculosis H37Rv
gcacccggucgagcg

SEQ ID NO: 3341649 - RNA, 14 nt, Mycobacterium tuberculosis H37Rv
gcacccggucggcg

SEQ ID NO: 3341650 - RNA, 19 nt, Mycobacterium tuberculosis H37Rv
gcacccggugagaagaagc

SEQ ID NO: 3341651 - RNA, 20 nt, Mycobacterium tuberculosis H37Rv
gcacccggugagaagaagcc

SEQ ID NO: 3341652 - RNA, 21 nt, Mycobacterium tuberculosis H37Rv
gcacccggugagaagaagccc

SEQ ID NO: 3341653 - RNA, 22 nt, Mycobacterium tuberculosis H37Rv
gcacccgguugugcgcgcgccc

SEQ ID NO: 3341654 - RNA, 12 nt, Mycobacterium tuberculosis H37Rv
gcacccgucggg

SEQ ID NO: 3341655 - RNA, 16 nt, Mycobacterium tuberculosis H37Rv
gcacccgugccgccga

SEQ ID NO: 3341656 - RNA, 21 nt, Mycobacterium tuberculosis H37Rv
gcacccguucgugagcggcca

SEQ ID NO: 3341657 - RNA, 23 nt, Mycobacterium tuberculosis H37Rv
gcacccguucgugagcggccagg

SEQ ID NO: 3341658 - RNA, 16 nt, Mycobacterium tuberculosis H37Rv
gcacccguugaucgcg

SEQ ID NO: 3341659 - RNA, 20 nt, Mycobacterium tuberculosis H37Rv
gcacccguugcgacaccucc

SEQ ID NO: 3341660 - RNA, 15 nt, Mycobacterium tuberculosis H37Rv
gcacccugcggcacc

SEQ ID NO: 3341661 - RNA, 15 nt, Mycobacterium tuberculosis H37Rv
gcacccugcgggccg

SEQ ID NO: 3341662 - RNA, 24 nt, Mycobacterium tuberculosis H37Rv
gcacccugcgggccgagaucacgc

SEQ ID NO: 3341663 - RNA, 18 nt, Mycobacterium tuberculosis H37Rv
gcacccuguuccagcggg

SEQ ID NO: 3341664 - RNA, 17 nt, Mycobacterium tuberculosis H37Rv
gcaccgaaaaacaccag

SEQ ID NO: 3341665 - RNA, 19 nt, Mycobacterium tuberculosis H37Rv
gcaccgaaaaacaccagcg

SEQ ID NO: 3341666 - RNA, 22 nt, Mycobacterium tuberculosis H37Rv
gcaccgaaaaacaccagcgagg

SEQ ID NO: 3341667 - RNA, 23 nt, Mycobacterium tuberculosis H37Rv
gcaccgaaaaacaccagcgaggc

SEQ ID NO: 3341668 - RNA, 21 nt, Mycobacterium tuberculosis H37Rv
gcaccgaaaccaugccgccga

SEQ ID NO: 3341669 - RNA, 19 nt, Mycobacterium tuberculosis H37Rv
gcaccgaaacgccgaccuu

SEQ ID NO: 3341670 - RNA, 20 nt, Mycobacterium tuberculosis H37Rv
gcaccgaaacgccgaccuuc

SEQ ID NO: 3341671 - RNA, 14 nt, Mycobacterium tuberculosis H37Rv
gcaccgaacccgcc

SEQ ID NO: 3341672 - RNA, 19 nt, Mycobacterium tuberculosis H37Rv
gcaccgaacccgccaccgc

SEQ ID NO: 3341673 - RNA, 16 nt, Mycobacterium tuberculosis H37Rv
gcaccgaagauggcca

SEQ ID NO: 3341674 - RNA, 17 nt, Mycobacterium tuberculosis H37Rv
gcaccgaagauggccag

SEQ ID NO: 3341675 - RNA, 23 nt, Mycobacterium tuberculosis H37Rv
gcaccgaagauggccagcgcggc

SEQ ID NO: 3341676 - RNA, 16 nt, Mycobacterium tuberculosis H37Rv
gcaccgaagcggucgc

SEQ ID NO: 3341677 - RNA, 24 nt, Mycobacterium tuberculosis H37Rv
gcaccgaauuacgcaccgaggccg

SEQ ID NO: 3341678 - RNA, 19 nt, Mycobacterium tuberculosis H37Rv
gcaccgacaccggccgcga

SEQ ID NO: 3341679 - RNA, 20 nt, Mycobacterium tuberculosis H37Rv
gcaccgacaccggccgcgac

SEQ ID NO: 3341680 - RNA, 21 nt, Mycobacterium tuberculosis H37Rv
gcaccgacagcccgaacgagg

SEQ ID NO: 3341681 - RNA, 18 nt, Mycobacterium tuberculosis H37Rv
gcaccgacaucgucaucc

SEQ ID NO: 3341682 - RNA, 19 nt, Mycobacterium tuberculosis H37Rv
gcaccgacaucgucaucca

SEQ ID NO: 3341683 - RNA, 15 nt, Mycobacterium tuberculosis H37Rv
gcaccgaccgcaccg

SEQ ID NO: 3341684 - RNA, 20 nt, Mycobacterium tuberculosis H37Rv
gcaccgaccgcaccgugccg

SEQ ID NO: 3341685 - RNA, 21 nt, Mycobacterium tuberculosis H37Rv
gcaccgaccgcaccgugccga

SEQ ID NO: 3341686 - RNA, 21 nt, Mycobacterium tuberculosis H37Rv
gcaccgacgucggcuucaccu

SEQ ID NO: 3341687 - RNA, 19 nt, Mycobacterium tuberculosis H37Rv
gcaccgacugcugucaccg

SEQ ID NO: 3341688 - RNA, 22 nt, Mycobacterium tuberculosis H37Rv
gcaccgagcaucucgucgucga

SEQ ID NO: 3341689 - RNA, 12 nt, Mycobacterium tuberculosis H37Rv
gcaccgagccgu

SEQ ID NO: 3341690 - RNA, 16 nt, Mycobacterium tuberculosis H37Rv
gcaccgagcugagcgg

SEQ ID NO: 3341691 - RNA, 17 nt, Mycobacterium tuberculosis H37Rv
gcaccgagcugagcggc

SEQ ID NO: 3341692 - RNA, 22 nt, Mycobacterium tuberculosis H37Rv
gcaccgagcugagcggccagca

SEQ ID NO: 3341693 - RNA, 18 nt, Mycobacterium tuberculosis H37Rv
gcaccgagcuuguccagc

SEQ ID NO: 3341694 - RNA, 14 nt, Mycobacterium tuberculosis H37Rv
gcaccgaggccgcc

SEQ ID NO: 3341695 - RNA, 15 nt, Mycobacterium tuberculosis H37Rv
gcaccgauccuggac

SEQ ID NO: 3341696 - RNA, 18 nt, Mycobacterium tuberculosis H37Rv
gcaccgaugccgaagccc

SEQ ID NO: 3341697 - RNA, 19 nt, Mycobacterium tuberculosis H37Rv
gcaccgaugccgaagcccc

SEQ ID NO: 3341698 - RNA, 20 nt, Mycobacterium tuberculosis H37Rv
gcaccgaugccgaagccccc

SEQ ID NO: 3341699 - RNA, 20 nt, Mycobacterium tuberculosis H37Rv
gcaccgaugcugacgaugcg

SEQ ID NO: 3341700 - RNA, 16 nt, Mycobacterium tuberculosis H37Rv
gcaccgauggcgcacc

SEQ ID NO: 3341701 - RNA, 17 nt, Mycobacterium tuberculosis H37Rv
gcaccgauggcgcaccg

SEQ ID NO: 3341702 - RNA, 20 nt, Mycobacterium tuberculosis H37Rv
gcaccgauggcgcaccggcg

SEQ ID NO: 3341703 - RNA, 19 nt, Mycobacterium tuberculosis H37Rv
gcaccgauuccuugaugcc

SEQ ID NO: 3341704 - RNA, 20 nt, Mycobacterium tuberculosis H37Rv
gcaccgauuuccucugggcu

SEQ ID NO: 3341705 - RNA, 21 nt, Mycobacterium tuberculosis H37Rv
gcaccgauuuuggcaagcugc

SEQ ID NO: 3341706 - RNA, 22 nt, Mycobacterium tuberculosis H37Rv
gcaccgcacggaggcggaccag

SEQ ID NO: 3341707 - RNA, 22 nt, Mycobacterium tuberculosis H37Rv
gcaccgcauuguugaagaaagc

SEQ ID NO: 3341708 - RNA, 17 nt, Mycobacterium tuberculosis H37Rv
gcaccgccacccugacc

SEQ ID NO: 3341709 - RNA, 22 nt, Mycobacterium tuberculosis H37Rv
gcaccgccacccugaccaacau

SEQ ID NO: 3341710 - RNA, 14 nt, Mycobacterium tuberculosis H37Rv
gcaccgccagccac

SEQ ID NO: 3341711 - RNA, 15 nt, Mycobacterium tuberculosis H37Rv
gcaccgccagccacc

SEQ ID NO: 3341712 - RNA, 16 nt, Mycobacterium tuberculosis H37Rv
gcaccgccagccacca

SEQ ID NO: 3341713 - RNA, 12 nt, Mycobacterium tuberculosis H37Rv
gcaccgccaggu

SEQ ID NO: 3341714 - RNA, 15 nt, Mycobacterium tuberculosis H37Rv
gcaccgccaggucga

SEQ ID NO: 3341715 - RNA, 16 nt, Mycobacterium tuberculosis H37Rv
gcaccgccaguuccgg

SEQ ID NO: 3341716 - RNA, 15 nt, Mycobacterium tuberculosis H37Rv
gcaccgcccccgucg

SEQ ID NO: 3341717 - RNA, 23 nt, Mycobacterium tuberculosis H37Rv
gcaccgcccccgucggccuuggg

SEQ ID NO: 3341718 - RNA, 19 nt, Mycobacterium tuberculosis H37Rv
gcaccgcccuugccgccgu

SEQ ID NO: 3341719 - RNA, 15 nt, Mycobacterium tuberculosis H37Rv
gcaccgccgagcaga

SEQ ID NO: 3341720 - RNA, 20 nt, Mycobacterium tuberculosis H37Rv
gcaccgccgauguggucggc

SEQ ID NO: 3341721 - RNA, 13 nt, Mycobacterium tuberculosis H37Rv
gcaccgccgcccc

SEQ ID NO: 3341722 - RNA, 16 nt, Mycobacterium tuberculosis H37Rv
gcaccgccgcccccgc

SEQ ID NO: 3341723 - RNA, 22 nt, Mycobacterium tuberculosis H37Rv
gcaccgccgcccccgccggccg

SEQ ID NO: 3341724 - RNA, 15 nt, Mycobacterium tuberculosis H37Rv
gcaccgccgccgccc

SEQ ID NO: 3341725 - RNA, 17 nt, Mycobacterium tuberculosis H37Rv
gcaccgccgcgccggcg

SEQ ID NO: 3341726 - RNA, 23 nt, Mycobacterium tuberculosis H37Rv
gcaccgccgcgccggcggccacc

SEQ ID NO: 3341727 - RNA, 17 nt, Mycobacterium tuberculosis H37Rv
gcaccgccgcugccauc

SEQ ID NO: 3341728 - RNA, 13 nt, Mycobacterium tuberculosis H37Rv
gcaccgccggcaa

SEQ ID NO: 3341729 - RNA, 22 nt, Mycobacterium tuberculosis H37Rv
gcaccgccggcaauaccgccag

SEQ ID NO: 3341730 - RNA, 19 nt, Mycobacterium tuberculosis H37Rv
gcaccgccggcaccgccgg

SEQ ID NO: 3341731 - RNA, 18 nt, Mycobacterium tuberculosis H37Rv
gcaccugggcgcgcuggc

SEQ ID NO: 3341732 - RNA, 20 nt, Mycobacterium tuberculosis H37Rv
gcaccuggucggccgcaagg

SEQ ID NO: 3341733 - RNA, 21 nt, Mycobacterium tuberculosis H37Rv
gcaccuggucggccgcaaggc

SEQ ID NO: 3341734 - RNA, 14 nt, Mycobacterium tuberculosis H37Rv
gcaccuucuccacc

SEQ ID NO: 3341735 - RNA, 16 nt, Mycobacterium tuberculosis H37Rv
gcacgaaaucagcccg

SEQ ID NO: 3341736 - RNA, 18 nt, Mycobacterium tuberculosis H37Rv
gcacgaaaucagcccgcc

SEQ ID NO: 3341737 - RNA, 23 nt, Mycobacterium tuberculosis H37Rv
gcacgaaauugggcgauucugcg

SEQ ID NO: 3341738 - RNA, 14 nt, Mycobacterium tuberculosis H37Rv
gcacgaaccggucg

SEQ ID NO: 3341739 - RNA, 18 nt, Mycobacterium tuberculosis H37Rv
gcacgaacgccugcucgu

SEQ ID NO: 3341740 - RNA, 13 nt, Mycobacterium tuberculosis H37Rv
gcacgaauccccc

SEQ ID NO: 3341741 - RNA, 19 nt, Mycobacterium tuberculosis H37Rv
gcacgacaacuucgccgga

SEQ ID NO: 3341742 - RNA, 18 nt, Mycobacterium tuberculosis H37Rv
gcacgacaccucgaaggc

SEQ ID NO: 3341743 - RNA, 17 nt, Mycobacterium tuberculosis H37Rv
gcacgacaucgucgcga

SEQ ID NO: 3341744 - RNA, 18 nt, Mycobacterium tuberculosis H37Rv
gcacgacaucgucgcgac

SEQ ID NO: 3341745 - RNA, 20 nt, Mycobacterium tuberculosis H37Rv
gcacgacaucgucgcgacga

SEQ ID NO: 3341746 - RNA, 23 nt, Mycobacterium tuberculosis H37Rv
gcacgacaucgucgcgacgacgu

SEQ ID NO: 3341747 - RNA, 12 nt, Mycobacterium tuberculosis H37Rv
gcacgacccggg

SEQ ID NO: 3341748 - RNA, 20 nt, Mycobacterium tuberculosis H37Rv
gcacgacccgggaaggaacc

SEQ ID NO: 3341749 - RNA, 19 nt, Mycobacterium tuberculosis H37Rv
gcacgaccucgcgcggggc

SEQ ID NO: 3341750 - RNA, 20 nt, Mycobacterium tuberculosis H37Rv
gcacgaccucgcgcggggcg

SEQ ID NO: 3341751 - RNA, 14 nt, Mycobacterium tuberculosis H37Rv
gcacgaccugguua

SEQ ID NO: 3341752 - RNA, 23 nt, Mycobacterium tuberculosis H37Rv
gcacgaccugguuauucgacucg

SEQ ID NO: 3341753 - RNA, 15 nt, Mycobacterium tuberculosis H37Rv
gcacgacgacaaccg

SEQ ID NO: 3341754 - RNA, 20 nt, Mycobacterium tuberculosis H37Rv
gcacgacgacaaccggccag

SEQ ID NO: 3341755 - RNA, 15 nt, Mycobacterium tuberculosis H37Rv
gcacgacgacaucga

SEQ ID NO: 3341756 - RNA, 15 nt, Mycobacterium tuberculosis H37Rv
gcacgacgccggccu

SEQ ID NO: 3341757 - RNA, 22 nt, Mycobacterium tuberculosis H37Rv
gcacgacgccggccuggccgcc

SEQ ID NO: 3341758 - RNA, 18 nt, Mycobacterium tuberculosis H37Rv
gcacgacgcgacacgccg

SEQ ID NO: 3341759 - RNA, 20 nt, Mycobacterium tuberculosis H37Rv
gcacgacgcgacacgccggc

SEQ ID NO: 3341760 - RNA, 16 nt, Mycobacterium tuberculosis H37Rv
gcacgacgggggagca

SEQ ID NO: 3341761 - RNA, 21 nt, Mycobacterium tuberculosis H37Rv
gcacgacugugcgccgcagcc

SEQ ID NO: 3341762 - RNA, 17 nt, Mycobacterium tuberculosis H37Rv
gcacgagccaucgucga

SEQ ID NO: 3341763 - RNA, 18 nt, Mycobacterium tuberculosis H37Rv
gcacgagccaucgucgag

SEQ ID NO: 3341764 - RNA, 19 nt, Mycobacterium tuberculosis H37Rv
gcacgauagccaccgacga

SEQ ID NO: 3341765 - RNA, 20 nt, Mycobacterium tuberculosis H37Rv
gcacgauagccaccgacgac

SEQ ID NO: 3341766 - RNA, 13 nt, Mycobacterium tuberculosis H37Rv
gcacgaucaggga

SEQ ID NO: 3341767 - RNA, 13 nt, Mycobacterium tuberculosis H37Rv
gcacgauccgcac

SEQ ID NO: 3341768 - RNA, 15 nt, Mycobacterium tuberculosis H37Rv
gcacgaucgcaccga

SEQ ID NO: 3341769 - RNA, 18 nt, Mycobacterium tuberculosis H37Rv
gcacgaucgcaccgaggu

SEQ ID NO: 3341770 - RNA, 13 nt, Mycobacterium tuberculosis H37Rv
gcacgaucgccau

SEQ ID NO: 3341771 - RNA, 12 nt, Mycobacterium tuberculosis H37Rv
gcacgaucgccc

SEQ ID NO: 3341772 - RNA, 13 nt, Mycobacterium tuberculosis H37Rv
gcacgaucgcggu

SEQ ID NO: 3341773 - RNA, 16 nt, Mycobacterium tuberculosis H37Rv
gcacgaucgcggugac

SEQ ID NO: 3341774 - RNA, 16 nt, Mycobacterium tuberculosis H37Rv
gcacgauggccgucga

SEQ ID NO: 3341775 - RNA, 16 nt, Mycobacterium tuberculosis H37Rv
gcacgaugucgaugcc

SEQ ID NO: 3341776 - RNA, 19 nt, Mycobacterium tuberculosis H37Rv
gcacgcaguucggucagcg

SEQ ID NO: 3341777 - RNA, 15 nt, Mycobacterium tuberculosis H37Rv
gcacgcccacagcug

SEQ ID NO: 3341778 - RNA, 15 nt, Mycobacterium tuberculosis H37Rv
gcacgcccucgacgc

SEQ ID NO: 3341779 - RNA, 23 nt, Mycobacterium tuberculosis H37Rv
gcacgcccucgacgcgcucgggc

SEQ ID NO: 3341780 - RNA, 14 nt, Mycobacterium tuberculosis H37Rv
gcacgccgaccagc

SEQ ID NO: 3341781 - RNA, 15 nt, Mycobacterium tuberculosis H37Rv
gcacgccgaccagca

SEQ ID NO: 3341782 - RNA, 14 nt, Mycobacterium tuberculosis H37Rv
gcacgccgauaccg

SEQ ID NO: 3341783 - RNA, 14 nt, Mycobacterium tuberculosis H37Rv
gcacgccgccggcc

SEQ ID NO: 3341784 - RNA, 15 nt, Mycobacterium tuberculosis H37Rv
gcacgccgccggccg

SEQ ID NO: 3341785 - RNA, 16 nt, Mycobacterium tuberculosis H37Rv
gcacgccggcaugcca

SEQ ID NO: 3341786 - RNA, 13 nt, Mycobacterium tuberculosis H37Rv
gcacgccggccgc

SEQ ID NO: 3341787 - RNA, 15 nt, Mycobacterium tuberculosis H37Rv
gcacgccggccgcgc

SEQ ID NO: 3341788 - RNA, 13 nt, Mycobacterium tuberculosis H37Rv
gcacgccggcgcu

SEQ ID NO: 3341789 - RNA, 16 nt, Mycobacterium tuberculosis H37Rv
gcacgccggcggcgga

SEQ ID NO: 3341790 - RNA, 16 nt, Mycobacterium tuberculosis H37Rv
gcacgccgguggucac

SEQ ID NO: 3341791 - RNA, 21 nt, Mycobacterium tuberculosis H37Rv
gcacgccgguggucacgccgu

SEQ ID NO: 3341792 - RNA, 14 nt, Mycobacterium tuberculosis H37Rv
gcacgccguccagg

SEQ ID NO: 3341793 - RNA, 20 nt, Mycobacterium tuberculosis H37Rv
gcacgccuugagccgaggcg

SEQ ID NO: 3341794 - RNA, 18 nt, Mycobacterium tuberculosis H37Rv
gcacgcgcaacucgccac

SEQ ID NO: 3341795 - RNA, 14 nt, Mycobacterium tuberculosis H37Rv
gcacgcgcgcgacc

SEQ ID NO: 3341796 - RNA, 19 nt, Mycobacterium tuberculosis H37Rv
gcacgcggaaaggcuuccg

SEQ ID NO: 3341797 - RNA, 13 nt, Mycobacterium tuberculosis H37Rv
gcacgcggacaug

SEQ ID NO: 3341798 - RNA, 17 nt, Mycobacterium tuberculosis H37Rv
gcacgcggcaauggugc

SEQ ID NO: 3341799 - RNA, 19 nt, Mycobacterium tuberculosis H37Rv
gcacgcggcaauggugcgg

SEQ ID NO: 3341800 - RNA, 23 nt, Mycobacterium tuberculosis H37Rv
gcacgcgggagguacccccagca

SEQ ID NO: 3341801 - RNA, 12 nt, Mycobacterium tuberculosis H37Rv
gcacgcgggcac

SEQ ID NO: 3341802 - RNA, 21 nt, Mycobacterium tuberculosis H37Rv
gcacgcgggcguuggccagca

SEQ ID NO: 3341803 - RNA, 22 nt, Mycobacterium tuberculosis H37Rv
gcacgcgggcguuggccagcag

SEQ ID NO: 3341804 - RNA, 16 nt, Mycobacterium tuberculosis H37Rv
gcacgcgguucaccac

SEQ ID NO: 3341805 - RNA, 18 nt, Mycobacterium tuberculosis H37Rv
gcacgcgguucaccacgu

SEQ ID NO: 3341806 - RNA, 21 nt, Mycobacterium tuberculosis H37Rv
gcacgcgguucaccacgucgu

SEQ ID NO: 3341807 - RNA, 23 nt, Mycobacterium tuberculosis H37Rv
gcacgcgguucaccacgucgucg

SEQ ID NO: 3341808 - RNA, 13 nt, Mycobacterium tuberculosis H37Rv
gcacgcgugccgc

SEQ ID NO: 3341809 - RNA, 15 nt, Mycobacterium tuberculosis H37Rv
gcacgcuagccgaca

SEQ ID NO: 3341810 - RNA, 18 nt, Mycobacterium tuberculosis H37Rv
gcacgcuagccgacagcu

SEQ ID NO: 3341811 - RNA, 14 nt, Mycobacterium tuberculosis H37Rv
gcacgcucgcgcac

SEQ ID NO: 3341812 - RNA, 14 nt, Mycobacterium tuberculosis H37Rv
gcacgcucggcacg

SEQ ID NO: 3341813 - RNA, 19 nt, Mycobacterium tuberculosis H37Rv
gcacgcucggcggggaccg

SEQ ID NO: 3341814 - RNA, 13 nt, Mycobacterium tuberculosis H37Rv
gcacgcucggcgu

SEQ ID NO: 3341815 - RNA, 15 nt, Mycobacterium tuberculosis H37Rv
gcacgcugaccggau

SEQ ID NO: 3341816 - RNA, 17 nt, Mycobacterium tuberculosis H37Rv
gcacgcugagccggucg

SEQ ID NO: 3341817 - RNA, 22 nt, Mycobacterium tuberculosis H37Rv
gcacgcugaguccccagguggg

SEQ ID NO: 3341818 - RNA, 13 nt, Mycobacterium tuberculosis H37Rv
gcacgcuggcggg

SEQ ID NO: 3341819 - RNA, 14 nt, Mycobacterium tuberculosis H37Rv
gcacgcuggcgggc

SEQ ID NO: 3341820 - RNA, 15 nt, Mycobacterium tuberculosis H37Rv
gcacgcuugaaagcg

SEQ ID NO: 3341821 - RNA, 19 nt, Mycobacterium tuberculosis H37Rv
gcacggaaggcccggcgcg

SEQ ID NO: 3341822 - RNA, 22 nt, Mycobacterium tuberculosis H37Rv
gcacggaaggcccggcgcggcc

SEQ ID NO: 3341823 - RNA, 15 nt, Mycobacterium tuberculosis H37Rv
gcacggaaggucgac

SEQ ID NO: 3341824 - RNA, 20 nt, Mycobacterium tuberculosis H37Rv
gcacggaaggucgacauggg

SEQ ID NO: 3341825 - RNA, 18 nt, Mycobacterium tuberculosis H37Rv
gcacggaaguacuccacc

SEQ ID NO: 3341826 - RNA, 15 nt, Mycobacterium tuberculosis H37Rv
gcacggaaucgcauc

SEQ ID NO: 3341827 - RNA, 20 nt, Mycobacterium tuberculosis H37Rv
gcacggaccaucgccaggcc

SEQ ID NO: 3341828 - RNA, 20 nt, Mycobacterium tuberculosis H37Rv
gcacuggugcccgacccgcc

SEQ ID NO: 3341829 - RNA, 21 nt, Mycobacterium tuberculosis H37Rv
gcacugucgagguggucgacc

SEQ ID NO: 3341830 - RNA, 22 nt, Mycobacterium tuberculosis H37Rv
gcacugucgagguggucgaccc

SEQ ID NO: 3341831 - RNA, 14 nt, Mycobacterium tuberculosis H37Rv
gcacugugagguca

SEQ ID NO: 3341832 - RNA, 14 nt, Mycobacterium tuberculosis H37Rv
gcacuuaccgagcc

SEQ ID NO: 3341833 - RNA, 20 nt, Mycobacterium tuberculosis H37Rv
gcacuuccaagccgaccugc

SEQ ID NO: 3341834 - RNA, 16 nt, Mycobacterium tuberculosis H37Rv
gcacuuccagcccggc

SEQ ID NO: 3341835 - RNA, 20 nt, Mycobacterium tuberculosis H37Rv
gcacuucggugccgugaucg

SEQ ID NO: 3341836 - RNA, 21 nt, Mycobacterium tuberculosis H37Rv
gcacuucguuuuccagccgac

SEQ ID NO: 3341837 - RNA, 18 nt, Mycobacterium tuberculosis H37Rv
gcacuuggacccggccgg

SEQ ID NO: 3341838 - RNA, 16 nt, Mycobacterium tuberculosis H37Rv
gcacuuggcccccgac

SEQ ID NO: 3341839 - RNA, 22 nt, Mycobacterium tuberculosis H37Rv
gcacuugggaaggauggucgaa

SEQ ID NO: 3341840 - RNA, 19 nt, Mycobacterium tuberculosis H37Rv
gcacuuucuuccucggggc

SEQ ID NO: 3341841 - RNA, 22 nt, Mycobacterium tuberculosis H37Rv
gcagaaaaucugcuagcuuggc

SEQ ID NO: 3341842 - RNA, 22 nt, Mycobacterium tuberculosis H37Rv
gcagaaacaacgucgccgcggc

SEQ ID NO: 3341843 - RNA, 19 nt, Mycobacterium tuberculosis H37Rv
gcagaaagucgcgcgcgaa

SEQ ID NO: 3341844 - RNA, 19 nt, Mycobacterium tuberculosis H37Rv
gcagaacaccaccgccaga

SEQ ID NO: 3341845 - RNA, 19 nt, Mycobacterium tuberculosis H37Rv
gcagaacaguaucgccgga

SEQ ID NO: 3341846 - RNA, 20 nt, Mycobacterium tuberculosis H37Rv
gcagaacaguaucgccggag

SEQ ID NO: 3341847 - RNA, 14 nt, Mycobacterium tuberculosis H37Rv
gcagaaccgccaac

SEQ ID NO: 3341848 - RNA, 22 nt, Mycobacterium tuberculosis H37Rv
gcagaagcccccaaaccggcgg

SEQ ID NO: 3341849 - RNA, 20 nt, Mycobacterium tuberculosis H37Rv
gcagaagucguugcgcgguc

SEQ ID NO: 3341850 - RNA, 22 nt, Mycobacterium tuberculosis H37Rv
gcagaagucguugcgcggucuc

SEQ ID NO: 3341851 - RNA, 20 nt, Mycobacterium tuberculosis H37Rv
gcagaauccggcaaccaccg

SEQ ID NO: 3341852 - RNA, 15 nt, Mycobacterium tuberculosis H37Rv
gcagaauccggucga

SEQ ID NO: 3341853 - RNA, 19 nt, Mycobacterium tuberculosis H37Rv
gcagaauccggucgaugac

SEQ ID NO: 3341854 - RNA, 21 nt, Mycobacterium tuberculosis H37Rv
gcagaauccggucgaugaccu

SEQ ID NO: 3341855 - RNA, 16 nt, Mycobacterium tuberculosis H37Rv
gcagaauccugcgcug

SEQ ID NO: 3341856 - RNA, 14 nt, Mycobacterium tuberculosis H37Rv
gcagaaucgccugc

SEQ ID NO: 3341857 - RNA, 14 nt, Mycobacterium tuberculosis H37Rv
gcagaauucggcgc

SEQ ID NO: 3341858 - RNA, 19 nt, Mycobacterium tuberculosis H37Rv
gcagacacagaaucgccca

SEQ ID NO: 3341859 - RNA, 20 nt, Mycobacterium tuberculosis H37Rv
gcagacacagaaucgcccau

SEQ ID NO: 3341860 - RNA, 19 nt, Mycobacterium tuberculosis H37Rv
gcagacacgaccccgucga

SEQ ID NO: 3341861 - RNA, 20 nt, Mycobacterium tuberculosis H37Rv
gcagacacgagucgccagac

SEQ ID NO: 3341862 - RNA, 18 nt, Mycobacterium tuberculosis H37Rv
gcagacacuaaagcccuc

SEQ ID NO: 3341863 - RNA, 21 nt, Mycobacterium tuberculosis H37Rv
gcagacaucggagaucauggc

SEQ ID NO: 3341864 - RNA, 17 nt, Mycobacterium tuberculosis H37Rv
gcagacauggcaaguca

SEQ ID NO: 3341865 - RNA, 17 nt, Mycobacterium tuberculosis H37Rv
gcagaccaccagugagg

SEQ ID NO: 3341866 - RNA, 15 nt, Mycobacterium tuberculosis H37Rv
gcagacccaguccgg

SEQ ID NO: 3341867 - RNA, 12 nt, Mycobacterium tuberculosis H37Rv
gcagacccgugc

SEQ ID NO: 3341868 - RNA, 15 nt, Mycobacterium tuberculosis H37Rv
gcagaccgaucggca

SEQ ID NO: 3341869 - RNA, 16 nt, Mycobacterium tuberculosis H37Rv
gcagaccgaucggcag

SEQ ID NO: 3341870 - RNA, 13 nt, Mycobacterium tuberculosis H37Rv
gcagaccgccacc

SEQ ID NO: 3341871 - RNA, 12 nt, Mycobacterium tuberculosis H37Rv
gcagaccgggug

SEQ ID NO: 3341872 - RNA, 14 nt, Mycobacterium tuberculosis H37Rv
gcagaccggugagc

SEQ ID NO: 3341873 - RNA, 19 nt, Mycobacterium tuberculosis H37Rv
gcagaccggugcugucgac

SEQ ID NO: 3341874 - RNA, 23 nt, Mycobacterium tuberculosis H37Rv
gcagaccgguuucuucggccagc

SEQ ID NO: 3341875 - RNA, 14 nt, Mycobacterium tuberculosis H37Rv
gcagaccguccagc

SEQ ID NO: 3341876 - RNA, 21 nt, Mycobacterium tuberculosis H37Rv
gcagacgcaaaaucgcacggu

SEQ ID NO: 3341877 - RNA, 20 nt, Mycobacterium tuberculosis H37Rv
gcagacgcaaaaucgcccaa

SEQ ID NO: 3341878 - RNA, 20 nt, Mycobacterium tuberculosis H37Rv
gcagacgcaaaaucgcccau

SEQ ID NO: 3341879 - RNA, 19 nt, Mycobacterium tuberculosis H37Rv
gcagacgcagaaucgccca

SEQ ID NO: 3341880 - RNA, 20 nt, Mycobacterium tuberculosis H37Rv
gcagacgcagaaucgcccaa

SEQ ID NO: 3341881 - RNA, 19 nt, Mycobacterium tuberculosis H37Rv
gcagacgcagaaucgccua

SEQ ID NO: 3341882 - RNA, 17 nt, Mycobacterium tuberculosis H37Rv
gcagacgcagagucgca

SEQ ID NO: 3341883 - RNA, 19 nt, Mycobacterium tuberculosis H37Rv
gcagacgcauaagcccccg

SEQ ID NO: 3341884 - RNA, 20 nt, Mycobacterium tuberculosis H37Rv
gcagacgcauaagcccccgc

SEQ ID NO: 3341885 - RNA, 17 nt, Mycobacterium tuberculosis H37Rv
gcagacgcggaaucgca

SEQ ID NO: 3341886 - RNA, 19 nt, Mycobacterium tuberculosis H37Rv
gcagacgcggaaucgcauc

SEQ ID NO: 3341887 - RNA, 22 nt, Mycobacterium tuberculosis H37Rv
gcagacgcguuucgucgaccgc

SEQ ID NO: 3341888 - RNA, 24 nt, Mycobacterium tuberculosis H37Rv
gcagacgcguuucgucgaccgcgc

SEQ ID NO: 3341889 - RNA, 17 nt, Mycobacterium tuberculosis H37Rv
gcagacggcugccacgc

SEQ ID NO: 3341890 - RNA, 20 nt, Mycobacterium tuberculosis H37Rv
gcagacguaaaagcccccgc

SEQ ID NO: 3341891 - RNA, 13 nt, Mycobacterium tuberculosis H37Rv
gcagacucgaggu

SEQ ID NO: 3341892 - RNA, 14 nt, Mycobacterium tuberculosis H37Rv
gcagacucgagguc

SEQ ID NO: 3341893 - RNA, 20 nt, Mycobacterium tuberculosis H37Rv
gcagacucgauaugcagcuc

SEQ ID NO: 3341894 - RNA, 21 nt, Mycobacterium tuberculosis H37Rv
gcagacucgccaccgcggcga

SEQ ID NO: 3341895 - RNA, 14 nt, Mycobacterium tuberculosis H37Rv
gcagacucggcgau

SEQ ID NO: 3341896 - RNA, 21 nt, Mycobacterium tuberculosis H37Rv
gcagagaacuccgccaccauc

SEQ ID NO: 3341897 - RNA, 16 nt, Mycobacterium tuberculosis H37Rv
gcagagaccaaggucc

SEQ ID NO: 3341898 - RNA, 18 nt, Mycobacterium tuberculosis H37Rv
gcagagaccaagguccgc

SEQ ID NO: 3341899 - RNA, 13 nt, Mycobacterium tuberculosis H37Rv
gcagagccaacgc

SEQ ID NO: 3341900 - RNA, 13 nt, Mycobacterium tuberculosis H37Rv
gcagagccccggc

SEQ ID NO: 3341901 - RNA, 15 nt, Mycobacterium tuberculosis H37Rv
gcagagccgccguug

SEQ ID NO: 3341902 - RNA, 23 nt, Mycobacterium tuberculosis H37Rv
gcagagucgcacugcgccggccg

SEQ ID NO: 3341903 - RNA, 13 nt, Mycobacterium tuberculosis H37Rv
gcagagucgccga

SEQ ID NO: 3341904 - RNA, 22 nt, Mycobacterium tuberculosis H37Rv
gcagaguucccugaugggcgaa

SEQ ID NO: 3341905 - RNA, 18 nt, Mycobacterium tuberculosis H37Rv
gcagauacgccaaccgcu

SEQ ID NO: 3341906 - RNA, 20 nt, Mycobacterium tuberculosis H37Rv
gcagauacuccgcgguuguu

SEQ ID NO: 3341907 - RNA, 17 nt, Mycobacterium tuberculosis H37Rv
gcagauacuuguugaag

SEQ ID NO: 3341908 - RNA, 16 nt, Mycobacterium tuberculosis H37Rv
gcagauauugccugcc

SEQ ID NO: 3341909 - RNA, 15 nt, Mycobacterium tuberculosis H37Rv
gcagaucaccgccag

SEQ ID NO: 3341910 - RNA, 16 nt, Mycobacterium tuberculosis H37Rv
gcagaucaccgccagc

SEQ ID NO: 3341911 - RNA, 16 nt, Mycobacterium tuberculosis H37Rv
gcagaucacgggugug

SEQ ID NO: 3341912 - RNA, 22 nt, Mycobacterium tuberculosis H37Rv
gcagaucagcacguugauucgg

SEQ ID NO: 3341913 - RNA, 16 nt, Mycobacterium tuberculosis H37Rv
gcagaucaggacgcga

SEQ ID NO: 3341914 - RNA, 21 nt, Mycobacterium tuberculosis H37Rv
gcagaucaggacgcgaucggc

SEQ ID NO: 3341915 - RNA, 12 nt, Mycobacterium tuberculosis H37Rv
gcagaucagggu

SEQ ID NO: 3341916 - RNA, 14 nt, Mycobacterium tuberculosis H37Rv
gcagaucagggugg

SEQ ID NO: 3341917 - RNA, 17 nt, Mycobacterium tuberculosis H37Rv
gcagaucaggguggcgc

SEQ ID NO: 3341918 - RNA, 12 nt, Mycobacterium tuberculosis H37Rv
gcagauccaggc

SEQ ID NO: 3341919 - RNA, 21 nt, Mycobacterium tuberculosis H37Rv
gcagauccaggcgucggugac

SEQ ID NO: 3341920 - RNA, 14 nt, Mycobacterium tuberculosis H37Rv
gcagauccccgcca

SEQ ID NO: 3341921 - RNA, 15 nt, Mycobacterium tuberculosis H37Rv
gcagauccccgccac

SEQ ID NO: 3341922 - RNA, 16 nt, Mycobacterium tuberculosis H37Rv
gcagauccccgccacc

SEQ ID NO: 3341923 - RNA, 17 nt, Mycobacterium tuberculosis H37Rv
gcagauccccgccaccg

SEQ ID NO: 3341924 - RNA, 17 nt, Mycobacterium tuberculosis H37Rv
gcagccccugccgaucc

SEQ ID NO: 3341925 - RNA, 13 nt, Mycobacterium tuberculosis H37Rv
gcagcccgccgga

SEQ ID NO: 3341926 - RNA, 16 nt, Mycobacterium tuberculosis H37Rv
gcagcccgccggaucc

SEQ ID NO: 3341927 - RNA, 15 nt, Mycobacterium tuberculosis H37Rv
gcagcccgccgggcu

SEQ ID NO: 3341928 - RNA, 18 nt, Mycobacterium tuberculosis H37Rv
gcagcccgcgaguauggg

SEQ ID NO: 3341929 - RNA, 14 nt, Mycobacterium tuberculosis H37Rv
gcagcccgcuggcc

SEQ ID NO: 3341930 - RNA, 12 nt, Mycobacterium tuberculosis H37Rv
gcagcccggcga

SEQ ID NO: 3341931 - RNA, 17 nt, Mycobacterium tuberculosis H37Rv
gcagcccggcgaugagc

SEQ ID NO: 3341932 - RNA, 17 nt, Mycobacterium tuberculosis H37Rv
gcagcccgggcagcacc

SEQ ID NO: 3341933 - RNA, 16 nt, Mycobacterium tuberculosis H37Rv
gcagcccgucggaccc

SEQ ID NO: 3341934 - RNA, 13 nt, Mycobacterium tuberculosis H37Rv
gcagcccguucga

SEQ ID NO: 3341935 - RNA, 16 nt, Mycobacterium tuberculosis H37Rv
gcagcccugcgcagcc

SEQ ID NO: 3341936 - RNA, 21 nt, Mycobacterium tuberculosis H37Rv
gcagcccugcgcagccgccuc

SEQ ID NO: 3341937 - RNA, 20 nt, Mycobacterium tuberculosis H37Rv
gcagccgaaccggcaccagc

SEQ ID NO: 3341938 - RNA, 21 nt, Mycobacterium tuberculosis H37Rv
gcagccgaaccggcaccagcg

SEQ ID NO: 3341939 - RNA, 23 nt, Mycobacterium tuberculosis H37Rv
gcagccgaccgaaucagcacggu

SEQ ID NO: 3341940 - RNA, 21 nt, Mycobacterium tuberculosis H37Rv
gcagccgauacaggccacgca

SEQ ID NO: 3341941 - RNA, 19 nt, Mycobacterium tuberculosis H37Rv
gcagccgaugcugcgggcg

SEQ ID NO: 3341942 - RNA, 18 nt, Mycobacterium tuberculosis H37Rv
gcagccgcagccgguuaa

SEQ ID NO: 3341943 - RNA, 15 nt, Mycobacterium tuberculosis H37Rv
gcagccgcagguggg

SEQ ID NO: 3341944 - RNA, 20 nt, Mycobacterium tuberculosis H37Rv
gcagccgcauaggccccgcc

SEQ ID NO: 3341945 - RNA, 13 nt, Mycobacterium tuberculosis H37Rv
gcagccgcccgcc

SEQ ID NO: 3341946 - RNA, 20 nt, Mycobacterium tuberculosis H37Rv
gcagccgcgacacgugcauc

SEQ ID NO: 3341947 - RNA, 17 nt, Mycobacterium tuberculosis H37Rv
gcagccgcgacauccgc

SEQ ID NO: 3341948 - RNA, 16 nt, Mycobacterium tuberculosis H37Rv
gcagccgcgaguccag

SEQ ID NO: 3341949 - RNA, 23 nt, Mycobacterium tuberculosis H37Rv
gcagccgcgcggugauggucacc

SEQ ID NO: 3341950 - RNA, 13 nt, Mycobacterium tuberculosis H37Rv
gcagccgcggggc

SEQ ID NO: 3341951 - RNA, 15 nt, Mycobacterium tuberculosis H37Rv
gcagccgcucgacgg

SEQ ID NO: 3341952 - RNA, 18 nt, Mycobacterium tuberculosis H37Rv
gcagccgcugaucugccg

SEQ ID NO: 3341953 - RNA, 11 nt, Mycobacterium tuberculosis H37Rv
gcagccggcau

SEQ ID NO: 3341954 - RNA, 15 nt, Mycobacterium tuberculosis H37Rv
gcagccgggcaccac

SEQ ID NO: 3341955 - RNA, 18 nt, Mycobacterium tuberculosis H37Rv
gcagccgggcaccgaacu

SEQ ID NO: 3341956 - RNA, 16 nt, Mycobacterium tuberculosis H37Rv
gcagccgguccagcgc

SEQ ID NO: 3341957 - RNA, 20 nt, Mycobacterium tuberculosis H37Rv
gcagccgguccagcgccggc

SEQ ID NO: 3341958 - RNA, 16 nt, Mycobacterium tuberculosis H37Rv
gcagccggugccgguc

SEQ ID NO: 3341959 - RNA, 15 nt, Mycobacterium tuberculosis H37Rv
gcagccguagcuggg

SEQ ID NO: 3341960 - RNA, 17 nt, Mycobacterium tuberculosis H37Rv
gcagccguagcugggca

SEQ ID NO: 3341961 - RNA, 20 nt, Mycobacterium tuberculosis H37Rv
gcagccguagcugggcaccc

SEQ ID NO: 3341962 - RNA, 21 nt, Mycobacterium tuberculosis H37Rv
gcagccucgaguucgaccggc

SEQ ID NO: 3341963 - RNA, 15 nt, Mycobacterium tuberculosis H37Rv
gcagccugcagcgaa

SEQ ID NO: 3341964 - RNA, 17 nt, Mycobacterium tuberculosis H37Rv
gcagccugcgccgcgcg

SEQ ID NO: 3341965 - RNA, 22 nt, Mycobacterium tuberculosis H37Rv
gcagccugcgccgcgcgagauc

SEQ ID NO: 3341966 - RNA, 16 nt, Mycobacterium tuberculosis H37Rv
gcagccuggucgcgca

SEQ ID NO: 3341967 - RNA, 13 nt, Mycobacterium tuberculosis H37Rv
gcagccuucgacg

SEQ ID NO: 3341968 - RNA, 23 nt, Mycobacterium tuberculosis H37Rv
gcagcgaaaacccggucggcgaa

SEQ ID NO: 3341969 - RNA, 22 nt, Mycobacterium tuberculosis H37Rv
gcagcgaaaaccgucgcagaaa

SEQ ID NO: 3341970 - RNA, 22 nt, Mycobacterium tuberculosis H37Rv
gcagcgaaacaccggccagcgg

SEQ ID NO: 3341971 - RNA, 16 nt, Mycobacterium tuberculosis H37Rv
gcagcgaaacgagccg

SEQ ID NO: 3341972 - RNA, 18 nt, Mycobacterium tuberculosis H37Rv
gcagcgaaacgagccggu

SEQ ID NO: 3341973 - RNA, 21 nt, Mycobacterium tuberculosis H37Rv
gcagcgaaacgagccggugcg

SEQ ID NO: 3341974 - RNA, 17 nt, Mycobacterium tuberculosis H37Rv
gcagcgaagaccagcgg

SEQ ID NO: 3341975 - RNA, 13 nt, Mycobacterium tuberculosis H37Rv
gcagcgacacguu

SEQ ID NO: 3341976 - RNA, 14 nt, Mycobacterium tuberculosis H37Rv
gcagcgacuccagc

SEQ ID NO: 3341977 - RNA, 20 nt, Mycobacterium tuberculosis H37Rv
gcagcgacuccagcgcccgg

SEQ ID NO: 3341978 - RNA, 22 nt, Mycobacterium tuberculosis H37Rv
gcagcgaggagcccggucccuu

SEQ ID NO: 3341979 - RNA, 19 nt, Mycobacterium tuberculosis H37Rv
gcagcgagucgacgucgau

SEQ ID NO: 3341980 - RNA, 18 nt, Mycobacterium tuberculosis H37Rv
gcagcgaguggccgagua

SEQ ID NO: 3341981 - RNA, 16 nt, Mycobacterium tuberculosis H37Rv
gcagcgaucggggcgg

SEQ ID NO: 3341982 - RNA, 13 nt, Mycobacterium tuberculosis H37Rv
gcagcgaugacga

SEQ ID NO: 3341983 - RNA, 16 nt, Mycobacterium tuberculosis H37Rv
gcagcgaugacgacca

SEQ ID NO: 3341984 - RNA, 14 nt, Mycobacterium tuberculosis H37Rv
gcagcgauucgccu

SEQ ID NO: 3341985 - RNA, 17 nt, Mycobacterium tuberculosis H37Rv
gcagcgcaacggccagc

SEQ ID NO: 3341986 - RNA, 19 nt, Mycobacterium tuberculosis H37Rv
gcagcgcaacggccagcgc

SEQ ID NO: 3341987 - RNA, 20 nt, Mycobacterium tuberculosis H37Rv
gcagcgcaacggccagcgcu

SEQ ID NO: 3341988 - RNA, 22 nt, Mycobacterium tuberculosis H37Rv
gcagcgcaaugcaucgcggcgg

SEQ ID NO: 3341989 - RNA, 14 nt, Mycobacterium tuberculosis H37Rv
gcagcgcauccggu

SEQ ID NO: 3341990 - RNA, 19 nt, Mycobacterium tuberculosis H37Rv
gcagcgccaacgcccccau

SEQ ID NO: 3341991 - RNA, 15 nt, Mycobacterium tuberculosis H37Rv
gcagcgccacccgau

SEQ ID NO: 3341992 - RNA, 21 nt, Mycobacterium tuberculosis H37Rv
gcagcgccacccgcgucaguc

SEQ ID NO: 3341993 - RNA, 15 nt, Mycobacterium tuberculosis H37Rv
gcagcgccagcagcu

SEQ ID NO: 3341994 - RNA, 13 nt, Mycobacterium tuberculosis H37Rv
gcagcgccagcgg

SEQ ID NO: 3341995 - RNA, 18 nt, Mycobacterium tuberculosis H37Rv
gcagcgccagcgggauga

SEQ ID NO: 3341996 - RNA, 12 nt, Mycobacterium tuberculosis H37Rv
gcagcgccaggc

SEQ ID NO: 3341997 - RNA, 22 nt, Mycobacterium tuberculosis H37Rv
gcagcgcccagaucgccgagau

SEQ ID NO: 3341998 - RNA, 15 nt, Mycobacterium tuberculosis H37Rv
gcagcgccgacagcc

SEQ ID NO: 3341999 - RNA, 16 nt, Mycobacterium tuberculosis H37Rv
gcagcgccgacagccg

SEQ ID NO: 3342000 - RNA, 18 nt, Mycobacterium tuberculosis H37Rv
gcagcgccgacagccgau

SEQ ID NO: 3342001 - RNA, 22 nt, Mycobacterium tuberculosis H37Rv
gcagcgccgacagccgauccga

SEQ ID NO: 3342002 - RNA, 14 nt, Mycobacterium tuberculosis H37Rv
gcagcgccgcgugg

SEQ ID NO: 3342003 - RNA, 15 nt, Mycobacterium tuberculosis H37Rv
gcagcgccggcaccg

SEQ ID NO: 3342004 - RNA, 13 nt, Mycobacterium tuberculosis H37Rv
gcagcgccggcag

SEQ ID NO: 3342005 - RNA, 17 nt, Mycobacterium tuberculosis H37Rv
gcagcgccggcgggcuc

SEQ ID NO: 3342006 - RNA, 13 nt, Mycobacterium tuberculosis H37Rv
gcagcgccggucg

SEQ ID NO: 3342007 - RNA, 14 nt, Mycobacterium tuberculosis H37Rv
gcagcgccucgauc

SEQ ID NO: 3342008 - RNA, 17 nt, Mycobacterium tuberculosis H37Rv
gcagcgccucgauccgc

SEQ ID NO: 3342009 - RNA, 14 nt, Mycobacterium tuberculosis H37Rv
gcagcgccucggua

SEQ ID NO: 3342010 - RNA, 20 nt, Mycobacterium tuberculosis H37Rv
gcagcgccugcggcagcacc

SEQ ID NO: 3342011 - RNA, 15 nt, Mycobacterium tuberculosis H37Rv
gcagcgcgaacacca

SEQ ID NO: 3342012 - RNA, 18 nt, Mycobacterium tuberculosis H37Rv
gcagcgcgaaggucagcg

SEQ ID NO: 3342013 - RNA, 19 nt, Mycobacterium tuberculosis H37Rv
gcagcgcgacaaaguucga

SEQ ID NO: 3342014 - RNA, 13 nt, Mycobacterium tuberculosis H37Rv
gcagcgcgacccg

SEQ ID NO: 3342015 - RNA, 17 nt, Mycobacterium tuberculosis H37Rv
gcagcgcgacccguagc

SEQ ID NO: 3342016 - RNA, 14 nt, Mycobacterium tuberculosis H37Rv
gcagcgcgaucacc

SEQ ID NO: 3342017 - RNA, 15 nt, Mycobacterium tuberculosis H37Rv
gcagcgcgaucaccg

SEQ ID NO: 3342018 - RNA, 23 nt, Mycobacterium tuberculosis H37Rv
gcagcgcgaucgauuccgcucgu

SEQ ID NO: 3342019 - RNA, 13 nt, Mycobacterium tuberculosis H37Rv
gcagcgcgaucgc

SEQ ID NO: 3342020 - RNA, 14 nt, Mycobacterium tuberculosis H37Rv
gcagcgcgauggcc

SEQ ID NO: 3342021 - RNA, 15 nt, Mycobacterium tuberculosis H37Rv
gcagcuucucgccga

SEQ ID NO: 3342022 - RNA, 14 nt, Mycobacterium tuberculosis H37Rv
gcagcuugacaucg

SEQ ID NO: 3342023 - RNA, 18 nt, Mycobacterium tuberculosis H37Rv
gcagcuugacaucgguca

SEQ ID NO: 3342024 - RNA, 17 nt, Mycobacterium tuberculosis H37Rv
gcagcuugcccgacggc

SEQ ID NO: 3342025 - RNA, 16 nt, Mycobacterium tuberculosis H37Rv
gcagcuuggacucauc

SEQ ID NO: 3342026 - RNA, 17 nt, Mycobacterium tuberculosis H37Rv
gcagcuuggacucaucg

SEQ ID NO: 3342027 - RNA, 15 nt, Mycobacterium tuberculosis H37Rv
gcagcuuggccagcc

SEQ ID NO: 3342028 - RNA, 16 nt, Mycobacterium tuberculosis H37Rv
gcagcuuggccagcca

SEQ ID NO: 3342029 - RNA, 18 nt, Mycobacterium tuberculosis H37Rv
gcagcuuggccagccacu

SEQ ID NO: 3342030 - RNA, 21 nt, Mycobacterium tuberculosis H37Rv
gcagcuuggccucagccaccg

SEQ ID NO: 3342031 - RNA, 15 nt, Mycobacterium tuberculosis H37Rv
gcagcuuguccggug

SEQ ID NO: 3342032 - RNA, 21 nt, Mycobacterium tuberculosis H37Rv
gcagcuuguuuuccaccagcg

SEQ ID NO: 3342033 - RNA, 20 nt, Mycobacterium tuberculosis H37Rv
gcagcuuuaaucguggcacu

SEQ ID NO: 3342034 - RNA, 19 nt, Mycobacterium tuberculosis H37Rv
gcaggaaaaccccggccac

SEQ ID NO: 3342035 - RNA, 23 nt, Mycobacterium tuberculosis H37Rv
gcaggaaaucguccuuggacagg

SEQ ID NO: 3342036 - RNA, 23 nt, Mycobacterium tuberculosis H37Rv
gcaggaacacccauaccuucggc

SEQ ID NO: 3342037 - RNA, 19 nt, Mycobacterium tuberculosis H37Rv
gcaggaagccggcgugcuc

SEQ ID NO: 3342038 - RNA, 15 nt, Mycobacterium tuberculosis H37Rv
gcaggaauucgccau

SEQ ID NO: 3342039 - RNA, 15 nt, Mycobacterium tuberculosis H37Rv
gcaggaccagcaccg

SEQ ID NO: 3342040 - RNA, 21 nt, Mycobacterium tuberculosis H37Rv
gcaggaccagcaccgccgcgc

SEQ ID NO: 3342041 - RNA, 12 nt, Mycobacterium tuberculosis H37Rv
gcaggacucgcg

SEQ ID NO: 3342042 - RNA, 22 nt, Mycobacterium tuberculosis H37Rv
gcaggaucgccugagcgccgcg

SEQ ID NO: 3342043 - RNA, 23 nt, Mycobacterium tuberculosis H37Rv
gcaggaucggcggauagucgcgg

SEQ ID NO: 3342044 - RNA, 14 nt, Mycobacterium tuberculosis H37Rv
gcaggaucggcuug

SEQ ID NO: 3342045 - RNA, 15 nt, Mycobacterium tuberculosis H37Rv
gcaggaucggcuugg

SEQ ID NO: 3342046 - RNA, 22 nt, Mycobacterium tuberculosis H37Rv
gcaggauguucaaucccuccgc

SEQ ID NO: 3342047 - RNA, 17 nt, Mycobacterium tuberculosis H37Rv
gcaggauucccagucca

SEQ ID NO: 3342048 - RNA, 22 nt, Mycobacterium tuberculosis H37Rv
gcaggauucccagucgcggcgc

SEQ ID NO: 3342049 - RNA, 14 nt, Mycobacterium tuberculosis H37Rv
gcaggcacaucgcg

SEQ ID NO: 3342050 - RNA, 13 nt, Mycobacterium tuberculosis H37Rv
gcaggcaccccga

SEQ ID NO: 3342051 - RNA, 19 nt, Mycobacterium tuberculosis H37Rv
gcaggcaccccgaucaccc

SEQ ID NO: 3342052 - RNA, 16 nt, Mycobacterium tuberculosis H37Rv
gcaggcagggcagccc

SEQ ID NO: 3342053 - RNA, 23 nt, Mycobacterium tuberculosis H37Rv
gcaggcagugagggucccacggc

SEQ ID NO: 3342054 - RNA, 13 nt, Mycobacterium tuberculosis H37Rv
gcaggcauucccg

SEQ ID NO: 3342055 - RNA, 12 nt, Mycobacterium tuberculosis H37Rv
gcaggcccaccc

SEQ ID NO: 3342056 - RNA, 16 nt, Mycobacterium tuberculosis H37Rv
gcaggcccacccgggc

SEQ ID NO: 3342057 - RNA, 17 nt, Mycobacterium tuberculosis H37Rv
gcaggccccacuggugc

SEQ ID NO: 3342058 - RNA, 17 nt, Mycobacterium tuberculosis H37Rv
gcaggcccgccaucaug

SEQ ID NO: 3342059 - RNA, 16 nt, Mycobacterium tuberculosis H37Rv
gcaggcccuggccacc

SEQ ID NO: 3342060 - RNA, 19 nt, Mycobacterium tuberculosis H37Rv
gcaggcccuggccacccag

SEQ ID NO: 3342061 - RNA, 12 nt, Mycobacterium tuberculosis H37Rv
gcaggcccuuca

SEQ ID NO: 3342062 - RNA, 18 nt, Mycobacterium tuberculosis H37Rv
gcaggcccuucaguucga

SEQ ID NO: 3342063 - RNA, 13 nt, Mycobacterium tuberculosis H37Rv
gcaggccgccggc

SEQ ID NO: 3342064 - RNA, 15 nt, Mycobacterium tuberculosis H37Rv
gcaggccgcgcucgu

SEQ ID NO: 3342065 - RNA, 20 nt, Mycobacterium tuberculosis H37Rv
gcaggccgcgcucgucgaag

SEQ ID NO: 3342066 - RNA, 13 nt, Mycobacterium tuberculosis H37Rv
gcaggccgcuggg

SEQ ID NO: 3342067 - RNA, 14 nt, Mycobacterium tuberculosis H37Rv
gcaggccggcggcg

SEQ ID NO: 3342068 - RNA, 12 nt, Mycobacterium tuberculosis H37Rv
gcaggccgggcg

SEQ ID NO: 3342069 - RNA, 14 nt, Mycobacterium tuberculosis H37Rv
gcaggccgggcgca

SEQ ID NO: 3342070 - RNA, 21 nt, Mycobacterium tuberculosis H37Rv
gcaggccuccaagcccgccgg

SEQ ID NO: 3342071 - RNA, 19 nt, Mycobacterium tuberculosis H37Rv
gcaggccucggcgccgccc

SEQ ID NO: 3342072 - RNA, 14 nt, Mycobacterium tuberculosis H37Rv
gcaggcgaacacca

SEQ ID NO: 3342073 - RNA, 15 nt, Mycobacterium tuberculosis H37Rv
gcaggcgacggcucu

SEQ ID NO: 3342074 - RNA, 21 nt, Mycobacterium tuberculosis H37Rv
gcaggcgaguuaggccgccag

SEQ ID NO: 3342075 - RNA, 17 nt, Mycobacterium tuberculosis H37Rv
gcaggcgaugcgccagg

SEQ ID NO: 3342076 - RNA, 17 nt, Mycobacterium tuberculosis H37Rv
gcaggcgcaagguggca

SEQ ID NO: 3342077 - RNA, 15 nt, Mycobacterium tuberculosis H37Rv
gcaggcggccagcga

SEQ ID NO: 3342078 - RNA, 15 nt, Mycobacterium tuberculosis H37Rv
gcaggcggccgccag

SEQ ID NO: 3342079 - RNA, 15 nt, Mycobacterium tuberculosis H37Rv
gcaggcggccuugcc

SEQ ID NO: 3342080 - RNA, 15 nt, Mycobacterium tuberculosis H37Rv
gcaggcggcucaacc

SEQ ID NO: 3342081 - RNA, 16 nt, Mycobacterium tuberculosis H37Rv
gcaggcggcugaacgg

SEQ ID NO: 3342082 - RNA, 19 nt, Mycobacterium tuberculosis H37Rv
gcaggcuaaucagccaggc

SEQ ID NO: 3342083 - RNA, 16 nt, Mycobacterium tuberculosis H37Rv
gcaggcucagcuggug

SEQ ID NO: 3342084 - RNA, 19 nt, Mycobacterium tuberculosis H37Rv
gcaggcucagcugguggcg

SEQ ID NO: 3342085 - RNA, 16 nt, Mycobacterium tuberculosis H37Rv
gcaggcucgaaccgac

SEQ ID NO: 3342086 - RNA, 17 nt, Mycobacterium tuberculosis H37Rv
gcaggcuggcugccacg

SEQ ID NO: 3342087 - RNA, 18 nt, Mycobacterium tuberculosis H37Rv
gcaggcugucaauccgcc

SEQ ID NO: 3342088 - RNA, 16 nt, Mycobacterium tuberculosis H37Rv
gcaggcuuagcuuccg

SEQ ID NO: 3342089 - RNA, 16 nt, Mycobacterium tuberculosis H37Rv
gcaggcuuccagccac

SEQ ID NO: 3342090 - RNA, 19 nt, Mycobacterium tuberculosis H37Rv
gcaggcuuucauugacacu

SEQ ID NO: 3342091 - RNA, 20 nt, Mycobacterium tuberculosis H37Rv
gcagggcauugcggcccgcg

SEQ ID NO: 3342092 - RNA, 22 nt, Mycobacterium tuberculosis H37Rv
gcagggcauugcggcccgcgau

SEQ ID NO: 3342093 - RNA, 19 nt, Mycobacterium tuberculosis H37Rv
gcagggccacuggccgguu

SEQ ID NO: 3342094 - RNA, 22 nt, Mycobacterium tuberculosis H37Rv
gcagggccacuggccgguucgc

SEQ ID NO: 3342095 - RNA, 18 nt, Mycobacterium tuberculosis H37Rv
gcagggccagcggcagcc

SEQ ID NO: 3342096 - RNA, 15 nt, Mycobacterium tuberculosis H37Rv
gcagggccgccgcga

SEQ ID NO: 3342097 - RNA, 17 nt, Mycobacterium tuberculosis H37Rv
gcagggccgccgcgaac

SEQ ID NO: 3342098 - RNA, 13 nt, Mycobacterium tuberculosis H37Rv
gcagggccgcgcg

SEQ ID NO: 3342099 - RNA, 14 nt, Mycobacterium tuberculosis H37Rv
gcagggcggugcca

SEQ ID NO: 3342100 - RNA, 13 nt, Mycobacterium tuberculosis H37Rv
gcaggggacgacc

SEQ ID NO: 3342101 - RNA, 15 nt, Mycobacterium tuberculosis H37Rv
gcaggggacgggcgg

SEQ ID NO: 3342102 - RNA, 23 nt, Mycobacterium tuberculosis H37Rv
gcagggggacccggaccuucggc

SEQ ID NO: 3342103 - RNA, 22 nt, Mycobacterium tuberculosis H37Rv
gcagggucgccccgaagcgggc

SEQ ID NO: 3342104 - RNA, 17 nt, Mycobacterium tuberculosis H37Rv
gcagggugaccaggauc

SEQ ID NO: 3342105 - RNA, 21 nt, Mycobacterium tuberculosis H37Rv
gcaggguggggcgguggccgg

SEQ ID NO: 3342106 - RNA, 16 nt, Mycobacterium tuberculosis H37Rv
gcagguacaucaccac

SEQ ID NO: 3342107 - RNA, 18 nt, Mycobacterium tuberculosis H37Rv
gcagguacaucaccacga

SEQ ID NO: 3342108 - RNA, 14 nt, Mycobacterium tuberculosis H37Rv
gcagguaccaccgc

SEQ ID NO: 3342109 - RNA, 20 nt, Mycobacterium tuberculosis H37Rv
gcagguacgccucgacagcg

SEQ ID NO: 3342110 - RNA, 21 nt, Mycobacterium tuberculosis H37Rv
gcagguagccaucggugcgca

SEQ ID NO: 3342111 - RNA, 13 nt, Mycobacterium tuberculosis H37Rv
gcagguagcucgu

SEQ ID NO: 3342112 - RNA, 15 nt, Mycobacterium tuberculosis H37Rv
gcagguagucgacga

SEQ ID NO: 3342113 - RNA, 22 nt, Mycobacterium tuberculosis H37Rv
gcagguauaccgagggucgggc

SEQ ID NO: 3342114 - RNA, 21 nt, Mycobacterium tuberculosis H37Rv
gcagguccaggguggucgucg

SEQ ID NO: 3342115 - RNA, 22 nt, Mycobacterium tuberculosis H37Rv
gcagguccgccaccgcgagcag

SEQ ID NO: 3342116 - RNA, 16 nt, Mycobacterium tuberculosis H37Rv
gcaggucgagcgccca

SEQ ID NO: 3342117 - RNA, 22 nt, Mycobacterium tuberculosis H37Rv
gcaucaucgcugugcgcugguc

SEQ ID NO: 3342118 - RNA, 15 nt, Mycobacterium tuberculosis H37Rv
gcaucauggccguga

SEQ ID NO: 3342119 - RNA, 15 nt, Mycobacterium tuberculosis H37Rv
gcauccacugcggcg

SEQ ID NO: 3342120 - RNA, 20 nt, Mycobacterium tuberculosis H37Rv
gcauccagccgugcggcggc

SEQ ID NO: 3342121 - RNA, 19 nt, Mycobacterium tuberculosis H37Rv
gcauccaggcugucgcggg

SEQ ID NO: 3342122 - RNA, 19 nt, Mycobacterium tuberculosis H37Rv
gcauccccagcacaaccag

SEQ ID NO: 3342123 - RNA, 20 nt, Mycobacterium tuberculosis H37Rv
gcauccccgguacgucgagg

SEQ ID NO: 3342124 - RNA, 15 nt, Mycobacterium tuberculosis H37Rv
gcaucccggccgcuc

SEQ ID NO: 3342125 - RNA, 17 nt, Mycobacterium tuberculosis H37Rv
gcaucccggccgcucag

SEQ ID NO: 3342126 - RNA, 13 nt, Mycobacterium tuberculosis H37Rv
gcaucccgggcag

SEQ ID NO: 3342127 - RNA, 16 nt, Mycobacterium tuberculosis H37Rv
gcaucccgguccagcc

SEQ ID NO: 3342128 - RNA, 17 nt, Mycobacterium tuberculosis H37Rv
gcaucccgguccagccc

SEQ ID NO: 3342129 - RNA, 14 nt, Mycobacterium tuberculosis H37Rv
gcauccgcggggag

SEQ ID NO: 3342130 - RNA, 20 nt, Mycobacterium tuberculosis H37Rv
gcauccgucguacacgccau

SEQ ID NO: 3342131 - RNA, 16 nt, Mycobacterium tuberculosis H37Rv
gcauccuccucgucga

SEQ ID NO: 3342132 - RNA, 19 nt, Mycobacterium tuberculosis H37Rv
gcauccuugccaaucgccg

SEQ ID NO: 3342133 - RNA, 20 nt, Mycobacterium tuberculosis H37Rv
gcaucgaacgcccugacggu

SEQ ID NO: 3342134 - RNA, 22 nt, Mycobacterium tuberculosis H37Rv
gcaucgaauuccagccagccgc

SEQ ID NO: 3342135 - RNA, 16 nt, Mycobacterium tuberculosis H37Rv
gcaucgacgaacccca

SEQ ID NO: 3342136 - RNA, 15 nt, Mycobacterium tuberculosis H37Rv
gcaucgacgcggcca

SEQ ID NO: 3342137 - RNA, 17 nt, Mycobacterium tuberculosis H37Rv
gcaucgacgugcgcggc

SEQ ID NO: 3342138 - RNA, 18 nt, Mycobacterium tuberculosis H37Rv
gcaucgacgugcgcggca

SEQ ID NO: 3342139 - RNA, 23 nt, Mycobacterium tuberculosis H37Rv
gcaucgacugccagcgccgcggc

SEQ ID NO: 3342140 - RNA, 17 nt, Mycobacterium tuberculosis H37Rv
gcaucgagacgcacggc

SEQ ID NO: 3342141 - RNA, 19 nt, Mycobacterium tuberculosis H37Rv
gcaucgagacgcacggcca

SEQ ID NO: 3342142 - RNA, 17 nt, Mycobacterium tuberculosis H37Rv
gcaucgagcagcccggg

SEQ ID NO: 3342143 - RNA, 15 nt, Mycobacterium tuberculosis H37Rv
gcaucgagcgucggg

SEQ ID NO: 3342144 - RNA, 21 nt, Mycobacterium tuberculosis H37Rv
gcaucgaguugucucgcaucg

SEQ ID NO: 3342145 - RNA, 17 nt, Mycobacterium tuberculosis H37Rv
gcaucgauucgaugucc

SEQ ID NO: 3342146 - RNA, 22 nt, Mycobacterium tuberculosis H37Rv
gcaucgauucgauguccucgac

SEQ ID NO: 3342147 - RNA, 14 nt, Mycobacterium tuberculosis H37Rv
gcaucgcacagcgc

SEQ ID NO: 3342148 - RNA, 14 nt, Mycobacterium tuberculosis H37Rv
gcaucgcaccaggu

SEQ ID NO: 3342149 - RNA, 14 nt, Mycobacterium tuberculosis H37Rv
gcaucgccacaguc

SEQ ID NO: 3342150 - RNA, 17 nt, Mycobacterium tuberculosis H37Rv
gcaucgccgacagcgcc

SEQ ID NO: 3342151 - RNA, 13 nt, Mycobacterium tuberculosis H37Rv
gcaucgccgagcu

SEQ ID NO: 3342152 - RNA, 19 nt, Mycobacterium tuberculosis H37Rv
gcaucgccgcuggccagca

SEQ ID NO: 3342153 - RNA, 23 nt, Mycobacterium tuberculosis H37Rv
gcaucgccgucaacgccucugcu

SEQ ID NO: 3342154 - RNA, 16 nt, Mycobacterium tuberculosis H37Rv
gcaucgccuccaggcg

SEQ ID NO: 3342155 - RNA, 14 nt, Mycobacterium tuberculosis H37Rv
gcaucgccuccucg

SEQ ID NO: 3342156 - RNA, 15 nt, Mycobacterium tuberculosis H37Rv
gcaucgccuccucga

SEQ ID NO: 3342157 - RNA, 16 nt, Mycobacterium tuberculosis H37Rv
gcaucgccugcgccuu

SEQ ID NO: 3342158 - RNA, 16 nt, Mycobacterium tuberculosis H37Rv
gcaucgcgagccagcu

SEQ ID NO: 3342159 - RNA, 17 nt, Mycobacterium tuberculosis H37Rv
gcaucgcgagccagcug

SEQ ID NO: 3342160 - RNA, 20 nt, Mycobacterium tuberculosis H37Rv
gcaucgcgagccagcugcuc

SEQ ID NO: 3342161 - RNA, 18 nt, Mycobacterium tuberculosis H37Rv
gcaucgcgaucggggcga

SEQ ID NO: 3342162 - RNA, 22 nt, Mycobacterium tuberculosis H37Rv
gcaucgcgauuccggcggccac

SEQ ID NO: 3342163 - RNA, 21 nt, Mycobacterium tuberculosis H37Rv
gcaucgcgccuuugagcccgc

SEQ ID NO: 3342164 - RNA, 13 nt, Mycobacterium tuberculosis H37Rv
gcaucgcggcauc

SEQ ID NO: 3342165 - RNA, 15 nt, Mycobacterium tuberculosis H37Rv
gcaucgcggcaucga

SEQ ID NO: 3342166 - RNA, 13 nt, Mycobacterium tuberculosis H37Rv
gcaucgcggcgac

SEQ ID NO: 3342167 - RNA, 15 nt, Mycobacterium tuberculosis H37Rv
gcaucgcggcggcgc

SEQ ID NO: 3342168 - RNA, 14 nt, Mycobacterium tuberculosis H37Rv
gcaucggcaaggcg

SEQ ID NO: 3342169 - RNA, 14 nt, Mycobacterium tuberculosis H37Rv
gcaucggcagcagc

SEQ ID NO: 3342170 - RNA, 15 nt, Mycobacterium tuberculosis H37Rv
gcaucggcagcagcg

SEQ ID NO: 3342171 - RNA, 14 nt, Mycobacterium tuberculosis H37Rv
gcaucggcagcccc

SEQ ID NO: 3342172 - RNA, 15 nt, Mycobacterium tuberculosis H37Rv
gcaucggccaccugu

SEQ ID NO: 3342173 - RNA, 13 nt, Mycobacterium tuberculosis H37Rv
gcaucggccccca

SEQ ID NO: 3342174 - RNA, 14 nt, Mycobacterium tuberculosis H37Rv
gcaucggcccccaa

SEQ ID NO: 3342175 - RNA, 12 nt, Mycobacterium tuberculosis H37Rv
gcaucggcggcc

SEQ ID NO: 3342176 - RNA, 19 nt, Mycobacterium tuberculosis H37Rv
gcaucggcggggcccacac

SEQ ID NO: 3342177 - RNA, 13 nt, Mycobacterium tuberculosis H37Rv
gcaucggcgguuc

SEQ ID NO: 3342178 - RNA, 21 nt, Mycobacterium tuberculosis H37Rv
gcaucgggcuugcgcagcagc

SEQ ID NO: 3342179 - RNA, 22 nt, Mycobacterium tuberculosis H37Rv
gcaucgggcuugcgcagcagcg

SEQ ID NO: 3342180 - RNA, 19 nt, Mycobacterium tuberculosis H37Rv
gcaucgggguuggugaacg

SEQ ID NO: 3342181 - RNA, 15 nt, Mycobacterium tuberculosis H37Rv
gcaucggucaccgcg

SEQ ID NO: 3342182 - RNA, 17 nt, Mycobacterium tuberculosis H37Rv
gcaucggucagcgccga

SEQ ID NO: 3342183 - RNA, 18 nt, Mycobacterium tuberculosis H37Rv
gcaucggucagcgcggca

SEQ ID NO: 3342184 - RNA, 14 nt, Mycobacterium tuberculosis H37Rv
gcaucgguccaaag

SEQ ID NO: 3342185 - RNA, 16 nt, Mycobacterium tuberculosis H37Rv
gcaucgguccaaagca

SEQ ID NO: 3342186 - RNA, 14 nt, Mycobacterium tuberculosis H37Rv
gcaucggugcagcc

SEQ ID NO: 3342187 - RNA, 15 nt, Mycobacterium tuberculosis H37Rv
gcaucggugcagccc

SEQ ID NO: 3342188 - RNA, 21 nt, Mycobacterium tuberculosis H37Rv
gcaucggugguaacaccggcg

SEQ ID NO: 3342189 - RNA, 22 nt, Mycobacterium tuberculosis H37Rv
gcaucggugguaacaccggcga

SEQ ID NO: 3342190 - RNA, 18 nt, Mycobacterium tuberculosis H37Rv
gcaucgucagcgaccacg

SEQ ID NO: 3342191 - RNA, 20 nt, Mycobacterium tuberculosis H37Rv
gcaucgucgaauccucgcga

SEQ ID NO: 3342192 - RNA, 17 nt, Mycobacterium tuberculosis H37Rv
gcaucgucgccauaccu

SEQ ID NO: 3342193 - RNA, 13 nt, Mycobacterium tuberculosis H37Rv
gcaucgucgccga

SEQ ID NO: 3342194 - RNA, 16 nt, Mycobacterium tuberculosis H37Rv
gcaucgucgccgaccg

SEQ ID NO: 3342195 - RNA, 19 nt, Mycobacterium tuberculosis H37Rv
gcaucgucgccgaccguca

SEQ ID NO: 3342196 - RNA, 15 nt, Mycobacterium tuberculosis H37Rv
gcaucgucgccgagc

SEQ ID NO: 3342197 - RNA, 22 nt, Mycobacterium tuberculosis H37Rv
gcaucgucgggucaaugcuggc

SEQ ID NO: 3342198 - RNA, 14 nt, Mycobacterium tuberculosis H37Rv
gcaucguggccgca

SEQ ID NO: 3342199 - RNA, 16 nt, Mycobacterium tuberculosis H37Rv
gcaucguugccgaccg

SEQ ID NO: 3342200 - RNA, 22 nt, Mycobacterium tuberculosis H37Rv
gcaucuagguucaguuccaccg

SEQ ID NO: 3342201 - RNA, 19 nt, Mycobacterium tuberculosis H37Rv
gcaucuccgucggccaggc

SEQ ID NO: 3342202 - RNA, 20 nt, Mycobacterium tuberculosis H37Rv
gcaucuccgucggccaggcc

SEQ ID NO: 3342203 - RNA, 22 nt, Mycobacterium tuberculosis H37Rv
gcaucuccgucggccaggccac

SEQ ID NO: 3342204 - RNA, 19 nt, Mycobacterium tuberculosis H37Rv
gcaucuccucgccugcccg

SEQ ID NO: 3342205 - RNA, 18 nt, Mycobacterium tuberculosis H37Rv
gcaucucgggcgaagccg

SEQ ID NO: 3342206 - RNA, 18 nt, Mycobacterium tuberculosis H37Rv
gcaucugcgggucggcau

SEQ ID NO: 3342207 - RNA, 14 nt, Mycobacterium tuberculosis H37Rv
gcaucugcuucugc

SEQ ID NO: 3342208 - RNA, 16 nt, Mycobacterium tuberculosis H37Rv
gcaucugucgcgcggc

SEQ ID NO: 3342209 - RNA, 15 nt, Mycobacterium tuberculosis H37Rv
gcaucuuuggcggcc

SEQ ID NO: 3342210 - RNA, 20 nt, Mycobacterium tuberculosis H37Rv
gcaugaacugcucgccgagg

SEQ ID NO: 3342211 - RNA, 16 nt, Mycobacterium tuberculosis H37Rv
gcaugacaccggccac

SEQ ID NO: 3342212 - RNA, 23 nt, Mycobacterium tuberculosis H37Rv
gcaugaccccgucagcgggcagc

SEQ ID NO: 3342213 - RNA, 14 nt, Mycobacterium tuberculosis H37Rv
gccacaacggcggc

SEQ ID NO: 3342214 - RNA, 16 nt, Mycobacterium tuberculosis H37Rv
gccacaacggcggcgc

SEQ ID NO: 3342215 - RNA, 15 nt, Mycobacterium tuberculosis H37Rv
gccacaaucgcagau

SEQ ID NO: 3342216 - RNA, 15 nt, Mycobacterium tuberculosis H37Rv
gccacacacugccgg

SEQ ID NO: 3342217 - RNA, 12 nt, Mycobacterium tuberculosis H37Rv
gccacacaggcg

SEQ ID NO: 3342218 - RNA, 19 nt, Mycobacterium tuberculosis H37Rv
gccacaccaugauugccag

SEQ ID NO: 3342219 - RNA, 13 nt, Mycobacterium tuberculosis H37Rv
gccacacccgugu

SEQ ID NO: 3342220 - RNA, 19 nt, Mycobacterium tuberculosis H37Rv
gccacaccgccgccaagcu

SEQ ID NO: 3342221 - RNA, 16 nt, Mycobacterium tuberculosis H37Rv
gccacaccuuggccgc

SEQ ID NO: 3342222 - RNA, 15 nt, Mycobacterium tuberculosis H37Rv
gccacacucccgcgc

SEQ ID NO: 3342223 - RNA, 19 nt, Mycobacterium tuberculosis H37Rv
gccacacucccgcgcccga

SEQ ID NO: 3342224 - RNA, 19 nt, Mycobacterium tuberculosis H37Rv
gccacacucgccagggcca

SEQ ID NO: 3342225 - RNA, 13 nt, Mycobacterium tuberculosis H37Rv
gccacagcaacgu

SEQ ID NO: 3342226 - RNA, 12 nt, Mycobacterium tuberculosis H37Rv
gccacagcccca

SEQ ID NO: 3342227 - RNA, 15 nt, Mycobacterium tuberculosis H37Rv
gccacagccccaggg

SEQ ID NO: 3342228 - RNA, 16 nt, Mycobacterium tuberculosis H37Rv
gccacagcccggcggc

SEQ ID NO: 3342229 - RNA, 15 nt, Mycobacterium tuberculosis H37Rv
gccacagcgacagcg

SEQ ID NO: 3342230 - RNA, 22 nt, Mycobacterium tuberculosis H37Rv
gccacagcucgccgugaccagg

SEQ ID NO: 3342231 - RNA, 17 nt, Mycobacterium tuberculosis H37Rv
gccacaggcguuuccgc

SEQ ID NO: 3342232 - RNA, 16 nt, Mycobacterium tuberculosis H37Rv
gccacagucgucgagc

SEQ ID NO: 3342233 - RNA, 17 nt, Mycobacterium tuberculosis H37Rv
gccacaucgccagcagc

SEQ ID NO: 3342234 - RNA, 15 nt, Mycobacterium tuberculosis H37Rv
gccacaucguggcgu

SEQ ID NO: 3342235 - RNA, 20 nt, Mycobacterium tuberculosis H37Rv
gccacaucguucaugaucgg

SEQ ID NO: 3342236 - RNA, 23 nt, Mycobacterium tuberculosis H37Rv
gccacaucguucaugaucggcag

SEQ ID NO: 3342237 - RNA, 23 nt, Mycobacterium tuberculosis H37Rv
gccacaugaccugauccggccgg

SEQ ID NO: 3342238 - RNA, 22 nt, Mycobacterium tuberculosis H37Rv
gccacaugaucgagcaguucca

SEQ ID NO: 3342239 - RNA, 13 nt, Mycobacterium tuberculosis H37Rv
gccacauuucacc

SEQ ID NO: 3342240 - RNA, 15 nt, Mycobacterium tuberculosis H37Rv
gccacauuucaccac

SEQ ID NO: 3342241 - RNA, 21 nt, Mycobacterium tuberculosis H37Rv
gccacauuucaccaccguggc

SEQ ID NO: 3342242 - RNA, 12 nt, Mycobacterium tuberculosis H37Rv
gccaccaaaccc

SEQ ID NO: 3342243 - RNA, 13 nt, Mycobacterium tuberculosis H37Rv
gccaccaaaccgc

SEQ ID NO: 3342244 - RNA, 15 nt, Mycobacterium tuberculosis H37Rv
gccaccaacaccgcg

SEQ ID NO: 3342245 - RNA, 10 nt, Mycobacterium tuberculosis H37Rv
gccaccaacu

SEQ ID NO: 3342246 - RNA, 16 nt, Mycobacterium tuberculosis H37Rv
gccaccaacucggcga

SEQ ID NO: 3342247 - RNA, 22 nt, Mycobacterium tuberculosis H37Rv
gccaccaagaaguugacaccag

SEQ ID NO: 3342248 - RNA, 19 nt, Mycobacterium tuberculosis H37Rv
gccaccacaacgccaggaa

SEQ ID NO: 3342249 - RNA, 14 nt, Mycobacterium tuberculosis H37Rv
gccaccaccacggc

SEQ ID NO: 3342250 - RNA, 14 nt, Mycobacterium tuberculosis H37Rv
gccaccaccagggc

SEQ ID NO: 3342251 - RNA, 22 nt, Mycobacterium tuberculosis H37Rv
gccaccaccagggcaacggccg

SEQ ID NO: 3342252 - RNA, 23 nt, Mycobacterium tuberculosis H37Rv
gccaccaccagggcaacggccgc

SEQ ID NO: 3342253 - RNA, 14 nt, Mycobacterium tuberculosis H37Rv
gccaccaccagguc

SEQ ID NO: 3342254 - RNA, 17 nt, Mycobacterium tuberculosis H37Rv
gccaccacccaggccau

SEQ ID NO: 3342255 - RNA, 14 nt, Mycobacterium tuberculosis H37Rv
gccaccaccgccgc

SEQ ID NO: 3342256 - RNA, 18 nt, Mycobacterium tuberculosis H37Rv
gccaccaccgcugccggc

SEQ ID NO: 3342257 - RNA, 17 nt, Mycobacterium tuberculosis H37Rv
gccaccacgccgucgac

SEQ ID NO: 3342258 - RNA, 21 nt, Mycobacterium tuberculosis H37Rv
gccaccacgccgucgacaaca

SEQ ID NO: 3342259 - RNA, 12 nt, Mycobacterium tuberculosis H37Rv
gccaccacgcgc

SEQ ID NO: 3342260 - RNA, 18 nt, Mycobacterium tuberculosis H37Rv
gccaccacgcuccccagc

SEQ ID NO: 3342261 - RNA, 23 nt, Mycobacterium tuberculosis H37Rv
gccaccacgcuccccagcgaauc

SEQ ID NO: 3342262 - RNA, 17 nt, Mycobacterium tuberculosis H37Rv
gccaccacggcgcgcuc

SEQ ID NO: 3342263 - RNA, 18 nt, Mycobacterium tuberculosis H37Rv
gccaccacggcgcgcucg

SEQ ID NO: 3342264 - RNA, 20 nt, Mycobacterium tuberculosis H37Rv
gccaccacggucaagccggc

SEQ ID NO: 3342265 - RNA, 22 nt, Mycobacterium tuberculosis H37Rv
gccaccacggucaagccggcgc

SEQ ID NO: 3342266 - RNA, 17 nt, Mycobacterium tuberculosis H37Rv
gccaccacugcgcccgc

SEQ ID NO: 3342267 - RNA, 19 nt, Mycobacterium tuberculosis H37Rv
gccaccagaaacaccgacg

SEQ ID NO: 3342268 - RNA, 13 nt, Mycobacterium tuberculosis H37Rv
gccaccagaaucc

SEQ ID NO: 3342269 - RNA, 21 nt, Mycobacterium tuberculosis H37Rv
gccaccagacaacgccgucga

SEQ ID NO: 3342270 - RNA, 21 nt, Mycobacterium tuberculosis H37Rv
gccaccagagucaacaucagc

SEQ ID NO: 3342271 - RNA, 13 nt, Mycobacterium tuberculosis H37Rv
gccaccagcccga

SEQ ID NO: 3342272 - RNA, 17 nt, Mycobacterium tuberculosis H37Rv
gccaccagcgacgacca

SEQ ID NO: 3342273 - RNA, 22 nt, Mycobacterium tuberculosis H37Rv
gccaccagcgcacgcucggcac

SEQ ID NO: 3342274 - RNA, 22 nt, Mycobacterium tuberculosis H37Rv
gccaccagcgcccggcccgcca

SEQ ID NO: 3342275 - RNA, 18 nt, Mycobacterium tuberculosis H37Rv
gccaccagggcacguucg

SEQ ID NO: 3342276 - RNA, 13 nt, Mycobacterium tuberculosis H37Rv
gccaccagggcca

SEQ ID NO: 3342277 - RNA, 15 nt, Mycobacterium tuberculosis H37Rv
gccaccagggccacc

SEQ ID NO: 3342278 - RNA, 17 nt, Mycobacterium tuberculosis H37Rv
gccaccagggccgcagu

SEQ ID NO: 3342279 - RNA, 17 nt, Mycobacterium tuberculosis H37Rv
gccaccaggggaccgcg

SEQ ID NO: 3342280 - RNA, 13 nt, Mycobacterium tuberculosis H37Rv
gccaccaggucga

SEQ ID NO: 3342281 - RNA, 20 nt, Mycobacterium tuberculosis H37Rv
gccaccagucacgcccacca

SEQ ID NO: 3342282 - RNA, 17 nt, Mycobacterium tuberculosis H37Rv
gccaccaguccgauggg

SEQ ID NO: 3342283 - RNA, 21 nt, Mycobacterium tuberculosis H37Rv
gccaccaucaccucgcacgac

SEQ ID NO: 3342284 - RNA, 16 nt, Mycobacterium tuberculosis H37Rv
gccaccaucgccgccg

SEQ ID NO: 3342285 - RNA, 14 nt, Mycobacterium tuberculosis H37Rv
gccaccaucuggau

SEQ ID NO: 3342286 - RNA, 13 nt, Mycobacterium tuberculosis H37Rv
gccacccagaaug

SEQ ID NO: 3342287 - RNA, 21 nt, Mycobacterium tuberculosis H37Rv
gccacccagcacgcgcgcgac

SEQ ID NO: 3342288 - RNA, 18 nt, Mycobacterium tuberculosis H37Rv
gccacccagggccuuccc

SEQ ID NO: 3342289 - RNA, 21 nt, Mycobacterium tuberculosis H37Rv
gccacccccaaccgccggcca

SEQ ID NO: 3342290 - RNA, 19 nt, Mycobacterium tuberculosis H37Rv
gccaccccgcguaugccag

SEQ ID NO: 3342291 - RNA, 16 nt, Mycobacterium tuberculosis H37Rv
gccacccgacaacgcu

SEQ ID NO: 3342292 - RNA, 13 nt, Mycobacterium tuberculosis H37Rv
gccacccgcaacu

SEQ ID NO: 3342293 - RNA, 13 nt, Mycobacterium tuberculosis H37Rv
gccacccgcgaag

SEQ ID NO: 3342294 - RNA, 18 nt, Mycobacterium tuberculosis H37Rv
gccacccgcgccgccagc

SEQ ID NO: 3342295 - RNA, 16 nt, Mycobacterium tuberculosis H37Rv
gccacccgcgccgccc

SEQ ID NO: 3342296 - RNA, 13 nt, Mycobacterium tuberculosis H37Rv
gccacccgcgcga

SEQ ID NO: 3342297 - RNA, 22 nt, Mycobacterium tuberculosis H37Rv
gccacccgcgcgaugcuggcga

SEQ ID NO: 3342298 - RNA, 21 nt, Mycobacterium tuberculosis H37Rv
gccacccggacauagccgcgc

SEQ ID NO: 3342299 - RNA, 22 nt, Mycobacterium tuberculosis H37Rv
gccacccggacauagccgcgcu

SEQ ID NO: 3342300 - RNA, 15 nt, Mycobacterium tuberculosis H37Rv
gccacccggccaggu

SEQ ID NO: 3342301 - RNA, 15 nt, Mycobacterium tuberculosis H37Rv
gccacccggccgcgc

SEQ ID NO: 3342302 - RNA, 15 nt, Mycobacterium tuberculosis H37Rv
gccacccgguccacc

SEQ ID NO: 3342303 - RNA, 12 nt, Mycobacterium tuberculosis H37Rv
gccacccuugcc

SEQ ID NO: 3342304 - RNA, 15 nt, Mycobacterium tuberculosis H37Rv
gccacccuugccgcc

SEQ ID NO: 3342305 - RNA, 17 nt, Mycobacterium tuberculosis H37Rv
gccaccgaagccgccgg

SEQ ID NO: 3342306 - RNA, 20 nt, Mycobacterium tuberculosis H37Rv
gccaccgaagccgccgggug

SEQ ID NO: 3342307 - RNA, 15 nt, Mycobacterium tuberculosis H37Rv
gccaccgaccccgga

SEQ ID NO: 3342308 - RNA, 20 nt, Mycobacterium tuberculosis H37Rv
gccaccgagaucaugccggc

SEQ ID NO: 3342309 - RNA, 14 nt, Mycobacterium tuberculosis H37Rv
gccaccgagcccuc

SEQ ID NO: 3342310 - RNA, 17 nt, Mycobacterium tuberculosis H37Rv
gccacgacgaacaccag

SEQ ID NO: 3342311 - RNA, 20 nt, Mycobacterium tuberculosis H37Rv
gccacgagcaacgggcgaac

SEQ ID NO: 3342312 - RNA, 13 nt, Mycobacterium tuberculosis H37Rv
gccacgaggaccc

SEQ ID NO: 3342313 - RNA, 18 nt, Mycobacterium tuberculosis H37Rv
gccacgaggacccgucga

SEQ ID NO: 3342314 - RNA, 14 nt, Mycobacterium tuberculosis H37Rv
gccacgauccuugg

SEQ ID NO: 3342315 - RNA, 15 nt, Mycobacterium tuberculosis H37Rv
gccacgaugauccca

SEQ ID NO: 3342316 - RNA, 16 nt, Mycobacterium tuberculosis H37Rv
gccacgaugaucccaa

SEQ ID NO: 3342317 - RNA, 18 nt, Mycobacterium tuberculosis H37Rv
gccacgcagcacggcacc

SEQ ID NO: 3342318 - RNA, 15 nt, Mycobacterium tuberculosis H37Rv
gccacgccacgucca

SEQ ID NO: 3342319 - RNA, 13 nt, Mycobacterium tuberculosis H37Rv
gccacgccagcgu

SEQ ID NO: 3342320 - RNA, 16 nt, Mycobacterium tuberculosis H37Rv
gccacgccagcgucga

SEQ ID NO: 3342321 - RNA, 20 nt, Mycobacterium tuberculosis H37Rv
gccacgcccacaggggcagc

SEQ ID NO: 3342322 - RNA, 17 nt, Mycobacterium tuberculosis H37Rv
gccacgcccgacgccag

SEQ ID NO: 3342323 - RNA, 14 nt, Mycobacterium tuberculosis H37Rv
gccacgccgaggcg

SEQ ID NO: 3342324 - RNA, 17 nt, Mycobacterium tuberculosis H37Rv
gccacgccgaucaacau

SEQ ID NO: 3342325 - RNA, 14 nt, Mycobacterium tuberculosis H37Rv
gccacgccgaugcg

SEQ ID NO: 3342326 - RNA, 17 nt, Mycobacterium tuberculosis H37Rv
gccacgccgaugcggug

SEQ ID NO: 3342327 - RNA, 23 nt, Mycobacterium tuberculosis H37Rv
gccacgccgccggugaacgucac

SEQ ID NO: 3342328 - RNA, 15 nt, Mycobacterium tuberculosis H37Rv
gccacgccugagcca

SEQ ID NO: 3342329 - RNA, 20 nt, Mycobacterium tuberculosis H37Rv
gccacgccugcucggagagc

SEQ ID NO: 3342330 - RNA, 19 nt, Mycobacterium tuberculosis H37Rv
gccacgcguuccuccagca

SEQ ID NO: 3342331 - RNA, 21 nt, Mycobacterium tuberculosis H37Rv
gccacgcguuccuccagcagc

SEQ ID NO: 3342332 - RNA, 23 nt, Mycobacterium tuberculosis H37Rv
gccacgcucggcggccagcuccc

SEQ ID NO: 3342333 - RNA, 15 nt, Mycobacterium tuberculosis H37Rv
gccacgcucggugcu

SEQ ID NO: 3342334 - RNA, 17 nt, Mycobacterium tuberculosis H37Rv
gccacgcucggugcugc

SEQ ID NO: 3342335 - RNA, 23 nt, Mycobacterium tuberculosis H37Rv
gccacgcucggugcugcgccgau

SEQ ID NO: 3342336 - RNA, 23 nt, Mycobacterium tuberculosis H37Rv
gccacgcuucuuccgcgcgccgg

SEQ ID NO: 3342337 - RNA, 22 nt, Mycobacterium tuberculosis H37Rv
gccacggacccgaagucacagg

SEQ ID NO: 3342338 - RNA, 18 nt, Mycobacterium tuberculosis H37Rv
gccacggcaaaggcgcuc

SEQ ID NO: 3342339 - RNA, 16 nt, Mycobacterium tuberculosis H37Rv
gccacggcaaucaacg

SEQ ID NO: 3342340 - RNA, 15 nt, Mycobacterium tuberculosis H37Rv
gccacggcagcgccc

SEQ ID NO: 3342341 - RNA, 16 nt, Mycobacterium tuberculosis H37Rv
gccacggcagcgccca

SEQ ID NO: 3342342 - RNA, 22 nt, Mycobacterium tuberculosis H37Rv
gccacggcagcgcccagaucgc

SEQ ID NO: 3342343 - RNA, 15 nt, Mycobacterium tuberculosis H37Rv
gccacggcaucggcc

SEQ ID NO: 3342344 - RNA, 15 nt, Mycobacterium tuberculosis H37Rv
gccacggcgucggcc

SEQ ID NO: 3342345 - RNA, 20 nt, Mycobacterium tuberculosis H37Rv
gccacggcgucggccacccg

SEQ ID NO: 3342346 - RNA, 13 nt, Mycobacterium tuberculosis H37Rv
gccacggcugccc

SEQ ID NO: 3342347 - RNA, 18 nt, Mycobacterium tuberculosis H37Rv
gccacggcuucgccgcgg

SEQ ID NO: 3342348 - RNA, 22 nt, Mycobacterium tuberculosis H37Rv
gccacggcuuugcggcgcgacc

SEQ ID NO: 3342349 - RNA, 18 nt, Mycobacterium tuberculosis H37Rv
gccacgggcggccaccgc

SEQ ID NO: 3342350 - RNA, 14 nt, Mycobacterium tuberculosis H37Rv
gccacgguccggcc

SEQ ID NO: 3342351 - RNA, 22 nt, Mycobacterium tuberculosis H37Rv
gccacgguccggcccaccagcg

SEQ ID NO: 3342352 - RNA, 13 nt, Mycobacterium tuberculosis H37Rv
gccacggucgccg

SEQ ID NO: 3342353 - RNA, 20 nt, Mycobacterium tuberculosis H37Rv
gccacggugacccugguggu

SEQ ID NO: 3342354 - RNA, 19 nt, Mycobacterium tuberculosis H37Rv
gccacgguggagcgcgccu

SEQ ID NO: 3342355 - RNA, 20 nt, Mycobacterium tuberculosis H37Rv
gccacgguggagcgcgccuc

SEQ ID NO: 3342356 - RNA, 22 nt, Mycobacterium tuberculosis H37Rv
gccacgguggagcgcgccucgc

SEQ ID NO: 3342357 - RNA, 22 nt, Mycobacterium tuberculosis H37Rv
gccacggugucgcgaugcuucc

SEQ ID NO: 3342358 - RNA, 23 nt, Mycobacterium tuberculosis H37Rv
gccacggugucgucgaccaccug

SEQ ID NO: 3342359 - RNA, 21 nt, Mycobacterium tuberculosis H37Rv
gccacgguucgggcagcaccc

SEQ ID NO: 3342360 - RNA, 19 nt, Mycobacterium tuberculosis H37Rv
gccacguaauuccccaggg

SEQ ID NO: 3342361 - RNA, 18 nt, Mycobacterium tuberculosis H37Rv
gccacguacuccaccgcg

SEQ ID NO: 3342362 - RNA, 17 nt, Mycobacterium tuberculosis H37Rv
gccacguagcagcagac

SEQ ID NO: 3342363 - RNA, 14 nt, Mycobacterium tuberculosis H37Rv
gccacguagcagcg

SEQ ID NO: 3342364 - RNA, 20 nt, Mycobacterium tuberculosis H37Rv
gccacguagcagcgccggca

SEQ ID NO: 3342365 - RNA, 21 nt, Mycobacterium tuberculosis H37Rv
gccacguagcagcgccggcac

SEQ ID NO: 3342366 - RNA, 17 nt, Mycobacterium tuberculosis H37Rv
gccacgucaaacccgac

SEQ ID NO: 3342367 - RNA, 19 nt, Mycobacterium tuberculosis H37Rv
gccacguccaucaccggcg

SEQ ID NO: 3342368 - RNA, 21 nt, Mycobacterium tuberculosis H37Rv
gccacguccaucaccggcggc

SEQ ID NO: 3342369 - RNA, 22 nt, Mycobacterium tuberculosis H37Rv
gccacgucccaggacuccggcc

SEQ ID NO: 3342370 - RNA, 16 nt, Mycobacterium tuberculosis H37Rv
gccacgucgagcaccc

SEQ ID NO: 3342371 - RNA, 19 nt, Mycobacterium tuberculosis H37Rv
gccacgucgaugugcgccc

SEQ ID NO: 3342372 - RNA, 14 nt, Mycobacterium tuberculosis H37Rv
gccacgucggcgaa

SEQ ID NO: 3342373 - RNA, 15 nt, Mycobacterium tuberculosis H37Rv
gccacgucggcgaac

SEQ ID NO: 3342374 - RNA, 16 nt, Mycobacterium tuberculosis H37Rv
gccacguggucgagca

SEQ ID NO: 3342375 - RNA, 20 nt, Mycobacterium tuberculosis H37Rv
gccacguggucgagcaggcg

SEQ ID NO: 3342376 - RNA, 21 nt, Mycobacterium tuberculosis H37Rv
gccacguuacgcucgcgggcc

SEQ ID NO: 3342377 - RNA, 17 nt, Mycobacterium tuberculosis H37Rv
gccacguugaucccgaa

SEQ ID NO: 3342378 - RNA, 19 nt, Mycobacterium tuberculosis H37Rv
gccacguugaucccgaacc

SEQ ID NO: 3342379 - RNA, 18 nt, Mycobacterium tuberculosis H37Rv
gccacuacggccuggcca

SEQ ID NO: 3342380 - RNA, 20 nt, Mycobacterium tuberculosis H37Rv
gccacuacggccuggccacc

SEQ ID NO: 3342381 - RNA, 20 nt, Mycobacterium tuberculosis H37Rv
gccacuagcauugucgccgg

SEQ ID NO: 3342382 - RNA, 15 nt, Mycobacterium tuberculosis H37Rv
gccacuccaggagcc

SEQ ID NO: 3342383 - RNA, 14 nt, Mycobacterium tuberculosis H37Rv
gccacucccagcca

SEQ ID NO: 3342384 - RNA, 22 nt, Mycobacterium tuberculosis H37Rv
gccacuccgguggccaacaccg

SEQ ID NO: 3342385 - RNA, 17 nt, Mycobacterium tuberculosis H37Rv
gccacuccucggugugc

SEQ ID NO: 3342386 - RNA, 22 nt, Mycobacterium tuberculosis H37Rv
gccacuccugaguuccggucga

SEQ ID NO: 3342387 - RNA, 13 nt, Mycobacterium tuberculosis H37Rv
gccacucgcccga

SEQ ID NO: 3342388 - RNA, 18 nt, Mycobacterium tuberculosis H37Rv
gccacucgcccgauccgg

SEQ ID NO: 3342389 - RNA, 13 nt, Mycobacterium tuberculosis H37Rv
gccacugaccgcg

SEQ ID NO: 3342390 - RNA, 14 nt, Mycobacterium tuberculosis H37Rv
gccacugaccgcga

SEQ ID NO: 3342391 - RNA, 21 nt, Mycobacterium tuberculosis H37Rv
gccacugaccgcgaucgccga

SEQ ID NO: 3342392 - RNA, 12 nt, Mycobacterium tuberculosis H37Rv
gccacugagcca

SEQ ID NO: 3342393 - RNA, 17 nt, Mycobacterium tuberculosis H37Rv
gccacugauucgcaggc

SEQ ID NO: 3342394 - RNA, 13 nt, Mycobacterium tuberculosis H37Rv
gccacugccagcc

SEQ ID NO: 3342395 - RNA, 15 nt, Mycobacterium tuberculosis H37Rv
gccacugccgaccag

SEQ ID NO: 3342396 - RNA, 16 nt, Mycobacterium tuberculosis H37Rv
gccacugccgaccagc

SEQ ID NO: 3342397 - RNA, 13 nt, Mycobacterium tuberculosis H37Rv
gccacugccggca

SEQ ID NO: 3342398 - RNA, 16 nt, Mycobacterium tuberculosis H37Rv
gccacugccggugggc

SEQ ID NO: 3342399 - RNA, 20 nt, Mycobacterium tuberculosis H37Rv
gccacugccguugccgccgg

SEQ ID NO: 3342400 - RNA, 14 nt, Mycobacterium tuberculosis H37Rv
gccacugcguucca

SEQ ID NO: 3342401 - RNA, 18 nt, Mycobacterium tuberculosis H37Rv
gccacugcuuccggaaca

SEQ ID NO: 3342402 - RNA, 14 nt, Mycobacterium tuberculosis H37Rv
gccacuggccgguu

SEQ ID NO: 3342403 - RNA, 22 nt, Mycobacterium tuberculosis H37Rv
gccacuggccgguucgcccgag

SEQ ID NO: 3342404 - RNA, 18 nt, Mycobacterium tuberculosis H37Rv
gccacuguugaagaagcc

SEQ ID NO: 3342405 - RNA, 21 nt, Mycobacterium tuberculosis H37Rv
gccacuguugaagaagcccga

SEQ ID NO: 3342406 - RNA, 16 nt, Mycobacterium tuberculosis H37Rv
gccagcaggccgaaga

SEQ ID NO: 3342407 - RNA, 21 nt, Mycobacterium tuberculosis H37Rv
gccagcaggggacgggcggcc

SEQ ID NO: 3342408 - RNA, 15 nt, Mycobacterium tuberculosis H37Rv
gccagcagguauuug

SEQ ID NO: 3342409 - RNA, 14 nt, Mycobacterium tuberculosis H37Rv
gccagcagguccgc

SEQ ID NO: 3342410 - RNA, 13 nt, Mycobacterium tuberculosis H37Rv
gccagcaucauca

SEQ ID NO: 3342411 - RNA, 19 nt, Mycobacterium tuberculosis H37Rv
gccagcaucgcggugguug

SEQ ID NO: 3342412 - RNA, 18 nt, Mycobacterium tuberculosis H37Rv
gccagcaucggcagcagc

SEQ ID NO: 3342413 - RNA, 13 nt, Mycobacterium tuberculosis H37Rv
gccagcaucgggu

SEQ ID NO: 3342414 - RNA, 14 nt, Mycobacterium tuberculosis H37Rv
gccagcaucgugug

SEQ ID NO: 3342415 - RNA, 15 nt, Mycobacterium tuberculosis H37Rv
gccagcaugacaccg

SEQ ID NO: 3342416 - RNA, 18 nt, Mycobacterium tuberculosis H37Rv
gccagcaugacaccggcc

SEQ ID NO: 3342417 - RNA, 16 nt, Mycobacterium tuberculosis H37Rv
gccagcauugaagaag

SEQ ID NO: 3342418 - RNA, 21 nt, Mycobacterium tuberculosis H37Rv
gccagcauugaagaagcccga

SEQ ID NO: 3342419 - RNA, 22 nt, Mycobacterium tuberculosis H37Rv
gccagcauugaagaagcccgaa

SEQ ID NO: 3342420 - RNA, 17 nt, Mycobacterium tuberculosis H37Rv
gccagcauugacccgac

SEQ ID NO: 3342421 - RNA, 21 nt, Mycobacterium tuberculosis H37Rv
gccagccaacgcgucccgccg

SEQ ID NO: 3342422 - RNA, 15 nt, Mycobacterium tuberculosis H37Rv
gccagccacuccucg

SEQ ID NO: 3342423 - RNA, 16 nt, Mycobacterium tuberculosis H37Rv
gccagccacuccucgg

SEQ ID NO: 3342424 - RNA, 15 nt, Mycobacterium tuberculosis H37Rv
gccagccagcgggcg

SEQ ID NO: 3342425 - RNA, 19 nt, Mycobacterium tuberculosis H37Rv
gccagcccacucgucgaac

SEQ ID NO: 3342426 - RNA, 23 nt, Mycobacterium tuberculosis H37Rv
gccagcccacucgucgaacaccg

SEQ ID NO: 3342427 - RNA, 14 nt, Mycobacterium tuberculosis H37Rv
gccagcccagcacg

SEQ ID NO: 3342428 - RNA, 14 nt, Mycobacterium tuberculosis H37Rv
gccagcccagccgc

SEQ ID NO: 3342429 - RNA, 24 nt, Mycobacterium tuberculosis H37Rv
gccagccccagcguucccgccggc

SEQ ID NO: 3342430 - RNA, 13 nt, Mycobacterium tuberculosis H37Rv
gccagccccgccg

SEQ ID NO: 3342431 - RNA, 18 nt, Mycobacterium tuberculosis H37Rv
gccagccccgccggggcc

SEQ ID NO: 3342432 - RNA, 15 nt, Mycobacterium tuberculosis H37Rv
gccagccccgcgccc

SEQ ID NO: 3342433 - RNA, 16 nt, Mycobacterium tuberculosis H37Rv
gccagcccggcgugca

SEQ ID NO: 3342434 - RNA, 14 nt, Mycobacterium tuberculosis H37Rv
gccagcccguccgg

SEQ ID NO: 3342435 - RNA, 18 nt, Mycobacterium tuberculosis H37Rv
gccagcccguugcaggac

SEQ ID NO: 3342436 - RNA, 20 nt, Mycobacterium tuberculosis H37Rv
gccagccgacaacuguccug

SEQ ID NO: 3342437 - RNA, 15 nt, Mycobacterium tuberculosis H37Rv
gccagccgcacgguu

SEQ ID NO: 3342438 - RNA, 20 nt, Mycobacterium tuberculosis H37Rv
gccagccgcgagccggugau

SEQ ID NO: 3342439 - RNA, 14 nt, Mycobacterium tuberculosis H37Rv
gccagccgcggccc

SEQ ID NO: 3342440 - RNA, 14 nt, Mycobacterium tuberculosis H37Rv
gccagccgcucacc

SEQ ID NO: 3342441 - RNA, 18 nt, Mycobacterium tuberculosis H37Rv
gccagccgcugccacagg

SEQ ID NO: 3342442 - RNA, 23 nt, Mycobacterium tuberculosis H37Rv
gccagccgcugccacaggugacc

SEQ ID NO: 3342443 - RNA, 20 nt, Mycobacterium tuberculosis H37Rv
gccagccggccgcgaccgcg

SEQ ID NO: 3342444 - RNA, 14 nt, Mycobacterium tuberculosis H37Rv
gccagccggcgcac

SEQ ID NO: 3342445 - RNA, 19 nt, Mycobacterium tuberculosis H37Rv
gccagccggcgcacucccg

SEQ ID NO: 3342446 - RNA, 17 nt, Mycobacterium tuberculosis H37Rv
gccagccgguggugggc

SEQ ID NO: 3342447 - RNA, 17 nt, Mycobacterium tuberculosis H37Rv
gccagccgucaccgcga

SEQ ID NO: 3342448 - RNA, 21 nt, Mycobacterium tuberculosis H37Rv
gccagccgucgucagguggcc

SEQ ID NO: 3342449 - RNA, 14 nt, Mycobacterium tuberculosis H37Rv
gccagccuccacca

SEQ ID NO: 3342450 - RNA, 14 nt, Mycobacterium tuberculosis H37Rv
gccagccugaaccg

SEQ ID NO: 3342451 - RNA, 16 nt, Mycobacterium tuberculosis H37Rv
gccagccugcuggccg

SEQ ID NO: 3342452 - RNA, 18 nt, Mycobacterium tuberculosis H37Rv
gccagcgaauggggcagc

SEQ ID NO: 3342453 - RNA, 16 nt, Mycobacterium tuberculosis H37Rv
gccagcgacgcgguca

SEQ ID NO: 3342454 - RNA, 22 nt, Mycobacterium tuberculosis H37Rv
gccagcgacgcggucaucgagc

SEQ ID NO: 3342455 - RNA, 21 nt, Mycobacterium tuberculosis H37Rv
gccagcgagaucagcaugccc

SEQ ID NO: 3342456 - RNA, 20 nt, Mycobacterium tuberculosis H37Rv
gccagcgagcauaccgccgc

SEQ ID NO: 3342457 - RNA, 18 nt, Mycobacterium tuberculosis H37Rv
gccagcgauaucggcggc

SEQ ID NO: 3342458 - RNA, 17 nt, Mycobacterium tuberculosis H37Rv
gccagcgaugugaaccg

SEQ ID NO: 3342459 - RNA, 23 nt, Mycobacterium tuberculosis H37Rv
gccagcgaugugaaccgggcacc

SEQ ID NO: 3342460 - RNA, 16 nt, Mycobacterium tuberculosis H37Rv
gccagcgcaccgccga

SEQ ID NO: 3342461 - RNA, 13 nt, Mycobacterium tuberculosis H37Rv
gccagcgcagcac

SEQ ID NO: 3342462 - RNA, 19 nt, Mycobacterium tuberculosis H37Rv
gccagcgcagccaggcugc

SEQ ID NO: 3342463 - RNA, 11 nt, Mycobacterium tuberculosis H37Rv
gccagcgcccc

SEQ ID NO: 3342464 - RNA, 22 nt, Mycobacterium tuberculosis H37Rv
gccagcgccccgcgguccuggu

SEQ ID NO: 3342465 - RNA, 12 nt, Mycobacterium tuberculosis H37Rv
gccagcgccgcc

SEQ ID NO: 3342466 - RNA, 18 nt, Mycobacterium tuberculosis H37Rv
gccagcgccgccgcgagc

SEQ ID NO: 3342467 - RNA, 14 nt, Mycobacterium tuberculosis H37Rv
gccagcgccgccgg

SEQ ID NO: 3342468 - RNA, 17 nt, Mycobacterium tuberculosis H37Rv
gccagcgccgccggcac

SEQ ID NO: 3342469 - RNA, 19 nt, Mycobacterium tuberculosis H37Rv
gccagcgccgcugaagcca

SEQ ID NO: 3342470 - RNA, 14 nt, Mycobacterium tuberculosis H37Rv
gccagcgccggcca

SEQ ID NO: 3342471 - RNA, 18 nt, Mycobacterium tuberculosis H37Rv
gccagcgccggucagggc

SEQ ID NO: 3342472 - RNA, 13 nt, Mycobacterium tuberculosis H37Rv
gccagcgccucgg

SEQ ID NO: 3342473 - RNA, 15 nt, Mycobacterium tuberculosis H37Rv
gccagcgccucggca

SEQ ID NO: 3342474 - RNA, 18 nt, Mycobacterium tuberculosis H37Rv
gccagcgccucggugagc

SEQ ID NO: 3342475 - RNA, 23 nt, Mycobacterium tuberculosis H37Rv
gccagcgccucggugagcugcac

SEQ ID NO: 3342476 - RNA, 18 nt, Mycobacterium tuberculosis H37Rv
gccagcgcgccacgagca

SEQ ID NO: 3342477 - RNA, 16 nt, Mycobacterium tuberculosis H37Rv
gccagcgcgccgauca

SEQ ID NO: 3342478 - RNA, 19 nt, Mycobacterium tuberculosis H37Rv
gccagcgcgcgcgggugca

SEQ ID NO: 3342479 - RNA, 12 nt, Mycobacterium tuberculosis H37Rv
gccagcgcggcg

SEQ ID NO: 3342480 - RNA, 13 nt, Mycobacterium tuberculosis H37Rv
gccagcgcggcga

SEQ ID NO: 3342481 - RNA, 13 nt, Mycobacterium tuberculosis H37Rv
gccagcgcggcgc

SEQ ID NO: 3342482 - RNA, 16 nt, Mycobacterium tuberculosis H37Rv
gccagcgcgucgccgu

SEQ ID NO: 3342483 - RNA, 19 nt, Mycobacterium tuberculosis H37Rv
gccagcggcaauggccagc

SEQ ID NO: 3342484 - RNA, 21 nt, Mycobacterium tuberculosis H37Rv
gccagcggcaauggccagcac

SEQ ID NO: 3342485 - RNA, 22 nt, Mycobacterium tuberculosis H37Rv
gccagcggcaauggccagcacc

SEQ ID NO: 3342486 - RNA, 23 nt, Mycobacterium tuberculosis H37Rv
gccagcggcaauggccagcacca

SEQ ID NO: 3342487 - RNA, 12 nt, Mycobacterium tuberculosis H37Rv
gccagcggcaca

SEQ ID NO: 3342488 - RNA, 17 nt, Mycobacterium tuberculosis H37Rv
gccagcggcagcggcgu

SEQ ID NO: 3342489 - RNA, 23 nt, Mycobacterium tuberculosis H37Rv
gccagcggcccuaucuggcggcc

SEQ ID NO: 3342490 - RNA, 19 nt, Mycobacterium tuberculosis H37Rv
gccagcggccgcuccaccu

SEQ ID NO: 3342491 - RNA, 15 nt, Mycobacterium tuberculosis H37Rv
gccagcggccgggcg

SEQ ID NO: 3342492 - RNA, 18 nt, Mycobacterium tuberculosis H37Rv
gccagcggccgggcggcc

SEQ ID NO: 3342493 - RNA, 23 nt, Mycobacterium tuberculosis H37Rv
gccagcggccgggcggccaggcg

SEQ ID NO: 3342494 - RNA, 15 nt, Mycobacterium tuberculosis H37Rv
gccagcggcgcgacc

SEQ ID NO: 3342495 - RNA, 13 nt, Mycobacterium tuberculosis H37Rv
gccagcggcugcc

SEQ ID NO: 3342496 - RNA, 21 nt, Mycobacterium tuberculosis H37Rv
gccagcggggcuagucggggu

SEQ ID NO: 3342497 - RNA, 19 nt, Mycobacterium tuberculosis H37Rv
gccagcggguccccgguca

SEQ ID NO: 3342498 - RNA, 20 nt, Mycobacterium tuberculosis H37Rv
gccagcgggugaaucgacac

SEQ ID NO: 3342499 - RNA, 22 nt, Mycobacterium tuberculosis H37Rv
gccagcgggugaaucgacaccg

SEQ ID NO: 3342500 - RNA, 19 nt, Mycobacterium tuberculosis H37Rv
gccagcgguaaugccagcg

SEQ ID NO: 3342501 - RNA, 21 nt, Mycobacterium tuberculosis H37Rv
gccagcgguaaugccagcggc

SEQ ID NO: 3342502 - RNA, 21 nt, Mycobacterium tuberculosis H37Rv
gccagcgguagcugcccagcg

SEQ ID NO: 3342503 - RNA, 17 nt, Mycobacterium tuberculosis H37Rv
gccagcgguggaccacc

SEQ ID NO: 3342504 - RNA, 18 nt, Mycobacterium tuberculosis H37Rv
gccagcgguggaccaccg

SEQ ID NO: 3342505 - RNA, 22 nt, Mycobacterium tuberculosis H37Rv
gccagcguaaauagcgcccugc

SEQ ID NO: 3342506 - RNA, 21 nt, Mycobacterium tuberculosis H37Rv
gccagcgucaacagcguggag

SEQ ID NO: 3342507 - RNA, 17 nt, Mycobacterium tuberculosis H37Rv
gccagcgucaccucacc

SEQ ID NO: 3342508 - RNA, 24 nt, Mycobacterium tuberculosis H37Rv
gccagcgucagcuguuugccggcu

SEQ ID NO: 3342509 - RNA, 15 nt, Mycobacterium tuberculosis H37Rv
gccagcgucgacaca

SEQ ID NO: 3342510 - RNA, 22 nt, Mycobacterium tuberculosis H37Rv
gccagcgucgacacacccacug

SEQ ID NO: 3342511 - RNA, 18 nt, Mycobacterium tuberculosis H37Rv
gccagcgugucccaacgc

SEQ ID NO: 3342512 - RNA, 12 nt, Mycobacterium tuberculosis H37Rv
gccagcguuggc

SEQ ID NO: 3342513 - RNA, 23 nt, Mycobacterium tuberculosis H37Rv
gccagcuauugcuauuccgcggc

SEQ ID NO: 3342514 - RNA, 13 nt, Mycobacterium tuberculosis H37Rv
gccagcucaacca

SEQ ID NO: 3342515 - RNA, 17 nt, Mycobacterium tuberculosis H37Rv
gccagcucaaccacaug

SEQ ID NO: 3342516 - RNA, 21 nt, Mycobacterium tuberculosis H37Rv
gccagcucacggacgcugggc

SEQ ID NO: 3342517 - RNA, 22 nt, Mycobacterium tuberculosis H37Rv
gccagcucacggacgcugggcg

SEQ ID NO: 3342518 - RNA, 22 nt, Mycobacterium tuberculosis H37Rv
gccagcucccgggcggcggccu

SEQ ID NO: 3342519 - RNA, 18 nt, Mycobacterium tuberculosis H37Rv
gccagcuccgccugccgc

SEQ ID NO: 3342520 - RNA, 19 nt, Mycobacterium tuberculosis H37Rv
gccagcuccggcgcuccac

SEQ ID NO: 3342521 - RNA, 15 nt, Mycobacterium tuberculosis H37Rv
gccagcuccucagcc

SEQ ID NO: 3342522 - RNA, 18 nt, Mycobacterium tuberculosis H37Rv
gccagcuccucagccacc

SEQ ID NO: 3342523 - RNA, 18 nt, Mycobacterium tuberculosis H37Rv
gccagcucgccggccggg

SEQ ID NO: 3342524 - RNA, 13 nt, Mycobacterium tuberculosis H37Rv
gccagcucggcca

SEQ ID NO: 3342525 - RNA, 12 nt, Mycobacterium tuberculosis H37Rv
gccagcucgggc

SEQ ID NO: 3342526 - RNA, 14 nt, Mycobacterium tuberculosis H37Rv
gccagcucgggcgc

SEQ ID NO: 3342527 - RNA, 19 nt, Mycobacterium tuberculosis H37Rv
gccagcucgggcgcgcggc

SEQ ID NO: 3342528 - RNA, 23 nt, Mycobacterium tuberculosis H37Rv
gccagcucgggcgcgcggcgagc

SEQ ID NO: 3342529 - RNA, 23 nt, Mycobacterium tuberculosis H37Rv
gccagcucgugaucuucggcgau

SEQ ID NO: 3342530 - RNA, 19 nt, Mycobacterium tuberculosis H37Rv
gccagcugacacccgcagc

SEQ ID NO: 3342531 - RNA, 20 nt, Mycobacterium tuberculosis H37Rv
gccagcugacacccgcagcu

SEQ ID NO: 3342532 - RNA, 14 nt, Mycobacterium tuberculosis H37Rv
gccagcugcgcagc

SEQ ID NO: 3342533 - RNA, 16 nt, Mycobacterium tuberculosis H37Rv
gccagcugcgcagcgc

SEQ ID NO: 3342534 - RNA, 12 nt, Mycobacterium tuberculosis H37Rv
gccagcugggca

SEQ ID NO: 3342535 - RNA, 20 nt, Mycobacterium tuberculosis H37Rv
gccagcugggcagccagauc

SEQ ID NO: 3342536 - RNA, 18 nt, Mycobacterium tuberculosis H37Rv
gccagcuguucgagccgc

SEQ ID NO: 3342537 - RNA, 19 nt, Mycobacterium tuberculosis H37Rv
gccagcuguugcggggugc

SEQ ID NO: 3342538 - RNA, 22 nt, Mycobacterium tuberculosis H37Rv
gccagcuugcggagccgccgcu

SEQ ID NO: 3342539 - RNA, 15 nt, Mycobacterium tuberculosis H37Rv
gccaggaacccgugg

SEQ ID NO: 3342540 - RNA, 16 nt, Mycobacterium tuberculosis H37Rv
gccaggaacucggccc

SEQ ID NO: 3342541 - RNA, 15 nt, Mycobacterium tuberculosis H37Rv
gccaggaagucccgg

SEQ ID NO: 3342542 - RNA, 13 nt, Mycobacterium tuberculosis H37Rv
gccaggaauugcc

SEQ ID NO: 3342543 - RNA, 17 nt, Mycobacterium tuberculosis H37Rv
gccaggacaacgcaccg

SEQ ID NO: 3342544 - RNA, 14 nt, Mycobacterium tuberculosis H37Rv
gccaggaccaacug

SEQ ID NO: 3342545 - RNA, 19 nt, Mycobacterium tuberculosis H37Rv
gccaggaccgcgccgauca

SEQ ID NO: 3342546 - RNA, 21 nt, Mycobacterium tuberculosis H37Rv
gccaggacuggcaccgccagc

SEQ ID NO: 3342547 - RNA, 17 nt, Mycobacterium tuberculosis H37Rv
gccaggaguuugaccac

SEQ ID NO: 3342548 - RNA, 16 nt, Mycobacterium tuberculosis H37Rv
gccaggauaaguccgg

SEQ ID NO: 3342549 - RNA, 18 nt, Mycobacterium tuberculosis H37Rv
gccaggauccgaccccgc

SEQ ID NO: 3342550 - RNA, 23 nt, Mycobacterium tuberculosis H37Rv
gccaggaucgaucguagcuccuu

SEQ ID NO: 3342551 - RNA, 22 nt, Mycobacterium tuberculosis H37Rv
gccaggaucuccccguccugcc

SEQ ID NO: 3342552 - RNA, 18 nt, Mycobacterium tuberculosis H37Rv
gccaggaucuguuugggc

SEQ ID NO: 3342553 - RNA, 22 nt, Mycobacterium tuberculosis H37Rv
gccaggaugaagacgcgggucu

SEQ ID NO: 3342554 - RNA, 23 nt, Mycobacterium tuberculosis H37Rv
gccaggaugaauuuggugaagug

SEQ ID NO: 3342555 - RNA, 17 nt, Mycobacterium tuberculosis H37Rv
gccaggauugccgccgu

SEQ ID NO: 3342556 - RNA, 22 nt, Mycobacterium tuberculosis H37Rv
gccaggcaaccggucagccugc

SEQ ID NO: 3342557 - RNA, 16 nt, Mycobacterium tuberculosis H37Rv
gccaggcacguccgau

SEQ ID NO: 3342558 - RNA, 20 nt, Mycobacterium tuberculosis H37Rv
gccaggcacguccgaucggc

SEQ ID NO: 3342559 - RNA, 21 nt, Mycobacterium tuberculosis H37Rv
gccaggcacguccgaucggcg

SEQ ID NO: 3342560 - RNA, 16 nt, Mycobacterium tuberculosis H37Rv
gccaggcaugccgccc

SEQ ID NO: 3342561 - RNA, 13 nt, Mycobacterium tuberculosis H37Rv
gccaggcccagcu

SEQ ID NO: 3342562 - RNA, 13 nt, Mycobacterium tuberculosis H37Rv
gccaggcccgugc

SEQ ID NO: 3342563 - RNA, 13 nt, Mycobacterium tuberculosis H37Rv
gccaggccgagcc

SEQ ID NO: 3342564 - RNA, 15 nt, Mycobacterium tuberculosis H37Rv
gccaggccgcacagc

SEQ ID NO: 3342565 - RNA, 16 nt, Mycobacterium tuberculosis H37Rv
gccaggccgucggcgu

SEQ ID NO: 3342566 - RNA, 21 nt, Mycobacterium tuberculosis H37Rv
gccaggccgucggcgucgaag

SEQ ID NO: 3342567 - RNA, 18 nt, Mycobacterium tuberculosis H37Rv
gccaggcgaagucgacuc

SEQ ID NO: 3342568 - RNA, 20 nt, Mycobacterium tuberculosis H37Rv
gccaggcggcaauucgggca

SEQ ID NO: 3342569 - RNA, 13 nt, Mycobacterium tuberculosis H37Rv
gccaggcgugcac

SEQ ID NO: 3342570 - RNA, 13 nt, Mycobacterium tuberculosis H37Rv
gccaggcugcgca

SEQ ID NO: 3342571 - RNA, 16 nt, Mycobacterium tuberculosis H37Rv
gccaggcugcgcagug

SEQ ID NO: 3342572 - RNA, 15 nt, Mycobacterium tuberculosis H37Rv
gccaggcuggcguca

SEQ ID NO: 3342573 - RNA, 16 nt, Mycobacterium tuberculosis H37Rv
gccagggagcgcagcg

SEQ ID NO: 3342574 - RNA, 17 nt, Mycobacterium tuberculosis H37Rv
gccagggagcgcagcgc

SEQ ID NO: 3342575 - RNA, 15 nt, Mycobacterium tuberculosis H37Rv
gccagggaggggccg

SEQ ID NO: 3342576 - RNA, 13 nt, Mycobacterium tuberculosis H37Rv
gccagggaucagc

SEQ ID NO: 3342577 - RNA, 18 nt, Mycobacterium tuberculosis H37Rv
gccagggaucagccgugc

SEQ ID NO: 3342578 - RNA, 19 nt, Mycobacterium tuberculosis H37Rv
gccagggaucagccgugcg

SEQ ID NO: 3342579 - RNA, 21 nt, Mycobacterium tuberculosis H37Rv
gccagggaucagccgugcggg

SEQ ID NO: 3342580 - RNA, 22 nt, Mycobacterium tuberculosis H37Rv
gccagggcccuagccggcgcgc

SEQ ID NO: 3342581 - RNA, 14 nt, Mycobacterium tuberculosis H37Rv
gccagggccgccga

SEQ ID NO: 3342582 - RNA, 15 nt, Mycobacterium tuberculosis H37Rv
gccagggcgggcguc

SEQ ID NO: 3342583 - RNA, 22 nt, Mycobacterium tuberculosis H37Rv
gccagggcgguggccacccggc

SEQ ID NO: 3342584 - RNA, 14 nt, Mycobacterium tuberculosis H37Rv
gccagggcuugccg

SEQ ID NO: 3342585 - RNA, 18 nt, Mycobacterium tuberculosis H37Rv
gccagggcuugccggguu

SEQ ID NO: 3342586 - RNA, 18 nt, Mycobacterium tuberculosis H37Rv
gccaggggacccggggcc

SEQ ID NO: 3342587 - RNA, 16 nt, Mycobacterium tuberculosis H37Rv
gccaggggaucaccgg

SEQ ID NO: 3342588 - RNA, 19 nt, Mycobacterium tuberculosis H37Rv
gccaggggaucaccggcug

SEQ ID NO: 3342589 - RNA, 16 nt, Mycobacterium tuberculosis H37Rv
gccaggggcgcagcgc

SEQ ID NO: 3342590 - RNA, 23 nt, Mycobacterium tuberculosis H37Rv
gccagggucacaaacccagcauc

SEQ ID NO: 3342591 - RNA, 16 nt, Mycobacterium tuberculosis H37Rv
gccagggugaccaggc

SEQ ID NO: 3342592 - RNA, 22 nt, Mycobacterium tuberculosis H37Rv
gccagggugaccaggccgagcu

SEQ ID NO: 3342593 - RNA, 18 nt, Mycobacterium tuberculosis H37Rv
gccagggugcccucggcc

SEQ ID NO: 3342594 - RNA, 20 nt, Mycobacterium tuberculosis H37Rv
gccaggucagccgcgcgggu

SEQ ID NO: 3342595 - RNA, 18 nt, Mycobacterium tuberculosis H37Rv
gccagguccgccggugcc

SEQ ID NO: 3342596 - RNA, 15 nt, Mycobacterium tuberculosis H37Rv
gccaggucgacaccg

SEQ ID NO: 3342597 - RNA, 18 nt, Mycobacterium tuberculosis H37Rv
gccaggucgacgggcacg

SEQ ID NO: 3342598 - RNA, 20 nt, Mycobacterium tuberculosis H37Rv
gccaucgaguccaccaccug

SEQ ID NO: 3342599 - RNA, 21 nt, Mycobacterium tuberculosis H37Rv
gccaucgccaugauggacagc

SEQ ID NO: 3342600 - RNA, 14 nt, Mycobacterium tuberculosis H37Rv
gccaucgcccgaug

SEQ ID NO: 3342601 - RNA, 20 nt, Mycobacterium tuberculosis H37Rv
gccaucgcccgaugcgccag

SEQ ID NO: 3342602 - RNA, 16 nt, Mycobacterium tuberculosis H37Rv
gccaucgccuccagcc

SEQ ID NO: 3342603 - RNA, 20 nt, Mycobacterium tuberculosis H37Rv
gccaucgccuccagccggcg

SEQ ID NO: 3342604 - RNA, 19 nt, Mycobacterium tuberculosis H37Rv
gccaucgcgcggaccagag

SEQ ID NO: 3342605 - RNA, 21 nt, Mycobacterium tuberculosis H37Rv
gccaucgggaccggggacgcg

SEQ ID NO: 3342606 - RNA, 22 nt, Mycobacterium tuberculosis H37Rv
gccaucgggauggacaccaccu

SEQ ID NO: 3342607 - RNA, 17 nt, Mycobacterium tuberculosis H37Rv
gccaucguccagcagga

SEQ ID NO: 3342608 - RNA, 22 nt, Mycobacterium tuberculosis H37Rv
gccaucguccagcaggacggug

SEQ ID NO: 3342609 - RNA, 16 nt, Mycobacterium tuberculosis H37Rv
gccaucgucgagcgcg

SEQ ID NO: 3342610 - RNA, 13 nt, Mycobacterium tuberculosis H37Rv
gccaucgucgugg

SEQ ID NO: 3342611 - RNA, 13 nt, Mycobacterium tuberculosis H37Rv
gccaucgugcggc

SEQ ID NO: 3342612 - RNA, 23 nt, Mycobacterium tuberculosis H37Rv
gccaucucgacggugaccggauc

SEQ ID NO: 3342613 - RNA, 18 nt, Mycobacterium tuberculosis H37Rv
gccaucugauccgguguc

SEQ ID NO: 3342614 - RNA, 22 nt, Mycobacterium tuberculosis H37Rv
gccaucugauccggugucgcga

SEQ ID NO: 3342615 - RNA, 13 nt, Mycobacterium tuberculosis H37Rv
gccaucugccugc

SEQ ID NO: 3342616 - RNA, 14 nt, Mycobacterium tuberculosis H37Rv
gccaucugccugcc

SEQ ID NO: 3342617 - RNA, 12 nt, Mycobacterium tuberculosis H37Rv
gccaucugcucg

SEQ ID NO: 3342618 - RNA, 17 nt, Mycobacterium tuberculosis H37Rv
gccaucugcuggcuggg

SEQ ID NO: 3342619 - RNA, 11 nt, Mycobacterium tuberculosis H37Rv
gccaucuggcc

SEQ ID NO: 3342620 - RNA, 18 nt, Mycobacterium tuberculosis H37Rv
gccaucuggguccgucga

SEQ ID NO: 3342621 - RNA, 15 nt, Mycobacterium tuberculosis H37Rv
gccaugaagccgggc

SEQ ID NO: 3342622 - RNA, 13 nt, Mycobacterium tuberculosis H37Rv
gccaugaucacac

SEQ ID NO: 3342623 - RNA, 16 nt, Mycobacterium tuberculosis H37Rv
gccaugccaagcucca

SEQ ID NO: 3342624 - RNA, 20 nt, Mycobacterium tuberculosis H37Rv
gccaugccaagcuccaacca

SEQ ID NO: 3342625 - RNA, 15 nt, Mycobacterium tuberculosis H37Rv
gccaugccgcucggc

SEQ ID NO: 3342626 - RNA, 19 nt, Mycobacterium tuberculosis H37Rv
gccaugccgcucggcaacc

SEQ ID NO: 3342627 - RNA, 18 nt, Mycobacterium tuberculosis H37Rv
gccaugcgccaacccggc

SEQ ID NO: 3342628 - RNA, 15 nt, Mycobacterium tuberculosis H37Rv
gccaugcggaaagcc

SEQ ID NO: 3342629 - RNA, 21 nt, Mycobacterium tuberculosis H37Rv
gccaugcgguuugccggugcg

SEQ ID NO: 3342630 - RNA, 17 nt, Mycobacterium tuberculosis H37Rv
gccaugcuaggaccacc

SEQ ID NO: 3342631 - RNA, 21 nt, Mycobacterium tuberculosis H37Rv
gccaugcuaggaccaccagcg

SEQ ID NO: 3342632 - RNA, 19 nt, Mycobacterium tuberculosis H37Rv
gccauggacgccaugguga

SEQ ID NO: 3342633 - RNA, 15 nt, Mycobacterium tuberculosis H37Rv
gccauggaucccacg

SEQ ID NO: 3342634 - RNA, 15 nt, Mycobacterium tuberculosis H37Rv
gccauggcguucugc

SEQ ID NO: 3342635 - RNA, 20 nt, Mycobacterium tuberculosis H37Rv
gccaugggauucggccagac

SEQ ID NO: 3342636 - RNA, 14 nt, Mycobacterium tuberculosis H37Rv
gccauggucagaua

SEQ ID NO: 3342637 - RNA, 19 nt, Mycobacterium tuberculosis H37Rv
gccauguagccguugccgc

SEQ ID NO: 3342638 - RNA, 17 nt, Mycobacterium tuberculosis H37Rv
gccaugucagcggccug

SEQ ID NO: 3342639 - RNA, 15 nt, Mycobacterium tuberculosis H37Rv
gccauguccaccagc

SEQ ID NO: 3342640 - RNA, 16 nt, Mycobacterium tuberculosis H37Rv
gccauguccaccagcg

SEQ ID NO: 3342641 - RNA, 20 nt, Mycobacterium tuberculosis H37Rv
gccaugucgauguccacgcc

SEQ ID NO: 3342642 - RNA, 20 nt, Mycobacterium tuberculosis H37Rv
gccaugucuccgacauuggc

SEQ ID NO: 3342643 - RNA, 15 nt, Mycobacterium tuberculosis H37Rv
gccauguggacggca

SEQ ID NO: 3342644 - RNA, 14 nt, Mycobacterium tuberculosis H37Rv
gccauguggcgucg

SEQ ID NO: 3342645 - RNA, 15 nt, Mycobacterium tuberculosis H37Rv
gccauguggcgucgc

SEQ ID NO: 3342646 - RNA, 18 nt, Mycobacterium tuberculosis H37Rv
gccauguugcccugcaac

SEQ ID NO: 3342647 - RNA, 19 nt, Mycobacterium tuberculosis H37Rv
gccauuccagaucaacgcg

SEQ ID NO: 3342648 - RNA, 14 nt, Mycobacterium tuberculosis H37Rv
gccauuccagccgg

SEQ ID NO: 3342649 - RNA, 19 nt, Mycobacterium tuberculosis H37Rv
gccauucuucgaucagcgg

SEQ ID NO: 3342650 - RNA, 23 nt, Mycobacterium tuberculosis H37Rv
gccauucuuggugaucgcgaacu

SEQ ID NO: 3342651 - RNA, 21 nt, Mycobacterium tuberculosis H37Rv
gccauugacgccguugccgcc

SEQ ID NO: 3342652 - RNA, 22 nt, Mycobacterium tuberculosis H37Rv
gccauugcccgggcgggagucg

SEQ ID NO: 3342653 - RNA, 12 nt, Mycobacterium tuberculosis H37Rv
gccauugccgcc

SEQ ID NO: 3342654 - RNA, 14 nt, Mycobacterium tuberculosis H37Rv
gccauugccgccgg

SEQ ID NO: 3342655 - RNA, 20 nt, Mycobacterium tuberculosis H37Rv
gccauugccucccgcgccgg

SEQ ID NO: 3342656 - RNA, 17 nt, Mycobacterium tuberculosis H37Rv
gccauuggcgccgccga

SEQ ID NO: 3342657 - RNA, 14 nt, Mycobacterium tuberculosis H37Rv
gccauugucgccaa

SEQ ID NO: 3342658 - RNA, 19 nt, Mycobacterium tuberculosis H37Rv
gccauuucgucgucgcuga

SEQ ID NO: 3342659 - RNA, 22 nt, Mycobacterium tuberculosis H37Rv
gcccaaaaacggcagcauggcc

SEQ ID NO: 3342660 - RNA, 20 nt, Mycobacterium tuberculosis H37Rv
gcccaaaacgucaccgccgg

SEQ ID NO: 3342661 - RNA, 14 nt, Mycobacterium tuberculosis H37Rv
gcccaaaagcgcgg

SEQ ID NO: 3342662 - RNA, 17 nt, Mycobacterium tuberculosis H37Rv
gcccaaaaggaagaccu

SEQ ID NO: 3342663 - RNA, 18 nt, Mycobacterium tuberculosis H37Rv
gcccaaaaggaagaccuc

SEQ ID NO: 3342664 - RNA, 21 nt, Mycobacterium tuberculosis H37Rv
gcccaaaggcuguaacacccg

SEQ ID NO: 3342665 - RNA, 23 nt, Mycobacterium tuberculosis H37Rv
gcccaaaggcuguaacacccggc

SEQ ID NO: 3342666 - RNA, 16 nt, Mycobacterium tuberculosis H37Rv
gcccaacaccgccaga

SEQ ID NO: 3342667 - RNA, 13 nt, Mycobacterium tuberculosis H37Rv
gcccaacaccgcg

SEQ ID NO: 3342668 - RNA, 17 nt, Mycobacterium tuberculosis H37Rv
gcccaacagcaacccgc

SEQ ID NO: 3342669 - RNA, 18 nt, Mycobacterium tuberculosis H37Rv
gcccaacagcaacccgcc

SEQ ID NO: 3342670 - RNA, 20 nt, Mycobacterium tuberculosis H37Rv
gcccaacagcaacccgccgu

SEQ ID NO: 3342671 - RNA, 23 nt, Mycobacterium tuberculosis H37Rv
gcccaacaggcgggacaaccggg

SEQ ID NO: 3342672 - RNA, 13 nt, Mycobacterium tuberculosis H37Rv
gcccaacccggau

SEQ ID NO: 3342673 - RNA, 14 nt, Mycobacterium tuberculosis H37Rv
gcccaacgacauga

SEQ ID NO: 3342674 - RNA, 20 nt, Mycobacterium tuberculosis H37Rv
gcccaacgcgagcuugauuc

SEQ ID NO: 3342675 - RNA, 23 nt, Mycobacterium tuberculosis H37Rv
gcccaacgcgauguccagguggc

SEQ ID NO: 3342676 - RNA, 17 nt, Mycobacterium tuberculosis H37Rv
gcccaacucggccagcu

SEQ ID NO: 3342677 - RNA, 18 nt, Mycobacterium tuberculosis H37Rv
gcccaacucggccagcuu

SEQ ID NO: 3342678 - RNA, 14 nt, Mycobacterium tuberculosis H37Rv
gcccaagaucucgc

SEQ ID NO: 3342679 - RNA, 17 nt, Mycobacterium tuberculosis H37Rv
gcccaagcucagggugg

SEQ ID NO: 3342680 - RNA, 19 nt, Mycobacterium tuberculosis H37Rv
gcccaagguggcggccagu

SEQ ID NO: 3342681 - RNA, 17 nt, Mycobacterium tuberculosis H37Rv
gcccaauggcguucguc

SEQ ID NO: 3342682 - RNA, 17 nt, Mycobacterium tuberculosis H37Rv
gcccaauugcgccgagc

SEQ ID NO: 3342683 - RNA, 22 nt, Mycobacterium tuberculosis H37Rv
gcccaauuucgugccgaaaugg

SEQ ID NO: 3342684 - RNA, 16 nt, Mycobacterium tuberculosis H37Rv
gcccacaaagauccgg

SEQ ID NO: 3342685 - RNA, 15 nt, Mycobacterium tuberculosis H37Rv
gcccacaccagcgca

SEQ ID NO: 3342686 - RNA, 13 nt, Mycobacterium tuberculosis H37Rv
gcccacacgcuca

SEQ ID NO: 3342687 - RNA, 19 nt, Mycobacterium tuberculosis H37Rv
gcccacacgcucacgggcu

SEQ ID NO: 3342688 - RNA, 17 nt, Mycobacterium tuberculosis H37Rv
gcccacagcuugcccga

SEQ ID NO: 3342689 - RNA, 15 nt, Mycobacterium tuberculosis H37Rv
gcccacaggggcagc

SEQ ID NO: 3342690 - RNA, 19 nt, Mycobacterium tuberculosis H37Rv
gcccacaggggcagcgcgg

SEQ ID NO: 3342691 - RNA, 20 nt, Mycobacterium tuberculosis H37Rv
gcccacaggggcagcgcggc

SEQ ID NO: 3342692 - RNA, 21 nt, Mycobacterium tuberculosis H37Rv
gcccacaggggcagcgcggcc

SEQ ID NO: 3342693 - RNA, 17 nt, Mycobacterium tuberculosis H37Rv
gcccacaugaacgacca

SEQ ID NO: 3342694 - RNA, 16 nt, Mycobacterium tuberculosis H37Rv
gcccagcguggcuggc

SEQ ID NO: 3342695 - RNA, 23 nt, Mycobacterium tuberculosis H37Rv
gcccagcguugucggguggcugc

SEQ ID NO: 3342696 - RNA, 15 nt, Mycobacterium tuberculosis H37Rv
gcccagcucgauacc

SEQ ID NO: 3342697 - RNA, 18 nt, Mycobacterium tuberculosis H37Rv
gcccaggcaaaccgauca

SEQ ID NO: 3342698 - RNA, 14 nt, Mycobacterium tuberculosis H37Rv
gcccaggcauggcc

SEQ ID NO: 3342699 - RNA, 15 nt, Mycobacterium tuberculosis H37Rv
gcccaggcauggccu

SEQ ID NO: 3342700 - RNA, 14 nt, Mycobacterium tuberculosis H37Rv
gcccaggccgauca

SEQ ID NO: 3342701 - RNA, 16 nt, Mycobacterium tuberculosis H37Rv
gcccaggccgaucagc

SEQ ID NO: 3342702 - RNA, 16 nt, Mycobacterium tuberculosis H37Rv
gcccaggcgaucgccc

SEQ ID NO: 3342703 - RNA, 22 nt, Mycobacterium tuberculosis H37Rv
gcccaggcgaucgcccggcccc

SEQ ID NO: 3342704 - RNA, 17 nt, Mycobacterium tuberculosis H37Rv
gcccagggcgaucugcg

SEQ ID NO: 3342705 - RNA, 11 nt, Mycobacterium tuberculosis H37Rv
gcccagggugg

SEQ ID NO: 3342706 - RNA, 17 nt, Mycobacterium tuberculosis H37Rv
gcccaggucgaugcggg

SEQ ID NO: 3342707 - RNA, 16 nt, Mycobacterium tuberculosis H37Rv
gcccaggugaucgcga

SEQ ID NO: 3342708 - RNA, 17 nt, Mycobacterium tuberculosis H37Rv
gcccaggugcguccagg

SEQ ID NO: 3342709 - RNA, 18 nt, Mycobacterium tuberculosis H37Rv
gcccaggugcguccaggc

SEQ ID NO: 3342710 - RNA, 22 nt, Mycobacterium tuberculosis H37Rv
gcccaggugggccgagagcagc

SEQ ID NO: 3342711 - RNA, 18 nt, Mycobacterium tuberculosis H37Rv
gcccagguguguggcggc

SEQ ID NO: 3342712 - RNA, 22 nt, Mycobacterium tuberculosis H37Rv
gcccagguguguggcggcgucc

SEQ ID NO: 3342713 - RNA, 15 nt, Mycobacterium tuberculosis H37Rv
gcccagguugccaac

SEQ ID NO: 3342714 - RNA, 23 nt, Mycobacterium tuberculosis H37Rv
gcccagguugccuuggcggccaa

SEQ ID NO: 3342715 - RNA, 20 nt, Mycobacterium tuberculosis H37Rv
gcccaguaagccgcgggcac

SEQ ID NO: 3342716 - RNA, 16 nt, Mycobacterium tuberculosis H37Rv
gcccaguagaucgcga

SEQ ID NO: 3342717 - RNA, 22 nt, Mycobacterium tuberculosis H37Rv
gcccagugcgcaacccagccgc

SEQ ID NO: 3342718 - RNA, 20 nt, Mycobacterium tuberculosis H37Rv
gcccagugggacuggcguga

SEQ ID NO: 3342719 - RNA, 13 nt, Mycobacterium tuberculosis H37Rv
gcccaguucugca

SEQ ID NO: 3342720 - RNA, 14 nt, Mycobacterium tuberculosis H37Rv
gcccauagcaccuc

SEQ ID NO: 3342721 - RNA, 16 nt, Mycobacterium tuberculosis H37Rv
gcccauagcaccucga

SEQ ID NO: 3342722 - RNA, 14 nt, Mycobacterium tuberculosis H37Rv
gcccaucacacccg

SEQ ID NO: 3342723 - RNA, 17 nt, Mycobacterium tuberculosis H37Rv
gcccaucacacccggua

SEQ ID NO: 3342724 - RNA, 21 nt, Mycobacterium tuberculosis H37Rv
gcccaucucaugcaucugcuu

SEQ ID NO: 3342725 - RNA, 19 nt, Mycobacterium tuberculosis H37Rv
gcccaucucgggcaggccg

SEQ ID NO: 3342726 - RNA, 21 nt, Mycobacterium tuberculosis H37Rv
gcccaucuucggacgccagcu

SEQ ID NO: 3342727 - RNA, 19 nt, Mycobacterium tuberculosis H37Rv
gcccaugaugcucgaugau

SEQ ID NO: 3342728 - RNA, 15 nt, Mycobacterium tuberculosis H37Rv
gcccaugauggucac

SEQ ID NO: 3342729 - RNA, 20 nt, Mycobacterium tuberculosis H37Rv
gcccaugccgggauugccgu

SEQ ID NO: 3342730 - RNA, 16 nt, Mycobacterium tuberculosis H37Rv
gcccaugccgucgggu

SEQ ID NO: 3342731 - RNA, 14 nt, Mycobacterium tuberculosis H37Rv
gcccauggccacca

SEQ ID NO: 3342732 - RNA, 16 nt, Mycobacterium tuberculosis H37Rv
gcccauggccaccagg

SEQ ID NO: 3342733 - RNA, 19 nt, Mycobacterium tuberculosis H37Rv
gcccauggcgucgaaccag

SEQ ID NO: 3342734 - RNA, 19 nt, Mycobacterium tuberculosis H37Rv
gcccaugguggcgaucugg

SEQ ID NO: 3342735 - RNA, 22 nt, Mycobacterium tuberculosis H37Rv
gcccauucccagaggcccgcgg

SEQ ID NO: 3342736 - RNA, 15 nt, Mycobacterium tuberculosis H37Rv
gcccauuggccaggu

SEQ ID NO: 3342737 - RNA, 15 nt, Mycobacterium tuberculosis H37Rv
gcccauuucggcacg

SEQ ID NO: 3342738 - RNA, 22 nt, Mycobacterium tuberculosis H37Rv
gccccaagcgccugagcggccu

SEQ ID NO: 3342739 - RNA, 21 nt, Mycobacterium tuberculosis H37Rv
gccccacaaggguuggccgau

SEQ ID NO: 3342740 - RNA, 23 nt, Mycobacterium tuberculosis H37Rv
gccccacaagucgcgcgccaaga

SEQ ID NO: 3342741 - RNA, 14 nt, Mycobacterium tuberculosis H37Rv
gccccacagcgugc

SEQ ID NO: 3342742 - RNA, 16 nt, Mycobacterium tuberculosis H37Rv
gccccacccgagcacu

SEQ ID NO: 3342743 - RNA, 14 nt, Mycobacterium tuberculosis H37Rv
gccccaccgcgccg

SEQ ID NO: 3342744 - RNA, 21 nt, Mycobacterium tuberculosis H37Rv
gccccaccgguaccgccacuu

SEQ ID NO: 3342745 - RNA, 14 nt, Mycobacterium tuberculosis H37Rv
gccccagcugcggu

SEQ ID NO: 3342746 - RNA, 22 nt, Mycobacterium tuberculosis H37Rv
gccccagcugcggucgcggcug

SEQ ID NO: 3342747 - RNA, 19 nt, Mycobacterium tuberculosis H37Rv
gccccaggcugguccgggu

SEQ ID NO: 3342748 - RNA, 22 nt, Mycobacterium tuberculosis H37Rv
gccccagggggcgugccgccgc

SEQ ID NO: 3342749 - RNA, 12 nt, Mycobacterium tuberculosis H37Rv
gccccagggugc

SEQ ID NO: 3342750 - RNA, 13 nt, Mycobacterium tuberculosis H37Rv
gccccagggugcg

SEQ ID NO: 3342751 - RNA, 17 nt, Mycobacterium tuberculosis H37Rv
gccccagggugcgccau

SEQ ID NO: 3342752 - RNA, 20 nt, Mycobacterium tuberculosis H37Rv
gccccagggugcgcuggccg

SEQ ID NO: 3342753 - RNA, 17 nt, Mycobacterium tuberculosis H37Rv
gccccaguccgaagcug

SEQ ID NO: 3342754 - RNA, 14 nt, Mycobacterium tuberculosis H37Rv
gccccagugugcgu

SEQ ID NO: 3342755 - RNA, 17 nt, Mycobacterium tuberculosis H37Rv
gccccaguucgacggcg

SEQ ID NO: 3342756 - RNA, 23 nt, Mycobacterium tuberculosis H37Rv
gccccaguucgacggcgucaaag

SEQ ID NO: 3342757 - RNA, 15 nt, Mycobacterium tuberculosis H37Rv
gccccaucaccaccg

SEQ ID NO: 3342758 - RNA, 17 nt, Mycobacterium tuberculosis H37Rv
gccccaucaccaccggc

SEQ ID NO: 3342759 - RNA, 14 nt, Mycobacterium tuberculosis H37Rv
gccccaugcaacac

SEQ ID NO: 3342760 - RNA, 17 nt, Mycobacterium tuberculosis H37Rv
gccccaugcaacacacc

SEQ ID NO: 3342761 - RNA, 18 nt, Mycobacterium tuberculosis H37Rv
gccccaugcaacacaccg

SEQ ID NO: 3342762 - RNA, 18 nt, Mycobacterium tuberculosis H37Rv
gccccaugccgaccggca

SEQ ID NO: 3342763 - RNA, 16 nt, Mycobacterium tuberculosis H37Rv
gccccauugcgggagc

SEQ ID NO: 3342764 - RNA, 16 nt, Mycobacterium tuberculosis H37Rv
gcccccaaaccggcgg

SEQ ID NO: 3342765 - RNA, 21 nt, Mycobacterium tuberculosis H37Rv
gcccccaacgcgguaaagccc

SEQ ID NO: 3342766 - RNA, 18 nt, Mycobacterium tuberculosis H37Rv
gcccccagcagcugcgau

SEQ ID NO: 3342767 - RNA, 13 nt, Mycobacterium tuberculosis H37Rv
gcccccagguaac

SEQ ID NO: 3342768 - RNA, 20 nt, Mycobacterium tuberculosis H37Rv
gcccccagugcacgcucggc

SEQ ID NO: 3342769 - RNA, 16 nt, Mycobacterium tuberculosis H37Rv
gcccccauugccgccg

SEQ ID NO: 3342770 - RNA, 23 nt, Mycobacterium tuberculosis H37Rv
gccccccagacaauccgccgccg

SEQ ID NO: 3342771 - RNA, 21 nt, Mycobacterium tuberculosis H37Rv
gccccccgagcccgccagcgc

SEQ ID NO: 3342772 - RNA, 12 nt, Mycobacterium tuberculosis H37Rv
gccccccggcga

SEQ ID NO: 3342773 - RNA, 20 nt, Mycobacterium tuberculosis H37Rv
gccccccggcgacggcguag

SEQ ID NO: 3342774 - RNA, 22 nt, Mycobacterium tuberculosis H37Rv
gccccccggcgacggcguagcc

SEQ ID NO: 3342775 - RNA, 13 nt, Mycobacterium tuberculosis H37Rv
gccccccggggcc

SEQ ID NO: 3342776 - RNA, 14 nt, Mycobacterium tuberculosis H37Rv
gccccccggggccg

SEQ ID NO: 3342777 - RNA, 16 nt, Mycobacterium tuberculosis H37Rv
gcccccgacacgccgu

SEQ ID NO: 3342778 - RNA, 17 nt, Mycobacterium tuberculosis H37Rv
gcccccgacguugcugg

SEQ ID NO: 3342779 - RNA, 13 nt, Mycobacterium tuberculosis H37Rv
gcccccgcacgca

SEQ ID NO: 3342780 - RNA, 19 nt, Mycobacterium tuberculosis H37Rv
gcccccgcacgcacggcgu

SEQ ID NO: 3342781 - RNA, 17 nt, Mycobacterium tuberculosis H37Rv
gcccccgccacgccgaa

SEQ ID NO: 3342782 - RNA, 17 nt, Mycobacterium tuberculosis H37Rv
gcccccgccauugccgc

SEQ ID NO: 3342783 - RNA, 14 nt, Mycobacterium tuberculosis H37Rv
gcccccgccggccg

SEQ ID NO: 3342784 - RNA, 15 nt, Mycobacterium tuberculosis H37Rv
gcccccgccggccgc

SEQ ID NO: 3342785 - RNA, 23 nt, Mycobacterium tuberculosis H37Rv
gcccccgccggccgcgccggccc

SEQ ID NO: 3342786 - RNA, 15 nt, Mycobacterium tuberculosis H37Rv
gcccccggcgcggcg

SEQ ID NO: 3342787 - RNA, 14 nt, Mycobacterium tuberculosis H37Rv
gcccccggugccgc

SEQ ID NO: 3342788 - RNA, 20 nt, Mycobacterium tuberculosis H37Rv
gcccccguagaugguggugg

SEQ ID NO: 3342789 - RNA, 21 nt, Mycobacterium tuberculosis H37Rv
gcccccgugggguguggcggc

SEQ ID NO: 3342790 - RNA, 19 nt, Mycobacterium tuberculosis H37Rv
gccccugucaacgccgcgg

SEQ ID NO: 3342791 - RNA, 19 nt, Mycobacterium tuberculosis H37Rv
gccccuucaaagcggccuc

SEQ ID NO: 3342792 - RNA, 23 nt, Mycobacterium tuberculosis H37Rv
gccccuucgcagcauguggccgc

SEQ ID NO: 3342793 - RNA, 18 nt, Mycobacterium tuberculosis H37Rv
gccccuugaccgcugccc

SEQ ID NO: 3342794 - RNA, 21 nt, Mycobacterium tuberculosis H37Rv
gcccgaaccaccaccggcaac

SEQ ID NO: 3342795 - RNA, 15 nt, Mycobacterium tuberculosis H37Rv
gcccgaaccaccgcg

SEQ ID NO: 3342796 - RNA, 16 nt, Mycobacterium tuberculosis H37Rv
gcccgaaccccgggcg

SEQ ID NO: 3342797 - RNA, 20 nt, Mycobacterium tuberculosis H37Rv
gcccgaacgaggcgcccagc

SEQ ID NO: 3342798 - RNA, 21 nt, Mycobacterium tuberculosis H37Rv
gcccgaacgaggcgcccagcg

SEQ ID NO: 3342799 - RNA, 12 nt, Mycobacterium tuberculosis H37Rv
gcccgaagagca

SEQ ID NO: 3342800 - RNA, 21 nt, Mycobacterium tuberculosis H37Rv
gcccgaagagcacgucaacag

SEQ ID NO: 3342801 - RNA, 16 nt, Mycobacterium tuberculosis H37Rv
gcccgaagccgggccc

SEQ ID NO: 3342802 - RNA, 20 nt, Mycobacterium tuberculosis H37Rv
gcccgaaggcggcuccaccg

SEQ ID NO: 3342803 - RNA, 18 nt, Mycobacterium tuberculosis H37Rv
gcccgaaucgccggcggc

SEQ ID NO: 3342804 - RNA, 17 nt, Mycobacterium tuberculosis H37Rv
gcccgaaugcgacgucg

SEQ ID NO: 3342805 - RNA, 22 nt, Mycobacterium tuberculosis H37Rv
gcccgacaccgccccgccgcga

SEQ ID NO: 3342806 - RNA, 20 nt, Mycobacterium tuberculosis H37Rv
gcccgacaccguccagcagc

SEQ ID NO: 3342807 - RNA, 17 nt, Mycobacterium tuberculosis H37Rv
gcccgacacgaaaucga

SEQ ID NO: 3342808 - RNA, 17 nt, Mycobacterium tuberculosis H37Rv
gcccgacagauggucac

SEQ ID NO: 3342809 - RNA, 15 nt, Mycobacterium tuberculosis H37Rv
gcccgacccaucacc

SEQ ID NO: 3342810 - RNA, 17 nt, Mycobacterium tuberculosis H37Rv
gcccgacccaucaccag

SEQ ID NO: 3342811 - RNA, 20 nt, Mycobacterium tuberculosis H37Rv
gcccgacccaucaccagcgg

SEQ ID NO: 3342812 - RNA, 21 nt, Mycobacterium tuberculosis H37Rv
gcccgacccaucaccagcggc

SEQ ID NO: 3342813 - RNA, 22 nt, Mycobacterium tuberculosis H37Rv
gcccgacccaucaccagcggcu

SEQ ID NO: 3342814 - RNA, 17 nt, Mycobacterium tuberculosis H37Rv
gcccgacccgccgacgc

SEQ ID NO: 3342815 - RNA, 15 nt, Mycobacterium tuberculosis H37Rv
gcccgacccgccgau

SEQ ID NO: 3342816 - RNA, 14 nt, Mycobacterium tuberculosis H37Rv
gcccgacccggccg

SEQ ID NO: 3342817 - RNA, 19 nt, Mycobacterium tuberculosis H37Rv
gcccgaccgggaaccacgg

SEQ ID NO: 3342818 - RNA, 13 nt, Mycobacterium tuberculosis H37Rv
gcccgacgacgac

SEQ ID NO: 3342819 - RNA, 14 nt, Mycobacterium tuberculosis H37Rv
gcccgacgagauug

SEQ ID NO: 3342820 - RNA, 21 nt, Mycobacterium tuberculosis H37Rv
gcccgacgagauugccgggcc

SEQ ID NO: 3342821 - RNA, 22 nt, Mycobacterium tuberculosis H37Rv
gcccgacgaggaugucgaugac

SEQ ID NO: 3342822 - RNA, 14 nt, Mycobacterium tuberculosis H37Rv
gcccgacgagucgc

SEQ ID NO: 3342823 - RNA, 20 nt, Mycobacterium tuberculosis H37Rv
gcccgacgaugcgggcgauc

SEQ ID NO: 3342824 - RNA, 15 nt, Mycobacterium tuberculosis H37Rv
gcccgacgccagcug

SEQ ID NO: 3342825 - RNA, 20 nt, Mycobacterium tuberculosis H37Rv
gcccgacgcguggcauccag

SEQ ID NO: 3342826 - RNA, 21 nt, Mycobacterium tuberculosis H37Rv
gcccgacggaguucgacgucg

SEQ ID NO: 3342827 - RNA, 18 nt, Mycobacterium tuberculosis H37Rv
gcccgacggcgcccagcg

SEQ ID NO: 3342828 - RNA, 19 nt, Mycobacterium tuberculosis H37Rv
gcccgacggguaucccguc

SEQ ID NO: 3342829 - RNA, 19 nt, Mycobacterium tuberculosis H37Rv
gcccgacugaacgucaccg

SEQ ID NO: 3342830 - RNA, 16 nt, Mycobacterium tuberculosis H37Rv
gcccgacugccguuca

SEQ ID NO: 3342831 - RNA, 22 nt, Mycobacterium tuberculosis H37Rv
gcccgacugccguucagcggcg

SEQ ID NO: 3342832 - RNA, 21 nt, Mycobacterium tuberculosis H37Rv
gcccgacuggucacugcccug

SEQ ID NO: 3342833 - RNA, 17 nt, Mycobacterium tuberculosis H37Rv
gcccgagacgguguugc

SEQ ID NO: 3342834 - RNA, 19 nt, Mycobacterium tuberculosis H37Rv
gcccgagacgguguugccu

SEQ ID NO: 3342835 - RNA, 13 nt, Mycobacterium tuberculosis H37Rv
gcccgagaucgcg

SEQ ID NO: 3342836 - RNA, 17 nt, Mycobacterium tuberculosis H37Rv
gcccgagaucgcgugcg

SEQ ID NO: 3342837 - RNA, 14 nt, Mycobacterium tuberculosis H37Rv
gcccgagcaggacg

SEQ ID NO: 3342838 - RNA, 18 nt, Mycobacterium tuberculosis H37Rv
gcccgagcaggacgguga

SEQ ID NO: 3342839 - RNA, 17 nt, Mycobacterium tuberculosis H37Rv
gcccgagcccagccggg

SEQ ID NO: 3342840 - RNA, 14 nt, Mycobacterium tuberculosis H37Rv
gcccgagcccagcg

SEQ ID NO: 3342841 - RNA, 16 nt, Mycobacterium tuberculosis H37Rv
gcccgagccgcguggg

SEQ ID NO: 3342842 - RNA, 13 nt, Mycobacterium tuberculosis H37Rv
gcccgagccggug

SEQ ID NO: 3342843 - RNA, 15 nt, Mycobacterium tuberculosis H37Rv
gcccgagccggugcc

SEQ ID NO: 3342844 - RNA, 20 nt, Mycobacterium tuberculosis H37Rv
gcccgagcgcuugaccccgc

SEQ ID NO: 3342845 - RNA, 19 nt, Mycobacterium tuberculosis H37Rv
gcccgaggcacccgugccg

SEQ ID NO: 3342846 - RNA, 21 nt, Mycobacterium tuberculosis H37Rv
gcccgaggcggguacaccacg

SEQ ID NO: 3342847 - RNA, 18 nt, Mycobacterium tuberculosis H37Rv
gcccgagucucgucgggu

SEQ ID NO: 3342848 - RNA, 19 nt, Mycobacterium tuberculosis H37Rv
gcccgagucucgucgggua

SEQ ID NO: 3342849 - RNA, 19 nt, Mycobacterium tuberculosis H37Rv
gcccgaguuaaacgcagcg

SEQ ID NO: 3342850 - RNA, 21 nt, Mycobacterium tuberculosis H37Rv
gcccgaguucgcgaaucccgu

SEQ ID NO: 3342851 - RNA, 16 nt, Mycobacterium tuberculosis H37Rv
gcccgaguuguuggug

SEQ ID NO: 3342852 - RNA, 18 nt, Mycobacterium tuberculosis H37Rv
gcccgaguuugaccagcc

SEQ ID NO: 3342853 - RNA, 14 nt, Mycobacterium tuberculosis H37Rv
gcccgauagaucgc

SEQ ID NO: 3342854 - RNA, 17 nt, Mycobacterium tuberculosis H37Rv
gcccgaucaccagcccc

SEQ ID NO: 3342855 - RNA, 14 nt, Mycobacterium tuberculosis H37Rv
gcccgauccccgga

SEQ ID NO: 3342856 - RNA, 18 nt, Mycobacterium tuberculosis H37Rv
gcccgauccccggagaac

SEQ ID NO: 3342857 - RNA, 20 nt, Mycobacterium tuberculosis H37Rv
gcccgauccggaucccacca

SEQ ID NO: 3342858 - RNA, 16 nt, Mycobacterium tuberculosis H37Rv
gcccgaucgaagaaac

SEQ ID NO: 3342859 - RNA, 14 nt, Mycobacterium tuberculosis H37Rv
gcccgaucgaccgc

SEQ ID NO: 3342860 - RNA, 24 nt, Mycobacterium tuberculosis H37Rv
gcccgaugaggacauccggcgccg

SEQ ID NO: 3342861 - RNA, 20 nt, Mycobacterium tuberculosis H37Rv
gcccgaugcccucgauggcc

SEQ ID NO: 3342862 - RNA, 16 nt, Mycobacterium tuberculosis H37Rv
gcccgaugccgugccc

SEQ ID NO: 3342863 - RNA, 15 nt, Mycobacterium tuberculosis H37Rv
gcccgaugcgccagc

SEQ ID NO: 3342864 - RNA, 18 nt, Mycobacterium tuberculosis H37Rv
gcccgaugguacccgcgc

SEQ ID NO: 3342865 - RNA, 12 nt, Mycobacterium tuberculosis H37Rv
gcccgauggugc

SEQ ID NO: 3342866 - RNA, 17 nt, Mycobacterium tuberculosis H37Rv
gcccgauggugccgacc

SEQ ID NO: 3342867 - RNA, 18 nt, Mycobacterium tuberculosis H37Rv
gcccgauggugccgaccc

SEQ ID NO: 3342868 - RNA, 21 nt, Mycobacterium tuberculosis H37Rv
gcccgauggugccgacccgcc

SEQ ID NO: 3342869 - RNA, 23 nt, Mycobacterium tuberculosis H37Rv
gcccgauggugccgacccgccgc

SEQ ID NO: 3342870 - RNA, 18 nt, Mycobacterium tuberculosis H37Rv
gcccgaugguggugccga

SEQ ID NO: 3342871 - RNA, 21 nt, Mycobacterium tuberculosis H37Rv
gcccgcaacacugaguucggu

SEQ ID NO: 3342872 - RNA, 13 nt, Mycobacterium tuberculosis H37Rv
gcccgcaccaccg

SEQ ID NO: 3342873 - RNA, 18 nt, Mycobacterium tuberculosis H37Rv
gcccgcaccaccggcccc

SEQ ID NO: 3342874 - RNA, 14 nt, Mycobacterium tuberculosis H37Rv
gcccgcaccagaaa

SEQ ID NO: 3342875 - RNA, 13 nt, Mycobacterium tuberculosis H37Rv
gcccgcaccagcu

SEQ ID NO: 3342876 - RNA, 14 nt, Mycobacterium tuberculosis H37Rv
gcccgcaccagcug

SEQ ID NO: 3342877 - RNA, 20 nt, Mycobacterium tuberculosis H37Rv
gcccgcacccaugaucccgc

SEQ ID NO: 3342878 - RNA, 18 nt, Mycobacterium tuberculosis H37Rv
gcccgcacccccgacacc

SEQ ID NO: 3342879 - RNA, 23 nt, Mycobacterium tuberculosis H37Rv
gcccgcacccccgacaccgccga

SEQ ID NO: 3342880 - RNA, 14 nt, Mycobacterium tuberculosis H37Rv
gcccgcacccgcgc

SEQ ID NO: 3342881 - RNA, 19 nt, Mycobacterium tuberculosis H37Rv
gcccgcacccguccggccg

SEQ ID NO: 3342882 - RNA, 12 nt, Mycobacterium tuberculosis H37Rv
gcccgcaccgcg

SEQ ID NO: 3342883 - RNA, 23 nt, Mycobacterium tuberculosis H37Rv
gcccgcaccgcugaccccggcag

SEQ ID NO: 3342884 - RNA, 15 nt, Mycobacterium tuberculosis H37Rv
gcccgcacgaucucg

SEQ ID NO: 3342885 - RNA, 19 nt, Mycobacterium tuberculosis H37Rv
gcccgcacggccgcagccg

SEQ ID NO: 3342886 - RNA, 15 nt, Mycobacterium tuberculosis H37Rv
gcccgcucauuggca

SEQ ID NO: 3342887 - RNA, 20 nt, Mycobacterium tuberculosis H37Rv
gcccgcucauuggcauugcc

SEQ ID NO: 3342888 - RNA, 14 nt, Mycobacterium tuberculosis H37Rv
gcccgcucccugca

SEQ ID NO: 3342889 - RNA, 22 nt, Mycobacterium tuberculosis H37Rv
gcccgcuccgccgucgccgccg

SEQ ID NO: 3342890 - RNA, 14 nt, Mycobacterium tuberculosis H37Rv
gcccgcuccgcggc

SEQ ID NO: 3342891 - RNA, 17 nt, Mycobacterium tuberculosis H37Rv
gcccgcuccgggaccca

SEQ ID NO: 3342892 - RNA, 19 nt, Mycobacterium tuberculosis H37Rv
gcccgcucgaucggcagcc

SEQ ID NO: 3342893 - RNA, 15 nt, Mycobacterium tuberculosis H37Rv
gcccgcucggagauc

SEQ ID NO: 3342894 - RNA, 19 nt, Mycobacterium tuberculosis H37Rv
gcccgcucggagaucgcca

SEQ ID NO: 3342895 - RNA, 18 nt, Mycobacterium tuberculosis H37Rv
gcccgcucggccgcagcc

SEQ ID NO: 3342896 - RNA, 21 nt, Mycobacterium tuberculosis H37Rv
gcccgcucggccgcagccagc

SEQ ID NO: 3342897 - RNA, 23 nt, Mycobacterium tuberculosis H37Rv
gcccgcucggccgcagccagcgg

SEQ ID NO: 3342898 - RNA, 22 nt, Mycobacterium tuberculosis H37Rv
gcccgcucgggguugcucgcga

SEQ ID NO: 3342899 - RNA, 17 nt, Mycobacterium tuberculosis H37Rv
gcccgcucguaggaccu

SEQ ID NO: 3342900 - RNA, 20 nt, Mycobacterium tuberculosis H37Rv
gcccgcugagcacucaugau

SEQ ID NO: 3342901 - RNA, 16 nt, Mycobacterium tuberculosis H37Rv
gcccgcugagccagcu

SEQ ID NO: 3342902 - RNA, 20 nt, Mycobacterium tuberculosis H37Rv
gcccgcugagccagcuccac

SEQ ID NO: 3342903 - RNA, 19 nt, Mycobacterium tuberculosis H37Rv
gcccgcugaucagauccuc

SEQ ID NO: 3342904 - RNA, 13 nt, Mycobacterium tuberculosis H37Rv
gcccgcugcagac

SEQ ID NO: 3342905 - RNA, 15 nt, Mycobacterium tuberculosis H37Rv
gcccgcugcgcggcc

SEQ ID NO: 3342906 - RNA, 16 nt, Mycobacterium tuberculosis H37Rv
gcccgcugggcucgcu

SEQ ID NO: 3342907 - RNA, 19 nt, Mycobacterium tuberculosis H37Rv
gcccgcugggcucgcugca

SEQ ID NO: 3342908 - RNA, 14 nt, Mycobacterium tuberculosis H37Rv
gcccgcuucagcac

SEQ ID NO: 3342909 - RNA, 15 nt, Mycobacterium tuberculosis H37Rv
gcccgcuucagcacg

SEQ ID NO: 3342910 - RNA, 23 nt, Mycobacterium tuberculosis H37Rv
gcccggaaaaauuucuucgccga

SEQ ID NO: 3342911 - RNA, 17 nt, Mycobacterium tuberculosis H37Rv
gcccggaaaggccgcgg

SEQ ID NO: 3342912 - RNA, 13 nt, Mycobacterium tuberculosis H37Rv
gcccggacaggcu

SEQ ID NO: 3342913 - RNA, 14 nt, Mycobacterium tuberculosis H37Rv
gcccggacaugcgg

SEQ ID NO: 3342914 - RNA, 19 nt, Mycobacterium tuberculosis H37Rv
gcccggacaugcgggcagc

SEQ ID NO: 3342915 - RNA, 14 nt, Mycobacterium tuberculosis H37Rv
gcccggacgauggc

SEQ ID NO: 3342916 - RNA, 15 nt, Mycobacterium tuberculosis H37Rv
gcccggacgauggcg

SEQ ID NO: 3342917 - RNA, 18 nt, Mycobacterium tuberculosis H37Rv
gcccggacgcaacacccg

SEQ ID NO: 3342918 - RNA, 12 nt, Mycobacterium tuberculosis H37Rv
gcccggacgucg

SEQ ID NO: 3342919 - RNA, 15 nt, Mycobacterium tuberculosis H37Rv
gcccggacugaucgu

SEQ ID NO: 3342920 - RNA, 20 nt, Mycobacterium tuberculosis H37Rv
gcccggaggguucggacggc

SEQ ID NO: 3342921 - RNA, 15 nt, Mycobacterium tuberculosis H37Rv
gcccggaugaucccg

SEQ ID NO: 3342922 - RNA, 14 nt, Mycobacterium tuberculosis H37Rv
gcccggaugcgaug

SEQ ID NO: 3342923 - RNA, 13 nt, Mycobacterium tuberculosis H37Rv
gcccggauuggcg

SEQ ID NO: 3342924 - RNA, 14 nt, Mycobacterium tuberculosis H37Rv
gcccggcaaugauc

SEQ ID NO: 3342925 - RNA, 17 nt, Mycobacterium tuberculosis H37Rv
gcccggcacacggccuu

SEQ ID NO: 3342926 - RNA, 13 nt, Mycobacterium tuberculosis H37Rv
gcccggcaccgcg

SEQ ID NO: 3342927 - RNA, 16 nt, Mycobacterium tuberculosis H37Rv
gcccggcaggacuugg

SEQ ID NO: 3342928 - RNA, 22 nt, Mycobacterium tuberculosis H37Rv
gcccggcaguucgcggccaucg

SEQ ID NO: 3342929 - RNA, 12 nt, Mycobacterium tuberculosis H37Rv
gcccggcaucgc

SEQ ID NO: 3342930 - RNA, 13 nt, Mycobacterium tuberculosis H37Rv
gcccggcaucgcg

SEQ ID NO: 3342931 - RNA, 18 nt, Mycobacterium tuberculosis H37Rv
gcccggccaaaauggcgc

SEQ ID NO: 3342932 - RNA, 15 nt, Mycobacterium tuberculosis H37Rv
gcccggccagccgca

SEQ ID NO: 3342933 - RNA, 22 nt, Mycobacterium tuberculosis H37Rv
gcccggccagccgcacgguugc

SEQ ID NO: 3342934 - RNA, 12 nt, Mycobacterium tuberculosis H37Rv
gcccggccaggu

SEQ ID NO: 3342935 - RNA, 12 nt, Mycobacterium tuberculosis H37Rv
gcccggccccgc

SEQ ID NO: 3342936 - RNA, 16 nt, Mycobacterium tuberculosis H37Rv
gcccggccccgcaagc

SEQ ID NO: 3342937 - RNA, 17 nt, Mycobacterium tuberculosis H37Rv
gcccggcccgcucagcc

SEQ ID NO: 3342938 - RNA, 23 nt, Mycobacterium tuberculosis H37Rv
gcccggcccugagcugccgagcg

SEQ ID NO: 3342939 - RNA, 13 nt, Mycobacterium tuberculosis H37Rv
gcccggccgcagc

SEQ ID NO: 3342940 - RNA, 14 nt, Mycobacterium tuberculosis H37Rv
gcccggccgcagcg

SEQ ID NO: 3342941 - RNA, 13 nt, Mycobacterium tuberculosis H37Rv
gcccggccgccac

SEQ ID NO: 3342942 - RNA, 15 nt, Mycobacterium tuberculosis H37Rv
gcccggccgccagcg

SEQ ID NO: 3342943 - RNA, 16 nt, Mycobacterium tuberculosis H37Rv
gcccggccgccagcgc

SEQ ID NO: 3342944 - RNA, 18 nt, Mycobacterium tuberculosis H37Rv
gcccggccgccagcgcgc

SEQ ID NO: 3342945 - RNA, 15 nt, Mycobacterium tuberculosis H37Rv
gcccggccgcggccc

SEQ ID NO: 3342946 - RNA, 15 nt, Mycobacterium tuberculosis H37Rv
gcccggccuugccgc

SEQ ID NO: 3342947 - RNA, 18 nt, Mycobacterium tuberculosis H37Rv
gcccggccuugccgccgg

SEQ ID NO: 3342948 - RNA, 23 nt, Mycobacterium tuberculosis H37Rv
gcccggcgaaagcuugggcgauc

SEQ ID NO: 3342949 - RNA, 22 nt, Mycobacterium tuberculosis H37Rv
gcccggcgaauacgaccgucgc

SEQ ID NO: 3342950 - RNA, 14 nt, Mycobacterium tuberculosis H37Rv
gcccggcgacgacc

SEQ ID NO: 3342951 - RNA, 15 nt, Mycobacterium tuberculosis H37Rv
gcccggcgagcaggg

SEQ ID NO: 3342952 - RNA, 18 nt, Mycobacterium tuberculosis H37Rv
gcccggcgaucagcagcg

SEQ ID NO: 3342953 - RNA, 13 nt, Mycobacterium tuberculosis H37Rv
gcccggcgcaagc

SEQ ID NO: 3342954 - RNA, 22 nt, Mycobacterium tuberculosis H37Rv
gcccggcgcaagcgccgcgcuu

SEQ ID NO: 3342955 - RNA, 12 nt, Mycobacterium tuberculosis H37Rv
gcccggcgcgaa

SEQ ID NO: 3342956 - RNA, 16 nt, Mycobacterium tuberculosis H37Rv
gcccggcgcgaagucg

SEQ ID NO: 3342957 - RNA, 13 nt, Mycobacterium tuberculosis H37Rv
gcccggcgcgccg

SEQ ID NO: 3342958 - RNA, 13 nt, Mycobacterium tuberculosis H37Rv
gcccggcggccaa

SEQ ID NO: 3342959 - RNA, 15 nt, Mycobacterium tuberculosis H37Rv
gcccggcggccagcu

SEQ ID NO: 3342960 - RNA, 14 nt, Mycobacterium tuberculosis H37Rv
gcccggcggcccga

SEQ ID NO: 3342961 - RNA, 17 nt, Mycobacterium tuberculosis H37Rv
gcccggcggccgcuucg

SEQ ID NO: 3342962 - RNA, 11 nt, Mycobacterium tuberculosis H37Rv
gcccggcggcg

SEQ ID NO: 3342963 - RNA, 12 nt, Mycobacterium tuberculosis H37Rv
gcccggcggcga

SEQ ID NO: 3342964 - RNA, 13 nt, Mycobacterium tuberculosis H37Rv
gcccggcggcggu

SEQ ID NO: 3342965 - RNA, 16 nt, Mycobacterium tuberculosis H37Rv
gcccggcguggugagc

SEQ ID NO: 3342966 - RNA, 21 nt, Mycobacterium tuberculosis H37Rv
gcccggcguggugagccucgg

SEQ ID NO: 3342967 - RNA, 18 nt, Mycobacterium tuberculosis H37Rv
gcccggcgugucgccgcc

SEQ ID NO: 3342968 - RNA, 21 nt, Mycobacterium tuberculosis H37Rv
gcccggcgugucgccgccacc

SEQ ID NO: 3342969 - RNA, 22 nt, Mycobacterium tuberculosis H37Rv
gcccggcguuguugaccagcac

SEQ ID NO: 3342970 - RNA, 17 nt, Mycobacterium tuberculosis H37Rv
gcccggcuaacuggacu

SEQ ID NO: 3342971 - RNA, 17 nt, Mycobacterium tuberculosis H37Rv
gcccggcuacgacggcg

SEQ ID NO: 3342972 - RNA, 16 nt, Mycobacterium tuberculosis H37Rv
gcccggcucacagcac

SEQ ID NO: 3342973 - RNA, 19 nt, Mycobacterium tuberculosis H37Rv
gcccggcucacagcacagc

SEQ ID NO: 3342974 - RNA, 20 nt, Mycobacterium tuberculosis H37Rv
gcccggcuccuccccggccc

SEQ ID NO: 3342975 - RNA, 14 nt, Mycobacterium tuberculosis H37Rv
gcccggcucggugc

SEQ ID NO: 3342976 - RNA, 17 nt, Mycobacterium tuberculosis H37Rv
gcccggcucucagcgac

SEQ ID NO: 3342977 - RNA, 17 nt, Mycobacterium tuberculosis H37Rv
gcccggcugcgccgggc

SEQ ID NO: 3342978 - RNA, 20 nt, Mycobacterium tuberculosis H37Rv
gcccggcugcgccgggcucg

SEQ ID NO: 3342979 - RNA, 21 nt, Mycobacterium tuberculosis H37Rv
gcccggcuuuugcgcccagca

SEQ ID NO: 3342980 - RNA, 18 nt, Mycobacterium tuberculosis H37Rv
gcccgggacaaguucggu

SEQ ID NO: 3342981 - RNA, 13 nt, Mycobacterium tuberculosis H37Rv
gcccgggauaccg

SEQ ID NO: 3342982 - RNA, 23 nt, Mycobacterium tuberculosis H37Rv
gcccgggauaguuuucggccgcc

SEQ ID NO: 3342983 - RNA, 21 nt, Mycobacterium tuberculosis H37Rv
gcccuauacgcaacaggccaa

SEQ ID NO: 3342984 - RNA, 22 nt, Mycobacterium tuberculosis H37Rv
gcccuauacgcaacaggccaac

SEQ ID NO: 3342985 - RNA, 16 nt, Mycobacterium tuberculosis H37Rv
gcccuaucuggcggcc

SEQ ID NO: 3342986 - RNA, 21 nt, Mycobacterium tuberculosis H37Rv
gcccucaacgaucgcgccguc

SEQ ID NO: 3342987 - RNA, 15 nt, Mycobacterium tuberculosis H37Rv
gcccucacaacgauu

SEQ ID NO: 3342988 - RNA, 16 nt, Mycobacterium tuberculosis H37Rv
gcccucaccgccugug

SEQ ID NO: 3342989 - RNA, 17 nt, Mycobacterium tuberculosis H37Rv
gcccucagccgcggcca

SEQ ID NO: 3342990 - RNA, 20 nt, Mycobacterium tuberculosis H37Rv
gcccucagcuagcgcgggcu

SEQ ID NO: 3342991 - RNA, 20 nt, Mycobacterium tuberculosis H37Rv
gcccucaguucacguucggc

SEQ ID NO: 3342992 - RNA, 18 nt, Mycobacterium tuberculosis H37Rv
gcccucauaggccugcag

SEQ ID NO: 3342993 - RNA, 17 nt, Mycobacterium tuberculosis H37Rv
gcccuccagggcccugc

SEQ ID NO: 3342994 - RNA, 22 nt, Mycobacterium tuberculosis H37Rv
gcccucccuggggccguccggc

SEQ ID NO: 3342995 - RNA, 12 nt, Mycobacterium tuberculosis H37Rv
gcccuccgacgg

SEQ ID NO: 3342996 - RNA, 14 nt, Mycobacterium tuberculosis H37Rv
gcccuccgagcaca

SEQ ID NO: 3342997 - RNA, 18 nt, Mycobacterium tuberculosis H37Rv
gcccuccggcgcagcgac

SEQ ID NO: 3342998 - RNA, 19 nt, Mycobacterium tuberculosis H37Rv
gcccuccggguauggcggc

SEQ ID NO: 3342999 - RNA, 23 nt, Mycobacterium tuberculosis H37Rv
gcccuccgugggcagcgcgcccg

SEQ ID NO: 3343000 - RNA, 16 nt, Mycobacterium tuberculosis H37Rv
gcccuccucgaccgcg

SEQ ID NO: 3343001 - RNA, 19 nt, Mycobacterium tuberculosis H37Rv
gcccuccucgaccgcggcc

SEQ ID NO: 3343002 - RNA, 24 nt, Mycobacterium tuberculosis H37Rv
gcccuccucgaccgcggccuuggc

SEQ ID NO: 3343003 - RNA, 21 nt, Mycobacterium tuberculosis H37Rv
gcccucgacgccgcgcagccg

SEQ ID NO: 3343004 - RNA, 23 nt, Mycobacterium tuberculosis H37Rv
gcccucgacgccgcgcagccggc

SEQ ID NO: 3343005 - RNA, 21 nt, Mycobacterium tuberculosis H37Rv
gcccucgacguccaucccggc

SEQ ID NO: 3343006 - RNA, 15 nt, Mycobacterium tuberculosis H37Rv
gcccucgaucgccac

SEQ ID NO: 3343007 - RNA, 18 nt, Mycobacterium tuberculosis H37Rv
gcccucgaucgccacgac

SEQ ID NO: 3343008 - RNA, 16 nt, Mycobacterium tuberculosis H37Rv
gcccucgaugccgcgu

SEQ ID NO: 3343009 - RNA, 19 nt, Mycobacterium tuberculosis H37Rv
gcccucgcgcgcgucgagu

SEQ ID NO: 3343010 - RNA, 13 nt, Mycobacterium tuberculosis H37Rv
gcccucggccgcc

SEQ ID NO: 3343011 - RNA, 18 nt, Mycobacterium tuberculosis H37Rv
gcccucggccgccugacg

SEQ ID NO: 3343012 - RNA, 13 nt, Mycobacterium tuberculosis H37Rv
gcccucggcggcg

SEQ ID NO: 3343013 - RNA, 18 nt, Mycobacterium tuberculosis H37Rv
gcccucgggacggccgcc

SEQ ID NO: 3343014 - RNA, 19 nt, Mycobacterium tuberculosis H37Rv
gcccucgggacggccgccg

SEQ ID NO: 3343015 - RNA, 22 nt, Mycobacterium tuberculosis H37Rv
gcccucgggacggccgccgccg

SEQ ID NO: 3343016 - RNA, 20 nt, Mycobacterium tuberculosis H37Rv
gcccucgggguagccaaccu

SEQ ID NO: 3343017 - RNA, 19 nt, Mycobacterium tuberculosis H37Rv
gcccucgucgcgggccacc

SEQ ID NO: 3343018 - RNA, 17 nt, Mycobacterium tuberculosis H37Rv
gcccucguuaucgaccg

SEQ ID NO: 3343019 - RNA, 19 nt, Mycobacterium tuberculosis H37Rv
gcccucguuaucgaccgcc

SEQ ID NO: 3343020 - RNA, 21 nt, Mycobacterium tuberculosis H37Rv
gcccucguuaucgaccgccgc

SEQ ID NO: 3343021 - RNA, 17 nt, Mycobacterium tuberculosis H37Rv
gcccucuaugcgggcag

SEQ ID NO: 3343022 - RNA, 21 nt, Mycobacterium tuberculosis H37Rv
gcccucuaugcgggcagcgau

SEQ ID NO: 3343023 - RNA, 20 nt, Mycobacterium tuberculosis H37Rv
gcccugacacaacaccggcg

SEQ ID NO: 3343024 - RNA, 14 nt, Mycobacterium tuberculosis H37Rv
gcccugacacccau

SEQ ID NO: 3343025 - RNA, 20 nt, Mycobacterium tuberculosis H37Rv
gcccugacacccaucgaccg

SEQ ID NO: 3343026 - RNA, 21 nt, Mycobacterium tuberculosis H37Rv
gcccugacacccaucgaccgc

SEQ ID NO: 3343027 - RNA, 22 nt, Mycobacterium tuberculosis H37Rv
gcccugacccggagccgccagg

SEQ ID NO: 3343028 - RNA, 15 nt, Mycobacterium tuberculosis H37Rv
gcccugaccgcccgc

SEQ ID NO: 3343029 - RNA, 19 nt, Mycobacterium tuberculosis H37Rv
gcccugagaacacguucgg

SEQ ID NO: 3343030 - RNA, 14 nt, Mycobacterium tuberculosis H37Rv
gcccugagccaccc

SEQ ID NO: 3343031 - RNA, 16 nt, Mycobacterium tuberculosis H37Rv
gcccugauugaagccc

SEQ ID NO: 3343032 - RNA, 17 nt, Mycobacterium tuberculosis H37Rv
gcccugauugaagcccc

SEQ ID NO: 3343033 - RNA, 12 nt, Mycobacterium tuberculosis H37Rv
gcccugcaaccc

SEQ ID NO: 3343034 - RNA, 15 nt, Mycobacterium tuberculosis H37Rv
gcccugcacagcagc

SEQ ID NO: 3343035 - RNA, 21 nt, Mycobacterium tuberculosis H37Rv
gcccugcauaggcgcggucac

SEQ ID NO: 3343036 - RNA, 14 nt, Mycobacterium tuberculosis H37Rv
gcccugccgccggc

SEQ ID NO: 3343037 - RNA, 17 nt, Mycobacterium tuberculosis H37Rv
gcccugccggcagcggc

SEQ ID NO: 3343038 - RNA, 14 nt, Mycobacterium tuberculosis H37Rv
gcccugcgcagccg

SEQ ID NO: 3343039 - RNA, 16 nt, Mycobacterium tuberculosis H37Rv
gcccugcgcagccgcc

SEQ ID NO: 3343040 - RNA, 17 nt, Mycobacterium tuberculosis H37Rv
gcccugcgcagccgccu

SEQ ID NO: 3343041 - RNA, 19 nt, Mycobacterium tuberculosis H37Rv
gcccugcgccucggcggcc

SEQ ID NO: 3343042 - RNA, 14 nt, Mycobacterium tuberculosis H37Rv
gcccugcggccacg

SEQ ID NO: 3343043 - RNA, 21 nt, Mycobacterium tuberculosis H37Rv
gcccugcggccacgguggcgc

SEQ ID NO: 3343044 - RNA, 14 nt, Mycobacterium tuberculosis H37Rv
gcccugcuggccca

SEQ ID NO: 3343045 - RNA, 22 nt, Mycobacterium tuberculosis H37Rv
gcccugcuugcaggcgaucugg

SEQ ID NO: 3343046 - RNA, 18 nt, Mycobacterium tuberculosis H37Rv
gcccuggaaugccgccac

SEQ ID NO: 3343047 - RNA, 22 nt, Mycobacterium tuberculosis H37Rv
gcccuggacauaccggcccggg

SEQ ID NO: 3343048 - RNA, 14 nt, Mycobacterium tuberculosis H37Rv
gcccuggaccagcg

SEQ ID NO: 3343049 - RNA, 15 nt, Mycobacterium tuberculosis H37Rv
gcccuggcaacgaca

SEQ ID NO: 3343050 - RNA, 23 nt, Mycobacterium tuberculosis H37Rv
gcccuggcaacgacacgccgcuc

SEQ ID NO: 3343051 - RNA, 14 nt, Mycobacterium tuberculosis H37Rv
gcccuggcccaucu

SEQ ID NO: 3343052 - RNA, 18 nt, Mycobacterium tuberculosis H37Rv
gcccuggccgcccagacc

SEQ ID NO: 3343053 - RNA, 20 nt, Mycobacterium tuberculosis H37Rv
gcccuggccgcccuggccgc

SEQ ID NO: 3343054 - RNA, 15 nt, Mycobacterium tuberculosis H37Rv
gcccugggcgccggc

SEQ ID NO: 3343055 - RNA, 22 nt, Mycobacterium tuberculosis H37Rv
gcccuggggguggcagcgcggc

SEQ ID NO: 3343056 - RNA, 18 nt, Mycobacterium tuberculosis H37Rv
gcccugggugauggccgc

SEQ ID NO: 3343057 - RNA, 20 nt, Mycobacterium tuberculosis H37Rv
gcccugggugauggccgcgc

SEQ ID NO: 3343058 - RNA, 22 nt, Mycobacterium tuberculosis H37Rv
gcccugggugguuccgcgcggc

SEQ ID NO: 3343059 - RNA, 15 nt, Mycobacterium tuberculosis H37Rv
gcccugguccaggcc

SEQ ID NO: 3343060 - RNA, 17 nt, Mycobacterium tuberculosis H37Rv
gcccugguccaggcccu

SEQ ID NO: 3343061 - RNA, 18 nt, Mycobacterium tuberculosis H37Rv
gcccugguccaggcccug

SEQ ID NO: 3343062 - RNA, 23 nt, Mycobacterium tuberculosis H37Rv
gcccugguccaggcccuggccag

SEQ ID NO: 3343063 - RNA, 19 nt, Mycobacterium tuberculosis H37Rv
gcccuguccggcgccgagg

SEQ ID NO: 3343064 - RNA, 22 nt, Mycobacterium tuberculosis H37Rv
gcccuguucgauaagcagcucg

SEQ ID NO: 3343065 - RNA, 13 nt, Mycobacterium tuberculosis H37Rv
gcccuguucuccg

SEQ ID NO: 3343066 - RNA, 19 nt, Mycobacterium tuberculosis H37Rv
gcccuucagcacggugauc

SEQ ID NO: 3343067 - RNA, 14 nt, Mycobacterium tuberculosis H37Rv
gcccuuccggccga

SEQ ID NO: 3343068 - RNA, 22 nt, Mycobacterium tuberculosis H37Rv
gcccuuccggccgacacgccga

SEQ ID NO: 3343069 - RNA, 12 nt, Mycobacterium tuberculosis H37Rv
gcccuugccgcc

SEQ ID NO: 3343070 - RNA, 14 nt, Mycobacterium tuberculosis H37Rv
gcccuugccgccag

SEQ ID NO: 3343071 - RNA, 20 nt, Mycobacterium tuberculosis H37Rv
gcccuugccgccagccccag

SEQ ID NO: 3343072 - RNA, 22 nt, Mycobacterium tuberculosis H37Rv
gcccuugccgccagccccagcg

SEQ ID NO: 3343073 - RNA, 23 nt, Mycobacterium tuberculosis H37Rv
gcccuugccgccguugccgccgg

SEQ ID NO: 3343074 - RNA, 14 nt, Mycobacterium tuberculosis H37Rv
gcccuugccgccuu

SEQ ID NO: 3343075 - RNA, 19 nt, Mycobacterium tuberculosis H37Rv
gcccuugccgccuuggccc

SEQ ID NO: 3343076 - RNA, 22 nt, Mycobacterium tuberculosis H37Rv
gcccuugccggcgagagcguca

SEQ ID NO: 3343077 - RNA, 12 nt, Mycobacterium tuberculosis H37Rv
gcccuugccuug

SEQ ID NO: 3343078 - RNA, 18 nt, Mycobacterium tuberculosis H37Rv
gccgacauugcugcucgu

SEQ ID NO: 3343079 - RNA, 22 nt, Mycobacterium tuberculosis H37Rv
gccgacauugcugcucgugagc

SEQ ID NO: 3343080 - RNA, 19 nt, Mycobacterium tuberculosis H37Rv
gccgaccaccccgagcggc

SEQ ID NO: 3343081 - RNA, 17 nt, Mycobacterium tuberculosis H37Rv
gccgaccagaacgccag

SEQ ID NO: 3343082 - RNA, 20 nt, Mycobacterium tuberculosis H37Rv
gccgaccagaacgccagacc

SEQ ID NO: 3343083 - RNA, 22 nt, Mycobacterium tuberculosis H37Rv
gccgaccagagcuucgccgcgc

SEQ ID NO: 3343084 - RNA, 23 nt, Mycobacterium tuberculosis H37Rv
gccgaccagagcuucgccgcgca

SEQ ID NO: 3343085 - RNA, 14 nt, Mycobacterium tuberculosis H37Rv
gccgaccagcaccc

SEQ ID NO: 3343086 - RNA, 17 nt, Mycobacterium tuberculosis H37Rv
gccgaccagcaucucgg

SEQ ID NO: 3343087 - RNA, 16 nt, Mycobacterium tuberculosis H37Rv
gccgaccagccgauca

SEQ ID NO: 3343088 - RNA, 14 nt, Mycobacterium tuberculosis H37Rv
gccgaccagcgcgc

SEQ ID NO: 3343089 - RNA, 19 nt, Mycobacterium tuberculosis H37Rv
gccgaccagcgcgcugcgc

SEQ ID NO: 3343090 - RNA, 18 nt, Mycobacterium tuberculosis H37Rv
gccgaccagcgcggcaca

SEQ ID NO: 3343091 - RNA, 16 nt, Mycobacterium tuberculosis H37Rv
gccgaccaggaccacc

SEQ ID NO: 3343092 - RNA, 16 nt, Mycobacterium tuberculosis H37Rv
gccgaccaggccagag

SEQ ID NO: 3343093 - RNA, 22 nt, Mycobacterium tuberculosis H37Rv
gccgaccaggccagagccgccc

SEQ ID NO: 3343094 - RNA, 16 nt, Mycobacterium tuberculosis H37Rv
gccgaccagucgacgu

SEQ ID NO: 3343095 - RNA, 16 nt, Mycobacterium tuberculosis H37Rv
gccgaccaucucaccg

SEQ ID NO: 3343096 - RNA, 20 nt, Mycobacterium tuberculosis H37Rv
gccgaccaucucaccgggcc

SEQ ID NO: 3343097 - RNA, 22 nt, Mycobacterium tuberculosis H37Rv
gccgaccaucucaccgggcccg

SEQ ID NO: 3343098 - RNA, 23 nt, Mycobacterium tuberculosis H37Rv
gccgaccaucucaccgggcccga

SEQ ID NO: 3343099 - RNA, 21 nt, Mycobacterium tuberculosis H37Rv
gccgaccaugcaagugggcgc

SEQ ID NO: 3343100 - RNA, 17 nt, Mycobacterium tuberculosis H37Rv
gccgacccaacccgauc

SEQ ID NO: 3343101 - RNA, 20 nt, Mycobacterium tuberculosis H37Rv
gccgaccccggaaugcccga

SEQ ID NO: 3343102 - RNA, 22 nt, Mycobacterium tuberculosis H37Rv
gccgacccgacgcuggucggcg

SEQ ID NO: 3343103 - RNA, 16 nt, Mycobacterium tuberculosis H37Rv
gccgacccgaucaccu

SEQ ID NO: 3343104 - RNA, 20 nt, Mycobacterium tuberculosis H37Rv
gccgacccgccacaucgugg

SEQ ID NO: 3343105 - RNA, 22 nt, Mycobacterium tuberculosis H37Rv
gccgacccgccgcgcccggcgc

SEQ ID NO: 3343106 - RNA, 21 nt, Mycobacterium tuberculosis H37Rv
gccgacccgcgcgccggcgac

SEQ ID NO: 3343107 - RNA, 22 nt, Mycobacterium tuberculosis H37Rv
gccgacccgcgcgccggcgacc

SEQ ID NO: 3343108 - RNA, 20 nt, Mycobacterium tuberculosis H37Rv
gccgaccgacaccaccaggu

SEQ ID NO: 3343109 - RNA, 18 nt, Mycobacterium tuberculosis H37Rv
gccgaccgacgucgccca

SEQ ID NO: 3343110 - RNA, 19 nt, Mycobacterium tuberculosis H37Rv
gccgaccggcacccgcggc

SEQ ID NO: 3343111 - RNA, 22 nt, Mycobacterium tuberculosis H37Rv
gccgaccggcacccgcggcgaa

SEQ ID NO: 3343112 - RNA, 20 nt, Mycobacterium tuberculosis H37Rv
gccgaccggcccgcauccgc

SEQ ID NO: 3343113 - RNA, 23 nt, Mycobacterium tuberculosis H37Rv
gccgaccggcccgcauccgcacc

SEQ ID NO: 3343114 - RNA, 13 nt, Mycobacterium tuberculosis H37Rv
gccgaccggcggc

SEQ ID NO: 3343115 - RNA, 18 nt, Mycobacterium tuberculosis H37Rv
gccgaccgggcucuggcc

SEQ ID NO: 3343116 - RNA, 18 nt, Mycobacterium tuberculosis H37Rv
gccgaccggucagcgcgc

SEQ ID NO: 3343117 - RNA, 22 nt, Mycobacterium tuberculosis H37Rv
gccgaccgguuggguagcaccg

SEQ ID NO: 3343118 - RNA, 16 nt, Mycobacterium tuberculosis H37Rv
gccgaccguaccgauc

SEQ ID NO: 3343119 - RNA, 22 nt, Mycobacterium tuberculosis H37Rv
gccgaccgucacugaugggccg

SEQ ID NO: 3343120 - RNA, 14 nt, Mycobacterium tuberculosis H37Rv
gccgaccuagucac

SEQ ID NO: 3343121 - RNA, 17 nt, Mycobacterium tuberculosis H37Rv
gccgaccucaucggcac

SEQ ID NO: 3343122 - RNA, 12 nt, Mycobacterium tuberculosis H37Rv
gccgaccucgag

SEQ ID NO: 3343123 - RNA, 16 nt, Mycobacterium tuberculosis H37Rv
gccgaccucguucguc

SEQ ID NO: 3343124 - RNA, 20 nt, Mycobacterium tuberculosis H37Rv
gccgaccucguucgucacca

SEQ ID NO: 3343125 - RNA, 21 nt, Mycobacterium tuberculosis H37Rv
gccgaccugcgcgacggcgcu

SEQ ID NO: 3343126 - RNA, 22 nt, Mycobacterium tuberculosis H37Rv
gccgaccugcgcgacggcgcug

SEQ ID NO: 3343127 - RNA, 23 nt, Mycobacterium tuberculosis H37Rv
gccgaccugcuggaucucggugg

SEQ ID NO: 3343128 - RNA, 19 nt, Mycobacterium tuberculosis H37Rv
gccgaccugguaugccgcc

SEQ ID NO: 3343129 - RNA, 17 nt, Mycobacterium tuberculosis H37Rv
gccgaccuuggcgucga

SEQ ID NO: 3343130 - RNA, 19 nt, Mycobacterium tuberculosis H37Rv
gccgaccuuggcgucgauc

SEQ ID NO: 3343131 - RNA, 18 nt, Mycobacterium tuberculosis H37Rv
gccgaccuuuugcggcaa

SEQ ID NO: 3343132 - RNA, 19 nt, Mycobacterium tuberculosis H37Rv
gccgaccuuuugcggcaag

SEQ ID NO: 3343133 - RNA, 20 nt, Mycobacterium tuberculosis H37Rv
gccgaccuuuugcggcaagc

SEQ ID NO: 3343134 - RNA, 23 nt, Mycobacterium tuberculosis H37Rv
gccgacgaacgaaccgccgccgc

SEQ ID NO: 3343135 - RNA, 18 nt, Mycobacterium tuberculosis H37Rv
gccgacgacaacagccag

SEQ ID NO: 3343136 - RNA, 16 nt, Mycobacterium tuberculosis H37Rv
gccgacgaccagcaga

SEQ ID NO: 3343137 - RNA, 16 nt, Mycobacterium tuberculosis H37Rv
gccgacgagacggcag

SEQ ID NO: 3343138 - RNA, 14 nt, Mycobacterium tuberculosis H37Rv
gccgacgauagcgg

SEQ ID NO: 3343139 - RNA, 14 nt, Mycobacterium tuberculosis H37Rv
gccgacgauccacg

SEQ ID NO: 3343140 - RNA, 15 nt, Mycobacterium tuberculosis H37Rv
gccgacgaucgacgc

SEQ ID NO: 3343141 - RNA, 19 nt, Mycobacterium tuberculosis H37Rv
gccgacgaucgacgccgcc

SEQ ID NO: 3343142 - RNA, 12 nt, Mycobacterium tuberculosis H37Rv
gccgacgaugac

SEQ ID NO: 3343143 - RNA, 13 nt, Mycobacterium tuberculosis H37Rv
gccgacgaugacg

SEQ ID NO: 3343144 - RNA, 16 nt, Mycobacterium tuberculosis H37Rv
gccgacgaugugccag

SEQ ID NO: 3343145 - RNA, 15 nt, Mycobacterium tuberculosis H37Rv
gccgacgauuaccag

SEQ ID NO: 3343146 - RNA, 20 nt, Mycobacterium tuberculosis H37Rv
gccgacgccccgaucggcca

SEQ ID NO: 3343147 - RNA, 21 nt, Mycobacterium tuberculosis H37Rv
gccgacgccccgaucggccac

SEQ ID NO: 3343148 - RNA, 23 nt, Mycobacterium tuberculosis H37Rv
gccgacgccgccggcaccguaga

SEQ ID NO: 3343149 - RNA, 18 nt, Mycobacterium tuberculosis H37Rv
gccgacgccgccggcccc

SEQ ID NO: 3343150 - RNA, 19 nt, Mycobacterium tuberculosis H37Rv
gccgacgccgccggccccg

SEQ ID NO: 3343151 - RNA, 19 nt, Mycobacterium tuberculosis H37Rv
gccgacgccgccggcgcca

SEQ ID NO: 3343152 - RNA, 22 nt, Mycobacterium tuberculosis H37Rv
gccgacgccgccggcgccaccg

SEQ ID NO: 3343153 - RNA, 13 nt, Mycobacterium tuberculosis H37Rv
gccgacgccguug

SEQ ID NO: 3343154 - RNA, 20 nt, Mycobacterium tuberculosis H37Rv
gccgacgccuuccagcccga

SEQ ID NO: 3343155 - RNA, 16 nt, Mycobacterium tuberculosis H37Rv
gccgacgcgaacccau

SEQ ID NO: 3343156 - RNA, 13 nt, Mycobacterium tuberculosis H37Rv
gccgacgcgcggc

SEQ ID NO: 3343157 - RNA, 17 nt, Mycobacterium tuberculosis H37Rv
gccgacgcgcggccagc

SEQ ID NO: 3343158 - RNA, 14 nt, Mycobacterium tuberculosis H37Rv
gccgacgcggcggg

SEQ ID NO: 3343159 - RNA, 22 nt, Mycobacterium tuberculosis H37Rv
gccgacgcuccaggguccggac

SEQ ID NO: 3343160 - RNA, 15 nt, Mycobacterium tuberculosis H37Rv
gccgacggaucgccc

SEQ ID NO: 3343161 - RNA, 14 nt, Mycobacterium tuberculosis H37Rv
gccgacggccagca

SEQ ID NO: 3343162 - RNA, 15 nt, Mycobacterium tuberculosis H37Rv
gccgacggccagcag

SEQ ID NO: 3343163 - RNA, 16 nt, Mycobacterium tuberculosis H37Rv
gccgacggccagcagg

SEQ ID NO: 3343164 - RNA, 17 nt, Mycobacterium tuberculosis H37Rv
gccgacggccagcagga

SEQ ID NO: 3343165 - RNA, 18 nt, Mycobacterium tuberculosis H37Rv
gccgacggccagcaggau

SEQ ID NO: 3343166 - RNA, 17 nt, Mycobacterium tuberculosis H37Rv
gccgacggcgggcgauc

SEQ ID NO: 3343167 - RNA, 17 nt, Mycobacterium tuberculosis H37Rv
gccgacgggacaacccg

SEQ ID NO: 3343168 - RNA, 15 nt, Mycobacterium tuberculosis H37Rv
gccgacggugauggg

SEQ ID NO: 3343169 - RNA, 13 nt, Mycobacterium tuberculosis H37Rv
gccgacgguuacc

SEQ ID NO: 3343170 - RNA, 19 nt, Mycobacterium tuberculosis H37Rv
gccgacguauagaccaggu

SEQ ID NO: 3343171 - RNA, 20 nt, Mycobacterium tuberculosis H37Rv
gccgacgucgaccacugccc

SEQ ID NO: 3343172 - RNA, 22 nt, Mycobacterium tuberculosis H37Rv
gccgacgucgacgccggccagc

SEQ ID NO: 3343173 - RNA, 20 nt, Mycobacterium tuberculosis H37Rv
gccgaggucgaaccgccggc

SEQ ID NO: 3343174 - RNA, 17 nt, Mycobacterium tuberculosis H37Rv
gccgaggucgguucggc

SEQ ID NO: 3343175 - RNA, 14 nt, Mycobacterium tuberculosis H37Rv
gccgagguugcgga

SEQ ID NO: 3343176 - RNA, 23 nt, Mycobacterium tuberculosis H37Rv
gccgaguaccggccagccgcggc

SEQ ID NO: 3343177 - RNA, 16 nt, Mycobacterium tuberculosis H37Rv
gccgaguucgucagcg

SEQ ID NO: 3343178 - RNA, 22 nt, Mycobacterium tuberculosis H37Rv
gccgauacagaucuggguuccc

SEQ ID NO: 3343179 - RNA, 15 nt, Mycobacterium tuberculosis H37Rv
gccgauaccgccggc

SEQ ID NO: 3343180 - RNA, 15 nt, Mycobacterium tuberculosis H37Rv
gccgauaccggcggc

SEQ ID NO: 3343181 - RNA, 17 nt, Mycobacterium tuberculosis H37Rv
gccgauaccggcggcga

SEQ ID NO: 3343182 - RNA, 18 nt, Mycobacterium tuberculosis H37Rv
gccgauaccggcggcgag

SEQ ID NO: 3343183 - RNA, 19 nt, Mycobacterium tuberculosis H37Rv
gccgauaccggcggcgagc

SEQ ID NO: 3343184 - RNA, 20 nt, Mycobacterium tuberculosis H37Rv
gccgauacuaaacaggccgc

SEQ ID NO: 3343185 - RNA, 14 nt, Mycobacterium tuberculosis H37Rv
gccgauagcaccgg

SEQ ID NO: 3343186 - RNA, 15 nt, Mycobacterium tuberculosis H37Rv
gccgauagcgcggca

SEQ ID NO: 3343187 - RNA, 15 nt, Mycobacterium tuberculosis H37Rv
gccgauauaccaggg

SEQ ID NO: 3343188 - RNA, 15 nt, Mycobacterium tuberculosis H37Rv
gccgauaucggugac

SEQ ID NO: 3343189 - RNA, 21 nt, Mycobacterium tuberculosis H37Rv
gccgauaugcgugagcugcuc

SEQ ID NO: 3343190 - RNA, 17 nt, Mycobacterium tuberculosis H37Rv
gccgauauuggcaucgu

SEQ ID NO: 3343191 - RNA, 23 nt, Mycobacterium tuberculosis H37Rv
gccgaucaacaugccggucaucc

SEQ ID NO: 3343192 - RNA, 19 nt, Mycobacterium tuberculosis H37Rv
gccgaucaaccccccgggc

SEQ ID NO: 3343193 - RNA, 16 nt, Mycobacterium tuberculosis H37Rv
gccgaucaauggcaac

SEQ ID NO: 3343194 - RNA, 15 nt, Mycobacterium tuberculosis H37Rv
gccgaucaccaccgg

SEQ ID NO: 3343195 - RNA, 22 nt, Mycobacterium tuberculosis H37Rv
gccgaucaccaccggcagauga

SEQ ID NO: 3343196 - RNA, 16 nt, Mycobacterium tuberculosis H37Rv
gccgaucaccgcaucg

SEQ ID NO: 3343197 - RNA, 13 nt, Mycobacterium tuberculosis H37Rv
gccgaucaccgcu

SEQ ID NO: 3343198 - RNA, 16 nt, Mycobacterium tuberculosis H37Rv
gccgaucaccgcugug

SEQ ID NO: 3343199 - RNA, 13 nt, Mycobacterium tuberculosis H37Rv
gccgaucacggca

SEQ ID NO: 3343200 - RNA, 18 nt, Mycobacterium tuberculosis H37Rv
gccgaucacugucgggua

SEQ ID NO: 3343201 - RNA, 19 nt, Mycobacterium tuberculosis H37Rv
gccgaucagcccggccuug

SEQ ID NO: 3343202 - RNA, 19 nt, Mycobacterium tuberculosis H37Rv
gccgaucagcgaaccaccg

SEQ ID NO: 3343203 - RNA, 16 nt, Mycobacterium tuberculosis H37Rv
gccgaucagcugcgca

SEQ ID NO: 3343204 - RNA, 13 nt, Mycobacterium tuberculosis H37Rv
gccgaucagcugg

SEQ ID NO: 3343205 - RNA, 15 nt, Mycobacterium tuberculosis H37Rv
gccgaucagcuggcu

SEQ ID NO: 3343206 - RNA, 14 nt, Mycobacterium tuberculosis H37Rv
gccgaucaucaccg

SEQ ID NO: 3343207 - RNA, 15 nt, Mycobacterium tuberculosis H37Rv
gccgaucaucaccgg

SEQ ID NO: 3343208 - RNA, 18 nt, Mycobacterium tuberculosis H37Rv
gccgauccagcaggccgu

SEQ ID NO: 3343209 - RNA, 13 nt, Mycobacterium tuberculosis H37Rv
gccgauccaggag

SEQ ID NO: 3343210 - RNA, 16 nt, Mycobacterium tuberculosis H37Rv
gccgaucccggcgagc

SEQ ID NO: 3343211 - RNA, 15 nt, Mycobacterium tuberculosis H37Rv
gccgaucccguggug

SEQ ID NO: 3343212 - RNA, 14 nt, Mycobacterium tuberculosis H37Rv
gccgaucgacaccc

SEQ ID NO: 3343213 - RNA, 13 nt, Mycobacterium tuberculosis H37Rv
gccgaucgcccgc

SEQ ID NO: 3343214 - RNA, 23 nt, Mycobacterium tuberculosis H37Rv
gccgaucgccgaguccggcgagc

SEQ ID NO: 3343215 - RNA, 17 nt, Mycobacterium tuberculosis H37Rv
gccgaucgcggcggccu

SEQ ID NO: 3343216 - RNA, 18 nt, Mycobacterium tuberculosis H37Rv
gccgaucgcggcggccuc

SEQ ID NO: 3343217 - RNA, 17 nt, Mycobacterium tuberculosis H37Rv
gccgaucggccugcagc

SEQ ID NO: 3343218 - RNA, 22 nt, Mycobacterium tuberculosis H37Rv
gccgaucgggcuucggccagau

SEQ ID NO: 3343219 - RNA, 18 nt, Mycobacterium tuberculosis H37Rv
gccgaucgggguggucgc

SEQ ID NO: 3343220 - RNA, 13 nt, Mycobacterium tuberculosis H37Rv
gccgaucggugcc

SEQ ID NO: 3343221 - RNA, 18 nt, Mycobacterium tuberculosis H37Rv
gccgaucgucucggccac

SEQ ID NO: 3343222 - RNA, 16 nt, Mycobacterium tuberculosis H37Rv
gccgaucucggugacc

SEQ ID NO: 3343223 - RNA, 14 nt, Mycobacterium tuberculosis H37Rv
gccgaucugcucgc

SEQ ID NO: 3343224 - RNA, 22 nt, Mycobacterium tuberculosis H37Rv
gccgaucugcucgccgagcucg

SEQ ID NO: 3343225 - RNA, 23 nt, Mycobacterium tuberculosis H37Rv
gccgaucugcucgccgagcucgg

SEQ ID NO: 3343226 - RNA, 17 nt, Mycobacterium tuberculosis H37Rv
gccgaucugcugcagcg

SEQ ID NO: 3343227 - RNA, 22 nt, Mycobacterium tuberculosis H37Rv
gccgaucugguaagucagcucg

SEQ ID NO: 3343228 - RNA, 17 nt, Mycobacterium tuberculosis H37Rv
gccgaugaacguggcga

SEQ ID NO: 3343229 - RNA, 15 nt, Mycobacterium tuberculosis H37Rv
gccgaugaccgaaga

SEQ ID NO: 3343230 - RNA, 21 nt, Mycobacterium tuberculosis H37Rv
gccgaugaccgaagagcgcgc

SEQ ID NO: 3343231 - RNA, 16 nt, Mycobacterium tuberculosis H37Rv
gccgaugaccgcaacc

SEQ ID NO: 3343232 - RNA, 23 nt, Mycobacterium tuberculosis H37Rv
gccgaugaccgccugcuggccgc

SEQ ID NO: 3343233 - RNA, 15 nt, Mycobacterium tuberculosis H37Rv
gccgaugacgauggc

SEQ ID NO: 3343234 - RNA, 15 nt, Mycobacterium tuberculosis H37Rv
gccgaugacguacgg

SEQ ID NO: 3343235 - RNA, 16 nt, Mycobacterium tuberculosis H37Rv
gccgaugaugcggcgc

SEQ ID NO: 3343236 - RNA, 22 nt, Mycobacterium tuberculosis H37Rv
gccgaugaugcggcgcagcgac

SEQ ID NO: 3343237 - RNA, 19 nt, Mycobacterium tuberculosis H37Rv
gccgaugaugugcggugac

SEQ ID NO: 3343238 - RNA, 15 nt, Mycobacterium tuberculosis H37Rv
gccgaugccgccgcc

SEQ ID NO: 3343239 - RNA, 16 nt, Mycobacterium tuberculosis H37Rv
gccgaugccgccgccg

SEQ ID NO: 3343240 - RNA, 15 nt, Mycobacterium tuberculosis H37Rv
gccgaugccggccaa

SEQ ID NO: 3343241 - RNA, 18 nt, Mycobacterium tuberculosis H37Rv
gccgaugccggcgagggc

SEQ ID NO: 3343242 - RNA, 18 nt, Mycobacterium tuberculosis H37Rv
gccgaugcgacccgcaga

SEQ ID NO: 3343243 - RNA, 20 nt, Mycobacterium tuberculosis H37Rv
gccgaugcgggucucgaccu

SEQ ID NO: 3343244 - RNA, 14 nt, Mycobacterium tuberculosis H37Rv
gccgaugcugcggg

SEQ ID NO: 3343245 - RNA, 18 nt, Mycobacterium tuberculosis H37Rv
gccgaugcugcgggcggu

SEQ ID NO: 3343246 - RNA, 19 nt, Mycobacterium tuberculosis H37Rv
gccgauggcuuggugccca

SEQ ID NO: 3343247 - RNA, 20 nt, Mycobacterium tuberculosis H37Rv
gccgauggcuuggugcccaa

SEQ ID NO: 3343248 - RNA, 17 nt, Mycobacterium tuberculosis H37Rv
gccgaugggaaccgaau

SEQ ID NO: 3343249 - RNA, 19 nt, Mycobacterium tuberculosis H37Rv
gccgaugucaacgcccagc

SEQ ID NO: 3343250 - RNA, 15 nt, Mycobacterium tuberculosis H37Rv
gccgaugucgacgac

SEQ ID NO: 3343251 - RNA, 23 nt, Mycobacterium tuberculosis H37Rv
gccgaugugauuauugauuacgu

SEQ ID NO: 3343252 - RNA, 14 nt, Mycobacterium tuberculosis H37Rv
gccgauguggucgg

SEQ ID NO: 3343253 - RNA, 22 nt, Mycobacterium tuberculosis H37Rv
gccgauuacggugaucgccggc

SEQ ID NO: 3343254 - RNA, 14 nt, Mycobacterium tuberculosis H37Rv
gccgauuccaccgc

SEQ ID NO: 3343255 - RNA, 18 nt, Mycobacterium tuberculosis H37Rv
gccgauuccggaguucuu

SEQ ID NO: 3343256 - RNA, 11 nt, Mycobacterium tuberculosis H37Rv
gccgcaaccau

SEQ ID NO: 3343257 - RNA, 23 nt, Mycobacterium tuberculosis H37Rv
gccgcaaccauguuaacgcgcgu

SEQ ID NO: 3343258 - RNA, 14 nt, Mycobacterium tuberculosis H37Rv
gccgcaaccggcga

SEQ ID NO: 3343259 - RNA, 15 nt, Mycobacterium tuberculosis H37Rv
gccgcaaccggcgau

SEQ ID NO: 3343260 - RNA, 19 nt, Mycobacterium tuberculosis H37Rv
gccgcaagccucgugguga

SEQ ID NO: 3343261 - RNA, 14 nt, Mycobacterium tuberculosis H37Rv
gccgcaaggcgccg

SEQ ID NO: 3343262 - RNA, 14 nt, Mycobacterium tuberculosis H37Rv
gccgcaauacccga

SEQ ID NO: 3343263 - RNA, 17 nt, Mycobacterium tuberculosis H37Rv
gccgcacaaguggucga

SEQ ID NO: 3343264 - RNA, 18 nt, Mycobacterium tuberculosis H37Rv
gccgcacaaguggucgau

SEQ ID NO: 3343265 - RNA, 14 nt, Mycobacterium tuberculosis H37Rv
gccgcacacgcgug

SEQ ID NO: 3343266 - RNA, 22 nt, Mycobacterium tuberculosis H37Rv
gccgcacagcggauucggcguc

SEQ ID NO: 3343267 - RNA, 15 nt, Mycobacterium tuberculosis H37Rv
gccgcacagcggccc

SEQ ID NO: 3343268 - RNA, 16 nt, Mycobacterium tuberculosis H37Rv
gccgcacaucugcggg

SEQ ID NO: 3343269 - RNA, 12 nt, Mycobacterium tuberculosis H37Rv
gccgccagcccc

SEQ ID NO: 3343270 - RNA, 14 nt, Mycobacterium tuberculosis H37Rv
gccgccagccggcg

SEQ ID NO: 3343271 - RNA, 17 nt, Mycobacterium tuberculosis H37Rv
gccgccagccggcgcac

SEQ ID NO: 3343272 - RNA, 17 nt, Mycobacterium tuberculosis H37Rv
gccgccagcgccgccgg

SEQ ID NO: 3343273 - RNA, 22 nt, Mycobacterium tuberculosis H37Rv
gccgccagcgccgccggcgccg

SEQ ID NO: 3343274 - RNA, 13 nt, Mycobacterium tuberculosis H37Rv
gccgccagcgcgc

SEQ ID NO: 3343275 - RNA, 15 nt, Mycobacterium tuberculosis H37Rv
gccgccagcgcgccg

SEQ ID NO: 3343276 - RNA, 21 nt, Mycobacterium tuberculosis H37Rv
gccgccagcgcggccauuagc

SEQ ID NO: 3343277 - RNA, 17 nt, Mycobacterium tuberculosis H37Rv
gccgccagcugcgcagc

SEQ ID NO: 3343278 - RNA, 19 nt, Mycobacterium tuberculosis H37Rv
gccgccagcugcgcagcgc

SEQ ID NO: 3343279 - RNA, 23 nt, Mycobacterium tuberculosis H37Rv
gccgccauaccucggcgaccucc

SEQ ID NO: 3343280 - RNA, 23 nt, Mycobacterium tuberculosis H37Rv
gccgccaucaacaaggggcagca

SEQ ID NO: 3343281 - RNA, 17 nt, Mycobacterium tuberculosis H37Rv
gccgccaucaccgccgu

SEQ ID NO: 3343282 - RNA, 15 nt, Mycobacterium tuberculosis H37Rv
gccgccaucagcccu

SEQ ID NO: 3343283 - RNA, 17 nt, Mycobacterium tuberculosis H37Rv
gccgccaucagcccuuc

SEQ ID NO: 3343284 - RNA, 17 nt, Mycobacterium tuberculosis H37Rv
gccgccaucagccgcug

SEQ ID NO: 3343285 - RNA, 20 nt, Mycobacterium tuberculosis H37Rv
gccgccaucagccgcugcgu

SEQ ID NO: 3343286 - RNA, 13 nt, Mycobacterium tuberculosis H37Rv
gccgccaucaucg

SEQ ID NO: 3343287 - RNA, 19 nt, Mycobacterium tuberculosis H37Rv
gccgccauccccuggccag

SEQ ID NO: 3343288 - RNA, 20 nt, Mycobacterium tuberculosis H37Rv
gccgccauccccuggccagc

SEQ ID NO: 3343289 - RNA, 14 nt, Mycobacterium tuberculosis H37Rv
gccgccaucgccga

SEQ ID NO: 3343290 - RNA, 15 nt, Mycobacterium tuberculosis H37Rv
gccgccaucgccgau

SEQ ID NO: 3343291 - RNA, 18 nt, Mycobacterium tuberculosis H37Rv
gccgccaucgccgccaac

SEQ ID NO: 3343292 - RNA, 16 nt, Mycobacterium tuberculosis H37Rv
gccgccaugcgcacca

SEQ ID NO: 3343293 - RNA, 16 nt, Mycobacterium tuberculosis H37Rv
gccgccauggccgccg

SEQ ID NO: 3343294 - RNA, 21 nt, Mycobacterium tuberculosis H37Rv
gccgccauggccgccguuggc

SEQ ID NO: 3343295 - RNA, 16 nt, Mycobacterium tuberculosis H37Rv
gccgccauugccauac

SEQ ID NO: 3343296 - RNA, 16 nt, Mycobacterium tuberculosis H37Rv
gccgccauugccgccg

SEQ ID NO: 3343297 - RNA, 14 nt, Mycobacterium tuberculosis H37Rv
gccgccauuggaca

SEQ ID NO: 3343298 - RNA, 20 nt, Mycobacterium tuberculosis H37Rv
gccgccauuggacagcgcga

SEQ ID NO: 3343299 - RNA, 14 nt, Mycobacterium tuberculosis H37Rv
gccgcccaaagaaa

SEQ ID NO: 3343300 - RNA, 17 nt, Mycobacterium tuberculosis H37Rv
gccgcccaagccgccgg

SEQ ID NO: 3343301 - RNA, 23 nt, Mycobacterium tuberculosis H37Rv
gccgcccacaugaacgaccaccg

SEQ ID NO: 3343302 - RNA, 17 nt, Mycobacterium tuberculosis H37Rv
gccgcccagaccgccga

SEQ ID NO: 3343303 - RNA, 17 nt, Mycobacterium tuberculosis H37Rv
gccgcccagcaucucgg

SEQ ID NO: 3343304 - RNA, 13 nt, Mycobacterium tuberculosis H37Rv
gccgcccaggagc

SEQ ID NO: 3343305 - RNA, 18 nt, Mycobacterium tuberculosis H37Rv
gccgcccagugcggccac

SEQ ID NO: 3343306 - RNA, 20 nt, Mycobacterium tuberculosis H37Rv
gccgcccagugcggccaccu

SEQ ID NO: 3343307 - RNA, 22 nt, Mycobacterium tuberculosis H37Rv
gccgcccaugccuccagaaccg

SEQ ID NO: 3343308 - RNA, 20 nt, Mycobacterium tuberculosis H37Rv
gccgccccauacuugcgccg

SEQ ID NO: 3343309 - RNA, 21 nt, Mycobacterium tuberculosis H37Rv
gccgcccccauaacugcggcc

SEQ ID NO: 3343310 - RNA, 14 nt, Mycobacterium tuberculosis H37Rv
gccgcccccgccgg

SEQ ID NO: 3343311 - RNA, 16 nt, Mycobacterium tuberculosis H37Rv
gccgcccccgccggcc

SEQ ID NO: 3343312 - RNA, 21 nt, Mycobacterium tuberculosis H37Rv
gccgcccccguuuacggcccg

SEQ ID NO: 3343313 - RNA, 14 nt, Mycobacterium tuberculosis H37Rv
gccgccccgcucgg

SEQ ID NO: 3343314 - RNA, 16 nt, Mycobacterium tuberculosis H37Rv
gccgccccggccgcug

SEQ ID NO: 3343315 - RNA, 18 nt, Mycobacterium tuberculosis H37Rv
gccgccccggcgcuggug

SEQ ID NO: 3343316 - RNA, 15 nt, Mycobacterium tuberculosis H37Rv
gccgcccgagccggu

SEQ ID NO: 3343317 - RNA, 22 nt, Mycobacterium tuberculosis H37Rv
gccgcccgaguuguggacgccc

SEQ ID NO: 3343318 - RNA, 13 nt, Mycobacterium tuberculosis H37Rv
gccgcccgcagcg

SEQ ID NO: 3343319 - RNA, 19 nt, Mycobacterium tuberculosis H37Rv
gccgcccgcagggccgccg

SEQ ID NO: 3343320 - RNA, 23 nt, Mycobacterium tuberculosis H37Rv
gccgcccgcagggccgccgcgaa

SEQ ID NO: 3343321 - RNA, 21 nt, Mycobacterium tuberculosis H37Rv
gccgcccgcaucgcggcaucg

SEQ ID NO: 3343322 - RNA, 14 nt, Mycobacterium tuberculosis H37Rv
gccgcccgcccgga

SEQ ID NO: 3343323 - RNA, 22 nt, Mycobacterium tuberculosis H37Rv
gccgcccgcccggacgcaacac

SEQ ID NO: 3343324 - RNA, 13 nt, Mycobacterium tuberculosis H37Rv
gccgcccgcgcca

SEQ ID NO: 3343325 - RNA, 16 nt, Mycobacterium tuberculosis H37Rv
gccgcccgcgccacca

SEQ ID NO: 3343326 - RNA, 17 nt, Mycobacterium tuberculosis H37Rv
gccgcccgcgccaccag

SEQ ID NO: 3343327 - RNA, 15 nt, Mycobacterium tuberculosis H37Rv
gccgcccgcuccgcc

SEQ ID NO: 3343328 - RNA, 20 nt, Mycobacterium tuberculosis H37Rv
gccgcccgcuccgccgucgc

SEQ ID NO: 3343329 - RNA, 23 nt, Mycobacterium tuberculosis H37Rv
gccgcccggcgagcagggcgucg

SEQ ID NO: 3343330 - RNA, 21 nt, Mycobacterium tuberculosis H37Rv
gccgcccggcguauugcaccg

SEQ ID NO: 3343331 - RNA, 20 nt, Mycobacterium tuberculosis H37Rv
gccgcccgguugaccgccga

SEQ ID NO: 3343332 - RNA, 20 nt, Mycobacterium tuberculosis H37Rv
gccgcccguaucggcuucgu

SEQ ID NO: 3343333 - RNA, 14 nt, Mycobacterium tuberculosis H37Rv
gccgcccgucccgc

SEQ ID NO: 3343334 - RNA, 15 nt, Mycobacterium tuberculosis H37Rv
gccgcccgucccgcc

SEQ ID NO: 3343335 - RNA, 17 nt, Mycobacterium tuberculosis H37Rv
gccgcccgucccgccgg

SEQ ID NO: 3343336 - RNA, 18 nt, Mycobacterium tuberculosis H37Rv
gccgcccgucccgccggc

SEQ ID NO: 3343337 - RNA, 16 nt, Mycobacterium tuberculosis H37Rv
gccgcccgugccgccc

SEQ ID NO: 3343338 - RNA, 17 nt, Mycobacterium tuberculosis H37Rv
gccgcccgugccgcccu

SEQ ID NO: 3343339 - RNA, 17 nt, Mycobacterium tuberculosis H37Rv
gccgcccucaccgccug

SEQ ID NO: 3343340 - RNA, 19 nt, Mycobacterium tuberculosis H37Rv
gccgcccucccuggggccg

SEQ ID NO: 3343341 - RNA, 21 nt, Mycobacterium tuberculosis H37Rv
gccgcccuggccgcccagacc

SEQ ID NO: 3343342 - RNA, 18 nt, Mycobacterium tuberculosis H37Rv
gccgcccugguccaggcc

SEQ ID NO: 3343343 - RNA, 21 nt, Mycobacterium tuberculosis H37Rv
gccgcccuugauguccgcgac

SEQ ID NO: 3343344 - RNA, 12 nt, Mycobacterium tuberculosis H37Rv
gccgcccuugcc

SEQ ID NO: 3343345 - RNA, 14 nt, Mycobacterium tuberculosis H37Rv
gccgcccuugccgc

SEQ ID NO: 3343346 - RNA, 18 nt, Mycobacterium tuberculosis H37Rv
gccgcccuugccgcccgc

SEQ ID NO: 3343347 - RNA, 16 nt, Mycobacterium tuberculosis H37Rv
gccgcccuugccgccg

SEQ ID NO: 3343348 - RNA, 17 nt, Mycobacterium tuberculosis H37Rv
gccgcccuugccgccgg

SEQ ID NO: 3343349 - RNA, 19 nt, Mycobacterium tuberculosis H37Rv
gccgcccuugccgccggcc

SEQ ID NO: 3343350 - RNA, 18 nt, Mycobacterium tuberculosis H37Rv
gccgccgaaacucaccag

SEQ ID NO: 3343351 - RNA, 22 nt, Mycobacterium tuberculosis H37Rv
gccgccgaaacucaccagcacc

SEQ ID NO: 3343352 - RNA, 17 nt, Mycobacterium tuberculosis H37Rv
gccgccgaacagcugga

SEQ ID NO: 3343353 - RNA, 21 nt, Mycobacterium tuberculosis H37Rv
gccgccgaacgccucugcgau

SEQ ID NO: 3343354 - RNA, 17 nt, Mycobacterium tuberculosis H37Rv
gccgccgaagccgacga

SEQ ID NO: 3343355 - RNA, 12 nt, Mycobacterium tuberculosis H37Rv
gccgccgaaucc

SEQ ID NO: 3343356 - RNA, 15 nt, Mycobacterium tuberculosis H37Rv
gccgccgaauccgac

SEQ ID NO: 3343357 - RNA, 23 nt, Mycobacterium tuberculosis H37Rv
gccgccgaauccgacgucgacga

SEQ ID NO: 3343358 - RNA, 16 nt, Mycobacterium tuberculosis H37Rv
gccgccgacaaccccg

SEQ ID NO: 3343359 - RNA, 13 nt, Mycobacterium tuberculosis H37Rv
gccgccgacacca

SEQ ID NO: 3343360 - RNA, 18 nt, Mycobacterium tuberculosis H37Rv
gccgccgacaccaccggc

SEQ ID NO: 3343361 - RNA, 16 nt, Mycobacterium tuberculosis H37Rv
gccgccgaccagaacg

SEQ ID NO: 3343362 - RNA, 17 nt, Mycobacterium tuberculosis H37Rv
gccgccgaccagaacgc

SEQ ID NO: 3343363 - RNA, 16 nt, Mycobacterium tuberculosis H37Rv
gccgccgaccggagcc

SEQ ID NO: 3343364 - RNA, 18 nt, Mycobacterium tuberculosis H37Rv
gccgccgaccggagccgc

SEQ ID NO: 3343365 - RNA, 20 nt, Mycobacterium tuberculosis H37Rv
gccgccgguguaacccucga

SEQ ID NO: 3343366 - RNA, 14 nt, Mycobacterium tuberculosis H37Rv
gccgccgguguugc

SEQ ID NO: 3343367 - RNA, 16 nt, Mycobacterium tuberculosis H37Rv
gccgccgguuccgccg

SEQ ID NO: 3343368 - RNA, 20 nt, Mycobacterium tuberculosis H37Rv
gccgccgguuccgccggccc

SEQ ID NO: 3343369 - RNA, 12 nt, Mycobacterium tuberculosis H37Rv
gccgccgucacc

SEQ ID NO: 3343370 - RNA, 13 nt, Mycobacterium tuberculosis H37Rv
gccgccgucaccg

SEQ ID NO: 3343371 - RNA, 19 nt, Mycobacterium tuberculosis H37Rv
gccgccgucaccgccgacc

SEQ ID NO: 3343372 - RNA, 20 nt, Mycobacterium tuberculosis H37Rv
gccgccgucaccgccgacca

SEQ ID NO: 3343373 - RNA, 23 nt, Mycobacterium tuberculosis H37Rv
gccgccgucaccgccgaccaggc

SEQ ID NO: 3343374 - RNA, 18 nt, Mycobacterium tuberculosis H37Rv
gccgccguccagcgccgc

SEQ ID NO: 3343375 - RNA, 22 nt, Mycobacterium tuberculosis H37Rv
gccgccguccagcgccgcggcc

SEQ ID NO: 3343376 - RNA, 12 nt, Mycobacterium tuberculosis H37Rv
gccgccgucccc

SEQ ID NO: 3343377 - RNA, 20 nt, Mycobacterium tuberculosis H37Rv
gccgccguccccaccgacgc

SEQ ID NO: 3343378 - RNA, 23 nt, Mycobacterium tuberculosis H37Rv
gccgccguccccaccgacgccga

SEQ ID NO: 3343379 - RNA, 15 nt, Mycobacterium tuberculosis H37Rv
gccgccguccccgcc

SEQ ID NO: 3343380 - RNA, 22 nt, Mycobacterium tuberculosis H37Rv
gccgccguccccgccgucgcca

SEQ ID NO: 3343381 - RNA, 13 nt, Mycobacterium tuberculosis H37Rv
gccgccgucgcca

SEQ ID NO: 3343382 - RNA, 14 nt, Mycobacterium tuberculosis H37Rv
gccgccgucgccga

SEQ ID NO: 3343383 - RNA, 15 nt, Mycobacterium tuberculosis H37Rv
gccgccgucgccgau

SEQ ID NO: 3343384 - RNA, 19 nt, Mycobacterium tuberculosis H37Rv
gccgccgucgccgaucagc

SEQ ID NO: 3343385 - RNA, 15 nt, Mycobacterium tuberculosis H37Rv
gccgccgucgccgcc

SEQ ID NO: 3343386 - RNA, 16 nt, Mycobacterium tuberculosis H37Rv
gccgccgucgccgcca

SEQ ID NO: 3343387 - RNA, 16 nt, Mycobacterium tuberculosis H37Rv
gccgccgucgccgccg

SEQ ID NO: 3343388 - RNA, 17 nt, Mycobacterium tuberculosis H37Rv
gccgccgucgccgccgc

SEQ ID NO: 3343389 - RNA, 17 nt, Mycobacterium tuberculosis H37Rv
gccgccgucgccgccgu

SEQ ID NO: 3343390 - RNA, 16 nt, Mycobacterium tuberculosis H37Rv
gccgccgucggcgagc

SEQ ID NO: 3343391 - RNA, 18 nt, Mycobacterium tuberculosis H37Rv
gccgccgucggcgagcag

SEQ ID NO: 3343392 - RNA, 16 nt, Mycobacterium tuberculosis H37Rv
gccgccgucgucgucg

SEQ ID NO: 3343393 - RNA, 22 nt, Mycobacterium tuberculosis H37Rv
gccgccguuaccgccggcgccg

SEQ ID NO: 3343394 - RNA, 23 nt, Mycobacterium tuberculosis H37Rv
gccgccguucccaccaccaccgc

SEQ ID NO: 3343395 - RNA, 22 nt, Mycobacterium tuberculosis H37Rv
gccgccguucccacccacgccg

SEQ ID NO: 3343396 - RNA, 17 nt, Mycobacterium tuberculosis H37Rv
gccgccguucccgccgg

SEQ ID NO: 3343397 - RNA, 18 nt, Mycobacterium tuberculosis H37Rv
gccgccguucccgccggc

SEQ ID NO: 3343398 - RNA, 21 nt, Mycobacterium tuberculosis H37Rv
gccgccguucccgccggcccc

SEQ ID NO: 3343399 - RNA, 15 nt, Mycobacterium tuberculosis H37Rv
gccgccguugccacc

SEQ ID NO: 3343400 - RNA, 22 nt, Mycobacterium tuberculosis H37Rv
gccgccguugccauugccuccc

SEQ ID NO: 3343401 - RNA, 14 nt, Mycobacterium tuberculosis H37Rv
gccgccguugccgc

SEQ ID NO: 3343402 - RNA, 18 nt, Mycobacterium tuberculosis H37Rv
gccgccguugccgccagc

SEQ ID NO: 3343403 - RNA, 20 nt, Mycobacterium tuberculosis H37Rv
gccgccguugccgccagcgc

SEQ ID NO: 3343404 - RNA, 18 nt, Mycobacterium tuberculosis H37Rv
gccgccguugccgccaug

SEQ ID NO: 3343405 - RNA, 18 nt, Mycobacterium tuberculosis H37Rv
gccgccguugccgccggc

SEQ ID NO: 3343406 - RNA, 22 nt, Mycobacterium tuberculosis H37Rv
gccgccguugccgccggcgccg

SEQ ID NO: 3343407 - RNA, 23 nt, Mycobacterium tuberculosis H37Rv
gccgccguugccgccggcgccgc

SEQ ID NO: 3343408 - RNA, 17 nt, Mycobacterium tuberculosis H37Rv
gccgccguugccgccgu

SEQ ID NO: 3343409 - RNA, 22 nt, Mycobacterium tuberculosis H37Rv
gccgccguugccggcuuggccu

SEQ ID NO: 3343410 - RNA, 20 nt, Mycobacterium tuberculosis H37Rv
gccgccguugccgucgucgc

SEQ ID NO: 3343411 - RNA, 21 nt, Mycobacterium tuberculosis H37Rv
gccgccguugccgucgucgcc

SEQ ID NO: 3343412 - RNA, 23 nt, Mycobacterium tuberculosis H37Rv
gccgccguugccgucgucgccgu

SEQ ID NO: 3343413 - RNA, 20 nt, Mycobacterium tuberculosis H37Rv
gccgccguugccguuggugc

SEQ ID NO: 3343414 - RNA, 19 nt, Mycobacterium tuberculosis H37Rv
gccgccucaaugaccaccg

SEQ ID NO: 3343415 - RNA, 17 nt, Mycobacterium tuberculosis H37Rv
gccgccuccgccgaggc

SEQ ID NO: 3343416 - RNA, 13 nt, Mycobacterium tuberculosis H37Rv
gccgccuccgcgg

SEQ ID NO: 3343417 - RNA, 14 nt, Mycobacterium tuberculosis H37Rv
gccgccuccgcggc

SEQ ID NO: 3343418 - RNA, 16 nt, Mycobacterium tuberculosis H37Rv
gccgccuccggugcau

SEQ ID NO: 3343419 - RNA, 14 nt, Mycobacterium tuberculosis H37Rv
gccgccucgggcac

SEQ ID NO: 3343420 - RNA, 17 nt, Mycobacterium tuberculosis H37Rv
gccgccucgggcaccug

SEQ ID NO: 3343421 - RNA, 22 nt, Mycobacterium tuberculosis H37Rv
gccgccucguacggaccgucgc

SEQ ID NO: 3343422 - RNA, 15 nt, Mycobacterium tuberculosis H37Rv
gccgccugacccggc

SEQ ID NO: 3343423 - RNA, 19 nt, Mycobacterium tuberculosis H37Rv
gccgccugacccggcgccg

SEQ ID NO: 3343424 - RNA, 19 nt, Mycobacterium tuberculosis H37Rv
gccgccugcccggcccgcu

SEQ ID NO: 3343425 - RNA, 16 nt, Mycobacterium tuberculosis H37Rv
gccgccugcgccgcca

SEQ ID NO: 3343426 - RNA, 18 nt, Mycobacterium tuberculosis H37Rv
gccgccugcuccucggcc

SEQ ID NO: 3343427 - RNA, 21 nt, Mycobacterium tuberculosis H37Rv
gccgccuggacgccgccggag

SEQ ID NO: 3343428 - RNA, 14 nt, Mycobacterium tuberculosis H37Rv
gccgccuggagcug

SEQ ID NO: 3343429 - RNA, 14 nt, Mycobacterium tuberculosis H37Rv
gccgccugucgggc

SEQ ID NO: 3343430 - RNA, 20 nt, Mycobacterium tuberculosis H37Rv
gccgccuucgccgccgccga

SEQ ID NO: 3343431 - RNA, 12 nt, Mycobacterium tuberculosis H37Rv
gccgccuucuug

SEQ ID NO: 3343432 - RNA, 19 nt, Mycobacterium tuberculosis H37Rv
gccgccuugacccuccgca

SEQ ID NO: 3343433 - RNA, 20 nt, Mycobacterium tuberculosis H37Rv
gccgccuuggucgcgucggc

SEQ ID NO: 3343434 - RNA, 18 nt, Mycobacterium tuberculosis H37Rv
gccgccuuuuuucgccgc

SEQ ID NO: 3343435 - RNA, 19 nt, Mycobacterium tuberculosis H37Rv
gccgcgaaaucaccgcuga

SEQ ID NO: 3343436 - RNA, 22 nt, Mycobacterium tuberculosis H37Rv
gccgcgaaaucaccgcugaggu

SEQ ID NO: 3343437 - RNA, 15 nt, Mycobacterium tuberculosis H37Rv
gccgcgaacgggucg

SEQ ID NO: 3343438 - RNA, 16 nt, Mycobacterium tuberculosis H37Rv
gccgcgaacuccagca

SEQ ID NO: 3343439 - RNA, 18 nt, Mycobacterium tuberculosis H37Rv
gccgcgaacuccagcagc

SEQ ID NO: 3343440 - RNA, 14 nt, Mycobacterium tuberculosis H37Rv
gccgcgaagcgcuc

SEQ ID NO: 3343441 - RNA, 16 nt, Mycobacterium tuberculosis H37Rv
gccgcgaaugucgccg

SEQ ID NO: 3343442 - RNA, 19 nt, Mycobacterium tuberculosis H37Rv
gccgcgaaugucgccgccu

SEQ ID NO: 3343443 - RNA, 14 nt, Mycobacterium tuberculosis H37Rv
gccgcgacauccgc

SEQ ID NO: 3343444 - RNA, 18 nt, Mycobacterium tuberculosis H37Rv
gccgcgacauccgcggca

SEQ ID NO: 3343445 - RNA, 21 nt, Mycobacterium tuberculosis H37Rv
gccgcgacauccgcggcaugc

SEQ ID NO: 3343446 - RNA, 12 nt, Mycobacterium tuberculosis H37Rv
gccgcgaccagc

SEQ ID NO: 3343447 - RNA, 16 nt, Mycobacterium tuberculosis H37Rv
gccgcgaccagcgccg

SEQ ID NO: 3343448 - RNA, 17 nt, Mycobacterium tuberculosis H37Rv
gccgcgaccagcgccgc

SEQ ID NO: 3343449 - RNA, 17 nt, Mycobacterium tuberculosis H37Rv
gccgcgaccgcagcugg

SEQ ID NO: 3343450 - RNA, 18 nt, Mycobacterium tuberculosis H37Rv
gccgcgaccgccucgccg

SEQ ID NO: 3343451 - RNA, 13 nt, Mycobacterium tuberculosis H37Rv
gccgcgaccgcga

SEQ ID NO: 3343452 - RNA, 15 nt, Mycobacterium tuberculosis H37Rv
gccgcgaccgcgagc

SEQ ID NO: 3343453 - RNA, 16 nt, Mycobacterium tuberculosis H37Rv
gccgcgaccgcgagca

SEQ ID NO: 3343454 - RNA, 21 nt, Mycobacterium tuberculosis H37Rv
gccgcgaccgcgagcaucugg

SEQ ID NO: 3343455 - RNA, 20 nt, Mycobacterium tuberculosis H37Rv
gccgcgaccggcguaaccgg

SEQ ID NO: 3343456 - RNA, 19 nt, Mycobacterium tuberculosis H37Rv
gccgcgacgacacgccugg

SEQ ID NO: 3343457 - RNA, 23 nt, Mycobacterium tuberculosis H37Rv
gccgcgacgaugccucggcggcc

SEQ ID NO: 3343458 - RNA, 20 nt, Mycobacterium tuberculosis H37Rv
gccgcgacgcacugccccgc

SEQ ID NO: 3343459 - RNA, 14 nt, Mycobacterium tuberculosis H37Rv
gccgcgacgcggcg

SEQ ID NO: 3343460 - RNA, 16 nt, Mycobacterium tuberculosis H37Rv
gccgcgacgcggcguc

SEQ ID NO: 3343461 - RNA, 23 nt, Mycobacterium tuberculosis H37Rv
gccgcggccaccgccgccgccga

SEQ ID NO: 3343462 - RNA, 22 nt, Mycobacterium tuberculosis H37Rv
gccgcggccaguacgucgauca

SEQ ID NO: 3343463 - RNA, 16 nt, Mycobacterium tuberculosis H37Rv
gccgcggcccgcgugc

SEQ ID NO: 3343464 - RNA, 14 nt, Mycobacterium tuberculosis H37Rv
gccgcggcccucga

SEQ ID NO: 3343465 - RNA, 13 nt, Mycobacterium tuberculosis H37Rv
gccgcggccggcg

SEQ ID NO: 3343466 - RNA, 18 nt, Mycobacterium tuberculosis H37Rv
gccgcggccggcgcucgc

SEQ ID NO: 3343467 - RNA, 21 nt, Mycobacterium tuberculosis H37Rv
gccgcggcgccauagccgcga

SEQ ID NO: 3343468 - RNA, 16 nt, Mycobacterium tuberculosis H37Rv
gccgcggcgcccggcg

SEQ ID NO: 3343469 - RNA, 13 nt, Mycobacterium tuberculosis H37Rv
gccgcggcgccua

SEQ ID NO: 3343470 - RNA, 11 nt, Mycobacterium tuberculosis H37Rv
gccgcggcgga

SEQ ID NO: 3343471 - RNA, 18 nt, Mycobacterium tuberculosis H37Rv
gccgcggcggaauucggg

SEQ ID NO: 3343472 - RNA, 19 nt, Mycobacterium tuberculosis H37Rv
gccgcggcggauggcgucg

SEQ ID NO: 3343473 - RNA, 12 nt, Mycobacterium tuberculosis H37Rv
gccgcggcggca

SEQ ID NO: 3343474 - RNA, 17 nt, Mycobacterium tuberculosis H37Rv
gccgcggcggcagcggc

SEQ ID NO: 3343475 - RNA, 18 nt, Mycobacterium tuberculosis H37Rv
gccgcggcggcagcggcg

SEQ ID NO: 3343476 - RNA, 17 nt, Mycobacterium tuberculosis H37Rv
gccgcggcggccagcgc

SEQ ID NO: 3343477 - RNA, 13 nt, Mycobacterium tuberculosis H37Rv
gccgcggcggccc

SEQ ID NO: 3343478 - RNA, 21 nt, Mycobacterium tuberculosis H37Rv
gccgcggcuacaucggcggcg

SEQ ID NO: 3343479 - RNA, 14 nt, Mycobacterium tuberculosis H37Rv
gccgcggcuaggcc

SEQ ID NO: 3343480 - RNA, 21 nt, Mycobacterium tuberculosis H37Rv
gccgcggcuaggccagcacgg

SEQ ID NO: 3343481 - RNA, 22 nt, Mycobacterium tuberculosis H37Rv
gccgcggcuccgagggcugcgu

SEQ ID NO: 3343482 - RNA, 16 nt, Mycobacterium tuberculosis H37Rv
gccgcggcugccaucc

SEQ ID NO: 3343483 - RNA, 23 nt, Mycobacterium tuberculosis H37Rv
gccgcgggacagauggcggccga

SEQ ID NO: 3343484 - RNA, 17 nt, Mycobacterium tuberculosis H37Rv
gccgcgggacaucaccg

SEQ ID NO: 3343485 - RNA, 18 nt, Mycobacterium tuberculosis H37Rv
gccgcgggacaucaccgc

SEQ ID NO: 3343486 - RNA, 15 nt, Mycobacterium tuberculosis H37Rv
gccgcggggaucagc

SEQ ID NO: 3343487 - RNA, 18 nt, Mycobacterium tuberculosis H37Rv
gccgcggggaucagcguc

SEQ ID NO: 3343488 - RNA, 17 nt, Mycobacterium tuberculosis H37Rv
gccgcgggucccggccg

SEQ ID NO: 3343489 - RNA, 17 nt, Mycobacterium tuberculosis H37Rv
gccgcgguacccaccuc

SEQ ID NO: 3343490 - RNA, 17 nt, Mycobacterium tuberculosis H37Rv
gccgcgguagacgccgc

SEQ ID NO: 3343491 - RNA, 19 nt, Mycobacterium tuberculosis H37Rv
gccgcgguagacgccgccg

SEQ ID NO: 3343492 - RNA, 20 nt, Mycobacterium tuberculosis H37Rv
gccgcggucagauccagaga

SEQ ID NO: 3343493 - RNA, 18 nt, Mycobacterium tuberculosis H37Rv
gccgcggucccgucgcuu

SEQ ID NO: 3343494 - RNA, 21 nt, Mycobacterium tuberculosis H37Rv
gccgcggucgauguccgcagc

SEQ ID NO: 3343495 - RNA, 16 nt, Mycobacterium tuberculosis H37Rv
gccgcggucggaccac

SEQ ID NO: 3343496 - RNA, 14 nt, Mycobacterium tuberculosis H37Rv
gccgcggucggcga

SEQ ID NO: 3343497 - RNA, 15 nt, Mycobacterium tuberculosis H37Rv
gccgcggucggcgac

SEQ ID NO: 3343498 - RNA, 20 nt, Mycobacterium tuberculosis H37Rv
gccgcggucggcgacguaga

SEQ ID NO: 3343499 - RNA, 24 nt, Mycobacterium tuberculosis H37Rv
gccgcggucgugaucagcaggacg

SEQ ID NO: 3343500 - RNA, 15 nt, Mycobacterium tuberculosis H37Rv
gccgcggucguuggc

SEQ ID NO: 3343501 - RNA, 15 nt, Mycobacterium tuberculosis H37Rv
gccgcggugacggga

SEQ ID NO: 3343502 - RNA, 17 nt, Mycobacterium tuberculosis H37Rv
gccgcggugacgggauc

SEQ ID NO: 3343503 - RNA, 22 nt, Mycobacterium tuberculosis H37Rv
gccgcggugagugaaucgcgga

SEQ ID NO: 3343504 - RNA, 19 nt, Mycobacterium tuberculosis H37Rv
gccgcggugaugggccagg

SEQ ID NO: 3343505 - RNA, 15 nt, Mycobacterium tuberculosis H37Rv
gccgcggugccaacc

SEQ ID NO: 3343506 - RNA, 18 nt, Mycobacterium tuberculosis H37Rv
gccgcggugccaaccgcg

SEQ ID NO: 3343507 - RNA, 21 nt, Mycobacterium tuberculosis H37Rv
gccgcgguguagaagcgggcg

SEQ ID NO: 3343508 - RNA, 17 nt, Mycobacterium tuberculosis H37Rv
gccgcgguuaucgccga

SEQ ID NO: 3343509 - RNA, 19 nt, Mycobacterium tuberculosis H37Rv
gccgcgguuaucgccgaga

SEQ ID NO: 3343510 - RNA, 21 nt, Mycobacterium tuberculosis H37Rv
gccgcguaccaauucccgcgc

SEQ ID NO: 3343511 - RNA, 21 nt, Mycobacterium tuberculosis H37Rv
gccgcguaggccuugcucagc

SEQ ID NO: 3343512 - RNA, 18 nt, Mycobacterium tuberculosis H37Rv
gccgcguagguggccagc

SEQ ID NO: 3343513 - RNA, 20 nt, Mycobacterium tuberculosis H37Rv
gccgcguagguggccagcgc

SEQ ID NO: 3343514 - RNA, 16 nt, Mycobacterium tuberculosis H37Rv
gccgcgucaaccgauc

SEQ ID NO: 3343515 - RNA, 13 nt, Mycobacterium tuberculosis H37Rv
gccgcgucacgga

SEQ ID NO: 3343516 - RNA, 15 nt, Mycobacterium tuberculosis H37Rv
gccgcgucgaacugg

SEQ ID NO: 3343517 - RNA, 21 nt, Mycobacterium tuberculosis H37Rv
gccgcgucgaacugggcgccc

SEQ ID NO: 3343518 - RNA, 23 nt, Mycobacterium tuberculosis H37Rv
gccgcgucgaacugggcgcccgc

SEQ ID NO: 3343519 - RNA, 14 nt, Mycobacterium tuberculosis H37Rv
gccgcgucgagcac

SEQ ID NO: 3343520 - RNA, 20 nt, Mycobacterium tuberculosis H37Rv
gccgcgucgcgaaaggccac

SEQ ID NO: 3343521 - RNA, 16 nt, Mycobacterium tuberculosis H37Rv
gccgcgucgcugagca

SEQ ID NO: 3343522 - RNA, 17 nt, Mycobacterium tuberculosis H37Rv
gccgcgucggccgcgcu

SEQ ID NO: 3343523 - RNA, 14 nt, Mycobacterium tuberculosis H37Rv
gccgcgucgucggc

SEQ ID NO: 3343524 - RNA, 18 nt, Mycobacterium tuberculosis H37Rv
gccgcgucucggugcagc

SEQ ID NO: 3343525 - RNA, 21 nt, Mycobacterium tuberculosis H37Rv
gccgcgucuuggugcgcguca

SEQ ID NO: 3343526 - RNA, 22 nt, Mycobacterium tuberculosis H37Rv
gccgcgugacguaccacggcga

SEQ ID NO: 3343527 - RNA, 12 nt, Mycobacterium tuberculosis H37Rv
gccgcgugccgc

SEQ ID NO: 3343528 - RNA, 14 nt, Mycobacterium tuberculosis H37Rv
gccgcguggcuggc

SEQ ID NO: 3343529 - RNA, 21 nt, Mycobacterium tuberculosis H37Rv
gccgcgugguuccggcgugca

SEQ ID NO: 3343530 - RNA, 23 nt, Mycobacterium tuberculosis H37Rv
gccgcgugguuccggcgugcagc

SEQ ID NO: 3343531 - RNA, 18 nt, Mycobacterium tuberculosis H37Rv
gccgcguucacgcaauug

SEQ ID NO: 3343532 - RNA, 15 nt, Mycobacterium tuberculosis H37Rv
gccgcguugccgggg

SEQ ID NO: 3343533 - RNA, 16 nt, Mycobacterium tuberculosis H37Rv
gccgcguugccggucg

SEQ ID NO: 3343534 - RNA, 22 nt, Mycobacterium tuberculosis H37Rv
gccgcguuucggucguuggugc

SEQ ID NO: 3343535 - RNA, 22 nt, Mycobacterium tuberculosis H37Rv
gccgcuaauggauccagcccga

SEQ ID NO: 3343536 - RNA, 19 nt, Mycobacterium tuberculosis H37Rv
gccgcuaccccagccggca

SEQ ID NO: 3343537 - RNA, 22 nt, Mycobacterium tuberculosis H37Rv
gccgcuaccccagccggcagca

SEQ ID NO: 3343538 - RNA, 17 nt, Mycobacterium tuberculosis H37Rv
gccgcuaccgcccgcgc

SEQ ID NO: 3343539 - RNA, 20 nt, Mycobacterium tuberculosis H37Rv
gccgcuaccgcccgcgccac

SEQ ID NO: 3343540 - RNA, 21 nt, Mycobacterium tuberculosis H37Rv
gccgcuacgccggcccgaggc

SEQ ID NO: 3343541 - RNA, 17 nt, Mycobacterium tuberculosis H37Rv
gccgcuagcggauucag

SEQ ID NO: 3343542 - RNA, 18 nt, Mycobacterium tuberculosis H37Rv
gccgcuaggacggcgcga

SEQ ID NO: 3343543 - RNA, 21 nt, Mycobacterium tuberculosis H37Rv
gccgcuaggacggcgcgagcc

SEQ ID NO: 3343544 - RNA, 22 nt, Mycobacterium tuberculosis H37Rv
gccgcuaggacggcgcgagccg

SEQ ID NO: 3343545 - RNA, 21 nt, Mycobacterium tuberculosis H37Rv
gccgcuaggaucggauggcgg

SEQ ID NO: 3343546 - RNA, 22 nt, Mycobacterium tuberculosis H37Rv
gccgcuaggugacgccgccagc

SEQ ID NO: 3343547 - RNA, 21 nt, Mycobacterium tuberculosis H37Rv
gccgcucacaagccgugcagc

SEQ ID NO: 3343548 - RNA, 20 nt, Mycobacterium tuberculosis H37Rv
gccgcucacauacagcaggc

SEQ ID NO: 3343549 - RNA, 18 nt, Mycobacterium tuberculosis H37Rv
gccgcucaucgaucccgu

SEQ ID NO: 3343550 - RNA, 22 nt, Mycobacterium tuberculosis H37Rv
gccgcuccaaaagccucagccg

SEQ ID NO: 3343551 - RNA, 16 nt, Mycobacterium tuberculosis H37Rv
gccgcuccacguacgc

SEQ ID NO: 3343552 - RNA, 21 nt, Mycobacterium tuberculosis H37Rv
gccgcuccacguacgcggcug

SEQ ID NO: 3343553 - RNA, 22 nt, Mycobacterium tuberculosis H37Rv
gccgcucccgcacaagcccagc

SEQ ID NO: 3343554 - RNA, 18 nt, Mycobacterium tuberculosis H37Rv
gccgcuccgcccauuccc

SEQ ID NO: 3343555 - RNA, 19 nt, Mycobacterium tuberculosis H37Rv
gccgcucgaaauccuggug

SEQ ID NO: 3343556 - RNA, 16 nt, Mycobacterium tuberculosis H37Rv
gccggauaggucgggc

SEQ ID NO: 3343557 - RNA, 13 nt, Mycobacterium tuberculosis H37Rv
gccggaucccagu

SEQ ID NO: 3343558 - RNA, 14 nt, Mycobacterium tuberculosis H37Rv
gccggaucccgguc

SEQ ID NO: 3343559 - RNA, 22 nt, Mycobacterium tuberculosis H37Rv
gccggaucgaaacucagcccgu

SEQ ID NO: 3343560 - RNA, 18 nt, Mycobacterium tuberculosis H37Rv
gccggaucgccggugaac

SEQ ID NO: 3343561 - RNA, 14 nt, Mycobacterium tuberculosis H37Rv
gccggaucguucgc

SEQ ID NO: 3343562 - RNA, 14 nt, Mycobacterium tuberculosis H37Rv
gccggaugacaccg

SEQ ID NO: 3343563 - RNA, 15 nt, Mycobacterium tuberculosis H37Rv
gccggaugcgcuucc

SEQ ID NO: 3343564 - RNA, 13 nt, Mycobacterium tuberculosis H37Rv
gccggaugcggcc

SEQ ID NO: 3343565 - RNA, 20 nt, Mycobacterium tuberculosis H37Rv
gccggauggguggccagcaa

SEQ ID NO: 3343566 - RNA, 17 nt, Mycobacterium tuberculosis H37Rv
gccggaugucgacgagc

SEQ ID NO: 3343567 - RNA, 15 nt, Mycobacterium tuberculosis H37Rv
gccggauucgaugac

SEQ ID NO: 3343568 - RNA, 19 nt, Mycobacterium tuberculosis H37Rv
gccggauucggcugccacc

SEQ ID NO: 3343569 - RNA, 20 nt, Mycobacterium tuberculosis H37Rv
gccggauucuccgcccucag

SEQ ID NO: 3343570 - RNA, 12 nt, Mycobacterium tuberculosis H37Rv
gccggcaacagc

SEQ ID NO: 3343571 - RNA, 16 nt, Mycobacterium tuberculosis H37Rv
gccggcaacagcucgc

SEQ ID NO: 3343572 - RNA, 17 nt, Mycobacterium tuberculosis H37Rv
gccggcaacgugcggug

SEQ ID NO: 3343573 - RNA, 17 nt, Mycobacterium tuberculosis H37Rv
gccggcaauaccgccag

SEQ ID NO: 3343574 - RNA, 20 nt, Mycobacterium tuberculosis H37Rv
gccggcaauaccgccagcgc

SEQ ID NO: 3343575 - RNA, 19 nt, Mycobacterium tuberculosis H37Rv
gccggcaaugccgcggcca

SEQ ID NO: 3343576 - RNA, 21 nt, Mycobacterium tuberculosis H37Rv
gccggcacacccaucagcccu

SEQ ID NO: 3343577 - RNA, 22 nt, Mycobacterium tuberculosis H37Rv
gccggcacacccaucagcccuc

SEQ ID NO: 3343578 - RNA, 20 nt, Mycobacterium tuberculosis H37Rv
gccggcaccaccguugccgc

SEQ ID NO: 3343579 - RNA, 22 nt, Mycobacterium tuberculosis H37Rv
gccggcaccaccguugccgccg

SEQ ID NO: 3343580 - RNA, 23 nt, Mycobacterium tuberculosis H37Rv
gccggcaccaccguugccgccgu

SEQ ID NO: 3343581 - RNA, 19 nt, Mycobacterium tuberculosis H37Rv
gccggcacccaccagugca

SEQ ID NO: 3343582 - RNA, 21 nt, Mycobacterium tuberculosis H37Rv
gccggcaccccacggccagug

SEQ ID NO: 3343583 - RNA, 16 nt, Mycobacterium tuberculosis H37Rv
gccggcacccgucggg

SEQ ID NO: 3343584 - RNA, 19 nt, Mycobacterium tuberculosis H37Rv
gccggcacccgucgggugc

SEQ ID NO: 3343585 - RNA, 15 nt, Mycobacterium tuberculosis H37Rv
gccggcaccgcagcg

SEQ ID NO: 3343586 - RNA, 20 nt, Mycobacterium tuberculosis H37Rv
gccggcaccgcagcggaacu

SEQ ID NO: 3343587 - RNA, 20 nt, Mycobacterium tuberculosis H37Rv
gccggcaccgccagugcccg

SEQ ID NO: 3343588 - RNA, 15 nt, Mycobacterium tuberculosis H37Rv
gccggcaccgccgcc

SEQ ID NO: 3343589 - RNA, 20 nt, Mycobacterium tuberculosis H37Rv
gccggcaccgccgcccccgc

SEQ ID NO: 3343590 - RNA, 20 nt, Mycobacterium tuberculosis H37Rv
gccggcaccgccggcgcccc

SEQ ID NO: 3343591 - RNA, 16 nt, Mycobacterium tuberculosis H37Rv
gccggcaccgccggug

SEQ ID NO: 3343592 - RNA, 14 nt, Mycobacterium tuberculosis H37Rv
gccggcaccggaug

SEQ ID NO: 3343593 - RNA, 12 nt, Mycobacterium tuberculosis H37Rv
gccggcaccggg

SEQ ID NO: 3343594 - RNA, 14 nt, Mycobacterium tuberculosis H37Rv
gccggcaccguaga

SEQ ID NO: 3343595 - RNA, 12 nt, Mycobacterium tuberculosis H37Rv
gccggcagcagc

SEQ ID NO: 3343596 - RNA, 13 nt, Mycobacterium tuberculosis H37Rv
gccggcagcagcg

SEQ ID NO: 3343597 - RNA, 14 nt, Mycobacterium tuberculosis H37Rv
gccggcagcgcccc

SEQ ID NO: 3343598 - RNA, 15 nt, Mycobacterium tuberculosis H37Rv
gccggcagcgccccc

SEQ ID NO: 3343599 - RNA, 13 nt, Mycobacterium tuberculosis H37Rv
gccggcagcggcg

SEQ ID NO: 3343600 - RNA, 18 nt, Mycobacterium tuberculosis H37Rv
gccggcagcggcgcgcug

SEQ ID NO: 3343601 - RNA, 20 nt, Mycobacterium tuberculosis H37Rv
gccggcagcggcgcgcugca

SEQ ID NO: 3343602 - RNA, 13 nt, Mycobacterium tuberculosis H37Rv
gccggcagcgucc

SEQ ID NO: 3343603 - RNA, 13 nt, Mycobacterium tuberculosis H37Rv
gccggcagugagu

SEQ ID NO: 3343604 - RNA, 19 nt, Mycobacterium tuberculosis H37Rv
gccggcauagaucgggucg

SEQ ID NO: 3343605 - RNA, 16 nt, Mycobacterium tuberculosis H37Rv
gccggcauagcggccc

SEQ ID NO: 3343606 - RNA, 21 nt, Mycobacterium tuberculosis H37Rv
gccggcaucgucgacgcccga

SEQ ID NO: 3343607 - RNA, 20 nt, Mycobacterium tuberculosis H37Rv
gccggcaucuccaccgucgc

SEQ ID NO: 3343608 - RNA, 23 nt, Mycobacterium tuberculosis H37Rv
gccggcaucuccaccgucgccgc

SEQ ID NO: 3343609 - RNA, 15 nt, Mycobacterium tuberculosis H37Rv
gccggcaugccagcc

SEQ ID NO: 3343610 - RNA, 15 nt, Mycobacterium tuberculosis H37Rv
gccggcauggcggca

SEQ ID NO: 3343611 - RNA, 15 nt, Mycobacterium tuberculosis H37Rv
gccggccaacugggc

SEQ ID NO: 3343612 - RNA, 20 nt, Mycobacterium tuberculosis H37Rv
gccggccaauggccugcagc

SEQ ID NO: 3343613 - RNA, 17 nt, Mycobacterium tuberculosis H37Rv
gccggccaccaccgcgc

SEQ ID NO: 3343614 - RNA, 20 nt, Mycobacterium tuberculosis H37Rv
gccggccaccaccgcgccgu

SEQ ID NO: 3343615 - RNA, 14 nt, Mycobacterium tuberculosis H37Rv
gccggccaccaguc

SEQ ID NO: 3343616 - RNA, 15 nt, Mycobacterium tuberculosis H37Rv
gccggccacccgcgc

SEQ ID NO: 3343617 - RNA, 18 nt, Mycobacterium tuberculosis H37Rv
gccggccacccgcgcgau

SEQ ID NO: 3343618 - RNA, 18 nt, Mycobacterium tuberculosis H37Rv
gccggccaccucggugcg

SEQ ID NO: 3343619 - RNA, 16 nt, Mycobacterium tuberculosis H37Rv
gccggccacgaccucu

SEQ ID NO: 3343620 - RNA, 14 nt, Mycobacterium tuberculosis H37Rv
gccggccacgaguc

SEQ ID NO: 3343621 - RNA, 17 nt, Mycobacterium tuberculosis H37Rv
gccggccacgcauucca

SEQ ID NO: 3343622 - RNA, 16 nt, Mycobacterium tuberculosis H37Rv
gccggccacgucgaug

SEQ ID NO: 3343623 - RNA, 19 nt, Mycobacterium tuberculosis H37Rv
gccggccagacggugcagc

SEQ ID NO: 3343624 - RNA, 14 nt, Mycobacterium tuberculosis H37Rv
gccggccagcaggu

SEQ ID NO: 3343625 - RNA, 13 nt, Mycobacterium tuberculosis H37Rv
gccggccaggauu

SEQ ID NO: 3343626 - RNA, 14 nt, Mycobacterium tuberculosis H37Rv
gccggccaguucgg

SEQ ID NO: 3343627 - RNA, 15 nt, Mycobacterium tuberculosis H37Rv
gccggccaguucggc

SEQ ID NO: 3343628 - RNA, 17 nt, Mycobacterium tuberculosis H37Rv
gccggccauacgcgcgc

SEQ ID NO: 3343629 - RNA, 22 nt, Mycobacterium tuberculosis H37Rv
gccggccauacgcgcgcggucg

SEQ ID NO: 3343630 - RNA, 17 nt, Mycobacterium tuberculosis H37Rv
gccggccaucgcccgau

SEQ ID NO: 3343631 - RNA, 17 nt, Mycobacterium tuberculosis H37Rv
gccggcccaccaggccc

SEQ ID NO: 3343632 - RNA, 22 nt, Mycobacterium tuberculosis H37Rv
gccggcccaccaggcccaucuc

SEQ ID NO: 3343633 - RNA, 16 nt, Mycobacterium tuberculosis H37Rv
gccggcccaccgccga

SEQ ID NO: 3343634 - RNA, 23 nt, Mycobacterium tuberculosis H37Rv
gccggcccauucaucuugcggca

SEQ ID NO: 3343635 - RNA, 14 nt, Mycobacterium tuberculosis H37Rv
gccggccccaccgg

SEQ ID NO: 3343636 - RNA, 18 nt, Mycobacterium tuberculosis H37Rv
gccggccccaccggugcc

SEQ ID NO: 3343637 - RNA, 22 nt, Mycobacterium tuberculosis H37Rv
gccggccccaccggugccgccg

SEQ ID NO: 3343638 - RNA, 13 nt, Mycobacterium tuberculosis H37Rv
gccggccccgccg

SEQ ID NO: 3343639 - RNA, 16 nt, Mycobacterium tuberculosis H37Rv
gccggccccgccgaug

SEQ ID NO: 3343640 - RNA, 14 nt, Mycobacterium tuberculosis H37Rv
gccggccccgccgc

SEQ ID NO: 3343641 - RNA, 15 nt, Mycobacterium tuberculosis H37Rv
gccggccccgccggc

SEQ ID NO: 3343642 - RNA, 23 nt, Mycobacterium tuberculosis H37Rv
gccggccccgccggccccgccgu

SEQ ID NO: 3343643 - RNA, 16 nt, Mycobacterium tuberculosis H37Rv
gccggccccgccggcg

SEQ ID NO: 3343644 - RNA, 14 nt, Mycobacterium tuberculosis H37Rv
gccggccccgccgu

SEQ ID NO: 3343645 - RNA, 19 nt, Mycobacterium tuberculosis H37Rv
gccggccccgccgucaccg

SEQ ID NO: 3343646 - RNA, 13 nt, Mycobacterium tuberculosis H37Rv
gccggcccgcggg

SEQ ID NO: 3343647 - RNA, 15 nt, Mycobacterium tuberculosis H37Rv
gccggcccugcucgc

SEQ ID NO: 3343648 - RNA, 22 nt, Mycobacterium tuberculosis H37Rv
gccggcccugcucggccaacgu

SEQ ID NO: 3343649 - RNA, 18 nt, Mycobacterium tuberculosis H37Rv
gccggccgcacaugagcu

SEQ ID NO: 3343650 - RNA, 19 nt, Mycobacterium tuberculosis H37Rv
gccggccgcacgccggcca

SEQ ID NO: 3343651 - RNA, 21 nt, Mycobacterium tuberculosis H37Rv
gccggccgcacgccggccagc

SEQ ID NO: 3343652 - RNA, 14 nt, Mycobacterium tuberculosis H37Rv
gccggccgccagcc

SEQ ID NO: 3343653 - RNA, 17 nt, Mycobacterium tuberculosis H37Rv
gccggcggucagcagcg

SEQ ID NO: 3343654 - RNA, 18 nt, Mycobacterium tuberculosis H37Rv
gccggcggucagcagcgc

SEQ ID NO: 3343655 - RNA, 21 nt, Mycobacterium tuberculosis H37Rv
gccggcggucccaugugcccg

SEQ ID NO: 3343656 - RNA, 12 nt, Mycobacterium tuberculosis H37Rv
gccggcggucgc

SEQ ID NO: 3343657 - RNA, 15 nt, Mycobacterium tuberculosis H37Rv
gccggcggucgccag

SEQ ID NO: 3343658 - RNA, 11 nt, Mycobacterium tuberculosis H37Rv
gccggcggugg

SEQ ID NO: 3343659 - RNA, 21 nt, Mycobacterium tuberculosis H37Rv
gccggcgguguuggcgccagc

SEQ ID NO: 3343660 - RNA, 22 nt, Mycobacterium tuberculosis H37Rv
gccggcgguguuggcgccagcc

SEQ ID NO: 3343661 - RNA, 19 nt, Mycobacterium tuberculosis H37Rv
gccggcguagaucaucagc

SEQ ID NO: 3343662 - RNA, 22 nt, Mycobacterium tuberculosis H37Rv
gccggcguagaucaucagcgac

SEQ ID NO: 3343663 - RNA, 12 nt, Mycobacterium tuberculosis H37Rv
gccggcguagcg

SEQ ID NO: 3343664 - RNA, 17 nt, Mycobacterium tuberculosis H37Rv
gccggcguagcggcgau

SEQ ID NO: 3343665 - RNA, 15 nt, Mycobacterium tuberculosis H37Rv
gccggcgucagcccc

SEQ ID NO: 3343666 - RNA, 21 nt, Mycobacterium tuberculosis H37Rv
gccggcgucagccccgacugc

SEQ ID NO: 3343667 - RNA, 13 nt, Mycobacterium tuberculosis H37Rv
gccggcgucgacc

SEQ ID NO: 3343668 - RNA, 17 nt, Mycobacterium tuberculosis H37Rv
gccggcgucgacccugc

SEQ ID NO: 3343669 - RNA, 19 nt, Mycobacterium tuberculosis H37Rv
gccggcgucgacccugccc

SEQ ID NO: 3343670 - RNA, 13 nt, Mycobacterium tuberculosis H37Rv
gccggcgucgagc

SEQ ID NO: 3343671 - RNA, 13 nt, Mycobacterium tuberculosis H37Rv
gccggcgucgaug

SEQ ID NO: 3343672 - RNA, 16 nt, Mycobacterium tuberculosis H37Rv
gccggcgucggcgccc

SEQ ID NO: 3343673 - RNA, 17 nt, Mycobacterium tuberculosis H37Rv
gccggcgucggcgccca

SEQ ID NO: 3343674 - RNA, 19 nt, Mycobacterium tuberculosis H37Rv
gccggcgucggcgcccagc

SEQ ID NO: 3343675 - RNA, 17 nt, Mycobacterium tuberculosis H37Rv
gccggcgucggucgucg

SEQ ID NO: 3343676 - RNA, 19 nt, Mycobacterium tuberculosis H37Rv
gccggcgugcacucccuua

SEQ ID NO: 3343677 - RNA, 14 nt, Mycobacterium tuberculosis H37Rv
gccggcgugcgcga

SEQ ID NO: 3343678 - RNA, 16 nt, Mycobacterium tuberculosis H37Rv
gccggcgugcgcgaga

SEQ ID NO: 3343679 - RNA, 13 nt, Mycobacterium tuberculosis H37Rv
gccggcgugcggc

SEQ ID NO: 3343680 - RNA, 13 nt, Mycobacterium tuberculosis H37Rv
gccggcguuagcg

SEQ ID NO: 3343681 - RNA, 22 nt, Mycobacterium tuberculosis H37Rv
gccggcguugccgaaacccgag

SEQ ID NO: 3343682 - RNA, 16 nt, Mycobacterium tuberculosis H37Rv
gccggcguugccgccg

SEQ ID NO: 3343683 - RNA, 17 nt, Mycobacterium tuberculosis H37Rv
gccggcguugccgccgu

SEQ ID NO: 3343684 - RNA, 20 nt, Mycobacterium tuberculosis H37Rv
gccggcguugccgccguucc

SEQ ID NO: 3343685 - RNA, 12 nt, Mycobacterium tuberculosis H37Rv
gccggcguuggc

SEQ ID NO: 3343686 - RNA, 21 nt, Mycobacterium tuberculosis H37Rv
gccggcuagauaacccaaccg

SEQ ID NO: 3343687 - RNA, 23 nt, Mycobacterium tuberculosis H37Rv
gccggcuagauaacccaaccgcg

SEQ ID NO: 3343688 - RNA, 22 nt, Mycobacterium tuberculosis H37Rv
gccggcuagggcccuggcggcc

SEQ ID NO: 3343689 - RNA, 18 nt, Mycobacterium tuberculosis H37Rv
gccggcucaucgcagccg

SEQ ID NO: 3343690 - RNA, 21 nt, Mycobacterium tuberculosis H37Rv
gccggcuccgccacuggcgcc

SEQ ID NO: 3343691 - RNA, 14 nt, Mycobacterium tuberculosis H37Rv
gccggcuccgccgu

SEQ ID NO: 3343692 - RNA, 15 nt, Mycobacterium tuberculosis H37Rv
gccggcuggcggccu

SEQ ID NO: 3343693 - RNA, 15 nt, Mycobacterium tuberculosis H37Rv
gccggcuucgcccag

SEQ ID NO: 3343694 - RNA, 17 nt, Mycobacterium tuberculosis H37Rv
gccggcuucgcccagag

SEQ ID NO: 3343695 - RNA, 12 nt, Mycobacterium tuberculosis H37Rv
gccggcuucggc

SEQ ID NO: 3343696 - RNA, 15 nt, Mycobacterium tuberculosis H37Rv
gccggcuucggcgag

SEQ ID NO: 3343697 - RNA, 19 nt, Mycobacterium tuberculosis H37Rv
gccggcuucggguguucgc

SEQ ID NO: 3343698 - RNA, 16 nt, Mycobacterium tuberculosis H37Rv
gccggcuucggugagc

SEQ ID NO: 3343699 - RNA, 16 nt, Mycobacterium tuberculosis H37Rv
gccggcuugggcggua

SEQ ID NO: 3343700 - RNA, 17 nt, Mycobacterium tuberculosis H37Rv
gccggcuugucgaccac

SEQ ID NO: 3343701 - RNA, 18 nt, Mycobacterium tuberculosis H37Rv
gccggcuugucgaccacg

SEQ ID NO: 3343702 - RNA, 19 nt, Mycobacterium tuberculosis H37Rv
gccggcuugucgaccacga

SEQ ID NO: 3343703 - RNA, 24 nt, Mycobacterium tuberculosis H37Rv
gccggcuugucgaccacgaccguc

SEQ ID NO: 3343704 - RNA, 16 nt, Mycobacterium tuberculosis H37Rv
gccggcuuugagccgc

SEQ ID NO: 3343705 - RNA, 22 nt, Mycobacterium tuberculosis H37Rv
gccggcuuuuccacgaguccgc

SEQ ID NO: 3343706 - RNA, 21 nt, Mycobacterium tuberculosis H37Rv
gccgggaaacaccggcuuggu

SEQ ID NO: 3343707 - RNA, 19 nt, Mycobacterium tuberculosis H37Rv
gccgggaaaguuguaucgc

SEQ ID NO: 3343708 - RNA, 17 nt, Mycobacterium tuberculosis H37Rv
gccgggaacaucccagc

SEQ ID NO: 3343709 - RNA, 12 nt, Mycobacterium tuberculosis H37Rv
gccgggaagccg

SEQ ID NO: 3343710 - RNA, 18 nt, Mycobacterium tuberculosis H37Rv
gccgggaauuucgacacg

SEQ ID NO: 3343711 - RNA, 17 nt, Mycobacterium tuberculosis H37Rv
gccgggagacgcugcgc

SEQ ID NO: 3343712 - RNA, 15 nt, Mycobacterium tuberculosis H37Rv
gccgggagggguuca

SEQ ID NO: 3343713 - RNA, 16 nt, Mycobacterium tuberculosis H37Rv
gccgggauaacccagc

SEQ ID NO: 3343714 - RNA, 19 nt, Mycobacterium tuberculosis H37Rv
gccgggaucgccguccagc

SEQ ID NO: 3343715 - RNA, 16 nt, Mycobacterium tuberculosis H37Rv
gccgggaugccgccgc

SEQ ID NO: 3343716 - RNA, 16 nt, Mycobacterium tuberculosis H37Rv
gccgggaugccggccc

SEQ ID NO: 3343717 - RNA, 14 nt, Mycobacterium tuberculosis H37Rv
gccgggauugccgc

SEQ ID NO: 3343718 - RNA, 18 nt, Mycobacterium tuberculosis H37Rv
gccgggauugccgccacc

SEQ ID NO: 3343719 - RNA, 16 nt, Mycobacterium tuberculosis H37Rv
gccgggauugccgucg

SEQ ID NO: 3343720 - RNA, 14 nt, Mycobacterium tuberculosis H37Rv
gccgggcaaccagc

SEQ ID NO: 3343721 - RNA, 16 nt, Mycobacterium tuberculosis H37Rv
gccgggcaaccagcag

SEQ ID NO: 3343722 - RNA, 18 nt, Mycobacterium tuberculosis H37Rv
gccgggcaaccagcagca

SEQ ID NO: 3343723 - RNA, 16 nt, Mycobacterium tuberculosis H37Rv
gccgggcaacgcgaac

SEQ ID NO: 3343724 - RNA, 18 nt, Mycobacterium tuberculosis H37Rv
gccgggcaaggccaccgu

SEQ ID NO: 3343725 - RNA, 21 nt, Mycobacterium tuberculosis H37Rv
gccgggcaaggccaccgucgc

SEQ ID NO: 3343726 - RNA, 20 nt, Mycobacterium tuberculosis H37Rv
gccgggcaauacguagucgc

SEQ ID NO: 3343727 - RNA, 13 nt, Mycobacterium tuberculosis H37Rv
gccgggcaccacc

SEQ ID NO: 3343728 - RNA, 18 nt, Mycobacterium tuberculosis H37Rv
gccgggcaccaccacacc

SEQ ID NO: 3343729 - RNA, 18 nt, Mycobacterium tuberculosis H37Rv
gccgggcagucaggccua

SEQ ID NO: 3343730 - RNA, 17 nt, Mycobacterium tuberculosis H37Rv
gccgggcagugcgcggc

SEQ ID NO: 3343731 - RNA, 18 nt, Mycobacterium tuberculosis H37Rv
gccgggccacggcugacc

SEQ ID NO: 3343732 - RNA, 12 nt, Mycobacterium tuberculosis H37Rv
gccgggccaggc

SEQ ID NO: 3343733 - RNA, 21 nt, Mycobacterium tuberculosis H37Rv
gccgggccaggccgaugccga

SEQ ID NO: 3343734 - RNA, 13 nt, Mycobacterium tuberculosis H37Rv
gccgggcccagca

SEQ ID NO: 3343735 - RNA, 13 nt, Mycobacterium tuberculosis H37Rv
gccgggccgccga

SEQ ID NO: 3343736 - RNA, 16 nt, Mycobacterium tuberculosis H37Rv
gccgggccgccgagcg

SEQ ID NO: 3343737 - RNA, 16 nt, Mycobacterium tuberculosis H37Rv
gccgggccggccacgu

SEQ ID NO: 3343738 - RNA, 16 nt, Mycobacterium tuberculosis H37Rv
gccgggccguguccgc

SEQ ID NO: 3343739 - RNA, 17 nt, Mycobacterium tuberculosis H37Rv
gccgggccguguccgcc

SEQ ID NO: 3343740 - RNA, 18 nt, Mycobacterium tuberculosis H37Rv
gccgggcgaguacaggcg

SEQ ID NO: 3343741 - RNA, 20 nt, Mycobacterium tuberculosis H37Rv
gccgggcgaguacaggcgca

SEQ ID NO: 3343742 - RNA, 17 nt, Mycobacterium tuberculosis H37Rv
gccgggcgcacgcccgc

SEQ ID NO: 3343743 - RNA, 21 nt, Mycobacterium tuberculosis H37Rv
gccgggcgcccuuaagccggc

SEQ ID NO: 3343744 - RNA, 22 nt, Mycobacterium tuberculosis H37Rv
gccgggcgcccuuaagccggcg

SEQ ID NO: 3343745 - RNA, 18 nt, Mycobacterium tuberculosis H37Rv
gccgggcgcgcguagccg

SEQ ID NO: 3343746 - RNA, 22 nt, Mycobacterium tuberculosis H37Rv
gccgggcggccaggcgcgacgu

SEQ ID NO: 3343747 - RNA, 16 nt, Mycobacterium tuberculosis H37Rv
gccgggcggccgcggc

SEQ ID NO: 3343748 - RNA, 14 nt, Mycobacterium tuberculosis H37Rv
gccgggcggcggug

SEQ ID NO: 3343749 - RNA, 13 nt, Mycobacterium tuberculosis H37Rv
gccgggcguccgc

SEQ ID NO: 3343750 - RNA, 22 nt, Mycobacterium tuberculosis H37Rv
gccggugauggccgaccagccg

SEQ ID NO: 3343751 - RNA, 18 nt, Mycobacterium tuberculosis H37Rv
gccggugauguccgcaca

SEQ ID NO: 3343752 - RNA, 20 nt, Mycobacterium tuberculosis H37Rv
gccggugcacucgguaaccg

SEQ ID NO: 3343753 - RNA, 14 nt, Mycobacterium tuberculosis H37Rv
gccggugcagcacg

SEQ ID NO: 3343754 - RNA, 13 nt, Mycobacterium tuberculosis H37Rv
gccggugccaccc

SEQ ID NO: 3343755 - RNA, 15 nt, Mycobacterium tuberculosis H37Rv
gccggugccaccggc

SEQ ID NO: 3343756 - RNA, 17 nt, Mycobacterium tuberculosis H37Rv
gccggugccacugccgu

SEQ ID NO: 3343757 - RNA, 23 nt, Mycobacterium tuberculosis H37Rv
gccggugccaguacucggccagc

SEQ ID NO: 3343758 - RNA, 18 nt, Mycobacterium tuberculosis H37Rv
gccggugcccgggcguca

SEQ ID NO: 3343759 - RNA, 17 nt, Mycobacterium tuberculosis H37Rv
gccggugccgacggcgc

SEQ ID NO: 3343760 - RNA, 17 nt, Mycobacterium tuberculosis H37Rv
gccggugccgccgccug

SEQ ID NO: 3343761 - RNA, 23 nt, Mycobacterium tuberculosis H37Rv
gccggugccgccgccugcuccuc

SEQ ID NO: 3343762 - RNA, 17 nt, Mycobacterium tuberculosis H37Rv
gccggugccgccgggug

SEQ ID NO: 3343763 - RNA, 19 nt, Mycobacterium tuberculosis H37Rv
gccggugccgccggugccg

SEQ ID NO: 3343764 - RNA, 16 nt, Mycobacterium tuberculosis H37Rv
gccggugccgccgucg

SEQ ID NO: 3343765 - RNA, 16 nt, Mycobacterium tuberculosis H37Rv
gccggugccgccguuc

SEQ ID NO: 3343766 - RNA, 17 nt, Mycobacterium tuberculosis H37Rv
gccggugccgccguucc

SEQ ID NO: 3343767 - RNA, 22 nt, Mycobacterium tuberculosis H37Rv
gccggugccgccuccgccugcc

SEQ ID NO: 3343768 - RNA, 20 nt, Mycobacterium tuberculosis H37Rv
gccggugccgccugcgccgc

SEQ ID NO: 3343769 - RNA, 16 nt, Mycobacterium tuberculosis H37Rv
gccggugccggcgcac

SEQ ID NO: 3343770 - RNA, 20 nt, Mycobacterium tuberculosis H37Rv
gccggugccggcguugccgc

SEQ ID NO: 3343771 - RNA, 21 nt, Mycobacterium tuberculosis H37Rv
gccggugccggcguugccgcc

SEQ ID NO: 3343772 - RNA, 19 nt, Mycobacterium tuberculosis H37Rv
gccggugccggucgagugc

SEQ ID NO: 3343773 - RNA, 21 nt, Mycobacterium tuberculosis H37Rv
gccggugcgaauggugcaacg

SEQ ID NO: 3343774 - RNA, 14 nt, Mycobacterium tuberculosis H37Rv
gccggugcgcugga

SEQ ID NO: 3343775 - RNA, 18 nt, Mycobacterium tuberculosis H37Rv
gccggugcggcgggcucg

SEQ ID NO: 3343776 - RNA, 19 nt, Mycobacterium tuberculosis H37Rv
gccggugcgguggugcgca

SEQ ID NO: 3343777 - RNA, 15 nt, Mycobacterium tuberculosis H37Rv
gccggugcugcggga

SEQ ID NO: 3343778 - RNA, 21 nt, Mycobacterium tuberculosis H37Rv
gccgguggcacccgcgucgag

SEQ ID NO: 3343779 - RNA, 14 nt, Mycobacterium tuberculosis H37Rv
gccgguggcgccgc

SEQ ID NO: 3343780 - RNA, 15 nt, Mycobacterium tuberculosis H37Rv
gccgguggcgccgcc

SEQ ID NO: 3343781 - RNA, 17 nt, Mycobacterium tuberculosis H37Rv
gccgguggcgccgccgc

SEQ ID NO: 3343782 - RNA, 20 nt, Mycobacterium tuberculosis H37Rv
gccgguggcgccgccgccaa

SEQ ID NO: 3343783 - RNA, 14 nt, Mycobacterium tuberculosis H37Rv
gccgguggcguggg

SEQ ID NO: 3343784 - RNA, 13 nt, Mycobacterium tuberculosis H37Rv
gccgguggggccc

SEQ ID NO: 3343785 - RNA, 22 nt, Mycobacterium tuberculosis H37Rv
gccgguggggcccucguagcgu

SEQ ID NO: 3343786 - RNA, 20 nt, Mycobacterium tuberculosis H37Rv
gccgguggucugcgcggugc

SEQ ID NO: 3343787 - RNA, 21 nt, Mycobacterium tuberculosis H37Rv
gccgguggucugcgcggugcc

SEQ ID NO: 3343788 - RNA, 19 nt, Mycobacterium tuberculosis H37Rv
gccgguggugccggcgccg

SEQ ID NO: 3343789 - RNA, 20 nt, Mycobacterium tuberculosis H37Rv
gccgguggugccggcgccgc

SEQ ID NO: 3343790 - RNA, 20 nt, Mycobacterium tuberculosis H37Rv
gccgguguaggccucggcag

SEQ ID NO: 3343791 - RNA, 19 nt, Mycobacterium tuberculosis H37Rv
gccggugucgacggggaac

SEQ ID NO: 3343792 - RNA, 14 nt, Mycobacterium tuberculosis H37Rv
gccggugucggcug

SEQ ID NO: 3343793 - RNA, 15 nt, Mycobacterium tuberculosis H37Rv
gccggugucgggcug

SEQ ID NO: 3343794 - RNA, 16 nt, Mycobacterium tuberculosis H37Rv
gccggugucguucggc

SEQ ID NO: 3343795 - RNA, 18 nt, Mycobacterium tuberculosis H37Rv
gccggugucucccuugcc

SEQ ID NO: 3343796 - RNA, 15 nt, Mycobacterium tuberculosis H37Rv
gccggugugcgccaa

SEQ ID NO: 3343797 - RNA, 17 nt, Mycobacterium tuberculosis H37Rv
gccggugugcggcguac

SEQ ID NO: 3343798 - RNA, 15 nt, Mycobacterium tuberculosis H37Rv
gccgguguguccagc

SEQ ID NO: 3343799 - RNA, 21 nt, Mycobacterium tuberculosis H37Rv
gccgguguguccagcggaucg

SEQ ID NO: 3343800 - RNA, 19 nt, Mycobacterium tuberculosis H37Rv
gccgguguuagugaggccc

SEQ ID NO: 3343801 - RNA, 21 nt, Mycobacterium tuberculosis H37Rv
gccgguguuagugaggcccga

SEQ ID NO: 3343802 - RNA, 21 nt, Mycobacterium tuberculosis H37Rv
gccgguguugauuccggcgug

SEQ ID NO: 3343803 - RNA, 15 nt, Mycobacterium tuberculosis H37Rv
gccgguguugccgaa

SEQ ID NO: 3343804 - RNA, 22 nt, Mycobacterium tuberculosis H37Rv
gccgguguugccgaagcccgag

SEQ ID NO: 3343805 - RNA, 22 nt, Mycobacterium tuberculosis H37Rv
gccgguguuuccgaaacccgcc

SEQ ID NO: 3343806 - RNA, 21 nt, Mycobacterium tuberculosis H37Rv
gccgguuacccggaccgucgu

SEQ ID NO: 3343807 - RNA, 19 nt, Mycobacterium tuberculosis H37Rv
gccgguucagggguggcgc

SEQ ID NO: 3343808 - RNA, 20 nt, Mycobacterium tuberculosis H37Rv
gccgguucccgaucaggcgg

SEQ ID NO: 3343809 - RNA, 17 nt, Mycobacterium tuberculosis H37Rv
gccgguucccuuguucc

SEQ ID NO: 3343810 - RNA, 21 nt, Mycobacterium tuberculosis H37Rv
gccgguucccuuguucccgaa

SEQ ID NO: 3343811 - RNA, 15 nt, Mycobacterium tuberculosis H37Rv
gccgguuccgcaaug

SEQ ID NO: 3343812 - RNA, 15 nt, Mycobacterium tuberculosis H37Rv
gccgguucgcccagc

SEQ ID NO: 3343813 - RNA, 23 nt, Mycobacterium tuberculosis H37Rv
gccgguucgcccagcaggcccuu

SEQ ID NO: 3343814 - RNA, 14 nt, Mycobacterium tuberculosis H37Rv
gccgguucggcgau

SEQ ID NO: 3343815 - RNA, 19 nt, Mycobacterium tuberculosis H37Rv
gccgguucuuggcguugau

SEQ ID NO: 3343816 - RNA, 16 nt, Mycobacterium tuberculosis H37Rv
gccgguugcggcugcg

SEQ ID NO: 3343817 - RNA, 19 nt, Mycobacterium tuberculosis H37Rv
gccgguugcggcugcguug

SEQ ID NO: 3343818 - RNA, 17 nt, Mycobacterium tuberculosis H37Rv
gccgguuggccagccac

SEQ ID NO: 3343819 - RNA, 14 nt, Mycobacterium tuberculosis H37Rv
gccgguuggccagu

SEQ ID NO: 3343820 - RNA, 19 nt, Mycobacterium tuberculosis H37Rv
gccgguuugggcgcgugcc

SEQ ID NO: 3343821 - RNA, 18 nt, Mycobacterium tuberculosis H37Rv
gccgguuugggggcuucu

SEQ ID NO: 3343822 - RNA, 23 nt, Mycobacterium tuberculosis H37Rv
gccgguuugucgugucaugcuca

SEQ ID NO: 3343823 - RNA, 16 nt, Mycobacterium tuberculosis H37Rv
gccguaacgcggaucg

SEQ ID NO: 3343824 - RNA, 19 nt, Mycobacterium tuberculosis H37Rv
gccguaagcaccagccagc

SEQ ID NO: 3343825 - RNA, 14 nt, Mycobacterium tuberculosis H37Rv
gccguacaacagcg

SEQ ID NO: 3343826 - RNA, 17 nt, Mycobacterium tuberculosis H37Rv
gccguacaacagcgcgc

SEQ ID NO: 3343827 - RNA, 20 nt, Mycobacterium tuberculosis H37Rv
gccguacaacagcgcgcgcu

SEQ ID NO: 3343828 - RNA, 14 nt, Mycobacterium tuberculosis H37Rv
gccguacaaccacc

SEQ ID NO: 3343829 - RNA, 17 nt, Mycobacterium tuberculosis H37Rv
gccguacacaccgagca

SEQ ID NO: 3343830 - RNA, 23 nt, Mycobacterium tuberculosis H37Rv
gccguacacaccgagcaccucgg

SEQ ID NO: 3343831 - RNA, 15 nt, Mycobacterium tuberculosis H37Rv
gccguacagcgcaaa

SEQ ID NO: 3343832 - RNA, 21 nt, Mycobacterium tuberculosis H37Rv
gccguacagcgcaaagcccuc

SEQ ID NO: 3343833 - RNA, 15 nt, Mycobacterium tuberculosis H37Rv
gccguacagcggcgg

SEQ ID NO: 3343834 - RNA, 19 nt, Mycobacterium tuberculosis H37Rv
gccguacagcggcggcguc

SEQ ID NO: 3343835 - RNA, 19 nt, Mycobacterium tuberculosis H37Rv
gccguacaucagcgcgaac

SEQ ID NO: 3343836 - RNA, 15 nt, Mycobacterium tuberculosis H37Rv
gccguaccaguuauu

SEQ ID NO: 3343837 - RNA, 12 nt, Mycobacterium tuberculosis H37Rv
gccguaccgaag

SEQ ID NO: 3343838 - RNA, 19 nt, Mycobacterium tuberculosis H37Rv
gccguagaagcgcuccagc

SEQ ID NO: 3343839 - RNA, 15 nt, Mycobacterium tuberculosis H37Rv
gccguagaccaggcc

SEQ ID NO: 3343840 - RNA, 19 nt, Mycobacterium tuberculosis H37Rv
gccguagaccaggcccagg

SEQ ID NO: 3343841 - RNA, 19 nt, Mycobacterium tuberculosis H37Rv
gccguagagccgcucggcg

SEQ ID NO: 3343842 - RNA, 20 nt, Mycobacterium tuberculosis H37Rv
gccguagagucguuuggcgc

SEQ ID NO: 3343843 - RNA, 15 nt, Mycobacterium tuberculosis H37Rv
gccguagaucccgaa

SEQ ID NO: 3343844 - RNA, 18 nt, Mycobacterium tuberculosis H37Rv
gccguagcccacgacgaa

SEQ ID NO: 3343845 - RNA, 14 nt, Mycobacterium tuberculosis H37Rv
gccguagccgccgu

SEQ ID NO: 3343846 - RNA, 11 nt, Mycobacterium tuberculosis H37Rv
gccgucgccgu

SEQ ID NO: 3343847 - RNA, 13 nt, Mycobacterium tuberculosis H37Rv
gccgucgcgcgac

SEQ ID NO: 3343848 - RNA, 14 nt, Mycobacterium tuberculosis H37Rv
gccgucgcggcacg

SEQ ID NO: 3343849 - RNA, 23 nt, Mycobacterium tuberculosis H37Rv
gccgucgcuagggugagcccggg

SEQ ID NO: 3343850 - RNA, 21 nt, Mycobacterium tuberculosis H37Rv
gccgucgcugacgcccuccug

SEQ ID NO: 3343851 - RNA, 17 nt, Mycobacterium tuberculosis H37Rv
gccgucgcugguguaga

SEQ ID NO: 3343852 - RNA, 13 nt, Mycobacterium tuberculosis H37Rv
gccgucggccgag

SEQ ID NO: 3343853 - RNA, 19 nt, Mycobacterium tuberculosis H37Rv
gccgucggccucggcgguc

SEQ ID NO: 3343854 - RNA, 20 nt, Mycobacterium tuberculosis H37Rv
gccgucggccucggcggucg

SEQ ID NO: 3343855 - RNA, 12 nt, Mycobacterium tuberculosis H37Rv
gccgucggcgaa

SEQ ID NO: 3343856 - RNA, 22 nt, Mycobacterium tuberculosis H37Rv
gccgucggcgagcagacgccgc

SEQ ID NO: 3343857 - RNA, 13 nt, Mycobacterium tuberculosis H37Rv
gccgucggcgaug

SEQ ID NO: 3343858 - RNA, 16 nt, Mycobacterium tuberculosis H37Rv
gccgucggcgaugaag

SEQ ID NO: 3343859 - RNA, 15 nt, Mycobacterium tuberculosis H37Rv
gccgucggcgccggc

SEQ ID NO: 3343860 - RNA, 16 nt, Mycobacterium tuberculosis H37Rv
gccgucggcgccggca

SEQ ID NO: 3343861 - RNA, 18 nt, Mycobacterium tuberculosis H37Rv
gccgucggcgccggcauc

SEQ ID NO: 3343862 - RNA, 19 nt, Mycobacterium tuberculosis H37Rv
gccgucggcgccggcaucg

SEQ ID NO: 3343863 - RNA, 15 nt, Mycobacterium tuberculosis H37Rv
gccgucggcgcgcac

SEQ ID NO: 3343864 - RNA, 19 nt, Mycobacterium tuberculosis H37Rv
gccgucggcguacagcgcc

SEQ ID NO: 3343865 - RNA, 14 nt, Mycobacterium tuberculosis H37Rv
gccgucggcgugca

SEQ ID NO: 3343866 - RNA, 22 nt, Mycobacterium tuberculosis H37Rv
gccgucggggaguucgcgcagc

SEQ ID NO: 3343867 - RNA, 23 nt, Mycobacterium tuberculosis H37Rv
gccgucggggaguucgcgcagca

SEQ ID NO: 3343868 - RNA, 23 nt, Mycobacterium tuberculosis H37Rv
gccgucggggguaauugccagcc

SEQ ID NO: 3343869 - RNA, 23 nt, Mycobacterium tuberculosis H37Rv
gccgucgggugcagcacggcgcc

SEQ ID NO: 3343870 - RNA, 17 nt, Mycobacterium tuberculosis H37Rv
gccgucggugccgcgga

SEQ ID NO: 3343871 - RNA, 22 nt, Mycobacterium tuberculosis H37Rv
gccgucggugccggggcugccg

SEQ ID NO: 3343872 - RNA, 20 nt, Mycobacterium tuberculosis H37Rv
gccgucggugggugccagcc

SEQ ID NO: 3343873 - RNA, 23 nt, Mycobacterium tuberculosis H37Rv
gccgucggugggugccagccggu

SEQ ID NO: 3343874 - RNA, 16 nt, Mycobacterium tuberculosis H37Rv
gccgucguccgcugac

SEQ ID NO: 3343875 - RNA, 20 nt, Mycobacterium tuberculosis H37Rv
gccgucguccgcugacccgc

SEQ ID NO: 3343876 - RNA, 17 nt, Mycobacterium tuberculosis H37Rv
gccgucgucgaccacga

SEQ ID NO: 3343877 - RNA, 14 nt, Mycobacterium tuberculosis H37Rv
gccgucgucgagcc

SEQ ID NO: 3343878 - RNA, 13 nt, Mycobacterium tuberculosis H37Rv
gccgucgucgauc

SEQ ID NO: 3343879 - RNA, 21 nt, Mycobacterium tuberculosis H37Rv
gccgucgucgccgucggugcc

SEQ ID NO: 3343880 - RNA, 12 nt, Mycobacterium tuberculosis H37Rv
gccgucgucggc

SEQ ID NO: 3343881 - RNA, 16 nt, Mycobacterium tuberculosis H37Rv
gccgucgucggcguac

SEQ ID NO: 3343882 - RNA, 12 nt, Mycobacterium tuberculosis H37Rv
gccgucgucggu

SEQ ID NO: 3343883 - RNA, 18 nt, Mycobacterium tuberculosis H37Rv
gccgucgugaucggcgaa

SEQ ID NO: 3343884 - RNA, 19 nt, Mycobacterium tuberculosis H37Rv
gccgucgugaucggcgaac

SEQ ID NO: 3343885 - RNA, 14 nt, Mycobacterium tuberculosis H37Rv
gccgucgugccacc

SEQ ID NO: 3343886 - RNA, 16 nt, Mycobacterium tuberculosis H37Rv
gccgucgugccaccgu

SEQ ID NO: 3343887 - RNA, 22 nt, Mycobacterium tuberculosis H37Rv
gccgucgugugacacaacgauc

SEQ ID NO: 3343888 - RNA, 17 nt, Mycobacterium tuberculosis H37Rv
gccgucguugcccgacc

SEQ ID NO: 3343889 - RNA, 12 nt, Mycobacterium tuberculosis H37Rv
gccgucucggca

SEQ ID NO: 3343890 - RNA, 16 nt, Mycobacterium tuberculosis H37Rv
gccgucucggcaugcu

SEQ ID NO: 3343891 - RNA, 17 nt, Mycobacterium tuberculosis H37Rv
gccgucucgucggcaac

SEQ ID NO: 3343892 - RNA, 17 nt, Mycobacterium tuberculosis H37Rv
gccgucucugccacgcg

SEQ ID NO: 3343893 - RNA, 16 nt, Mycobacterium tuberculosis H37Rv
gccgucugacagcauc

SEQ ID NO: 3343894 - RNA, 21 nt, Mycobacterium tuberculosis H37Rv
gccgucugacagcauccuucg

SEQ ID NO: 3343895 - RNA, 23 nt, Mycobacterium tuberculosis H37Rv
gccgucugaucacucacccgggc

SEQ ID NO: 3343896 - RNA, 18 nt, Mycobacterium tuberculosis H37Rv
gccgucuucgccgccacc

SEQ ID NO: 3343897 - RNA, 16 nt, Mycobacterium tuberculosis H37Rv
gccgucuugccggcca

SEQ ID NO: 3343898 - RNA, 16 nt, Mycobacterium tuberculosis H37Rv
gccgucuuggcccggu

SEQ ID NO: 3343899 - RNA, 21 nt, Mycobacterium tuberculosis H37Rv
gccgugaacggaugugguugc

SEQ ID NO: 3343900 - RNA, 15 nt, Mycobacterium tuberculosis H37Rv
gccgugaacggcgcg

SEQ ID NO: 3343901 - RNA, 16 nt, Mycobacterium tuberculosis H37Rv
gccgugaauucgccga

SEQ ID NO: 3343902 - RNA, 22 nt, Mycobacterium tuberculosis H37Rv
gccgugacaaggugcgcugggu

SEQ ID NO: 3343903 - RNA, 14 nt, Mycobacterium tuberculosis H37Rv
gccgugaccaggug

SEQ ID NO: 3343904 - RNA, 16 nt, Mycobacterium tuberculosis H37Rv
gccgugacccucagca

SEQ ID NO: 3343905 - RNA, 23 nt, Mycobacterium tuberculosis H37Rv
gccgugacgauucgagcaacugc

SEQ ID NO: 3343906 - RNA, 14 nt, Mycobacterium tuberculosis H37Rv
gccgugagcccggc

SEQ ID NO: 3343907 - RNA, 21 nt, Mycobacterium tuberculosis H37Rv
gccgugaucagcucgcgcacg

SEQ ID NO: 3343908 - RNA, 18 nt, Mycobacterium tuberculosis H37Rv
gccgugaucgcuggcgac

SEQ ID NO: 3343909 - RNA, 19 nt, Mycobacterium tuberculosis H37Rv
gccgugaugauguccgggu

SEQ ID NO: 3343910 - RNA, 22 nt, Mycobacterium tuberculosis H37Rv
gccgugaugccacggcgucgcu

SEQ ID NO: 3343911 - RNA, 22 nt, Mycobacterium tuberculosis H37Rv
gccgugaugcuggucgugccgc

SEQ ID NO: 3343912 - RNA, 20 nt, Mycobacterium tuberculosis H37Rv
gccgugaugucccgcaaaau

SEQ ID NO: 3343913 - RNA, 21 nt, Mycobacterium tuberculosis H37Rv
gccgugcaauagcucgggcgc

SEQ ID NO: 3343914 - RNA, 22 nt, Mycobacterium tuberculosis H37Rv
gccgugcaccucguguccgggg

SEQ ID NO: 3343915 - RNA, 20 nt, Mycobacterium tuberculosis H37Rv
gccgugcagcucggucagcg

SEQ ID NO: 3343916 - RNA, 15 nt, Mycobacterium tuberculosis H37Rv
gccgugccacgucgg

SEQ ID NO: 3343917 - RNA, 20 nt, Mycobacterium tuberculosis H37Rv
gccgugccagcaggggacgg

SEQ ID NO: 3343918 - RNA, 22 nt, Mycobacterium tuberculosis H37Rv
gccgugcccaggccaccggcug

SEQ ID NO: 3343919 - RNA, 19 nt, Mycobacterium tuberculosis H37Rv
gccgugcccggugcggugc

SEQ ID NO: 3343920 - RNA, 21 nt, Mycobacterium tuberculosis H37Rv
gccgugccgccgacaccaccg

SEQ ID NO: 3343921 - RNA, 12 nt, Mycobacterium tuberculosis H37Rv
gccgugccguac

SEQ ID NO: 3343922 - RNA, 15 nt, Mycobacterium tuberculosis H37Rv
gccgugccgugguga

SEQ ID NO: 3343923 - RNA, 18 nt, Mycobacterium tuberculosis H37Rv
gccgugccucgaggacgg

SEQ ID NO: 3343924 - RNA, 18 nt, Mycobacterium tuberculosis H37Rv
gccgugcgccgugcgauc

SEQ ID NO: 3343925 - RNA, 13 nt, Mycobacterium tuberculosis H37Rv
gccgugcggcggc

SEQ ID NO: 3343926 - RNA, 14 nt, Mycobacterium tuberculosis H37Rv
gccgugcggcggcu

SEQ ID NO: 3343927 - RNA, 18 nt, Mycobacterium tuberculosis H37Rv
gccgugcggcggcugccg

SEQ ID NO: 3343928 - RNA, 19 nt, Mycobacterium tuberculosis H37Rv
gccgugcggucgcgcccuc

SEQ ID NO: 3343929 - RNA, 18 nt, Mycobacterium tuberculosis H37Rv
gccgugcgugcgggggcu

SEQ ID NO: 3343930 - RNA, 19 nt, Mycobacterium tuberculosis H37Rv
gccgugcuacccauucggc

SEQ ID NO: 3343931 - RNA, 21 nt, Mycobacterium tuberculosis H37Rv
gccgugcuacccauucggcgg

SEQ ID NO: 3343932 - RNA, 18 nt, Mycobacterium tuberculosis H37Rv
gccgugcugaacuccgcc

SEQ ID NO: 3343933 - RNA, 22 nt, Mycobacterium tuberculosis H37Rv
gccgugcugaauugccaagcgc

SEQ ID NO: 3343934 - RNA, 21 nt, Mycobacterium tuberculosis H37Rv
gccgugcugcggcgacgguga

SEQ ID NO: 3343935 - RNA, 22 nt, Mycobacterium tuberculosis H37Rv
gccgugcuguuccagcgucugc

SEQ ID NO: 3343936 - RNA, 17 nt, Mycobacterium tuberculosis H37Rv
gccguggaacacgaagu

SEQ ID NO: 3343937 - RNA, 17 nt, Mycobacterium tuberculosis H37Rv
gccguggaagacgucga

SEQ ID NO: 3343938 - RNA, 18 nt, Mycobacterium tuberculosis H37Rv
gccguggauacgcacggc

SEQ ID NO: 3343939 - RNA, 21 nt, Mycobacterium tuberculosis H37Rv
gccguggauggcccguucgac

SEQ ID NO: 3343940 - RNA, 20 nt, Mycobacterium tuberculosis H37Rv
gccguggaugucgcggucga

SEQ ID NO: 3343941 - RNA, 22 nt, Mycobacterium tuberculosis H37Rv
gccguggcagucgcacggugcc

SEQ ID NO: 3343942 - RNA, 18 nt, Mycobacterium tuberculosis H37Rv
gccuccagaaccgaagcc

SEQ ID NO: 3343943 - RNA, 19 nt, Mycobacterium tuberculosis H37Rv
gccuccagauucgccgccc

SEQ ID NO: 3343944 - RNA, 13 nt, Mycobacterium tuberculosis H37Rv
gccuccagcaccc

SEQ ID NO: 3343945 - RNA, 19 nt, Mycobacterium tuberculosis H37Rv
gccuccagcacccggucga

SEQ ID NO: 3343946 - RNA, 21 nt, Mycobacterium tuberculosis H37Rv
gccuccagcagguccgcggcc

SEQ ID NO: 3343947 - RNA, 23 nt, Mycobacterium tuberculosis H37Rv
gccuccagcagguccgcggccgc

SEQ ID NO: 3343948 - RNA, 18 nt, Mycobacterium tuberculosis H37Rv
gccuccagcgcaccggug

SEQ ID NO: 3343949 - RNA, 18 nt, Mycobacterium tuberculosis H37Rv
gccuccauaucgcagcgu

SEQ ID NO: 3343950 - RNA, 13 nt, Mycobacterium tuberculosis H37Rv
gccuccaucgcga

SEQ ID NO: 3343951 - RNA, 19 nt, Mycobacterium tuberculosis H37Rv
gccuccaucgcgacaucgg

SEQ ID NO: 3343952 - RNA, 20 nt, Mycobacterium tuberculosis H37Rv
gccuccauuucgucggagaa

SEQ ID NO: 3343953 - RNA, 18 nt, Mycobacterium tuberculosis H37Rv
gccucccacucacccagc

SEQ ID NO: 3343954 - RNA, 13 nt, Mycobacterium tuberculosis H37Rv
gccucccgggccg

SEQ ID NO: 3343955 - RNA, 17 nt, Mycobacterium tuberculosis H37Rv
gccucccgggccgccgc

SEQ ID NO: 3343956 - RNA, 22 nt, Mycobacterium tuberculosis H37Rv
gccuccgaggaauacagcuuga

SEQ ID NO: 3343957 - RNA, 17 nt, Mycobacterium tuberculosis H37Rv
gccuccgccgaggccgc

SEQ ID NO: 3343958 - RNA, 15 nt, Mycobacterium tuberculosis H37Rv
gccuccgcugccgcc

SEQ ID NO: 3343959 - RNA, 21 nt, Mycobacterium tuberculosis H37Rv
gccuccggagaauccgggacg

SEQ ID NO: 3343960 - RNA, 15 nt, Mycobacterium tuberculosis H37Rv
gccuccggauccucg

SEQ ID NO: 3343961 - RNA, 18 nt, Mycobacterium tuberculosis H37Rv
gccuccggauccucggcc

SEQ ID NO: 3343962 - RNA, 20 nt, Mycobacterium tuberculosis H37Rv
gccuccggauccucggccgc

SEQ ID NO: 3343963 - RNA, 21 nt, Mycobacterium tuberculosis H37Rv
gccuccggauccucggccgcc

SEQ ID NO: 3343964 - RNA, 16 nt, Mycobacterium tuberculosis H37Rv
gccuccguugccccca

SEQ ID NO: 3343965 - RNA, 21 nt, Mycobacterium tuberculosis H37Rv
gccuccuccccgaccgccacc

SEQ ID NO: 3343966 - RNA, 20 nt, Mycobacterium tuberculosis H37Rv
gccuccucgacgucggcgag

SEQ ID NO: 3343967 - RNA, 21 nt, Mycobacterium tuberculosis H37Rv
gccuccucgacgucggcgagc

SEQ ID NO: 3343968 - RNA, 16 nt, Mycobacterium tuberculosis H37Rv
gccuccucgauagcgg

SEQ ID NO: 3343969 - RNA, 17 nt, Mycobacterium tuberculosis H37Rv
gccuccucgugcaggac

SEQ ID NO: 3343970 - RNA, 22 nt, Mycobacterium tuberculosis H37Rv
gccuccucgugcaggaccagca

SEQ ID NO: 3343971 - RNA, 16 nt, Mycobacterium tuberculosis H37Rv
gccuccucuugggucc

SEQ ID NO: 3343972 - RNA, 21 nt, Mycobacterium tuberculosis H37Rv
gccuccucuuggguccacaac

SEQ ID NO: 3343973 - RNA, 15 nt, Mycobacterium tuberculosis H37Rv
gccuccugccgccgc

SEQ ID NO: 3343974 - RNA, 20 nt, Mycobacterium tuberculosis H37Rv
gccuccugccgccgcuccau

SEQ ID NO: 3343975 - RNA, 12 nt, Mycobacterium tuberculosis H37Rv
gccuccugcugg

SEQ ID NO: 3343976 - RNA, 21 nt, Mycobacterium tuberculosis H37Rv
gccuccugcuggcccugcucc

SEQ ID NO: 3343977 - RNA, 22 nt, Mycobacterium tuberculosis H37Rv
gccuccuggaaggaggccggga

SEQ ID NO: 3343978 - RNA, 16 nt, Mycobacterium tuberculosis H37Rv
gccucgaacgccgccc

SEQ ID NO: 3343979 - RNA, 21 nt, Mycobacterium tuberculosis H37Rv
gccucgacacccagccgcagc

SEQ ID NO: 3343980 - RNA, 14 nt, Mycobacterium tuberculosis H37Rv
gccucgaccgccag

SEQ ID NO: 3343981 - RNA, 16 nt, Mycobacterium tuberculosis H37Rv
gccucgaccgccagcc

SEQ ID NO: 3343982 - RNA, 18 nt, Mycobacterium tuberculosis H37Rv
gccucgaccgccagccgc

SEQ ID NO: 3343983 - RNA, 22 nt, Mycobacterium tuberculosis H37Rv
gccucgaccgccagccgcgagc

SEQ ID NO: 3343984 - RNA, 19 nt, Mycobacterium tuberculosis H37Rv
gccucgacgcggcaggccg

SEQ ID NO: 3343985 - RNA, 23 nt, Mycobacterium tuberculosis H37Rv
gccucgagcaacggacgaagcac

SEQ ID NO: 3343986 - RNA, 15 nt, Mycobacterium tuberculosis H37Rv
gccucgaggaccacc

SEQ ID NO: 3343987 - RNA, 20 nt, Mycobacterium tuberculosis H37Rv
gccucgauaggugagcgcgg

SEQ ID NO: 3343988 - RNA, 22 nt, Mycobacterium tuberculosis H37Rv
gccucgauccgcaucaugucga

SEQ ID NO: 3343989 - RNA, 16 nt, Mycobacterium tuberculosis H37Rv
gccucgaucgacucga

SEQ ID NO: 3343990 - RNA, 22 nt, Mycobacterium tuberculosis H37Rv
gccucgaucgacucgaaccguu

SEQ ID NO: 3343991 - RNA, 19 nt, Mycobacterium tuberculosis H37Rv
gccucgaugucgcggucgc

SEQ ID NO: 3343992 - RNA, 19 nt, Mycobacterium tuberculosis H37Rv
gccucgauuguggccagcg

SEQ ID NO: 3343993 - RNA, 16 nt, Mycobacterium tuberculosis H37Rv
gccucgccauccauga

SEQ ID NO: 3343994 - RNA, 17 nt, Mycobacterium tuberculosis H37Rv
gccucgccgaagugguc

SEQ ID NO: 3343995 - RNA, 17 nt, Mycobacterium tuberculosis H37Rv
gccucgccggccgccag

SEQ ID NO: 3343996 - RNA, 19 nt, Mycobacterium tuberculosis H37Rv
gccucgccggccgccagcc

SEQ ID NO: 3343997 - RNA, 21 nt, Mycobacterium tuberculosis H37Rv
gccucgccguagagcuggugc

SEQ ID NO: 3343998 - RNA, 22 nt, Mycobacterium tuberculosis H37Rv
gccucgcggaugagcucggcca

SEQ ID NO: 3343999 - RNA, 21 nt, Mycobacterium tuberculosis H37Rv
gccucgcgggaagucccgagu

SEQ ID NO: 3344000 - RNA, 17 nt, Mycobacterium tuberculosis H37Rv
gccucgcgggcagggcc

SEQ ID NO: 3344001 - RNA, 18 nt, Mycobacterium tuberculosis H37Rv
gccucgcgggcagggccu

SEQ ID NO: 3344002 - RNA, 13 nt, Mycobacterium tuberculosis H37Rv
gccucgcguucgc

SEQ ID NO: 3344003 - RNA, 17 nt, Mycobacterium tuberculosis H37Rv
gccucgcuaacucccca

SEQ ID NO: 3344004 - RNA, 13 nt, Mycobacterium tuberculosis H37Rv
gccucgcucucca

SEQ ID NO: 3344005 - RNA, 16 nt, Mycobacterium tuberculosis H37Rv
gccucgcugcucagca

SEQ ID NO: 3344006 - RNA, 19 nt, Mycobacterium tuberculosis H37Rv
gccucgcugggcucauggc

SEQ ID NO: 3344007 - RNA, 16 nt, Mycobacterium tuberculosis H37Rv
gccucggaccagaccc

SEQ ID NO: 3344008 - RNA, 21 nt, Mycobacterium tuberculosis H37Rv
gccucggaccagacccacgau

SEQ ID NO: 3344009 - RNA, 21 nt, Mycobacterium tuberculosis H37Rv
gccucggagaucgagaucacc

SEQ ID NO: 3344010 - RNA, 13 nt, Mycobacterium tuberculosis H37Rv
gccucggcaucgc

SEQ ID NO: 3344011 - RNA, 18 nt, Mycobacterium tuberculosis H37Rv
gccucggcaucgccgcgg

SEQ ID NO: 3344012 - RNA, 15 nt, Mycobacterium tuberculosis H37Rv
gccucggcaugcagc

SEQ ID NO: 3344013 - RNA, 18 nt, Mycobacterium tuberculosis H37Rv
gccucggcaugcagcccc

SEQ ID NO: 3344014 - RNA, 18 nt, Mycobacterium tuberculosis H37Rv
gccucggcgaccaucuga

SEQ ID NO: 3344015 - RNA, 21 nt, Mycobacterium tuberculosis H37Rv
gccucggcgaugggccggucc

SEQ ID NO: 3344016 - RNA, 15 nt, Mycobacterium tuberculosis H37Rv
gccucggcgccgccc

SEQ ID NO: 3344017 - RNA, 18 nt, Mycobacterium tuberculosis H37Rv
gccucggcgccgcccagc

SEQ ID NO: 3344018 - RNA, 13 nt, Mycobacterium tuberculosis H37Rv
gccucggcgcugc

SEQ ID NO: 3344019 - RNA, 23 nt, Mycobacterium tuberculosis H37Rv
gccucggcgcugcgcaccgccgc

SEQ ID NO: 3344020 - RNA, 20 nt, Mycobacterium tuberculosis H37Rv
gccucggcggccagcucggc

SEQ ID NO: 3344021 - RNA, 23 nt, Mycobacterium tuberculosis H37Rv
gccucggcguaggcgauggcggc

SEQ ID NO: 3344022 - RNA, 14 nt, Mycobacterium tuberculosis H37Rv
gccucgggcaccug

SEQ ID NO: 3344023 - RNA, 13 nt, Mycobacterium tuberculosis H37Rv
gccucggggccua

SEQ ID NO: 3344024 - RNA, 24 nt, Mycobacterium tuberculosis H37Rv
gccucgguaaagccgcggacggcg

SEQ ID NO: 3344025 - RNA, 17 nt, Mycobacterium tuberculosis H37Rv
gccucggugagcugcac

SEQ ID NO: 3344026 - RNA, 13 nt, Mycobacterium tuberculosis H37Rv
gccucgucgccgc

SEQ ID NO: 3344027 - RNA, 18 nt, Mycobacterium tuberculosis H37Rv
gccucgucgccgcgguag

SEQ ID NO: 3344028 - RNA, 22 nt, Mycobacterium tuberculosis H37Rv
gccucgucgucggacucguccu

SEQ ID NO: 3344029 - RNA, 18 nt, Mycobacterium tuberculosis H37Rv
gccucguugaccagaacc

SEQ ID NO: 3344030 - RNA, 18 nt, Mycobacterium tuberculosis H37Rv
gccucucgaccucagaca

SEQ ID NO: 3344031 - RNA, 21 nt, Mycobacterium tuberculosis H37Rv
gccucucgggggccgagccga

SEQ ID NO: 3344032 - RNA, 22 nt, Mycobacterium tuberculosis H37Rv
gccucucuucccaaccgcccgu

SEQ ID NO: 3344033 - RNA, 13 nt, Mycobacterium tuberculosis H37Rv
gccucugaccagc

SEQ ID NO: 3344034 - RNA, 15 nt, Mycobacterium tuberculosis H37Rv
gccucugcucagccg

SEQ ID NO: 3344035 - RNA, 18 nt, Mycobacterium tuberculosis H37Rv
gccucuggaucacgucga

SEQ ID NO: 3344036 - RNA, 12 nt, Mycobacterium tuberculosis H37Rv
gccucugucuuc

SEQ ID NO: 3344037 - RNA, 19 nt, Mycobacterium tuberculosis H37Rv
gccuggucggccaggucga

SEQ ID NO: 3344038 - RNA, 20 nt, Mycobacterium tuberculosis H37Rv
gccuggucuuguugcgcagc

SEQ ID NO: 3344039 - RNA, 16 nt, Mycobacterium tuberculosis H37Rv
gccuguagucccucau

SEQ ID NO: 3344040 - RNA, 12 nt, Mycobacterium tuberculosis H37Rv
gccuguccacgu

SEQ ID NO: 3344041 - RNA, 13 nt, Mycobacterium tuberculosis H37Rv
gccuguccacguc

SEQ ID NO: 3344042 - RNA, 19 nt, Mycobacterium tuberculosis H37Rv
gccuguccacguccagccc

SEQ ID NO: 3344043 - RNA, 17 nt, Mycobacterium tuberculosis H37Rv
gccuguccugcgggagg

SEQ ID NO: 3344044 - RNA, 13 nt, Mycobacterium tuberculosis H37Rv
gccugugccgccg

SEQ ID NO: 3344045 - RNA, 20 nt, Mycobacterium tuberculosis H37Rv
gccuguuuguuugcugcggc

SEQ ID NO: 3344046 - RNA, 21 nt, Mycobacterium tuberculosis H37Rv
gccuuacacgccuggcuacgc

SEQ ID NO: 3344047 - RNA, 21 nt, Mycobacterium tuberculosis H37Rv
gccuuacgcgggugaccaaca

SEQ ID NO: 3344048 - RNA, 13 nt, Mycobacterium tuberculosis H37Rv
gccuuagcugcca

SEQ ID NO: 3344049 - RNA, 20 nt, Mycobacterium tuberculosis H37Rv
gccuuaggugaccaggguga

SEQ ID NO: 3344050 - RNA, 14 nt, Mycobacterium tuberculosis H37Rv
gccuuauuggacgu

SEQ ID NO: 3344051 - RNA, 15 nt, Mycobacterium tuberculosis H37Rv
gccuucaaaaggaag

SEQ ID NO: 3344052 - RNA, 23 nt, Mycobacterium tuberculosis H37Rv
gccuucacgcuggccuccagcuu

SEQ ID NO: 3344053 - RNA, 14 nt, Mycobacterium tuberculosis H37Rv
gccuucagcucacc

SEQ ID NO: 3344054 - RNA, 16 nt, Mycobacterium tuberculosis H37Rv
gccuuccaggcgggcg

SEQ ID NO: 3344055 - RNA, 21 nt, Mycobacterium tuberculosis H37Rv
gccuuccaggcgggcggcacc

SEQ ID NO: 3344056 - RNA, 15 nt, Mycobacterium tuberculosis H37Rv
gccuucccagccgac

SEQ ID NO: 3344057 - RNA, 16 nt, Mycobacterium tuberculosis H37Rv
gccuuccucggcaagu

SEQ ID NO: 3344058 - RNA, 13 nt, Mycobacterium tuberculosis H37Rv
gccuucgccagcg

SEQ ID NO: 3344059 - RNA, 16 nt, Mycobacterium tuberculosis H37Rv
gccuucgccagcggcg

SEQ ID NO: 3344060 - RNA, 22 nt, Mycobacterium tuberculosis H37Rv
gccuucggcuaggucagcgggc

SEQ ID NO: 3344061 - RNA, 21 nt, Mycobacterium tuberculosis H37Rv
gccuucgggccaggauccgac

SEQ ID NO: 3344062 - RNA, 16 nt, Mycobacterium tuberculosis H37Rv
gccuucggggugcacg

SEQ ID NO: 3344063 - RNA, 23 nt, Mycobacterium tuberculosis H37Rv
gccuucggugucgccgaacaccg

SEQ ID NO: 3344064 - RNA, 17 nt, Mycobacterium tuberculosis H37Rv
gccuucguagaaggacc

SEQ ID NO: 3344065 - RNA, 23 nt, Mycobacterium tuberculosis H37Rv
gccuucguagaaggaccgcucgu

SEQ ID NO: 3344066 - RNA, 18 nt, Mycobacterium tuberculosis H37Rv
gccuucguagcggccgca

SEQ ID NO: 3344067 - RNA, 22 nt, Mycobacterium tuberculosis H37Rv
gccuucuccggcgucacggcgu

SEQ ID NO: 3344068 - RNA, 21 nt, Mycobacterium tuberculosis H37Rv
gccuucuucgcuaccuucuug

SEQ ID NO: 3344069 - RNA, 21 nt, Mycobacterium tuberculosis H37Rv
gccuucuuggcaggugccuuc

SEQ ID NO: 3344070 - RNA, 22 nt, Mycobacterium tuberculosis H37Rv
gccuucuuggcaggugccuucu

SEQ ID NO: 3344071 - RNA, 16 nt, Mycobacterium tuberculosis H37Rv
gccuucuuggcgggag

SEQ ID NO: 3344072 - RNA, 17 nt, Mycobacterium tuberculosis H37Rv
gccuugacagcuuucuu

SEQ ID NO: 3344073 - RNA, 18 nt, Mycobacterium tuberculosis H37Rv
gccuugacagcuuucuug

SEQ ID NO: 3344074 - RNA, 24 nt, Mycobacterium tuberculosis H37Rv
gccuugacccauggcuccgcccag

SEQ ID NO: 3344075 - RNA, 19 nt, Mycobacterium tuberculosis H37Rv
gccuugacccuccgcaucg

SEQ ID NO: 3344076 - RNA, 20 nt, Mycobacterium tuberculosis H37Rv
gccuugaccgcggucuucuu

SEQ ID NO: 3344077 - RNA, 19 nt, Mycobacterium tuberculosis H37Rv
gccuugaggcccugcggcc

SEQ ID NO: 3344078 - RNA, 14 nt, Mycobacterium tuberculosis H37Rv
gccuugaucggcga

SEQ ID NO: 3344079 - RNA, 15 nt, Mycobacterium tuberculosis H37Rv
gccuugaucggcgag

SEQ ID NO: 3344080 - RNA, 19 nt, Mycobacterium tuberculosis H37Rv
gccuugaucugagcgcggg

SEQ ID NO: 3344081 - RNA, 18 nt, Mycobacterium tuberculosis H37Rv
gccuugcagcgcccccgc

SEQ ID NO: 3344082 - RNA, 19 nt, Mycobacterium tuberculosis H37Rv
gccuugcagcgcguucggc

SEQ ID NO: 3344083 - RNA, 13 nt, Mycobacterium tuberculosis H37Rv
gccuugcccagcg

SEQ ID NO: 3344084 - RNA, 14 nt, Mycobacterium tuberculosis H37Rv
gccuugccgccggc

SEQ ID NO: 3344085 - RNA, 20 nt, Mycobacterium tuberculosis H37Rv
gccuugccgucgagcuccca

SEQ ID NO: 3344086 - RNA, 17 nt, Mycobacterium tuberculosis H37Rv
gccuugcgggcucucgg

SEQ ID NO: 3344087 - RNA, 22 nt, Mycobacterium tuberculosis H37Rv
gccuuggacgugcgcgccaagu

SEQ ID NO: 3344088 - RNA, 20 nt, Mycobacterium tuberculosis H37Rv
gccuuggcacccuccgccgg

SEQ ID NO: 3344089 - RNA, 13 nt, Mycobacterium tuberculosis H37Rv
gccuuggcagccc

SEQ ID NO: 3344090 - RNA, 14 nt, Mycobacterium tuberculosis H37Rv
gccuuggcagccca

SEQ ID NO: 3344091 - RNA, 16 nt, Mycobacterium tuberculosis H37Rv
gccuuggcaguccagc

SEQ ID NO: 3344092 - RNA, 20 nt, Mycobacterium tuberculosis H37Rv
gccuuggcgaacgccacggc

SEQ ID NO: 3344093 - RNA, 14 nt, Mycobacterium tuberculosis H37Rv
gccuuggcgcccgc

SEQ ID NO: 3344094 - RNA, 17 nt, Mycobacterium tuberculosis H37Rv
gccuugguagccggccg

SEQ ID NO: 3344095 - RNA, 16 nt, Mycobacterium tuberculosis H37Rv
gccuuggucaccuucu

SEQ ID NO: 3344096 - RNA, 16 nt, Mycobacterium tuberculosis H37Rv
gccuuggucgccgccu

SEQ ID NO: 3344097 - RNA, 20 nt, Mycobacterium tuberculosis H37Rv
gccuuggucgccgcuuucuu

SEQ ID NO: 3344098 - RNA, 14 nt, Mycobacterium tuberculosis H37Rv
gccuuggucgccgg

SEQ ID NO: 3344099 - RNA, 17 nt, Mycobacterium tuberculosis H37Rv
gccuuggucgcgucggc

SEQ ID NO: 3344100 - RNA, 12 nt, Mycobacterium tuberculosis H37Rv
gccuugucuagu

SEQ ID NO: 3344101 - RNA, 22 nt, Mycobacterium tuberculosis H37Rv
gccuuguuccagcgcaucgagc

SEQ ID NO: 3344102 - RNA, 16 nt, Mycobacterium tuberculosis H37Rv
gccuuguugccgccgg

SEQ ID NO: 3344103 - RNA, 19 nt, Mycobacterium tuberculosis H37Rv
gccuuguuggcgaagucgu

SEQ ID NO: 3344104 - RNA, 14 nt, Mycobacterium tuberculosis H37Rv
gccuuugagcgcgg

SEQ ID NO: 3344105 - RNA, 21 nt, Mycobacterium tuberculosis H37Rv
gccuuugagggcgacgacuuc

SEQ ID NO: 3344106 - RNA, 17 nt, Mycobacterium tuberculosis H37Rv
gccuuugcccgccgcgu

SEQ ID NO: 3344107 - RNA, 19 nt, Mycobacterium tuberculosis H37Rv
gccuuugggcuguggccgc

SEQ ID NO: 3344108 - RNA, 16 nt, Mycobacterium tuberculosis H37Rv
gccuuuggucgcggcu

SEQ ID NO: 3344109 - RNA, 16 nt, Mycobacterium tuberculosis H37Rv
gccuuugucgccuucu

SEQ ID NO: 3344110 - RNA, 18 nt, Mycobacterium tuberculosis H37Rv
gccuuugucgccuucuug

SEQ ID NO: 3344111 - RNA, 16 nt, Mycobacterium tuberculosis H37Rv
gcgaaaagccuugacc

SEQ ID NO: 3344112 - RNA, 19 nt, Mycobacterium tuberculosis H37Rv
gcgaaaaucgcgcgcgaaa

SEQ ID NO: 3344113 - RNA, 13 nt, Mycobacterium tuberculosis H37Rv
gcgaaaauucguc

SEQ ID NO: 3344114 - RNA, 17 nt, Mycobacterium tuberculosis H37Rv
gcgaaaauucgucgcgu

SEQ ID NO: 3344115 - RNA, 18 nt, Mycobacterium tuberculosis H37Rv
gcgaaaauugcuccacca

SEQ ID NO: 3344116 - RNA, 20 nt, Mycobacterium tuberculosis H37Rv
gcgaaacaccggccagcggc

SEQ ID NO: 3344117 - RNA, 22 nt, Mycobacterium tuberculosis H37Rv
gcgaaacaccggccagcggccc

SEQ ID NO: 3344118 - RNA, 22 nt, Mycobacterium tuberculosis H37Rv
gcgaaacagcuugcugcgcacc

SEQ ID NO: 3344119 - RNA, 23 nt, Mycobacterium tuberculosis H37Rv
gcgaaacccugaaaagggcuggu

SEQ ID NO: 3344120 - RNA, 18 nt, Mycobacterium tuberculosis H37Rv
gcgaaacgcccgggcggc

SEQ ID NO: 3344121 - RNA, 14 nt, Mycobacterium tuberculosis H37Rv
gcgaaacgcuggcc

SEQ ID NO: 3344122 - RNA, 16 nt, Mycobacterium tuberculosis H37Rv
gcgaaacgcuggccac

SEQ ID NO: 3344123 - RNA, 19 nt, Mycobacterium tuberculosis H37Rv
gcgaaaguccugcagugcg

SEQ ID NO: 3344124 - RNA, 16 nt, Mycobacterium tuberculosis H37Rv
gcgaaauagcgagcgu

SEQ ID NO: 3344125 - RNA, 22 nt, Mycobacterium tuberculosis H37Rv
gcgaaauagcugcggaggguuc

SEQ ID NO: 3344126 - RNA, 19 nt, Mycobacterium tuberculosis H37Rv
gcgaaauauuggcccguca

SEQ ID NO: 3344127 - RNA, 20 nt, Mycobacterium tuberculosis H37Rv
gcgaaauauuggcccgucac

SEQ ID NO: 3344128 - RNA, 23 nt, Mycobacterium tuberculosis H37Rv
gcgaaaucaguucccgaaccccg

SEQ ID NO: 3344129 - RNA, 22 nt, Mycobacterium tuberculosis H37Rv
gcgaaauccccugcgcugcagc

SEQ ID NO: 3344130 - RNA, 22 nt, Mycobacterium tuberculosis H37Rv
gcgaaauccgcgaucggcugac

SEQ ID NO: 3344131 - RNA, 16 nt, Mycobacterium tuberculosis H37Rv
gcgaaaucgacagcag

SEQ ID NO: 3344132 - RNA, 17 nt, Mycobacterium tuberculosis H37Rv
gcgaaaucgacagcagc

SEQ ID NO: 3344133 - RNA, 21 nt, Mycobacterium tuberculosis H37Rv
gcgacacucacgggugcuggc

SEQ ID NO: 3344134 - RNA, 23 nt, Mycobacterium tuberculosis H37Rv
gcgacagacaaacuccgacacca

SEQ ID NO: 3344135 - RNA, 20 nt, Mycobacterium tuberculosis H37Rv
gcgacagacagcaccgccgg

SEQ ID NO: 3344136 - RNA, 24 nt, Mycobacterium tuberculosis H37Rv
gcgacagacagcaccgccggugcg

SEQ ID NO: 3344137 - RNA, 13 nt, Mycobacterium tuberculosis H37Rv
gcgacagcgcggc

SEQ ID NO: 3344138 - RNA, 15 nt, Mycobacterium tuberculosis H37Rv
gcgacagcgcggcgg

SEQ ID NO: 3344139 - RNA, 11 nt, Mycobacterium tuberculosis H37Rv
gcgacagcgcu

SEQ ID NO: 3344140 - RNA, 18 nt, Mycobacterium tuberculosis H37Rv
gcgacagcgcugggccca

SEQ ID NO: 3344141 - RNA, 14 nt, Mycobacterium tuberculosis H37Rv
gcgacagcggcgac

SEQ ID NO: 3344142 - RNA, 14 nt, Mycobacterium tuberculosis H37Rv
gcgacagcggcguc

SEQ ID NO: 3344143 - RNA, 21 nt, Mycobacterium tuberculosis H37Rv
gcgacagcugccugaccggcg

SEQ ID NO: 3344144 - RNA, 18 nt, Mycobacterium tuberculosis H37Rv
gcgacaggacgucggcga

SEQ ID NO: 3344145 - RNA, 12 nt, Mycobacterium tuberculosis H37Rv
gcgacaggccga

SEQ ID NO: 3344146 - RNA, 18 nt, Mycobacterium tuberculosis H37Rv
gcgacaggccgagcagau

SEQ ID NO: 3344147 - RNA, 14 nt, Mycobacterium tuberculosis H37Rv
gcgacauacccgau

SEQ ID NO: 3344148 - RNA, 16 nt, Mycobacterium tuberculosis H37Rv
gcgacauacccgauca

SEQ ID NO: 3344149 - RNA, 16 nt, Mycobacterium tuberculosis H37Rv
gcgacaucaccaccga

SEQ ID NO: 3344150 - RNA, 21 nt, Mycobacterium tuberculosis H37Rv
gcgacaucaccaccgaccugg

SEQ ID NO: 3344151 - RNA, 12 nt, Mycobacterium tuberculosis H37Rv
gcgacaucaccg

SEQ ID NO: 3344152 - RNA, 13 nt, Mycobacterium tuberculosis H37Rv
gcgacauccgcgg

SEQ ID NO: 3344153 - RNA, 15 nt, Mycobacterium tuberculosis H37Rv
gcgacaucgggaaug

SEQ ID NO: 3344154 - RNA, 13 nt, Mycobacterium tuberculosis H37Rv
gcgacaucgguca

SEQ ID NO: 3344155 - RNA, 20 nt, Mycobacterium tuberculosis H37Rv
gcgaccaacacgguacugug

SEQ ID NO: 3344156 - RNA, 21 nt, Mycobacterium tuberculosis H37Rv
gcgaccaacacgucgagcagc

SEQ ID NO: 3344157 - RNA, 22 nt, Mycobacterium tuberculosis H37Rv
gcgaccaacacgucgagcagcc

SEQ ID NO: 3344158 - RNA, 12 nt, Mycobacterium tuberculosis H37Rv
gcgaccaccagc

SEQ ID NO: 3344159 - RNA, 13 nt, Mycobacterium tuberculosis H37Rv
gcgaccaccagcg

SEQ ID NO: 3344160 - RNA, 15 nt, Mycobacterium tuberculosis H37Rv
gcgaccaccagcgcc

SEQ ID NO: 3344161 - RNA, 15 nt, Mycobacterium tuberculosis H37Rv
gcgaccacccccggc

SEQ ID NO: 3344162 - RNA, 18 nt, Mycobacterium tuberculosis H37Rv
gcgaccaccgcgucgggc

SEQ ID NO: 3344163 - RNA, 13 nt, Mycobacterium tuberculosis H37Rv
gcgaccacgcacc

SEQ ID NO: 3344164 - RNA, 15 nt, Mycobacterium tuberculosis H37Rv
gcgaccacgcaccgc

SEQ ID NO: 3344165 - RNA, 16 nt, Mycobacterium tuberculosis H37Rv
gcgaccacggcaccga

SEQ ID NO: 3344166 - RNA, 23 nt, Mycobacterium tuberculosis H37Rv
gcgaccacggcaccgaucaacgg

SEQ ID NO: 3344167 - RNA, 17 nt, Mycobacterium tuberculosis H37Rv
gcgaccacgucggcgaa

SEQ ID NO: 3344168 - RNA, 11 nt, Mycobacterium tuberculosis H37Rv
gcgaccagcgc

SEQ ID NO: 3344169 - RNA, 21 nt, Mycobacterium tuberculosis H37Rv
gcgaccagcucagcugcggau

SEQ ID NO: 3344170 - RNA, 15 nt, Mycobacterium tuberculosis H37Rv
gcgaccaggcgcggc

SEQ ID NO: 3344171 - RNA, 21 nt, Mycobacterium tuberculosis H37Rv
gcgaccaggucggcuucgaca

SEQ ID NO: 3344172 - RNA, 18 nt, Mycobacterium tuberculosis H37Rv
gcgaccagugguggccga

SEQ ID NO: 3344173 - RNA, 19 nt, Mycobacterium tuberculosis H37Rv
gcgaccauauucagcucgg

SEQ ID NO: 3344174 - RNA, 16 nt, Mycobacterium tuberculosis H37Rv
gcgaccaucucgacgu

SEQ ID NO: 3344175 - RNA, 21 nt, Mycobacterium tuberculosis H37Rv
gcgaccaucugaucgggcccg

SEQ ID NO: 3344176 - RNA, 21 nt, Mycobacterium tuberculosis H37Rv
gcgaccaucuuaacgucggca

SEQ ID NO: 3344177 - RNA, 21 nt, Mycobacterium tuberculosis H37Rv
gcgaccaugaugccuaccggg

SEQ ID NO: 3344178 - RNA, 22 nt, Mycobacterium tuberculosis H37Rv
gcgaccaugcuccuaucacugg

SEQ ID NO: 3344179 - RNA, 15 nt, Mycobacterium tuberculosis H37Rv
gcgaccccaggcgcu

SEQ ID NO: 3344180 - RNA, 21 nt, Mycobacterium tuberculosis H37Rv
gcgaccccaggcgcucaucac

SEQ ID NO: 3344181 - RNA, 23 nt, Mycobacterium tuberculosis H37Rv
gcgaccccgccgagcgguugccu

SEQ ID NO: 3344182 - RNA, 20 nt, Mycobacterium tuberculosis H37Rv
gcgaccccugguagcaccca

SEQ ID NO: 3344183 - RNA, 17 nt, Mycobacterium tuberculosis H37Rv
gcgacccgaucgcgcca

SEQ ID NO: 3344184 - RNA, 15 nt, Mycobacterium tuberculosis H37Rv
gcgacccgcagaccg

SEQ ID NO: 3344185 - RNA, 18 nt, Mycobacterium tuberculosis H37Rv
gcgacccggcccagcgcc

SEQ ID NO: 3344186 - RNA, 19 nt, Mycobacterium tuberculosis H37Rv
gcgacccggcccagcgccc

SEQ ID NO: 3344187 - RNA, 20 nt, Mycobacterium tuberculosis H37Rv
gcgacccggcccagcgcccc

SEQ ID NO: 3344188 - RNA, 19 nt, Mycobacterium tuberculosis H37Rv
gcgacccggguagacaccg

SEQ ID NO: 3344189 - RNA, 14 nt, Mycobacterium tuberculosis H37Rv
gcgacccggucgcg

SEQ ID NO: 3344190 - RNA, 13 nt, Mycobacterium tuberculosis H37Rv
gcgaccgaccagc

SEQ ID NO: 3344191 - RNA, 13 nt, Mycobacterium tuberculosis H37Rv
gcgaccgacgcca

SEQ ID NO: 3344192 - RNA, 15 nt, Mycobacterium tuberculosis H37Rv
gcgaccgagacggcg

SEQ ID NO: 3344193 - RNA, 14 nt, Mycobacterium tuberculosis H37Rv
gcgaccgaugaucg

SEQ ID NO: 3344194 - RNA, 18 nt, Mycobacterium tuberculosis H37Rv
gcgaccgaugaucucacc

SEQ ID NO: 3344195 - RNA, 15 nt, Mycobacterium tuberculosis H37Rv
gcgaccgcagcuggg

SEQ ID NO: 3344196 - RNA, 12 nt, Mycobacterium tuberculosis H37Rv
gcgaccgcaucu

SEQ ID NO: 3344197 - RNA, 15 nt, Mycobacterium tuberculosis H37Rv
gcgaccgcaucucgg

SEQ ID NO: 3344198 - RNA, 21 nt, Mycobacterium tuberculosis H37Rv
gcgaccgcauugagcuggcgc

SEQ ID NO: 3344199 - RNA, 14 nt, Mycobacterium tuberculosis H37Rv
gcgaccgccugcgc

SEQ ID NO: 3344200 - RNA, 15 nt, Mycobacterium tuberculosis H37Rv
gcgaccgccugcgcg

SEQ ID NO: 3344201 - RNA, 17 nt, Mycobacterium tuberculosis H37Rv
gcgaccgccugcgcggc

SEQ ID NO: 3344202 - RNA, 13 nt, Mycobacterium tuberculosis H37Rv
gcgaccgcgccaa

SEQ ID NO: 3344203 - RNA, 22 nt, Mycobacterium tuberculosis H37Rv
gcgaccgcgcucaccggggccg

SEQ ID NO: 3344204 - RNA, 18 nt, Mycobacterium tuberculosis H37Rv
gcgaccgcggccccgccg

SEQ ID NO: 3344205 - RNA, 15 nt, Mycobacterium tuberculosis H37Rv
gcgaccgcggcgaag

SEQ ID NO: 3344206 - RNA, 23 nt, Mycobacterium tuberculosis H37Rv
gcgaccgcgggccgacgcaggug

SEQ ID NO: 3344207 - RNA, 17 nt, Mycobacterium tuberculosis H37Rv
gcgaccgcggucgcugc

SEQ ID NO: 3344208 - RNA, 18 nt, Mycobacterium tuberculosis H37Rv
gcgaccggcaacgcggcc

SEQ ID NO: 3344209 - RNA, 22 nt, Mycobacterium tuberculosis H37Rv
gcgaccggcaacgcggccuugc

SEQ ID NO: 3344210 - RNA, 13 nt, Mycobacterium tuberculosis H37Rv
gcgaccggccggc

SEQ ID NO: 3344211 - RNA, 15 nt, Mycobacterium tuberculosis H37Rv
gcgaccggcgagccc

SEQ ID NO: 3344212 - RNA, 22 nt, Mycobacterium tuberculosis H37Rv
gcgaccggcgagcccgcaucgc

SEQ ID NO: 3344213 - RNA, 13 nt, Mycobacterium tuberculosis H37Rv
gcgaccggcguaa

SEQ ID NO: 3344214 - RNA, 20 nt, Mycobacterium tuberculosis H37Rv
gcgaccggcguaaccggcag

SEQ ID NO: 3344215 - RNA, 23 nt, Mycobacterium tuberculosis H37Rv
gcgaccggugccugcaacgccag

SEQ ID NO: 3344216 - RNA, 22 nt, Mycobacterium tuberculosis H37Rv
gcgaccgucagggucaccugcg

SEQ ID NO: 3344217 - RNA, 16 nt, Mycobacterium tuberculosis H37Rv
gcgaccgucgggacgg

SEQ ID NO: 3344218 - RNA, 19 nt, Mycobacterium tuberculosis H37Rv
gcgaccgucgggacggcca

SEQ ID NO: 3344219 - RNA, 20 nt, Mycobacterium tuberculosis H37Rv
gcgaccgucgggacggccaa

SEQ ID NO: 3344220 - RNA, 16 nt, Mycobacterium tuberculosis H37Rv
gcgaccgucguccaga

SEQ ID NO: 3344221 - RNA, 13 nt, Mycobacterium tuberculosis H37Rv
gcgaccucacgaa

SEQ ID NO: 3344222 - RNA, 14 nt, Mycobacterium tuberculosis H37Rv
gcgaccucacugcg

SEQ ID NO: 3344223 - RNA, 16 nt, Mycobacterium tuberculosis H37Rv
gcgaccuccggaaucg

SEQ ID NO: 3344224 - RNA, 17 nt, Mycobacterium tuberculosis H37Rv
gcgaccuccggaaucgc

SEQ ID NO: 3344225 - RNA, 17 nt, Mycobacterium tuberculosis H37Rv
gcgaccucggcggcggc

SEQ ID NO: 3344226 - RNA, 20 nt, Mycobacterium tuberculosis H37Rv
gcgaccucggcggcggcacg

SEQ ID NO: 3344227 - RNA, 16 nt, Mycobacterium tuberculosis H37Rv
gcgaccuggucgaacu

SEQ ID NO: 3344228 - RNA, 19 nt, Mycobacterium tuberculosis H37Rv
gcgaccuggucgcuggugc

SEQ ID NO: 3344229 - RNA, 19 nt, Mycobacterium tuberculosis H37Rv
gcgagaaucacggucaucu

SEQ ID NO: 3344230 - RNA, 18 nt, Mycobacterium tuberculosis H37Rv
gcgagacgcaugucgggc

SEQ ID NO: 3344231 - RNA, 13 nt, Mycobacterium tuberculosis H37Rv
gcgagacgcucca

SEQ ID NO: 3344232 - RNA, 21 nt, Mycobacterium tuberculosis H37Rv
gcgagacgucgaacuucagcg

SEQ ID NO: 3344233 - RNA, 22 nt, Mycobacterium tuberculosis H37Rv
gcgagacuucgacgcggcgacc

SEQ ID NO: 3344234 - RNA, 23 nt, Mycobacterium tuberculosis H37Rv
gcgagacuucgacgcggcgaccg

SEQ ID NO: 3344235 - RNA, 14 nt, Mycobacterium tuberculosis H37Rv
gcgagacuugguga

SEQ ID NO: 3344236 - RNA, 13 nt, Mycobacterium tuberculosis H37Rv
gcgagagccggcg

SEQ ID NO: 3344237 - RNA, 15 nt, Mycobacterium tuberculosis H37Rv
gcgagagccuccaug

SEQ ID NO: 3344238 - RNA, 14 nt, Mycobacterium tuberculosis H37Rv
gcgagagcgcggag

SEQ ID NO: 3344239 - RNA, 16 nt, Mycobacterium tuberculosis H37Rv
gcgagauagcaccagu

SEQ ID NO: 3344240 - RNA, 18 nt, Mycobacterium tuberculosis H37Rv
gcgagauagcaccaguuu

SEQ ID NO: 3344241 - RNA, 15 nt, Mycobacterium tuberculosis H37Rv
gcgagaucagcaugc

SEQ ID NO: 3344242 - RNA, 19 nt, Mycobacterium tuberculosis H37Rv
gcgagaucgggccggccgc

SEQ ID NO: 3344243 - RNA, 18 nt, Mycobacterium tuberculosis H37Rv
gcgagcaacucguccagc

SEQ ID NO: 3344244 - RNA, 21 nt, Mycobacterium tuberculosis H37Rv
gcgagcaacucguccagcagu

SEQ ID NO: 3344245 - RNA, 18 nt, Mycobacterium tuberculosis H37Rv
gcgagcaauuccucagcc

SEQ ID NO: 3344246 - RNA, 17 nt, Mycobacterium tuberculosis H37Rv
gcgagcaccaccccagc

SEQ ID NO: 3344247 - RNA, 21 nt, Mycobacterium tuberculosis H37Rv
gcgagcaccaccccagcggcc

SEQ ID NO: 3344248 - RNA, 22 nt, Mycobacterium tuberculosis H37Rv
gcgagcaccaccccagcggcca

SEQ ID NO: 3344249 - RNA, 21 nt, Mycobacterium tuberculosis H37Rv
gcgagcacccguugaucgcgg

SEQ ID NO: 3344250 - RNA, 23 nt, Mycobacterium tuberculosis H37Rv
gcgagcaccgcgguagccgagcu

SEQ ID NO: 3344251 - RNA, 21 nt, Mycobacterium tuberculosis H37Rv
gcgagcagacacagaaucgcc

SEQ ID NO: 3344252 - RNA, 21 nt, Mycobacterium tuberculosis H37Rv
gcgagcagacgcaaaaucgca

SEQ ID NO: 3344253 - RNA, 17 nt, Mycobacterium tuberculosis H37Rv
gcgagcagacgcagaau

SEQ ID NO: 3344254 - RNA, 20 nt, Mycobacterium tuberculosis H37Rv
gcgagcagacgcagaaucgc

SEQ ID NO: 3344255 - RNA, 21 nt, Mycobacterium tuberculosis H37Rv
gcgagcagacgcagaaucgca

SEQ ID NO: 3344256 - RNA, 21 nt, Mycobacterium tuberculosis H37Rv
gcgagcagacgcagaaucgcc

SEQ ID NO: 3344257 - RNA, 20 nt, Mycobacterium tuberculosis H37Rv
gcgagcagacgcagagucgc

SEQ ID NO: 3344258 - RNA, 22 nt, Mycobacterium tuberculosis H37Rv
gcgagcagacgcagagucgcac

SEQ ID NO: 3344259 - RNA, 22 nt, Mycobacterium tuberculosis H37Rv
gcgagcagagaacuccgccacc

SEQ ID NO: 3344260 - RNA, 14 nt, Mycobacterium tuberculosis H37Rv
gcgagcagcacagc

SEQ ID NO: 3344261 - RNA, 12 nt, Mycobacterium tuberculosis H37Rv
gcgagcagcagg

SEQ ID NO: 3344262 - RNA, 15 nt, Mycobacterium tuberculosis H37Rv
gcgagcagcccggcg

SEQ ID NO: 3344263 - RNA, 23 nt, Mycobacterium tuberculosis H37Rv
gcgagcagggcgucgaccgcggc

SEQ ID NO: 3344264 - RNA, 14 nt, Mycobacterium tuberculosis H37Rv
gcgagcaggucgga

SEQ ID NO: 3344265 - RNA, 20 nt, Mycobacterium tuberculosis H37Rv
gcgagcaucugggguccggu

SEQ ID NO: 3344266 - RNA, 13 nt, Mycobacterium tuberculosis H37Rv
gcgagccacggca

SEQ ID NO: 3344267 - RNA, 13 nt, Mycobacterium tuberculosis H37Rv
gcgagccagcugc

SEQ ID NO: 3344268 - RNA, 14 nt, Mycobacterium tuberculosis H37Rv
gcgagcccagcugc

SEQ ID NO: 3344269 - RNA, 19 nt, Mycobacterium tuberculosis H37Rv
gcgagcccagcugcgccga

SEQ ID NO: 3344270 - RNA, 14 nt, Mycobacterium tuberculosis H37Rv
gcgagcccgcaucg

SEQ ID NO: 3344271 - RNA, 17 nt, Mycobacterium tuberculosis H37Rv
gcgagcccgccacagcc

SEQ ID NO: 3344272 - RNA, 22 nt, Mycobacterium tuberculosis H37Rv
gcgagcccgccacagccccagg

SEQ ID NO: 3344273 - RNA, 20 nt, Mycobacterium tuberculosis H37Rv
gcgagcccggccucggcgag

SEQ ID NO: 3344274 - RNA, 14 nt, Mycobacterium tuberculosis H37Rv
gcgagccgccaccg

SEQ ID NO: 3344275 - RNA, 13 nt, Mycobacterium tuberculosis H37Rv
gcgagccgcgccc

SEQ ID NO: 3344276 - RNA, 13 nt, Mycobacterium tuberculosis H37Rv
gcgagccgcucgc

SEQ ID NO: 3344277 - RNA, 15 nt, Mycobacterium tuberculosis H37Rv
gcgagccggcgaagu

SEQ ID NO: 3344278 - RNA, 14 nt, Mycobacterium tuberculosis H37Rv
gcgagccggugauc

SEQ ID NO: 3344279 - RNA, 15 nt, Mycobacterium tuberculosis H37Rv
gcgagccgugccagc

SEQ ID NO: 3344280 - RNA, 16 nt, Mycobacterium tuberculosis H37Rv
gcgagccucgcgcgcc

SEQ ID NO: 3344281 - RNA, 22 nt, Mycobacterium tuberculosis H37Rv
gcgagccugauaaagcccggcg

SEQ ID NO: 3344282 - RNA, 13 nt, Mycobacterium tuberculosis H37Rv
gcgagcgcacacc

SEQ ID NO: 3344283 - RNA, 13 nt, Mycobacterium tuberculosis H37Rv
gcgagcgcagcgc

SEQ ID NO: 3344284 - RNA, 14 nt, Mycobacterium tuberculosis H37Rv
gcgagcgcccgcag

SEQ ID NO: 3344285 - RNA, 12 nt, Mycobacterium tuberculosis H37Rv
gcgagcgccggc

SEQ ID NO: 3344286 - RNA, 19 nt, Mycobacterium tuberculosis H37Rv
gcgagcgccggccgcggcg

SEQ ID NO: 3344287 - RNA, 21 nt, Mycobacterium tuberculosis H37Rv
gcgagcgccggccgcggcggc

SEQ ID NO: 3344288 - RNA, 14 nt, Mycobacterium tuberculosis H37Rv
gcgagcgccuuucg

SEQ ID NO: 3344289 - RNA, 12 nt, Mycobacterium tuberculosis H37Rv
gcgagcgcgcca

SEQ ID NO: 3344290 - RNA, 12 nt, Mycobacterium tuberculosis H37Rv
gcgagcgcgccg

SEQ ID NO: 3344291 - RNA, 14 nt, Mycobacterium tuberculosis H37Rv
gcgagcgcgccggc

SEQ ID NO: 3344292 - RNA, 12 nt, Mycobacterium tuberculosis H37Rv
gcgagcgcgcgu

SEQ ID NO: 3344293 - RNA, 13 nt, Mycobacterium tuberculosis H37Rv
gcgagcgcgcgua

SEQ ID NO: 3344294 - RNA, 16 nt, Mycobacterium tuberculosis H37Rv
gcgagcgcgcguagcg

SEQ ID NO: 3344295 - RNA, 11 nt, Mycobacterium tuberculosis H37Rv
gcgagcgcggc

SEQ ID NO: 3344296 - RNA, 14 nt, Mycobacterium tuberculosis H37Rv
gcgagcgcggccug

SEQ ID NO: 3344297 - RNA, 15 nt, Mycobacterium tuberculosis H37Rv
gcgagcgcggcggag

SEQ ID NO: 3344298 - RNA, 22 nt, Mycobacterium tuberculosis H37Rv
gcgagcgcggcggagccgggug

SEQ ID NO: 3344299 - RNA, 23 nt, Mycobacterium tuberculosis H37Rv
gcgagcggaauggaggccgccga

SEQ ID NO: 3344300 - RNA, 16 nt, Mycobacterium tuberculosis H37Rv
gcgagcggccuccagc

SEQ ID NO: 3344301 - RNA, 13 nt, Mycobacterium tuberculosis H37Rv
gcgagcggcgaac

SEQ ID NO: 3344302 - RNA, 19 nt, Mycobacterium tuberculosis H37Rv
gcgagcggcgaacucgggc

SEQ ID NO: 3344303 - RNA, 18 nt, Mycobacterium tuberculosis H37Rv
gcgagcgggugcgucgau

SEQ ID NO: 3344304 - RNA, 15 nt, Mycobacterium tuberculosis H37Rv
gcgagcggucgacgu

SEQ ID NO: 3344305 - RNA, 16 nt, Mycobacterium tuberculosis H37Rv
gcgagcguuuggacgg

SEQ ID NO: 3344306 - RNA, 22 nt, Mycobacterium tuberculosis H37Rv
gcgagcucaacacgagcgguac

SEQ ID NO: 3344307 - RNA, 14 nt, Mycobacterium tuberculosis H37Rv
gcgagcucccgggc

SEQ ID NO: 3344308 - RNA, 15 nt, Mycobacterium tuberculosis H37Rv
gcgagcucccgggcg

SEQ ID NO: 3344309 - RNA, 18 nt, Mycobacterium tuberculosis H37Rv
gcgagcugcgggucgcgu

SEQ ID NO: 3344310 - RNA, 21 nt, Mycobacterium tuberculosis H37Rv
gcgagcugcgggucgcguuuc

SEQ ID NO: 3344311 - RNA, 22 nt, Mycobacterium tuberculosis H37Rv
gcgagcuggcguucccgcucgg

SEQ ID NO: 3344312 - RNA, 17 nt, Mycobacterium tuberculosis H37Rv
gcgagcuguaggucagc

SEQ ID NO: 3344313 - RNA, 20 nt, Mycobacterium tuberculosis H37Rv
gcgagcuguaggucagcgcg

SEQ ID NO: 3344314 - RNA, 14 nt, Mycobacterium tuberculosis H37Rv
gcgagcuuggcuug

SEQ ID NO: 3344315 - RNA, 16 nt, Mycobacterium tuberculosis H37Rv
gcgaggaacgccgggg

SEQ ID NO: 3344316 - RNA, 18 nt, Mycobacterium tuberculosis H37Rv
gcgaggacggcggccagg

SEQ ID NO: 3344317 - RNA, 16 nt, Mycobacterium tuberculosis H37Rv
gcgaggaugcugagcg

SEQ ID NO: 3344318 - RNA, 18 nt, Mycobacterium tuberculosis H37Rv
gcgaggaugcugagcgcc

SEQ ID NO: 3344319 - RNA, 16 nt, Mycobacterium tuberculosis H37Rv
gcgaggcagcacccgc

SEQ ID NO: 3344320 - RNA, 12 nt, Mycobacterium tuberculosis H37Rv
gcgaggccagcg

SEQ ID NO: 3344321 - RNA, 14 nt, Mycobacterium tuberculosis H37Rv
gcgaggcgcucacc

SEQ ID NO: 3344322 - RNA, 16 nt, Mycobacterium tuberculosis H37Rv
gcgaggcgcucacccg

SEQ ID NO: 3344323 - RNA, 21 nt, Mycobacterium tuberculosis H37Rv
gcgaggcguaaucaagcagcg

SEQ ID NO: 3344324 - RNA, 16 nt, Mycobacterium tuberculosis H37Rv
gcgaggcgucaccccg

SEQ ID NO: 3344325 - RNA, 17 nt, Mycobacterium tuberculosis H37Rv
gcgaggcucgcguggcc

SEQ ID NO: 3344326 - RNA, 14 nt, Mycobacterium tuberculosis H37Rv
gcgaucuccuuggc

SEQ ID NO: 3344327 - RNA, 21 nt, Mycobacterium tuberculosis H37Rv
gcgaucucggcgagcaccacc

SEQ ID NO: 3344328 - RNA, 18 nt, Mycobacterium tuberculosis H37Rv
gcgaucugcgacaagacc

SEQ ID NO: 3344329 - RNA, 16 nt, Mycobacterium tuberculosis H37Rv
gcgaucugcggcgccc

SEQ ID NO: 3344330 - RNA, 15 nt, Mycobacterium tuberculosis H37Rv
gcgaucugcucgccc

SEQ ID NO: 3344331 - RNA, 17 nt, Mycobacterium tuberculosis H37Rv
gcgaucuugcgacgccc

SEQ ID NO: 3344332 - RNA, 21 nt, Mycobacterium tuberculosis H37Rv
gcgaucuuguccagggugguc

SEQ ID NO: 3344333 - RNA, 23 nt, Mycobacterium tuberculosis H37Rv
gcgaucuuguccaggguggucag

SEQ ID NO: 3344334 - RNA, 16 nt, Mycobacterium tuberculosis H37Rv
gcgaugaacgggaucg

SEQ ID NO: 3344335 - RNA, 17 nt, Mycobacterium tuberculosis H37Rv
gcgaugaccgggcgauu

SEQ ID NO: 3344336 - RNA, 20 nt, Mycobacterium tuberculosis H37Rv
gcgaugacgaccgaucggcg

SEQ ID NO: 3344337 - RNA, 22 nt, Mycobacterium tuberculosis H37Rv
gcgaugacgaccgaucggcgcg

SEQ ID NO: 3344338 - RNA, 16 nt, Mycobacterium tuberculosis H37Rv
gcgaugacgaucgcgu

SEQ ID NO: 3344339 - RNA, 16 nt, Mycobacterium tuberculosis H37Rv
gcgaugaucgcaucga

SEQ ID NO: 3344340 - RNA, 19 nt, Mycobacterium tuberculosis H37Rv
gcgaugaugacggcggccc

SEQ ID NO: 3344341 - RNA, 15 nt, Mycobacterium tuberculosis H37Rv
gcgaugauguucauc

SEQ ID NO: 3344342 - RNA, 16 nt, Mycobacterium tuberculosis H37Rv
gcgaugauuucgucga

SEQ ID NO: 3344343 - RNA, 21 nt, Mycobacterium tuberculosis H37Rv
gcgaugauuucgucgaucggc

SEQ ID NO: 3344344 - RNA, 22 nt, Mycobacterium tuberculosis H37Rv
gcgaugauuucgucgaucggcu

SEQ ID NO: 3344345 - RNA, 16 nt, Mycobacterium tuberculosis H37Rv
gcgaugcaccccauga

SEQ ID NO: 3344346 - RNA, 18 nt, Mycobacterium tuberculosis H37Rv
gcgaugcccacgcacagc

SEQ ID NO: 3344347 - RNA, 18 nt, Mycobacterium tuberculosis H37Rv
gcgaugccccacggugcg

SEQ ID NO: 3344348 - RNA, 14 nt, Mycobacterium tuberculosis H37Rv
gcgaugcccgucga

SEQ ID NO: 3344349 - RNA, 20 nt, Mycobacterium tuberculosis H37Rv
gcgaugccguccaagauguc

SEQ ID NO: 3344350 - RNA, 11 nt, Mycobacterium tuberculosis H37Rv
gcgaugcgacc

SEQ ID NO: 3344351 - RNA, 17 nt, Mycobacterium tuberculosis H37Rv
gcgaugcgccaggcuga

SEQ ID NO: 3344352 - RNA, 15 nt, Mycobacterium tuberculosis H37Rv
gcgaugcgcgccgau

SEQ ID NO: 3344353 - RNA, 20 nt, Mycobacterium tuberculosis H37Rv
gcgaugcgggccgccaggcg

SEQ ID NO: 3344354 - RNA, 18 nt, Mycobacterium tuberculosis H37Rv
gcgaugcggucggccaca

SEQ ID NO: 3344355 - RNA, 13 nt, Mycobacterium tuberculosis H37Rv
gcgaugcguccgc

SEQ ID NO: 3344356 - RNA, 14 nt, Mycobacterium tuberculosis H37Rv
gcgaugcguccgcc

SEQ ID NO: 3344357 - RNA, 16 nt, Mycobacterium tuberculosis H37Rv
gcgaugcugaucaccg

SEQ ID NO: 3344358 - RNA, 15 nt, Mycobacterium tuberculosis H37Rv
gcgauggcagcgccg

SEQ ID NO: 3344359 - RNA, 12 nt, Mycobacterium tuberculosis H37Rv
gcgauggccagc

SEQ ID NO: 3344360 - RNA, 17 nt, Mycobacterium tuberculosis H37Rv
gcgauggccaucaucga

SEQ ID NO: 3344361 - RNA, 22 nt, Mycobacterium tuberculosis H37Rv
gcgauggccccugucauguccu

SEQ ID NO: 3344362 - RNA, 18 nt, Mycobacterium tuberculosis H37Rv
gcgauggccgacgcugcu

SEQ ID NO: 3344363 - RNA, 19 nt, Mycobacterium tuberculosis H37Rv
gcgauggccguccgaccga

SEQ ID NO: 3344364 - RNA, 20 nt, Mycobacterium tuberculosis H37Rv
gcgauggcgauagcggcgcu

SEQ ID NO: 3344365 - RNA, 14 nt, Mycobacterium tuberculosis H37Rv
gcgauggcggcauc

SEQ ID NO: 3344366 - RNA, 18 nt, Mycobacterium tuberculosis H37Rv
gcgauggcguagcccaug

SEQ ID NO: 3344367 - RNA, 18 nt, Mycobacterium tuberculosis H37Rv
gcgaugggagcccggcgg

SEQ ID NO: 3344368 - RNA, 15 nt, Mycobacterium tuberculosis H37Rv
gcgaugggcccagcg

SEQ ID NO: 3344369 - RNA, 15 nt, Mycobacterium tuberculosis H37Rv
gcgaugggccggucc

SEQ ID NO: 3344370 - RNA, 17 nt, Mycobacterium tuberculosis H37Rv
gcgaugguagucgcgac

SEQ ID NO: 3344371 - RNA, 15 nt, Mycobacterium tuberculosis H37Rv
gcgauggucuccucg

SEQ ID NO: 3344372 - RNA, 17 nt, Mycobacterium tuberculosis H37Rv
gcgauggugcgccgggc

SEQ ID NO: 3344373 - RNA, 23 nt, Mycobacterium tuberculosis H37Rv
gcgaugguggccgccaccuccca

SEQ ID NO: 3344374 - RNA, 13 nt, Mycobacterium tuberculosis H37Rv
gcgaugucguucg

SEQ ID NO: 3344375 - RNA, 20 nt, Mycobacterium tuberculosis H37Rv
gcgaugugaaccgggcacca

SEQ ID NO: 3344376 - RNA, 20 nt, Mycobacterium tuberculosis H37Rv
gcgaugugcgccaccucgac

SEQ ID NO: 3344377 - RNA, 23 nt, Mycobacterium tuberculosis H37Rv
gcgaugugcgccaccucgacgca

SEQ ID NO: 3344378 - RNA, 16 nt, Mycobacterium tuberculosis H37Rv
gcgauguggguuaccu

SEQ ID NO: 3344379 - RNA, 21 nt, Mycobacterium tuberculosis H37Rv
gcgauucacacucgggcggcu

SEQ ID NO: 3344380 - RNA, 21 nt, Mycobacterium tuberculosis H37Rv
gcgauucacgggugcgccaca

SEQ ID NO: 3344381 - RNA, 14 nt, Mycobacterium tuberculosis H37Rv
gcgauuccacggca

SEQ ID NO: 3344382 - RNA, 17 nt, Mycobacterium tuberculosis H37Rv
gcgauuccgcgucugcu

SEQ ID NO: 3344383 - RNA, 19 nt, Mycobacterium tuberculosis H37Rv
gcgauuccgcgucugcucg

SEQ ID NO: 3344384 - RNA, 23 nt, Mycobacterium tuberculosis H37Rv
gcgauuccgcgucugcucggcgg

SEQ ID NO: 3344385 - RNA, 17 nt, Mycobacterium tuberculosis H37Rv
gcgauucgcaaucagcu

SEQ ID NO: 3344386 - RNA, 17 nt, Mycobacterium tuberculosis H37Rv
gcgauucugcgucugcu

SEQ ID NO: 3344387 - RNA, 21 nt, Mycobacterium tuberculosis H37Rv
gcgauucugcgucugcucgcc

SEQ ID NO: 3344388 - RNA, 22 nt, Mycobacterium tuberculosis H37Rv
gcgauucugggcuucaucggcg

SEQ ID NO: 3344389 - RNA, 23 nt, Mycobacterium tuberculosis H37Rv
gcgauucugggcuucaucggcga

SEQ ID NO: 3344390 - RNA, 14 nt, Mycobacterium tuberculosis H37Rv
gcgauugauccggu

SEQ ID NO: 3344391 - RNA, 19 nt, Mycobacterium tuberculosis H37Rv
gcgauugauccgguggcac

SEQ ID NO: 3344392 - RNA, 19 nt, Mycobacterium tuberculosis H37Rv
gcgauugucggggccgcag

SEQ ID NO: 3344393 - RNA, 17 nt, Mycobacterium tuberculosis H37Rv
gcgauuuccaucgcgac

SEQ ID NO: 3344394 - RNA, 21 nt, Mycobacterium tuberculosis H37Rv
gcgauuuccaucgcgaccucg

SEQ ID NO: 3344395 - RNA, 13 nt, Mycobacterium tuberculosis H37Rv
gcgauuucggcgc

SEQ ID NO: 3344396 - RNA, 17 nt, Mycobacterium tuberculosis H37Rv
gcgauuuugcgucgcgc

SEQ ID NO: 3344397 - RNA, 18 nt, Mycobacterium tuberculosis H37Rv
gcgauuuugcgucugcuc

SEQ ID NO: 3344398 - RNA, 18 nt, Mycobacterium tuberculosis H37Rv
gcgauuuugugucugcuc

SEQ ID NO: 3344399 - RNA, 22 nt, Mycobacterium tuberculosis H37Rv
gcgauuuugugucugcucgccg

SEQ ID NO: 3344400 - RNA, 20 nt, Mycobacterium tuberculosis H37Rv
gcgcaaagacaccgaaagcc

SEQ ID NO: 3344401 - RNA, 13 nt, Mycobacterium tuberculosis H37Rv
gcgcaaauugcaa

SEQ ID NO: 3344402 - RNA, 15 nt, Mycobacterium tuberculosis H37Rv
gcgcaacacauccag

SEQ ID NO: 3344403 - RNA, 13 nt, Mycobacterium tuberculosis H37Rv
gcgcaacaccucg

SEQ ID NO: 3344404 - RNA, 17 nt, Mycobacterium tuberculosis H37Rv
gcgcaaccagauccggu

SEQ ID NO: 3344405 - RNA, 19 nt, Mycobacterium tuberculosis H37Rv
gcgcaacccagccgcgcca

SEQ ID NO: 3344406 - RNA, 22 nt, Mycobacterium tuberculosis H37Rv
gcgcaaccuaaauugccgggcc

SEQ ID NO: 3344407 - RNA, 17 nt, Mycobacterium tuberculosis H37Rv
gcgcaacgccgccagcc

SEQ ID NO: 3344408 - RNA, 19 nt, Mycobacterium tuberculosis H37Rv
gcgcaacgccgccagccug

SEQ ID NO: 3344409 - RNA, 14 nt, Mycobacterium tuberculosis H37Rv
gcgcaacggccagc

SEQ ID NO: 3344410 - RNA, 20 nt, Mycobacterium tuberculosis H37Rv
gcgcaacgggacgucaccgu

SEQ ID NO: 3344411 - RNA, 16 nt, Mycobacterium tuberculosis H37Rv
gcgcaacguagccagc

SEQ ID NO: 3344412 - RNA, 19 nt, Mycobacterium tuberculosis H37Rv
gcgcaacguagccagcagc

SEQ ID NO: 3344413 - RNA, 14 nt, Mycobacterium tuberculosis H37Rv
gcgcaacucgccac

SEQ ID NO: 3344414 - RNA, 22 nt, Mycobacterium tuberculosis H37Rv
gcgcaacucgccacggucgccg

SEQ ID NO: 3344415 - RNA, 19 nt, Mycobacterium tuberculosis H37Rv
gcgcaacuucuucagcagc

SEQ ID NO: 3344416 - RNA, 20 nt, Mycobacterium tuberculosis H37Rv
gcgcaacuucuucagcagcg

SEQ ID NO: 3344417 - RNA, 16 nt, Mycobacterium tuberculosis H37Rv
gcgcaaggcgccgcag

SEQ ID NO: 3344418 - RNA, 19 nt, Mycobacterium tuberculosis H37Rv
gcgcaauagcgacagcagc

SEQ ID NO: 3344419 - RNA, 15 nt, Mycobacterium tuberculosis H37Rv
gcgcaaucgaccacg

SEQ ID NO: 3344420 - RNA, 20 nt, Mycobacterium tuberculosis H37Rv
gcgcaaugcaucgcggcggc

SEQ ID NO: 3344421 - RNA, 13 nt, Mycobacterium tuberculosis H37Rv
gcgcacagcgagc

SEQ ID NO: 3344422 - RNA, 15 nt, Mycobacterium tuberculosis H37Rv
gcgcagggaucgcag

SEQ ID NO: 3344423 - RNA, 16 nt, Mycobacterium tuberculosis H37Rv
gcgcagggcgucggcg

SEQ ID NO: 3344424 - RNA, 13 nt, Mycobacterium tuberculosis H37Rv
gcgcaggggcggc

SEQ ID NO: 3344425 - RNA, 14 nt, Mycobacterium tuberculosis H37Rv
gcgcaggggcggcg

SEQ ID NO: 3344426 - RNA, 15 nt, Mycobacterium tuberculosis H37Rv
gcgcagguacgccuc

SEQ ID NO: 3344427 - RNA, 22 nt, Mycobacterium tuberculosis H37Rv
gcgcagguagucgacgacgugg

SEQ ID NO: 3344428 - RNA, 21 nt, Mycobacterium tuberculosis H37Rv
gcgcagguaucgguauaacga

SEQ ID NO: 3344429 - RNA, 14 nt, Mycobacterium tuberculosis H37Rv
gcgcaggucgccuu

SEQ ID NO: 3344430 - RNA, 18 nt, Mycobacterium tuberculosis H37Rv
gcgcaggugccuuucggc

SEQ ID NO: 3344431 - RNA, 17 nt, Mycobacterium tuberculosis H37Rv
gcgcaggugcugggcga

SEQ ID NO: 3344432 - RNA, 18 nt, Mycobacterium tuberculosis H37Rv
gcgcagguucucggugcc

SEQ ID NO: 3344433 - RNA, 22 nt, Mycobacterium tuberculosis H37Rv
gcgcaguacuugaccguccacc

SEQ ID NO: 3344434 - RNA, 16 nt, Mycobacterium tuberculosis H37Rv
gcgcaguagccgacca

SEQ ID NO: 3344435 - RNA, 18 nt, Mycobacterium tuberculosis H37Rv
gcgcaguagccgaccagg

SEQ ID NO: 3344436 - RNA, 16 nt, Mycobacterium tuberculosis H37Rv
gcgcagugacgccucg

SEQ ID NO: 3344437 - RNA, 16 nt, Mycobacterium tuberculosis H37Rv
gcgcaguuggccaugc

SEQ ID NO: 3344438 - RNA, 18 nt, Mycobacterium tuberculosis H37Rv
gcgcaguuguacggcacu

SEQ ID NO: 3344439 - RNA, 21 nt, Mycobacterium tuberculosis H37Rv
gcgcauaccuacccgagaacg

SEQ ID NO: 3344440 - RNA, 14 nt, Mycobacterium tuberculosis H37Rv
gcgcauauccgcag

SEQ ID NO: 3344441 - RNA, 13 nt, Mycobacterium tuberculosis H37Rv
gcgcaucaccacu

SEQ ID NO: 3344442 - RNA, 21 nt, Mycobacterium tuberculosis H37Rv
gcgcauccaauccacgguugc

SEQ ID NO: 3344443 - RNA, 13 nt, Mycobacterium tuberculosis H37Rv
gcgcaucccgaag

SEQ ID NO: 3344444 - RNA, 17 nt, Mycobacterium tuberculosis H37Rv
gcgcaucgagcaccucc

SEQ ID NO: 3344445 - RNA, 14 nt, Mycobacterium tuberculosis H37Rv
gcgcaucgccgaca

SEQ ID NO: 3344446 - RNA, 17 nt, Mycobacterium tuberculosis H37Rv
gcgcaucgccgcuggcc

SEQ ID NO: 3344447 - RNA, 21 nt, Mycobacterium tuberculosis H37Rv
gcgcaucgccgcuggccagca

SEQ ID NO: 3344448 - RNA, 17 nt, Mycobacterium tuberculosis H37Rv
gcgcaucgccuccucga

SEQ ID NO: 3344449 - RNA, 17 nt, Mycobacterium tuberculosis H37Rv
gcgcaucggccagcagc

SEQ ID NO: 3344450 - RNA, 18 nt, Mycobacterium tuberculosis H37Rv
gcgcaucggccagcagcg

SEQ ID NO: 3344451 - RNA, 14 nt, Mycobacterium tuberculosis H37Rv
gcgcaucgucgaaa

SEQ ID NO: 3344452 - RNA, 15 nt, Mycobacterium tuberculosis H37Rv
gcgcaucugcucggc

SEQ ID NO: 3344453 - RNA, 13 nt, Mycobacterium tuberculosis H37Rv
gcgcaucugucgc

SEQ ID NO: 3344454 - RNA, 18 nt, Mycobacterium tuberculosis H37Rv
gcgcaugcaagucaaacg

SEQ ID NO: 3344455 - RNA, 18 nt, Mycobacterium tuberculosis H37Rv
gcgcaugucgauccggcg

SEQ ID NO: 3344456 - RNA, 19 nt, Mycobacterium tuberculosis H37Rv
gcgcauguuaugagcgcuc

SEQ ID NO: 3344457 - RNA, 23 nt, Mycobacterium tuberculosis H37Rv
gcgcauuucggaucucgaccucg

SEQ ID NO: 3344458 - RNA, 16 nt, Mycobacterium tuberculosis H37Rv
gcgcauuuguugcugc

SEQ ID NO: 3344459 - RNA, 14 nt, Mycobacterium tuberculosis H37Rv
gcgccaaaaaggau

SEQ ID NO: 3344460 - RNA, 12 nt, Mycobacterium tuberculosis H37Rv
gcgccaacaccu

SEQ ID NO: 3344461 - RNA, 17 nt, Mycobacterium tuberculosis H37Rv
gcgccaacagaugccac

SEQ ID NO: 3344462 - RNA, 21 nt, Mycobacterium tuberculosis H37Rv
gcgccaacagaugccacccag

SEQ ID NO: 3344463 - RNA, 15 nt, Mycobacterium tuberculosis H37Rv
gcgccaacgggcugc

SEQ ID NO: 3344464 - RNA, 18 nt, Mycobacterium tuberculosis H37Rv
gcgccaacgggcugcccc

SEQ ID NO: 3344465 - RNA, 23 nt, Mycobacterium tuberculosis H37Rv
gcgccaacucgagaguggccucg

SEQ ID NO: 3344466 - RNA, 20 nt, Mycobacterium tuberculosis H37Rv
gcgccaagacgaacagcacg

SEQ ID NO: 3344467 - RNA, 21 nt, Mycobacterium tuberculosis H37Rv
gcgccaagacgaacagcacga

SEQ ID NO: 3344468 - RNA, 17 nt, Mycobacterium tuberculosis H37Rv
gcgccaagccgugccgc

SEQ ID NO: 3344469 - RNA, 18 nt, Mycobacterium tuberculosis H37Rv
gcgccaauucagcggcaa

SEQ ID NO: 3344470 - RNA, 14 nt, Mycobacterium tuberculosis H37Rv
gcgccacagcagcg

SEQ ID NO: 3344471 - RNA, 16 nt, Mycobacterium tuberculosis H37Rv
gcgccaccagcaccgc

SEQ ID NO: 3344472 - RNA, 19 nt, Mycobacterium tuberculosis H37Rv
gcgccaccagcaccgccgc

SEQ ID NO: 3344473 - RNA, 18 nt, Mycobacterium tuberculosis H37Rv
gcgccacccagcaccagg

SEQ ID NO: 3344474 - RNA, 16 nt, Mycobacterium tuberculosis H37Rv
gcgccacccgcgccgc

SEQ ID NO: 3344475 - RNA, 21 nt, Mycobacterium tuberculosis H37Rv
gcgccacccgcgccgcccgcu

SEQ ID NO: 3344476 - RNA, 20 nt, Mycobacterium tuberculosis H37Rv
gcgccacccgcgucaguccu

SEQ ID NO: 3344477 - RNA, 21 nt, Mycobacterium tuberculosis H37Rv
gcgccacccgguccggcccgg

SEQ ID NO: 3344478 - RNA, 22 nt, Mycobacterium tuberculosis H37Rv
gcgccaccgccgcugccggugu

SEQ ID NO: 3344479 - RNA, 15 nt, Mycobacterium tuberculosis H37Rv
gcgccaccggcaccg

SEQ ID NO: 3344480 - RNA, 15 nt, Mycobacterium tuberculosis H37Rv
gcgccaccggcgccg

SEQ ID NO: 3344481 - RNA, 19 nt, Mycobacterium tuberculosis H37Rv
gcgccaccguuaccgccgu

SEQ ID NO: 3344482 - RNA, 20 nt, Mycobacterium tuberculosis H37Rv
gcgccaccguuaccgccguu

SEQ ID NO: 3344483 - RNA, 21 nt, Mycobacterium tuberculosis H37Rv
gcgccaccguuugcgcaccgg

SEQ ID NO: 3344484 - RNA, 13 nt, Mycobacterium tuberculosis H37Rv
gcgccacgcaccc

SEQ ID NO: 3344485 - RNA, 20 nt, Mycobacterium tuberculosis H37Rv
gcgccacgcacccggcaauc

SEQ ID NO: 3344486 - RNA, 13 nt, Mycobacterium tuberculosis H37Rv
gcgccacggcagc

SEQ ID NO: 3344487 - RNA, 20 nt, Mycobacterium tuberculosis H37Rv
gcgccacggcagcgcccaga

SEQ ID NO: 3344488 - RNA, 13 nt, Mycobacterium tuberculosis H37Rv
gcgccacgguguc

SEQ ID NO: 3344489 - RNA, 14 nt, Mycobacterium tuberculosis H37Rv
gcgccacguccauc

SEQ ID NO: 3344490 - RNA, 23 nt, Mycobacterium tuberculosis H37Rv
gcgccacguccaucaccggcggc

SEQ ID NO: 3344491 - RNA, 14 nt, Mycobacterium tuberculosis H37Rv
gcgccacgucgacg

SEQ ID NO: 3344492 - RNA, 15 nt, Mycobacterium tuberculosis H37Rv
gcgccacgucgacgg

SEQ ID NO: 3344493 - RNA, 21 nt, Mycobacterium tuberculosis H37Rv
gcgccacgucgacggucuggc

SEQ ID NO: 3344494 - RNA, 12 nt, Mycobacterium tuberculosis H37Rv
gcgccacucaag

SEQ ID NO: 3344495 - RNA, 20 nt, Mycobacterium tuberculosis H37Rv
gcgccacuggaagccaagcu

SEQ ID NO: 3344496 - RNA, 17 nt, Mycobacterium tuberculosis H37Rv
gcgccagaucaccgucg

SEQ ID NO: 3344497 - RNA, 18 nt, Mycobacterium tuberculosis H37Rv
gcgccagaucaccgucga

SEQ ID NO: 3344498 - RNA, 20 nt, Mycobacterium tuberculosis H37Rv
gcgccagaucaccgucgaca

SEQ ID NO: 3344499 - RNA, 21 nt, Mycobacterium tuberculosis H37Rv
gcgccagaucaccgucgacag

SEQ ID NO: 3344500 - RNA, 15 nt, Mycobacterium tuberculosis H37Rv
gcgccagcaacagcg

SEQ ID NO: 3344501 - RNA, 11 nt, Mycobacterium tuberculosis H37Rv
gcgccagcaga

SEQ ID NO: 3344502 - RNA, 16 nt, Mycobacterium tuberculosis H37Rv
gcgccagcagccaccc

SEQ ID NO: 3344503 - RNA, 18 nt, Mycobacterium tuberculosis H37Rv
gcgccagcgauaucggcg

SEQ ID NO: 3344504 - RNA, 13 nt, Mycobacterium tuberculosis H37Rv
gcgccagcgccgc

SEQ ID NO: 3344505 - RNA, 17 nt, Mycobacterium tuberculosis H37Rv
gcgccagcgccgccacc

SEQ ID NO: 3344506 - RNA, 14 nt, Mycobacterium tuberculosis H37Rv
gcgccagcgggcug

SEQ ID NO: 3344507 - RNA, 12 nt, Mycobacterium tuberculosis H37Rv
gcgccagcggug

SEQ ID NO: 3344508 - RNA, 12 nt, Mycobacterium tuberculosis H37Rv
gcgccaggaacc

SEQ ID NO: 3344509 - RNA, 15 nt, Mycobacterium tuberculosis H37Rv
gcgccaggcaccacg

SEQ ID NO: 3344510 - RNA, 13 nt, Mycobacterium tuberculosis H37Rv
gcgccaggccacg

SEQ ID NO: 3344511 - RNA, 12 nt, Mycobacterium tuberculosis H37Rv
gcgccaggccgc

SEQ ID NO: 3344512 - RNA, 17 nt, Mycobacterium tuberculosis H37Rv
gcgccaggccgcacagc

SEQ ID NO: 3344513 - RNA, 12 nt, Mycobacterium tuberculosis H37Rv
gcgccaggccgu

SEQ ID NO: 3344514 - RNA, 19 nt, Mycobacterium tuberculosis H37Rv
gcgccaggcgcgaucgcgc

SEQ ID NO: 3344515 - RNA, 17 nt, Mycobacterium tuberculosis H37Rv
gcgccaggggugugccg

SEQ ID NO: 3344516 - RNA, 21 nt, Mycobacterium tuberculosis H37Rv
gcgccaggucggcgggcgcgg

SEQ ID NO: 3344517 - RNA, 15 nt, Mycobacterium tuberculosis H37Rv
gcgccaguggccacc

SEQ ID NO: 3344518 - RNA, 18 nt, Mycobacterium tuberculosis H37Rv
gcgccaguggccaccauc

SEQ ID NO: 3344519 - RNA, 15 nt, Mycobacterium tuberculosis H37Rv
gcgccgaauggcggu

SEQ ID NO: 3344520 - RNA, 13 nt, Mycobacterium tuberculosis H37Rv
gcgccgaccaccg

SEQ ID NO: 3344521 - RNA, 22 nt, Mycobacterium tuberculosis H37Rv
gcgccgaccagaacgacgccgc

SEQ ID NO: 3344522 - RNA, 13 nt, Mycobacterium tuberculosis H37Rv
gcgccgacccgcg

SEQ ID NO: 3344523 - RNA, 17 nt, Mycobacterium tuberculosis H37Rv
gcgccgacccgcgcgcc

SEQ ID NO: 3344524 - RNA, 18 nt, Mycobacterium tuberculosis H37Rv
gcgccgacccgcgcgccg

SEQ ID NO: 3344525 - RNA, 19 nt, Mycobacterium tuberculosis H37Rv
gcgccgacccgcgcgccgg

SEQ ID NO: 3344526 - RNA, 20 nt, Mycobacterium tuberculosis H37Rv
gcgccgacccgcgcgccggc

SEQ ID NO: 3344527 - RNA, 21 nt, Mycobacterium tuberculosis H37Rv
gcgccgacccgcgcgccggcg

SEQ ID NO: 3344528 - RNA, 23 nt, Mycobacterium tuberculosis H37Rv
gcgccgacccgcgcgccggcgac

SEQ ID NO: 3344529 - RNA, 19 nt, Mycobacterium tuberculosis H37Rv
gcgccgacccguaccagcc

SEQ ID NO: 3344530 - RNA, 19 nt, Mycobacterium tuberculosis H37Rv
gcgccgaccucaucggcac

SEQ ID NO: 3344531 - RNA, 21 nt, Mycobacterium tuberculosis H37Rv
gcgccgacgaaaucgucgggu

SEQ ID NO: 3344532 - RNA, 17 nt, Mycobacterium tuberculosis H37Rv
gcgccgacgacuccggc

SEQ ID NO: 3344533 - RNA, 15 nt, Mycobacterium tuberculosis H37Rv
gcgccgacggccagc

SEQ ID NO: 3344534 - RNA, 17 nt, Mycobacterium tuberculosis H37Rv
gcgccgagauccacgcc

SEQ ID NO: 3344535 - RNA, 21 nt, Mycobacterium tuberculosis H37Rv
gcgccgagaucgacaucguug

SEQ ID NO: 3344536 - RNA, 15 nt, Mycobacterium tuberculosis H37Rv
gcgccgagccagcac

SEQ ID NO: 3344537 - RNA, 15 nt, Mycobacterium tuberculosis H37Rv
gcgccgagcgugaag

SEQ ID NO: 3344538 - RNA, 15 nt, Mycobacterium tuberculosis H37Rv
gcgccgagcucggcg

SEQ ID NO: 3344539 - RNA, 20 nt, Mycobacterium tuberculosis H37Rv
gcgccgaguuguucgcccac

SEQ ID NO: 3344540 - RNA, 16 nt, Mycobacterium tuberculosis H37Rv
gcgccgauacccagcg

SEQ ID NO: 3344541 - RNA, 17 nt, Mycobacterium tuberculosis H37Rv
gcgccgauaccggcggc

SEQ ID NO: 3344542 - RNA, 21 nt, Mycobacterium tuberculosis H37Rv
gcgccgauaccggcggcgagc

SEQ ID NO: 3344543 - RNA, 14 nt, Mycobacterium tuberculosis H37Rv
gcgccgaucaccac

SEQ ID NO: 3344544 - RNA, 17 nt, Mycobacterium tuberculosis H37Rv
gcgccgaucaccaccgg

SEQ ID NO: 3344545 - RNA, 18 nt, Mycobacterium tuberculosis H37Rv
gcgccgaucacggugggc

SEQ ID NO: 3344546 - RNA, 23 nt, Mycobacterium tuberculosis H37Rv
gcgccgaucacggugggcgccga

SEQ ID NO: 3344547 - RNA, 13 nt, Mycobacterium tuberculosis H37Rv
gcgccgaucagcg

SEQ ID NO: 3344548 - RNA, 22 nt, Mycobacterium tuberculosis H37Rv
gcgccgaucggcaccgugucga

SEQ ID NO: 3344549 - RNA, 17 nt, Mycobacterium tuberculosis H37Rv
gcgccgaugaacguggc

SEQ ID NO: 3344550 - RNA, 20 nt, Mycobacterium tuberculosis H37Rv
gcgccgaugaacguggcgac

SEQ ID NO: 3344551 - RNA, 17 nt, Mycobacterium tuberculosis H37Rv
gcgccgaugccggccaa

SEQ ID NO: 3344552 - RNA, 14 nt, Mycobacterium tuberculosis H37Rv
gcgccgauggccgc

SEQ ID NO: 3344553 - RNA, 20 nt, Mycobacterium tuberculosis H37Rv
gcgccgauguggccggcgau

SEQ ID NO: 3344554 - RNA, 19 nt, Mycobacterium tuberculosis H37Rv
gcgccgauuccaccgccga

SEQ ID NO: 3344555 - RNA, 22 nt, Mycobacterium tuberculosis H37Rv
gcgccgauuccaccgccgacgc

SEQ ID NO: 3344556 - RNA, 15 nt, Mycobacterium tuberculosis H37Rv
gcgccgcaaccgccg

SEQ ID NO: 3344557 - RNA, 19 nt, Mycobacterium tuberculosis H37Rv
gcgccgcaaucagacggcg

SEQ ID NO: 3344558 - RNA, 17 nt, Mycobacterium tuberculosis H37Rv
gcgccgcaaugacgucg

SEQ ID NO: 3344559 - RNA, 21 nt, Mycobacterium tuberculosis H37Rv
gcgccgcacacucucggugaa

SEQ ID NO: 3344560 - RNA, 17 nt, Mycobacterium tuberculosis H37Rv
gcgccgcaccaagcagc

SEQ ID NO: 3344561 - RNA, 17 nt, Mycobacterium tuberculosis H37Rv
gcgccgcacccgggacg

SEQ ID NO: 3344562 - RNA, 14 nt, Mycobacterium tuberculosis H37Rv
gcgccgcacgccga

SEQ ID NO: 3344563 - RNA, 13 nt, Mycobacterium tuberculosis H37Rv
gcgccgcagagca

SEQ ID NO: 3344564 - RNA, 19 nt, Mycobacterium tuberculosis H37Rv
gcgccgcagagcaccgcga

SEQ ID NO: 3344565 - RNA, 19 nt, Mycobacterium tuberculosis H37Rv
gcgccgcagaucaccgcca

SEQ ID NO: 3344566 - RNA, 13 nt, Mycobacterium tuberculosis H37Rv
gcgccgcagcgau

SEQ ID NO: 3344567 - RNA, 12 nt, Mycobacterium tuberculosis H37Rv
gcgccgcagcgc

SEQ ID NO: 3344568 - RNA, 16 nt, Mycobacterium tuberculosis H37Rv
gcgccgcagugacggg

SEQ ID NO: 3344569 - RNA, 23 nt, Mycobacterium tuberculosis H37Rv
gcgccgcaucauagacagggccg

SEQ ID NO: 3344570 - RNA, 14 nt, Mycobacterium tuberculosis H37Rv
gcgccgcauccagc

SEQ ID NO: 3344571 - RNA, 21 nt, Mycobacterium tuberculosis H37Rv
gcgccgcauccagccgugcgg

SEQ ID NO: 3344572 - RNA, 14 nt, Mycobacterium tuberculosis H37Rv
gcgccgcauucgcg

SEQ ID NO: 3344573 - RNA, 15 nt, Mycobacterium tuberculosis H37Rv
gcgccgcauucgcga

SEQ ID NO: 3344574 - RNA, 18 nt, Mycobacterium tuberculosis H37Rv
gcgccgcauucgcgacaa

SEQ ID NO: 3344575 - RNA, 20 nt, Mycobacterium tuberculosis H37Rv
gcgccgccaacuccucagcc

SEQ ID NO: 3344576 - RNA, 17 nt, Mycobacterium tuberculosis H37Rv
gcgccgccaagggcccc

SEQ ID NO: 3344577 - RNA, 13 nt, Mycobacterium tuberculosis H37Rv
gcgccgccacagc

SEQ ID NO: 3344578 - RNA, 22 nt, Mycobacterium tuberculosis H37Rv
gcgccgccaccgaagccgccgg

SEQ ID NO: 3344579 - RNA, 18 nt, Mycobacterium tuberculosis H37Rv
gcgccgccacugccggca

SEQ ID NO: 3344580 - RNA, 14 nt, Mycobacterium tuberculosis H37Rv
gcgccgccagcacc

SEQ ID NO: 3344581 - RNA, 15 nt, Mycobacterium tuberculosis H37Rv
gcgccgccagcacca

SEQ ID NO: 3344582 - RNA, 17 nt, Mycobacterium tuberculosis H37Rv
gcgccgccagcaccacc

SEQ ID NO: 3344583 - RNA, 18 nt, Mycobacterium tuberculosis H37Rv
gcgccgccagcaccaccg

SEQ ID NO: 3344584 - RNA, 19 nt, Mycobacterium tuberculosis H37Rv
gcgccgccagcgccgccgg

SEQ ID NO: 3344585 - RNA, 20 nt, Mycobacterium tuberculosis H37Rv
gcgccgccagcgccgccggc

SEQ ID NO: 3344586 - RNA, 21 nt, Mycobacterium tuberculosis H37Rv
gcgccgccagcgccgccggcg

SEQ ID NO: 3344587 - RNA, 16 nt, Mycobacterium tuberculosis H37Rv
gcgccgccauugccau

SEQ ID NO: 3344588 - RNA, 23 nt, Mycobacterium tuberculosis H37Rv
gcgccgcccaugccuccagaacc

SEQ ID NO: 3344589 - RNA, 20 nt, Mycobacterium tuberculosis H37Rv
gcgccgccccauacuugcgc

SEQ ID NO: 3344590 - RNA, 16 nt, Mycobacterium tuberculosis H37Rv
gcgccgcccgcgccac

SEQ ID NO: 3344591 - RNA, 21 nt, Mycobacterium tuberculosis H37Rv
gcgccgcccgcgccaccagca

SEQ ID NO: 3344592 - RNA, 19 nt, Mycobacterium tuberculosis H37Rv
gcgccgcccgcgcccccgg

SEQ ID NO: 3344593 - RNA, 23 nt, Mycobacterium tuberculosis H37Rv
gcgccgcccuugccgccggcccc

SEQ ID NO: 3344594 - RNA, 19 nt, Mycobacterium tuberculosis H37Rv
gcgccgccgaucccgucgg

SEQ ID NO: 3344595 - RNA, 10 nt, Mycobacterium tuberculosis H37Rv
gcgccgccgc

SEQ ID NO: 3344596 - RNA, 16 nt, Mycobacterium tuberculosis H37Rv
gcgccgccgccgacga

SEQ ID NO: 3344597 - RNA, 12 nt, Mycobacterium tuberculosis H37Rv
gcgccgccgcgu

SEQ ID NO: 3344598 - RNA, 12 nt, Mycobacterium tuberculosis H37Rv
gcgccgccggca

SEQ ID NO: 3344599 - RNA, 15 nt, Mycobacterium tuberculosis H37Rv
gcgccgccggcaccg

SEQ ID NO: 3344600 - RNA, 16 nt, Mycobacterium tuberculosis H37Rv
gcgccgccggcaccuc

SEQ ID NO: 3344601 - RNA, 22 nt, Mycobacterium tuberculosis H37Rv
gcgccgccggcaccucccuggc

SEQ ID NO: 3344602 - RNA, 15 nt, Mycobacterium tuberculosis H37Rv
gcgccgccggcgccg

SEQ ID NO: 3344603 - RNA, 18 nt, Mycobacterium tuberculosis H37Rv
gcgccgccggcgccgccc

SEQ ID NO: 3344604 - RNA, 17 nt, Mycobacterium tuberculosis H37Rv
gcgccgccggcgccggc

SEQ ID NO: 3344605 - RNA, 15 nt, Mycobacterium tuberculosis H37Rv
gcgccgccggcgcgu

SEQ ID NO: 3344606 - RNA, 14 nt, Mycobacterium tuberculosis H37Rv
gcgccgccggugcc

SEQ ID NO: 3344607 - RNA, 16 nt, Mycobacterium tuberculosis H37Rv
gcgccgccggugccac

SEQ ID NO: 3344608 - RNA, 17 nt, Mycobacterium tuberculosis H37Rv
gcgccgccggugccacc

SEQ ID NO: 3344609 - RNA, 15 nt, Mycobacterium tuberculosis H37Rv
gcgccgccguccagc

SEQ ID NO: 3344610 - RNA, 17 nt, Mycobacterium tuberculosis H37Rv
gcgccgccguccagcgc

SEQ ID NO: 3344611 - RNA, 16 nt, Mycobacterium tuberculosis H37Rv
gcgccgccgucgccgc

SEQ ID NO: 3344612 - RNA, 19 nt, Mycobacterium tuberculosis H37Rv
gcgccgccguuaccgccgg

SEQ ID NO: 3344613 - RNA, 20 nt, Mycobacterium tuberculosis H37Rv
gcgccgccguuaccgccggc

SEQ ID NO: 3344614 - RNA, 17 nt, Mycobacterium tuberculosis H37Rv
gcgccgccguugccgau

SEQ ID NO: 3344615 - RNA, 23 nt, Mycobacterium tuberculosis H37Rv
gcgccguaaagccaacuggucgc

SEQ ID NO: 3344616 - RNA, 22 nt, Mycobacterium tuberculosis H37Rv
gcgccguaacagccggccggau

SEQ ID NO: 3344617 - RNA, 17 nt, Mycobacterium tuberculosis H37Rv
gcgccguacagcggcgg

SEQ ID NO: 3344618 - RNA, 18 nt, Mycobacterium tuberculosis H37Rv
gcgccguacagcggcggc

SEQ ID NO: 3344619 - RNA, 18 nt, Mycobacterium tuberculosis H37Rv
gcgccguagaccagcagg

SEQ ID NO: 3344620 - RNA, 13 nt, Mycobacterium tuberculosis H37Rv
gcgccguagagcc

SEQ ID NO: 3344621 - RNA, 19 nt, Mycobacterium tuberculosis H37Rv
gcgccguagagccgcucgg

SEQ ID NO: 3344622 - RNA, 20 nt, Mycobacterium tuberculosis H37Rv
gcgccguagagccgcucggc

SEQ ID NO: 3344623 - RNA, 22 nt, Mycobacterium tuberculosis H37Rv
gcgccguagagccgcucggcgu

SEQ ID NO: 3344624 - RNA, 16 nt, Mycobacterium tuberculosis H37Rv
gcgccgucaccgaucg

SEQ ID NO: 3344625 - RNA, 16 nt, Mycobacterium tuberculosis H37Rv
gcgccgucagcccagg

SEQ ID NO: 3344626 - RNA, 17 nt, Mycobacterium tuberculosis H37Rv
gcgccgucagcccaggu
